United States Patent 8,067,671 (METHODS FOR GENETIC CONTROL OF PLANT PEST INFESTATION AND COMPOSITIONS THEREOF) - sequence listing, part 12

SEQ ID NO: 10975 - DNA, 1486 bp, Heterodera glycines
tggagttccgtcagtcggtccaagaatttttttttgttagtaaattttaatgctaattctgaggtggggaagttaatttttcctaccaatcaaaaaaaaatttttttttagtttttcaaggcaacggtggacgcagaatggatgtggtggatgcccgacccttttttctattgaccaccgacttgtgccagcagttgctccttctccaggtccctcttgcgcgtgtagtgtccctcggtccgggcactgccggtccggttcggcatgacgccctccagctccgcgtccacgtagtagtagatggagcccggccgtctggcatccgtgtacggtttgggctggaaaaacaaacaaaaaaaatattaattttaagtaaataattgaaaagggaatgcatttttggaggagttaagaggaaaacaagcgcttattgtgggagttgaacggtcagttaaaaattggttttgggcgatgggttcaagtccacctggctgcaaatttttttaaaatttgattcaagaaagaaattagtgattacaacggtggggttaatcataaattgatcacatttttttaaaaattcttttaattaaaaaactctaaaaataaaattttccaggaagaatgtcgtatttgctagccaaacaagtgaattgagaaggaaatgcttataatttatataaaatatagagaaagtgaaatgccacaactcacaaacacattcggcgtctcgcaaatgccctccggctccacccagacaaacggctgctgcgcctgcacatccgccgcatcggcacacggcattcgacgcacattttggaaggccgactcgttgatgtccgcacacaaatcggccaggtccaagtccttgaatgccatcttcaggtactcaatttcctccagctcaagaccgtcctggaggagggggaatgattttagacataaaattaaaaaaaaatttccaaggctttaacaacttggattagagaaattttatgatggattggacaaaaacagggatgggccaaaattttttataattgactgaatttttgcaaaaaaacatttttaatatgggggaagcaacttgttaaaaattatagttttttacataaaaaaatctttgaagaaatattttttatttagattattttcgaaaaaaacctcaaaaaactcaatgaaatatagaaaacataaaatttttattttttaaattcgtcatgacggaagtcaaattgttattttgaaaaaatttttgtcaaattaaaaaattcttcgataaaacaaatttgggtgggcgttttttttcttcaaaattacaacatatttcattttgtttacccgcatgtactcgctcagcatcgcgtcctcctctgctggcgaccgcttggcccactgcttgacggagcgcagttccgcctcgcggagacgggccagcaacaggtaaagaccgcttccaacgcagcggtggcactgcaatgcacaa

SEQ ID NO: 10976 - DNA, 1183 bp, Heterodera glycines
tgattctccataaatatgaagaaaatcgctagaaaattaaaaaacatagtttttgaaattttcttcgaggaaaccgaggggaggggcggggggggggggaaacgaactgctccctgcttgtccaccttcaccttcatcatcctgatggtcatcgtcggcgccaacactggtgatggtggtgacgcgacgacgtcgacaactacgacgcactttgttatctccgtcggcggatggacgacgcccagcaattgaggaggacgccgatgcgaccgatgacacggacaccgacctgtcactgctgctaccgctgctgctggtggctgaggtgacactgtccctcctccgtcttcgggacctgtaccgatgacgggaagatgatgatgatgaactgcttgaagttgttgtggaagttgatgacgacctgctgccgccgctggtgctgtgactgcttcgtcgtgatgaacttgccatggatgtttcgcgcagctttgttcggcgctgactgctgccaccggtgatggtggcggcataacgatggtgaccgcttcgccgactgtcgtcgtcggtgtccatttgctggtcacttccgctccgtgtccgtcgccgcctttcatcgtcagcctcgagacgtcgcctcttcttaaacgtgacaaaaaaaaaaattggcattttagcgatattttaggggtttttcacccaattgttcctccccggcccagtcgaatttaaagatacacccatttttcaaggcgcgctacttcgtcagctatccacaattttttttttaatttcaagggacagagaagagagaaaaaaatccaaaatattttatgtaaatgcttttattcaaatttttcagtgccggggacaaatattagccgttttcgaccaaaaaaatgtcaatttttttttaccattttttgataatttttattttgatttctggcccgtggccatgtgggcctgcgattaacgtaattaaacccacagacataggtatataacaaacagtttgaccagagttcccaagtgtcctttttttaagattgtcgtttttttcacaaactttttaaatttttgtgcttaatgatttattttgctgatataaatgctaccaaaattactaattctcaaaaaaaatttcccggcggcgcctatcggcaccgccggccccccaaatctt

SEQ ID NO: 10977 - DNA, 2936 bp, Heterodera glycines
ccttaggctttctacataaaacataaaagaatgagaggggcccggtcctccccactgcgcctcttcgtcctcctttccttcatctttctctcgcgcttctccgtgcgggaacagttcgtcggcgagctctgaaagcgtccgcggcctggagcagtgacttgcggattttgtagatagcttcctccgcgcgttccagtggcatccctttccgaaacggcgcgtatgtcttcctcacggggctcctctccgcgctgcgtgtcgtaaactgcggcactggcgctggagtcggtcttcttttaagcatttcgcgatttaatccctcgggtggaatacagggacggtcatttactgtcccgacggccgatttgagcatgtttgtgaacaagcgcttcccgctcattcccaagttcctttctctgtcccctctttcttctcttcctcttggtttcgacgctgagtccaattcgctttggcactcaaagcgcgccacggcgctggaatagaaaggcctgcgctctcttggcggctccggggggttctcaaagcgctccttctcctttcccaactcctttgcctcttcttctcccatttcttctctgggtttccctgccagttttgccgtcaattcctcaattttgtttcggatttgcctttgcttggcctcctcttcgacttcttttacaatatccgtgatctctcggcgcgctttttcctcggcatccttctggcttcgctcttccttttctgcttctgttaagcgccttttctttattcccctggcgattattgtgtcattttcttctctttctgccttctttttcggttttgtcttcgcttccttttctttctttcgcttttcttcctcctctcttttgactttctcctccctttccttctgcgcttttgcttcttcggcttccttttgcgtcttttctttcgcttcttccgcttctttctgtgatttttctttcgcttcttccgcttccttctgcgccttcttttccgcttccttccgcgcttcctcttccaattccttcctcgcttccgtttctgcttctttccttatttaggagtaaatttccgactttcctaacttcgaagtcatcaaaagaaaaataaggacaaaagtcatccaaagaaaaataaggagagcagacatatcattaaattgataccattttgacatcgtggaggcaaatgttaatgtagcgcagggaaaattttcaggagtaaatttccgactttcctaacttcgaagtcatcaaaagaaaaataaggacaaaagtcatccaaagaaaaataaggagagcagacatatcattaaattgataccattttgacatcgtggaggcaaatgttagtgtagcgcagggaaaattttcaggagtaaatttccgactttcctaacttcgaagtcatcaaaagaaaaataaggacaaaagtcatccaaagaaaaataaggagagcagacatatcattaaattgataccattttgacatcgtggaggcaaatgttaatgtagcgcagggaaaattttcaggagtaaatttccgactttcctaacttcgaagtcatcaaaagaaaaataggacaaaagtcatccaaagaaaaataaggagagcagacatatcattaaattgataccattttgacatcgtggaggcaaatgttaatgtagcgcagggaaaattttcaggagtaaatttccgactttcctaacttcgaagtcatcaaaagaaaaataggacaaaagtcatccaaagaaaaataaggagagcagacatatcattaaattgataccattttgacatcgtggaggcaaatgttaatgtagcgcagggaaaattttcaggagtaaatttccgactttcctaacttcgaagtcatcaaaagaaaaataaggacaaaagtcatccaaagaaaaataaggagagcagacatatcattaaattgataccattttgacatcgtggaggcaaatgttaatgtagcgcaggggaaattcgcgtgcgctcacactgggagctctcccgaacggagtgattggcctcaccgaagaatggttcatggacaaacttcggctgctcgtctcctactggacaacggcatgctgcatttacgtcacattcatttttgggcgcgatgtcctgatacccttggtatgggtctacttaatggggcccgtcatcgttaccatccgcaatttggtgacgggaaatcagtggacgcagcggaacagagctactcgaggcacacggcgagcaccggcaatttcaaggattgaagcaattgagctggtaccgccttcaatgccccaggaaatgagagcgaacgaaacgtcaagttcacatcaagaggaccccgagccgtcaccgttggtgatggagctgaaacgacaaatggtcgcattccgttcgaagcgacgttttcaaagccgtgggaatgtcgcggctgaacgacagccgcgaatgtccgttgagcggacaaatgaggagaacggggaggagtgaatgaagttgcgaacaaggagtgataaatgaatggaaagatgggaaaaatagggcaaacgggaaatgatgaagggaagggaggacaaaaagggggcgaagggagggacggcagcaggcgagcacgtgaatgaggggaaggaaagcgataaaaagcggaggtggcgccttctccgcatgaaggacgcccgaggcagtgcaaaaacgccgatcggaccatcgcggtgcgacgggcgaaacaacacatcaccaaggcggacagccgatgaaaatcggcgatcatttgatggaaaattgcgaatttgcgggagagcaaattcgcccggacccttcccctcccgcctttctccggtgatgtgcccgcctcccgcgactcacccccctttttgggcccccattgtgccatttttcctttgaatttccccctc

SEQ ID NO: 10978 - DNA, 1641 bp, Heterodera glycines
ccaagctaattaaaaaataaaagcatacggttaatttgaataattagcttatttaagccttgcgcgcgtcaacaacactcattaagcaaaagcaacaaatcaagaatgggaaaacgtacattgtctcaagaacatgtcgatcaaaagccaaaaatagcattttaccaaaacttgaattcgactcttgtgtcttcgagtgctggtacataatcagtgatgattggacttgcttgaatgatttattttttttttcattcagttgagcattttgaacaatcattcagttatgaagggttagtgcaaccagcgaatttcgatgacatatgttcaacttcaaaaaatcaccatggaagctttggctctgccggatgcactccggtgaagaaaatgcattgggatgagcacaacaacgcagcagaggaagaccaatgctttggcccaatggttgaatttggcggttgcgaggcgaaggaaacgccggagaaagttgaactgaacgaaagcagcgaaacgttggtggacgatttgaaccaacagctcaaagagttgaaggaaaagctgacgagtgcaaacgaaaaacttgtgacggttgcaaatcaaatggacaagacattggacgagtcattcgttggaatggagcagcaaaacgaatgggccaacaaagaaagcgcaaatggcacgcgggaaaagacaacgaccaacaaaggactaaagggcaaatccacacaaacaatgggctcctggtccatgggcttcggtgctccttttggaaaagacaattcagcagttccgaggatgtcttcagatttggaatggttggttttgtgtgggatttacacttatattttagttttttttcacacacctttctaaatattttacaataacaccaaacaaataacgcacttttttgtttatgtcgaaatttcaaactttttatttagaagaatggagatatttggatgtttttaatcggttgactgaattcatttgtctaaaaattaagcaaaatgcggatggagtgcagggagctgatgagaaagcacatcgaaacgctcagagagcatatgaaagtgcgcgtgtttttgctgcacgccaaaaggaagggaatggcagcggctgagaagaaaaagtgccagacaaaattcaaagcattaatggacgaatttgacgaagccaaacggaagataaaggcggactttaagcggggaaatgcggacaaagtgggaaatcgaagttaaatttaaattttaccattcaaattgagggaatgatggcgaagcattacgtggaaattggccaattgcagagggagacgcgaattttgcaagcgaaactccagcaaattgtcaacgggaaaaacgctgtcgcaaatgcgtcgcgattgtacgttgtttttacgttttatagacttatttgcaagaaataaaagctttcacatggagctgaacaaaatgtcgccggaaaatttttttattttaaagggggggatttgctgaccggcccttacaatatatataattctgttgtccattgttgttgggaaaaatggatttgtttagttcttccgtgacaattcaccagcaattcgacaatttgttcagcttcgtaaacatggacaaacgcactgattttgtggaa

SEQ ID NO: 10979 - DNA, 3914 bp, Heterodera glycines
  misc_feature (2282)..(2282): n is a, c, g, or t
attggacttgcttgaatgatttattttttttttcattcagttgagcattttgaacaatcattcagttatgaagggttagtgcaaccagcgaatttcgatgacatatgttcaacttcaaaaaatcaccatggaagctttggctctgccggatgcactccggtgaagaaaatgcattgggatgagcacaacaacgcagcagaggaagaccaatgctttggcccaatggttgaatttggcggttgcgaggcgaaggaaacgccggagaaagttgaactgaacgaaagcagcgaaacgttggtggacgatttgaaccaacagctcaaagagttgaaggaaaagctgacgagtgcaaacgaaaaacttgtgacggttgcaaatcaaatggacaagacattggacgagtcattcgttggaatggagcagcaaaacgaatgggccaacaaagaaagcgcaaatggcacgcgggaaaagacaacgaccaacaaaggactaaagggcaaatccacacaaacaatgggttcctggtccatgggcttcggtgctccttttggaaaagacaattcagcagttccgaagatgtcttcagatttggaatggttggttttgtgtgggatttacacttatattttagtttgttttcacacacctttctaaatattttaacaccaaacaaataacgcacttttttgtttatgtcgaaatttcaaactttttatttagaaggatggagatatttggatgtttttaatcggttgactgaattcatttgtctaaaaattaagcaaaatgcggatggagtgcagggagctgatgagaaagcacatcgaaacgctccgagagcatatgaaagtgcgcgtgtttttgctgcacgccaaaaggaagggaatggcagcggctgagaagaaaaagtgccagacgaaattcaaagcattaatggacgaatttgacgaagctaaacggaagataaaggcggactttaagcggggaaatgcggacaaagtgggaaatcgaagttaaatttaaattttaccattcaaattgagggaatgatggcgaatcattacgtggaaattggccaattgcagagggaaacgcgaattttgcaagcgaaactccagcaaattgtcaacgggaaaaacgctgtcgcaaatgcgtcgcgattgtacgttgtttttacgttttatagacttatttgcaagaaataaaagctttcgcatggagctgaacaaaatgtcgccggaaaatttttttattttaaaggaggggatttgctgaccggcccttacaatatatataattctgttgtccattgttgttgggaaaaatggatttgtttagttcttccgtgacaattcaccagcaattcgacaatttgttcaacttcgtaaacatggacaaacgcactgattttgtggaagttcaaaaaacggacgggagagattcgttggcaaacttttcatcgtttcaagacggttttgtttcttttaatttgtttacaaaaaaactgctattggattttttggcgaattatttattttcccatggtctgtctgatgctttaaaactgtaaattttagacccattgaatccacaaatgccacagccattccaagcgacgatctctccacaaattccgccgcttaatttcgaccaactttctgtcaatgacattgaatatgatgacaatgatggcggcggggaaggcttacttaacaaaacgtttactctccccgaagaacagaatgacaatgttcatgaagaggaggcggagaatgaaaatgggagcaacgcggacgagggaatttggcaggaacaggtgggaaaggaggggagctcaacattcgcctctatttctgtatcgaaacggggaaaaattgaaacggggtatataaccggggattagctttttctttgaaaattatataaaatataaagtaaatgttttgaaaaaactttaatccattcacagatagttgtgtccaatctgtcgacgagccattcagaagtcggaaatgtcactcagaacagtgacaaaattagcaatgaagttcaaatggtcgaatgccatgccgatggtcgttatttcaataaaaaaacagttgtttgggtcttaaatctttacgtatttaaggcgttgaacactcaaaggaaggctgtggcgacaatgtgagcttttctgaactgaccagcatcgccggggggaacaccagcgacgacattacctcaatcccttacccgagtgaagcggacaaaagggcgaataaggacgaagacaatgttgngaatgacgacaaagcaaatggagaggaacagcagggattggtctcctcccaaaacagtggttcaaccccaacctcgtcacgtcgtgtcaaatacaaaatttgtgcggaagaaagagggacaaaagtggaagtgtcggctcacggacgccaaatggacgtggaacggacgcattgcgtagttcaacagcagcaaccaattgaggcgattgaaagaagcaaaactggccaaaatgaaatccaaccgatggacgacggatcggccgacgatgacgagccgagcgaacgtaccgcagcggaggattcaacccaatcgagggaggtggccgactcagtgttcgaagagacaacgcaaaattcaaattcatcgccgaccaacaaaataggggagagtggtggaccaacaaacacgggtgaatgcacaccaaatgcacaatctgtgcatggcaaacgacagagaggggaggaggaggaagaagaggtggaagtgatctcggcaaaaagtttagttcgaagttcggctttaacgcagaggacattggcggaggtcgagagtatccccgaagaggtagggggggggggtggcgaaataacgagggcaaaagaactgtctcaggaaattaacttacaatcagtgcaatttttcatagaatgggtgctctgcttcaatttttgtattgatttaatctatattattgctagctttcaatggcttcacattcggcgaaatccttgccaaactcctccgtttccaccatgtcatctgggaaggggatggtggtcgccgtggaacccgtcgctgaacaccagcaacaacaacagacggacgattcgattgcggaagaagtgttttcggaggacatcgtttccaccttcaaaccgtcggagaagtcgctgcactccattctgtcattgcgtagcaattcgatgagcaccagtgcgcgggacagcatgggcaaactgaggagggactcggccagcgaagcgctgctcaaactgagaacgatgaattgcgtgccggagctgagaagtcctcgcgagtccaaaagtccacccaagtaaagccattacatgttttcagcagtcccaatccaaaaatttacagacccctgaggtcgccacgtggcattgaccgttttatggccaaattcccgcacaactcttcccgagaggccagtttcagtgaagagctgagtgtcaagggagaaatgctggaggaattgccgaatgcgagtcaaattgggatggtaatttttgggcaatcggtcccactcactttacccttgaattttttagcttttcgatgttagtggagcgtctgttgaaggaactttgtccaaattggacagcactgccgactcaaaacgtggacagtcggacatttttttgggcacggacaaacgcacggattccgtcgaatccaataaaatggagagaggcaattcgttgggcggtttcggtgtgccggaaggttaagtcttttggcgaaataaatcaaaaacggttctgtttgagtttgttcggctggtgtcaaggcacgggcagagaagacaagccatgttcagttggatactaacagaattctgttggcacaataggctacgaccacctcaacatttggccgactcaggaaat

SEQ ID NO: 10980 - DNA, 1260 bp, Heterodera glycines
ttctctttcatatagtcgttttctgtcctccttctctttctctctacttcctcttttatttcctttgtcttaatcatctataaatgtctaaccaattctatttcaatttattcttttcttctcttccctctgagaatgttttcagcataagaaagaggatgttgtttttgctcttcccgttttttgggtcaacattttgccgaaaaaacataaaaaatgtaaacagtgaaggatagagaatggtaatttacatatttttagttatcctattattcattggcatttgttcttcagaaacataaatatttccaaacgaaatttaaaattataacagtattttaagatagcaaactaaaaaatgtcaatttcgaacaattcaatgaattgtggagatgatttcacaccagcagcagaaaatggaggtaaatgatgaaaaaggggaaaatatctcagtgaaattattttaaatttaaagaatattataaaaattttagaagtgaatggcgattcaattagtttggacaatgatggacaatttgatggaaatagtgaatcgattgctgatcaacaacagcttaaggtgggctaaaaaaacaaaaaacagagtaaaatgggataataatgaatttatatggtacaaaagtgattttgttaattgaaattcaggaattccgtgaaaagtttgccaaaatggaaatggaattgaaaatggccaaattggaactcgaaaatgtgagttttggtataaaaaatttttgagtaaaaataaatctcaaaaaattaaaaaataaaattatgtttagaaggcacttgaacaaaagttaaagcaccaggaaatgatgggtgaacagaaggcattgaaggaaaaagtgaccaaaattgaacaggaaaaggagaaaaacggtaaaagaaaataagtaaagaaattggtaaattttaaggaattaatttaattgaataagttgataaaatactggaatttattaaatcatcattaaaaactttcatcagcgaaagcattctctccactccaacgtaaaatattttgtttaaaataaaaatttgaaaacccaagaatttaattttttaagcaattattccaaatctgagcacatccgaggaaatgagtgttctgattgccagaattgctgagctgtatcgagcgaaaacaattgaagcatctgttgcaagcagctctgatttatttggacaagtcggaaacggtaggaaattaggcgatacagtatcaaaatatactgt

SEQ ID NO: 10981 - DNA, 3263 bp, Heterodera glycines
  misc_feature (70)..(70): n is a, c, g, or t
ttttttctacaacttttttaatagttaaaatcataagcaaaaatcatttttaaaaatttatttccaaatntaaaaatcaataaaacgcttttttgaggcgctctttttccaaaaaaactttttgggaagagggggcaggcggcgccgggaaaacttttgaaaatttgattaaaatttgttaacagattttcactaaaaaatgatcaaattttgcgattttgggccattttctaataggagttttgggggcgcggcggtgccgataggcgccgccgggaaaaaaattggaaattttgatcatttataaacaggttttcactgaaaattagccaatttataggtaaaattttgaaaaattttatgggaatttaatccaattcttaggggtgtaaaagtcgcatttcgcgccaaaaagcgaaatgcgaaaagcgaaacctaagcacatccctgtactttacttcaaatattgtttaatataatctgttctattttaagtagggtaggtcgggaccgggactttttggctggaaaaaccggaaaaaccaggactttccttataaatttctaaaaagtattctaattgatgggtcataattttgcccaaattacttttttgccgtcaaatgccagcccataaatagaggggagattcagcgcaaaagatcaaatgttcattcattcatttacatgcgaagatgaattttatttccaattttcatattttttttatttaaaaattttaatttgtagccagtccaattaataccttattaattcgaaaaatgtcttcaaattttatcggttcgccaaattgctttttccgtccaacagctgatcagggtaagagaaataattaaaaaaagaattacgaaaaaaggaaattattttatcttttttaaataaaataaaataaaaatttatcaccattagcagcagcagcagaagaagtggacaagtatgaagtgttcagttggcacggagatttgagcgaccaattggcagcacaatttttggtcagtgatcagcagctgttgaaggtgggacatttcagaacggacaaatgagcacagaggggggagcacaaatgatcacagtgggggggggggagggggagagaggccggacggatcagtcacggacaaagggccgaccaattccgagagcaatcaagagacattttgccaaaaatcatgcaattaatgagtgaaggaaattggaaattatttagtggactgaaaaactttttttatttaaggaatgccgagaaaaacttgccagtgccgaattgagagaaacgaaattgctgtgcaaaaacggggaattgaatgcagagaatgtaagaaaaattaattattaaaaaaaaatttaaaaaatgacgaaataactgagagcgaacgcgcataaaacagaaactttcaaattttgtaagaaaattcagaaggcgcttaaagcagagttggagaaacaaaagctgatgtcggaaaacagtgaattgaaggcgaaagttgataagatggaccaggaaaagcagcagcaattggacaaaaaatacggtagagacaatttaaaaaaataaataatttttattaccgtactcggacagtactgtatgcttcaaaattatttcagtttctgtcgatgtgttcaattcattggtggagcgaatcaaacaattggaaaatcggcagaacaaagaggagggcagaaagggtaaataataaatttgaaataaataattaacggaccgaaattttgcatactttgaaaaggcgaaaaaattttaacggaccataagcttttacaattttgatcagttacaaattttaaatgaacatatttaattagctgaccaatgccaattatttttaattttcattttctattattcaattggatacattttttagcagaggaaaagcagcagaaggaaagtgttggtcaacagaacaaaaacaccgaacagaaattggatggaaaatatgccgtggtggacaaaaacaatgttttgggtgggcacaattggcaaattatttaaaattaaaaattggcgttataaaaaaaatgcattttttgagaggggacaaaaccctcgtattatatcgggattttatacatatttggtacatatttcggacttttttcttacatattttcattttttttacatatttgaggattttttacggaaatttttggaaattctcaaaaaaaaaatccaaaaatttcggcaaatttttcatttttttacatagctattctgagaatttttgaaaatttttagaaatttcttgtgaaaaaattaaaaaatctttttttaaatgtacccctccaaaaataatttttcaaatgttaaaaggtgattttaaacattttggtcatttttatggcattttgtgcctatttaacactttatgaaaaaaaattttccaaaaaataacaatttaaaaaaattttatttacatattttcgtacatattttgggtttttatacatatttcttacatatttcgggatttttttttacatatttatgtacatatatgaccactttttgtacatattttttacagccctaattataaatatttaggtgttaaaaaattaatttttctttttaaaatgtatttattgctaatttagttgctttagtgacgtcatcgggcgaccattcgccgccggcggttgtctcagcgaaagttgcaaaggtgggaaggaaaccttaattatttcacaaatgccatttaatttcaggaagtgcctaattcgcagcaacaaaatggctgggatgccaaagtttgccacaaagacatcgaaatcattggggaaaagcaattgacgatcaattgcaagggcagcagatttggtatttaatataaaaattaaaaaatgtaattaattaatttctttcttaattaggatggcactctgtttttgcgaaatttccaattacgaacttttgtcgtcccggaattttctacttcgaaatgaaagtgttcaaattggaaaggtgttcattttgatgatttcttagcgttttatttataattttgaatttattttaacagttttgctgcgattggattcgccacgaaggaagtgccattggacgggtcaattggtcaaattttgaacagttacgggtaccgaagcgatggctcatttggctgtaatggcatcaatcggccgtgcaaaatgccaatgtcattatttggttcgtcattttcccccgtggcaatgcaatcggcggacgtggaaatggcata

SEQ ID NO: 10982 - DNA, 4963 bp, Heterodera glycines
  misc_feature (186)..(186): n is a, c, g, or t
  misc_feature (4078)..(4078): n is a, c, g, or t
tgtctgctgcatggctgctgctgccagtgttgtgcgccagagtttaccgcattttccccgtcctgctgctggcggttaggcccatcaatcattaggatggctaaaagggcaccaccacacatccattttagggattttaaattgaaattactaattgatggcccattatattaaacaataagatcncaaactcgttaaaaatgggttgttttcctcctgttctttcgaatccctattcgaaatatctaaaaaaaattttgcactttttaaaattagtttttttccaacaacaaattgcaatccaccgattttactctccgtttttcatataaatgccgaggaaatgtgtgccgtatctgtcgtccaaaaagcagatattgtgcccgagggagggccctttaattaggcaatgaatggcacagacccacattttgtgcctcgaggggctgacattattcggcacctcgcaaggcaagccaggccaggaggccactcacatgcgtatcgttgacatctcgcgcatattctattcagcagttcgtcgctcgtgaataggggcaggccattgttgttggttgagtggccaagtgagggggggggggcgggcgacaaggcttatgtaaagaataaagcggcacccaaaaatgagagcccccgggggaccaataattttaaatgtcgtttaattacacaaattaaccacttactatgcccttggtttggtagcgtataaatttaaaaaatatatggcatataaaagcattaactagagatgatatacggtaattaaacccagtactttcttataatttttgaaataattttcaatttttggagaaaaatttatttcattagcctaatgtttaagagatgtttttcgttgcttttaaagctatttaggttttttaaaattgaaaaatttaccgatttaagcataagtcaattgtcagcgtcgcagttttgaccacttaattttttaataaaattaaatttttcttttcaggatttaactaaccgaaaagtattttttaatgaaaaatggctacaattccatgcttggaactcatttttcctattgtttggctttttgtttcaacattcgtcaaccccagcaagttcaaccaacgaattcacctttcagtgaagttcgtaaaatttattaaaaattacaaagtttttaattaattttctttcctttttcatggccatccattacgttgatccgacaaaaaatggctttcgtgttgtgctgcgggatgaatttttgcgctcacatatgacaccaaatcttctgcccacgctttatctgaccgcgttgcccctacgacaccaagacggacctggtgcagaacaccagcaacaacaccagcaagtcacccgtgtgttctaccctgattcgttggccgatgaaaaagaggtggtccgaacaattttttgaatatttaattaataaacaaatttattttgggtgttgcggggtgccaatgatggttgtcgtcggaaaaaaaaattctttaataaattattctctaaaatcagtacatttctgataaatcagagtatacggtacccttggtcgaacccaagagcgtagccaatgggtcttttcggcgggcgccgccggtgctattccaagttttcagactataactaaaattgcaacaaaaaaaagtcgaaatattttgaagttttttcttaataaatgttttacaggccataaaattttttttgctttttgtaaggctaatagagcatgtgaaaagggctttcaaatgttaccaagaattgttatttttccaggtgactgttgatggtctgcacgagaaatgttggtactatttgtgcattgaatgggagaacttcaatcggcacaacgaaactacaggcacagatgtaaaaaaacttaattaaaatttcttttagcgattttgaaaaatttctgttcatattatatgaaaattcgattgataaaattaaattacaaaattttctttaaagtgtcgtctctttcgcacattggaccgtcttggcaaaggtgcggacagtacggtgtccgaattggaacccactgatttctcctcacaaatgatgcaattccggctccgttccgtgtccgattttccgatgaggtaggtgttggattacgaaaatttcaagaaaatttacagcaagtataaaatttattaattattgatttatttttggcactattcattaggaatctctctttcctcttatctctcgttttcacagtctgtcctcttatctctcgtttttctctaactgtctgtcctcttatctgtcggttttctaatctaactgtctgtcctcttattttttgctcatactctcatcatttcctttttctttctttaacattggtcttctctcaatttgcttaagtaattaattttaaatcaattaacaaaatccctgttaaggctaactgttgggttggagggtggtaaattggcaccgacaccacctgcccaagtgtttcaattgtccggtgaacggccatttgtcgaaatggagttgattttcacgtaaaaccaattttctttattatattaataatttaaatattattttgagaaatttaattttattattttgacagatttttgcgacaactgatggattacggtcagttatgtacggttgaagagcctatggtcatacggtacacagctttgggccgacttgtgtccggcatcagcatccgaaaatgccatttccgtaggacaaaatattaatttttcaaaataatcttgatattcacaaaataaaaaattatatattaaaatatttatttagttgttatttcttaattttaatattaatccttgacttttttttcgaaaagaaaaaaatcacatatcttttttttgtaattagctttaaccaattaattaatgttttatatttctttttaattttccgataaaaataaaaaataaaaaaatatattttttgagaaaattttttaaatattttatgatttaaaactgggtacaaatgaattaaaatagcatatttttaaaagttaaaaaaaatttaaccaattaaagcttgcagcaatattttttcaactttaaagacaatttgaccaccacggactacgagctgtccattgcgggctcagccgaggcaagcccatatattcggagcagtagcagaagcaactgcagctgttttgggaacacattaatgaacatcatttttgtcacattggccatcaccacactgctcaatcatcatctgttgctgatttggccaatgttggcacagcaaaagtggcaaaattgaatagtcaaaacattggacatgaatttgaaaatcatctcaaaaaatttttaaatcaaatgatgtgtatgttctacgggttgtattgtataaatttctgagttgcaaatcccaatttttctgatggataatagtattatcaacaaatttctggaaaaacagaacctcttaagaagcaaattaaaaaaactgcgcaggttagattccatttgaaaaaatattcatttaaatttttatcaaaaaattagttttgaaaatttcaaatttatacgttttaaattccaacttttcataagattttaaatttctgaaaaacaacacctctttagaaccaaattaataacaaaaaatgtacagatacttccattaaaaaatattcattcaattgaattttatcaaaaaaataaataaataaattttatatttacctattttggaaaatatagtttttagatcagcaaactaatgaactctaatatttacaaattttcttggccagacagtttcgtttaacttggaaatctttattttattttatgtattaatcggtttatttagaaatacaatttaaatagaattaaattaatttaaataattatttggcatatgaacaaatatatggaaaaaaaaattttgcgtctgttcatcatatttctcttttcttgctgattatttttgactgtttctgttatgtgtaggttgtcttgatcctctgtctaaaattaaaaaatgaaataaaaatcattatttaaaagccgttatccctctttgnaatagagccaaggcacaaagtgcaaactttgaatttaaaaaaatcgaatataaaatttcggtctcaaaaatctttgtcaattttcaaaccatattaaatttataatttttgaattgggaattattattttttttcacataaattgagtttttaaattatcatagaaatttgtaaaaaaaatttgaaaattgttataaaaaatattttactacaaaaaaatctcgaaaaaatagaaaattaaaacattttaattttttaatattaaaaaaattcggcaattggcattccgacacatccatgtatcatgtatatactaaattaaattaccgtaattgatcattttaaggaatgcggaagaggaggcactggcgcggcgccgtcttcgtcgctgatggaacagtcgaagtgccgccgccgccgggttagcaccgccggcatctgtctgacagcaaaagccttcaatgcactcatagccaggaggacaagtgccgtccggtgcgcatgggccggactgctcctaaaacgaccaaaataatcgttaaaaatgaattaggaaattaaaattaattaattgaatttgaatgatgacagacctcgggcgcacatgtgccagtgtctagtcgaaagcattggccctctccttcgcccacacatgcataaccttttttcaatttggaaaatgatttgaatgttacgaaaaatcaatcaacaattaattatagtagtgctgctcgtcttggtctcgagaaattgtcttggggttttgttctggtctcagattgtcggaaatcgagaccaagaatttttttatacccataatgattgactttcgataaactttaaaaaaataatgtttaaatgaaatttaatattcatgggaatttc

SEQ ID NO: 10983 - DNA, 1114 bp, Heterodera glycines
  misc_feature (6)..(6): n is a, c, g, or t
  misc_feature (23)..(23): n is a, c, g, or t
  misc_feature (44)..(44): n is a, c, g, or t
tgtttncactgtttggtttttcntgaatggggatactcgtaatnttggtacaaaatatagacaaattttgggaaagagaaactgtacttaattaaaaaataataattatctgaatctttttaaaattgttattcatttgaaacaaatttgaatggcgtgccatttattgaaaactttggtttatgtcataggcctgtaatgccaaataaatacggtaattaaaaattaggaatttaaatacagttcaaatattttgcgtgggagaaaaaaaattgttttttgtcataatgcaataaaaatgcttgatgactgttttttgagagaaggaatattaaaaccataaatgaaatttaaaagatctaaaattaccatcaccattttttatgatattttatttgcagtaaaaaataaaattttattatagttttaaatccaaaagggaccaaagcaataaaaatttaaatttattcgtctgaatatttattcaaatatttttctggccctttataaagctaattttctattttattttatctttagtttgaaatgactctttttattctccttgtgttttttgttttcttcgcttatggcacggctcaaccagagcccgtcttttgtccgggtttttcaaaccaacatgactgtctggcgccaaaaattgtggacggaagcattcacccggcgaattggtcaaaaaatttaatttgaaaattattgagcttttttaataaattttttttggaaagatatctaaaatattctgcctttggattaaagctcgctcattaataatatatccttaatattcaaagatttaaaaataattcttcacatcaattaaattttattcgggattagcatcttttaaaggtgccattggttgcgcaacacatgccaatggaatacgccgaacattggccagcgttactgcttcagaaaaccgcactcgcaatgcctggttttttttatttggataattttttaaaatattaatatttatttaggcccctttttgcctgattgacaaggtttacttgcttttaacattgtcttttgcgtaaaattaagcagaaaattacaaggacgtagcctcaaacttgggggggggggg

SEQ ID NO: 10984 - DNA, 897 bp, Heterodera glycines
  misc_feature (892)..(892): n is a, c, g, or t
agatgccaatggtacccggtgagaaaagaaattaatttctttaggtaattatcattaagaagggggatgccgagtaaaatagcaaaaaattggcaaattcaaaaaaatacggggaagaatgttgaataattgctaatttatgccgaaagtttaaatttggttttattttcgttttatattttgaagccaacgaagcaaattagggattgaaacagttaattaataaattattcaggccggcgcgacaccgcaaaatccatttttcccaatttgtggaacaccgtataaagaccgaagacagaacaacagaatgcaaatgcttttatgagatgaagtgtgatacaaatggatttaaaaattacgtaaagcaaagagattgtattttaattgtttaatttacgaactgaattataaagaataaattacataaaattgacgactatcatgccgtaatttggcttaaataattactagggctgggaattatatggaaatccatatttttttcctggactgtggaaggcctgaaacgcacgaaaaacatgtttttagcttggtttgaagcttctaggatggatttctatatccatattttccatatttttccatatttcgcgatttatgtccatatttccatatttttccatattttggcattttggtccatattttatgtccatattttggcatttttcaaaaaaacctctattagaacggcccccatcagctaaattagcctttttgagcccaaaaaccgaaaatttttcaaaaaatcattttttcgccaaaatttctcgagaatattgaataaatttaaattttcttaaaaattaataaattatgtcaaaataagcaaaaaagcgaaaatttcgcttttgttgttgattttcgnctaaa

SEQ ID NO: 10985 - DNA, 2639 bp, Heterodera glycines
cccccccccccccgggggggggaccagtttttttggttccccccctttccccgcccctgtactcagacccccccaaccccccccccccgggcctttcccccccgggggggggggggggtgaaaatacccccttaagaatggcatattcgttgaataaaggcaaaaatttatacatttttgattttttaatcatcttttactttttatgaaataaagtaaattttgcttatattttttaaaatatttgtggtttagtggttagtgcttcagcactaatagaaatctttgttatgagttcaacaccggttgacgttttccttaaataaattttttttttcctttaattaattttttttctgattaatacagggtttcttcgtgcccccgccaccgcccccgcgactctgacccccgccaacccccgcccccgcgaaaagccacccccgcccacggggctcgaaccctaatcttaagaaaggaaaaattcttcttatctgtaacaaaagcgcaaggaattcgctgtagaattttgtgtacagcaccaaaatatgaatttacttatttttctcactaatctcaaaaaaaccaaattcgtttccaatgttcaaatgtgtgtacaactttaatatccttttaccgtgtcaaaaaattctgctgcatcaactgcaaattcaaaatgggtccgtatcgttttggcgccgacgttttggcgccaagctataataaaaaaaagaaaacacccaaatttaaaaattttgtaaaacaacaaaaaaaaacgtatttttcgcgaaggtaatactgccgatggttggttgccccccttttttgaagaaaatttttttgttttcaaaagtcatgaaaacatgcttccaatggttttcagggtcgctgctcacgaaccaggcatccatttcgaccaattcggaacccggagccgaaattcgaacaaaaaatcgaaaataaaaaatttcaaaattctctttttgttctaaaatagattaaaacaaccaaaacgttttggcgccgacgatttggcgccatgtagggaggaggtagaaatgatgagaaatcgttataatttttctgacgaagtctatcaaagagccggatttaattcttcatttactctttttcgctttggcttatgttctcttaattttgtatttaagtaatgaatcgtcaaattgatacgaaaaaacaaaagcctaaaataacgcatgaaggccagcttcggccggtgggctgatcgaatgaaagaatgtttcggagacggcacattctcattggcacctccaatgttctaccaaataaattgtttccatttcttcattttgttaattattatatttaacgaaaaatttgcttggcgccaaaacgtcggcgccaaaacgaccctggcgccaaaacgtcggcgccaaatcgtcggcgccaaaacgtcggcgccaaaacgacctggtcccttcaaaatcgtctctgatgctcaacaaataatgtgccagtgttggatttttattttgaatgtaataaaaataaagaatgcaaaattaagcaacaataataattaaataaaacattaaacaaatttataaataaattaaaagtttttggtgaatattttcatttggtcatttgtctaatgaatacaatttttgatgaattcattagcgaaaacatcaaagcaataaacctcataaaaagcattgcccaacaaacaaattgaatagaattatgggatttaggcgcttatgcattaagcacaaaaagtccaaaataggcaaaattaggcattttaaaagtcatcgtaggaattccacaccaagctgaaaactcgtttttcgtgcttatctgtgatctgtgcgtattaagtgcgcaaaaattttatcatttgcttaaaaacgaatccctagtgatcagaaacatccttaatcaattccgtaatcagagcccaaatcacaaccaagtgcagtgatcagcaacaactctcataagcaatcagtgaccagcccaattctcaaccaaatttcaatgatcagcacacatcttcagtcaattcagtgatcacaaattcttttgggtattttggccctaattagcaatcaaaaaacttagcgtccaaaaatcatccgatgacgtttcgtctggcacggcattttccatgcagttcgtcgaattaatttaaaattttaacgaatgaacaaaaggtctattgaaaatacaaaaccgaccaaaagcgttcaaccaaatggtgttcgatcttttaatgattatgcacttttcctttagatggcatttgttgcgtgaataaaatgaaaactataaattaacgaaaaacttttcactttatttattatcgaaacaaataccatgtcgtgacacgattttttcattttgaaaatttttagtttttcttttttattactcaatttaaaaatccttttaatattttaaattagttttaataaattgttttcgctatattggtggcaaatgagttagacgtgaccactttgcctaattttaaggcatttactatatttttgtggtcttcgcctcttattttttcttattttttttataatgttttgtttttcttatctttaagaaaaatgctcgaccaaattgttaattgcataatcatc

SEQ ID NO: 10986 - DNA, 1789 bp, Heterodera glycines
aaatgcaatttaggaacataatatggccgaccggcttgtcaatttggcacttattgccggtggggctgagcttgtcgacgcggccgatttttacagggaattgccaggacatgctgacaaagtggtgatgctctaccacaaggtgtccccttttcagcctttgctttcactcaccaaattgctttctaattaggccgggcttatcggtcgtgccctcgatttcgcttttcgaaccgaacaattcggcgccttggatctgatcacgcaggaattgaacgaacattcggacccttccgttttggcacgcgccgctgaattcttttcggccaatcagcaggacggtgtggacattttcagtgtttggcatttgtcacttacaattagcagattttggaatttcaattgcatttctataccaaattgccttcctttaaggccaagccgttcgtttgttggtttatgccaaaaaagtaaagacccttttcggaatgattttcaccgctttttgtccgtttagtattcacaagcggtcgcattatgtgctgataaaaatgtacaaataactgaagagttagaaaatgttttgacgccaaataaattaggtataattaaataatgaataaaataaattggacaatttttaaaacttagaaagtttaccctcgggggaacggtcgcttttgctagaacaaattgcgcgctgtgctcttcagcaagggaattatcatattgcggcaaagaaattcacacaatccggcaacaaaatagaagtggctaattaagactaattatcatttcgttttaattggctaattaaggcaatgcgcgcccttttaaagtcgggcgacactcaggcaaacaaatgcaaaactccttttgttttttgctcgcatattctgctgctttagcgtgtccttctctttgctcagacggcgcgagtcggcgccatttatcgcatggcgggtaattacctgcaaacgcttaattggaaggaggacgcgcaactgatgcgccaaatcgaagcattttatgtgaaggcgggcgccatggatttgctgtccaacttttacgaatcgtgcgcacaagtgggacgaaaagcaaaacgaaacgaaaagcaaaacgaaaataaaaagcaaaacgaaacgaaaagcgaaaatgatagaaacgaaaagtactttcgggaataaaagtaggatttccatttgactttttattgaaactgaataaaagtgcaaatttggaaattgaggtggaaatcgacgagtaccatgactacgaaaaggcggcggcagcgtacggagaggcgtaaaaacactgaaaattggcatcttttgatgcgttttttgttttgtttagcattcaatgtttggccaaaaaattggctgacggggacgagaagaacaaaaactatctgacagagagaagggaaaaacttagccaaacgttggacataatcgcgcactttaatgagacaaaagggtgcacttgggctggggtaattaattaattatgggtcgtaatttggagcttttcagtttgtatgagaccgacccgggggaggccattagccaactgagcgaattggcacaacggaaaggcatcgatgagcacgtccgactgggcgatatttacgctttgatggtggcccattattacaagcgggaaaattacagaaaggtggggcaaatcgcagaagggcaatgccggtggggggggggggggaaatgacacaaaataaaaggaaaatgaacaaatgccaaaatggccaaagtggcacttggaccagtgc

SEQ ID NO: 10987 - DNA, 1444 bp, Heterodera glycines
  misc_feature (1336)..(1336): n is a, c, g, or t
  misc_feature (1396)..(1396): n is a, c, g, or t
cccccccccgcctcgtccacctgatacccgtcgatgctttggtccatttccctcactctcccacaaatctcccaaacactttggcggtcatttctctccaaaaaatatgtgcgcaatttttcctttcccttaatcaaacttttgtttttgctgcttttttccatttgcctttatttttatggcccctctctctgtgaacaaaaatgacggattgtttctgattgccaaagccttcgcagttttgctgacgtggattttggatggcatccctaaaatccgttaattttgtgcgaattgttcaaacgcacccaaagattccattcgattggccaaatgaattgtgtcaccaaaaaggcaatatctaacgacaaatttaaacacaatttatgtaaagaaagaaacaccttggcatctaaaaaaatgattggtaaagcactcttaagataagggaaaatggaaaagctttacttttactccgacgacgccggcgacgacggggccggaatggacgccaattcggatggaaatggccaattcgttggtggggttggtcacctgcaaaaagcacagaacggagtacagcaggagaggggccacccctgacaaatcgcgactccatcagaaaaccaatggcaacattcagaattttctccgcgtgattttgggactctttcggcacccctccgacgatcatataagcatcgcctgttaatgaaaagaagcttttgcttattgtatctttctgttttattcctttgtcactaatttaccaattgtctccactttgtacacgtcgtgaaggccgacaattcgatcaaatcgttggtataggtcattaagcagtttgatcacatccttaattagccaattaaggcaaaagagccgacaaatgaagcattgggcaaacaaacgtaaggcgtgcagaaggagcaaatgttcgtaaaagtgacgatctgaaggaacactttgaaaattaacccatgtgacagcttaaaatgtgccgaatattcgtccccattcccggcccaactgctttcattttcaatttcgaattattagcattatttacaaattacatctgtgaacagcacggtcgcctcggagaattccgctgcgtcgaccgttgcgccgcgccgaagagactctgccacgctgggcggcatcagttcgcaaagtaacccctcaagcagttaattaggcaaatttagtcattaattgattaacatggtattatttcattctctctcgcctcagtccgttgcttttccgcctttagcgcattggccaaacacttcaaatttcgtgtcgtctcctccaatcttcggctgaccattanaggttaaatgtcctaatttttctcggcatttgctattgcgcccacttgagctccacttgngacattcgcgactgattcagcatgattaagtctcgagtgctgtcatgg

SEQ ID NO: 10988 - DNA, 2514 bp, Heterodera glycines
  misc_feature (2449)..(2449): n is a, c, g, or t
  misc_feature (2455)..(2455): n is a, c, g, or t
  misc_feature (2457)..(2458): n is a, c, g, or t
  misc_feature (2465)..(2465): n is a, c, g, or t
caaaaaaaggaggaaaaacattgactgatcgggaggatgaaacgaaacttcccgaggaaggacggcacgcgatcggtcggcttatgcttatgccgttctcgacctgtcaattggggcatcgcttcacatattattggccttgtgtgctgatcggcccacttggttgatcacgaaaatcacatgctccgtcatcatcgtgtccatatgctcctgctttcgctcttgcactttcataatcacttctgtgtcgtaaattcgtcgtgccacctctctgatcacgcctttggcatatttggcatttaaaagccttccccattagttcgtttacccttaacgattgggtacagtccgcaccgtcgggagtagtaatgcaaaatcagggacccgtccgattggggctcacaccgaaacgccggccctttcagttttgttcggtagacgacatgatcaatgaactgtgccaatcgccaacgattagcacagattgtttttgattgatcttacataatgtaatgcgtccaatgcatccaaaaagcccttgagaattgaaaattatttcaattttcacccaattgcacctccaaatcgggcgaaagtgccctcagaagttcgtcccaccctgtctccatcgtaaattggatcagaaagccaccgtaagcctcccacacttcctcgacggggatgcctaagggaagtgaaggcttcaaaagtcgatcatttgacatttcaaaggcaaccgatcactgatcccatggcggacacgatccgaaaggattcctcgtctttgtaatatttgccaatttcgttttctgtcccttcctcgaatttggcaatttctctaaaagccataaataatgtgcaaattcattagcaaggtaaacattcattttacaatattttagtccaaatttctcttccgtatttgcgcgtcatcaattgccgaaaactttcgtggatccatccgaactgagaaaggaaatacgtaagaaaaagaaaaaataaaaaaaaggagagggataattaccatttgtcgagaattaaggagaaagacaccgaataaagaaagaaagaatgaaacaaatgtattaaatcggttgcaatttctttggcactttctcatttgataatttatcccaccacaacggcactttgtcattcgttattctcactccatatttttgctctttctctcagttcgtgaaaaggtgccatttcacaaaatgcaggagaaagtttgtcactgttggcagtcgcactaagtgacagctgatgaatgactaattaattaatggagtagtcttggagaagagcagtggtatattttgcatgatgaagtcaattaaaagcataattgacagacagcacgcacgacggaaccaatcaaagagtttttattaagggaaaaggaaaatgaaacaaaaaatgccaaaaaataaaggaaatgccaacacaatttaacatgatctgattgccatcggcatattcacactattcacattcataattggatgctagggatcgtttagtgacttccgccagggattagatttctaatgagttttgaaaaagtcatttgcgattttattttatttttttaccccatggcagaaataacgtcccaacacaacgtaatatttggaagtgccgagttcgatcattggcaccgatgcgccctcagttcggcgcgtgtcgcgaaatttgtttcacatcgtttgcactgcctcgaagcgctgaccccgcagttctctcccaattttgtccctgctgctccggtggaatgcacgcggaggtgcgcctgcaaattgctggcgcgattaaacgctttgccgcattcggcacacacaaacggcttcaccttaatcaggcgaagctaattatgacaaagtgccaaaaagcatttgggaacgaataaatcatcagaccattattgaatgtttatcaaaatccctctattcgcatttcgatttgtgctcaccgtcgtgtgcgtataagcatgccttgtcaaattgccaggctgtcgaaatgctctcccgcaatgttcgcatcggaatggcttttcacccgtgtgaattcgcttaagcaaaacaaaaaattagctatttttcaatttatttgcgacttttcccgccatttgcctttgtcccttcggcaggtggccctttgctcttctctctcatcattcgaattcgattaacaattccgcaccctttgtttagcccccgccccttcgcctgcttttcctctcccccttttccctctttttgctcggcctttcgcttccctcccaatggctaaccccaatttgttctcccattcattggctcaatgaaagaaaggaaagaagcggccataaggaatgaatgaaaacaatggtcagcaggcaaaagcaaagcaaagcaaaactgatggatgaaagaattgacaaaagagggggggggggggggggggngggggngnnggatggnacaaaaatgaaaagtgaagggaccgaaagtgggaggagaatgagggggg

SEQ ID NO: 10989 - DNA, 3407 bp, Heterodera glycines
  misc_feature (19)..(19): n is a, c, g, or t
ctccatttaccgccagcanttgggtgaagaaaaggaaacgaaacaccaaacaaactgttgcaaagcgatcactgaccaattttaacgctaattgttttgttatactcattaaattcctttacctcatatttttatggacattcatagttttattgccgtaacgtattggaactcagaatctctctgcttgttccgtttgttgcgcttaaatctgtgtttaaattcaaatttgtttctttttgaggtaaaaaagtgccattccgtttttattagtttaaaatcatttttcttttttgcgtagagcttacttcaaaaatttaatattatatattttgttttatcgacaaataaattgccaaaggaatgccattttatctttgattagtttctttgggtccttatcacttatcagcgaatgtttacccataagttccttctccatcgtattaattttctctattaggttaattcaaccgaccaatgttttcatgaaaaacggaatcactccaaaaagaataaatgaattagctgctgtcaaaggacatcagtagattaattcatcccagcaggaatctctttttttgtttatttccttcatttaatatacataattgtttcattccaaatggagggaatattcggcactcagcgggggggaggggacattctaccgaataacgacaacaacggcaatcacaacgacaggcaaccgttgctactcgaagaaaatgaaaaagccagctacgggtcgctggtgcctacagaggactcatttaggtagaaaaccattcccaataaaacattaggcatttaagcggggaaagaatcgaccaaagaggcggagggaaaacggaaggatagaaaactaaaagcaattccatccatctctgaagtcgagaacaaaatcgtataaatttgaatcgctgtcggaataagctgtgaaatcgaatgtcaagaatattgaccaccccttgtattattttatatcaattgctcggttggcaccattttactacgcagcgaaattctgaacagagttacagacccgatactgaagtgtctaaattacaccggcacataagctgtcagaaaaaggaccggctggatccaagtccaggccgagctctaattgtcaatttaagggtttacgatattttgggcgcgaatttccaattgcctaaattttttaagctgtcgaaattccaattgccgaattttgagggcgtcggcacttgacacttatttgttagtcccgggcccggtgtatttcgacatttcaatacgggtctgtatcatagttgccgccgcgccctaaaaatggtactaatcggggaactgattgatatatagaatatatcaaaatcattggtgtcattaacttgatcttttccaacgcttttttaaatctctaaaaatgtttcaataaatatgttaggcaagacaaacattggtggaaaaggagcggaaaactaaaggcctcgaaacgacaacttggcatagtaagtttaaagttatttttttgcgccttcttccttttttggcatattgttcaattaaaagcaaatttaagggatttgaataaaaaatttaaaaaagtaaaaaccataaatttggcaaaagttcggaatttgacctgacaaaatagagactgccttccccaatgctctcagatgggtctccctccccccaaaagcccttcccaattagcccttcctccgctcagtttgcttattcctcctccgttgattatgcgctgattgcttttggtacggtcgcttctgtgctccacggggccggcttccccttactttcgattgttctcggtgggatgacctcaggtagaatgttttgggttttccatagatttttcttcattttttagtttttttgagggccgaaaattccgattttgttcatggccaaacgccgcgtcaaaatgctactaattcctctgccatttcgccaatttcaaagtgaaagtgaaaaacaaattcgcaatttccttttttaaagagaggaattccaatcggaagtggccgctttctccgtgtactatttggtcttgggtttcgtcatgttcgtcacttcttacatccaggcaatctttcgatgccaaacattgccaattccctcctcattgtcagatcgcttgttgggaggcggtggcagagagagttgcccatcggcttcgtcatacttatttgaaagcgcttctccgccaggaaatcgcttggtttgacaccgttcagtccggcaatttgacggcccgcctttcggagtgaccgaccgactgatcattttttgtcaccgcttttccaatttagcgatttggagagagtgcgcgaaggcctcggggacaaagcgtcgctattcatccaaatgttctccgctttcgtcgccggcttcgtcgtcggctttttctacaattggcaaatggccctggtcatggtcagaatattccttctctttctccatttgcgttgcgtttgcccctaaaggcacttttcaccccggccattgccttcaccggcgcgtggatgggacgaatcaccgccacacggacgcaagtggagcaggagaaatacgcagtggcaggtgcaattgcggaggaaacattcagctcaatgcggacaattcatgcgctgaacgcggaacggcaggaaatggaaaggcacaaaaagggggaaaataccaaaaatggaaagggaaacgaatcaaaacgcgaatgaaaaggaacagaagaaaattaactcttttgcttaggtatgaaaaggcgttggaggacgggcggaggacggggctgctcaaatacctttacatgtccgtcggcttcggtgccacccatttgatcactcacgcgtcttacgccgtcgctttttggtccctcccccgtggtttttttttcaaattgacatcgctttaggttcgcttctcgtctcatcgtgtgggatgagcaatttgatcgcggcaccgttttcattgtttttttctccgttatgagcggctccaccgccctcggggcggcgctgccaaattttacgagcatttcaagcgcaaaaggggcggcacggcacgtgctcaaagtgatcaacagagtgagtttgatgatacatgctcaaaagtgggttcttattcatctatgaatatctatgaattcaattgcgattctttccctttttaaaatttgcttttttttgaaaggaaccgaaaatcgacgcttattccgaaggtggtcaaatgctgcgagaagtcaaaggcgaaatttgcttccgaaatgtgcgctttgcttaccctttgagaagagacatcgaagtgagtgtttttcagtgcgtccgaatgagtcccaattcccttttctttttaaggttctcaaaggcgtctctttcaaagtttgtcccggcaaaaag

SEQ ID NO: 10990 - DNA, 1409 bp, Heterodera glycines
  misc_feature (27)..(27): n is a, c, g, or t
  misc_feature (97)..(97): n is a, c, g, or t
tgtttggcctgactgacagtgattttntaaaaaactttttgctttcaaaattaataaaaaaggaaatttggagtaaagttattttttataataccancaccgaaaaaattctttgcccccatgccaatgaatgaaaagtgccatttaaggcccaagagggcagaacgacaattgtggtcgctcatcggttggccaccattcgaaacgtcgaccaaagtaagtgacctcaaaatgccaattccctttcttttctttctattcttttcagttctcgtctttcacaatggccaaattgtcgagacgggcactcacgaagaattaattgaaaagaaaggcattttccatgggatggtcagccaacagcaaatccaacagggaaacgccgaccaatccctccagaaaatcggtttctgtccctctctttggaaatcgaccccaatgaaaattcgaagacaaaaatattttcaaaaaattttccagcgatttttttgaaaactttttagaaaaaaacttaatttttcatcatttagttttgaaaaaagcgctgtaaatttttttaaaggtatttttcttgaaaaattgctgtttaaaaaatttttaatttttttttcggagtttcggcggcagagttttgtcctgctccggaatcaacgacccttttttgcttctcaaaacgccctttttcaagaaacttttcgggacagtgggtccggctgcgacgataggcgctgtcttgaaaaaaacatttttagaaattctcccctctttcagatgaggcgccaaattcggaagaaagcgaaggtacggcggaaggccagcggccaattgaaaaaccgaacgacgaaaacggagatgcatttgaagacggaagtgaagagaaagacatggcgattccgttgttgggcgagggatcggtcggatcggcaaaaagttcgccgagaaaggcaaaggcggccgagggcggcggcactttgtggcgaaagcattcgccggcgatggtaaaacaactcaatgcactcactgctccaagtttacgcaaatcaaaattttagcataaatatttttgttatttcaaagaaagttttgtgctcccgccaattttttaccgcctctaattattttagccatttaattgtccttttttcggttctccgtcgtcgcaaaacttcttccgcctctttacgcacttcagcttcgacggatgtgttacaaatcagccaaatgcaaaaggaattggacgaggtcgtctctttttctcttctccctttctatctctgtccacttttcccctctttcctcttcctccccccctcctttctctctctctctcctctttccccgttctctctcctcctcttcctcccttcctccttcctttctttctttcttcccttcccttttctctctat

SEQ ID NO: 10991 - DNA, 6301 bp, Heterodera glycines
ttttggcaaaatgtccccatcggaaattccatcattcatcatataggcctgactgaccctattgtgctaccgatacggccacctgagcagaacacagccgacactctgatgggtgaactggaaaagctgggacagtcggacggagacgaagacgtgcatggcggaggaatgagcaagcgatccctgttgctcagtgaaccggttcaaattgtcatcacttgcattgcaccgccggttggagcagctccgcgcttccaccattatcagcactggggttacaatgaaaggcagttgatccgaatacggaatgtcggtgaccatttctgcctgttccacgcgttgattgccgcccgttcttacactgatcatgacttgacaaaaatgattgcaccacagcaacaacaatgccatcaaggggacgtaagcagcagcagcagcagcagtgatcatcttattaacgtgccgtccgctgctgcaacagcagtgatgaggaggccggatttttgcgcaaatcatgaagtactgaatcgtcttctgtccagcccgggtcgaatgcaagaagcggtccgggggttgatgctgcatgccggcattgaccctgatgggcaagcgtacggggtggagcatgtcccgcatgtccaaaaccattgggtcagtgccatttttgaaaatgctttctgccgcataatttggcaaattttttttttaacaggatcggctctatccgggaatgtaccgcattgtgctgtttgaggaccgccctgaggaactgccgaggcctatctggaaggggccgatgggacgctgctttgtggtcgctttgttcatgtccggcggacatttcgacgcaatcaaaaaagtcaactgttttttcaagcttagccgtaaatattgtattgactgcgaatgcgtctacaccactgatgccaaacacaccatatcatgcaaaagccggtgtgctcagtgtacaagaggttattttgtgggccgtgtgcgcaaaattttgttattgttgttgttgtacagtaggaccacagcagccatgtgcgagggaaccaggcgtcagcatacattgctctcaatgcaatcgcttctttttttcacgcaattgttttgatgctcatcggagcggacaagcgtgtagcctgctgaaacgatgcacaaaatgcaatcgaacattccaaaatgatgccaaaaacccgcaccagtgttacaccagtttttgcgggcgctgtaatgtacgtttttttttttaagcggacggataaggacaacaaatttttcacaaaaaatgctcaggtataccacgaaaaagatgctgcttgtttcatcaaaaaaattcctgtcccgaaacaaaagcaaaactaccgcattttgtgctgggacacggaaacgcggctcgaacacctacaagaagcgggtcatcagcggcacaaagttaaccatttgtcggtcaacatcacgtgcacggaatgctgcgattctgcgacaggcgaatgcgtagaatgtgcgatatgcacaaccgaggagggaattttgtgcagaaagaaggactggtcggttcttcttcctttcttaatacatgcttgctcacatttttgccgacaggagtgaagcgaatggtgatgaaccgctcagggattttgtcgaatgggttctccgtgcttggagcaataaacacaagacgtatttatgggtttgttgttttttttttgcttcactgactaatttagcctcgaattgatcagctcaaattcaggcacacaactcttctcgttttgacggacatttcgttttaaagtatttgggcgagaccagtcgacgtccagatgtggtcatgaacgggcttaaaatttatgagtttcgactgcagcatagccgtcaaaattctctgctcatctggagagattcttgccttctgatgcccgttcgtctcgatcaactgccaaaaacgttcaatttggactgtgcagagaaacctttttttccctatgctttcaaccgaaggttttttccgaaagctgtgacatttgtcaaaaaaataatgcttttaagggaaaactatgacgtgaggcttccgcatttgccgccaatagaagactactgtgctggctcaatgaaacaagaaaaatacgataaatttgtcagttggtaagcaaaactatagggttatttcagtggtgggggttccccatttcacataggtatgaggaaaataaaacaacaacacccttctatttgccggacgagcttcaatcctattgccaaaatgatacggagattcttctgaaggcaattgtgcagttcagaaaaatattgatgcgtgatataacagggggatacgatgtgctacccatctcgtgcactattgccaggtaaaacattgattgtgtgatcatgtgaaaaaaggagaagaaatgttttaagcatctgcatgagcatcttccgggcccaattcctttgtgagaatcaacttgccattgtacccgaacgagggtatgagcggaacgacagagccagtgtgtttgctattaaatatttggattggcgtgctaaaacggatgcggttaaaattcaacatgcgggaaacggcatggaaaagcggtggagacagttcaaattggacggttggatagaagagcagaaccgctgtattgaagtgcttggctgctactggcacggctgtgagcgttgttttgatcccggcgacaaactggtggacgccaaatcatgcagagaactgaatgaggagaccaacctccgattgatgcagcttcgtgaaggcgatgtggacggacatggcttgcaggtcgaagcagtttgggaatgcgaaataaacgcgcagttggcctgcaatgccgaaatgcgagcctttttctctgatttggggatggacagagggcctattgaacccagaggagcctattttggtggaaagaacgggccccattgaaagctatttgcagagccgaaaggaggacgaaaaaaatatcagtttttgatatcataagtctgtatccttttgtgaattatacgtgcgaatatccggttggcataccgaccatcatacggccaatggccgatgaaatgtgcgttaattggacacggccggagcagttgccataccgcggcattctgcgtgttcgagttgtccccccacggggtctgcgcgtcccggtgctgcctgtaaaaattgacgagcgacttttgttttgctgttgtcatcattgtgcaacgatgtttcgcaaaaaaagcacgcgccgcccacataaatgtccacacacggatgcacaaagatccttcaccggcagctacacgcatattgaactggaaagagcacttgaacacgggtacaaaattgatcgtctttggagagcttggcactatgatgaatggtaattgtctttctgtttaaaatttgtatgcgatattttttttctctgtaggagcgaccaaatttttaaagattatgttagactgctcatcaagttgaaggtttgcctgcagatttttgacccatttgtttaatcatgtgtttttttttgttaagattgagtctagcggtttccccgaaggagttagcagcgtggatcagaaacagcgctatgctgatgagtatcggcgcatttacgaagtaaacattgaattggagaatgtgaaaaaaaatccggggcttcgattcattgccaagcttatgcttaacagtctctggtttgtatatatgtccagccgattaaggtgcagcctatttttaggggaaaattcagtatgagaaacgaacttggcgcaaacaaggtcatcaccagaccacaagagttctttagtctgctctttgatcataaaattgtaagtttataacataccgttttgctggcttaactacaactaatgtgtgtccaggaggtttctgcaatcgtaccattctctgatcaagcgctacgcgtgctgtacaaaccaaagaaaaacttcgtttccgaacatacaacaagcaatattgtgataagtttgtggacaacaagctgtgctcgtctcaagcttcacgactacatggtacaagtcgaccaaagagaagattctgatttgctctatacagtaaacggggttttcgtgagcgcactatatttgtgattttaaggacacggacagtgtcattgttctacataagcgggacactactccacttgagactggagagtttttggggcaaatgagtgaggagtacttggattgcgatataaaaacgttcatatgcggaggttagtcgtaaatagcttattcaaaatttttatgcattaaggtgccaagcaatatgcctttcgtatgcgccacaggcggacaaacgaactggaatttgtccaaaaaatacggggaattacttttgatgtcaacaacagcaaggctctgcaatttgaaaaatttgttgaaaaagtgctcaattatggtagagttgatgataacgacgacgacgacgacaatagtgctgtttcgcctgctgttttctcctatcaaaagataatgccaacgcgcgacagcaaagtcataactcggaagcagttgaaaaaatatttaccagtgtgtcaaaaggggatcatcaacaacagctatgaagtgtttccttttggatatgaatgattgggccgccctcaataatacccattctcaccattattataaaaacatatatttaaattttaaaatattgcttataatagtttgcaacgcgcacacacacacacacacacacatgaatatatctgacagatgatgtcgttttgtgtgtaaattttataattcgttttgaaagtaatattctgcgtccttctgatctaaatcatcatggacaatggtaagaaagaagagctcaaggatcgcaaaaatgtgaaacgacgatacccattcccgttggtgtccgcacgagcacaggactcatggtaagtatgtgcaataagacacagcccaaactgcagatcaaaacccaggaggatcaaacttgaacaaatggaggaaaaatacgccaaaatggaagaggaaatgtcgtcggaagatagcgacgatgccatcgatttcttccaagacaccattgaggatattgtggaaaagtgggttcacgtggcatatatgtttggatttaattgttatattcctaataagaatcaaccgttccgaagaaaaaatcaaaaaatgggaggagaaaggcagcagcagcattaagatggagaacatgggcacaatggtcgaatggtaggccaactacagaagtgctgctgcagatacgttttttttgataaaatttgcagcagtggtgtggacaacggcgaaatcgatgacatggatgatcagcaggatgatgatgatgctccaacgtcaactgtttatttgaatttgggcaaagacgagcgcaccgcgaaaaattcttaaaggcctggatagactgttagataaatttaatccaaaaaaaatgcttgaaacatttattcttcatcgtgattatgttagagaaaaatagtaatagttaaaataaacatattaatcggtctcatgctcttctgaaacaacatggagtaattcaagtggaaaattgtcttggtgactgctgccaccaaattgtacaacacatggtaattggggatatttcagcacaatacgatgacgcgcatataaatgttgttgaacagttattcccatgaatccacggtaggcaaacatcatgttggctccatgtcgggatagcgcgtctgcggaaacagctacatttcttttcaggtgatgggtggctaatgactgtttgttcaagaatttcaaattttcttccttccttttctgaagcattttgtgaagccaagttggcgaacatcggttgaatcggcagagcactctcaccaagtcgcgtcgttctctttgtcgtcgtcgctgttgcttgcgctgtgcaggtccaactcgtccaccgctagctggtaataactgctgctgctgctcgctcgtccgcaacgtgagagacattcccgcgagtcgcccggacagatcatcagatccttcagttccacgtacagaggttcgctcctgaatgtaaattaattcatatttttccacaaacatttaaacttaccacactacaccctctgtcttccgcttgggaaagcatgttgtgtaaagttcgagtccctcgacaaggtcaagtgacccttccacgtacactggttggtttctgtgctcagtgttttcgatatgcacacagtcgactgcacgcaacggattccgaaacaatgactgaccgtctccctgtggactattttttatctcc

SEQ ID NO: 10992 - DNA, 1989 bp, Heterodera glycines
aatgattagtaaaaaaaattggaatttttgtttaattataattttgtaattgatatgtatgaatgacgaacttcattgaataaaagtaaatattttatgatacaaatttaattcggttttttatgtctaatgttttgaatccgcgtgcgccacccgcgattcgcggcgtttttgcgtgattcgcgaccgcggcaattttttgcgcggcgcgccgcggatttttggggtccgtatcgttttggcgccgacgttttggcgccagggtcgttttggcgccgacgttttggcgccgacgttttggcgccaagccataataaaaaaaagaaaaacacccaaatttaaaaattttcgaaaaattttgtaaaacaacaaaaaaaacgtatttttcgcgaaggtaatactgccgatggttgttggttgcccccctttttgaagaaaatttttttgttttcaaaagtcatgaaaacatgcttccaatggttttcagggtcgctgctcacgaaccaggcattcatttcgaccaattcggaacccggagccgaaattcgaataaaaaatcgaaaataaaaaatttcaaaattctctttttgtttctaaaataaattaaaacaaccaaaacgttttgacgccatgtaggggggggggggggggtagaaatgaagaaatcgttataatttttctgacgaagtctatcaaagagccggatttaattcttcatttactctttttcgctttggcttatgttctcttaattttgtatttaggtaatgaatcgtcaaattgatacgaaaaaaataccaagcggctgatgagcgcctcttcaatttggtgcagaattacatcccggtgaacccgaacaatgaaaatgatcacaattaccacataaatccaaattttcatattattttagaatttctccgtggaatttcgcgcaattatcatatgaacccataaattgtttccatttcttcattttgttaagtttattatatttaacaaaaaatttcattttttgtttccatttcttcattttgttaaatttattatatttaacgaaaaatttcatttttttataatttttacaatttcttcctgccttttttttcatttttggcttggcgccaaaacgaccctggcgccaaaacgtcggcgccaaaacgtcggcgccaaatcgtcggcgccaaaacgtcggcgccaaaacgacctggtcccattaatggggacggaacaattattaaaataatgaatattaaataacgaataaaatgggacaaaaattcagcagcactgctctcgagaccaaggctgaacttaactggattttcaattacggaaatccgtaaaccgtaattacttgggtccaaaaatgccgtaattacggaatccgtagttgcctccgcactgcttggatttctcgagaatttcgatgaaaaatgacaagaaattgcatcaatttccatcgaatttcgtgttctctcgaacagaagcactgcttatgaaaatgagcaagaaaattgctaacagagtttgcattttggaattaattaagaaatgaacgagagtgaccaaacgacggcgaaggaagggggagggaagggaggagtaattagtgactaggggaaagggagggggagtaattagtgcctaattgagagtaatcgattaaaaatattttatgttaagtcaaactaaagagaaaatataatgataaagtcaacaaaggtatcacaaagacaacaaattgtgtgtgcgattgatcgggcaatttcttaagccaccaatagtcaagagtgccaatcgccagtctcccgatcactcttcatccgtctgatttgatccgctcgtgcatgcttcttcgacggtcgactgataagagccactaaaattgattggaaaatctttctatttaattaagtttgcatttattgcgagtttactttcgtcgctgctgtcgaatgattctcgtcatccgcaaaaataattctgccc

SEQ ID NO: 10993 - DNA, 2672 bp, Heterodera glycines
aaaaaaagttgacccggcaatgactggaaaaagacagccaacagttaaggaacatttgaaaatggcttaattagcagaacggcaatttgcgagtcactcaccccccccccatcaaatgatacgtcatcaactgtttccggaagtgccagccgaggaagggaggcaagccactaacagagaaacgccgcccgccccgccgtcttcaaaatgtccggcagcaaaacgccgtgccaatttcccgtgaccccgccttttctcccttctctccctctatcgctgtacttacgtgatttgtttgaattgttttctgttcattttataatattttaaatatacaaaatgcgtaattcataaaataaacatttatttttttgtttaattctttatttgcaaatttggaaatgcatttttaaagaaagtaacaaatattcacataaattgaaaacaaaaattcaccacagcagggatgaaaaatcgttactaggtatatactcatttgtacacctttttcagtaccagtacgggtactgctctactccacttacgagacagggctgctgatggactgtttatgtgaatgagtcgcggcggaaagccatggaattggaaaattttgcatttgatcagactgattctcttttgccaccgatcagctgaagataataatgagcaacattagatgatgatcactgatcagcagcggatgtttttgtcaattaggcgggggggggggggttaattaaaaataaaacgatcagcaatgtgggaaatattaaaaagcggtggaaaatgccaccataacatggtttgttccgcgatctcttccagtccggccaaatcaaaattcatttggaaattggcacgtaccgcagcgaagtgatgacactcgtcaacaaaaattctttcatcctgaaacactccattgtcggcatgaaattctatcatcatcacctgcgcattcttcggaaacggtgcccaactttcctcggcctgtgcttcgctctgcgctccatcaactcattcatcttctatatggactttccggcggatcatagtgctgatgcttccgcgggcaaagtgttgacccaatggctttacaccccgcgtgccgacggcactcccaaattgttacggcttgactcggtgcagctccaaaaaatttggtgaagcttgaagaggtacagcagaccgacttttacacatattaattttgacttttcttttttccaggaattcagtcgtgatttttgacgtgccagtttcatcatggtcatcaaaatcctggcgtttggtgaatttgtttcgccgaaattatgcaaggaaaaccatcggacgggcgaaaagttgctgctgaggaaatacgggaatggacatcattttctacttttccgccgtcccatctcatcagcaaatgatgtccaatgggccaaatgggagaaggaggcctaagaatggcaattcgatgatcagtggggcagacttatttttgcggatgacgatgaatcattcgacaacagcgacgaaaggtaaactcgcaataaatgcaaacttaattaaataaaaagattttccaatcaattttagtggctcttatcagtcgaccgtcgaagaagcatgcacgagcggatcaaatcagacggatgaagagtgatcgggagactggcgattggcactcttgactattggtggcttaagaattgcccgatcaatcgcacacacaatttgttgtctttttgatgcctttgttgactttatcattatattttctctttagtttgacttaacataaaatatttttaatcgattactcacaattaggcactaattactccccttccctttcccctagtcactaattactcctcccttccctcccccttcctccgccgtcgtttggtcactctcagtcatttgccattgttttggtccattatggtcattctaatgagttattcagtgccatccccgcggggttagcgtacaaaaattgacaaaaattgtttttttcataatttttaaaaaaattatttaccaaattaattatttttttaatcatccattagccatacgattctttgcaaaatttgcgtcgcttttctccgtccgctctgcgcgagtgccccgcgcttcgatggatcgagtgccacgcgcttcaatggatctcctcatcgtcgtactttgagtttccggccgacgacagtgccaatgcgtcgtatggccaagcggtgaccaaatggctttttacgccccgtccggacggagcgccgaaatttttttgttgtttattcgatcaagtgtcgtggcaagagctccatttgttgtcaacaattgacgccttaaaagcggtgagtgtaaatattcgagctgttcgagaaaatctctggatttggcctcggtcccgtgtcttggcgccattaaaataaattttggcagagtatgtgccgtggcattcgattggtcttagagctgcccttttcggtggtcccccccccctcccctccggcgtttttcccttttcattttgccttttcatcactttaaactttttatgcttttgccaatacttcttctccggccaatttcttcatacaatttcgctttccgttctgtttttacgacgctgttcaattcgatgtgccgttttcgctgctcaacgaattcaccggcgaacg

SEQ ID NO: 10994 - DNA, 1610 bp, Heterodera glycines
attattttcaccgagtccaagcagtgcggaaccgatcagcggtgaccatggcacgtgggcccactcaacacggtcccagccaaggtggacaagcagggcggacagtggggtgttcagcaacaaattctgcacacccaaaacggtcatgaacagtgacacttggccaagcgtggcattaccaatgcacaatttgaacagcaccttttagggcagagaggaaatttaaaacgaaaaaacatgttcaagaaaaatgaccaaatcaagattttcacgagggtcctgatttttcggaaaatattaatcaatgccacagggtcaacaattttaaaaaaatacaaaagtggtttataaatgagggtcatttggtcatagatttgtttactaaaaaaataaaaaaatttccaaagcgttatacgttgtttttttggaaaacaaaattttgtatctaattagtaaattaatttttttaatgaaaaattaatttattaagtttggttgattaaaaataaattgttttcaaaaaaaaaagagtcgcttttcctcaaaaatactcacaccttataaaaggaagcgagtacggtactgaaaatggcaagacaaatgccgagacgatttgcagcaaattcgttgtccaatgcgaccagcagaacaccgaccattgccaccaaaacggcgacaaactgtgtaacgaaaaataaataaataaaaataataaaatttcaaagccggggtttagggtttatgctaatctctctccccccccccgccccctataaaaatttttgaaaatttgtaatataaggagcaaaattatcatcaaattcataaacatttcgctaaactcatggaaacatgaagaagttcgaaaaagtccaaaatgtagaaaaatccaaactgcagccctagcgatcagcatcattgtaaatcgcgctcaagtacaaatttttaagcttgtccggaaggtcggtgatgctcgagagtctcggtctcgagtctcgactcttgaaaagtctcgggttttttgatttcggtctcgagtttctctaggtctcggtcccgatctcgaggtcaaatctaggtctcgagtctcggaaaattgtgggtcttgcgcatcattagggggagggggggggggtagaataactcgaaaataacaaaatatatcaattaattaattagtaatcttgactttgagcgttgaaaatcgctctcggagcagagtccagctcagcacccagaccagcgctgtgctggcactcataatggacgacgcagcgccggccgaaatcagtcccaaggcttgggcgtacgcgtaatttattgcagtccacagggcgagaaaaagcagcgggcagagcaaagaatgccttcgagaagaaagatattagttaattcaattaaatacatatttatcaatcatttgtaaataattaaatttttgcccccccccaaacctcaaaaaatgaaatttttgagttttcaaaagctcttgctagtaaacaaaaaatattaagactttcataataatctctttcaaatatatttttttaaattcttgtaattattaaagaaaattttaagaaattaacttttttcaaaaaataataaaa

SEQ ID NO: 10995 - DNA, 1339 bp, Heterodera glycines
  misc_feature (1165)..(1165): n is a, c, g, or t
ttttttctcattgtcagcagttttatttcacatttagcactcacaaattaatatcacttttaatgctaaaatttgatttgcttctgaaaaaacgtaatttttttttgttacaaaaaatagtaagaaacgggtacagtatcaaattggcctacacggtattcttttgcatattttcaactgtattcgtaaataaaaatttattaatatatattttaattattaataaatcaaagacaccagtgagaatggtgcatagaaatgggatgggtcgatcaccaaagtcgacttgcggaactgtacggacaatgcccaggaaaccgcaacaccaacaatgacgagaaaattgatcacaaactggaaagcgaaagacatgaattgatcggaggcgtttttaggagctaaaaattgtcaaaaattttttcgggtttttttttggggataaaagcaccgaaaatttacaaaaaggacaagcacctaaaagcttcaaatcatttggaatgtaaaattttttttacaagaattttacgtctgtcattaaatttgccattcatttcgaacgagacaccataaaaacacgagaatacgatatgagacagttggggaatattttaaaagaaaaaaaaaactattttcaacaaaaaaattgtagtttaattttagaaaacaaaaaattaaattgaaattcatctcaaaaatttaaccaacccaaaagattttgtccataaaaatttgcattttttctggcctttttggatttagggggtttaggtcctgcgatgccagaagtctcctctgcctgggaaatttgtgtaactatttgtaagaaaaaacaaatgtgtttttttggctattttaaaaatgagatttttaaaaatagggatagatttaaatgattcttttctaaaaatgccaattttcaaaaaatattttctctccccgacccattcttatcagtgcataaaaaacaaaatctcacaacattttcagttctggcgctttcggagtcagttctcttagttataatttttagtgtgtccatgacataattacttggcaaattctcactaccgcacctggcgaatgttgctgctcgccaacggcactctcgccgtaatgccagcattttttctttgagtggtgccatcatcaattcccattgctgctntttgttgttgtacttgttgcatttgttttactcattaaacaaatgccctcctcctcctcctcttcctgccgttggtccgcgttaattgttgtctttgatgttgccgccgcttttgctcctccccgcctgtcctgctggctgtcgccacgttttgccgctgttccgtcgtcgtcg

SEQ ID NO: 10996 - DNA, 3434 bp, Heterodera glycines
tagagagagagagagagagcgagagaaagtgagagagagagatagagaaagagagagagagagaaaaagagagagagagcgagagaaagtgagagagagagatagagaaagcgagagagagagagaaagcgagagagagagaaaaagagagagagcgagagaaagtgagagagagagatagagaaagcgagagaaagtgagagagagagagcgagagagaaagcgagagaaagagataaagcgagagagagagaaaaagagagagagagcgagagaaagtgagagagagagagagagagaaagcgagagagagagagcgagagtaagtatgcctttatgttccgtttttcatcgctttaaagaaagataattaggaattgattgatgtgtttgttatgatgttaaacagcaaacattggccaagtgaatcgttccttttactttgccagtaaattatgtatacctagttagttaatcattcgaattaattgtgtcttaattaaaaaccaaaatttaaattttctaacactcaagaggacaagacttattggtcatattgtaatattttttttttaatctatcgatggctctaaatgttatccaatagaattaataatttaaaaaaatttatgttgaaatagccaataaacaggcgaaaaaatgaacgtcatcaaatttataatattaaccaatttaataatatatttgacattaaacaaattctgtcagattgagcatattgatttggaaaatttgtaatattttttgctaaaattattataattcaaaaataagtcatttaattgtgtaaagtttgaaaatattttaaaatcttttagactgtcatataaaaatgaaaggatgcttattaacttctttatttgtatttttgatcaccatcttaattagtaataattatgttggatcagtaaagaaaaaattggaacaaaaatcttttgaagaaatatttggagaaaaatgggaagaaaaaagaaacgaagaacagaaaagaagagaaataattggaaaattttataaaataaaagagaaaattaagcaaaaaggaagaaaatattcaacaaaaggggggcaccatcgatagtattgccgactggggccttattcccggttaagttaaccgcggttaacgccttaaccgtggtttatttaaccgcggtttatttttaaccaaaatatgtattctcgtctttaaccgtagttaagctaaccacggttaaataaaccacggttaagcacttaatttattaaataaataaatacaaaaaataaatttttattctaaaattcgtgagaattaattttcattgattaaaattaaaaaaatatatatctaggctaattactcagcaaataataggtataaaaatcgtaaataattttttttatttactattggtgaaaatcatataacaagttacagaataatttttaaaaaatttcacgagggcgactgcctgcatcgccggcctcctctccttgttctaaaaagtttttgaaaaaagggccgcataaaaagttgttgaaatcgataatgggaggtgtaaaatatttgatcgcataaatcagagtcccaaatttttttaaaataagacaaaatggctgaaaaactaagattcggaccccaaaaataagattttttataaaattaatagtagcgcgaaggaaacgcaataatattatattagcgtaaaacccaaggtttgccaactggaaattttctaaatcagcgtttagcagacaaaaaatcatcatttggggtcaaaaatcattagaaaatcttattcaaaatgaaaaaaaaatcaataaaaatgttttttccggcgcgctttttccaaaaaaaattttgggaacagtttccccgtcgggaacattttttgaaaatttggatgcaatttgttaacagattttcaccaaaaaagactagtttttgagcctaggtacactgccggaggaaaatagaaatgttaacatattggctaataacagttaaaatgtttaattaattttgaatatcaaataattttacaattaatcatttttaattgctataccaatgaccccccaaattaaaaatgtgtgtaccgaaaaggatgagatgtgaaagtgcaaatcgttctgttcagccacataaaagcctgaaatggaataaagtggaaaaaatgagttttattcaaaaaataaaacattttgttttcgcagatatccgtgccaaagtttaaaatttttaatggaaggatggtatggtaaaatagaacttgttattgtacgatgtatatcgaccagggctggacgcaattgcggattgcggattgcggattacggaaattgcggggtttttggacccccgtaattgcggattgcgggttgcggatttttgggatttatccgcaattttgatccgtaatttgactattggattatttttcgagacgatttcttgtaagattattttttataaaatgaatttttttctatttttatttaaagaaaatatgtacatttgtttaaattcttatttctttagcaatttaaaaatgtccatctgcattggagacacgacaaaaagccgaagttgaagtaaatgaatatttgcgggatccaaaaattaaatccagggccgatccatcattatactgggaagttaattcacaaaaatggccaatgattggtgccgttgtacggaaatttctttctccgcctgcaacaagttcagaaagtgagaggcttttctcaacggccggtctaatttcagatgacttgcgaaagagtttattaccagaaaatcttgcaaaacttttgtttcttcatcacaatttgcttttaaccggtttctcaattgaatgattttgcttttataaatttgctttttaatatgcttttaaattgctttaaaagatttataggattttttaaaataaaatttaaaattatttaaaaaaaattttttttaattgcggattgcggattacggaaattacggaaattgcggggtttttggacacccgtaattgcggattgcggatttccgcaactgagaaaatcgccgcaattgcggattgcggatttccgtaattgtaaatccacttgcgtgcagccctgatgggaatcctatctaagtttccggtgtccaaatttccattagtgtccaattttctaatgtctaatttccggtgtccaatttaccgggagccgaccaatcccggacctgaattcaaacaaaaagtcgaaagcatattttccaacacatttatacaactaatcacttcgaatgcataagtgtgtttcgtggacttcgcctataagtatgaaaaaaggcaccaaaggtcaaaaaaggcacaaaaattacatgcccggcataaggcactaaaatcgtaaaaaaggcaaaaaaatgcaccaaaaagttcaagatagaa

SEQ ID NO: 10997 - DNA, 2714 bp, Heterodera glycines
acaagggaacacatcgaactgtatgtgtccaattttctttaaaaccacttttattgtgtatatcatagtcgagttactattgccaattttcggcttttttggctcatggcgacaaaaatggcaagaaaaaagtgatctaagtttcgaaaaatcgataaaaagcacacacaactaaaaacaatatttattatgataaagatgcgctgaaaatatcagaaagtttaattgattttactattcaaccttcaatattttcataggattttaaattttcaatcgtaatttagaaataatttaagaaaaaatgtaaataaaaattttaatattttggaattatttttgaatttacaaatttttttaaaatttttttatttatcaatgttgctcgagagtctcgggatcgagaccaagagggcctcgtcctctggatcaagtcttaatttcgtctctcgacctcgagtctcgcgaatttcctgtacgaataacacttcgtaatcaatttaaataatgaaaatttcataaaataaattgtgtcccgaagctcgaaacggagttcattttaaaaatgcaatagaattttaaacattagaattatttagctggtaaaattaataaatttaaaaacaaaaaaattatagcataagcaagagttggtcgcatgatttattaaaatgaatagattactaaatatatgtatgtaaaattgaaaaggatttaaaaatacggaaatattgaagaaaaatgaaaatggtacaattttttatgatgatggaaattagaatattattagcacattaaataaattatatgaaatgtcctatatttccctttgttacctcatgttaaaacaacacgattattaaattccaaatttatgtaataaatgaaaatgtttttgcagttaaaataaacataattttgaaatgttgttttggtttcataatgaattttaaagaaaaatagtaaaaaacctaaagccatatttttaatagataactttagacaaaaaaggccttctatttggtttctaatacaataactagcgatcaaatagaatagtaaaataaatagttgagcccgaaatttgaaagtgccgtgacgggggcttttttcaaaatttgtgggacggtgaatttatacaataaaaaaattgtatagtttctattttagcttgggattaattacttatagtaaaataacattttattttaattccataaccttaaaagcttaaaatttttagcctcagataaattgtgtattagagttgatataatattatgtctccgttttaaagaaatttttaacacgtaacagggggttctaccggagaccctaaaaaacttcctcaatccgaattttagtttttatgcgctattttcaaaatcttttctgatgggtggagggtcagacgccagaaatttttttaatgaatttagttataataagaattcacgtatttttatttcgaattcagcacaaacaatgttcaaatttggattttgatctaataattcgttttcttaattattattttttgctttttgaaccgctctttttgcggcgaatggaacaaagtggtcaagtggtgtcgaaattaaaggcatttcgccaaaataatatttaaatttttcaattttttcgtcaattgaaaatacacccgttcaataataaaaaaaaaagaaaaaaatacagatcacagtgtcggccatcaaaacttaaatgagagagcgattcaaaaaatctttttataattgtttttaatttttttgcccaattttaaagtggcaccacacgaattattccatcctattacttcaattcccacgcaatttttttttgattaattttataaattttattaaataaaaatggaaaaaaaataaaatgaaagtagaataatctaattgagaaatttaatttttaggaaattagaaaaatatacaaaattaataacatcaacaaatcggaaaccaatttgttttccaacgagacaagcaaaagagagcaaatgtatataaatactgtccatatgttaactgaaaatcatccaaatcaacgcggcacagtaataaaatattaaaagatccgaaaaaatgccaaacattttcaaaatccttctgattgtgcttttggccgtcgtctcattccgtctctcggcttctactggtgacaaaagtaaaatattgaaataacttttgaatattccttccaattgtgtcaaagttcaccattttggtggccatggaaatccttattctgtgatgaaccctaaaaataattgacataaaattggtatttgctttaagaaactgctaatgatgggagtggaaacaactcatcagctgggattggtacgaagatcaaaagaattgtcaccgctggactgctcttcacttccctggcgacgggtggggcggaagcgattgggcgaagcaatgctcagggaggaaaagccgccggattggtgcatcgcatatgacaaatcgctcaatggtagctaatagtgccaagttatcacgatacgactgaaactcatttttaccaggctccaccgcctcctcctgcgcaatttgaaaagagggcaactcgagtagaaaaaatgagggcacacctactcgaactttcggagaaaatgacggacaaagagcctaaggtaggaattccggcttcagtaattgtctttttattgagccgtttatggactgtcaccg

SEQ ID NO: 10998 - DNA, 5028 bp, Heterodera glycines
  misc_feature (1202)..(1202): n is a, c, g, or t
aattgaaattatttacttttacttttactctaaaaatgtatttaagtcattttaaattgttcgtttgaaaatttacggccggccttataaaatccaacccgtggaagtaaaagcggattactacccgtacaaacattactaccgatccgtaccatgactcgcacatcaagccaagctgtacgacttcagaccgcgtttgattgacggtgtttatcgtttaatccataaaaagggatgggatagacagaatttgacagaaaaaatgccaatgataatttccataaaaagaaataattatttaattggagatcactgttttcattttgtgcaaaattaatgcttaaatatgatgtgatattaaaacagaacaaaagcaaattaaaaattgagaatttaaatttgattcaaaaacggcccatttttagcaaatacaaaaactaaaaccgagccaaattaaaattgggaccatatttgcattttttttttgttgtaaattgaataaagctaatgatggtgcctttcactcccccaatttaatgagtgattgtcgctttgtcctccacaatatttttgagtgacgttttgtctttgctcccctcgggggctgtttattcacattttctgaaatggggaggggagagtcataataattaactaattaattaataatttatcatcatctgtcgtcaatttgggaacacctaaaaccacaccactgaaattttgcaaaaaaatgaaatttgaggaaaaagcttcaatcaaacgcctccttatcactcttttgcttactcaggccgaccaaatgtgggcttatgctttataaaatggtttaaaccgttcaaaattcattcaattaatttctgtggaatgaatgaaaaaacatcttttctctttattttgtttttttttggtaataaatgttataattacccctaatttgttggcccataaattagaagcatttctttcggcataaattattcctttccattattttaaaatgatggaattgtttttaacccaaaataagtctcgttcacatacaaatttttttatcatctcttacaaattatatttaattaaggaatatggtttcaaaaatcacggtggttttggcatttctctgcctgctgttggcattattggtgggcatcgatgctcagcaaagtcaatgggagcagaagcagaacagtgcagcaccngcgagggttggcaaggtgaaaacaaaacttttgtcaaggaaaaaacaatttcaataattagcgaattctaatttcaacttctgcctcttcagatttagttttaattaaagattcaaaagttttctgttcggtgaaaaataattttgtagggaattcgaatttattatattttagcttttttgattaaagtttttcttgcttaatttagaacttaaaattgctttaaaatccaataaaaattaaaactaatactttacaacctaaaaatttctcgaaaaatctccgagaatgaaaaaaattaaaaaataataaaagagaaaagattacttaaaaacgatatccttaaaaaattttcaaaatcacctttttaaattctttttttatagtgtgacattgcgccggatggacaccgtccgctcgcggctggcagccgccggttcactcgtccaattccgtaagcatttgcgccaggcgctgcgccaacgcttggaccgtctgtacagtgacaaaatggcacgcgcagacgtggcatttgacaccgatgccgcggcaagggaaggcattgacgaagtgttgcgcaattacatggatgtgggtttcaaaactaacaatagtaatgaatttaatatattcttacaggttaaaaatggttttcaattaagggactaaaatctttaaacggcacaaaaaatttctttttcgaattgctatttaaaagaagacttttaaatttatataatgtgaaattgaaataaaaaattttaatttaatttaataaaatattaaaatttaaattcaagcgtaaataaaatttcaggctcaatattatggtgacatttctattggctctccaccgcaaaacttcaccgtgattttcgacaccggttcctcaaatctttgggtgccgtccaaaaaatgctcatttttcgacctcgcatgccgtaaatttagtttttcatgagaaattttaaaaactttaaccattcaggctaccatagtaaatatgaccacaaaaaatcgtccacctatcagccggacggacgcgaagtggcaattgaatacggtaccggatcaatgaaagggtacggtaaatttctaataaaattatttctttaatatattgatcattaaaataatgtaatgcttttttcaaattaagcttcgtctccaaggacacggtttgcattatggacggtatgtgtgtggaaggtcaggaattcgcggaggcgacaaggtcggattacatatgcataagaatatgtctaataaattaaaaacattgaaaatataaaaatcattcattgggattgataagagaaaaataggcaattaaaatatgttgcaaataatatttaaatttattggtatgggaaattttttttataatattcgaaaaatatatattttttcaaagggagtgggattttttagaattcatattttacaattagagtccgcccgttttgctcctttccttccgcgtcacttacatatgtataatgggaattggtccacagggattgaattttgcttttgatgctccataattttttgatatttgctatgagcgcgtaatagtaaaattcatagtcgaaataccaaatttatacccactttccgacttacagttcttcgcatcctttcacttgtttgagttcttaaaaattgttagacagacgattttgaagggtgcatttattgctcaatgagaagctgaaaattacaaaaaattatgccaaataattcagaaattttctctatttaaattttaagtgaaccaggcgacacttttgtaaacacaaaagctgacggcattctcggcatggcttacccggcaatttctgtgcagaaattggcaactgttttcaacaatttggttgagcagaaagaagtggaggagccggtgtttgcattttggcttaatcggtcagttaattgacaatttaaaatataagaaaagtcggtgaaataaaaaggaatttcaaaccgaagaaatgtttttagtgacccttcgtccgaatttggtggccaaatgaccgtcggtggcatggacaaacgccgttttgtggaaccaattaattatgtgccggtcactcgccaaacttattggcagttcaaagtaaggatggaataaggttttttgaaaaaaataaaacgtatgacaaatttcaaagatggactcggtcactggcggacaaaatggcaaaagcaaaattgcatgccgaaacgggtgccaagcaatcgctgacacgggttggaattgcaaaaatgttttaatatttattttgtttttaattttatgtttgtccaggcacttctctgatcactggacctcagaaggacgtggaagccatccacaaacacattggtgccaccgaacttgcgcagggcgaagtcatttaaaaaaaatttatgtctgagtgattacgggactaaatttgagattatctcaaatgggtctttattagatatttaaaaattaaaatttgattgatcattcggaagccctacacgtttagatgcataaattcaacagcttataaaaaagttgaaacatgaatactaccaaaaagtcagaatttttgcatattcttttttacatgtcggttatctttgtgttttttgggaagccgatagagcttgttaagagcatttgaatgataccaagtttattggaattggttaacaaataaaaaagttatgatgctctaaacttggctcagactataccggccagactatagtgtctcagtccgaataattttttaattgaatgcactcgtttttatgggtagaccgagttttatagaacaaaatttcgatagttttgaagacaaacttttttgttgcccaattcatattctaaatttatttatttacttttgtttaaattattttgtcaacaataacataaaaatatttttacaattttgttacagtacaccttgccctgtgacagtatcgagcaacttccccacatttcgttcaacatcggcggcaaggcgtacacattgacgggcaaagactatgtgtggaaggtcaactcacgggggaaaacaagctgcctgtaaattggaaaaaccaaatgaaaattttgaagttttccactttctcatttcagctccggcttcatgggcatggaaatgtcatcgactgctgacaaattgtggatccttggcgatgtgtttataggtgaatggatggcatgattattttttaaattatcaccaaaatttgcgtaaattcgtcaatttctgttgaaatttttgtctttaggccgctattatacagtgtttgatgcgggccaaaaccgtgtcggttttgcgcaggcaaaggacgaaaatgagtgagttcaataacaactcaaatgccaaatttaaaattttcctttttaaccttgaacatgaacaattttcaattctggaaatgtcttaaaaattaaaatttttagttttatatattttaaatatttttttaaataattaaaatgcacttttagcgagcccatagaaccaaaagtggacgacaatgatgatgctgatgatgcggatgatgatgggatgccggcatatgatggtgatgatcaagacgcttcatcttcttcggctgatcagcagcagtcagtggacagtgacgacgacgaaccaatggaaaacaattgggacaaattctgatcagactcagatgatcaaaaatgcttaataacaaaagccattgtagagaatcagccgatatcacttcaatattgtatagcaaaactaatttaaactttatttttgcattttttagacaaaagttcaaacaacagaactaactaacttttaca

SEQ ID NO: 10999 - DNA, 4191 bp, Heterodera glycines
ttgaaaaattagaatgaacttaacattggttttaattcttagacaaatttttggctcggacaattgggcgttctggtgggaccttctggtcacttattcggatgagccgacattgagcagtgatccttccgtgtcttgtggggacaaaatcatggccggaagaaaccaattcgaattcccaaataacgccgtaaatatttttatttcctttaattcgagtctggagcctattagagatcgtgcgagagtctcgacggttcccgactcggaaaatttctcgtgtttttcgcttgtcggttcccgtcggtctcggctttttagtctcggaaaccgagaaatttttacatcgttaaggacggccacttcgggggggggggggggggggggggaatcgccagcgaaagtggaaaaatttttgtgttccataactttttttaaatcccagttttaaaaaaaattcgtatcattcaaaagctcttaaaaaactttattatgcaacaaaaaaatcaaatagattaaaaagttttttagagttctttaatagcttaaaacttgcttatcaatattttagtttataaatacatagatgctttctaaccaattttgtaaaatttggccgattttgaaaagatttatgtccgaaataatttgcctcattgaacagaattggccaaacggaaaaagaaaaaagggtgtttattttttttaaaaatatttttagtcagaaaaaagggcgcgaattttgacagctgctcagaagcaaattgatgagctcaaccaaccttgggtaaaattaaaaaataataataaattgttttaattttctttgtaaattccgccaacaaaaagatgaaaagcaaaaaacattttatattcaacagaaaaaacaacaacaaaatttttaaagacattagtgtaaacaaaattgagaaaattattaaataattggatagaaaaatttgttttcattttattttattccttttttcattcttaggctgtcatcaatgaagatattgagatgatgacggctgaacccgccgatgctaatgatgatgataatgatcaattaccaaccgaatttgacagccgtcaaaaatggaaggaatgtgcggacatcatcgcgagtggctaccatcaaagtgaaagataaaaaataatcagaacaataattaaaataatatttttttaaatatagttttctgtagcatttagaacagtaattactgtatttaataaataaaattcttagcatttagtattgtatacaaagggttaacattgtataagaatctcagttctgaattcatcaatacaaagtggggataaaattgaaaaatacagaattcaaaaaagtatactgtaattggatatcataagttatttgcgcataaattcacgcttaaaatttcaatcatcatacaatttattgtgtcacttttttaataattctgaatattattatctcaagttttcccctgaaattttgagaatgaagagaattgacgacggctccgattgtagaagttataaaaaattgaagttttagcataaaataaaattcaaaatttcatatataaattttgaaaatcaaaatattttgcaattgtctaaaaaactgaatttttacacaattcttggcattttttgagggttaaaaggccattttttgtagtttttaattcatatttgggcatttttcgtctttttatggcatatttgagggatttttagcgcatattttatgtgcatattttgcgttttttagtccatactgttgtgtccacaaggaacaacagaaaaataaaatttattgttggaagacaaatgataacaaacaaataaataataaacaaaacaaataaaataatgatgacgacggagtcagaggaaggcaaaattggaaggagcaaaacagaaataatttagaactgaaaatgatgataaaaataataatgaaaaataataatgaatgagagcgaacagcgggggagaataatgacaggagagtatggcgtcacaaataacatgaacatcatcgttactgtattggcgctaattcaaataaataattaaaatccatcatatccaacatctccctccttaaattaaaagtccgacatctcccttcttaaataatgttgtcgtcacggcgaataacgtatcggcggacggcgttgtctctgaggacgttgcgttggttgaactgggagattggtcggcggagtagtcgcgacagagcggtggcaaggactttgttgttgcggaacttgctcaattgtatcattcggaaacgtcgtttctgattgataagggacaaaagaacgcatttggtttacatgtcgcttgacagtaatattcaacaatggaattttgactttccaaatcagacctttaccagcgacgattttgccttcaaaccaatttgacttgccagtttttccgtagttcaacacacgaacagtgtcaccgattttgaaatgacagggacgttcatcaattgtgttgacttttgttggggcgcttgacaaatccaatgtcgtcgcgatgggagattgcgtggccttctcaatcggtacaatccaatcaagtcccatgatgtttggagctccggtgtttgctactgaacatttgagcttaaattcaacacctttaaatttcaccaaacaatcaaattcgcccaacaaactcaatttatgcccgtaaaaactaccaacttttttaccttgacttctcaattttggacttcccaaacttatccaaagtgattcctgaataatcgtcagatgcgagcaggtgtcagccgcaagcttcacaggatgaccattgatcagtggatgcgtccaaatccaatcgtggcacttttgagtaacacaaaatgttgaggccacagtgacagcgtttgactgcgtgcgttcaggacaaacgggtctgatgtgtccacgttttccacagcggtagcaattcacatcctctgcataaggacagtcgttgacatgaaattgaccacatcgcttgcacttttgctgttgatcttcatcggtcctattcgaattgaaaggaaaattatactctttcgaatttggaaccgaaatattgcccttttggttgaccattttacctcggttcgacttcttacttccatcgcttactcgttgcggtcggacctgcactgaatgaacttgtccgggaccagacaaagcggcggccgaattttgaagcgattggatggagcggcactcttccagaagtgcttccaaagtcatggacctcggcggcgttgattttcgcgctttttccatttggcggagacactcttgtcgaagttctttgtgcgcgtcgctcaaacctgtgatgaaaataaggcatttgacttcctcctttgacagagtcatgtcggcgcgttcacagcgagcattgaccatggcaccaaactccatgacattttgcaagaggccacatgacagctgaaagcattcgaagcgcctgacaaaaattgatttagtgtcaccaaataatgccttaagagtggaaatcgtaagctgaaactcaatttcggcaggcttcttaggaagaacttgctgttcatacctcaaataatccgttgccgatagcttacccaaaatcaaacgcactttcatgtcgccggtcaaatccttaccgtccttctcgacaaattgtccaaaacgatcccaccaaagtgagaatgtttcatctgcctcggggtcgtaatggaattggggaagttgactattgatttgactgaagaggtccgaagaactggcacttggtgccgtatttttaggcaaaatttttgaaattaaatccaaaaactgtttttgctgcgcttccagaataattttgagctcttccttcgtcgccatgatagagaaaatgaatttgaaatgacagtgacaaataacaaatataaaattaaatttatgccacttgcaatatttggcaaataccgaacaaacacttagctttactcagtcagaatactgagaaactcttcaggcttgcgtcagatggggaataactttagtgttatgggttatgtgaggtggccgtcagagtagctttttggaatgttcacggtaaagcacaaaatatgcactcgggcgtcgccaatgttgtttccacaaggaacaacagaaaaataaaatttattgttggaagacaaatcgataa

SEQ ID NO: 11000 - DNA, 2230 bp, Heterodera glycines
ttttccccccctctttatttcttttttatttaacttttcatttctttcccttttgtcaatacataatttttccttcacttccaccatttccttttctttccaattttttgcccattcacatctgcctccgatgttgattcttttgttcccctttttccgatcgccattttcatggggccgtttttgcattcatctcattatttccctttgtttggcatttttctcccccgccgatttttgtacccttcggcgtcgctcttttgcatcttaatctttgcccccccccagggggaaaatgttctggtacttaagtattgtttatcgtctatttggggccattccattccattccattccattccatttggcacacattcacctcttgctcttcactcgttctcactcctcaccatctttttctttttgctgaatctttcccaatttttgaccccctcaataatccttatcgcccttcccttcctccaattttcaccatataatccatcaacatctcgcgtataatcatccaccaatttttgaccattttatcatcatcatcaccaataaacattttgtcggaaaagtgttgaaagggtcagagggcaaaaagggggggaaaaattcgctcgggaacgaagtgaccaaaggggagccaaagccccgagaatcgaagcgggggacaatcccccgcagagcagcagaaaaaagggacgggagccagttcctggcggttgacgcagttcgcggccggaagtccaactcttctcccgaacctcaaccgggagcgccgacagctcttcaaaaagtcggtggtgccgttacagcaacaaccgcaaaccccatcttgtttgtcctccccaccccctccccagttcactcccttgggcacggacccaacggcagcagtagcagtttcaggaaattgagtgaattgggcccgagggacgggagagaaactcccgcgcacagaccccctagctgtcagcgccggccgagtttctttgccacaaacaatttggtgccgttagcagggggcaactgcagccatcaacaatcggtctacgagcgaccaacgagcacgaattcgagaagctaacggcaatttggtgccgttagcagggggaccagcaacaacactccggtcgcaaaggaccagcacaaccaccagcaacagcacttcggtcgccgaggaccaacacaacgcatttgaacaaaaatggagcgacacgacgacgaccaattcaacgaaaacgcgaatcagggggatcctcccccctctgatcagcaggacgagaggcgagcgatcggagctcagccagccaagcccaagacagtcttggaagcgcacggacttgggacaagccaaccgggtgttacacccgccgtgacgaagaatttgcgtagcggactaatcgcagtgcggtcggcacgggaccaaatcgaaagagcagcgggcactcttgccgcgcgaatcgtcgaagcgcgggagctgatggacgacgattacacaaggggcgaagcgctcgaacacgctgctcggatgatggcaatggagcgggggctcggagaagtcaagcgaatttttgaagggcattttgagaagggcatagccgaagcgggtgcggcacctgatgaacggcaggacttcttctatgattccattgccgcccctttgccagctgcaacgaaataccttcgactgcgggagcacccaactcccgccgaactccttcaaattgcggccgagcacctcggggatctgcgagcgatgcggcaaacattcgaggacgaagaaagggagagcatctcccgatcgagcagatcagtcgagaccgagaacaatcaggcggaggaagaactcccacgtgccatgccacgacggagcatgcaagagtgggagacatcgttcagagaagcttatgttcgacagcatgacgaactgttcggccagcagcaaccattggtcaaccaagctgaacgggtggccacacccgtaatgtcaaacctggccgcgcttatccaacgacgctcaaatgctccctcggtggccagtgttcgtgtgaacaatccggtcagggagtggatggcaaggaaccaaggggtcgggaacggacccccggcacaggcccaacaaccaacacaagcgcaacgcccgctacaggccgtaccgcaacgcctcgaacaacttacgctccacgatcaaagagccattttccctcggacagcacct

SEQ ID NO: 11001 - DNA, 1375 bp, Heterodera glycines
  misc_feature (1219)..(1219): n is a, c, g, or t
  misc_feature (1292)..(1293): n is a, c, g, or t
  misc_feature (1335)..(1335): n is a, c, g, or t
gacacagtgcaaccgcagctgctgatcggaatacggcgattttgggacttcgtacaaggatttcggaagacggcggaggggacttatctgatcgacaccgtcttcggcactgtgatttgcggggagcagtttcagaccacgacgggagttactcccgattcgtcggtattcgcgatccccccatgtggggaggacgagcgggatcaaatgccatcggtcaaagcaatcgaacagttttggtcggttgaagcgatcggaattcgcgacgacccaacacaagacgccgacacggaggcgatcatccaatttgaacgatcagtgcggcaacacgacgacggacggtacagcattcggctcccatggcgggaggaacatcccgagctgccctccaattatgcggtggcttatcgacgactgatcgggctactccagcggcttcagaggacgcccggagtcctcgagcagtaccaaggagtgatcgaggagcaattgcgggctggcgtgattgaggaggcgacagtggggacgggaagtaccgagtatttcatccctcatcaggccgtgatcacccccaagaagctgagggtggtgtacgacgccagcgctcatgccaagggagttccctccctcaacgactgccttttgagaggccccgtgtggctgccagacttggccggaatgctcatccgttttcgggcatgccaagtacccgtactcgccgatgtggagaaagcttttctgatggtcggcattgaagaagctgaccgagaagtgtgcaaatttctgtgggtgcgcgacccacttggaccattgacaacggccaatttggtgccataccggtttcggcgattggcgttcggcctgacacccagcccgttctgtttggctgcggtggtacgtcaccacttgcgcaaatacaactccgaatttgccgagcaactcatccgggatacatacgtcgacaatgtgttaattccggccgacaccattgaggaagcgacgacaaaggcccaagaagccaaacgaatgttcacggacgcaaaaatgaatcttcgggagtttctgacgaatgaccaagggctcaatgacagcttttcggaagccgacgcgctgggcaaaacgacagcgaaagttctgggactggagtgggactcagtggacgattcaatccaaatttccttcccgggagttactcccgagggagagtgccgccaaacanggaggacagtcctcaagaccattgcgcgactggtagacccgctcggactgctcgcaccgggcaccctccccgnncagcagtacttccaaaggctgtgggacactaccccataatgngacgcgcctctcgaaccggacgatgcgcgagattggaaca

SEQ ID NO: 11002 - DNA, 1302 bp, Heterodera glycines
aaaaaagacatatgtcataggtgatccttaaacacattatttgagtctcgggatctcattgtcaagtctcgactcttgagtctcataaaaaatttagtctataaactaagacagcgaaaaacccagattcaggtcctactctagtagcggtattcaagagtctcggttcagactcaagaaaagtatcgggattttcgggaatagcccaagtctcgagcacaattttcgaaaaccatattgtcataagtgatccttaaacactctatttgagtctcgggagtagattggaccattaaaataaatttatttaaagaattcatagtccacccacccggaaaatatattttattatatgtatatactataaaaatatataatttcaagaaaatattattacaatttatgcttttcgctatataataaaataaatttttataaaattttcttatgagaatatctccccatattttcattgcccggtagcttttggcttgtttaatgaaatgaatttttacgtggaaatttgttggcaaatataataatattcattatttttaattttccttttcctttttcttctgactatgatgtaattttcatatgctgagtatgtatgtatattaatgtatttgccaaattattgactttaattgatttgaaaattgttggcaaaaaaaaataatttattttatgtaatatctataatattttaatttttttaatattataataaaaatatattttcacttgaataaaacataaaattaattttaattcgttccaatgaaaattgccctatttttcgcgctgtttttggtcattgatcttcagctggaaaatgtttttgcaactgatctgctcattaaagcattctccatcgagagcgagtatagtgattatttgcattatcatttggccaaggtttaaaatttattaaatttaaaatcaatttgaaattaaaatcttaaataaatatgagtctaaataaatgtgcttatatgagtagttagccaaaagggattatataatttgttttgccacttgggaccaatttttataggtttaaaaaaatgggttttgggctttttagtgccgatgtcggggatgaacagcttcattcgggatgaagtttggcaaattcccgactccgacagttggccccaacccctagcttcaaatctgaatttttttgggacccattcccggcatctctaatcccaaacattcatccattgaaggcttttgatcccatcaagcctaaataaagggtcgatttttagggggtgtattttttttttgtgt

SEQ ID NO: 11003 - DNA, 4186 bp, Heterodera glycines
gtccataccaagtgatcatttgggatcaacaagtcgggcaccatgatctgctcgccgccagctcgtcaaccagcagcagcaaccgattctgtgatgggcgtgaaatttttcatgtgccgcgtcaacgggggggcggctgatcaacgacaatatgttttcctggcggatgccatgcgaaatgatgatgccaatgccaatttgaatgatgctgcattggcgaaatgttttgtgcatttttacaccgtcaaaacggacaggaagggccgctttttgttgcgatcggacggcaaactggcggaccgttcttccatcttcaaccagcagtacaatgtccatttgatcgcattgaatgacaattccgtaagcaacattaaaattaattagggcgctagttcagctctggaatatggttcgtccttgttttcaagggcatgcattaaagcgggtagacgggggcaactgatgaggcttccttccgtccttattcacatagggaatccttgtaaaggggaactcatgtttttcgtccttatttttaagggctagcttgaaaaagaaagaggttcttgaacaggttcagcagttgtaccgctccggatgcgggatgggaaagaggggtgggaccgattgtgtttcggtcaattggtgagggaaatgggagtggtcaggtaataaaaaactcagaaacacaattacggggacaaaaatgaatgcttacaaattagtcaagatgtaacggagttgaaaagaagcggagagaggatgaagagaattgttgccttacaaattggcggcacttcgtagtcaaaagtcgtctgctgataaacactttgttgatcagaacaaattaaggcgattttgaagaacaatttattttttttaaaacacggagagaggaagacaaaaaaatcggagaaaatccagaacaacgacaaaaataataaaaatatcaaaacgaatatgaaatttaaacacaaaaataacgcgaaaagtcatcgttttaaaataattaaattgtgatcccagtacgcggcaagtgaatcgtcgtccttgaaaataaggacggagcgtgtccttgttgaattgtgaaaaaattggctgaattgtggccgtaccaaaattttcatagaatgacgtcctgaagaggaaggacatgcttgtcttatgtttgtcattatacgaatcgaagttcctttttctcgaaaaaaaattttatttaaatgtttcgtcactttcagtaattaaacgctgccaaaatatgcagggtttatggctcaaaaaacaacaaaatagtaattaaaaatgaaaaaaattacctaaaatgctaatttgtgaggtaatattgttaagaaaaatttttcgtaacttcataatagcacctaaacaatttttcgtatgtttaagaccaatcagaactcatgggcagggttccatctctaaaacatcaaaacataaaatccggcacacaaagttgaaaaacccggcgaaataaaaaaaaaccggtaaagcctggaacaacccccaaaaacctggcaaattcggggtttacccgatcaaatagcaaccctacctggcaaatgcggggtttacccgatcaaatagcaaccctacctggcaaatgcggggtttacccgatcaaatagcaaccctagctggcaaatgcggggtttacccgatcaaatagcaaccctacctggcaaattcgggggtttcccgataaaatggccaaccctggctcaggaaaaaatagataaattcttaaaaatcttttattaccttccaacaaataaaaatttatccttcaacaaatttttcacacctttttgaagcagccaatcgttgatgatgtgtcatatgcggcatctaccaaagtggtggcacaacgtgtttatgtcaatgacatgcgaaactcggtggacacaatatgccaacatattgatgagcgatgtgtgatcaatttttatccgacgggatatgatcgcgagaaacaaatgaaagaaatgacaaaaagatggctgacagatcagcagcattaccaggaaatgtcggaaatggtgagattattttttaatgttgattgacttaaataatacaaaataattaatataaaaataccaaaatatttttgaaaaaatatttttttgcgtaaagggtcaggaaaagccttctattagcttataaaattaaaaaatcgaaagttatcctcaaaaaacgaaatgcttgacttaattcaaattttggcatcctaattactttaacaattaatttttaaataaagagcaattgataattaattctttcactaattgaattaattatgcaattaattattcaaggtaaatttcttcctaattgccgtttttcgcgaactgattacaagtgccaaagagaaatcggcattaaacgttggcacattgacatccaatgaggcccaattaattggccatttttggaacaaatttgcgagcacaaaaaagaacggactgttgcataaacgattgagattgatcgatcaccaaatggtgcgactgatcgacgatttttgtaaaatagacgactcatttctgcgatcacaccacgagttgaaaagtgctttatcagtgcgtttatatcaaattcattttattaattgtttttaattataaaatgaaaatcaataattatgataataatcattgtgttaaaatatttattaaaggaagtgtaataaaagtttcataaaattctaaaaaaataaatcaatcaaaaaaattcaaatttttgttatctttatgaaaaaagtaaattaaaaaaatggaaaattttcaaaatctacttctataaaagtttcacattttataaaattcattttcattttaagctaagtgaaaaatttcaatttgcctgtctttattattcataaatttcaaatttattttaggccttattttccatgaaatcttatttattattttggaggctttttcaaataaaaagtcaaccccaaattaattggtttttgaaattttattttgcagttaagcaatcagccagaaaaattttgtgaaaattggccaaaagtcaaagaaacatcgaataaatatacaaatttggacattgtaatggaagcatttggccattggctgcataccagtgaacagcttaacaatgatgaggaaaatattatctttttttggattgaagttttctcgaagcggcttcaatcaaggtgttataattggccgtttcttgaccaaaatttgttcaaagaaattggtaattttttggatgattaatttaacaattattttaaaaaaatcatttatttagcatgaggaccgcaaaagaaaaattattatttttgatcgttttttgctaaaatttttagaaatcatataattaaaatatttattaatttttgtaaaattcaaataaagtatttgttgttattataattaaattactttcattattatttttaatatgcttatagagctattgttaaattaattaattaattaattaatttcttaattaggtatgatgtttgtcacagtaaaagatgaacataaattgacattagacaaaattgtacgaataaaaaacattaataatatgttggacaatatttgtagaaaaattttccaaataagtgccaatgagcaattcaatccagtgccgtggaaggaacagctttgtacaggaagttattttcaggtaaacttaatttttctgatcattaatttttcgagtatttcgaaatattatttcaaaaagttaaatatgtttttatattttgaaattttattccatcttccagaaaaaaatttcgtatctttttttaattatgccccttaattcctttggaaatccttgtctctttaattaatccctttaattaatttgcgatacggtatttcattaataattatgcgtaatacaaaaatttaaatttgcaaatatcactaaaattttgatttcacaaacgcaattttttcagcaaaaattaaaaaaaagggtcaacaattttgataaatgttctgggttttatgtttggaatttcaaatgcaaattttagaataattctcggtttaacaaaaaaaaaataataattccatataattacactcctaattacagacagtctctcctaatgatcttagaaataaacgaaaaatgtcaaatgaagaagaaaatcaaactaata

SEQ ID NO: 11004 - DNA, 1726 bp, Heterodera glycines
  misc_feature (14)..(14): n is a, c, g, or t
ccgccggacccccntcccctcgcacttcccaaaagttttttggaaaaatgcgccgcaaaaaattgttaaaaatctaatttttttttatcccgaatgcactaaaattttatgatttgcttctaatttcctcccaaaaattgttaaaatcgttaatgggagacaaaaatatactatttgatacatttttgatcgaataaattgtaaaaataactgatttgaagcaattttgcgaaatgttcttatttttgaccctaaaatcttattttttggccttgatgttcttattttgaaaaattttcgatacgcgccctgatcaaaattcacatttattgcacaaaaacaaatcaaatatactgaatggaatagaaaatagtgattcatagccatttcaatcatttgaaatgattttaggacaataaaggttgatttttatgaaaatctaatcaaacattttgccatacttttttttgcctagaagtaacgtcaaaccaaacccaaactaaaaccttcacaaagaatgtcatccaagagaaagtatcgagaaatggcattacatacctatgtattcttatgatagtcttttttagagtttttatgtggcataaagccactcattgattaatccgttaactaaccttacatattaacggctaaatactcgacattttacccggaccacccctcagctcatctctgattcatcacacttccgttttcacatacaatttcatattcatcccaaaactgctgaaatggacactgcgggtattttttttatacacatgtgctaattttcacaaattaatcacttctctgtttaggacaattcagctaatttttgaagttaatgtctttttaagaaaattgttcaaaatccaaaaaattatatgtcaaagttccttcaaatatgttacttgaataactgaaattaagtgcaacattactgtttagagcaactcagagacaaagtggacgacccgtccacctcaatgcccccctcccttcacaacccagacaatttgcagggcatttacgtttatcaacttccctttcccggttggcatgaaaaaacaataaatggaaagcaaaagtaaatttagggacattgccggaaaaagctcagcgcgagcaacttgctgctgttgtgcggaaatactcgaaaatcgttgaaattcgtatgcattaatccacctgtcttatgtgaaatcaataaatgcttgttagggttcgatgctgttcccaataatccggatgtaacatctgtacaagccggcagaaggtaccaattgccacctctgagccgcagggcactgattgttttccaaaagtataaattaggttaggtaaaaactaacaaatttcgaaaatgtccaggatctccatcgcaagttacgaagcactgcttgccgagtttaacaagcaggtgatgtcccagtgccatctgagcgcctctacggcaaagtctgagcacatcagtgctttgatagcgatgcgaaatgccgcttccgctggacacaaccccacaaaagcacaccaaacaatggcagcaaaaaatgcacaacaaagttcgacgacagcgacagctgctgagcagccatctcaacaacaacaaccgcagcaactgtactcctccaagaggccgatgactttgctcaaaatccaaccacctgcaccggccgtcaaagcataagccatggactcgcagacgcacacacaacccgaccca

SEQ ID NO: 11005 - DNA, 2595 bp, Heterodera glycines
gatgtcatttggcgccacccccggaccctccaaaaatgtttgtcctcttctcacagtcagccaaaaaaatcacccagtccgcctcctgacccttcaatgtaaaattagtttcatttgcctcattttacttaggtttctatttccattaatttcaatgaaagtggtggcggtcattgcgcatcggtcatcaaaaggccgattggccgtcaaaaagtgcttttggttgaacagcagcagcaaagccaaggtgcagcgcacggttttgagaagacattgccaaattgcaactcaaaaattggacgcacaactcgggaaacgacccattcgaattcaatggcagaagagacgcaaagccaccgggaaaagacgacgaggggaaagtcgcaggaaaattcggaacggggacgatctgcgaatgtaagacaagtcagaagcaactcatcatcgagcaacacgtcgacagacacatacagccaggtgggtatactgctctaacaagtcggaccatatgtcaatcattcacttcaatagatttgtttacatattttttttctgctgcgtctctgcaccactaacaatgaatccccatttcagaaatttatacaaaaaagaactgaaatcttaatctgactacacatttaaattgtttattcttatttcaacataaattttttcgtttttaagtctcctcggaagcgttggcgtcatcctccacaaccgtcggaattcaacgaattttccggaagcagacacaaaattacgacaaagaaaccagcaccagaaacaaagcacaagtgggaaagaaaacatcgctctcagagaagcacagaacggagaagggaaagtcgcgtggagaaaagagagaaacggcgcgagagactgcggtcgcggacacgacagacacttggggtgggcagagagagggagagatagcctttgacaatttaccactttaattgacagaccgcgagacgaacagagggcgaaaggagcggagagattgcctcaggcggagacagaagcaaaaggggcgaacacggcggaggaaaaagcacttcagacgcaaacaaacgtagcaaaacgaccagcaaagctgagaagtacaaaggccgatcgaacggtaagccaagaaaagctttgtcaatttccttgcttgcattttccaatttgactttaaaaaagaaaggaaatgcgcgaattttttaaaatttctcttttgaatttaacatcggcgatttaggacaaatcgaacactttgcttgatattttgtaacatattttagaaagggtacacaccaaaacctcctccaacagcaacagcagcagtcaattgctccctccgccgcctgtgcctccgcttcgaattgataaaacacacgaccaacacaaaaggcgtcgttccacttcctcatcctccgattcccactcgtcctgcacatgttcctcctgttcaaggtccacccacaacttttatcattttcctccattttagttttacttacatggtttaacagtaaccctttagcaattcgtcatccaactctcggaccaaattcgttgtcggaaaatagtgactccgagttgagcagttctgagaatgaagctgaacaggagcagtcatcaacacgacgcagtcatcggagcagaaaggatgggtttgtttcaccaattgtttttgtttcgccaattgttatgcttattggtttagatttaccgacgaaccttcccaagtcgacacccgacaaccatctataaaaagagagacaccgaatgcacaagctgtgcacattaaaagcgaacaagtgccattggtcactccgattgagtcaacgacaattgtcactaagaatatcgtacaaaatgctggtaaatgagtaattgttggatatcttttttaacagcattcttttagaacgcggaaatgaaaaaattatgcaaaatgaaacaaaggaagagaacacagagaaaagcaaagacacaaagggggatgaacagtcgaaacagaaaaaccaaacggcgtcggaaaaggacgaaacggcaccgaaaaagagtactgatcaatccatgggaatttgactatggtggggaaatgctctgagcaaatttagcaactgccgttgctccatctttgcctgtgcagccaccgcaaacggttggaaaggtccaagtgccaaggccatcccaacggacggtcgtctgcatcccattggatgtccaatcgacgtcatcaccacccaccgatccgcgacaaatgcgtccaaaacagcaacgaccaagcgctgttacggagtcaataatgtgcttggatttgccacgctttgtccataaagtgagaacaacagcctgcagcggcaatgatcggccgtcaagttcatccataagcggggaaggagcaaatttgacagaagagttgcctaaaagtggcaaatgttagctggattttcatttattgattgaattttacactctccagtgaaaactgtcccttctacggcaactgattggataaagcatgaacccgaaaatgccgaaatggaacccaacttaaaaataaaaacagaagaatcaaacgacggtgatgcccaagtgagaaga

SEQ ID NO: 11006 - DNA, 2375 bp, Heterodera glycines
aaaaaatccaggagttcttttattcaaagtaaaataaattattattttaatttaaaacaatttttcacaaaaaaataatttaatttaaattaaaaatttttattttttatggattaaacaaaactatttatatttattaaaatgaaaattaataatataatatttatttaatttgaaatgaaattaaacatgcaaaagtaatcaaaaaatgcacataaaaataatgtacaccggccggattcgaacttcccccccccccctcaaaatgatgcctcagaatccccaatcacacagggattctgaggtctgaacgatgtcaaaagtgaaaactgatcacgtatccgtgatcagcgtcattaaatggccttaaagacatattttttgaagattttgggtgaaaaaattttttcactcaaaaaccatgtgcacccccctttggtcccgaatcccaaaatcacttttatttttataacttttttttaaaaagggataaaaatgtaaaataaaatttatattatagagaaaaaaattgcggatttttgtagtttattatttttacagaatgacttttcagaagcgagttctgaatttttttctgaaaaatctaaaattttcagaatttctggaataacttctttcatattgatgttagaaaacccaaataaatcccataaaattctcctgatttttctctatttttaaggctttatttgctcaaaattggtcaacccttaggctagatatgaatttttcaatattcgcccaaaatcccgtgggccaaaaaattggaaaatatttttgaatttttaaaaaattccaaaaattttgaaacgaaaaataaacatcatattcgtgctcagcacatcaaaataccccagaaaaatatttttgacccccattttcaacccaaaaaaaatttccgaaaaatgaatttttgaaaagttattaaggggttgtaggctaacatgtattaacataatgaaatgcaattaatttttgaaaagttattaaggggttgtaggcagctttgcggccttagatgggcgcttcgcgcccatttcttaatttgtggggctcataagaacacttcgtggcctcggtgcttcgcgcccgcttcaaaatatgttacatgttacatgaaaacggagggagttcatgaatttcctctcttagcatgtaacatgtaacatgtattaactaatgaaagcaatgaatttttgaaatattattaaggggttgtaggcaggtttacgccctaagatgggcgcttcgcgcccatttctaaatttgtggggctcattagaacacttcgtggcctcggtgcttcgcgcccgcttcaaaatatgttacatgttacatgaaaacggagggagttcatgaatttcctctctgagcatgtaacatgtaacatgtattaactaatgaaagcaatgaatttttgaaatattattaaggggttgtaggcaggtttacgccctaagatgggcgcttcgcgcccatttctaaatttgtggggctcattagaacacttcgtggcctcggtgcttcgcgcccgcttcaaaatatgttacatgttacatgaaaacggagggagttcatgaatttcctctctgagcatgtaacatgtaacatgtattaactaatgaaagcaatgaatttttgaaatattattaaggggttgtaggcagctttacgccctaagatgggcgcttcgcgcccatttctaaatttgtggggctcgtaagaacacttcgtggcctcggtgcttcgcgcccgcttcaaaatatgttacatgttacatgaaaacggagggagttcatgaatttcctctctgagcatgtaacatgtaacatgaatttgcgagggtatcccatagactaggtgaagcgctgttatggtgctatctccagattttctgcctttaaagttttttattaatttttacagcttcactatgttatttttttagcacaattaattcataaatattttttcactaactgctctgaaacgcaccaaattttatttccgagttattttaggcactcgaatgctttcactatcaaaaagggagaagaataaaaatctaataattttgtaataattgtttgagtaccccaaacggacacttgaaaaaatcgatttttttgttttcggggcattccccccgaaccgatgcgaccagatatatggggacaccgaatccttatgggaatagcttccctatagcctgtactttatttctgcatgggatttttgctcctcataattgtttgagtgcaccataattacacttgataaaatctatttttttgtttgcggtggcgtccccccgaaccgatgcgcacagatttatagggaggacgaatccttcg

SEQ ID NO: 11007 - DNA, 1357 bp, Heterodera glycines
  misc_feature (1183)..(1183): n is a, c, g, or t
  misc_feature (1255)..(1255): n is a, c, g, or t
  misc_feature (1278)..(1278): n is a, c, g, or t
  misc_feature (1302)..(1302): n is a, c, g, or t
atgaaaagggagggagttcaagaatttcctctactagcatgtagcatatagcgaaataagtttcatcataatgaaaattcacagcaattttgaatagttaattctcccaaaagttttttattttaaaagataataattttttattattaacttgaaattattaaaaacgggtaaaaataagaaaaaaatacataaaaaataatgtataccgcccggattcgaacttccccccctcccccaaaaaatgatggctcagaatcaccaagcacacagggattctgaggccttaacgatgtctaaggtaaaacctgatcacgtattcgtgatcagcggcccaaataaccatcgaatgcatttttatttaaaaattttttaataaaatagtctttattaattaaaaacacatttaaaattattaattgaatatttattaatttgaattaaattaattttttacaaattcaaaaataaataatgaaattctttaattaaaaaaataaatttaattaatttaaaagaaatcttcaaattaattaaaaacggtgaaaataacttaaaatgcatagaaaaataatatacgccgtccggattcgaacttgccacccccctgctcaaaatgatgccccagaatccccaatcacacagggattctgaggtcttaacgatgtcaaaagtaaaatctgatcacgtattcgtgatcagcgtcataaaatagccctaatgacatgtttttgaaagatttttgatgaaaaaaatttttcactcaaaaatcatgtgcacccccctttggtctggaatcccaaaatcacttttatttttataacttttttctaataatttataaaattgtgaaataaaatttatataatagagcaaaaaattgcggatttttatagcattttacttttcgagaaagacctttcagaatcgagttctgaatttttttctgaaaatccgaatttttccagaatttctggaataacttttttcatatttatgttagaaaagccaaatataacccataaaattctcctgatttttctctatttttaaagctttaaaacaattaaattgagcaactcagtaataagttatgatttttcaaaaattagctcaaattctcgagggccaaaaaaatggaaaattttcaaaaattttttaaaaaattcaaaaaattccgaanacaaaaacaaaggtcatattcgtgctcagcacctcaaaataccccagaaaaatatttttcactccattcttncacccaaaaaaaatttttcgaanatttctagggggcctagctcgaanatttttgaaaatttttcgacatatagtacaccattcgatagcattttgaaagctc

SEQ ID NO: 11008 - DNA, 2354 bp, Heterodera glycines
  misc_feature (47)..(48): n is a, c, g, or t
  misc_feature (200)..(200): n is a, c, g, or t
aaaatgtttttgattttgtccctttctttgactttctttcgttgcgnnccattcccttttttaatttggccaaaagcgaaatgtaattaaaagtttcacaacacaaaaagattgcatgtatttcaaattcatataaataagcaaaatgggaaaggtcaaattggtcgaaaaataattttataataattttataataattntaataattttattattaaattttattaaaaatattttcgaattttatttgatttatttctcttacatttaattcccaaatttcgcgtccctttgatgaaatgttccgtttgaatttcttcacacttttcccaacacttttcttcgccctttcccgcggtaactcggcattcattgcctttccttaatcgttttgctcatttgtcagctcattacactaatgagccccctcattacgcgaccgttccctcccctccgccctccccgtcctaccgcacttataaccctgcccccattaacaccccaattccgtcttaccaaatctatccgaccaattgtaagtgtccaattttggatttccttttgcaatttcaaattttgaagggccaccccaaccgtcgccttccaccacaggttgagtttgaggagtacaaaatgtcagttttgttttcttcccattttttcaggatgtgttcgtccgtgttccgtcccatgcgtttgttcgccaacgaatggaactccaaaattgagcaaattttgcccgacacggcttttcattttggcccattttgtgatgttcgctttgattgtcggctgattaagcctcccctcccctctttttcatacttatctgagtctatcaagtgctcagaaattaagcatttgcgttcaaatggtacaacaaataatgtttttggtacataatactgtaatttgtccccttttttaaaaaaaaaatgcaaaattattttaaacgtttcctggagttttcgaggtcgttgatcacgtcggcttccattgaggccaattccgggccccggacccaagcaaacataatttgtcaacttttcatcaccttttcttgctcagttaccaagtgccaatgggatttttaaattcaatagaaaaggaatacactggtggaaaaagtctttactcaagccgatcaaatttgaaaaaattaaaatttcgactagaaaatttaattgattattttttgtttatgtgtttttatttacccctatttatgtgctttttatgcaccacatttctttttttgtgatatttcatgacacgattttcgggccaggacattttcgtaccgccgttttcgtacgagtggatgtgcaaaaaaaaaattgcattcaaataatttgttaattttttaaattacttttaatgttttgacagttaagcttttattaactacaaattgaaccagcagcaagtaattaaaacaaaactaaataatgataaattggtgcatgatggtgcacagaaaaggaagtatcgcgatgccgacgcacggattcttcgtctcgtccaacgctataacgatatcaataacaatattgtccctcaaaatgatcacaattatgccaatcccaatgtgaatcccgaaaacattaacaattttctcgccggtatttcccgaaactatgagatgcgaccctagtttgtcccattgttattgttaaatttatgcattttttacattaaatttatgaatgggaaattaaaaaatgataaaattttggttcgattagttagtcataagtttttctaattgaatctgacgcttgtacaagaactcgtacgaaaatgtcccccgtacgaaaacggcggtacgaaaacgtccatgaccggtaaattttatgcaaatgcaaattttttcctggattctaggtagtccaaatagtacgaaaaacataatgaatgttcccaatgtaaaatgcttacaacaacaattatttataaatgttatggcattatgttcatttttttattggcgatattttcgaaatataaactttaagcaggaaaaaccgtagttgattttgattttggccatggaccagttttcacgatgtttttgcaatattacatattttcaaaaaaattatatgagaagggtctgccagagaattttttaaaactaatttgtaagttgatttttgtaacagattttgatcaaaaaacaaattttttggctaaaattttgaaaacctaaagaaataagtggaccgaaggtgggggaaattttgactgatgtgaaaatttaaaaaaatagtctgggtcgccctcgtttcggcgccgctcgttggaccataacttttttctttgtcaaccaaatctaacattcttggtatcattct

SEQ ID NO: 11009 - DNA, 2308 bp, Heterodera glycines
tacgaaaacgaccctgaccgcacgatttttcatcaggactagtccctaaaatccataaatcccgtttttcaaaatacaggttccgaggaggatcctacacatgatctcctgtcctctgccaatcattctctaattgtgattggcccccttttactttttttttttgcatttgtctaataattccacaacaatttccgttgttttcatttaatttcttcatggatcatttcttgaattccttcgtttctgacaatgaattgtccaccggggtacgtacttctgccctttcttcctcccttatcaaattccgtcttttgaagatggtcactgtcatcggccacgtctttctctgtgccctcttttccactttcctttggaattggctttacgctgccaaatgcgacttcgcctttctctggtcctctgctgacacttctcttctcgtgcgttttcttcgtattttatttattttttcctttttcagtctgtccccgtccttttcctttgcttagtcgccacaattgcctctgccattgcctttttgatggttttcagttggaaaaggaccgtcgtgttcattattcagcttgcccacctttgtctgctcttcactctcccattgaacattttcgcgtgcttttcccttttccaattcatttttcccctcattttccgtgttcagtgactttctcgactttgttcccattggctattcccttcaactcttttcgttgtttgttctcgtcttcctctatttcacatttggctctttggtttcgtttcgtttccttttcaattccatcattttcttcccttttattgtccattttaggctttgttcactgaccgactttcggcacgagttcagcgtcttctcgtcgttctcaattgttcttttatcactgtcattttgctccgctgttttccccacaacacaatttggcaaatcattttgttggacatcgcctggggtaacgcgtccaatccgtctcacaatttgcttggcatttgtttttttcagattctttctctgtcctcgctgggcccgtgcggaaaatgttagaaaattcgcatgaatatggcgagaaaatggtgcgatgtgtgctattctccgccgcggatgagcaaagtgacgcaaaggaagagacgccggcggcggcgacggaagcgacttttattagcaacgcgccgggggagagaaatgcgaacgacgcactcggtgagcagcgaaacaataaactatcctttttttgcaatcacttttaaacagggtagccagattaaaattttcaaaagcctcatttggcatgtaaaaaaaacctcattttggatcaaaaagcctcatttttacaaatttattcaaaacacatttaaaatgttcaaatgttatatttttgattgtccatgaccaatttgagtaattttttgttagaaataagcttttttgtgaattctgagcccaaaatcgaaattgattttttttttttgcggcgcttttttcaaaaaacttttggggaataagggggtcggcggtgccgataggcgccgccgagaaaaattttgtaatttttaatgcgatttgttaacagatttgtccgcaaaaatgaccaaattttgcgattttgagcaaatttttaagaacatagaaaaattaagaattttgaccatattttagcatattttcattaaaaaattctttattttgcggtttttatcaaaaaaccacaaaaagcctcattttgaaaatttagcctcattgacctatcaaaaaaaccacaaaatgaggctaaagcctcagatttggctacactgcttttaattcattaaaaagtgattgaatttggtcgttgataatgaatctgatgactacgcgttgaaaagtcaatagtatcagttggtttttgtcttatatatcgtggagaaaacagatgaaacacatttccgtagtcagaggcaagcagccctaaccagaaaaataaataaattttttttcaaatcaacgaaattagcaaagaaaatggacagtaattttcacaaaaaaattatttgttcaggcggtgttcagttgggcttgggcgacttcgttctgttcgcccttttggtggcacgcgcgtggagtgaccatccgacgggcgcagccgctgctttggttggcattgccattggactcttcgccaattttgtcgtcgccttttcatacgcgagaaaaaaggacgcttttttctttgtgcctgcgcttccgtgtccgatgcttctcggaatgggccttcacttcggcattttatttgccattaaaatgtttgtgcaa

SEQ ID NO: 11010 - DNA, 5689 bp, Heterodera glycines
gtttttgaagaaaattaataaaaatgcaaattttaccgttaaacaaacaaactaaatttattattaattaaaaattctaataataatttttacagaaataaaacaaaaataataaattgaagaaaaaatggaaaatataaactcgcgaatttacccaacggagttggaaaagaaaatgtgcataaatgaagcaattattgctttattggtcattgttttgtcgcacccatcacaacgattaccacacacataaataaaaatattgttcaaaaataatcagcaaaaatagaaaaaaaaagtggaaaacaaattaaaaacgaaatcccattaattaagggaataaaacaaaatggaaaaaataattaaattatcaaattttaatccggatttaaataccgttactgaaaagcatagattaaataaatgcattcacaaacaaaactaaccccaccaaaaaaggggggaggggagaaaaattcgaacatttgtcggcaaagtacaaagaaatgcattgcgatggagtggccattaattaattaatgagtgcggtaaaatggggccaaatcactgcgcgccgccgcctcctcactaatttcccatcaattctctgctaatgatcccccgaacatataataacaaaaagggggaggagagaatggatgggatgggcaatggacccgtggggtattttcgtttatactttctgagcgtggcggcgccctaaaacgagttttgtgtcccaacattgcgcacctgtttttgttttcctctgcagtgcctggggctgaatttaacaccctctcacttttgcgttatctctcttcccattttattttccgccaaaagtctctttttaaaaaattgctttatattttcaaaaaatgatacaaattttaaaaatagcgttgatattaggttgatggcgtaatgttattttgatttaattaatagtagagttgctcggtaccggtaccggtactggccggtaattaccggtttttttggtaccggtaccggttttttcaaaaatcaaagtatcggtaccggtttgtctagtaccggtaccgccggtaaaaatttgcactggtaagaatgggggtctgggtgagaaaggagaagtggaggagaaatttttgaaaaaaaaattaaattatttattttcatttaaagcatttgttcatatgcataagtggtcaagtggctaaaccttctgattttattatttgtcgcttgggttcaattccccactcggatagaatattcttcatattttctttaccattattttaattgaaattttaattaaaaaaatattccaactttttttctttcattttaagcatcctaaaaacccaaaaattaatcaattggtctttttttacaaattctgttaacaaatcgcattaaaaaatacaaaatttttcccggcggcgcctatcggcaccgccggccctcctgttcccaaaagtcttggaaaaaacgtgccgcgtaaaaagcggtcttgaaagcaaaaaaggtcattgatttacattaatttacatggccggagaccccttcgcaaaattggaaaattggctgctgaccccttgttttgcaataatctgaattttgaggtctacatctgaattttagtgttctttatcctgaatttgaaaaaaaaacttggtcaccctcaatatacatatacttctgaacaattctaatgctaaaaaacaggcacttgcgcgaaaactgaataaaaattttgtatttgaaaaattttgtccaaaaatttttacgttggaaaattaccggtttttaccggtaccggtaccggtaccggtggaaaaagttggtaccggtaccggtttttgcattactggtcagtaccggtaccggttttttaacaattaccgattaccgagcaactctagttctcacccttctgatgacttttttatttttacgaataaataaataatcgtttaattccaaatatttttgaatattttttcaatcaaattccataaaaataaattcaaatgaaaagtttaatcgctacttacaataatagtaaaataatcaaacgaagaagctataattggtaacattctttgtccacaattgttttttttgcccgctcattttttgatcagagtgagaaactcctcgcgcgtcttcggatcatcgctgaaaaataagggggtactaaaacaataaattttctgaatttttgaaaaaaaaaattaccgaaaaacgcccatcatacacgaggtggtggtggtggcattgatcttctgcacgcccctcatcaccatgcacatgtggctgaagaatgggaattcatacaaacaatataatatatatccaaatttgagtaaccaaaaaagctataaatttccccaagaaaaataatagcgacataatttgtgcaaataaattacatttttaatttttaaaaagcacctcaattttcaactttcatatcatactaaagcattgcataagtttacacttggaaaattttttgtaaaaaaatctataaatctcacatgaattaaacctggctcaattttaaagcgtaaaaatatggtttttggttttgtatagccaattgagttcgagaattgcttttaaatagaaaaagcaaacaaatgccgtcttgaattttgtgtgcccttccccaaagtccgttatataatgtaaatatatatgttcacctcgcttcaatcacaactccgacgcccgtcgggtgcacagcttggagaattgctgaagcaatttgcttggtcagtcgttcttgcactgaaaaaagtaattttaattaaaaatagagtaatttaaatgtaacaatttgatttaaatgtttttaccctgaagacgtcgactgaacatttcgacaatgcgtgccaatttgctgagccccaacacttttttgtttggaaggtatccaatgtggactgaaaaattcaaagaaaaattaataaatcgtaaaatatttaaaaaattaaataaattaaaaatctctaaaaattattgcccattaaacctttgccaagaaaagggacaagatgatgttcacacaaagaaaacatttcaatgtcacggacaatcacctgaaaaaatgaataaatattcgagtgtttaaattatttatgaaaatgaatttaccatttcatcggtgtcttcatcaaaaaccgcctcgttcagcacatcttaattaattcaatcattaattctaattaattcttaatcaataattaatctaatttttatttgttaattttaccatcaaagttttcgtcgtatccctttgtaaaataaagcattgctttcgcggcacgcactggcgttttgagcagacctaacaattaaaaatttaaataaaataatttatttatttcaatttttttgaaatgcctctgcttttacgtaccctgcctctgtacgtcttcgcccacatggctgatgatgctctcgtacgccttgaccatgttgtccaattgcgggtgctctccctgccccgccattggcactgccgtcggcgaagggggcaaaagcctcgaaacctatcaaaaaaaaatccgttaattttatgatttaccacttttttaaattgccttatcaattggctttgctgctgttgctaatgtctcctcctcccccttcttcagcttttgctcattttcttctccgctgattgcttccaaaaagccgctgctgctgctgctactgctataacttgtgttgcttgtgctgcttttgctcatttgggacaatttcgaattagaatgagcacaacaatcaatcagcaaaggctaaattgacacgcatttatgtctgttcgatgggcttccgtggtgaatgagggataaaacatttgaaaatgccttggttgaaacatcgggattttctgatttcccaaaattttagggcattttaattacatccccagaggaatgcgctcttataggaaaaaaagaaaagatatttttgtaaaaaaagccttcaaaatttggaatgttcctcagttctgttgcggtagactttcaagtcccccccccctccctcaaaggctttttcccctgcggacgaaaatattagactaaaaaatttgtgcggtgtgccctccggcgcgaacaatgaaaattcccacaggcgtaatgacttctcccccctctctctcctcaagagggtacggcgcgttgggcgatgaaaaagaaagaatattaatggaaatgacccactaaattattccgcccaccgccaaaattcaaaggacaaaaaaaacaatcgactgattttccacattacggcggaggctgatgttctttgaatttccgaccccttaaaaattcctaatgaaaaaatcaaaatttttgcagtcgaaaacaaatgaaattgggaaaaatgctataaaagttaaatgaacccgaaaaatttgaatatttgtcaaatgcacaactcggcaactgcggatggatttgtagtaagatgacacccaaatcttttcctttatagacaaacacataaatacataaaataatatctgaagccccttataaattttttatatgcaaaatttcgaataaaaaaaacaatgggtagaaaaggcaaaaaaccggctttttctcaacattttaaaatttttttaccctaatttttgggtttctttatgaaacaatttgacattctgtttgagaaatgaaaatatgagaaaaaggttcgaatataataattatgttaattaaatatggcaaacatccgttgccgaattgtccgtggccacggaacttttaaatgattccatgggataagtgggggggggaagtgaaaaagtttaggaaagtgaatgtttagtaatttaaatagaaaataaattccacccaatacaaaaattgcctgtgctttatgacgcttttccgttggcccagcaaaattgagccaattttaggcttccaatttgccaacgagctgagagtgagtgagcattgcgagcggaaagccgcgccgcttttagcctttggcccgcgccgtttgttggcccacctccgccccaattatttttgcccatattttgtgctttggaggaaattgaggggttttttcggcatttggttcaggcaactatttgtggataggccaaaatatgaccacaaataaacaatgtaattggaaatgtaatgatatcaggtttgtttacccttttaaaatcttaaaatatcaaatgacggaactgaaaaataaaaattaaaataaaaatctggcggtgtaacaattttgaatatttttttccattaaaattaggggccaggccgttttcctacgaccacaatgttttggctataactttgatctttgtcgaccaaatatgacattgtctttataccttcaaaatttctatatccgcgacaataatatgggaagaataatatgtacaatttgccactagcgatgccataaatttggaccatcaacaaactaaacaatggccatttttatgcccttgggtgtaatgatgacacatcttgacgtacaaaaaatattaaacatctgctgcacattttgcactctagtagccagatcagccctaattccgataatcaaaaattttagggactttccgttaaatatttatttttttaaccctttaaatgtgataaataaaggaattcctattttatattaaatatgaaataaaaaataaaaa

SEQ ID NO: 11011 - DNA, 2800 bp, Heterodera glycines
gcatcgacggaaatctgtgcaaagttcggagggaagtgtcctcgttggactgcgacttttcacctgctcccattcaaggacatttgctcaattacaaaacggaacccgcgctggcaatcgaaaatgtgtgccaactgtcaacaaacactcagcttaggaaataaacgaaatttcaatgttatagtcaattttgttgttattttaattttctttttcataaagtaattactgtatacgcttgttatttatttattttttgaaagaaaataccctattaaatttccatgaagccattcgaccatcgacttttctttgaattcaattttggcgacaaacaaacccgatcatttctagagcctcaaaatctgatcaaattgaccaaattttaaaaccgctttctgtgcatacctatattttagagctgataaacacaattaacagttctgcacttctaattttttactcttttacaaaagagacatttgcattgcagttttcctttttgcgtcaccaaatttttgaattagcgctaaatttttggcgtgttgatttcgagtttaagccaaaaaatataacgaatcgatggaccgaattcctcgaagtttcactggcatttttttactgtccacattagaatcctatccactttttcctaatattatactagttaaattgcaattgcttatttttcctttttcagatagtccgacttaaaaacaaagatgggttttgttaaagtggtgaaaaatcgcgcttatttcaaacgttttcaacccaaatttaaacggcgtcgtcaaggttgggtttttttttcttttttatgctataaatattattttaccatgtcatttcgttaggcaaaacggattactacgcacgtaagcgcttgacagtgcaagacaagaacaagtacaacacgccgaagtatcgtctcattgtgcgcttcacaaacaaggacatcattgcacaggttaactttcttgacaaaattgcagtatatatgtaatagttcaatatcaaaaaagcatcaattgtaaattgtacacgtatttgttttaagattgccttttcgcgcatcgttggcgacatggttgtctgttctgcgtacgggcacgagttgcccaaatatgggataaaggtttcattttttaataatcaatatgcggtaatactggaaaaaataaattaaaattgtttcttttccaaaagtcgttaaaatatatttatgagggttttcggttcgctgatcacgaatctgacattaattttgaccaatttcgaatctctgatccagactcgaacaatagtcgaaattcaaaattctcacacataaaaacaagtttgaattttcgactttttgtcttagttcgggtcctggattcggaattggccaaaactaaggtcatattcgtgatcagcgatagaaaactcgaaaagaaaaattttaaatttatttttcgcaggggcaccaattctccagtattacctaatatgcttcacctaaaaacaaaaccacaggttggactgacaaactatgccgcagcttacgctaccggacttttgttggcacgtcgccacctgaacaaattgaaattggacagcgtttataaaggcaaagaaaatgtggacggagaggactttgacgttgagcaggtttgttaacacagcaaacttttcaacactgctttttattgaaactttgattttcctcaatgtcttttcatttaggaaggggacaatccgaacccgttcacatgtgtgctggacactgggctcgcccgcacaaccaccggcgcaaaactgttcggagtcatgaaaggagttgcggacggtggcattcacgtgcctcataggtgagcaatgggaagaaacgtggaccgactgttgccgaaattttggcttcttttctttaaatccagcctgagttcacttatttgttcccttttccattcaagtgagactcgtttctttggctatgacccggaagagaaaaagtacagcgcagaagcccacagagaccgcatttttgggaaacacgtggctgactacatggcccacctgaaggaagaggacgaggaagcgtacaagcgtcagttctcccagttcatcaagaatggcatcgagtcgggaacggtcagttttatttgggacagagggaataatattatcatacacagacagccattaaatggtgggtcatttatgaacacccaaaattgaatgatcggtgttaaatgattatttgatgctctttttagttggaagaaatgtataagaaagcgcacgaggccatccgcgcggatccgtccttcacgaaaaaggaaccaaagaagccaaaggagcaaaaacattggaacaaaaagaagtacacactgaccgagcgcaaacaccgtgtggccaaccgaaaggtgcagctttcagtatttttatttttgtctaattttcatcttttaggcgtatctgttgcatctgaaaaaccagcaggaggcagcgttggaaggctgaaaaaagcgattgacctatttgagagtgattgctctttctcaatttttatttgttgttttgtggtgagagagaaaaatttgttgtttgcttttttggcaattttttccaattcaaatgccttgatctggcgctaaattttgttggtttatttgacctcgtttatttggcaattgtgaagattattggtcccacaaaaaaaagaataaaaattaaaaaaaaccatttttaggggttatttgatgcgctgagcacgaatatgacatccatttcggccaatttcgaaccggaacccgaa

SEQ ID NO: 11012 - DNA, 1794 bp, Heterodera glycines
tgaaacaatcggcggacggtcccggcgggaaacggttgttcgttgtgattgaggactgcagtctcgaagtggccaaagtgtgtaatttttgttgcccgggggggggggtgttatagctgtttttgtctaaaaaataattcttttaatagtaatttgtgggtaaaatccatgcatatgataaaatgtgtgtccggcggcgttcttttttgtgctcccctcaaaaaatatggtttttctcgttggatgttgtaaaagtaggtaatcttttttttacaaaaaaaaggtaaattttttatttggaaaaattggtaattttttttcttttttttgaaattttttttttattatttttttggaattaaaaaaaaattaataaaaaaaattagaaaaaaaattaaaaaaaataataatagaaaaatttattttttatgtcggcaatagtgaagattattggtcccacaaataaaaatttaaaaaaacatttttaggggttatttgatgcgctgagcacgaatatgacatccatttcgaccaatttcgaaccaggaccggaatacgaacaaaaagtcgaatactcaatttttcaatttcgcacttattctacaattgattaaaactagcagaaataaatcacaggtaattttaacagcaaaataagtcattttatgtagattcgaacatacataaagtaaaaataaaaattttcaattttgttcgaattcttgtctggggttcgaaatggatatcttattcgtgatcagcgaccttgaaaacctcaggaaagacttttatttagatgacttttaaaaaataatttatttttaagtaaaaaataaattaaaaaaattgttcgaatcaggatttggggttcgaaaaaagtcaaaaaaacgatcatattcgtgctcagcgcatcaagtaacccctaaaaatggtttttttttattttctttttttgtgggaccaataatcttcacaattgccgtttatttctcttttccttttttgttcggtcatgagcagcacgaccagtcgggagtattattttgtgattgttggtcgtcaggaccaacctctgttcgagatggacttcccgccaaagaagcgcgagcagcagcaggagacgcaccatttgctgcagttcatcgcgcacgccgcgctggacattgtggacgagcagacacttcgcgagacgcaaatgtattttaaggtggattattcagaaaaatactctgattgtgagtcccaaaaacgtcgaaaaatcgtttgagcgaattatagttgaaaataccgataagactgatttatcaaaaatttttggttttaatatcgaaatttcttacgcctaagagcccatttccagcattgttcactttctatccattccccaacctctatatttgattgtttttttcatttttattgtcatgatgccattttcagattgtagacaagttcaacgaatggtttgtgtcggcatttgttactgccagtagaattcgctttttgatgttgcacacgcaaaaaaatgaagacggaatcaaacaattcttccaggaaatgttcgtttgttgtcattgaatttagcgaaaattcaaatatcattcagttatgagatgtacatcaaattctcgatgaaccctttctatcgacaagacactccgatcagatcgccaagttttgagcaaaaagcggcgatgtatggacggaagtttttaggggtttaaaaaagaccttggaaatttaagtttttgttgccatcagatttgtgtattttttgcattacattattttata

SEQ ID NO: 11013 - DNA, 1009 bp, Heterodera glycines
  misc_feature (932)..(932): n is a, c, g, or t
  misc_feature (984)..(984): n is a, c, g, or t
cacagtccgagtcgtattcccacagtctttgtcatttttattttgatgttttttcatcaaaatgtaatggcaaagcattacatctcggaatgctcaacctttccgcaatttgcggcaaagcatcctttaatagagatgcgagtgcactctatgaatcaccaaattcatcgggaagagatgaacaagctcctccctcaagaatgggaaggaggaaaccagtcagtatttaaggcactgactggagggaaggaggatcaattgaaattaattgaaatgtcctcctcctcctcttccccttttgctccatcaatggaagatggagagatttctgagtctccctcagaaaacgaaatccccctttgccaaagaggggtaaaaaatgccgacaccgagctggaagatgccaccaaaccggtgggtaagaggatcaaaaggcgtggaaaggatttggaagccctagggctaatcgacgctgaggctagggaggttccggaaaggaagcctccccattgctcagtctgtggcttaagtggtcacagaaaggggacaaaaatttgtcccttttactccagcggaggtcagaataaactccgaccttccactcctattcaggaattggaagaggagagaattggccgttcgaccaatcgacgagcgttggccgctcgaaagccttcgccaaaagtggctaaaagagccaccaaagagagcagtttgtattccgggctgccacatccggatacctctggcttagtccgtctttcaaaggatggtcaagcgggcaccagcggcttccgggagaacccggtggttcctctgagagaggaaatccgcggactccagtcagccattggcgcactgactgaggaagtctgtgccctccgtcgggcaatcccccctgtgctgacagggggaaacgcgactccacttgngagacgccgagggcgccaacagcgttcttcttcgtcggaagagaaccgaaanaacacgccgacacttctaccgctga

SEQ ID NO: 11014 - DNA, 1154 bp, Heterodera glycines
aaaatgccaaaatatgtgccaaacccctctccctgtgcgatatgtttttatgtgcgaaaacgccaaaatatgtgtttttatgtttttataagtcgctctaaatcaaaaattgttcggagaaaatgctatttttgggcttctctcgccataactaagccgcaaaaaaaatatgttaaaacataaaaatcccagccctatttataatacctattttacctatttgggggtttttctacctattacctaggtacctatttcggcatttttgttacctattttatggattttcaaaaaattcttaacaaaaatgcaataaaatcaaaaaatatactcataaaaatcgaccaaaaaatttttcaaaaaattcaccctaagaattggaaaaatttctcaacaatttattccaaaatttatttatttttttctattgacaaaatttttaatttaaaatgtcaatattatctaagaaaatattaatatatttaaattttcgattacaaagagatatgtagaaccaaaattttccctctttgtttgcttttttccattaaataataaaaatttttatttacctattttgattttggaatttttatacctatttgatgcctattttgatatatttttaaacctttttaagtacctattctgcgatttttcttacctaaaattagcagccctaataataatatataaatattttctttaaattttattgtttttaataaaaaaatcaataaaaatcaattttgatagattaataaaaagttaatcctaattttatctttttcatttactcaaatcacttgttgatcccaaagatgcaattattttttcatattttcctggtcggttttgtgggttttacggttgtcaaattggccatggagataccgtaacgcaccaacagctgctgacctgaccagatacagtacaccatcaacaaaccaagagaatttaaataatggaatcaatatataaattcatttaaatgaaatattttgattttgactaattgatgggccaattggtgttcatttttatcaacaatatgaggagaaaaaaaatacactggcatgagccgttatagctcagtcggttagagcgtgggtctaataagcccaaggtcgcaggttcgacccctgctaacggca

SEQ ID NO: 11015 - DNA, 2632 bp, Heterodera glycines
ttacaaaatttcgtttttttaatttggcctaatgatcctttttggcgctttaattcaattcaataaatgttaggcgcgcgaatgtttttgcatttttgttgtcttagcatgtcaaactgccaaaatgaacaaggttaatcataatcacagcagcagcagcagcaaattcccccacccccttcctatattaaaaataattccataaaggcagcggcataacaattactcaaattcagaaaatgtcggaccacccagaaaaagtgacaaaaccgatgtatgtggtgccgttttcttgtaatacaaatcaaattgttactgacacagaccttatacgcttttgtgccaaaattggttacggcatttgccattttccttatgggtagaattgttgctttatctacccgttttcctattttaaacaaacacctgcaaaaggaggagagtgtatttatcataaacccaaaggcttttagcttcatttgcggcgacatctggctttcgctgttccatttgctgccacctgacaaagttgggcttgaaattgcgctgctcagctgccgttttgacgctttggttgatgagcacttcaaaacgcggcattggacattgggattattgaaattcgaaacaagtttcggcgttgctatcgagctaccggtaaagtggaaatggaaattttaaatgccgaaggcaatgtgatcccaattccggacagaccgttgcccaacaaagtcgtcgggttcggcataatttgcacagagtaagtaattgcgcatatattcatatccggattcctaacccaaaaattttggaaatcggcacttcgacaaaatcactaatagctgtcatgattagttgagtttcctgctttttcttttatacgagcaaaatgcatctctattttttgggtgtttgctttttgcagttacattgatcaaaatgtgatagcatttttgtgccgatttcgacatctgttggcctcttatgcaaccaaagtgaaaatttgcgcaagaaatgattgtgcttcggagtacattgtgaacaacttttgccaactgctcagtggtaacatttatgcataatcattacaatttttgataaatttttgccgtcaattcgcacaaaaattatctgacccacgaatgccaaaagaaacaaaatgcggccccttaaaaagctcctaaagacgcaacccgcaatttcggaccctctgggaaacccatcaaaaaatgaagattttgggaaaatgatccgtaggatcgcgattagagatccaaatgaaatcccgtctcgtgattactaggctcaatttgtacggattttctttaaaaaatgataaaatatgtgtcaataaaaaatataaataatcatcttttgtcgataggaaacccataagtatacaaaaagaaaatccaaaatattttaatttctttagaggaacgaaccataaaaagaagtagaaaataaaggggatttgccactcggccatgtgcacattggcagagtcatttttaaagaatatattaattttattttttacttttttcattttaattcaattttcatcactaatttttcactcagacccccattcttaccagtgcttgtttttcccggttgccatactgggaccgggacctgagattttcaaaatccgggacctaggaggaccgggaattcccggcccggtcccgctctactctacttttttctgctaaatttttgtctaaaaaaactagttaattttttttttacttattttggttcacatttcggaatttctgtatatatttattatgtctatgtttcacaattgtttttacacatttttttacattttttcttacttattatttgcattcctagtcatttgtcaacgcttcctctcgcgccagcttcatcattgtcattgcatatgctttggcaaacccaattgaaccgttttgcttgaccaacgaattgaccggcgaacaattgacgctggaacggtgtgaaataaatagtgttaagccccgacgctcggggagtgaaaaggcggggattggggtggaacccagagaaaatttgttgtaaaaattcatttaaagatattctcgtctaatttggagtgtaacatgcgagatattcccgcaccgggtcgcgtgggcttaattagagatcggatacgggccggacccgtatacggatcagtagtccgtaatccgtgttttttttggccgatacgtattttttacggactacggatatcaagtccgtaatccgtatcgatttatcaagtccgtaatcctgatccatattttcgaaaaatttcgatccccagcgtaaccctaaaaactttgcaaatccgacatcttcaccactttttttgacactcataagcatcatataacagaaaaattttaattacatatggtaatttaataatatttgatatatttatttgtttataagaaatgtttaaacgaatttttggcttaaaagtgcgcaaggatgttggtgttttataaaatgtccctcggcattgttttgaaggcgttgctatcacgcatggcctgtgtggctgatccgccgttgtccgattgcgcgtgatcagcacaaatgggccaaatgggaaaaggaggcgattaaatgg

SEQ ID NO: 11016 - DNA, 3358 bp, Heterodera glycines
  misc_feature (1931)..(1931): n is a, c, g, or t
tgaaccaaaatcggcgcgcgtcgaagtgccatcgccgccctcgtcgtctgacagtgacaagcgcaagaccaatgaaccgtcgaaggcttcaggcggtccgccaccaaaacaacggcacgaatcgcattgccaaatcattggagtgcttcccggcttaccgaactactccgattcgaggcattttaatttttttttttcgattatcatttccatacatattcattgtttagtttaacacaaaattttaagtgacgaggccgagagtagcagcaacagcgagagtttggagtcgggattgccatgtgtggcaatttacgcgggtaaaggcgcaccaaagccgcacggagagtgttgaaatggatacgaacgaacgtgatgaggacatgctttttatgacgtatttttgcgaaatcccgctcatatttgtctaatttgttaataaaagctttaaagagatttccatgttattgacttttggatgaattactccttcaaaaaaaatatgaaacggttgtcttttttgcaaatttaaattattattttttaaaagtcaaattatttttttcaaaaaatcgtttcaaaattccaattttccccgtcggagctgacaaaacctttaatttttcttttaaaaatggcaattcacaaaatagctcattttttactaaatattttaccaaattgcactcaaattttgcgcgatccgcgaccgcggcaaattgaatccgcgaaatttgttatggattcctgatcagcgtccccgaaaaccattatttgcagtttttttaatgttgagacgtaaaaaaaatttttgggggttaaattccataggagcccttttttcatatgcgttaaatagcttagccgatttggttcttatcccttttgtcacccccccccccctgaaatttttttaaataattttttctagggtaattttatgcgctgaacacatatatgatgtttatttttagctcttatgctctttacgtgtgttacgtgaaattttttgactagtcaacaacagtattaacataaaagtaaatttttaaaaatttgaatttcgactttttgttcgagttcgggtccgggcttccgaatcggccaaaactaatgttagattcgtattcagcgcataaaattagtttagaaaaaattattttaaaaaaaatttcagggggggggtgacaaaggggataagaaccgccgatttttcgaataatattaaattgttcggtttaattgggaatgaagcgagttatggctgatcaaaaaccattacaaaaaatggtagtgatcatgatcagtttgtattttgaattagcgcgcaaaataaatacagaacttaagcgattaatcgcattgcaaaaattttttacaggtacgggtggttttgatcagtttaaactttaaagtttatactcaatgtatatacaattcaaatgatcgggggtattgacaattacaatatggggcattatgacagtttatggacacgctgacaacgcacacattcgcaaaagatcatattctatcctgacgatccctccgtcatcggccggcccggcgacgtcagatccggtttaaaatcaaaaacgagaaatcagcaaaaatcagcatgaaaaaagtggacttagaagcctaaaccaagttagaaatgcgtttttcatgcttattatcacgcccatgttagcaaaaaaaacagcatatgctgcaaaatgagcactttagttatgaaataattacttaaaggcgatcgaatattttaacaaaactagcatttcgcaccaacaatataaattttataacaatgcttcatgtcggccatgcgcaccgtcttggtgacgttggacgagaaaaaaacttaactcgagatgaaggaaatttttaataaaattcgacgaaatattttttgtttgagtttgagttgngattaaaaatggatgtcggaatcagattctccgaccatgaaaattccaaaagatacatatctgttttaatttttttttaatgtgttgcatgacagtacacatcgagccaattttgggccatcaattttaaaaagctttttgccaaccaaatggacaatcttggtatgattcaaaagctcttgaacaaaaacgttttatataacacaccgtccgaaaaaacgagatgtgtaccaataaatagagagtgccagagaaaaacattatcttttttttctaattttttgtctccttttggcgtactatctaatatttttaacatttacttcgctatgtttagcttcttttctatatgttagatccacaggaaattttgctgcatcgattaatgctgaattgatttttgttgatgctctatttcaaaagttataagaaaaacaaaattttaaagcctcataacttttctctggtacaccaaatcgcttagcattgcttagaaaaagcttctcattatcaagagctttcgaaagataccaagattatccaatttggttggcaaatacctccaaaaataattcccaaaattcgtaattttttaatattttggacaaaaataaatgaaaatattcatgttgcacaacggactcgaaccaccaccctttgtcccttactatcttacaaaaaccactgacaaaggaaggtccccaggtgtccgtgggatttccgaatgaaatttcgtgggtggatagagcataaaaaggcaaaaataaaattaaaaaatgagtttgcatgtcagggatccgaacctgtgggcttaaaaaacgaggactagctcactaccgctgcgccattagagacctgatgagggcgcaaataaattttaatttatttattcactaaaaaacttcagcacgtcataactcggcactcgggttcattccgcaaaaaataaaatcacttttcttaagaacctgtgggtgctctatccacccaccaaatttcattcggaaatcccacggacacctggggaccttctttgtgggaccacacatgcaaatcttttctggtacaggagctcatttcccggacgctgtgtatattcgctgttgttgccgaagaattcgatattttccgtaattgttaaaaaagcgggaatgaaacaatatgagaaattttttcaatattgtgttttaattgtaattttgaaaaaacattggtaaactggtaacccttctaagaaagcgaacaatcagagtgaaacgaatttttagcacattaaacacaaacaattaaacataagcgataataattttaaaaaacgaaatgaaaacgaaaaaaatatcaaaaagtcattaattaataattaattgtcgtcaaaatcgttttgagtgttcgtctccatccttctgcttggctcagtcctccaagtc

SEQ ID NO: 11017 - DNA, 636 bp, Heterodera glycines
tcgttttgagtgttcgtctccatccttctgcttgtcagtccaagaagtccgtctcgcggatgggccggcagcgctcgtgttggaaaatggcgtgcgcctcgcgcagcagaaaggcaccgaactcggcgatttgtttgcgcgaccagcgcgaggcgagcccagggaacgagccacgcaccacgttggtcagattgtcaacacctttttgagggggcatcattaatatagcaatttgagttttattcatttttaaaagccatgcaatgccaaggatttggggtactaatgtggtttgggtcccggtttttggtcaattttttttcaaatttttttttctcttttattgtcagaaatgctttaaatgacaaataaaaggtgctttatgtgtttattgggtacaattcagcgatttgagaccacaaattataaaaaatatccggtcctccaaattgcttacgccacaaaaaatcagaaatgtatgtggaaaaaagtgatctgtgactgccaaatctcactttatggtgaattttttaagcttttccattaatctaaaagcaattctgacaataaaagagaaaaaaaaaatttgaaaaaaaattgaccaaaaaccgggacccaaaccacattagtacccca

SEQ ID NO: 11018 - DNA, 1856 bp, Heterodera glycines
  misc_feature (1779)..(1779): n is a, c, g, or t
  misc_feature (1822)..(1822): n is a, c, g, or t
aaggcttgaaaattaaatttgaatgcaattaagtaaataccaaagtggaaatcgccggaccaaaccaacccaatggaattggcacaattcgactcgccttctccttacccctcattctctgcttacttgatcgccgacgtacagaaatcccccggtcgcaatggtcaaattcgccagacgatggccgtagaagggaaaagcttcagacggatgccctgccgagaaagggttaaaatcctaagtttttaaaagattgttcgttagcccaagagcacaaatgattattatgttcatgatgacaaattactgacgatgataaaggataaatatggaatgtctttaaaatttatttgctcaaaaaaattgaatttgcgtggtttcaattgagattgattgatacatgggagaaaaggagagggaaagacgacggaataaatttggtaatgaaataagtgaaacaaaatgaaagagaaatggcggcggtatggttcaaagaatgggccattcatcagttcgagaaacgcggggaggaaagggtggtgcacttggtccgaatgggcgttcgcacagtgcatttgaaagccccctccaacgtggttcacaccattttccttaaaaaacattgtattttcaaaatgaaaattactagacacttacactttgaagttacacccctcgttaacgttgatacagttagaataacgcgcaaattttctccgtcttagcggcacacacccaatgtcagccaaaaagttgtttgcggtgtgtagatcaggcaatacattgtgggcatttgcccagttatataaatttgccatctatagggatgggaattttatgcaaatagatgaaaattgtgaaaagttaagaaaaaaaaataaatgactctgttccagtttacgggaccacatcagtttattaagccataacttttttcttactttatcaattctcaacattcttggtatcaatcgaaagtttaaatttagggaatttatacgctgacccacaaaatgtccaagccacgaattgtccaagccacgaaatgtccaagccacgaattgtccaaaagagtaaaaacccacgaagtgtccaaaactcgaaaaagctattaaaaaggcggaaaatgggtctaaattaaggttttcggggacgctgaatacgaatacgacatttatataacccatttcctaaccctggacccaaatataaacataaaattgcaaaaaaaaattcaaagctcctaaaaagagtgctgatcaaaattcgaacaagttttagggttcctatgccatccgaattctctctatagacacaccctcagcttcacatattaaaaaaaataattttattaaacattcaataaaattctttacggaacgtggacaattgaatcatcaaaattctcgaaatccttcaattttcctgcatatccctcaatttgtaaaccgagcgccgtcataagatcatggatgtcaccgttgttgttgtacgacgcgtccgccaaaattcgcataatgacagcatcctggaggatgtatcgtttgtgtcgcttgtgaatgaaatggcgagcagatcgggcagcgtccacctgtctgtcgatgctttcattgactccacagatgaagtcagagagtgccgggtggtgacagagacctttctaaatatattttaaaaaatttgcccgtagtaaattaaaaaccataaaatgcagatgagttgcttccagtccattgtttgtacgagcgagggcagatgcggcctgcgagtgcatgttcncaattgcaattgggaaatggggcgcccgacagatttcttcctnccacacgggaactgaatttttttttattaaatat

SEQ ID NO: 11019 - DNA, 2089 bp, Heterodera glycines
ttgttggtgctgttgaactgctagcaaattctgcgattccctggctgatatttgctgcctttgcgttatttttgtgcttttccgttatgtgtcgaataattgcgttttttcctgcggctccgagtgagatgtctacattgcatgaaatacaatgaaattcttcagcatttttggcacgttgaaattatagttgggactagagatcggcctgtatctggatccaggcctgtatttttcctggatccaggtacaggtacaggccattgttcggcaacctgtatttttcctggatccaggtacaggtacaggccattgttcggcaacctgtatttttcctgtacctgtatcttcctgtacttttgcacagaaaatacaggtacaggccatttttggaatacaggtacaggtacaggccttaaaaacctgtattttctgtattaatttttaatcactattttttggcgaaatgtgtgaaaaaattaggaaaaattcaaaaaaaaatatcattttattcgctgaccaacgaaatgtccaagccacgaaatgtccaagccacgaaatgtccaagcctcgaaatgtccataagagtaaaaaacacgaattgtccaaaaacccgtaaaacggatctaatttagggtttttggagtcgctgagtacgaatatgacatttacctaacccatttcctaacccaggacccaaatataaatataaaaaatgaatgaatttattaaacattcaataactgacgctgtgtcaagcctatgtatgttcgagagaagtaaaggaaaaactcatgcattcctgcaggagctgacgccacaataattgagaaaaccattctgacaatgctgggaggcaaaagaggcaaaaaaagaacacttctgaaaaggaatttgaatttcaccaaaatttttttaaccggaatgtgttgcgaacttcctccccacgttctgtcttctcaccgtacaaatggacaagaccaagtcgtttgaagttcctgtaaaggctttgcccgtagtggaacatgcagcacttaatctgtgccgtgggaaatgccgtacgcaccgccgcaatttcggccttttcaaaatcacacaaaactaaaaatcacatttttgatttgttttttttttgtaaatttcaaagggttaacctttgcttgggacctccggagagatgcgttcacggagaaagttcagtgcttcttcgtagtagcgtcgctgtttcccaggcagaagacaccacatacagatgcacattttctgattcactgacgcaccaatgacgaagcactgctcccacatcgctggagcgcatttgaaagttccgtcgaggtgccacgtgccacattggcgcaaaatgtccagagtctaaagaaatgccaataacaaacagaattttatagccaaaaaatgtaccttaacactgccgaaaataaggacaacgtccttttcgccttgcctgacatttcgactgtcatacaagacgatgtcctcaccgcccttttcgcgtaacgttgctgggatgacaaaggccagtgggttctgcacgtcgacgtttcccagcaactttctcttctcacgccgcatcatttgggtcaacgcattgtttgaactcatggccacaaatgcttcatctgttgctgatcgcctcacttttgccaaaagtcgcgtgggcttcagacacggctcggccaggacactttctttgattttctgtcgccttgattccgcctttaacacagcattaattatttggttttaaatttaaacaaacttgtcgtttctgaggcgctgggaggtggttgtgttctttttgacccaaggttccagtagctccaatttcgtcattgtttgtgatgtttgcatatgctgagcaactacgaattgtgcatctccaacggtcccctgagtggtgtgtgtaacgaaatcctgaacatttggagtctatttttttgcgtcgcttcaaacgtaccattcaaccataggcaatgtcccccaaaatttgtttttccgcgctcaaaggtcattactgaaacttcagcctcgttcaaagtctgttgttcaacgttgtcgaaagttatcacgg

SEQ ID NO: 11020 - DNA, 816 bp, Heterodera glycines
gaaaatcatttgaacagtctaataaaaaaacaaataaataaataaataaaatgaaaaaaagtattcaaaaacggaccaattcggtcagataattgtcgcacaaatcgagcacacgaagccgttccaagcggacaatggtggggggcagcagacggagctcacactgggcaacatcgagaaactgcaaaaaaaaaagattggaatttccggggaaattttttgaaaattttgttgcaaaaatttcgagtttttccctttaagagggagaagatgggtgaaagaacattgacaagaattttttgataatgtttagggttaataagtgccaatatgtgccacgccgagggaatattcccttaaattcgggatattgcccaacaattttatgcaaaaaaatgtaaaattaagcaatttttaatgcgggaaaagttttttttttcaattttaaccgttaaaagaattgtatgaaattcaaaaatttgcccgtttttcgggtttcattggcgctgacagttaattaattagtgagtgagtaattaatggaattcatataaaaaaaaactgtgcctgtaaattgacgagaaccgtcaatgccctggggcagttgggtgatggaattgttgaacaagttcagactggacagctgagtcaagttgacaaatgatttggggaaactgaaaatggcaatttaagcaccgccaaattgtttttggccgccttcagcacttccaatcgcttcaattggcccgcaaaaatggggccatgaatttttggacttttccaaattaataatttaaaatttgattaaattttatt

SEQ ID NO: 11021 - DNA, 3949 bp, Heterodera glycines
atttctgatgaaaattctttagcacaatgccattcgcccttttcagcggcatgacttgcacagcgatcatttacaccgccattaatttcgcattttttgtcgttctcagcgtttgtgatattcaaaattccaccgccgttgcgatggtaattaaaagccaactaatatacatttgaaattactattaatgtgcataaatgaatgtaaaagaaaaatcaaaatacaaataaattttcagacattcgccgaccaaacgatgggatattttaccaaacttatgccatttatcatctctttggttttgttaaatgctctgaatgcatcagtgtttatgggaagtaggcacgtaaattgaatgctttatttcttaaaataaatattattaatttttttagatatttatacgctgtggcgcgtgaacggcaactcccctcgtttatcgcgtgtgtccaccgaacgcacgacagtccccgggcggcactgatagtccatgtaaaaggaaaagcatttgcaaatttaacattaagcaattggctaaaacatttacggcattcagacagtgttcattatgatcggattgtttcttggcaatgtcaatgaactgatcagctacgtcagcttcgcggtttggcttcagcgcggctgtgccatgtgcgcacttttgtacatccgattcaaacatttgccggtccactcggagtttagttttaaaaataatttaaaaaatcaaatggttaaaatgatatttcaaccaactgctcccatattttggacaaatgtttcggcattttcaaaaaacttaattttcgaataaaaatatctttaaacacaaatttaacatgaaaataataaccgaatttaggccattcgtatgccaattgttctgccatttctgtttttggcaatttgcttttccctttcaattatcacaattatcaaagacttttccaccgcttacattggccttacattaattggcagtgcactgataatctatggcatatttatatgggaaaaggcgttgaatcgaatctcagcttatcgggaacaaagcagcaattggaatggtcagtggaaatgagtaaaatcccaatgcccgagggttaccgaaaacatcaccacctcccaaaaaagacaatttgatatttgttgggtttaagaccatttccaaggacctccatcctttacatccaatgaccgattccttcagtcctaggctaaaaaagtgcaaatattcttaaatttagaattttgtgttcggatagtgcaaattataacggacggtcaacttgaaattattccagaaaaaatggattatgtcgaataatattaaaaatgaattcccaatttacaaaacattactaataaatttattgtttcatatataaatttatttcgactatcattttgtgcattttacttatcgttcgttccctaatgaataaacaaatgacgacaaaataataaaaaatctgtgtgaaaaactcagcaataaataaataaattattaattagattttttggtttaataataattgggttatatttcttcatgcaatttagcgaacatcgtttcattgaactcgttttgttaagagtaatggtcaaagtaaatgtacaattaaaaaacggagaaggattcgcattttggttgaaattgcgaatgattgatcaccagaaatggtgctttaattttggctataaatattcgttttgcattttcaaaattcaatttttattttctaaaagatttcttttattttacataattttgtttcttctttcagataaaaatgcgcttcttctttcttctgaccattgctcttctctccgttgttcttctcctttccccaagtgcactcgcaaagaaaagagcccgccgttcgatggtaaaatgaaaagcactaattttgcttaattactaatgacaaatgctaatgattcagcccgttaacgctgccatgccggaatggaaaattttgtccgctgaagtggaaaacgatggcacagcataagaaggaggaggcaaactttggatcatcggcatgatcgaagaaggaatttgccaaaatgatgaagaataaaccaatgaatgttgtggatttgtagaaattcattcaaatgccgggaataaaaatagttaaattatttatatttatattaaggtaaatgccaaacaaatgctaattgagccgaatcaaaaatataaacatacttttttgagtcgaaaatagaatttttattttacgaaacaccctaaaatgtgacctaaaaatgggaaaggaaataaaagaaagtctgaatttagaatgggattgtgtaaatgtattaaattctcttaaaaaaggtgttgacaattatgaacattcaaatcattcagaaaatggcttaagaatagcacggaaaacttactttttcatggattaatcgaaaatgttttgaaatcattttaattagactgccccaaaaaagtcataaatagggaagagattttctgtgttgaaaaatggataattaaaaatttattataaattattcagaaattagcatatgtccactgttcaaaaaatccattgcggttcctgctgcaggattgttcgggattgggacacagaaattttgcgggacggaacccagagggattaatcccgcaccagcaattttcaaaaaaagcaggattgcggcctggcgtctcgcaaaatcccgcgggaacccgcatcttgcaattttcaaaaatgcaggattgtggactaaaaatccgcaaaatcccgcgagaatcccgtaccaagcaattttcaaaaaatgagggcttacttactgggattcccgcaaaatcccttggcacccccttctcgcattaacctctcgtcttcatcactaatctcatcactatccttctcttttaaattctaatgaaataaaaaatcgcttccattcttgaaattttgcacaaattatttcataaacttttttgttaattttgctggccgaaatagcggaacaaataaataacatctgacgaaaaatgaccttacctttaaattgtcattagaaaaaaatgattaattgtatgtaattacacgtcactgccgatggatggttctcttttcggtcggtcattatttgatctcctcattttcgaaacattattaaatattatttattcatttctccacgcctttaatcgcaataacaaaattcataaaataatattttttctttaaaaaaatcaaaaaaataaaataatatggaggaatatgaagcttcatcagtgagacaacgggccaaaattgaagaaagggatggcaaaagggcaaaagcgaatgcacaaaaggcaccaaaaaatggcgaaaaaagtctccaaatcggatggattgtttgctttgtgctcttcacttttgcaattggaatcgtaagccaatcaaatcatttcgcatgattacatggcttgcttatccataggattggtttacgagttttgaattacttttgcaatttttatgcaaatttttaatggaaaaaccaacggttaaccagcttttaatcattaattaccaacctaaaatttaatcataatttcgtgcagttaatgtatcaaagtcgtgaaacaccgacaaattatcaaaaggaggtgaaccgagaatgtgacgaagggacagggcaatgtattgcaatagcagattatacacgggattctgggtataataatgaagccgatttaaaaaatgttaatatttttagtaagacatggcatcgaggcattttttatgtcaatgaaacgacattcgattttgagaaaatgctcgagaaaaaaatcggagcagaagcaattctcaaatgtcctgcaaatggtaaaagtaaagctttaactcgctgataaacattttttgtcaaatttctacacgggaggtacaaaattaaacataaaaattaaaatgaaacaatcaat

SEQ ID NO: 11022 - DNA, 1822 bp, Heterodera glycines
ttacctgtttcttccctccacatattttccttccactcacttattttatcattaaccatttcccagcacggaccggctccgtatgcattccgtcgcaaaggaaaattcggcgttgccaaaccggtcaatttcgggcctcctccggccccgattcctcgagtttctgaggtgctgctccaattggtgaccgagttcaccaacttcaccaccgaatacacgcgcaacttcaacgcttttgcgaccagtttttcgtgtgataaagaagaggaggaggaagaggaaaccgaggccaacgatgcctaaggaggaaacccctggctggggggaacttctgtcatggacagaaattttgttgaatccatatgtaatcttgatcgtataaatttcgcttttccttaaaggatttggattgggaattttgccctagtcggacctttttaaaatatggggatcatcttcccacctaatccctgcgtttttcccattttttaaatatcttcgtggtcagtacgtagcgtaagccggtccttggtcatcaacaatttgccgaacgcccaactcaacggcccgcccatggatcagcttgtccgacggatggccgtataaaagaaagacgaatgaacgatgctcaccttcttccactaccattttccaaagtccaatttctttccccaaaatttccttctgctatccaattttcaaagatcgtattcaagtgatcattttcatttcacatttaattttcttggtgtgtaataaaggttttgcgttgtaaaaccttcttgcgttcaaagcaattgtgtgccatcccggccactcgaactccctgacattctcagggacggtcttaagccgatccggcaaattataataaaataaaaccaaaacaaaaaaaatatttttccaatcacttcattttcacataaaattttcatttcccaaaacgaatcaaaagttttggattcagccgcctcggttgacgtctgttctttaaaccgggtcagacgaagtcgaaacaaccgcagtcagcggccacatgcttgctgttagggtaccaaccatgggtgacccttttgatttacaaaattttgtatcttaaaaagggacggccaacttgttttttcgtgttatatgtatatgaactgtctgacttcacgctgtctgcctcctacataattatatagacaaaaaacgagtggccgaaaacgagttgggtttttattagagagcgacattacggaatacgggtccgtaaaaacccgtatacgtgtcagacccgtagtcgctctctaattttttcggatgatcacttttgataaatctctatctgaactcgaacagaatatcgaaaattttaattgttggattgcgcttttttgctcaaatttagggactcaaaatttgattaatagattgcaaaccaaatgggtcccccatagtttttcggggtgacccaacaataagcatcatgtgtcaaaacagcaaaagtgccaatttcatgattttagattatagtagttgcgtaaagattgattcactccatccgacactaagaaatattcatttttcattcccgggatggttagcattgaaattcgggtaatacctactattgatggtaaccccccccccccaacctttcttaaaaaaattacaaaactttttcgaaaaagaggggtcggataatattgtcttaccgcaattcgtaaacttacggttacctaaaaatatgaaatttgttgtcgaaaaagcattacgaactgctgagctcaagaggtcgtggtataaattggctttctgccatcaatcattcgtcttgacc

SEQ ID NO: 11023 - DNA, 925 bp, Heterodera glycines
tgcaaatgtctttcaatgttttttgacgaccttaaaatttattctacctgatcacaatcgcgtaatagcgaatgttgtccattgacgttgagtcaattccgatcgaaaagcgccctgtttctttgatctcatccaaaagaatgtttaaaaaatgtgggctgagcactccttaaaaattggtttttctcggaaccagaatttgtactcaccccgaattaatgccgttgttttcatacgttttgatgcaaatccaattgctgctggatcggcagaaaaaaccacaccaaaaagatcagatgaacaactgatgtgcggcaaaattggttgggatgagcaggcgtggactactcggatcgagtaggccgaggaaaacgttgaccagaaaatttttttggagaccaaaactatttacccctgagtggtgatgtcagtgccccaaagaacaagacggaagggggcgtgtgaaaaaaactcaatattaaaatacggatgatgacaatgacaaatcaaaatttattttattctaaattgtaagattttaattcgttttcttcagaaacatcttatttaaaataaaaggatttcctattacctgaaaatggtcattttttgtataccatataactctacttccaatcattttgttcatgtaagtttctctaatccataaaatgaatacaattaattacattattccgtttctggaacaaaatgaatccttttccactaatttatcttggtttcttattcataatatttcaaagtgtacttatatttctaccgttgtcctttatacaggattcgtgctacaaaaaaaatgaacgaaaaaccagaaaattgctacaactttaggcaaagactgtaaaaatatcaccaattataaacagaaaaacccagatcttgaggaaaacaagaattttttatg

SEQ ID NO: 11024 - DNA, 3797 bp, Heterodera glycines
aagattatatttcacaaaataatttttttttttttagaatttttttttgcgtcaaaataatgtttttaaaatttctgattttggtcttctgttttcaattggcaatggctaacctatttggtcaaaaacaatctgtagctgttgttggaatgctcaaatgtaaagggaagccaagtgctggtacaaaggttaagctctacgacaatgaccgtaagttttcagttatttacaaaaataataatacagtagtttcatcaaaaatgtttccaaaataaggacatcatttgttaaaaattatttttgtggacaataataaggtctacataattatacgctctatgtacatttgtcatcaatttttaataccctttaaattcaaggaaaatttcaatgatttgttagtctaaaaataataaaatcatagaaatatttaaaaaatcaaaggtgatatgataaatatctcaggaattaatatttttttgaatttataatattttgagtcttacaattaggacaacccttagtttttcgggatcaaaattaggatatattaagtgccgaatgtcgtcataattaaactttctacgcatatatttaactacaaattttcaatgccatttaaattcagagccaaatttaatgggtcggggtcactttggcatgggccataacttgtttgtgtatcagtcagattttgtttagaatttttgcatgcgaatagggactatcaagcgcttaaaacccatatccattttatttaatttggatgacaaatataaatgctttaacaaaatcgtagaaatagcgaaaaaatcaagaaaataggggcgaaatattgacaaatctaagaatttggtatttttgttattttttttttattaccgaaacatgcaaataggggggattaagcatcgaaatttggacaaatgctacctttgttttttttaaatattcgttaatttttcagattttacgactgatgatttgatggcacaatccaaaaccgacaattatgggcgtttcaaattgagtgggacggcaaaagaaattacgaaaattgacccaaaattgaatctgtaccatgtgagaaattaaaaatacatttaattcattactttattaattttgacaatttaaatttcaggattgcaacggcgatttcccatttacaccatgcaaatggaaaattacaattaaagtaaaaaatataaattgaataattcagcaaaaatttaataataaaatagctggaattatacatctaattagtgatatcaatttaaaaaattacatttacctctaattaggaattgaaataaatttgacaaggcttatatggtgatgaattaggttcccccttccgtatcgtgcgcgatcaaaaaattttcaaaaagttttcaaaattttttttatagaaattcctcattgaaaaaattttctcatttttgagcatatttttgttttgaatttttttttataattgctcccttttatatgtattagcagcatctccgtactaattttgtggctttattgctttttcaattccatttttttgggtaattgatcgccaagcggaattttctaacacagctcattgttttcgaaagagtttaaaattttgcatgaaaatactttggtataaggcctagcatcttgccaaattctagaattttttatgcactcagagattttttaaaaaatccgctttttccagcctgaacgccaactttgtggtcaagttttgaaaacaggcggttttttgtaaaaaagtttaaccaatataaaaaattctgaaattttgcagggtgctaggtctcttgccaaagtattttcatgcaaaatttcaagctattctgataactctgaaccgaattacaaaaatcaacttgagcaaaatgcaaacttttattcactaaaattcacagccctaataataaaataaataagaaattgccgaaatgttaggccttgggtgggagtcgagcccacgccttcagctagtggttcaagcagctctaccattgtgccaccgagacaaaaccacaactttatatatttgtagaatttaaattgtaatctcaattttatattttaatttttataataaatattagccacttttcatttattttttacagattccaaaaagttacatcaccactggaccacatgcaccgaaagtgtttgatatcggcgtgttgaatttggaaggcaaattcagtggccaaaaaagggattgcatcaactgagtgcgatggttgattaaatgttacaaaaactcaaaaacccattaattgttgacaattattaattcaatgaaatatttttgaattaaattaatgcatttcttgaatatttgaaattacatttgcaagagttaaaatgtaatcatttttaatgggattaattacgcaatttttataaaacaaactttgacatatataaaatttaaaaaaatttaaaaaacctcaaaaaataaatgaaaattgaaaattaaaaattgaaaacagaatttataattttatatcataattccggcaaaacttagttgaatgtaccgcttaaaatgggttcaatacattatttattattaatcattttgcctcggtgggtaagtgtgaaaaaaaccgcttaggtcgcaggttgcggaattgcaaaaaatcggtttttgaaccgcctacacgcacgaaatttgaatgcatttttttcactatttcgtcatttttgcatctcggacgagatttctttatttcttttgaatttaatgcttgcaacattggcgctaaaaactagcgcacactcgacttcggcggacagttggcgggacgagagactccgggctttggaagtaatccgcgcgtgatccgcaggcagaggcggatgactgactgactgattggcggggagggacccttcgggcctccgcagcaaccaccaacggctttatggattttttatgttttaacataaaaacattatttttacctgaattattttcattcagagcgaattttagcatataaaaaaaaacttattttatactttttggctcatggagaaatttttgggattttaatagggtttggcacatacctattttgccgattttaattttaattttttttttgccaaatattcgtaaatatttggcgtttttagcacattgctttcccactattgttaatagggattggattttttggcaaatgtctaaaatttttacatgttttgtaacgttgaaagcacaaaaaaagagtttttagattggtttaaaaagcttcttactatatcaatttgctaatgcctatttttgcctattttggacttttgttgcttaatgcctaggcgcctagttttgtgggtattcaacggtttaaatttctcgagtttagaatcgagaaggaggtttcaacaacgccgcattttacgaacattttgcttttttagcggcgcatttcaaaaaaaaaaaaaaaaactttcggggaacagggtgaaccggcggcgccgacagaaacccgccgggaaaattttttttttttttgggatttttaactcttttccgccttcgccggcgacgcccccccccctcctcctccacaatggtcatcattaacggtgtaaaattttctcgatttcccagactaaacgagaagcgaaaacccgagaaatttctcgagtcaaaaactgagacctctcttccctactatttaatgcctattttgcgggatttatttgctattatttttttttttgcatttttagctgcctgtttttgcatttttgtgtctaaaatt

SEQ ID NO: 11025 - DNA, 4316 bp, Heterodera glycines
  misc_feature (4309)..(4309): n is a, c, g, or t
aacacacaaaatgaattccactgatcagatttaccctgtggaatgtgccggctctgatcagcaaatgtcgtccatctgtgccgaacttcatctgggccgtctgccgaggccagtactcttccgcccgtccgccggtggttacgacatcaattacggtacttgttgtgtttgatgagactcacaaattttgtgatcagtaagacagaccaatacgatgacttatccaataaatgacttagccggcttttcaatttaatttggcaccttttacataaggcaatgccaaaatggacgacactcggcaattggccaaattcatcaccaagttcgccaagttgcagctgatcgtactgaatgccgacaaatacaatgttgttgtgccaaatcaaatgtgtaattttggtccattccaaatttctacagcaaatccatgccgacgtgacagccgcctccggcacactgtggatggtcgaacacttcgtgccctgctggtgtcccccgcgtctcggcctgttggccgaactgcgcaaatttccggccaaagtggacgggcaaacgcttcagttaaattgtgaagcggaagcgaccaattgccaaaactcgagcaccagaaggtgagagaagaagcacgatgagaagccatggctcattaggagattggggattcagtgctgagtcgatacttttgccgaattgcgatcatttcaagtaccgacgttttcattcctttcctgaatcccggctgattcaaaaatccgagacttatttaactctcgacagcattcttgatcgcgacatttttttggatcaccccccccctcctcatttagttatccccactccatgctgttcacgccgtatggtgctcgtcggcattccatcatcggctcccactcggcggaccaccaattgctcgaatttgttgccgaatcattaaacccgtcggtactggcgctgaacaccactttgttcatggaacgcgtggtggtgcacgtaattactgctcttgagtgagtaaagtattattgcccagccaggttccctactcctaaattgtagacatatccctaaaattgtgccttttatgcctgatcagcagaccactcttggttttagaacactgcatttgcctatcttttcgcgttgcacaacacctgctgctctaccaaatcaatgcaaaatttttgtgagcgaaaaaaagaataatgaaaattgaatttacggaaatttgttatgtacatatgttcgttgcaagtattaaacagttttctcagttcttcctgttgttgttgtgcacagagttctgttcttccgctgccactaacatgactgtcaatgagagggtatgtccgacattcatttgtccaacaaaactgcttccaataggaagcagcaatggagggtgactcaaggcggatttgtattcgtatggcactttgcttttcgctggatatggtgctttgatatttgctggagcgtccttaatcctcgcgtttgctgcgttggtgatcccaattgtcaaccgcatttgtaaaagttcatgccaagagagtttacatgggaggggcatatcacgtgatcttatttcgaaaaactttttgttttttaaaggcagtttttttggcttttgtacaatttgtcatgcatctggcaaaaattagaattttgtcaaaaaatgataaacaattatttagccactcgtggtccataatttttatatttttgttgaaatatggatatcttatttaaaatacagtctcacattaaaaatccactctacatctaaatctggaaaaatatttgataaaaaagttaaaatctttaaaacattttgactcacaggctgtacattgccgacgtctacggctcctcaattgcattctttttgaacgttttcacccatatggtcggcctttgtttgatgtgtaaaatgccataagtggggagctggagagggaagggccggcagttcagctggtagaacactggtccggaaagccagagacaccggttcaaagccgacccgccccatagtttttccctcaaaaacttccccagctcgttcatatatttcatactcaattgaaagggttcatgtggtttaggcgggaccaattttgaataccaatttccttatttaatagatgcttattcaaagtaccctttgtgtgctcaattgtcaactcactcaaccttggtcataaattactgagaggtattcggaatgtttggatcaccaaaatcctggtgaccaataatgcgtgagaataggtgtcggaagaatttgaaaattttatgctaatagaagggtttttgggcagaaaatcgtaaggcattggagcaaaatagggtgccaaatcaatgagcaactgctttatggactatttcgaagtgtgcgtgcaaatgggaactttgcgtccagaagtgtaggagaaatctataaatttataaatgatcagtattgcttatatgtggaaaatgatcataatgtgccaccaatggagcagcatgagcaagaactggagcccaacaatgacaatgaaagcggggcggtgcaacagtgacaaatttgcgggcatttccatggtggtttgagaggccgtgtgaagaacctggaacggtgcatgttggttgtattccacggaacggccacattttatcactgattggagtgccactgccaaatgggtggcaccaacgtggcggaggactcggagctgcttaaaccagtggatttggataaagacattgcggtggacgtggtggctttgtgtggagtggacagcacccgcatatggagcaaatataccgctaaggatccgacgaaaagaattgcgtgtacaattctcgaaggaagggcggaatgtcgggatgtggaatccgccctcagtaattttaaacaatttttctctgtaaaatcacagacattctggtcgtcagcattccatccacatttttttcaaatcgcgggttctctcctggacggacgatttgtacctttttccaaaagaattttcgacaaaaacatacataatataaaatcgattctacatccgtttcgaccaattccgaacactgactcgaacaaaaaatcgagaccccatttttgaacaaaattcagatttatacacaaaccgcaaaaaaatattatagaaatcaagtccggattaggaatttgttgaaacggctgtaattattgggtttcccgaccctgaaaactcctaaaataatttgggccaacaaatcagtttcatttcaggtgtatcgaccattcagttatcacttttctccgttccaatcaaaaaatttgggacaatggcaccaaattggttttgaatgtgcgttgttcacacaaaaccggaactgatgcccagccgatttgggatatttgggcccgtcaaatttggccaatttttgcgccaaatattcgccgttttcaatttgccaatgctgacaacctggacaatttgcgtcgtctcatctccacaacaattctcactgatctcaacctgaattcaatgcattctggtaatctgttgcccgatttgatcgatgatgatgggccaaatgcaactgctggccaagcgttgtccaaatggttgcacactccgagaaaagatggccaaccgaggcgattgcgttgcagaattatgaatacaccgaaagattgggtcaacgatttcaaggaggttacaatatttcggggattttttcatgttagccccaaaaactctaaatttggacaatttattttcgttcattttgctttctattttttcaaaaagaaaatgaatcctgcaaataaaacaactttgtggaaaagaaaatattaaattttaatgattcttacgcgtgtttttttgccttgaaaaacaagctaatgccgggatttttgaaatggcattgagtcgtccctgctaattggcgctgtttcggcatgcaatttactaatgggctcgcaaatgtccttatttttaagatttttcttattttcaggcttcccctaaactttttaaatttattctgcttaattatatttttttgctggtttttgatttaaaaaaatcctttaaaatggcctttttatataaaaaatgctaccaaaaactctcaattttcaaattttcccgcaggcgtctatcggcactgccggcccacaaaagctttatgttcttaaaaattggttcgaaatcccaaaccttgagcctttttggtgaaaatctgttgataaaatgaactcaaattttcaaagaaaaattttccacagccctcttatcgaaaaagtttgttttgtttttttggaaaaaancgcgtcg

SEQ ID NO: 11026 - DNA, 1609 bp, Heterodera glycines
  misc_feature (28)..(28): n is a, c, g, or t
  misc_feature (36)..(36): n is a, c, g, or t
tgcaggtcatatcgtatatgggcaacancctaaatnagatatcgatgtttcattcaaaggttaatgcaagtctcaaagagttccaccaatattttgaaagagagtggataagaaaactggaaacttatggaatttccataacttagcccgaacgagaaatactaacccagctgaggcgtggcactccgctataaaaaggttgaatccattcatttaaaacattccaaatattttttgagagatcgcaataatgtgcgtcacgcttcagttggagtctttttgaacttctttcaaacagtgatgtcagaaatcgatgacatattaataaaactaaaaaatgaaaaaataaaaccaaggccgcgagataaaatatatgaatgctagatgaacttcgcccacattgatacttttgtcacttcgtcctagcaccggcaaatgccaattcttcttcgcattgtttgatcgagataacatttctaattttgtttgaagctcctctgacctttgtaatgcctttttgccgattttaccatggattccgcgcccccttttaatttactctgagtttattgcttgtatttgactatttgaacggatcattgcaagggcgtagccagacccttggctttgggggggggggggggggtgaagtcaaaaattcgatttttaggggtgtatttttggtttttttaaatcccgaattatggggtgtattttacaaaatttttcgccgtttttcgccaaaaaattaatattttttgccattttggcctcccggcgtgccgataggggccaccgggaaaatttttaagtattttaatgcaattttgctaagaaaattgcttaaaatttcaaaaaaattcactgaaaattttttactttttgggtttcggggggggggggggggtttttaattctcccccccccccctccaattgccttttaattttccatttttcattttaacttaaatttgatatgtaatttgttgcccattttattccaatttctccacgctaatgaaaaacaatttcgaaagtgaattgtcaacagcgaccgtttcatttcgcctttctcccccttttgggtctttaatcatttgaaatcgattgtttaatgcaattcattatttctcactttgctttcttcgtggcttctaacatatgctaatcgcaactcctttggcatttcaatgccaaaaactgatttttgatttgtgccgttctcccccttccccagtcaaatccctctccccccctccattctttgcctgtttattcgacgattttacggtcggttttgcgccgacaaaaagtgactaagaatgtcaaaaacgtggccatggttatccttcggatgcattgcctaaggcaaaaaggagaaatgaatttaattaaatttgtgtcctccccgacaaaaactgtcaatggcacggaatttaattcaattcgaattatttttcagtgtgccaccctttgcttggcgacaactcaaaacggactcattcccccattttatttctcaaaattccctccccttttttcgttttgttttgcctccattgcttctgctattaaacatcatatgaaataaaagcttttgctcaaac

SEQ ID NO: 11027 - DNA, 4350 bp, Heterodera glycines
  misc_feature (74)..(74): n is a, c, g, or t
tccagcgattatattgactttaatgattcggggatttaagaatttttgttagtgtttgagcttgtcccgtatcncatggatgtgaaaattcatttatttatttttttgcttatcctttttagtgaaaacttacataacattaaaatggaatattttgatggatatgaattaacataaaatattcccacagaacgaaatggcatatttatccgttaataaaattgcatttattaggtttaagcactaaaagatgtcctaaatatacaaaacatttagggattaattgtctatactttctaataattgctgaataaatgctctattactctctctctctccctaatataaatcagcttcttcccatttccttctgttcagtcagtgtctttcattatgctccttttgctttttggctctccattttcgtcatatgcttgtttcttttcctttgccttctcctccaacatttcctttaaagcttaaaaaatttttattaaattttttcctttaaatcatacaaaagcaatggaaactcaaagaaccacgacaccaaatttatcaattaaaaaaaatggttctccccccgcccatcccgagccccgatatttttaggcctattctccgacccgactcccgaagaaaaggctattaattttatttttagtactttgactttcagtgcgatgaataatgaatgttgatggttggacttcttgtaaagtaattccaaaatacttttttccatctaaataaaaataataatattaattttttactcattaaatttaatatttcgtctttcattttattgttgaaacataccaatgtctgtgtatataaaaccagtggatgggttatcatcttctctttcaccgccattattttgattataataaatttttcgtacagaacagatatttgaattctttaaaagaattttattagggtaataagagcagtcatttttgcgtctttgaagtgtcatattatttaaaatcaaaaaaatttaaatatatatggggcttcactattttgtctgtttcaaatgattattaattgatgttttctttataatttatcaaaacccatgttgtgaaacaaaacttaaaatggatttttttaaaaataaaatgttcaaccaatgggtttggcacaaaatgagaaagacagtttattttaatattttgccataattcttcgctttaaaatctatcagttgaaaatttaaatttatttatcaaaaaattagtgtccctttatattttgtgtcactttataatgcactaatgtaccaacatatgtttcgtctgtttgagttcctacactttttctcccaattgttttttgaatagagttggaattcacactttctttagctgtttcattttcagcctaaaataaatataattatttatttttttacaaaaatataaaatctaatcgtcttgaagcaaaaaaagtgattttagttttatttagagtagagcgggactgggaccaaaacacggacaactgagtactgaggtcccggtttagaccgggaccgggaccagtcccgggttttttcccggttttcccagccaaaaattcccggtttttcaacccgaaaaggtcccggtcccggttaagcccaaaattcccggtcccgctctactctagttttattgattccgaaaaggatagaaatattacaaaaataaattggagccgatataaaagactgacttttatttgttgtccttcggtggtttggccaacgtcaaatttttgttgtttaacattttttgtgtttccttttaatgtcttttccacgttatgatcatttgtgttttggcttttgatgttttgaccaacatcgtcatttagttgcgcaacatttgtgttttcagtttgagtctcttcctcatttgtgttttgtctttctgtgttttgatcaacatcgtcgtttggttgcgcaaggtttgtgttttcattttttgtttgttccacgttatgaacataagtgttttgtcttcctgtgtcattttttgtttgttccacgttatgaacatttgtgttttgtcttcttgtgttttgaccaacatcgtcgtttggttgcgtattagtgttttggctttctgtgttgggaccaacatcgtcgtttggttgcgcaaggtttgtgttttcattttttgtttgttccacgttatgaacatttgtgttttgtcttcctgtgttttgaccaacatcgtcgtttggttgcgtattagtgttttggctttctgtgttgggaccaacatcgtcgttttgttgcgcaacatttatgtttccggtttttttctcttcccttttatgaacgtttatatttccaatttgcgatacttccccgttatgaacatctttattaaaatttgtttttttgctttcaattggcgattttaaattaaattttgtattttcctgttgcgtttgattgttgctctttcgtccttcaaatatttctgtttttattttctctgcattataaatgagggaaaagggtgtgggcgtaggtaggaagcaatttgctgataaggaaattagtcggcaatgaagtgggaaagcatttttgaaaaaaaaattgaattttgataattgttcgaatccgggttcggagttcgaaatgggtcaaaacggacataatattcgggttctacgaccccgaaagcccatagaaacgactttttattaatttaaaatcaatttaacaaagagaaaaagtttgatgacacaaaacccgaaagtaccgtgtcgacttcttcagcctcaatggcctgcggactgcaacagcgcgcgttggatgaggcggatcaaatacacaacgaaacgacggacatttggccaaccgatgatcgaataccatgtgggtgaggaggaaatggcacaattttccatgaaatgccatgggttagttgaacacagaaaccgaggggagaaaaacaaaggaatttaattgtgttagaggaggtttatttttgaattttgttaacgcttcggcaaatgctcaatttcttttgagggcgtctccttcaaactcgctgaaatggccatgcatttggaggcgtccaaaggccttgtgaagcgggcgggcaaaaaggtggacgcgcaggcggaggacgccgtttattttgcgtcaatggccaaatgctttgcatgcgatgcggcattccaagtgcttttttattaggaaaatactttttctgaatttaatttctttttttaaggcggcatcaaacgcagttcaggtgattcggggaatatttccataaaaattttctgtgtttttttaaattaatagtttctatgactcatcttttcgtatatgaaagaaaataatctttcatacctatctcaacacacggttcaatttcttttttacataaaaaactattttaaagtttgtgggttattagaattttgtcatgtgattcgtcgggcgactttttgtctccggcaggcccgtagccggggggggggggggggggaatccgaccaccgaaatgaaaaattaaaaaattttcaaggaaaaatttgcaattttttaaaatttttaatttttgttttaaaagttaaatctttttttcttcggttcccccctccgaaatttttttctggctacaggcttgctccccggtaaaattatttgctgtgttcatttgaatagattttcggcggcaacggtttcaacgaacagtttccggtggaaaaattgctgcgcgactcgaaaaccttgcaaatctacgggggcaccagcgaaatacaacgggttgtgattgcgcgggagttgcgcaaaaagtacggcaacggcggcgaccaactgacggtggcggccacgccaacgccgtcgtcccaactttgaccaaaaaattttaacacatccctattttaactgccaatttaatgtttttattattagggcccggatttgttttgatatatatttttttgaacactatttggaaaaaatttctttgcgtgtttagatttctatttaaaatttttaaaaaataagaaaattaattttcttaatgaaattttttcttctttaaattttgggtttttatccatattaatccggtcccttttattatttatgcattgtctcattaattctattgttcattgcaatgttttgtgttgcgaacggtttacctcagttcggcccacacggttcggcccagcatgtttttccactatagcttttttctttgtcatccaaacccaacattttggtgtcattcgaaagcttaacatgtttagaagctttttctaagatattgcttcgcgatttgacaattaccaagttatacatgaaaattgcaaaaattcgaa

SEQ ID NO: 11028 - DNA, 4231 bp, Heterodera glycines
  misc_feature (4213)..(4213): n is a, c, g, or t
ccgggacctggtagcggacaactgagtacaactgagtccttaggacccggttttgaccgggacggggactagtcccggcttttcccggttttcccagccaaaaattcccggtttttcaacccgaaaaggtcccggtcccggtcttgcccaaaattcccggtcccgcttcactctactaaaaacaaatatccgggggttttcgaggtcgctgatcacgaatatggcatccatttcgaccaattcgggatccggacccgaattcgaacaaaaagtcgaaaattcaaattttcgaattttgcatacctatttggatagtttttaggactttaagcctaaaaaaaaagttataaaaatcttgaacaaaatcattttccatgtcatataaaagtccactttcttcgcttctccattcattctcattcttcacttttttctgcattaacacatttttttctgctcagctggagccttgtcattattatttcttatccaattgcgaaattaaaattattcaatcgaacatttaaaggtggacttaaatttaattaatatccaaataaaagccccccccctctctatggtctttcatcggggacacttaaactggaaaagtgcacgatttttgaagcccttgggaaaaggccgccaattctgttgtcatttctacagtgtcggggccaaatgtaaccctatttaacagcctttcaacagtttaatttacataaaatgtttaaattacattttgctaattgctttccgtatttccatttaggcaaaattattatttttaatggcaccgcccgtcaaaaaaaagaaaaagttttcctccgacaatcgccgcctcatttcttctaccggaattggtgaacatgaacaacaatcgatgggttcacttacgacatcatttggaaaacggcgaagtgttcgcgtgtcaaggaaattgaaccgaccgttgtggacgaaattgaaacggtcatccaaaattggcactttttcgttttagggcccaacttttggatttggcactcaatttcttttacaagttaaagtaatttttccccgcattttagctggatttgcagcgatgttttgatggacagtctcccattctttaaccatgctcaactcggcctcaaattggcgctggtttcgccccgttttgatgcgttggtcgacaaacatttcgacggcaaatccgcgctgacaatttggagacaaatcagaattgacaagattggaacaatgccgagactgtccgtgtttatcaactatgtcaaatctgtgccatttcctttgcccgaccgtccgttgcccaacaaaattcatttcaaggaccttcaaattgcgtaattccaaattaaaaacacatttaaaaaacattccttccgttttcaggtacattgaccatttcgtcatcgcatttctccgtgccaataaacaaattttcgatggaaatggcactgctttgaaattctccatttggtcagccaaaaacgatgtggtgccgatttgggatgtttttgccaatcaaatttggcccatttttgcgccaaacattcgccacatgggcttgaccaatgctgaccatctggacaatttgcgtcgtctcatctcaccgacaatcctctccgatctgaaatggctgaattcaatcaattcctatcgtctgttgccagatgcgattggtggtgattttgatcagtcaaatgcaactggtggccaaattctgtccaaatggttgcacactccgacaaccaatggccaacccaagcgatttaactgtgtttattatcaggagccagcaattaacatcgacgaatggatcaacaccttcaaagaagtgtgtggccacattttcctcaaacaactgattaatgattgccttttaattttgtttcccattggttatgtaggaatttggtggatggcggaggtgtaaaagatcagcctgcggtgggattcgaacccacgtcccttcctttccgtggaatgctctaaccactgagctacacagggcaccctttacacccttctattgcactttttcatcagtgcaatgagaaactctctgcctcccaggcactttgagagagcccgcactacatccccggcctctgagaagaccggtccccgggctcttttatatgctgtcggccgccagcacgtaagagtggagaggtgaacgaatgcagcagacacatcccactcatggtctctgaacttgttgccgcccaggcatacaagacagagaggagaatcgtctcacccagagatcgattactccgatgcatcaatccacccaggagcgccatgtaggaatttggtggatggcggaggtgtaaaagatcagcctgcggtgggattcgaacccacgtcccttcctttccgtggaatgctctaaccactgagctacacagggcaccctttacacccttctattgcactttttcatcagtgcaatgagaaactctctgcctcccaggcactttgagagagcccgcactacagttaggcatttctccgtgccacttcttctgcttgctacgaaattcaattttctgttcatgccacgtcgacgtccatggtgccgtttgaagaggtgaacaaacgaaccaacgagaagctgacactgatcagaaaagcatgtgaatatggatgggccatccgctggatgattaaacgacaccaaattggacaaatggttcagtgggaggacgcaaatttggacaatttgaacaatgtcagcattgatttgagtggcgacaagcaaaacattgggtgagtatgaataatagaagaattaaaaattttttagaaattcatggtaatactttagatggggagccccccttgaagaaaaattttttaatttttttttaatttcaaatttcaaaattattcaagaaaaaataaaaataaattccaaatttgattaacaatttttttggtggcgagatttcggccggcgagattttggggtgcagccgtttatgttgggtttctgggtcggagaatccgaatccgatattcattttgactaattttgaataccggctccgaacgcgagcaaaaaaaaagtagaaaacttcaaaattcttacttttgttcctaattgatcgaaccaagctaaattcagtcaaaaaccgttgcagaatcaaaaaaaaatggtcatagaaaacaaattaaaatttttcgagattaaagtcacttaatttaggccattgtctccacaaaacgaagaaaaagaaacgggacaaatcggcggaaaagggtgccgaaatgtgcttaagaagtgaaataaattgagaaatgatcggctatttttgagattattgaatggacaaatggatctgttaattattttagatgctcatttgctcgttaattttgttgtaattctttcatttctggcatatgtaatttcgcaattctatccgtgccaataatcattttcatgtaatttcgtgcattgaattaatttgttgtaaaaatgtgaattcttaaattctatttttcgacattttcttaagagtcctggttcggggtgccgaaatagatgttggatttgggtccctcagtcctgaaaaaacttaaaattacagaaaatttcttcaaaattcgtccaaaagggaccctaaaaatggaaagtagttaaataacaaggaaaggaataatttatgttttaaagacttctgataaaattcaccggtgtcataaatttttattttgcattaaaaaataaaaattagtacaataagtcaattagtttcataatattgcagtaaaaattaatacttatactacagtagttagaaacacctttagtgcacggtaactccgattttgttacaattttcggtcttttatcatttttcatttgatttttgagttttttactgaatattttttccttatttttatttttttgttttaaaaattcttttttaattaaaaaggttctttttcaaatttaattgtcttgaattatgaattttcattttttgttgttttaatttaataattaattttggtttcagagacaggcaaaacttcggcttcaaaactccgtatttttggtctttgataattacccaaagctttgtgaaaaataaaacccaaaagttggcttattgcaagaagacacttttttctattttttttcaaaaattttctattaattctttcaatagaaggaaatttttgatcaaaaaanggtacagaagatcagttt

SEQ ID NO: 11029 - DNA, 2673 bp, Heterodera glycines
agagggcgagagcaacactccctcgcctactctttttccttcccccttttcaccatctctcgctctctcgcctctttctctttccacccgactattgcgtattttctacctcctttccttccccctccctctctctttcttcctttcccacctttttcccactcccactccctccctctccatttccttttcctctctccctccttctctctctcccgcctctctttctcccctttccacgctatttcctgtatatgtgtagccaaaaatgcaagaggattccgcttttcgctgtctttctttatgttatgttatgatgggcggccgagtgggtgccgcccttgttgctattttgggcggtcccattaaatccgctccccccattgcctcccttttttccaagcgcccgcctggcggcggtcttccctttgccattgcttcttcttttaagttcataacgaaaaaaaaagtctttgtaaaacagtgaatgaattttattgccaagagaaaataaatcactgtttactccgttggaccgcgcgcgcgtgtgcgttatcccgcgaaaatttacacaccgttctgacactacgccgcgttttggttattattcccccgggcgcgccttttgccatttttgtggtcactcataatttgcaggtgttaagtgcttcctttctcttcgtatttttaataatgacaattaagtaattaattaatttacctacaaatgtcgccaattctttgtcagcaatttatccgaaacaaagacactgattgaattcgttcataccttttccttttttaaaaaatggaggagggcggattaccgcccgagaccgcccccggctcagccaccgccgaacaacagcagcaacaacaacaggcaactcaaccgagtggaaacgaagcaccgcttgacgatgggttggccatgttgcaggaggtcagagtcaacggatggacgattgaacacaccaaaaaataaaacagcaaataaaggccgaatgatttattattcctttggaggagtcataaattaaaaaccttcactcttcgcatatttatttattttttgttcagctttaccaacgacgtcatgctgaactgctcgcgcagttccagcagtctcagagcattgcccagcaggactacctgctcaacctgcagttgctccagtccgcactgcctgccgctgctgcgatggttgtgttgcagcagcaacaaattgccgtgatgccttccgccgcttcgcagcaccgtccgctgctcggttcgttggcgcacacgagcagtgagcagtccaccgaagagtttgatgtctcggcacagcaaaccgcgcagcaaccgcaacaccaccagcagacgtgcagttcggtgccgctggccaaggaacacgcggcgggcggaattgcggcgacggcacgcaaccgacgcactttttcgggatcaggccaaacaatttcccaacacacgcgagaccgactgaaatccatgtgatttgggatacggaaatgattaactctgattttggggatttgttactcaaagccatgtgacaatttggcaatttgaagtgcgatactttttaggattgcctgcaaaaaacagaaacagcgtctgcacaactcaagttccaccggctcaacgtcaaacattgccgcctcggtgaacggcacggccaattgggcgcacggagccaccaatccggagctaaatctgataggcggtgggacggaggcggcgcatggatgcgccataggcacaactccgtcgcattttgaccaaaggtttttgttggtcgattaattcaagggagggaggtgaacgcaaccaaaaatggaaatttttcgataattgccaaacatttgttcaggtttttgccctatccccacccggtgaaacacagcgcggacaattcagtaaacaacgcaatggcagcgaacaacaacaacggcgacaccaacacatcgcccaccgattttcaactgcgcaaagtgaacagtgagcccaacctgaaaatgcgcatcagggcacgactgctgaacaaagggtcgagcccacaacagcaccaacaaacgccaaacacaggaacaacaatggcccaacagcagcaaaggttggataagggacttatttgtggaagccgactgcgtttattttaggcccgacagtgctgccactgccagtttagctgaacaacagcatttgatcccgcaaaatccggcagtgagtgtctccgttgacgcggctacacttctccaacaggcggctcagtcggcccagcaattggcagccgcttcggcgttgaccggctccaacacgatggtgccgtctccatcgcttcccaatctgcccgcatccgtcacgcttggactgaaatgcggtgcgacgaacggaggcgcggctggcacagaaacagggggaggcagcggatcggcgcagcaacacgacatgctcaatctgttgatgcagaatccgttcatgcatttcctgtccatgccgtcgctgttgaagaatactcagctgatgccgtccaattccatgtttgacccgccccagcagcagcaattggttgatgcggcacaaaaggcctcaggtctctgggaattcgtccaaaaaaaaaatttgtttggcaaaatgaaaagccctaatttttatatttcctgtgactct

SEQ ID NO: 11030 - DNA, 1435 bp, Heterodera glycines
gtattttttggttttagggaccggtgcgtcgctgggacggaccgtgcgatttgacaatcgaactgcgacaatgttcccgagtttgcttaagcaacaattgcgcgatttggtgctccgtcgcaagtcgctggtcgagagggagcccgaagatgacacaatgatgaattcagcaacagtcggactaccacccatccgggcacagagaaactgttggtcaacaaccaactcaaatcgggtgaacaaagcaaacatttgacgtaaccacaaatagccgttttagttgggaaattgtttatgggatattcattttccctaatttaaggcattgcctacgaccctttgatggcccggcatcagtgtttgtgtgccgaaaacagcaaccacgtggagcacagcggccgtgtgcagtccgtttgggctcgcctcgtcgagaaaggcctggccgcagtgtgtgaacgcatcacgtaaataaatttagttttaaaatcaccattttttgttgttgtttcagcgctcgtaaggcgccgttggaattgctccgactcgtccattcgcccacttatgtgacttttttcgccgtttctcccaccgcatgtcttaaaatggaccccgcagaattgcctctaaagagttttgtgcaggtcggtcattctaaagcggatttcaattattttccttttttcagttgccctgcggtgggattggcgtcgactcggacacttacttcaacgacgcgagcactcaaacggcggcaaaaatggcagttggcagtttggttgaattgtgctgccaagtgatggaggggaaactgcaaaatggagtgagtgaggagttggaaggacagtcaatattgtgcttttttgagtccaattcattacccagggttttggcttgaatggcggggatacaccgccctttgcaccaaaaattaagttttgaaagattcaaaaaatttgggtgagagagatcttggacagataccactatggagtcgaaaacctaattttgtcagttcgcatgcattcgtcctcctggccatcatgcggagcgagaacaggccatgggcttttgtttcttcaacaatgtaaatgcaatctatgaatttccttcaaagttttcgctaaggtggccatcgccgcccgttacattcagcagcgttttgccacgacgtgcgctcgcattgccatcgtcgattgggacgtccaccacggcaatggcacgcagctgtgcttcgaggccgaccccaactgtttgtacttgagcatgcaccggcatgacaacgggaatttttttcctggtaattttgaaaagatgtactaatttaaatttgcgaatcgactttcattactttgtctcttttatccattcaattttttgttttcaaactttctctttctcacttttgttccctattttcctctcattctgccccaac

SEQ ID NO: 11031 - DNA, 1433 bp, Heterodera glycines
  misc_feature (1414)..(1414): n is a, c, g, or t
  misc_feature (1425)..(1425): n is a, c, g, or t
ttcggaactccactggcagaccatctcccaacgcttttcctcactcacgatgcactcgtgatgattctttccgatctgatgcgaaaaatcatacctaagttattctccgccagaagaatttttgttttaggttttgccccaattgcaaaaatgacaaattcaaaatgaattttccccgcttacaattagttttttcgtctagtcaaaaagggagaatcgttcacacttttcatattttcattatgactgactataataacattataaatatcggaaatgttctgactttctttccctcttttcactgtttttcttgtgattgccccatattaataatattaattaacaatgaaaaacaaaactccatctttgttttggagtcagccagttcctttttgtttatcctcacacaaaattttaattatttctgtctcaaaaatttattttgtaaaacgcgaataaagattttgttaattagtcgtaaaagatttgaaagggcataaaattggaaaacgagcccttagggtaaatgatcattggaagagccgtactaaattgttatatcatattttttagaaaatccaaaataaccgacttttactcgaaaaaaagtattaatttgcgatgaatataaaatatccaaaaaagattttcgaccctggcaggactcgaacctgcaatcttttgattcgaagtcaaacgccttatccattatgccacagggccgatgactgttacgatccatgtttcatttttctctcgattttaataaccaaaaagaaaaattttattttttaattactatagaaaaaaatttttcgaccctggcaggactcgaacctgcaatcttttgattcgaagtctaacgccttatccattatgccacagggccacgggataggtgacttagaaagtgactgataattactttttatcttccgccttactgtacttctgtgacaaagccaatttattccatacgtttttaatagtctcctttttaattggacagcagtgaatggattcgctaataaatgcttcgtccgttaattctcgtcttgaaattcatccggatgcatttgtcgactcgagaagtgtcttaagaggtcacataatcgtcggacccggcaccgtcattcatccccaagtgattatttcctactgataatcttaaattctcggcttcttcaggcggtgattgactcgggagatggttgcatcgaatttggcaccaataacattgtggaagaaacagcaaaaattcaaaatttgtgagacttttttgtgttttctaattatttggcttttcaagaaatcattcgggcacaatgcgaatcggaaatgacaatttgtttgagataagctctggtaaaatggcattgttaaaaaaatatatgattttgtcccttccaanagttttcagtngtgtgact

SEQ ID NO: 11032 - DNA, 3294 bp, Heterodera glycines
atgaattaattgttgcaaaaaattaggaaaagtacgcaaaattcgtatgtttaaaatttttaaagaaacattatagggacagttaaataattatatgaataagcattcttctcagctgttaccctgcaaaatctggtgcgcttctgatcactactcgtaaaattatgagtgattgaattttcactaaaaagttaagcctaaactttttggcctgtttaaaaaggattaaaaattttaatcatcttcctttttaatagaaaaagcatcagagagccttattaacatgtaaataaaatttatcagattcagatcgccatgaaggagtaatctgatcatgttggtccaaaagatttatttgttcagcatcaaaagttagcttacaaattagaggaaatttttctgatttttttctctatataaatagatttttggttaaatttaagaaaaatttgaaaaattttcttaataaacttagttaaaaaataaaatttttccttggagatttctacaaaaaggcctaattttcatcaaaaaatttgctcaaaatcgtaaacttagtcattttttggaaaaggtacgcagcaaaaaaagcggattgtgttttggtttctttaaaatatcttttaggaatttttccagcgattaaattccgtttttctaaataaatttaaattaaaaaaatcattagaaaaaaattttttaatcaaggatcacggctcacggagtttttggggtgccgtgatctcggattttttttaaagccccgtgatcacggctcacggatttccgtgattggaaattcaatcacggccagccctggggatttgggatataccataaaataggacaattaaaggaaaataaaattttatcttcaattcacagagtttaaaaaagagatgggcacaaataaaacaggaacagtgaaaaacaaaaaaatttaatacaactcatcgtcgaactagaaggtcaccggcttgcgctccgcttttttgcttgcttttgggctcggcatcactccgttggcgctgtttttcctgttccgaattgctaatgcccgtgccacgttttttctgcttggcccggatgtccaaatttgactgtaaatttattttttgtaaatattattatttaaatttggctggcaattttttttcacttcggccgctggcgtgacaagcagcttggcgccaactttgtgcttgccatgcgcgttcttcaccatcaatgtgtactcgcccccatcttgtggccgacatttggaaatgatcagagaaacctgacaatatttttaacattattttaatttgataaaatatttttaacattattttaggatttgataaaattttttttattaaatttgctgctaagttttgaatttagtttagaaataaatgagctacattaattaattaattgagtgccgtaaaaatcccttccaagattagaactacagtaaaaagttttcttgtcctccatttgagggctacggtatgaaaaatgtaattttattgaaattaaaacaaaaaattttttatgatttctcagttttatgataaatgactttttcacaaaaaaagttttttccaaaaaacagcagttttttttaaatttctgtgtttaaaaatttcatttaaaaattgccacttacatgtcccgtgtcaccgtccgtttggcaccgcactcggtcgtcggtcaatggcatttttcggccgccctttttccacacaattgtcggtgccgggttgccctccacgacgcatttgatgatggccaattcgccctcaaccaccgtcacattttctgggatttcgacaatccgtgccggtgtgccggatgtttccaggtcctttaaaaaatagaaataaaaaaggggtgcccaaaaattgaaaaaaacaattaaaaagtgaaagatttttgtttttgtgctgcttttctcaaggaaaaatattaataaataaaaaatccaaaaaataggcgccaaaaatggcgaaataggcacaaaaaaggcgcctaggtattaagcacaaaaatcccgaaaagcatacacaataattttgaaattttttttttaccaaaattgccatcctttttgtcaccaccgccatgttctgtcgctcctcctcgttgttgtacacctcgtcctttgcctcttcgcccgcagcgcaagccgctgctgccgcctgtgccgaccgatccgccgctgtgctgccaacgcgtcgccttcggctactggacgcggtccgctcctgttcatatttttatacattaaatatttaaaagaatattttgtaaaaaagaaaatacagtaaaaacgaaaaatactccgttaaaattaatttctaaaaaaaaattcaaaaaatccttcctaattgttttacaaatatgcccctctcatcattttctgtttacaaaaatattcccaatgttttgcaccttcaatgtcccctcgggcggtgcagggcgatcgaccaccttcaggcgcaagtccaccgaagccgagccgaattcattcacaatgcgaatggaataggtgccggtgtccgattgttcgcatttcggatagcacagctggatgagagtgtctaaaaatgggagaaaaaaatgtgaaaatgaaaaataaaaaaaatagaattaaaaaaaataataaaaagagaatttagcccaaatcttaaaatttggccattttttagacaaaatcttctaacaaatagcaaaaaaagttgtttaaaagtgtgccgcaaaaaaaaacgctttttaaaaacaaaaaaagtgcagtcgccttgttaaagaatcgcaatttggcagtgaaatatcaaattgcattgagttttcaaaaattttccggcggcgcctagccgcaccaccgtccccccccccgtcgacccactccttccagaccattttgcaaaaattttggttaatccccctcccttttttaaatgtatgactctgcgcctccaccctgttaacaagggaacattccgaactgtcaccactcagagcgttttaaaaccgcttttatcgtgtagagcatagtcgatttgctattgccaattttcggctttattggctctggcgccaaaaatgataagaaaaagtgatcaaagtttcgaaaaatcaataaaaaagacaaaattttaaaagttcataaaaaattcaaaaaaaatgatagagcaagcaaacttattttaaaatgattagcaaacaattctctatgaaataacattatagaaaatttaaataactgcataaaaatatgctaggtggagtactactttgaataaaatt

SEQ ID NO: 11033 - DNA, 1339 bp, Heterodera glycines
ttataaagaaatttttcaattaacaaaatgtttgaatactttttaaaaaatacaatcaaacgtttcctgtttctttattatttttacaaaccctgtgtatcaagaaagattttcatgtaaataaaaaaattaaaaaatattatttattatggcctaattccacgaacatttgccaagaaaataacataagcagagaagcgagagaagacggacagagagagagagagggagagaaagagagagcgagcgatgtgaaacatgaaaaatgtgcgtgccctcgggggtcagcgatggacaccgaccggtcccgactcactctcgttgtcttcgtgtccgtggccgtacactatttccagcatctttcgctctgtgcgtttccgtccgtctctcctcagtttggcattgcttcaactcaaccacaaatttctttctccgaccggcgcttaaaataggcgaggcggaggggcgggggcggtggggggccgcgtagaaagaccggtccaaccgcggggggcgggcggtaaagggcagcgctcatcagcagttgtcttccgtcatcgtcgtccattcgacggggctggcagcagcagcatcggcagtattgaacaatacacatacatagttagagccagccgacccctcccctccccccgccccttttctcggggggggggggcacggagagagtgagtgaagtgaatgtccacccccgccccccattctccttgcggggagagagggaccttttgcactttcactcgcccttttccgctgcttgcggcgatgcccttttcctccccattccgccctctcacttttgtccactctttccgtctttttgcattattttagccaaccctttctcaatttctccccccccctccccaattctctcttctctcacacattttcccgcaaaaagcctcatccgtcgtcctcgtcgtcgtcggacgttggacggcgtcggcggcggatgtggtggacacaagggaaggaataatttcatcgacggccagtcagcggctggcacgaccgccgtcccgtcaacgaactgctgtaaatggcggagagggtgtgggggcggggtgcatacggcccggggacggccaaccgaccgaccgagcaaccccggtcggaaggatgggtgggtgaccattgaagaaccggccaaaagagggcattgtcgtcgtggcactttgccatcattttcctaggccacagcattccgtcgttaggacagttcattttcatttgtatgccttcttccgctcctccttttcgtcctctcattttgttggagagtgccagctgctgagtttgaagccaagtcccttcgccc

SEQ ID NO: 11034 - DNA, 838 bp, Heterodera glycines
cccccccccgcctttcacaattctttgcattttctttcttcccttccgtccccggctgtccataattttcgttgtcgaaaaagtcgcacgaagtgatgttgtaaaacgaagggtttggatggacagatgataaaaatggacggacccacattttgcacttttccgagcaaagtgcacaccaaaatcaacaacaacatcagcagcatcgtcttcattcattttttttgaatctttttattgtatacctcgcattaataaatggtgttattatttttaaacaaatatattttcacctgattttttcttgttttaagctctatggtaaaataattcgctccttttccgcaaatatcactgtgttcatttgctgtcgatgcaccgccagcaccgtttgttgtttcgtgtactgcttgccgacgcggccgttgccgcgtgaactgctgattttccgctacgcgtaaacatcgcttcccaaaactgttccgcgccgcccgcacctctgaacggcgttgcactgttgccttacgtcgcgccgccgccgctgccgcgacaccgccgtcgtttcaacgacgacattccgcagcagaaactgttcagcgattttggccataccgcggccgccttcgttcgtcgccgagtgcagcagcaaaaaatggtggtggagacgcaggaacagctgaatattgaccaccatccatccgcgtttcaccgtgtcggctcggccactgttgcgccacaaccgcccgctgctgtggtggagacgaacgtcgttgccggaacgatgccgacaggtagggggagggagggggtcacagtgataattgtttttttttcggag

SEQ ID NO: 11035 - DNA, 211 bp, Heterodera glycines
ggggggaaacgatggaccaaccgacagaaaacaaatctttttttgatactttgtatagtaataatagccacacacaacgaatgatgaatgaatggggggggggggggagggaaggaaggtccgttcatcagctcaagcagtaacagaatgttttttcagccaaaagctcataggagtgctaatattttgattacatccaaccaaaacaaaa

SEQ ID NO: 11036 - DNA, 4154 bp, Heterodera glycines
  misc_feature (846)..(846): n is a, c, g, or t
ccctttagcgtgaaaataaattttgtttttgcttttttctgctgtgtccgccccgcggccctcccaaatcgataaaacattcgcagaaaaaaagaaaaaaaatttcggggtttgttgtttttgcctccccccccccccaattttgtgcacttttctctctcttttttaattattttgtgtatacatatgtactagagcccggcgggaacggaattcccgcgggaaaacccgagaatcccgttcccgtttcccgtcttttttcgctgacgggaattttacgggaacgggaaaaatgacgggaatcccgttcgggaatcccgccccgttctttttcgttttcccgttcccgttcccgtaaattttttctcaaaaacgggaataaaagtaaactggtaagaatgggggtctgagtgaaaaaatttgaaggaaattggtgggaaaagagagatttttttgtgaaaaaataaatataaattcattttaattcattagcgtacgtatttatgtagcctagtggttaatacttctggtctttcattatttgtctcctgagttcaattccccattaggatagggggtttttcatattttctttaagttattttatttgaaatttaattaataagaaattttgtctaactttaaaaaatatattttttaatttttaaatagccataaggccataaattaaccaattatagttcattttttggacaaaatttgttagcaatttcactaaaaaattaatttatttttatttttaaatagccataagccaacaaattaaccaattatagttcattttttggacaaaatttgttagcaaatttcactaaaaatttcaanaattttccccggcggcgcctatcggcaccgccggaccccctccctgtaccacaaaggattttgtaaaaggcgctcacaaaaaaaagagattttaaccaaaaaaagattttgtaaataagttgaaaacatagaaaaattctctaagaatattttggaattttaaaaataatagacaattttaatgaaaattattgtacatatataaaaaaattttctaggattttagaacagaaaaattaccagtttttgccggtaccctcaaaaatattattaccggattaatttcaaaaactcaagttttaaatttttcgtcattaataaagcaatgtttaatctttacatagcaagaaatttttttaattgtttaaaatataaaattttacttaaaaaataagtaaattaaaattttataaaaaaaaaatcaatattttttcgaaaaaaaatttttcccgttcccgcccgggattcccgttaaaaaatttgttgtccaacacaaagttactaagtgtcccaatcgaattctccgtcccatttttttgcgatataattcgaaaagttgccgaacgaacgcagcagcgccaaagcgaatcttaatggggtattaattattgctgttaattagtactaattaacaattaattgttgttaatatatatattaattattagtaattttacaccttcttcagaagcatcgcaccaaagagaaaagtccaaacatttctcaatattgtcagtgctttccgtcaactgacttatttctgccactattttccatggtaatccatttatgtacactttttcgctgtaccgactgctctcaacctcctctcgtgcaaattctgacactttttcaatgtccagcaaaagtgtgcccttttttcgatcggaaatccgtccattagtcgaaaatggcattgggaaaattccgtcggaaatcccatgacaatttggaagggatttgaactggtaaacggcgatcacttcatcttttgacaaaacaccgaagggaactgtaaatatgtatcaacttattgaaaaataaattttaaaaaacttttttaaaaaatcgccacaaaaacaatgaatattctacggcatctcatcagagaacgagtttgaaattttgacttatttttttaccaattttcttcgtaaattcctcatttgacaaaagcggaaagcgaattttgaacagtgccgggccaagcatttgacggcgattctctgctgaacaatcaatgccattttcacggcatttttcatcggcccaacggagtgcctttaaaaaaatttaatggaaataattaaatgactaataaaattttcagtttttaaatttaattgttaaaattaccgcattccaaattgaaatttctccacggatttgcaattcgtcacactccaaaatttcgcacaacaatttttggtcaatttgcaaaaaagcatccgatttgagcaaagtgtccgcatttttgccaatgtaagccaaacaacaattggcaaaattctaaaatttaaaggaaaaataatctttaaaatgtagtctttctctgagagtgccaaagcgagaaaagaatcgagtttttcttgtccaggttttcgagtttagaagaccgagatttctttaagccctctaatgattgtttggcttttgacaaacttaaaaaaacattcattttttgaggaacatattttacaaaaaaaaagtctaaagtcaagggtttttcggtctcacaatcagacagcagcaattaattggtcttaaaatccttaatttattatacattctaaataaacgaaaaaatttttgtaaaaattttagtgtaggaaaatatttgcaaaaaaatgcaaataatagcgaaattcaagacggaaaaattcacgagattgagtttaatcattcaaaaaaaccactctaaacagtttattatgtattttatttaactggaaaatgtaaaccgacaaaatagttaaaaattagcaaatttttaattctttcgcatttttcaatttttcctacccactttcaagtcgagaagacgggcctgggcaaaagcgaagaaaacattgcgcaattcggaaattggaatttgcaaagatgagccgaccagagaggggatattgtacttattggctaattaaataatttatttatttttgtcacataaaattaaatccaccggcgtaaagcacagccatggcattttctccgttcagttcattcaactcttccgtataaatgaagctcaacatcactttgaatgctgctgcttcaacgtcggggacctccacgggacaatcagcagaggctaattgaaaattattagtgtaattagcggcggctaattgaaaatttattagagcaattagcggaggactattgaaaattaattagggtaatttgcagagattaaattgtaaatgtcattcagtaatgtttttaccgaattccgctttttcctttttggcatcaaaacggaacatcgcctcaaaaacgtcggaagcgtgtttcaaaatgagcttatgggctggcacaagcttaagaggattaaattttaaaaaacacaaaatttaccattcactaaatttccaatttttaattaataaattaaatttttaatttgaagactcgcctcttttgcgtctccgtcgcccaccaaaaaataaacatccgcgtcctcacgcgtgctcaacaaatgcttcatccgatcaagcactgattgggacatgataagcaatatgaaaatcgtatttatctattaatgtaatgaaatgaaataatgggaattaagtgaattaagacccccccccccccctgaccgtccctgatcagagtgcgcttgtgtttattgtaaatcaattatgaacaaatttttacacagttttcagtttggacctcagaataatgtttttttgaaaatttatacaaaattaaaactgaaatatttatttaaaattcaaataaatatacactaaagatataaaattttgctgtaatggtgaattaaaatttagggtttctccaatgaatgaacgctacagcggtgggaaggacattattgttgaactccctgaaagctatgatgtccatcacattgattggctttcagtactaatgaaatgaatttctttttttaacatttaaattatacatttaggtttactgtgttcgattcgaagttgactacggtcacatttttatccgtaacatttcaccaatggtgccaccatatgttcaaaaaccaaaaagggtaaagcaaaattggctctagtgcactttatgagtccaattttcagtttctttgg

SEQ ID NO: 11037 - DNA, 3024 bp, Heterodera glycines
ttacagccgaattcggtcacagttcgttggaagtactgtacaaatgtccgacgtgtggcaaagaaacgcacagaaattatgagtgcttcagtacgtcaaattttaccacaaatgcactcaattacaataattgttccgctttaagttgacgtctcttacaactggggccgacgacacggcgatacagaaatgtttcgctaccgtactttcgcgggcagtttgtggggacagtacacgaaaaatgtcacaaaaacgatactgcagaagcggatgaccatgaacaactttgagttggtggagcacaaatacgatgtgatgagcaatgtttggatgggcaattattacaagacaagcgatgaatggaccaacgatttgataaggcgtcttttataggcatgccaaatggcagcactttattgtataactgtatattatatttgtattcctcgtataatttatttgtatctctcgtataactgtattatatttgtatatgtgaataatactgtgttgtctgaatgaatgttatacggtcttttttgtccaaaatgagtacgtttcattccccaatgtctttcacccttccaatccgaaaagatagcaatcggagacgcaaaaccgctcaactaacaaaaatgagaagaaaaattgcagccaaacctacataggtagttttgtatgtaccaaatacaatttgatagttttttccttcgtgttttggcaatggataactgagtccccctttgaaaagagacacttcagtatccgattttttacatgaaaatggcaaatacgcccctaatttgcatttttctcatcatacaaaaacggcttacctaaatacgcgtaaacaaactgaaagccatgccaattgaaattgggatttttgatcgacagcaccgagcaaaattcggaactttcggcagattaaaaatagatttttggatttaacttttggttagtcgataccggggggggggggtctcagaatcgctgatcagtgatcacgaatccgacatccatttctgctaattcaggatgtttggagcgcaaattcgacaatttcaaaagccactcattaattatatgctttacttaaatctttaattaaagagtacttctacatatagttggttgtaattgaaaagtcacttaaaatttgtgattgttgtttttatttctcaaaatccattacaatgacaacaacatatcgtccgtacaacaattaacaaagccaacaaacagaacaatccaacaaatccgaacatggacaattattcaggcggatcctccttctcccctcctcgttgttccgcctctgcgcggctaagcattgtttggaaaatggcgtcgagctgtttctgcagttcgccaatttcctccttctgtttttcattcgcttcctgcaaagtttcattcgcttccttcaaacggttgcattgagcctgcaaagtttgaagtttgtctgcgcattttaggagcagtttatcaaaagactattcgagaaaatatgagtaagttttttgtgaatttaatgggatatgctacatttgactttccaaaagttatctatctctttttacaataaaaagctaaagaaacaacacaattacaaactctgacaagtaatagaatttgttgttttttgttcaaaacttgttttgtggtgtgctttttgtgctaccactccaacctcgctcacttccgaacatgcactcaacagatcttaagcggattaaattaaactttgatgtaccttaacttttttagaaccattcaacttagatatttttgatattatttgggcgcgctgtcaaaatcccgctgcgtcgaaatcccgccgcgtcataatcccgccgcgtcgaaattccgccaaagccaaaatgagtcgaaatcccgccaaataaaaattagcgaaaaagtcttaaaattacattcctaaggcttcaaaatacgaaattcattaatactttaccagaatcgcataaataaataacaattttcacgaaaaataatgatatttttaaatattgaatgaatcgaaaaaagagaattgtatgatcgaatcttcaaaattttcatagtgcacgaaattccgagctcaattcgctgcgtccgcttgtcggtcgatgtttctgctgacttcaaaaattaagtcggaaagggtcgggcgatcagacacttataaaatttgttaagttttttgggggtttacaagtaaaaaatacagaaaagatgggttacttcgagaccaatgttgttgttgagggggcgggtgaattgatgccgaactacaacggctgccgtgaatacgtatggtcgggttcaacggattgaaaatgatgccccgcgaatgcttaaaatgcaaataatcaaagaggaaattataaaaaatggttctttacggttatctgtcctcagattttgaaaaaaaacatttttttgaaataaacttgttttaggggttttcaaggtcggggaaaccgattctggcatctgttttgacccaattcgaaccccaaacccggatttgaaaaaaagtcaaaatccatttttcaaaaaattcacattttatacacaaaatcgcttcacaatgtcacgaggatgacccgcacaaccaaaaaatgacacgacgacgactcgtataaccaaaaaatgccctgagtacagataaccgtaaaataccaaaaaaattattagaacaaacattgaaagcttatttggggcaagaaaacactcgccgaacgaacaccaaacgcgttgacgccatcaagcaatgactgtcacgcgtggcagtccgcctaccttttgagttttcccaagtttgaaattggtgatgtcttgttcttctccagtcttcataacgttcattgttgttgtcgtttgctcacaatgatcagaattttttgcattttcgccgtcattgttgttcagaaatctgtgtttacaacatttatgaagaatttcaatttttcaacccatattgcttagaataatctaatttttatatatgtataatataaa

SEQ ID NO: 11038 - DNA, 2466 bp, Heterodera glycines
  misc_feature (2445)..(2445): n is a, c, g, or t
ttttctgctccagtcacgcatccccatgtcaaaccggtcagtaaatactttatcgtttttgtgtaaattctctttgaactcaggccattccctgttgttcgtgaaagtaatgaagagacgcgctttcttcgcgtcatggcaccgtgcaaaaacggtgttgcaatcttcatacattttcttccaatattggagagaatttacgttgtgttcggaaagccgaacaacactgccaatgtcatcaacagttttctgttgggcattggggttttgccgtgcttgctgcccattgtattggttgaccaaatactgcagcagattttttggagtgctgatccgcagatccatgtcaggtctacgcaaaaatgttgctatttgccaatcaatttttgcagcctggtcaaggatccagcgctgaccaagtcctccaccacatgaaagaatgtggtggtattgcaactccacattttcatcccttattgcgagataatacttgcaataatctcgcagggagataaattgtttggatttgtcaatccgccggtgcggcgatgaaacagatgctacagattcagcatctgaatctgcgactgaccccacatcagatgatgcaattgactgagtctcgcacgactcattatctgactcggcttccgagtcaaataggccagatgcattctgagcaccttttcgcttacgcgatggtggcttagcatatttaatgccagttgtgtatccatcatcgcccattggcttgattaatggatacgtaagactatcagtccacggactgaaaggagcaatttcatttaattgcccttgtttgttctctacccaaattcctttgggcggaggagcaccagtggggtccgcatgaatagcgaacatcccttcacccgtagaaggggtgattatttggtgtgggtgcaattttgggtctttaagaccagctggagccctgcggctatccaacaaagtcatgcggaagaaacgaagctcttcctgattttgttgttggagaagctcagtgagctgctcacgcgcctgcttatatgcttgcgcagcaggatgatgcacttggatcatttgttctaagatctcaagagtctgctcatttagctggtgaccctgcacaaactcatcttcgtttgtgattttctccccagtaaacctggggttgtttcgacgctgttccatagcctcgactgggtccagaatgtacaactggccaaagccaggaatctgagttgtaccagcctgcatgctgcttatgcggcgatggaattctccgttaagaataacggccatcggaccgccagcagggcttggtttgttgccagcggaaacgctcgcaaattggaacaggttgttataacgcgacatgtgtcgcacaaattctttcccttcacgggattgcttattccccacaatcagctgtttgagctcatcaggatgcgggttaagcattggcagcacaactcttcccttccggcagcaaatgctactgtcttcatgtgagaagagatgtgcaccgcaatcggcgcattttttgtcaccgagtttcccggagtcacaatattccgggaaatgtttggctgctgctgcagcgcattgccaccccttgtgaaatgcagagcaacgccgtgtgatcggcgttgccactcccagcgaatttgctggcggggggcgtttcggcgccggtgaaggcgaacggctaacagaagctgaaagccttttttgaacgcgcattgatcgccttggtggcgtcttaggtctgatgaaaattacatcatcagcctgcgcaattggctcttgcgggatgcaagactccgacaccaaaccaagcgtgtcagcttggttttcaccggccacttgggcttgggtgagaatggcatcaactgcctgtccacgtgtctgtggttcgatgatcattatatcatcatgttcatcaacttccattagctcagcggccttggatgtcgactgcgtttcatccgtatgccgatagacaattgggcaaggagttggcaccccttcccttggatgatatggcacattatcagagccatacagctcgttaatgtgccataaaatgcgttttttttcataattgatggataaatcaggcagaacaaatgtgcgattgttcataagccatgactcagcatacaggcacacgaagtacccacaactattaccatcgtgttggaccgtcagattttcgacatcaacaatccctgtcaacagtgctgacggcaaaatatccgaaatgatatttttaattttatccgtcagttgcggatccaacctgccatatgtggtaggcaaagaatcggcaaaatgagtgccaaattgcacatcatggacaatgagagtccaatgtccagggaaatgtactggcaaaagtataacttctgccggaacaaaagggtcgtacccaaatgtcantatttttgtaaggccatgact

SEQ ID NO: 11039 - DNA, 5333 bp, Heterodera glycines
attaccttcaattaaagtatattttaataggcctcaaaacattggcacttgtcgattcctgtgcttatgtttcttactgccgagaatcaacagctcacaaagccgatttaacaattcagaaattgaaaggggaaaataccaatttaacggctgcaaatgattcaaatattcaaatttacggaaaagtcagtacaaaaattcgaattaaggacccggagtctggaaaatttggagaatggggcattattttatttgtctcaccggacaaacactgtccaggaccaattttaatgggactaccacttttgatggacctaaaaggagtaatcgcacttggtgaacggaaggttagacttggcgaaatttggacaaacattgtttcagtaattggatctgaaacagtgaagccttccagagtaattttagataataccgaaatttttgaaccaaggacagaaaatattttaatggctaaaataaatgaaaattatccgactgaccagaattttttggtggaaagcatttcacataaataccctggaattatagtgggaagaactttggtcgcaccgggtaacagtaaaaatgttgttttacacgttttaaatgcgggaaatgctccgattaaaatttatgaaaattcacatttggcggacttggaaccaataacagtaaatgcgttaccaggagatgaaatttctcctaaagattacattccaccggaaacaaaatggagtgaaaatttgccaaatttaccagaaaaggggatgaatcgtgtaccgtcggagagattaaatttggatgggtctttacaaacagtgcatacgggatggataaacccagtgagagtgccattacaatcatttgtacccgagaatttaattcaaatgaggacggtgaaagatacattatggcatggattttcaatgaaaattttgaaatgtacatttctgaggctatagaaaacataattttgggcatggaagttcagttgaaaatgggagaaagatggaaagtaaggacacacggggaagttgaaacatattgggaagtaatggaacggactgatgaattaactattgaaatgcttatgattcccgaaattttaatttcttataaggacaggcccactcagagtaataatgaaaatatgggagacagaatttgtcaaattaacataaatgcgatcacaaataatgagcagggcattttggaaaattttgaaaatttagaagaaatggccaatcaacttaaacgacggggaagactgaatgaatccagaaaatgaaaaatataaagtcattcttattttaaatcaattgcggatcaattaacagaaatggcggagccaaaggaagtccatccaatggaagaaatgaccgacggagagcagctatcgctccaatcgatggaaagaagcctgcttaagcaattggaaaaagtcagaaaaacattggccagtggccaattaaggtgcgggaagaggaggaccaagtggcaccaataatgaaggaggaaaatgaaatgaatgacgatgatgggaaaccggaaactgaaaaaaaggaattaaaattggaagcaaaagagaagggcaccaataggaaatgggaggaggaaaaggaaaaaccgtaaaaaaggtttctgaaacggaacagcatgaaaaagaaaaagtgaaatgcgctgaggatgttatttcactcgattctggagaattttatgacgatcaggctattttgtatagcccaaaagcacaatttgatcgctttggattttgggactcatgtgtcaacacggaagcaaaaagagatttaaaagaattgaaagagaaggagaaaatcgtgaaaagtgaattggacaccccgtctatcgaaaagtggggaatccgagtccaaaagttgcgagagcatgagaagaagacgaaggaggcccgaagtactccaatgccttttaaaaattcgcgaaagggcactcatggatgaacttcacaggcccatcgacatcggccgcatggactatggtaccaggaccatcaacggccatggactttccgagaatcaccggcggatttcaacagaactaatttgattggatttaattacaatgctacattttaaccaaattaatcctttttattttaatcaaaatacccaaaaaaaaaatgtagcataattacattttgtatttcgaccggggacggtcttttagcgtgccgtggatgaatatgataataatatttaacacatttattcaattatctaccatattttgtaattcacatgtcacactttatatcttatgtcctaaacaattgtctctctcctagtgggcgggtctttgagcaccccctccacctttgattacgccccgggaattttacctggatcactctattcttcatcgggcctctccctcggcagtctctgctcccgagaccgaatcgggttgagtgcctaagaattgtatccttccccctgaataaaggcgtactgttgtatactcttgttaatggggaataaaggaatacaaatggccctaggtgacacataacattcaagacctaaaatcctgagaccgagccccaattgtacaaaaaacaataactaagtcacttatatatgacatatcataatttaaattataatctgatcggctctttaatatcaaatttctatgttattttttttgcccctatagtgccattttttctggtctccaatttttcgggagccatggtaataaaccatttgtaagagtaaagtctcgttaaaataaattttccaagacctcgataaattataagctcaaaaaaatgtgaaaagatttttaaaaaatgaataaaaggatatatgttaaggacaaggataaaaatttactacatctctgttattagaaaacatgggatttatgtgtaaaaaaaacgagaaataggtattgtacattacctaaaatttgtaaaaagcagaaatagttgctaaaatattaaaaattccaaaatatttgttaaaaagttgtaaaaattcagtccttttggcgataaaaggctacaaattcttgcttatccgatgctgaaaatttgaataatagagggatctggcggtgccggtagaaccgccgtggaaaattttgaaaattcgagtacaaattatgataaattctttaaaaaacgccaaattgtttcaaaatatttgttaaaagattttatacgcaaagcttcggctataaaaattaaaaagctagaaaagaatttattgactcaagatcccgcgaggaactcgcaattttaaatgagagatttgcggggtcttcgctgattaatcccgtaaatccagttcggcagaaaatttaatcccaatcgtcaactttgtccttaaataaatctcagcaaactgttactataaggttgggtttatatcaaattacctctatttgatattaaatttttaatctggaatgtcatgacactgaaaaagtcggtccctaatttttacattctattattattttaataaataaatttttcataaatttaatcgtaataaccgggacaattttttttcatttttcataattatatttgcattcaataaagtaattggagtttctttctttctcagccttgctatttcttttgaaaaatttcattaacatatgccaaaatacgtggaaagaaattggcattttctttctttctcagcctctctatttctccaggtctcagtccaacatatgccaaaatacgtggaaagaaaattggccaatttttctctttttctctgtctcactatttcttcattaattctcattgaataatgccacaattacatggaaagaattttattcattgggtagtccatcataaaacagaatgactagctaaatgcagataattattcattttcatttcttgaaattccattctctttcaaaattattgtttttgccttctttctatacaacagggatattccatgtcaagaaatttttttgaattttatcaaatttttaaccatttttcgaaagttttattttggggcgtttggttttttgctttttaaattatttttccaaaaaaatatatttcattgctaaatctcactttaattcctcactactttttcatacagaaaatggaacatttttctttctgcgcattaattattgctatttttgttggcgctacttttcgtcacttttgtgttgcaatggacaacagtagacaaaactcgctcaaccacatgtatccaaatctgtttgggagtggggggaattcgtcatcaggaaatttgggacagggacagaatttgtacagcactcaatcatcatcagttggtcaatacggaacggcaccattgcaacaatatcaacctatgccatcatcacttggtcaaggagcagccacaagtggagatatgctgcataatgtacaaatgatggcaacaaataatcagcaaattggtaccagcggaagtggcagctacaactattttaaagatcaaaaagatttgtttgacgaggtcaacccttttgcctcgccaaatgcatcatttgcacatacgcatcaggaagttgttcagcaacaacaacagccgcaaacgcaaacgccctcattgaatgcaatggttcaacaacaatcacaacagaaacaaaagctcaaaaagaagacgacaataaagcaacaaagcacccttgccactgggcagatgggtaatttgtcaattaacgagtcaaatacagcctcttcacatacggctgtgccagtgccattatcatcacaagcaaatcaaccgagcattcaaacctcgccattacaacacactggaggccgtacaagcttccaaaatttaccaccaggaggaaatcaacagtcgcatccacaaatgttggcgcactctccgctaggcaatatggctggaagcactagcatgggccacgcatcggcgggacctattcagggtgggcaacatccgctaggcaatatggctggcaaagccagcattggtcaggcttcggcactgccggcacaaactggacacatagggctatcaccgcttggtcaagcggctggcaacaacagtatgttcaataatgcgacaatgatagcacagcgacagcacgcccaaatgcgaacacagccgaatattcaaacacaaaactcattggcatcaaattattcaaattctttttgtacaccacaattaaacaaccctactggaagaaatagtaatgcgacaatgatggcacagcaacagaacgcccaaatgcaaacacagccgaatatgcaaacgcaacatacaatacaaaataattcgcaaatgcaaaacattcaatggcaa

SEQ ID NO: 11040 - DNA, 2491 bp, Heterodera glycines
tgtaccccgtaagtgccctcaaaaatcacttaaaacccgtttttaatgccgtcgctggcccacatcacttggcccgtgccgacaacgccgagcaccgagcgcccgtcgggcgcaaccgcgacacgctcacgcacccaaagtgcacggcacggaatgggcacgcggaggacgagcgtgccatggcgcacggatgggacgatgacaacagcgatgagaagcagcaaaaggaggaacagggagagaaggacgggacgacgacgaagcggaagagcagcaggagtgccaggaataacttccggaagagcagcgggggcggaggacggcggcagaggggcggggctgaatggagagggcgctaattaaaacgagggcactacaaaaaacaaattcaaacttaaaatttttctacaaaaaaaaaattcttttacaaaattattttgtaagaaaaagtaaagaaaaattccagtgatttttggaatttttatgaaaaaagtaacaattagaagtaaaattcatcacaaaattttgcaaattgctgaattttttttttttgaatttcgggggacggcgagggagaggtgaaatgagctgccattagagaccggaaatttcaaatttgcggatcccgctgcggggctggaactcaaaattttttgcgggacgggatcccgcgggattaatcccgcattttccaaaaaatgcgggattgcggactgggatcccgcaaaatcccgcgccggtctctagctgccacccaaaagtcccccaagggagaaaaaagtggagattattcacaaattatttgccataaaaaggtgaaaaattcattttctttttttttagaaatcacgaattaggagatgtatttttagattaattggagtatttgcaatatttctttttgttagttaaacaattatttttgttaaaaaaaccttattttttcgttaattttttttttttgttttgggatttcggaggagggcgaatttattgttatgtaatattttgcaacccctttgctcccaaaattttttttgggaaagcgcgccgcttctcttccctccaaccacctgtcaatcatgttctgttgctgctcctccgtctccctcaactcttcaaaaagggacttctccaccggtttgccgttgctgttctgctccaacccctcctccgacggttcgtcgtttctgtgctgctccaacccctcctccgacggttcgtcgttgctgtactgctccaacccctcctccgacggttcgtcgttgctgtactgctccaacccctcctccgacggttcgtcgtttctgtgctgcaccaacccctcctccgacggtttgttgctgcttaatggccacaattggtcaaaaagtgacaacaattgctgcggttgctgaacccatccgttgtttttgtccatgtactgcttccactcctccgtcccatcatcgtccgcctcccccgtcgtcgttgtgctgatgcccgaatcgcgcggtcggaaaaactcatcatctatacagaaaaaacaaatcagtcattataataccgtgttgaaaaattccaaatcaaaaaaaaaagggattgaccgaggatgggtcattttgtttggcatgtaataaaatatatgtaaactttttggtgcctacacttacccccccccccccccttgtccccttgtcgtaggggggccggtgtaaaagaggtagatgtagtaggtaaaaagaggaaaaattctgaaaaatttgggcgattttctttatttcattgtttgctccttggccttatgatgtcagacagaaaacgaaaaaaaaaaaatttctgcaattcttggcaaaccgttgcggtgctgaaggcaccgccgggaaatttttttttggaattatcaataaaatttgaaaaaacgcaaaatttggaattggcttttcctttcctcttcttgttccttttttaggggggggggggcacgcgagctctattttaatgtggacgacgaccaaaacgaagcaaccccagcggaggatctcaccatcgccacgctcgtagcacaaagggagggcactccctgttaaaaggaaaaatgacccaagtcggtgcttaaccgctgcaggaaatgggcaaaagttctccgcgtgactgcctgggacaggcgattcaccacgaatgctcgaaaacgctggcacaggaagcaaaaagtgagagcggaaactcccagccttgacacgggggaaaaaagccgcctgcggagcaaaaccaaacctggcggacaatcgttgtccgacccaagatgcgacgacctaacaagcgcccaatggacggttattcgtcgcagtccagctcactagccaaattcaggacaaaattcgggcggaaaaggatgaaaatgaggtacagagactgctcagccggatcggatgttgcgaagaaacgtaagggagccaaacagtgctactcccgagagggacaagagagggaggcactcatcatctatgac

SEQ ID NO: 11041 - DNA, 3041 bp, Heterodera glycines
ggtcgttgatcacgaatatggcatccatttcgattaattcggcatcccggcaccgaatttaaacaaagtcaaaatttgaatttcgaattttagttcgaatttgggttccgggttcgtaataggttaaaataattgtcatattcgtgatcagcaacctcgaaaatcctcgggtacttgttttcaggactttttaaagcgaaaaaaatttgaaaaattagaccaaaaaaagtgcaaaaaattttcaaaacagggctctttgtaaatagcgtcaaaaatttttagagggggggaggtaacaaaaagggtaagtgccccgctttcattctcccccccccccccctcccccgtcggtttgccacctttttcggcaccctgcgaacagtagcagcaaaagcagctaatttgcgcatttcctctgcgtcttcttccgctctttggaggtgttctttgagttttttgatttcgtcctcctgaaaatttaaaaaaaaaaatgtaaaagctgaatttgatttgatgggtcgaatgttgcaatttctatttgcactgaattttcgttttttgccgcctgaaaatttcattttttcgacccctccgttttttgccacctttttttccttgtcccttttcaatgctttgatttctttcgcttgcgcctccaaaagatcgtatctttcttcgtcttcttcctcaagcgacttaataaaatcttcttttttttgtatttggtttttcaaattttcaatgattttgtctttgtcgtcgtcagccataaaaggaaaaaaaattgaaaaatggctaaaaacgggggaatttaagacggtctacgtcagttcgggttcggccccagcgaatttttggactataacttttttctttatcatccatataaaacattgttaggtatcattcgaaagcccttcagatgctctattagcctgcaaatttccaaaaaatttcgtctattttcaacaaattttatgaccaaaaaattaggaaactctggtcttttgagttcttctggccataatttttttgaacctttacgaaatttttcaaaattttgcaggctaatagaggacatttacagcttccgaatgataccaacaatgtttgattttggatgacaaagaaaaaagttatagtcaaaaaagtggctggggctgaaccgtgcggggccgaactgacgggttccggatttaagaggcacaaatttgagtttaaacagggggacatttcatttttccataagggatgcggcgatttaagcacttaaatcacggatcaatgaaaatttgattttctttgttcaaagttttggaaaaaacatgagtacatttgaaaatttgtacgcagtaaaattttcttgaacttttacctggaagtaatgtaaaaaaaaaaaaattgctgaaaattcaggtgtttgtatcttttgtatcgactcattttttaaaatagaaataaacacaaaatcagggacaaatcgatgcaatttcaaagaaaattcgaacttttcaacacaagaattctttttgtttgtcaatttaatgattttgaataatttaagaaacaaaaaaaaattagaaaaaaatttctgatttttcgaacaaaaactttaaattttatttatcgatttgacccggtgtaccgacatttcgccaacttgacatctcgccaactgacatctcgccaactcagccaaaaacattcatttcgccaactcaaccaaaaacattcatttcgccaactcagccaaaaacattcatttcgcctactaagccaaaatttgacatttcgccaactgacatttcgccaaatagttaaaaaaattaaagaaaaaaagtaaaaagagtaaaaaaaatgctgtgttaatatcaaatacagccctattccagtttacacgtccaatcagtgaccatcatcatttcttatgtcctgttcggcgcgctttttcaactattgtcagcgcggcaccgcttggagttcaaggatggctggcgtattttgccaaaacctacattggcaccactcaattcgagattgatcgcggggcggagtcatttgaaccgcatgctgatgtcggacactttcttctgcgtcgcactcgaagcacaactcgtaaatgcacctattctgtcatgaaatttatgaaattttcaattttagcgttcagtatttcccaggcatccataatgacaggcagtggaccaatacaattcggactgcattcgccacaaccttcaactccaaccattccattgtcagaagaaagcagcttgcagcttattccacgctgggaacaagacatcgtctgtcctccacgtttcccgatctcgttttggaatgtatacaccagggctcaaatggcaattgagcgaacgaacaacggcatggaagccgcgcatggacaatttgcagtaaaaaatttcatcggaaaacattattttttggtattttcagcgtgagctcaaccatcatccatcattgagtgacttcattgctgcattcacgaaggacatcaacaaacagttggacatcggacgcgcagaacagctccagaaaagcactaaacgacgacaacggtacgtcatcaaagaacaaaatgtggtgcggatccttgacgaggccgactttgaatcggaagaaggattgacaaacgcctcgcatctgatcgggctcgtgatgcaagtctttgcggagggacttcacgtccgtggaaattcagagagtggtgaagaaactgaggccgatgaaaattgatttaaacattttcatattattgttttttttattgatattttatatatgttatgaagatttctttgcttgaagcacttttataataaatttaatatcattatatagttaaaattcaattttcgactagttggcgaaacgtcagattttggctgagttggcgaaatgaatgtttttggatgagttggcgaaacgtcaggttggcgagatgtcagttggcgagatgtaaagttggtgagatgtcagttggcaaaatgtctgattttggctgagttggcgaaatgaat

SEQ ID NO: 11042 - DNA, 1030 bp, Heterodera glycines
tgagaattaaaccccactttccgcgtcttaaaccgtccagataacctcttccttataataatatcccatcgctaccataaaaacttatgaatttgacttaactcaagagattgctggtgaggcaatattagcgccgcatttgtcctgtgttgtgggaaggttgctttcattttcaataaatgtaaaaatatattttttaatctaataatcccaatcatttggcataaatagtatctcaaactaaataattatagcaaaattacataaaaatgacctaaaagtaaaaagaagccaaaatatttattcatgacataaaaaaactcattcccattattttatatatccatttactaaattgcaaatttaacatctttagaattaagtaatccacttgcatctgttgatcaatcagttcacgacattgacaaatggatgttccagcttaaaatgttcgggctaatcaaaatgggatcaatgctaatgcctaagataaagcgtttttgtctgatcagttatcctgccgcttcccgcgttttccctgaaatttgttcggtcttttccttacctgctgatggtcccaaatagtgacaatacaccagtggcccacaggggctaagtgttaaaggaaagtctttgaaattagtcgttgaatctgacaaaaaagccgaagaaactatgtatttgcgagactaaataaatcaaagcttttgtttgatatataagcttaacaaaaattaaaaaattaaataaatgaattaagaaatgttttttataaatagggttataaattaaatggactagaaaacacgaaatatggacataaatatggactaaaaaagcccgaaatatggactaaaaagcacaaaaatggccaaatatgggccaaattatggactaaaaactgccaaaatatttgttttaaaccctaaaaattaagaaaaccctatttatattcaatatttgcttaaacagattaaaaatacgctaaaagctgccaaaaaatggatttaaccataaaaatgccaatttt

SEQ ID NO: 11043 - DNA, 1783 bp, Heterodera glycines
taaaaaaatttaacgtagtgctatttttgtgcccctttctttatagcatatgcgtagaaaaaaatatttaatttataaaagtttataaccctatttataaaatatataaatatttaaaagattgaaatttcgtctgagcaaacaaaaaacaagcagtgaatgattttgacagaactacagaatattattctttaaatccaaaccaaaattcctccctttactttaattgtgacaattttttaaaaatataattaaaaatgaatggcacgaaatttatatattataggcaaaatttgtgtctttataaaaaaaattttcataaggccacctttgaaaatggccaaaatctttttttggcccaatttgtaaaggggagatgggactattgaaagaacttaaaagaaaatttttcttcaaccaaactttttgattttttcactttctaaaagcggcagtactaattatggtattttctagtagtgaaaaaatactttctgtcctatgagcggactgaaccaaggcgaaactgaagagactgcaagcttatccattaggccaatataaatcaatttgagtgcagccctcacggttttttaaaatagtggtggttaacaaatccaatattaattaattttgaaaaaatatcaattattctgacaattaatttaatttccctaatgagttaagagaagttgctttcgtaagcttaacgatatttttgcactcgcctcaattgagcattaatcttcctcccgagaaagcttcttttctcagtcgtagttttaattttgtaaattttgattttccagacaattaataaatgaaataaacgaaatagagatttcatattcatttattatgaaacaagtattttttcggcattggcgaatcatggaagttttgcactatttcacttcacgcggatgggttttcgagtagcgaaatgcgctcaaaatgtgggaacggttaagcgaagaggacaaaaaggtggtaaccaaatgctcacaattaagggatgcgccatttccgatagatttggacggaattccgttctaaaaccattgggataccggcggaattcaatttgcattttcgtctaattacggaattaacggcttcctgatgcttttcccctcactcattatttccgtaaaatactatttttaatttttaataatttgcgataaagtaaagaatgtcggttttttgaaatcttctgattattaataaaattttatacagattctgtcataaaattgtaaatttgttgccaagaaatggcattctgtgacatctgtttaataaacaaatattaatttaacaatgttataacaaaggagtcattttcggccatttatatttcgctaccgattctaaatttaagtcttttaattaaatttttaaatttgattatttaccaacaaagcgccgaccacggcaccgggagagcaaaaagaatgttcagatgggaaaaaaatatcagccattgcgaatgtttcaatcagttcagaagcaacattcttaatgtgaaaacgcagtttggaagaattgaaatttgatttaattgatttttcaccaaggtgtccaacaaaaggttcatcaataagccgaatctgatgccaatctcggccatattgcctttgttttgtgcggccattgcgtgtaattccacaaaaaatgcattccgatgcgctttttgctgatcagacaatggcacaaaacgttcaactaatggaagaagtacaatttttgtagcaaaatacacagtaaaaacaatattaaa

SEQ ID NO: 11044 - DNA, 1774 bp, Heterodera glycines
tgagtctcgcaaaatggcgtgtcgccttcagcagaccttttaaaaaaatgcagcgaagtaaatctccgcggcacatcactttcttctttgtccctttcattcacttcaaactatttcttttttctttctgtggtgcactaatgagaatatttcgaaattctgccttttttaataacttttcgccagattttgaattttcttgcagaaaagtaagaataagagaagggatatacgttctatttgttttcctgacctctatatggtctgaaacggacgaaaaacatgctcaatactgaattggcttaatttttacttttttgaatacgttttgtattttacacccctaaattgaggttttattaggggttggggtcaattccctaccgccaattccctactaacctcgtttccccctctccgaaccaaaaaatttttcgaaaattttcggaaaaatttcaaaaacagaaaggggattttcaacattttgatgtttctcgtgaattataagactataaattttttgtttaatgttgcagagaagaaaattaaaatacttctaacaaaaaaagaaccgtacaaagcttcaaaacaatgaccattcatactttttcacaaatcgaagtaaaaattttaaaatagtgttttgtctattttagcagctttatccagtctccggattcttaaatttgatcgtgaattttttttcgaatttacaattgatttcaaatcgctttataggacttccaggggcccgaaaattaggaagtaaggccggggtttaattattcaaatttcatacaagcaggtactttacgaatccgaagtccctaaagctccgggattttgagcccggtttcgggttccccgggagttgcggaaatgggtttagaacctatttttaggagggttcaaaactcgaaaaattgagagatttgacacttctaacttttttaaaacgatcgaatcttgataaatttggtatcatccgaaagctcttgacgagctatctaaaaagcagtgaataaattttcttgtgtgttttactctcaatgtttatcaatattcaacacttttggtatggaaatggcccaaatgccttagtagggaattggcggtagggaattggcggtagggaattggcggtagggaatcggccggtagggaattggccggtagggaattggcggtagggaattggctggtagggaattggcggtagggaattggcggtagggaattggccggtagggaattggcggtagggaattggctcggtagggaattggcggtagggaattggcggtagggaattggctggtagggaattggcggtagggaattggccggtagggaattggcggtagggaatcggctggtagggaattggcggtagggaattggcggtagggaattggctggtagggaattggcggtagggaatcggctggtagggaatcggctggtagggaattggcggtagggaattggccggtagggaattggcggtagggaatcggctggtagggaattggcggtagggaattggcggtagggaattggctggtagggaattggcggtagggaatcggctggtagggaattggcggtagggaattggcggtaggaaatcggctggtagggaattgtcggtagggaatcggctggtagggaattggcggtagggaattggcggtagggaatcggcgggtagggaattgtcggtagggaatcggcgggtagggaattgtcggtagggaattggctggtaggaaat

SEQ ID NO: 11045 - DNA, 2036 bp, Heterodera glycines
ctcccccccccccacaaagtgtcagtgtccaagcctattcagaaacgttaatgtgcggcgaacaggaaggggataaatttgtttgggacacatcaggcagcgccacagggctactaaattaggggagacgagtaaatatgccgcggtatttggcaaatgaattaggaaacgggtataaaacaattcagaacaccgaaggggataaaaaaaaattgaaaatttaatacaaataagaaaaaagtgagagatgtaatgataggtaataattttcacgggatttatttaaatttttattcattaaataaaaatagaccaaaaaaaacccataaattctttttttttatcacaaagaataatacagtttccccctataaagaccattattaaacattaaacgggttttgttgaccatgccgaaaataatgcgacaaaaatttcacctacttagttatgagggagaaaaaggcaaatttcccttcaggggcggacaggtggcggcggcacacaaaaaagttgcgccgcaggcaattttgtttgccactttttttccttccaattgttcatcaaccgccgccagcgccgcacccatttgtacaccacaaaagtcagcgaccgcctcggctcaacttaatgcgattcatcgatggaggagggagttggggacggatgtgtgcgtgctttaatgcaggcggtcagtggcgcggcaaaagcagccaacactttacagccgcccgcgtcggaccctagcgctgggggctgggtgcggacggcggcgggcggagacgggggaaagtccacttgaatttttgttatggatttgaataggtatgctttttctctctaccgccccgctaaccggggacgaagagcggggagcggtagacggggaaagtgatttgaatgggtatgcttttcctctccaccaccgcggccggcgacggggagcggagcgggggcgggaggagacggggaaagcccacttgaatttttgtgttgtggattgcaatatgcttttcctcggcaattatcatccacgttgtgttgtcccctcttccgccgttgatgatcagccgatcgttggaagacgatcggtgctggactgaaggatgggaagaggaagaagggcgggaaggaggggtgggggatacacacattctgctggacaaatattatatttatgatagtttcttccgatgtgacggaggggagggggaggtgaatggtccgcgaaaggtgaggaagatgagatgatgatacggatgattgggatgggaaacaaggagacggaagtggcttgagatgtggcttattcgtgttttattgtttaaagcaaatctgccagaggctaaagccaaaaaaaaccggcaaaactttttgataaacccggaaaaacttgcaaataacaggttaccccaaaatggtgaccctgtgcccttgattcagggatcggccagccctaacaaaaagctaattttgcgcaacgcggagcaaaaaatgcgcccttctagcggttgtgatcccatcagaagatgaatagtgaaaagggatgtggccatgggaaaatgccttggattaagtaatcaaaaattatataatttggacgaagataaataatcgcttaactaattttttcggatttatttaattgggactatttgtttccattgttaattgtttgttgttataaaaatatatatataaaccatttttaaattaaaattttatttgttcgtgtgccatttgttatcagttattatcatacaattgtttcccgcttgaccatttttcgaattaaacattactaattgatttccattatcaaaaaaatgattaaaatcggggacgaaaagatgaaaagcaatttctccgattaagcatcgacatgatgaataataatcaccaatgcagctgagcaaaaacatcacacatttcattcattgcccgatcagactgatgactgttgagactaactgtcgtcggtctatggaaagaaccggcggcggggaagggggggggggggggggctatattggaga

SEQ ID NO: 11046 - DNA, 2257 bp, Heterodera glycines
  misc_feature (2222)..(2222): n is a, c, g, or t
  misc_feature (2244)..(2244): n is a, c, g, or t
tggtcaaggggtaaataggaaaaatgagaaaattcgacgaaaactctctttcgcggggtaatgggatgggtaggggggggggtaaagtgcttcatcgaataaggggcagcttattgccaccgattcgatggggggagaggggggggggtgaaaagtgggggcaccggggggagaaagagacgcaaaattggcggtgaataggaaaaagcgatgtggatgaatggaaaatggaaaaaggtgatgatggaagaaggaagattcacaatatttttttttgttgagctttaactttaagaaaatgtttccatttttatttttaaacgatttttatttttttgaattttatatttaatacaaaaatggaaaatcgttgcaaattctgctgttgggttaagaaaacaaaagaaaatgagtaaaaaatggtggaggtaaaaatgatttatgagactgaaaatggaagatggaaaaaatggtgccggggagggaaatgaagaaaattttagaaaaaaataatcgtgcatagagatgattaatgatgaacggaaaatgaagaggaatgatgaaagggtaaggggatttttatgaaaaaaattttggtgtgtgaaaaatgaaggtgagaaaaaggatgatgatgaattggtgaagtaaaatgaagaggatgaaaggaaatgagaagaatagaaaattataaaaaaagggatataaatttggaggatgaaacaaatccaatacaaagaaaaatatggcttaaggagaatttgttgggtgaaaatggaggtgggaaaagggatgaagatgaagtgaaatttttgagggaaaacaaagaaaaaattatgacgaatagaaagatgaagaaagaagaattgttgaaagaaataaattcaaataaaaaacttaggatgtaaaagaaagtgccgattaaaaaaacggcactaaattggtaggaggaaattaaaaggaaggaaaatggcttagaaaggaagaagatgatgatgatgaattgatggaagaacaacaatggagctggaaaggttgacgatgaatataatgaagagggataaacactaaagggatggaaagaatagaaaattggcaccaaattttggaaggaaagatgaaagaggaaagggatgatgacgaagaagaaagaattgactggaagaaaaaaggaacaaacaaaaggaggtggaaaaaaaggagaaggatgatcaacgaggaagaggatgaaagggaattggaagaaagaatggaagagaaaagaaaatcttccaccgccgatcggtgcatcaaataataatgggaagaatggggagggggaagagattagacagactttggggcgccgggggcggcggatgatcgccctttgggaatgatgaatgaatgaatagactgatgtgctgctattgatgtgtgaagtgaagaataactagcaaaaagtaacaccacatcacccactttataagtgttttctgctgctgatgggttggggacacaattggcaatttgtgagactaatgactaatgatgatttagagagagagacccccgcttggggcgggaactgttttttgatggtgcggtgaatgtatggagaaaaatgggagagaggaaatgaaaattgaaatttgtaaagaaaatgatttgtatggttgcggtaaattcaaactaataaatttaatatttaattataattagaaataaaataaaaataaatgagaggagaaaatgaagaaaatttaattaaaaatttttttatgtttgaaatttatttaatttgaaaatattattaaatttatttatttaattcgattagatttagaaataaaatgaaaattgagaggagaaaataaaaaaaaatgaaaaaaattataaattaaagtatatctgacgtttagtaaatttagaactatttatttaacaattaattataattaattaactgaatgtttaaaataaacggaaattagagagatgcaaaatattaatttaatatttaattagattattaataatagaaaaattgttgtgttaaatttaaaaatgataacaggaaaaagctaattcgacatatcattttactgcgtacatagtttaaaaaaaaataaaataaaaaatgcccttttatatgcaaaactttaaacacaatatgcaaagatttaaaaaaaacccgcctttacacagcatttgcaattttcccattcccttaacattttgcccanatttttcattttccgcttccgnttataggatgacc

SEQ ID NO: 11047 - DNA, 1570 bp, Heterodera glycines
atgccatagtcgacaaatttaatgcgcaaaagtgctggtcgattggcattttggagactaaactggctgctgaccaggccaatggcgaaatttgctgtttcgctaacgacaaaaaatttcttgggaaatttccaatcgctgaaacgccgccgccgaagggattgaaggaattcaaaagcatttccctgaggtgatcagttgtgccacattttacaaaacactaattattcctcttttaagttactttgatagcactgtccttcaatttattcgcaatttgcggactctcttcgtaaagaatggcattaatttggttctgagtgtttgcaattacacgtgcggccgaacgccaaagtggtggcccatctcatcgcccgaagtttggcctctattggcacagaatgttgttaggttaaatttttcagaaatgtaaagatattttcaataatttaatatacaaagaataggtcgaaaatccgacaaatactaggttgaaaatgcttaggtatatccaaaaaattcggatgggcgcacctctgacggcatttcttcactatatttttgatattcgcattttaaaatggtaaaataatgccttttcattgtcagattggcaattttggatgactacgacttttgcagtccaattgaacgtttaccagtcgactttctgtgccaatgtgtgaatctttacctgatggactcccgggttggttttttaaccgaatacccaactttaaaaaaaaatttaatcttgaataaagatctaacttttgggggatttgctatcgtttctctctttttctgaatttgggtctcccgaaaatgacaactttgacttagagtgctgtttttagggtacaatctgaatgctttctccaatatttaaggacattttccccgattcatcgccggtcaacgccgtctcttcctctccaatttcgtctgcccatgccctgtggcaatggttgcattcgccgcggggggacgggcgacctaagattttgctgtgccaggaaatttggtcattcgctgacaaaattcgggaactaaaaacggtaattatcttaataaaatatgaatgtctccgctaataaaaaagattgccggctaaattgcaaattaaggcattttgcgacgcctctgcccccgttagtttcatcattcgtttgtctttgagcagttttgctggtatgtggcattttaaaaatttctagtatttaagacccccaaacatttgttgttttctgtgcaggtgaacagtttgaattgcgcaatgatcggaccggggaaatgttgagcatggaaatggtcgcgacagaggaagacggagaaggacaacaactacagcagatggaggaggaggacaacgacaatgccgacattctgacccactacatcaagccggagcgcaatttgtggttgttgaagcgtcgtccaaccgttgggggaggaaaatggcaaaaacagtgggcccaatgggaggcggaggcaatcggatggaattggaccaatgcatggaatgtgatcgaagttgccaatgaagaggacgtggacgtgatcgaagatg

SEQ ID NO: 11048 - DNA, 1321 bp, Heterodera glycines
  misc_feature (1205)..(1205): n is a, c, g, or t
caatttttttttcaaaaaatccgtttagtgaatgtttatgagcctggccatggcatccctttgcatttggacgcccattccgcctttgaggagcccatttactcgctgagtttgctgtccgacgttgtgatggaattccgcgactgcgccaacagtgcccggcgcgcctctgcgcatttgcccaggcgtagcattctgtcgctgcgcggcgatgtccgatatcggcacaagcacgggtcagtcagcagaaaagcggacgaatgcactgaataatcgggggagctccatccgggaacagctcgtttcccccaccccccgccggtcccccccccctcccccgaaaacttagaaattttttaagaaaaaatcttattgttagaaagttttttcttaagaaaattctaagaaaaaaatttttttgagaattttcagcgatttttttgatttttttttgaaaaatcgtagtaattcaccataaaaatttctcgaaaaaatttttttatgaaaattcttctagctaaagtctaattactaaaaaaatcagggggcataggatagaaaatacgaaaccctatctaattcagattagtaattatgtctaatttggtccgagtaattctgggagagtggaccatttttttcaactggaattgaacgacaagtcttttaataattcaaaatggccgaaacgtcgtttctgttctccatttctcagaattctgacgcgtcagtacgacgtccatccgtcgtccaaccgtttgctgaaacggcagcgccgaatttccatcacttttcgcactgtccgtcgcgtgccatgccaatgtccgtacgtcgaattttgcgactgggaccgcgcgggtaggctgagaattccgagcgaagagtgcgacgggagacaaatggagcagcgatatgtgaccaaggtgggcaagagaaagttggttgattgccgatggcaattttagcaagttaatgacgggacgggtggggcacgttcaatgaatggcaaataatcatagacatgtacaaatcggggcataaaattcccatatattttgccattttccccaaaaaaggtgtatgatgccattgcgcctcactttgacttaactcggcactccaattggcactgtgtcgtcgcttttttggcctccctccccagcggcgcttctctgctcgacgtcggctgcggaaatggaaatatntgttgcattcggacgcactggacaaggtgggccacgacatttttattctttattccattaccctaattacgacatttttgtaaatggattttactgagaattgggtacttttttga

SEQ ID NO: 11049 - DNA, 1337 bp, Heterodera glycines
ggaaataaatatgaatgatttatttgactggtttgaatgcaaccgatatatgctggtttttttaaataaatttgtcctttccggtccattacggtgtatcagatctaagctatggcctcaaaaagcgaatggctgatttccttagaacactcactaaaattcttaaaattttgccgctgcggcacttatcggcaccgccggcccctaaatttccttaaaaaattgctcacaaaattggtcattttttgggaaaatcttttaacaaattgcgctcaaattttcaaaaaaaaaaatttcccgtcggcgtacaactccaacgatctaatcatcaacaacatcctcgcactgacaacctattcctcgcatttgacaagttttatgaattggctctgtaatgtggtcgaaattacagataaacttttcactctaataaatgtttcagcatacgaaaattagttaagaacaataattctaatcgttcgggggaggggggagggtcgagtggaaatgacacacaactagggttatcgctcgcttattttactgggattctttagccaagcttggctcaaatacatacaataaaattgatatccattcaaatgccaaaaaataaatacctaataaaaaaacattccaaaacatttcctctcaattcttcgatgaacatgccgcgcgggtctcgactaaaactttatgaaacagtactagttttgcccaattgtttcaatgtaccctcagtcatgaacaatgtggcccatcctttttcgttcatttttacaactttgtaagttgccggcattgtcagaaacacttcttgcaaaacagtaaatggcaattttatcgttctaatttgcaaacagtgcatctccaattcgggctttccctgctaaatttggaaattacattaaaataaactggctaatatttattaaaattggcgacggccaaaaggttttcttatgagaaaatcgaatttttttttgaaaattccccctccccttaaccaaatatccaagcgtgtggaggccagagtggcgcagacccttgcacatgtatagtctcaccgatgttcacgttgtcgatatcttttgaacaggctatttttcaaatgcccattttaacacgcgtccaccaacccagtgaagtggtcagcgacctaaattttgtcacgctggtttaagaataaattaaatttgattaaaaatcccagccatcatttgtcacttctacgtatagctagaacacataggatagggagtaaaaaaacgcaacatgattcaaactgggcctcttaaggggcgcaccaatgattgtgaacaccgaaaaaatagaaa

SEQ ID NO: 11050 - DNA, 2764 bp, Heterodera glycines
  misc_feature (2730)..(2730): n is a, c, g, or t
attttcttttttgaatatttagattggaaggtataaaattttgaaaacgaccaaaaattccaattttctagcgcatttaaatggaatatgcaatcagaaaatatttatacattcatcgttcattttatagacaattttcctctttgtaatttagaccaaatgaccaacgaaaaagactctatttggttttattttgacaaaattcacaattcttattttacaaatgtgcgatccgcggcgttttttgcgcgatccgcgaccgcggcaaattgaatccgcgaccgcgggattttttttgcgcgatccgcgaccgcggcaaattgaatccgcgaccgcgggatttttctgtgcgcgccccacccctgttgccgacttgatgaaaaatctggtcaatagcagtacaataaaatttttacgaaataaagtctaagcttagggctaagcctaggctcaatcctaaacttaatccgaaagcttatgcatattctaaggcttttataaaaatgcctgaccaacttcagtttcttaaattgatatttttgacacgcaaaacttaaaaaagaatgcttaggcttaagctgttcaattcatatcaaatgtgtgttttatttaaatgaaagaggtcaacaaaagcatttcggagagaataaatgagagaatcaaatcaaattggtgagaacgattgtttctcaaatataattaattaatttccacgcaattagacgacattttcaaaaaatcactcattccgttaatccacttggcccgggagtcgtcgagaacatttcaatgttgctttgacacgcttctttttctttcgtccgctgggggcgacaatggcctaaaattaagagcaatttgaatcgggcatatatcaacaatttgacaaaaattcgcctaactaacaaaaaaaaaaaagagtattgaagcgaaaattaaaaaacatagacatgaagaaacagcagacacaatgagtcagagactacattaaaagttaatgaaaattaaatgggcgcccccacaaaaaatctcagcggcacctaacggatcccttttaaagatgattaggcagctcggtccctcctccatacatttcaatatctaaataatattaatttggccacatttttttctctttctcccctctctttaattttcgttaaaaattaatttttcgtcatttttttgtgtgtatttttttatgttttttgggtaatattttttctatttgttcatttctgcaggcacggattatgtgatgtatgtgctaattgttgcggaaaagccaactattgcagaggagattgcaaaaattttatcgaatggcaactacaaaaagctgagaggtgactaaattaattaaaaaataaaaacgagttgaaaaacattttatttttttgcaggatggaacagccatacttttgtttttgaatgccttggcaaattttatcaacaaattgtcactttccgaattacgtcgacttttgggcacattatgagtaagtcaaatggattttaacaaaccaatttaatatttattaatattaaatcgtaatttaaaattcgattacaatttcaaatttcagtaaaataactaatgaaaattcaaatttaattcaattttttgtcagtcgtccacttaattggtgctttaattcctgctttttagacacctcttttccccagaagttcacttcatggcaccgcgaagagccaaaggcgctgttcaagtgccccattgagccgagagtggccaacccaatgcacaatttgaatgaagtaagtgggtttttgcgccctaataacattttagaaattttgaaatataataaagtaagtcatggctcctaacaataagttacagaaattgttgtcggataaaaaattggtttgatgtatcacttattaggccacttttcgtcgaggtgcataaattcatttattttttttcaatctaacccaaaaattgaagacaatttgtcattttttggccaaaatctgttaataaatcagttttagacagctttatctcccccattttgttcagttcctcgctgccgaggcggccaattgcgagtttattttgttgtggttagattgtgacagagaaggggagaacatttgcttcgaagtgatcgacgccgtgcgcaaggaaatgtgcagggcgaagggactgacggaggaggaatttatggacagagtgttcaggtggacaaatggacgcattggggcaatgggtttctatgtatttaaatttctgttttttttttcattttaattttctttccccatttttaaaagctaaagacacaaataatttctgatagcgaaattccggcggtgaaattttggggtgcaccccttaaaaatgttagaccaaacgcaaaaacaaaatgccgccatttgcgtttcagggctcgtttttcatcgatcaccgccaaagagatcaaacgggcaatggctgatctgggcaagccgaacttcagcgtttcacagtccgtgcttgttcgacaggaactcgacttgaggatcggatgcgcattcacccgctttctgacgacgcattttcgggttttcaatttttgctatttttcaacaaaatttcattttttaatgcagcgtggttattgcgactttgacgacaattacgtttcgcttgggccatgccaaactccgactttggcattttgtgtgagacggcatgacgcaattggacagttcaagccccangccgtactgggtggtgcaagccgaggtagtcccc

SEQ ID NO: 11051 - DNA, 1679 bp, Heterodera glycines
aacacatttgttcaggtcgaattgccaaatggtggccaatcggtgacattggattggtgccgaacgaggcaatacagtcgcgaagctgcgcaaacactgctcaacaagatgaaagttcggcttgttttttatacgattcactgattatttcgctattttggttttacggagggggcagcggaagcggaacagaacaaaatttcgccgccaaatttttaaaaaagaacatttgcgcttatttgggaacattctaaaatataaattatgtcgcaaacgcgaaaaattgcgtaacaaattcattcacaagcatgagaaaatttgcattttatttacataatgccataatataatcaaaatatcgttgaaaattacaaagatttctcaaatttctttgaatttttttaaaacttttctaaatgttcattttcaaggacgtccttggcatccaaggacattttttattttcaagaaagagggcccaatttcaaggacgtccttgccattcaaggacggatgggaaccctgttctaatttattaacggactgtacaaatctccaattctcactcgagcatttaagtttaagctttttgtttcttttcttatttctactgcttttgcatgcgttcgtttttccctgttttttagagtgcctatatttttttcttttgaaatttccattaaatgtaatgcattgctcgccgattgggtacattaaacaccaacagcaagaacaacaacaacagcgtcttgctctttgtgttggcattacaagcaatgaatgccatttgctatttgttgatgatttgtccgccttgacaattcgtccccgttttgccaattgtcgttccggtcgatggtttcgcgttttgccatcgtcaaatcatcacagcatcaacaagcattcatcaaaccaattttctttgctcgacaatgaaaatgaatggccatttccgacccgttttgtggacaattccttcgcaaaatatgtccaggtttttgctaccgaaacgaatacaaagcattggcttagggggacagaaattttttggcactatttacaaagagcactattttgaaaattttttcaacttttttttggtcaaatttttttttgtttaaaaagtcctgaaaccaagtacccgggtgttttaaaggtcgctgatcacgaatatgacaattatttgggcctattaagcaaacttggcgctagttataaagtgatagattttgaattttatcaaaaaccataggggggacccttttgttttgtaaattttttttggataaaaatcgtgaatatacattttattcaccataaatgtgctgcatattacttaatattcatcatgatggggattcggatgataatcagcttgatgagctttatgcagatcaccaactcgttcaaatacatgcaaatgggaacaatgatcaccccgaaaatgacaatctttatgataacaataacacggataagtcaaaaataattgaccatgacaaggaattgcgggatcagtcccctgagctcaccaaagtgccagaattaaatggaggagagttggttgggatcctataaaatacacgaatcaccgaaaagcgacacccataaaaacaaggaaattaatagccggaaaagaaccttatcttaaagaatttaaaaatttaatgaagtttcgg

SEQ ID NO: 11052 - DNA, 3189 bp, Heterodera glycines
aattttcagcgcggtgtcaatgggagcgtgtcgtcattgcggaccgaagtgaaaatggtgcatgccgttggccagccgctttcactgcgcagcactgtcggccttggcattggcggcggacttgaggtgaacattttgtggaaaatgaaggaagcagtgggcgggggagggggggggcaacaaatcgtaagaacaacaaaaaaattgcaacaacatccccctcccatgatttaggcattgccgcgccgtgttcgtgaggctgttgcacaagtgaatgcgcagcaattgcagcgaatggcgagcaaacaacctgaattcgcgacggtcgtgccgccgattgccgagagcggattctcgaacatccattggctccttttggaatggaccgccgatatggttatgaagtgagttagttggaaaagggtcaaaaatggaattttttaattttaatttatttcaaattttacagcagaattgttgggctcgttgtgcttgccggcccattcaccacccaaagcgacatcaacggcttcgacgttcggctgatttttgaccagcagaacatggaccacgaattggcaatgcatggatggcaagaatgcgtggcgcggatgaacaacatttcgccgggacaaatcgtcgaattcacgcggctgaaagttcgtgaacaagggagaaatggaaatgtgaaggggagtttccccttcacgttgctgtacaacggcgagtcgcgccaccgtgtgctcggacaggcgcctacggcggtgacaaatgcgggtgagcaaaagggttgcgattttttttggggattcttatgactcaaaaatccaattttctgtcccttttccagtgtgttctccgaatttcaacacgcccatcattgttgaagcaaatgatcaacaccaacacagcagcagcaacggcacaatcattggcggcggcgaccgggacggaaacgatttgaacaaccccagcaacaatgacagcgccgacaatgacgcactgccggcacaactgaccaatcgcccggaccaagtgaacattagcgacattggtaagttgagcggaagcccgatcacagtaaaatgattgatcaaccgcccccccctcccatttcacaggcgatgagcagcgcctgcgcatccaaagcaacaatgaggacgccgaggacgacgattttgaccgcgcagggcacagcggcggcggcagcagcacgatgtcaaacggtgcgcttttttcggccatggcagcgccgggcactgttgttgtgcgcaatgaggacagcggctcgtcatcggtgagcggccaatgaagaaaagaaaggaaaaagtgacgaaagacaagaaagaaaagcaaagacaagaaaaacaaaaaacacataaaaatcaacatacagacagacacacacacattttcatacactcgcatacgcacatgttgttttttaaattttaaatacaactcagtcaaatttttgtgctttctgttgttttttgtccttttcattattctagtgggcagggtcagaggggtgattgattgttttttgtggggttttttgcggaaagccatgcgctttttttggatttaaattttgttttgttcgaaatcatccaaactggacccgttcaggcgtggctttccgcagcacgcccaccgccacgtagtcggcccgttgcctctacgtctccgtcgccctcgccacggccaaattcgccatcgctgccgggtcgctcctcgcctccaccggttcgcgcatgctctttgactgcacagcgcactatgaccgccattgtgcagcgcatgaatgtaattgaggcggaagtggcgcgcgacgagcgcctttctcgcgagcgtgatcgccgccgccgccgccgccgtcaacttctgcaagattgcccgcgctccacaccccgctcgtcgcgcggacaacacagcggacagcagcagcaccagcagcaacggcacgaaaatgtcatcaccattgagtccgatggcgaagaagcagcactgctcggtgttcaacagcagcagccgcttgcgtccgacgacgaagtgtactacaacgacgaactcctcacgattgaggaccaagtggcgcaggggctcgtggagggggcggccaacgaggtggtgatgatgggcaaccacccgttggcagccgccgaccgcgcctggctcatctcgacggcgttcaacctgcgcgcccttccctcgtcagtgaagggcgttgtcgagctcgacgaggaggggcgccgcaacctcgcctgttgcatttgtagggaatggttggttggcggcagccaacgggtggtgcgcccatcgtgcgaccatttcctccatgtcggctgcttcgaggctgaagcgaagcttcgccgtgtgtgcccgctttgtgccggccacttcatcagcggcaagcggatgagcccttagcggctaccgatgaaaaaaaataaaatttattttattttaattatttttaaattaaaaaaaaatttttcattttaattatttttaaatttataaaaattccattttaatttttttaaaacttgttcaattttatttatttttctttttttctccttgatcaattgttgtcaatttcaacttctaatgccattttaataaatttctatttctttttttcaaattgcatttgttccttttgtgtgtgtgtgtgtgtgtgtttcttatgtgattaggacgtatgaattcaataatttgggattgggggaagaatttggtgggggaaaatcgaaaaaggggaaaaggaaaatgggtaaaaaaaagctttgcatttatagtgcaatgcttggcgccaaatcgggcgcggccgtccgccgatcaccaaccggtccgggaacgacgacaataccagcagcagcaacactgaaactgccgccgtcacaacagtaagcgccaacagtgggcacagtgacgaccgagccggtgcccgcgactcggacgggcagagattggacagtttctgcaaagtcattggcgcctgggagcgcaccgaatgccgcagccgcaacacacgctgtgaggcggttgaggtgtcgctgcgcgggtgggagggggcgcgccgccccgacacactgttggcccgctgcattgagcatctgctgcagcgtgtgctgtccggcagtgcgccgccgatgcgcatcggcatgtcgtgccaaccac

SEQ ID NO: 11053 - DNA, 1193 bp, Heterodera glycines
aaatcccgctctacacatatttggaccaaagtttataaaacatatattcgtcctcttttagaatatgctcctgaaatttggaatccgtcatacaaaaaagatataaataaattagaaagatgccaaaaatattttacaaaaattgctttatttaaatgtaggcttccatatataccttatgaacaaagacttgatttattcaaactttagaagaaaggagaaaaacaattgatttagttcaggcattcaaaattattaatggtctcactcatcttaaaaaagatatatttcctcagttttctggtcacatcccttacaatcttagacgtaaagttgtgttaaaatcacaatccagtaaaacttcaaattcttttatcaacaggacgaccttaatatggtctaaactcaacaaagatataacagatgctccatctgttgacagtttcaaaaaacgtataaataaatggattgagttaaacaaaaatttagtctgtaaaagagctccttggacttgatactaatttactaaaatctaacgtgtaagtggtcacaccttcgttggatattttatttcttctgaataaataaataaataaaatggcaagctttgggttttggttgctatcttgttaatcgttttaatttggaaggtcaatcccttaatttgaaatccaatctaaagaacgccagaacaaaaatttttaatttaaaaactataaacaaaactttaaaaagtgcaaaaataagaatcaaaaagggcacaaatgccaaatattagacctatataattgaattccactttttcatccaacgaacgattgcctacttatttatcatgacggaattattgtttttaactaatactgatcaaacaaaacatacgaaaaaagaaatacgtgagaatggttacaaaattgaagagttaatgaaccgaaaattgacattcaatgggacagaaaataaaaagtgaaggggaaaacgggagggacgcgagattatccgagacagtccgctcaaataggcgtttatgtgctcagccatggccatagcattggtttgtttctcttccccaatgccattccccgatcgaattatgtttatgcaatgggatagcaacgtttgctgctgctggtgggcgaatgaatcacgtcgaatcagtcagtcaggccccgacaatcatcgccataacacat

SEQ ID NO: 11054 - DNA, 2510 bp, Heterodera glycines
  misc_feature (162)..(163): n is a, c, g, or t
acctgcgcaaaaacggcaacttacggatcaatcgccagcaaccgatttcaattcgaagagttcagcaactgccgcgcgcccaacttcttccaagccgtaatcttcaattggctcatccggaacatgaacctcaacatttgatgtacaccccccccccccccnnccctccccgtcctatcccaatccatcataccatctaacaatgcttttacttgtaaaatgaaaaaactcccgcttttttcttttcaccgctgtttccttcaatttaaactcggcttcccatccgttttttgccttcgttgcattgtcctctttttacttgccattttcactatttggtacctgcaacttgctttttttcaaaagccaagtgacaaaagcatttcaaaagttagcaaatggagagtaatccaaaaaaatggcaaaagcacttggacaaagccgaggatgaaatgcgaaagagtgttcagtggggacaaagcactggtgcgacgaatggtgcgacgcagacggaaaatgagtgacccggctgagttggagatgaattgtgaggcgattaaagcgagacacggaggagatccagaacaagatgatcaaatgatcacaaaaatcacggagttggaacgacaaatgccaatggcattcgcccgagtgatttatacggtgagtgaccaatcgaccggcccattaagtcaaccgctcacatttcccaaggattacctcttcctggaggcggaattgctcgtcaattacgcgtccaataattggtactgttacgtgttggactcgaagtcctccactgtcttccaacttcggatgcggcaacttgcctcatgtttcgacaatgtgatcgtcgtggaccaaatgtttgacattgaaggtctcggggccaacatgaacaaggcggtgatggaatgtgtgcgtacgttgagcgacgagcgaaaacattggaaatatttggtgacgctgcaggtgaaatgagaagctgaaggaagagagacgaacgaacggctgactgtgttcagaaccacgatgtgcaggcgaagaccaacgcggaaatggcacagattttcacttggttgggcggggccaacgacgtcgaagtcgaattgcaattaccactgacgaagaagcgtttggaacactaccgaaaaaagttcaattggacttttgacgaactaatgctgtttaaggatggtgttgaccagaaacgagatggactaaatatcggaaatgcatctttcagaagcgatgaatcaccggactgacaaagaggggaaaccgttggcattggcactttccaaggggtacatggccgtgtcgttgagtcggcaatttgtggacttcgtggtcaacaagttgaacgttacgccattgttggagcaactgaacaaaggcttatttggagtggacgaacatttctggcagtctttgagctcaagcgaatcattggacgcccccgggggtttcccacacgaatgttttgtgaagggaattgatgagaaggacacgtcattcaggaagtacaagtacatcaccaggtgagcgacagggagagcgagggagaaggagttcacttataaaagtcacaatcctccactttagttcgcaattctcatcattattctgaaatttcatttaattgctgactttggacagatttgcgttgtgggccgacccgtccagcaaatgtcggagcggcaattggcgccacgccgtctgtgtgtttggcttggaagatttgatgggacccgacaacgaaatccgccgacttccccacctttttgtgaacaagctgatgcaagaattcgatttcgatgctatcctttgttggcaccaatggatgcgcgagaggctccgatcgggcagaatggagttggacagagatttttacaaagaatggcctcaggtggggggggggaggggtggcgagacgggaaaaatgaatgaatgcatgatcaacgaactgatcaaacagacgcggtaccaaatggagcgcagccgcctagggaaagaagcgggcgagcagaagacagcggtggactgcgaatcgggaattatccaaatgaaaatgaagagagagagggaaataagaggaaagcggaagaaagaaaaaagggaaaaagagcgaggaaaggaagcggaaacaaaagggatgggaggaaggaaagcgaaggaagaaacaaaagcagacagtgtcgtgaaccaattttgaattgtctgttttaattttgtaccaggaatgtctcctcccagcccctgtagcaagaagaatttatcacatttttagggtctttcccccatttccttttttttttacaaacgccattttaaacatgcacactgtaactgactgtataatgttacttgtatatttattggggcaaagcattattgagattaatgttacaaataagtagcaatttgaattgttcgggagaaggacagttgattgtcagtcaaaatagatttgtaaattaaaatggtcgttcaacataaaatcaaaggat

SEQ ID NO: 11055 - DNA, 4852 bp, Heterodera glycines
cttttcgaccaatgcccagctctttcagtactttctcctcctcctcttttgttaacgatttcacactttcgttcaccggcgtctcctcctcgaagtccaaaagtttttcatcgtcgcagtccatttgatcaaaggccatttggttttctataatgaattcggttttttcgggcaaatgcgacacattttcaataaatgaatcgacaaaagatgatgaaaaaggtggaataattttacagaatgaaatgcgaacagaattcagtaaagtggtgttgtaatttttcggagtttcgttgaaatttaagatttcatttgtaagtgtgtagtgtgtttccgatgtaatagcctagtgagtttaatgctttcgggccaaaaacgaaatcgtaaggaaaggaattattcgttacaacacaatttatttcacattcgaaatttccccttctcattggaacattaagcactccaattattgggatttttccaccagtaaaagaagcaacttcaaaagacaattttgaatttcctttgtttgggcaaaaaccccattttagcaaatccacgcctttttcgttggcgattttgtgtaaaaatttggggtttgctgcatttatttctgctgccgaatcgattagaccgatcgccttcattccgacaatattcacttccgtcgttggactttcagaacattcagcgttggcgggattttgagatggaaattcgtttgaatgtaaaatcaaagaattaaaaaatttttcataagttggaatttctccgtgtcccacgtgattaagggaaacggttttcgaatccgaattttcaggtattacttctttcaccatgatcatattcgattccttgttttgagctcttttgtttgactgaaacagaggggttctgtttgcacccgtggcttcgaaattttgagtgttttgacttgtgggaatataatttctgttttgaaaatcaaaatttcgattggaaggaaagttttggttttcctgtcggaatgcttcgtttctgaaaccactctgtcggtttggcctgaaattattttgcgctctcatcccaaagtttggaaaattccttgcaaaacgttgtccgtaatttgggttttgaaattggacagtacggttttgttgtgggccgggttgttgaaattgaacaggaattcccactgattcgtttctttcccggttttttcatcctcaataagactcaaacggttggccatcatcaaaagctcatcaaaagtttggtttgctttggtctggcattccaaaaatctggctaaattcacatcgtttatgtttgaaatgaagtgcttttttgacacctcatccaactggttttcgtccagaccaatgtatgagcaattaaccaaacgttgaattcgctcaccaaactttataatgtcttcatttggttttcttttaccattctgcgtcaattcggaaaatgcgtttgcctctttgtagtctgtctctctcaaaatggacattatttcggtttttagaatgccaaatgtcgcctcatttccaaatttgttcagcgcaatatgatacgctttcaaagcttttcctttcaactttgtctgcagcaactctttttgcttttctggtctccactctccggcacacatttgaacatttaggaagaaatccttaattttgtcccgaccttccgttccgtataggttcggaatttctcggagcgtatttgcgtattggtttgacagagtaactttatgtaattccattacaatatcaggaatttgattttgttggaaattttgctgagggacaaactcgaaattttgaacgttcggaaagtgattgggttgtggtgccaaattttcaaaatttggattcggtcgctgttgataatttggttgattgatattccgaaccggatgaaaattttgaaaattgggtccatttccaaaatctcttgtattctgaattgggtgattcaccccaatttctcgaccataatttggatttggaaagttttggttttgctcaccaaacatttcttcatatccgaaattatgagcatgccgaaccggttgtgctcttaattcccgattttgttcaaaatttattgcggaaaactgatggttgttcgtcatttgtgagttgacgaaaattcgagggttttggcggcgatgaaattgcatattttgtccatgaatctcattaccaaatcggttcgcatcaggattccgattttggttttgctcgaaattttgttgtcccccattgtatgaaatgtgtggtgaaccattttgaggggttgaatgagcccggggatttccgaaactttggacagcattttggttgggaggtcggaacattgcaagctgcatttgttcttcgacattttgttgcattcccacttgctgagggatactgttttcgaaatttcgcggaaatggatttgggttttgcacattgtccaaaatgttttgaggggccaaattcaaaccattgttttgttcagtgccatttcgtcgactgtggcgagaatgcgacgattcctcttgttccatataatttatcggccggcgcactcggaaattatatctttgctgaaaaccggttgactccatacatttctaaactttgaaatgaaaaggagaaagaaaaaattcaaaacaaaaatcctccacaattggtgttgaccaaatttccaatgtcgcttgcacacaatcggtttgcaattcggtgtcgaaaggttggattttacgtcgcttttgcaggagcgccacgttggagaaaaggcgtattttcggggagggactttgggatttgctggggtttgggttgagattttggggtcaaggaaagatttacttaattttcaacaccactttactgacaaggaattagagaataaggcaaattgcaattaggaactcaaataacagtaccaattaagcctttgggcgtttgttgttgttgaatgaaagtccacggggaaaagcaccaaattttgtagttttattacaataattcaaaagcacaaaatatataaaacttgagataacacgaagacaaagacaaccaccaaaaggaaaattaaatgaaggatgcaaaaatattttaaattaacgcgaaaaacaatcgttgcaaaacaataaaataaggataaatcattatttatcctacgaaaatggccgctttaataggggggggggcgtaccgttttaatagaggatttctttaaaaaatgcccaaatatgcacataaaatatgcacaaaataccaaaatacacacaaatatgcatataaatcgcgaactaggcataaatatgcaaaatatgcatatggaaatacgtcctagaagcttcaaaacaagctaaaacatgtttttcgtgcgtttcagacctccaacagtccaggaaaaaaatatgcatgtgcatataattctacaccctatcaatgtcatacatgtgttatttgtatcattacaaggcttagtctgttcaagacttaaaattttatgagtttaaacaaaattagacgggttcttgttataaattttaatgatatataacaatttacatatttattttgttttatttttttgaaatccctccctcttgcccaaacttcatgtcaccaaacgaagatgtgcggtaggtttcggaacgaaacttgcccctccaagttcagttctgaggaccaaagaaatacatgaaaaggggtgaggattcaaaaaaaattttatgaaatgaggagggggggggggggggtcggtggcaaacactcgaagggttccacaaaaaaaaatgcaattaggaattcaaatgcgcaattctgagttttctaaaaatttgagaatttttggaatttttagcagtttttgcaccaattttggcactttttgcgatttttagcataaattttataggttttagcaatataagtcttggacacttaaattaaaatttgacaaagtaaatattttattgttcttggtttttcaacattacccttaactcaaaaacaccgaattaattaaattctaagagattaaataaacttggcgagacttaagtttgttatttcgtgaaatttgattcatcacccaaaaaaaatctgagccaaagaaattaccaattttaaataaacaaacattcatctcattacactcactttcaatgggacacaaaaaattaagataaaaattttttgcttggggtaaacaaatccgaacacagatgattttataaaaagaggacttccatcaaataaaaaaattcttttcattgaataaatgtgaagaataaacctagacccatttttttatatactcagctgtttttaaaattttcttgtcaaattatttattatcagttattttttaattttaatttttatttgcgaattaaggtaaaatttgcatgaagaataagccgtctacaaaatcagttactttttaaaatgaataaaaaacgaaaatagagaacaagctataaaacatttttatcgttctgttaaaaaagttttctcattaaaatcatttctttggtttttaattaaactaaaaaaataaaaagaatgtaaaattaaaaaaaaacttaaaacatgacaaattgtcaaatttcatatttttaaaattgatactaatttacccaaacccgagacccggaattccgccctaaaacttcgaatttggttacaccttgcttggtttcttccattaaatttgtgttcattttcatgtgaatttactcccccaaaagttattttctcgaaaaatcttacacccccacaaattaaaaaaaagcaaaaagtatcccaagccgaggtcagtagcccctttgaatgctcttcctattgactctaga

SEQ ID NO: 11056 - DNA, 3867 bp, Heterodera glycines
  misc_feature (70)..(70): n is a, c, g, or t
  misc_feature (75)..(75): n is a, c, g, or t
cgacgatttgcacagtgagtggggagaaattggtttgctaagtgatgagttaagattagaaaacggttcnaatcnggattttatacacccataaaaaaaatacgcttcccacatttgtgcctgtgcccttctatttttttttcaatttttattaacatcatgtaccatattaaaattaaaaaagttaaaaaagtcttaatctactttcactttaaaatagagtttatttgaattagcagatgccagtcacttttcacaaccgactccggcgaatgcgatggctgccagtgccagcgcgggttacgatattccgcagcgtttgaaaacgctccacaatttggtaagtttgtctgctattctctgttcttgactatttaactgttaattaggtcattcaatacgctgcccaggggcgttacgaagttgccgttccgttgtgcaagcaggccctggaggacctggagaagaacaacggccacgaccaccccgacgttgccaccatgctgaacattctcgcattggtttatcggtttgtcccgcggttctttctgtacgctatgtttcccattcagtgaccagcgcaagtacaaagaggctgccgccctcctcaacgaggccttggccattcgcgagcgatgcctcggcgaggaccacccggcggttgccgcaactctgaacaatttggccgtcctttatgggaagaggggcaagtacaaagaggcggagccactttgcaagagagcgttggaaatccgagagaaagttttgggcaacgaccatcccgacgtggccaaacagctgaacaacctggccttgatttgtcaaaaccaggcaattatcaacaactgaatcacccattcattgtccatttttagggaatgtacgatgaagttgaaaaatattatcgtcgagcgctggaaatttacgagtcgaaattgggaccggacgattcgaatgtggcgaagacaaagaacaatctttcgtcggcatttctgaagcaaggcaaatacaaggtaaacagtcaaaagtgggaaaagggcgagcagtctcttaattttgcaaattttggtgatttgttaaattaaggaggcggaaatgttgtacaaacaaattctgacacgggcgcacgaacgacagtacggccgagtgaccgatgagaacaaaccgatttggatgatagcggaagaccgggaggacagtaaacaagcggacagcggaatttaccacgagaatttgcaagtgtcgatgaaagttgacaagtgagtgatgcaataagacacgtgaatgttttgacgcttccctcagaattcggtcccaaaattagatcctaaaatatgttctttattgcaaaactcctttttaagtccaactgtgacgacaactttgaagaacctcggcgctctttatcggcgccaggggaaatatcaggcggcagatacgctggacgatgctgcacttcgtgcgaagaaacaggtaacgataaataattaactctgtgggtggaacagtcgtaaaaaacaaatatgattgttgtcgtcaggggctttaataatgttgttgttgcacacagcaaagacaacaacccaaagcaacacagccctatcccgaagacaatttttatttcaaattaataaggcgaagacaaaatcaatagggaaaactgccgattgcataaaactaacaactaactaacacaaaatcacaaccaaaaatgacacaaaatcaaataacaaaacgtcaaaatctattttaaatctaaatattatcacagaacaatatcctaaatagtgccgatgactcttctcaccaaaaaaaagtataattggaaaacgtttttctattcagaatgaattatcataaaatgaaaatgcaattgttgaatcctatgcataagcctgatcggtctttttgctcgattaagagttgggtacatgccttaattcttaattagcatctttttactattaaaagtcgataaaaatgctttagtcggtgggtgaaatccgacaggaagaccgattcagtaaattgttggctctgaaggagttttccgattcgtgaggtgaggacggaatgaatggattgaataatgcgctgttgtgttttgtgttgctgctttgtttttgcttttgtcggtcccttgttggtccgtgtttttctccttttttgagggtttctccgaaaggccatcggtccttccataaagcgaatgtcattaatttgccatttgtgtttgtctgtcgcttttagcctgggcctcacccgtcagtccagcaaagtggcgccgccggcgatgacgatgcccaactgctggccgggggcgatcaaatgagccagtcgctaattacttctgtgtctatgaccccgtcccaatcgtcgaacaaattgaagaatcgtctgctgaatgtgctcggtttctccggagaaggcgctggtggggcaccacaacagtgactgacgacgacggattgataaggaactgatggacggacggacggagggcgagtggagggacggagtgactgacatttgtgtaacgatggactgaggcactcttattgagcttcgattctttattttctttacatattatcgttttctttgttttacttccattttcttcccttttttgccttccaatctctcgacggggtctctctttctctctcttcatcattctctccctaccagaatttaatcaaactttctttttgatggatattgtttttcttttatgtatgactgtaaatctatttttctttttctttgtgttgtgctgttttcgttattagactttttcaaaatgactttggcattttcagttctcttctgtcttccctttcgatcgtcaacttttaaatgaagcattctgtggttatggctaagaccgcccaaattgctcgaataaaacgaaaatccttcaatagcatttgtgtggtttcttctgacttgataaaaatgaaagtgtggtggtggtcccatttaatctggcggcggcacttttccctaattcaatttgcggccattccatgccaagggcttttcctccttaagccatatgaccacgctcccttcccttacagtttttcaaattgggcatttttattacgacaatgttttcgttcgtttcccttcccattattgtgtaaatcattccattacatagtcaaagagagaattgcttttggcatttcatttaatgggttgatgaatgatgccacggttattcttctgacagaaaaccccaaattcgctaacatcgcgatgaaagtgccctcctccgccgatggtttcctttccctccctttccgtctgtccatttttctgcttttgtttgtcgctgctttgccaaactttggtctttgtaagcccgagcacagtccgtatgaaactgttctcatcgatgaccccgccgagaaatccgcgggcatttattttcggatcagtcaaagaggtcagtctcaacagatgaaaagggaggaggttaagtcggtcggtaggaaaggccaggggacggacccatggactttcccttgtgaatttggctttatttgggccaaagctttttcctcaatgagttcgtcgacatttcaattcacccgcctttccaaaaatcaaaattaatgcggcataaatatgcataatttaaaacacaaaagtcatcgtatttgggttttgcccccgggcgccttcgcaatgccccaattttatttttgaattcgtttacattttgtcatgactaacaacaattaggcgtcgattatctggcggaattggcttccgacggtctccctagcattttggtgagttcgtccgaaatccgtacgattgctcccccccccccccccaaagcatcggatggttctg

SEQ ID NO: 11057 - DNA, 1612 bp, Heterodera glycines
  misc_feature (46)..(46): n is a, c, g, or t
  misc_feature (214)..(214): n is a, c, g, or t
  misc_feature (221)..(221): n is a, c, g, or t
cccccccccccccccccccccctccatctttttagtctcgcgcgcnttgtcgatggaatgcgtcgtttgcttggaggcgatgtgagtgcgtgtccggcgcaagacaagtgcacaaattgtgtcccgcacgaggacagcttcgtgtcgcggtcggtcggccttctcccccggcacaaaccaatgctctttctctccaaattcacagattaaaccncacttcnggcattctcgcttgtacagtgacgtgctgttaacaggcgtggacttcaaggtgtacaagggcggtatggacggcattatggcgggtgccattcgaaaaatggtctcttttctcatcccacgcgctatttggcccaaaatccagcaaaggcttcgtttggtcgtcaattacaaaggcatgccgacaattccttttgcccaatctttgctgttctgaatgctctccgcaggtgtccaaatcccgcgtctctgctccgtcgagttcaatcacctccacttggattatattgcccacgcggcaattatcagcggggattttgacgtcgatttgcccctttttatccgttccttcaaggaatttatggacgagaagcaaagacggacaaaaacgcgcagagaattgctcactcagttcagatacctttgaaagaatgagggacaaaacaaaagagaaaaacggggcgaaagaaacgaaaaacttttggaaaacgaaaggccaaatgcattttcaaaagaaaaaaccacaaaaaagaattttggcagttttttaatcaattaaactaaatttattgtatggaaaacataacaaatgccattttttgtatttggtacgataaaaaaggaagtgaaatgaaagagaagtgatatgtggagggttgttctgctgttctcattgtcagtatgagcctcggaccggctgactgtgctgtaaaatcactctccgttgggttgtgctaaatgctcataatttgaccaaattcggcaatgaatgagtggcaaatgccaaactcacaggtcgcgtcgcataaacacaacaacggcgtcgatgacaaagagaagggcacaaaggaagtaaaaggccttgggggcgaaagagattagcagaggcaattagcaaatggggggtcattatcgactcaacgcactgctgccacggcccatcccttgacgatgaaaccaacttcgcagccttaaaaagccgaattaatggacgacagaccagaaagcgatcaataagttcagcttccgcctgctctgacccggcagtccgacgcatccgctgactaaattaagccaagccataaaattaatggatgatcccaaatacaaacatgtgccggcgccgatttgtcggatgaaagttggcatgtgatctttgtgagaagaatggcaccaaaaaaaacaaaaaagcataacctaccaaatcctgtggcgtaccaagtctaaacgtgggggggggggaaacgtaagtacgacgaaccctaaaaaagcaatgccatttgagtgtatatactgacttcaaatgcgccaaagacaaggaaagcaatcactccgacgccagaggcaatgatttgctgaaagaaaagttggagatttaaaaccgtaatgaaaa

SEQ ID NO: 11058 - DNA, 1305 bp, Heterodera glycines
gtaataattacgtttgcgatttttaggcaaatgcctaagatttttgcgcacttaatacgtgtaaataagcatgaaaaacgcattttccgcttggtttggggtgtctacgatgattttataatgcctaactttgcctatttcggggttttcgtgcctaaggtgcctattttaagatttttgaaaaaatctttaacaaaaatgcaataaaaacggaaaatacacccctaagaaatggcccgaaacatttttcggaaaatacacccctaagaattgaaaatttttcacaaaaattgatccacaaaatttaatatttttctcttaaaaaaatatttggtttttaaatttgtctttattcgaaaaaagttttaaataatttcatttacttttgaaaattttaaaattttatatgttttgctacctaaaaagcgttaataaaaaaaaattttgcctatttttatgcctatttggtgcctatttcgtgatttttttttctgcctttttagttgcctatttcgcgattttgtgtgcctaaaaatcgcatccctagtaatttgtcaatttgattccattccaagagcatggaacgccttgaggcggtggtgcacgaacggaacgacgcctttttgcagttggagacgggcgacagcgcgtcgcccccgaaaaggacggtcacttccttcatgggattcacctacgagtgagaaatgcttaaaaaccaaattaatatatggcattttttcctcaaaaacctttaaatttgttaaatattatattttgagttttcctgttttgaaggcgtgcaactgcatttcgtaaaaaccgccaaagggttctaaacaaaaaatatgtaacaaataaaaattcataacttggcccaagttaaaccaaattaatatttcatggtatcttttaatagctatgggtgtattctttcagaatataatattacaaaatttttatcttaagtataaaaaaagttataaatcattgaacattctaggttttttgctttggtcaagcatatataattttataaacacaatgttttaaatctataaaatgcaattgagccaaattaatttatgtattcgatagctctaagaattctctatttacctttaaaatttcagaaaatttaattgaatttcaaaaaagttctgtacaaaaaattctgaatgaaatattaatttagttgaacttgggccaagttatgaatttttatttgttacatcttttttgttcagcacccattgggcggttacgaaacgcgcatgggtggcggtttttacgaaatgcactagcacc

SEQ ID NO: 11059 - DNA, 2398 bp, Heterodera glycines
ctttttgcacttggagacgggcgacagcgcgtcgcccctttaacggacggtcacttccttcatgggcttcacctacgagtgagaaaaattttaaaaaatggcattttaattttccatatataaaatatccattttttgaagcctatgaatgtgtgaaataatcatattttgagtttccaacaaacaaacaaatgcacatttccttctgattgtatgccaaattttttggccataactttttttaaacatgccaaattggcattattcgaaagcatttcaaaaagtctattaatcaattaaaaaatcaggtatttgaaccaaccttataactttttagagttatttaatggctttccactcgcttaaaaatagcttctatttatatatggagctttaaaattatgccacttaattaaaatttatgtaattttttgtaaaaagttttggcccggaaaccttgcttttccctcctaaatgtactccctctaattgcatttgtcatcagtgaatacgcaactgaacattatcttccggccgaggccaccggggagaagcagtacgagcagccaatgctggacgaccaggcccatctgatgcaagtgttgtggcgagagaaggagcagctgaagaaggaggtggcactgatggacgagtatttgtacatggacccggagcgggacgaacgcaacgatatgatgtgagaaggtcggggggggggcggcacaaaagccaattccaatttgctctctctgttgttcatccttttcttgttagctgatcactgatcacccatttgggtgttattttttctgatcacttctcccaattcatccgcacagtttgacacgtccaaagcgtcgctactacgaccgggtggaggacttgccgcagaatgttgttgcccggtggcgcaaggagcgcgaacagttccaaccaccgaccgacccatatgctggaaaagaggacgaagaatgagcacggagcggataggatgatgattaatgatcatgaagatggtgttgaacaacatataattaatgaatgcaaatgataaaaataaatatgccacaaaatttaatttttcaaattgttcaattgatggacaagttaattcttatccattttatttttgttcatttccgatgtatttttcgttttgttaattttaaaatatgtaggaaggatgaatgaggagcaaaaagctaagatgtcttgcccattctgcgcttatttattcagaaaaagagagagaattcaaatccgggccctaaaacagataccattttctcaactcagaaatggctatcattatcaattattgaacattggcatccttttgattgtatttttacagttaaataccgtatcccatttctaccctaccatatttttggttggcattcttttacttgttttttaaagttagatactgtatcccatttataccctaccatattttctggggccgattttgttggtttttttctagacaaaattgattgtgacttcaactagttcaaaaaccgtattttgcttttgccccctcactatacattaatgtcctccacaattgctcccgtttcttccgccgatggcaccgctgggagtgccgccgccgtcgccagcgctgggccctcctccgtcgagccgatgccgccggtggagcagctgatggagggcattgaggagaagtgcccgccctcgttggaccagcgactgaacgccatggacgaggtggacatgcgcatcgacgacctgctcaccgtggtggccgaagtgatggccggtctggacaaggacaagccggtgggtgccgggagaagcaaaagcggcgaggacggcacagttgcccaattgtcctggcacaaaaagcgtcatctaccaattctcttggctctgcctggaaaagttgaaattcctctaaattttcaaggaatttcctctttttctccctctcacttattttcagtcctttctcctcttattgcctctaatgaattgttgctttgttaccgtggtcaatttgctcaaaatgaaccatttgcatttattttttgattaaattcgttgtgaccagagcagatcataacccaaaacaagcatataaaatttaattgagaatgatcaagaattatgccgtcatgtgcttatgtacgataatttggcatcattctttgattttaaaaatttgatcagcgtgagtgattgattgatcaatttatgaaattagtgtggcccggttaatttaaaattttatataaaattaattcgaatgctcatacttctcgaccattgatcactgatcattagggccgctacttttagtgatttaactattttttctgctcaattgttttgaagaaaggagctcaaaaacgcatttctgcgttaaattttt

SEQ ID NO: 11060 - DNA, 3334 bp, Heterodera glycines
cccgattgagtagtgatcaacaaaattttaacaaaaaaagaccaaattttctctttatatgctcgaaatcttccttttttcactttaatcatctgattctaattcattcgttggcgccagtaaaagtgcgtccaatttggcattttatacaaggcatcccaggccccaaaaattttcagaaatcgaattccgaggctcaattttaacctaaaaaatttgacaattttagtggtgcgcttttcaaaaacttttggaaacttggggcgggaatgaggtccggcggtgaagacaggcgccgtcgagaaaatttttgaaaatgagtataatttgttaagagaattttgtccaaaaattgtcaaattttgtgattttcaagccaattattggtaaaaaaaaaatttggagttttgggaggccggcggtgccgataggcgccgccgaaagtttttcggaattttaggaatttttaattaattttattaagaaaattgtacaaatttaaaaattttcaagagtccccaattccccgagttagtgtcggggggtcgggggataaaaagtcggaggtagggggctcggggagcaaccctattataaacccccaaaataggtgctaaaaatggaaacgagataaatattttaaaaatcaaaaatgtagtcaagtaaataaataaataaattttgaatatgaatttttgataaaattttccatttctcaggggtgtatttttagttttattgcatttttgttaataatttttttcaaaatagcagaaaatattttacaaaaaattcttcaaaatgaaaaagagcacaaaaaaagcaataaatttattattattacaggttatatcgctccaatttgattcggtttttataaaagtcggtcggttgtttcggttttttgattatttcggtcggtcggtttcggttaaaaacccgaaaaaaaccgaaaaagtcaaaaatttctcggtcggtttttttcggccaaaaaccgaaaccgaaaaataccgaaaaaaaccgaaaaaaaaccgaccggtccgatctctatttgtatccatattttctcattaagaaatgcaattttttctaagcataaacaatatagtaatcccttaaacattatattgttagtctatgaccgtaataattattaaattgataaatctaattttgatttcaccgtttgtgttggcgatctgttgtcgtgccactgttccgcctgtttttgcaagcatttgtgatgatgagcagtacccgcaggtcaacggacattgcgcagccatcaaactgacccattttgggtcagtacagcgatgggcatttgtaggacagtccgatggacggcccggcacattcaaatcacggcatccggaatttactttaggtagatcaagagtaaaatcttaagcagtactggaacggactccggcgtgtttttatggatccatgatcagggctgcacgcaattgcggattgcggattgcggattacggaaattgcggggtttttggacccccgtaattgcggattgcgggttgcggatttttgggatttatccgcaattttgatccgtaatttgactattggattatttttcgagacgatttcttgtaagattattttttataaaatgaatttttttctatttttatttaaagaaaatatgtacatttgtttaaattcttatttctttagcaatttaaaaatgtcaaacttaaagaaaatcttgcaaaacttttgtttcttcatcacaatttgcttttaaccggtttctcaattgaatgattttgcttttataaatttgctttttaatatgcttttaaattgctttaaaagatttataggattttttaaaataaaatttaaaattattaaaaaaaaaatttttttaattgcggattgcggattacggaaattacggaaattgcggggtttttggacacccgtaattgcggattgcggatttccgcaactgagaaaatcgccgcaattgcggattgcggatttccgtaattgtaaatccacttgcgtgcagccctggtcggaatggcttgggtttaaaattttgtataaaaaaaaatgccttggcataacgtctaccagtctattcaattaaaaaattttcagttaaaactgcttggagttttcttgtctacaaatcctttattctaatgatagattcttcctacatatgcctagctaacggtctctgaccagtagggaagtgccgagagtctcctcggttcttccatttctgatcacctcactgatcaaatgaagttttttgctttcaaatttggcagcaaaatattttggcataacgtctatcaatcttcaaaatgcaaaatttttcaaaacttccaactgatcacctctgatcagaaaatgaatgtttttttgatcgatcgcttttcccaacctgtttcagctcaatgcattgcttctgctcgtcccaatgggacaaataatcggcacgttggacactgagcgccaacggttggtgcactccttcgtcatggatttgctgcgcaatttccacgcatcgtttgatgtacgggtcgcccttgaaaatttcaaaattttcgattttttccgaaaacttaatagaaaatggcaaaattttgaattttttggcataaaaccgctataaatttctgctttttcgctccggcattgaaatttttgaaaaataagctggagaaaaagaattttttggccctaagcagggttcttcttccctccgaaattttttaattttgctacgggcctgattaggacagtataccgtaatccgtacactgtaccttgatcacgtctttgtacgtctcgagcaggaactcgtggtcacaggagatgcggaagtacagttcgttcagtgtttcctgcacctcaaatgcttttgtgtacagactgagcgggaacggcgagggcattagtgccaacggcggtgtcgtcgcaatgtccgattcgaatttgtgctccacggtgcgcgcacaaagccctgagggggggggggatttcaggcttacggtattccctccgttatagccacgtccaaacaactagagcccctgagggcttttaaaactgtgaaaatggctaattatgtatacaaaaatggcattgcaactgccaaaataaaaattaaacctattgaataaaaaatgcaatggcttgaggcttcttcatcaagttttttgcattaaaaatagaaaattataaattaaaacaattcagaaactatactcaaattttgattttctaaaatcgcaaaaaatttataagaatacaaaattgggctaaaaaatgccaaaaaatataaaatgaggta

SEQ ID NO: 11061 - DNA, 525 bp, Heterodera glycines
aaaatacatttccgttttcaaaatggaatgctttttcttattgattttataataattattaaattattcataattttatttgtgaatttaaaattaaattattatattgtttagaaataccaatttgataattcttttaattaattaattaattaggaaaattccgttaattgattagagtggggggttccgtacccatcggtcgccggaccccaaaaagtcctaaaagtccgtccacctcctgctgtgggtacacaagcccagcggggacataagattttctgccatttccacgctaatacggtggggatgtgacgtaggggggaagttggccccctccgcagttgtgttgacaaaattgttgactctcgtctcaattgtgagtcccaaattttttggttttattatttttttataatggaactctcaatttgttgatggaccagtaatgataaatgcgcgattattagataaaattatttaaataatatgatttgattaattagttaaaatttatcaaaatca

SEQ ID NO: 11062 - DNA, 762 bp, Heterodera glycines
aaatgcgtttgaatttcacaacttttaccatcacatgcaacttgtgtttttatttttaacggcgagagggcgttgtgaaaaaactcagatactgtatccatttgcaatgtggacaacgcttttctatacaagaaactgggtttaaggtcatacagcgaccgccgtcgcctttatagaaagtggccataaaatcagttagtttaaagtgagaacagcaatttaatatcatattagagcgtcagatccgaaacttagtttccaaacaggtggaggaactctaatatataacatggtgggattacatacgcccctgaaagtttggttccgaagtcccacaggcacttgggtacccttcctttgtcaggggaaatccctaaaaaacaggtctagcaaaaaggtgcgtttaatcccataactctaggcagataatttgtagttttacccttagaatttttatatttctttaatttctctaattccgaaaatattttattgacaaaaatagtatacatcactattggaagccatttgaaacaactggatcactttccctttttatagtttaaaaaacgcatttctaaggggtccacctcgtttcggcgccagcccagtttttggactataacttttttctttttccaccaaatctaacattgttggtatcattagagagcccttccgatgctctattattttgcataattccaaaaaatttgatcaattttgaacaatagttatggccaaaagtacacatgcggcctg

SEQ ID NO: 11063 - DNA, 3651 bp, Heterodera glycines
tttcccactcacagctcggaatgttcccttgtaaggaattcaaaaagtgtgtgttctgacttggtttataaatgaaatcgtcacaaatacaaaaattataatacactcggctagtcaatcgtcgtcttttttcacattcttccgtttttctcatgcggttgtgactagttttgtttccgtgtccccctcttcacacacgcaccggttcaacttcaccaatggaatgtcgttgatgccacagttcaaagcgttttcagtcgttttcggagcttctggcgttgaacatcctccgccacagtcctccgtttcctcttcgccggtgcacgagtcggacgtgtacatgctggacgtgatgctcgaccgcgactcttcgtcctcctcgctgtacttccgcttcgtgccgctcttcttcttctctccaattgctaacaattcaatgctttgtttgatgcctccaattggcacaatcagtcgattctgctggaaaacattcagtattctcaacaggctgtccatgcccagcaaatatccatcgtcagtgctcgagtaaggttggtcgtccaaaaaaccgttaaaagtcgaatgagcaaagtcgatcattttgacagtaaccccttcgttggctttgcttttgtgcccgctgccgtcaaaggcaattagcaatgagctggagaagaagcgaaacccttccgcgttgagcagtgttttacgcaatttcaacaattcctttaaaattaaatgacgaaaataaaagacgattgtgtgtttatgcacttgcctcaataatacgcattgtccttgctcttgcagcaactttgaaaaagtgaaagagcgcattatgaactgcattctgtccatgcgtcgcccttcgtatttattcataaaacttaaatagttacaatgattgatataaataagtaattagaataattagaaataaggcaacatccgtcgaaaaaaagatttaaaattcccccgccacgcattactcacatatattctcccacttctcgatcaaacaattgcatccgaccaatcggacgccaatttctgaacttgtcgactgtcggcatttttgcgtttgcgttagtcgtttttgtgcgcttgcgtcgtcgccgtgctgacgagtgcctgaagcagaaataaaatgacagaaaatggcaaaatggcgaacccattttcaggtcgatcacacagggccggttgtatctgctgaccaaatcctcgaggagtatgaagcttctgtcgtgtcctttcagcaatttctgtacaatctgaaagcattttccgttgcattgttttttctaatcccaaaatcccacaaactttgctttgacattgccacgcccaattatttgcggtcaccgatttctccgcttccactcgaccgctttttacacgaaatgtcattgaatgcttccttttgccattcgcatttatagaggctgtagcaatacttttttgaaatgaacagccaattgaggtgggcaaatcagcgacattttccggtgggtgtcggtggcaattgacaatttgctctgtgctcatcattaaagtcccatcttcaacattttgattcaaacactgcactttgattttaccttaaaacatattaagaaattaggtgttaaagtgttaaatacttactgcacagttttgcagtgaatggtgccaacttcgcatccattcgagaataaaattcaaactctcggtgattgaaaggtttgcacacatggcccaagattgaaagaagtcccttaggaggaagcatagtgaaaattgaaataggcatttcaattggaatatttttacttacaaaatggccaccaacttgatgaggaaatccgaaaacttccatgttaacaagaaaaatagaggacacggctgaaaaaaaagaagtaatgtcgaaaaaatcgaggagacaaataaatgtacaaaacaatccaaaaagagtaaaaagatgtgtgtattttaaaaatatgaacaattcaaacagacagcgccagatgtgctgataaaatgagacggacgtgaataatattggtcggaaggggggagggattgactgaattaatttttgtgtttgtatttgtacatagtaagtcactaatgtgtatgtatagtgagacaccacaccacaatcagttgatttggagagagaaagcggcgcagcaaagggaggaatcatttattaattgcacgacaaaagaggggaaaatgtacgtggggaggggggaaagggaggggtgattgtatcgcaaaaaaacaggtcgaattaatgagaaccattgcaaatcggaaaggcaggcaaatgagcaatttccctaaaaatggacaaatgcagacgacagatatttttgaagcgggtcacaaggaatcggtcagttcattaattatgaaaatcaatttagatttttattgtaatgaaagaaaagaattgtatcctaaattgaatctgaccggaaatgaaattgccttattgttacataggtcgttccttaaataaaaataaaacatgtgtttgtatgagacgaatttcatttcaggaaagtgattgacaatgaaaaatgtgtgggtggggtgacatttgtgacacagaacaacggctttctcaatttttatctaaaaataaaaacagcggatcgaatttcactccacgtactgtaatgaccggatgattgtttctggatgatgatgagtgacgagagtgaagaataaaaaggagtaattgagaaaagaaaggcatgtgaggaattcacagacaattcacagcaaaaaggcattgtctgtttggtggtcacatttcactctcttggagaatgaaagtcataagttcaatgccttggggcttaacaaaagctaagaaaaggaacggacgggcgtatggccatggcaaaacattggaatggcagagaagagggaaggacggagggagggcattggctggttactcactcgctctcttattccttcgtcaccctttttctatttgatggaggcggcagtctctctgctgttcttcgacaatcgataagctcagcaaaatttgagagagtaaaaatgcactgaacttttgaagttttcggctaataatgtaataaaaagcgtgcgctcattctccactaaatggtcagctctttgcgcagttcgcagcttgaagttttggttgagcgtcgcgaatggcaccgcgtcaacgtgtcactcgaggagaccgcgttggtcctttctccgctcggcgatggttttgtcgatttaggcgcgacttcgatagaattgactggtacgaacaattaattaaagttaattaggtaattaaccaagcaaaattaatggataaatcgttttgtgtattccttcgcagatgcactcgcccccaatattggaacatggaatccaaatcccgagaaacgttttgtgcgcattctcaagcaggagaaccaggggttggggataagcattcagggaggcgcggaggggggacgacccattgtgatcaggtgtgttgtgttttcgggaaccgcccagttcggcgccgaccctttcggcgccgttgctaataacttttctcattatcaaccaaattaaatattttcggttccattcgatagctcttaacgttctctattagcctgcaaaatttcaaaaaacttt

SEQ ID NO: 11064 - DNA, 3036 bp, Heterodera glycines
tttccggcctatgccatcgtcgccatcgctttgaacgtgccgaaaagtggtggcggcaaattttgtcagttaatcaacgaatttgccaatggcaagcagtgccaaatgtggcggcatttcctttgacgctaaaatttgaatttgtaaacaataagctatggataatactcacttttgaaaattttagtaataaaacagtcatttgatatttaatttaaatattttcttaattcaatttaattacttttcaaattttccttttaatttataatagaaattttttgaaattttattaattaataaacttgtattatttaatagatttataattctgttaattgttttttcaaattttccatttttgattcaataattttttttaatttttattttatccaatccgtgcactttcaattgttttattattgttcaaacaccaaacaaaagcagcacactttaagtggtttgtaaaattgagttaaaaaacacagacaaaaaatacaaagctacaaaaaacgtgtgaaatttggtattgcaaaaaaagcacgcaaaaagtgaatattacaacggtgtatttcggcattttttcattgtgttttccgtcaaatccacattgagtaatgacgtgacaattcatccgcagcagcagcaacgtttggcaaaagtggcccaacaaatggtgccgacgccataggcgtgtgctcacgtttttgacggatctgcaaaaattgcgtgttaattgaaattagccacactaattgggtttaattgatgcacattaccgcagtggccggatatgagccaccagtgcggggcaatgcgaccacattattgggagttcctccgcttaaaaaaaaataaaaatttgttgagtcattaaaaagtaattaatttttaaatataaattttaatacttttttttaaatttatttaacggataaaaaataaggataaatgacgctagcaatgaaaacttgtttctgaggtttataaatctgacatctattttaaccaatttcgacttcctgacctagatttaacaaaaaatttaaacgaaaaatttgagttttcggttattgttcgagttcgggttcgggatcagaaaattgatcaaatttggtgtaagattcctgatcaggcaccctaaaaaccctctagaacaggttttcacgaatttttatataaaaaaataatttggtaaatcaaaaggaataaaattcaaaatacccactttccaaagagcgccgaataaacttaaaaaacacaatgacacttaaaaattaattaccctccatttgaatttgatgaagattggtcctgttggtaatttgttgcttcggactaaaataaattaaaaataatttatattataaattttaatttttcaaattgcctgatccttattcaacacttgatccacatttttgaccgttccatatgctaacaaataccttaaatataattgaattgtttttttaattttttttatcaaaaaataatttaaaaacaaatggtttttgcaatatttccaattaattttaaagaacctttgtaatgtaaaatatttatttagtatttaagtaattagatctaaaattattgaattttttaaaattaaatttaaaatttactttccgccctttccattttctgttctgctgttatcaggggggatggatgggccccgggggcgggggattcatcggcgtttaccgatcgacgacgaaaacggctgcgacgaagcattggccattccctcgtcctccgtccccccagcatacataaatttcatctttttttgaataaaaagcaaaaaatagtctgtttttcatacagaaaacataggggggggggggcattaaatgaagtattttcgtgttaaaaatgtgtttctcttttctcattgaattaaaagccgcagaaaaaataactaaaaacttaaaaatccccaccctactcatcaatttcaattattttttgagccgtgggcggtcaaaaatccatgagtaggactaattcaaacagtgtcagtctgtttagttgttattcttcttcatttttcatatctttgatgaacctaatcaatgttaagatttttaatgattataaataaaaaaaatcaatgtttatctttaagtagtgattttttgaaatttttcacttcgttattttcgtcgttgggtttttagtaatcttattgatattagtgaaattgaaatgaaaaatattatttttgctgagcggcgcaaatgtccatttttgctaggcggagcaaatgtccatttttgctaggcggagcaaatgtccatttttgctgagcggcgcaaatgtccatttttactaggcggagcaaatgtcgcggcgcaaatggagcgacgcaagtgtcgactttgctgagcggcgcaaatgtccatttttgctgagcggcgcaaatgtccatttttgctgagcggcgcaaatgtccatttttgctaggcggagcaaatgtcgcggcgcaaatggagcggcgcaagtgtcgcatcacggttttatccacccacaaagtaaattattgatcagtgaaatattgatgaatataaacaatgagagtaatatgcataaaatgatgacgctatgcaggtacaaaattgattcatatacacatttgtgattgcatatcaggtaaaatattgatgttattttccttaaataagaattcacataaataaagagcaataagcactgaaaccccactatttctaattcaaaatctttattaaaatttataataattaggggtataatttgtatgcttatgattaggaagctgattcttaaacaggggcgtccctattttggcatttcggtcctatttcggcatttttgagaaacttatcaaaaatgctatacaaaatgcactcatcaggaatggacttcgaaaatttttaaaaaatctggaaagtaataaaaattttcaagatttttggacaaaaaaaaacaaattatcacatttttatctatttaaaaagttgaagtttttggcgctaattaatgata

SEQ ID NO: 11065 - DNA, 1223 bp, Heterodera glycines
  misc_feature (1020)..(1020): n is a, c, g, or t
cgtttaaatgtaaaggggcgttgctttcattcatcagctacatcattagggatgccaaaaatatggatataaaatcgcaaaatatggccataaaatatggaccaaaaatcgcgaaatatggacataaaatggcaaaatctcaaaatatggacataaatggcaaaaatgtcaaaatatggacataaatttttcaaaattgagtgcaaaatttcttcaaatttattggttgaaattgcatatgagatacatttccaaattttttgactcggtaaggcgctttgacaaagacggctttcgttttggcaattagtcggtcaacattcggaaattggtctcgaattttttcggcaattctgtgcaatcattttagaagaaaaaaaacatgaaagctaaaatttatcaatttttttagcgtaaaatcaacaacaaaagcgaaattttcgcttttgtgcttatttttgacataaatttattaatttttaagaaaatttaaatttattcaatattctcgtgaaatttcggcgaaaaaatgattttttgaaaaatttttcggtttttgggctcaaaaaggctaatttagctgctgggggccgttctaatggaaatttttttgaaaaatgccaaaatatggaaaaatatgggcataaatcgcgaaatatggaaaaatatggatatggaaacccatcctagaagcttcaaaccaagctaaaaacatgtttttcgtgcgtttcaggccctcaacagtccaggaaaaaaatatggatatccatatgattggcatccctatacatcatccattccactcaacgcgtcaacggtccgtttgtggccagcaagccaaacatggtcataaattgagtgctggttggagaatttgcacgcgtcgcgcaggtggtcaatcagtgcgccgcggggctcaatttgaacacgaagacgtgcagcaggggcgacgacggcaccgcccgacgtggcgccatgttgtgaagtgccaaaaaagcgacgctattcaattgggggggnggggagggagtgggtagattatggtgcaaaggacagcacagagaggagctacagtatagagctgacatcgcaattgtcatgcgttttgtgctcgcaagatctaagcaagcttacgtcattgtcgacagcttcccgtgagcccagatttatgaatcaccaatgtcctgatttgtacagtccaaaattcgaacttgaacaaatgc

SEQ ID NO: 11066 - DNA, 1291 bp, Heterodera glycines
attggactataactcgtcaatttaagtgggggattttgggctctaatggaactgaaaattgcaaaaattagatggggtgcgtccctttgtaaggaattccctcgtcgtctaacccgccccttttcatgcactatttcagggtctaaaaaatgaaaaaaaacaaatgatttttttgttaaaaatcatagaaacttttcagcttttaaattttaaacccgcacgattccgcgattcgaaaacgaacgaaaattttgacttgaaaatttcaaacatttgcctccaccttcttttaagtcccacccgagggcgagacagttccaaaatttgggtgccacataaatgtggatgtaatagtaccttaattggactatcactagtcaatttaggtgggggattttgggctctaatggaactgaaaattgcaaaaattagatggggtgcgtccctttgtaaggaattccctcgtcgtctaacccgccccttttcatgcactatttcagggtctaaaaaatgaaaaaaaaacaaatgattttttttgttaaaaatcatagaaacttttcggcttttaaattttaaacccgcacgattccgcgagcgattcgaaaacgaacgaaaattttgacttgaaaatttcaaacatttgcctccaccttcttttaagtcccacccgagggcgagacagttccaaaatttggatgccacataaatgtggatgtaatagtaccttaattggactatcactagtcaatttaggtgggggattttgggctctaatggaactgaaaattgcaaaaattagatggggtgcgtccctttgtaaggaattccctcgtcgtctaacccgccccttttcatgcactatttcagggtctaaaaaatgaaaaaaaaaacaaatgatttttttgttaaaaatcatagaaacttttcagcttttaaattttaaacccgcacgattccgcgattcaaaaccgtgaaaaaaagcgagaaaactattgcattatatttaagaacgaaaattttgacttgaaaatttcaaacatttgcctccaccttcttttaagtcccacccgagggcgagacagttacaaaatttgggtgccacataaatgtggatgtaatagtaccttaattggactatcaccagtcaatttaggtgggggattttgggctctaatggaactgaaaattgcaaaaattagatggggtgcgtccctttgtaaggaattccctcgtcgtctaacccgccccttttcatgcactatttcagggtctaaaaaatgaaaaaaaaaca

SEQ ID NO: 11067 - DNA, 4039 bp, Heterodera glycines
tttcaaagtatgaaattcagtttttgaattagtataacccgcccgattcccggcattaccggtcggtagcccaccaatttcgtattagaaatatcactcaaaattgggttattttacgttacagctaaaaatttatttataaaaattgcaaattttaatttcgcgagaacggatggtcggtcattgctgcaatttttgagggtttgagttttattcacaatttattgcgtgtgagaaagatggtagaaaagatagactaaaaagttacccaatttttaaaaaagtttgtgagatggtcgactgactcaccgggtcaaaacggctgtcacggaaggcactgaaaaagcgagaaacaaagaattattcgtattttcattcattttatagtatagaccggacggacttaaccatattaaatcaaaaatcatctacaaccgtcgctagggccatttttgggccgggaatcttggtattatattatagccgcggcagagacatcttttaaaaattagttaataaacctgcccatttttcaaattttgccaaaataacttttttgtccctcataaatcagtccgctccctaaacacagcgccgccggtttaacctgatttgagcgtattcgttgagcccctcatgaagcggcaagttccgactgaacgtgccgatgcatccgcgcaactgtcgcgcgtggccctttttccatgtgacaaaaagcgggaaacattcgttgggaatggtcggcggacatttgggcgacggccgtttgttcagacgggcaagtatctgtgcagcaaattgcagacattacacatcaatgttcggtgtaaaattcgaaaattttgatgaaaaacagccaaaatttcgaaagatcgagtttgatttcgtgaattatgaaaatttctctgggcgatggtaaagttttgtggttcttcgaaaaataaaattaaaaatttaaataagccgcggccaagcgggctcgaaccccggaccccgtctcatatgaccacaactatgtagttgatacataagtaaattcaaaaaatcatagaaaattaaatatttgacttctccaggccttttatagcttattcgaaagctctttttgttctctacaacatttgtgtatgagttttttacgcccgattaattttcttaaaattttttgaaaaagtcaggtacttgatgaataatcatagataaaatcaatgattttgcaaaatctgagctcagattcgtgatcagcgtatttttttagcgtagaaaaggcacttccaaaatttttaattctatttttcgaagaaaccacaatactttaccattgccttcctttctcgtctctgcgaattttataggccaattgcgcataattaaggctatcaaatgatatcaagaatgttcaattttgcctgttctaaattgagttatgaacaattaaaatatccgattttttttttggcattttcaactatttttttactctcatttttcaccaaattttcccatgcccccgtaccacgtcaaaacaataaacggccaattccatggaacagacgctctcatttttggtggtgtccaaatcaatggcgccactggtgaagcaaatgttcgggcaagccatggcgccaatttttagtgttttgttgaattgcctccaaaattgtaaaagttggacaagtttgttcctgcaactaacaggctgaaaatagaaattcaaatttattttttaattaaatttttttttataataatggtaacaaattagagttcggcctggtctccaacatggaatccaggtccaggcttttttcaaaatgccgagctcttttgaaaacccgaaaatttaaggactgatttggagattgaactacaaaagacaaaaaaaaattatattggcgatctattttataattcaaatataaaacaaagactaaatttgcattttctttgacgagtcactgccttttcgcttgttttgcatggattaaaaagctctttgaaaagaatattttaaatgatcaaattgcgattttggcaaattttttgggatttttaatgaagtttgaaaattttgattttttttcaagatccaaggacgtccttggcatccaagtaagaatcccagcccgtgtttaaactgaagagttaattgaataagggaagaacattaaaaaaacaataaaattggtttataacagatatacaatagaacacatgcaaatatagggaatattaaaaattttattaaaataaaattattaaaacaatttttgcatcatttaaccgaacattagtattattattattattatttatttttccatcttatggccatggcgaagatttccttctcatcattgtcagctgtgtcctcctcatccattttttgtcgtttttcctgcgcaaaagcgccgtcttttttgctgccgatggcatggcacaacaatggaattgccctccggcggacaccgtcgtactttcgggcactgctacagtttcctcctcatctgccaatgtcattaccgtcgtgctgttgctcatactgtagtggtgatgcttttgtcgtcgtccgcttttgccgccgtcgccgtcaatttcggcaaaatgttcttgacaataatgatgccccgtgatgatcgtggtcgtcccgtcatagtagtcagttttggtgccattgccatccccgccgctggtgatggcccaacatgcgaagccaccccggtggatgatggacacgtaatagaaaagggcaaagccagccaaggacagtgccaacgcgacgaacacggcacaggaggcgaccagaagctgaacgatgaacgaaattttttggtcaagaaatgtgcaacatagaacagggaagatattgcgtctatgccgatcagggatgccggtcatgacccaatgtcgaaaacccggctttttcccgaccagatcgaattttttcttggcccgcaacagccctaatgcccatgttattgggacccatccgagtcagagttgggtccacgaatgccaccggcggagaggcgcctggaagtggaggtccgcagtttcgaaatgcggcttcttttaggccaaataaattgcgccttgtacaaaatcaaaatacgttccgaatcgcgtgccgcccggcccctcagggcgtggcaaccaaacaatgatggcaacaaagtgttcaacagtcggaagcactcaccaagaatgattggctcatcgtctgttgttgccgatgctgctgtgccgtggtggcgaaatgttcgcttcgccgccaccactgtggtaagtcatcgtcgccaccatcatcatgatcagcatcagcagcaatgccaagccctcctctctgatcactgttgccattgtcttgtcctccgatcagttcatcaattgaaccgtcattttctccgatcagcccttcataggcattttctgctgatccttctacatcatcgagcagcgtgtcatcaatctcacgacgatattttggcaacctataaggacaatgtctcatttagaaagcgttaatccgttcatataattttctattaatcgaaaacaaaaaagtaccaaaaaaaagttttaaaaaaatcgtattttccacccaaaatatttccaaaaatctatgggaaatctgaaccggtattgtccattatactctgatttagtgtgcctttctccctacccgtgccgctgctgttcatgttgttgctgttgcattgtcattagcagccgcaaattgtgccgccaccgttggtgccgttgttgcccctcaagcattgggccgtcaatgtcgaaaaagtattgttgctggtgccgttgttgttgcttttcggctgattgttgttctacaggaactgctctaacttgatgacggtgatggtgacgagcagaagcaaaagcaacaaaattgagcagcactccggtgaaaattgttgcggccaaaataaaacggcaaatcatttgggggcccatcaaaaagatttttgccatatgtaatttgctaaattgattttaaaaaaattatttgtaacaaaatgac

SEQ ID NO: 11068 - DNA, 2466 bp, Heterodera glycines
gtcgccacttatgcagaaagacgccgagtcaatgtcgcggacaacgggcacaatgtggtcaatgacgtcggcagcgttcatcgatcggccgacagactaaaatattttttggaaattgttttgtaaaaaataaattcgacctgaaaggtccgtagcgatgcgttgcgcaccaaaagcgaagcggcctcagccccgtccagcaaatgctcggaggaataaatgtcggcatctgaggctttccttgcccaaaatacgaagtgccgtcgcgccgctgagaatgtcgccttggccaccgcaacggcgcatcgaagtttccgcttggacaattcgcgtttgggcggcggaaccgttggagattatgtcaatctctcctaaagtgccaatgacaattgttattgaatacaaactcatatttttcggttgcgtttctgtgccaccgaccctttctcatcacagtcacttccaaatgctttgccaattgttccgccatttcgcattgaattttcaatttgtcagtttcctctcccttctgctggttagggaacatttgggtataaagccgaacaaattcttaagaaatatgcattttgtttgctttgcttttggggtgcgttttgcctctgtggtttggcgtaatgatcactttgtctgtgcaccctttgaacagttgcgaacattctttgacgaagaacagaccgtccgcgtcaatgaccaaacaaagcttaaaaagcaaagaaaatgatgattgtatctcaataattagatggatttagattggaggggaattacattttgtttgctcctgacgaaatttacgacgtccgccagcaaattttgtgtgtgtttctgtcggccaagccccggcccgaacaccagcgcgtccaaccgctcaatgctgtgtctattcgtggcgaaatcggcgctggggtaaacctattaaggagggcaattagcaaacccaaccccaattagttaactagtcataatgaaaacccacgatcagttccggactgtaacttttgatcaccggagcagcgtcggaatgggcgtaaacaaaggccaaatcggcaccgattttcattggggtgatcgaagcgaaataaggcgcacctaacggggaaaagccataaaaatgcattcatttctctgcaatatgccaccggtgtagtcgggcgaaccgccgatcactccgattttgccacagtcgcccttgcgaaggtgtttgttcggcttcttcgccccgcacaatttctttgggcttcgctttcgaacagcaaaagcgaatgatcgccctgcaaatggcccttcgaattcgccggtcgttgcatacgtattcattgtaatcaactcgtccgctgttgatcaaaaaaaaaaaatttgaaactttggccccaaaatggaaaagaagctggagaaaaaatgaatggccgcctaatacaaactttgcggataatctcttacattgtaatccgaaacatattgctgtgtctgtcataaaaccaaacattcatttaaaagcaagcaaataaatgtattacaaaagcatttctgagagaaaatgatggcatcaaatcaaattccaattgtgtgatcaattgtgacgctgttcaaattgtcgtcccaaaattcgtcgtattccaatgtaaccgccgccgccttttcactaattgggcatcgctttaacagccaataaaaagcaggacttggcactttgccaagagtcagcttttccttggttcgttcgttcaccgcttcaaatggttcaattgatgtatgcactgcaaacagaattttgtagctgacagaagtggtggcacgggcaaatgcctaaacaaaaaggaatcgaaattcaaaggcaatcagtagggctcggaattatatggaaatccatattttttcatggactgttagaggcctgaaacgcacgaaaaacatatttttagcttggtctgaagcttctagaatggagtttctatatccatatttttccaaaaaaaaacccctattagaacggtgcccccccatcagctaaattggctgtttttaccccaaaaaccggtagaaaatggaaattttcagtttttgttcggttttctctatacattgctttttttcttctaaaacggttattatactttgttcagcgattttagatgtatttcatttaatgaattgaagaaaattaaaaaatttaaccctcagttcggcaaacttatgtccatatttatgccattttttgtccatatttttccgagccatagtaatcagtcaatttttatgaaaatatgaccacacacacctccttgaaactgttgacccaattgacgtttctttcttcttcctccaaatcttcgcaaaacaatcgtttcggttgtccatttttgctcggcgtgtgcacccatttggacaacgcttggccaacagttgcatttggtccaccaaatcatcaccaatcgcatcggggaa

SEQ ID NO: 11069 - DNA, 2947 bp, Heterodera glycines
tccggttaatgatttctcatgggtaacatgacaacataaccttcggtttcatttcaagataagaaaaggtcatttaaacttaaatgtacaagcaatctgcttcggcagcactgtcaagaaaatcggaatattggtcaatagaaacacgttaaattaatatactatctttttctctagctaattgagaaaaagcattttcgccttatatttgttttcaacttttacataatgaggaatttcctgcggcgaattatttaatttttttattacaacttttcgctattcaaaaataaaagtttcaaggcccacaattttttatagtgcattgtcgcttatttttttcgcttagaaaagcttctcgtcaaggtcatccaattcggctgcaaaaaaaatcaattaataaagcttcaaaaatattttcaaaaataatcattttatttttaaagaaaaataaataaaaacattaatattgtggagtggactcgaccctcctccttctttccgtttacttcttacaaaaaacttttttgccacacacggcacctttttgataaaggagttcattttcgggactctgtgtaaatggtcattcgtcattgttcagaataaataattttttttaatgagttaaactttgacggaagcaaacggacttagaattagaaaattataaactcagtgttttgaaatgtgttgttagaattccaatgtgaaaagagcggtgaagcattgagaaaaaggcaaactcatagcagaatggactttggtccatcagtcatgcaagttacttttaaaatgaatgccttaaaacctaagaggtttttgtaatttaagtttttattgaacatttgacaagccaattataacgaagccgtaactgattgttgagcgtaatttatccaaaatggatcaaaactttaatttgaaattatagaccccatttttattagtgatatacaaagtctcacgaaatcattttgcaattattttttcttgtttacaaaaaaataatttgaattatttaaaaaactattgacaaaaaataattaatttttgatttatttactctaatatatacatttttagccagcacttattcagcaattaaacgccttaaaatccgtgcctataaaaccaatttttttttctcaacatttcataatcatgacattattcacctatcggatataaaataaaagttttgttctggtcattccatgtgattaaaaaaattaacccaatcactgtctgtttgacaccgattataatattttcagtcaaaatctaatcatttatgatcattattctcatgactttggtcaatcagtcacgttttgatgcttattttttaaaaattaattcaactcaaaagtaactcaatcaaagtttgaggacaaacttaaaggaagggtggacgtgtaaggcgcaatttatcatatccgttcaatctctttctcacaccatttatccccgcttttccccatctttattccgttccataagtccaactatttaatcgggagcattctctcgataaggagtcagttgagcgggcagttgatcggcgagcgagagccgagagcagaacgcggcggaattattattaatgtaattggccaatatttatattattattttactccttctcgcccatccccgcacgcgtattagatctaataggcgcccatgggattacaaatttggggaggtcatttatccagggcccggattttggcttattccttttttcccccaaatccaatccccattttcactcgtcccttcctcatattctgggctggacatcagcaccttcactcaatacagaaaccaattaatcttcttcaattttttccccttctcagctaaaagctaccactttcaaaaatttttttgaaattttactatcgaaattggccaaaagcggagcaaaagaaatgagaatacgttagaaaaaaaaagaaataataaacgtacagaatttctgaagacatttgcaggaacaaaatgaccggaaatagacgaatgaatgaatggaatgaggcggaggaggagaaacaagggcattttatactaaaatattagagtagcgccccgagttgtagcatgtttttgcgtcaaaaagtcacaaatttttgccaatttggggtcacattttcaaaaaaggaaaaaatttttggaaattttaatgttatatggtaaaaaatgttcaaaatttttattcgatatacttgaaaaatgtcgaatgatttttgagatggtgaattggaatttggtgatatggaatttgttggtgcagtgaatgaattctgtcgttggaccaatcactgaattttctgtgtcgacgtgtaaaaaagtggggaaaagccaccaacagaagaaaaagcggacgaacgaccacacattttgtagcagagattgtggacaccgataaatgacaaaagtaatttattcatttattttaacattttggccaaatcatcacaaattaattcgtcgacaaatttccaccactttttcatcggataatttggcgtaaaatgtgaatgaatacataattaattatttattgcataattaataattgtacgtctttgtgatgataaaacaaaatgataaaattgaataaatgatgctgtgataagataaagcatagaaaaagtgtatcgtcttcattagcgtaagcgccgccgccggggtcattttaactggactgactgatcaggattgtgattgtcttaaaaaatgatcaatcattactcagctgataaagccacaattatccgtttagttggttttgagcaaagttagggctagttttttgttgaaaattttcatttgatggcttttttataacggctcagcacccggcggaggctgcctttgatgccgtcgttgctcattttgttgttgcccttctctggcaaccgaggaggacgaagtggac

SEQ ID NO: 11070 - DNA, 2981 bp, Heterodera glycines
cccttttcggcgccgaaattttttctttccttaaaaatcattttaggcaaaactccatcctcaaacccaagccccacaagtcttgagataaaagaattattttataattaaattttccgaaattactattcaaaaatcataaacaattactgccctctgtttacacaaaaaggtccaaatatgttgaagctgtcacttaattatttagttacaatacaacactatttattgcaaaaagccgacaaaaacgaaaatatttgtttaaaaatccattgtttacttgttaatggatgcctccctccctcagaaaggcgtgggatgggacaacttttctcgaaaagtgtacgcccattaaaccataaaaaaaattaatttttttttaaatttagattttcaaaaaattaaaaaaaaaatgggcaacgaaggttcaaaacaaaatcagcagcagcatcaacatagtgccaacaacaacagtggcattagcagcagtgccaacaaagtgggcaaaaaggtgtcccgtcggatgtccatgggcgctggcattccgcccaaaacaccgacaatccgcgtcggtggttccaccggctttcttgacgtgaataatggtaaatccaaaaaataaaataaaattattattattaatttaatttatgtgataagccggcgaattaaaatattcatctgtataagattttttttttttgaatttttagcatagtcctaccaattttggcgtttttcatcctattttgccatttttctcaagattttggttccttattttggcatttttctcaagattttggttccttattttggcatttttctcaagattttggttccctattttggcattttttgcccctataacctgatccttagtaatatttatttaaaaaaatgtatgccatatagacgagcaagtccaaaaataaaatttcaaatgaaattcagaaaattgtgagactacagcgggcgatggtgacagtccccgcctctcactgtcaattgatcagctgtcagcacgttcccgatccggcagccaagcgtcgggaagccaatcgcctaacaaaatgccacaaaagcaacgccgatgctcattgattgtcaaataccgtcagctaatccaggtgtgaaattaatacccccccccaaaaaaatgccgtttttttcacgcaaaaatatgcctaattttggcacacacaaatttaattgaatggtttaattaagggttgcttcaacaacccgcatgaaaacattggcgtccgcattctgaagcgctcagcagagaagcgcaaagattttggccgcttttacatcagcattggggcggaacactgtgcacgcattgcggacatactaaagcaactgttgaagaaatcagtggccaacatttacggtggtgatgaagaggtacggtagggagagagagggacaaatactctgggaacagagcaatactacggtagtgggcgaattacaggaaaatcatatggtatggattaaaatggaggtaaattattctacaatatgattacgaaaggggtacggtagggagaaagggacaaaaacgataagaaatttctctaaaattacagtatacagtgagataatcagtaatttgaaactgagctatggtaatcacaatgttgatactgtaatactaataataaaaaaaacaaattatagcttcaaagcctggcaaatgagttcggtgcccgttttgttgacttgcgcttgctgggtttcaaggcggatttctttgccgttctggccgattcgaccaccatggaatgtgtactgctcgacgccgctgtccatccagcaaacgttacactgaatgctttctcacagttcatcacaatggtcaggaaatagaatatttaatcatttttcggcttaattagggtcgtgagactgattgtaaatgctcccccgaaatttttattttttaacaataatggaagaaacattctaatcttgctgggataaaggtattagaaatagtttaaatatgttactgttttaaaattaaattccgaatgtacgattcaaaaatgaagtcgagatttagggatgggcggaataggtttatctagaaataaaaacatttttcaatttttaaattataaatatgacatttttagctgttctctgctgtccgtgacggtttctacactgaaatgcgccgactgcggcgtaccagcaacagttttaccatcaacccgaacgcaccaaacacaatgatgaagaaattgtcggttgatgacaatatgaaggtggttaattcattaattaattcttttttgattaattttattttgaagaaatattttaggtcagccgagccttgcaaggtgcccgatcaatcagtccaagtccggaactggagacatgccaaaaatgtaagtgaatgtttttatttaatgaataagacctgaaaaaagtgaggcgattagaactatgaaaaattttgaaatttaaacacaaattaattaacctatctaattctgtgattaattaaaaattaagaagaatttttttatcaaaaaagatttacctagggattgggagggttaaatattactccaatataatcaattaattcattagttacatataattgcacttcattgctttagccgcgcatagctccccaattggccatggaagtcaagaatcaattacggaccgtcaatcccagcagaataacaacaatggcacaaatagtcgcaaaatttcgcccgaatcactgcaggccaaggaggaaattcgtctgctaaccgccgaattcatgggccgtgcaatggtggtcggaggcaaagaatgccagcgggactgatcagtgcagcagagcgatgatcaatttttaaaaaatcatttttttgagacgataatttgatcaaaacggatttaagggcgcgggaatttggaggcaaatgtccattcttggattattcttttttttcttgatgaaatgc

SEQ ID NO: 11071 - DNA, 1480 bp, Heterodera glycines
  misc_feature (1462)..(1462): n is a, c, g, or t
ttttttcaattttcgaaatcttcataaagaaatgcccaattccttcacaaattctttctgtttgccttggccatataaacttttaaattcatcaaatcgttcaatgaattcgttctttttctgcttataataattattttccatttttttgtttttctttaaattcaattcttttttccatttatatattttttcgcgatttactccaataattttccaattttccactcaattttagttctattttttcgttgatattttcctttttatcttaacttttcttttttggtcgctttttctttactttcttttttgtcccattcttcgccgaatatttgtcaaaatttggtcggattttgcctgattcaattccaaaagcaaagaaaattaataaaaatattaattgacacaaaatcattgaatatttttataaaaaattaatattcgaatttattgcttcaaatgaaactattttcgtttattcgctttttattaactttaattttgttatttattatgttttcttcgatggatttttcgtaattccgaggagcgaaatcaatttttcgctcaggttttaatcaatttctcattcagtttttgataaaaaattttcgtaaaaacatgttttattgataatatgttaataaaattttattgtgacattttttgaaaaataaaaagcgataaaaatatcataaaagtaagtggattttttgtattttaagcatcaaataaatactccaatgaggaaaattgagaaagatgaacatatattttgaaattaaaaaaataaattcaaaaatcagtgtccaaataattgcaaagaaattagaaatttaaatccaaacattggtcattaggaaaaagaaattttcattatttacaaaaatgtgattttttgtggtacaattataaaaactcattaattatatttataatttgtcttgttgatgaaaatgcttttttggtgagacagaaaatgttgaatttaataattttaactttttttcaaagaaatcgcaacttttaagccaaaggatattgttgacaaaattgtaatttgaatttaacactgccttacaaatatatcaataccgaaagaatttatcgcttgaaaagcaaaacatagaaataaaagaaaacaaaaatgggtggttatacaaatatactacagtaataggaaagtgtttacagaaataaattagaagaaaacagtggaataatgccaaaaaattaggcgttgtcaccgaattggcattgtgcgaggacggagaagggcactacaaaaagtcggtgattcggccatgtcggaatttaaggcccactgtcgcggatgaagattggtaaaccgggggtcggggagggacggggagaagcacaaaaaaatcaaacggggacagaccttagcgaaacagaaatttgtcatgcgccctaaattgtttgtgctttcatcgaattntccaaatttaaatttttt

SEQ ID NO: 11072 - DNA, 1645 bp, Heterodera glycines
cagttcaacttccatgaccaatgtgatgaaatcggcatgaaattgttgtacaaacattttcactatggccaaattggcatttttgctattccccgcagaattttggccaacattttggtcttcacaataatggaatggcctcgcttaatgagtataaaaactgtgaattgtctttgttgaatttgcagttttgctttttgtcatttggaaggcacaaaaaaatgcatttctttgactttttgttctaactcagttaaattgcccttcaattcaccatcacattctaaagcagttttttaaatttaagaattaattaattgttaatattgaaaaattacaaaaaaaacaattatctaatgtaaatttttaatttaaaatgtaaagaaaaaaaatactttcagctttctccgcagaactcttgatttttacgagaatctctttacaagcattcacccattgctcttcaaattgtgctgcaaccacagcggaatgaatgccaatggaaataataatggaatataaataaatgttcatctttcctgaatatagttaaattcattctttaaaaaaagagggcggtttttttctttttttaaattatttaataataaattattaattttagagaaatgatattccatgcatgtttcttatttaaaaagaaattgactatgctgtataaggtaaaatgacatgtcattattgccgtttccatttatggcatatttatgaatgtattcattaatttaaaatataaaacatttgcatgaatatttatgcttcatagaattatgacgtgaaattattgtcatttccattaaaataaaaatatttgcgttaatatgtatgcttctatatttttattgcataggcttatgacgtaaatgacgtggaatcattgccatttccattaaaatataatatttgcgtgaatatgtatgcttctatatttttattgcataggcttatgacgtaaatgacgtggaatcattgccatttccattaaaatataatatttgcgtgaatatgtatgcttctatatttttattacataggcttatgacgtaaatgacgtggaatcattgccatttccattaaaatataatatttgcgggaatatgtatgcttctatattttattgcataggcctatgatataaaatgaagtggtatcatggtgattagaagagttacaaacaatgattagaagaggtacaaaagtgattagaagaggtacaacagtgaaaaagtgatacaaaagtgattagaagaggtacaagtgattagaagaggtacaactttgattagaagaggtacaacagtgattagaagaggtacaagtgattagaagaggtacaacagtgattagaataggtataactgtgattagaagaggtacaacagtgattagaagaggtacaagtgattagaagaggtacaactgtgattagaagaggtacaacagtgattaaaagaggtacaagtgattagaagaggtacaactgtgattagaagaggtacaacagtgattagaagaggtacaagtgattagaagaggtacaactgtgattagaagaggtacaacagtgattagaagaggtacaagagagtagaagaggtacaactgtgataagaagaaggtacaa

SEQ ID NO: 11073 - DNA, 2511 bp, Heterodera glycines
agtctaaaaagtaatcaaaatataaaagttgaccaaataacgacccgagtgaagtaacaaatctattatcaaatataaaacaatttaatcattatattcatatatttattatcgctttcaaaagttatacacaatgtaaaaatatctaaattattgccatagtaattgttaacctcaagatgtgtgcttatcttccaagtcagcaactaataaaagataaacataacaatttcgaatataaataatttacttcacatttattaaattccacaaaaccttaagtcggaattattaaagttttaaaaaagttctagtcaaataattttgactcaaaacttattgaaaatttatactataacttttttacgattttataaaaaaaatttgaatctgatagaatcttcattcaaacttaaatattttttggttatttttttcaatgtggacatacgataaataataaatattaatattgatacattttgaaaatattcaaaaaacctatgatgcctaataaatattcggtaatttgaattttttcaacaaaatttataattattatattgcatcattaatgaatagctattacattctttgaaaattttgaaaaatttacaataatttttcaagagtgaagtttattcgcactaaatttttaaaaagaattttttattgaagcgattactttaaatatttaattatttaaaaagtaagttttatttataaaaaagcagaaatttatggaaaattgggttctttttcttttttttcaaacatctttcaaaatgcaccgaccaaattctttaattttctttaaaaaattggttctaaataacaaatttgtatgcactgggattttatttaattttttatataaggaattttaaaaagttaaaaaattttgattttttaagtgccctacagcaatacgcgattacgcggcaataattacgttaaaattaaacgagtaataattttaaaactaaaaaacttaaaattaaaaagcattaaattaattaataaaatttttgttataatatttatgaaataaatattataagagagtatcagtagttgtcagcatgatcacggaatatgagcaaaactccttttcagaagtttttaatagggttgcgtccccgaccccgaaccccgacccttaaccctgactcggggttaaatatacacccctaagaatggcattttcgtgagagaaaaggcaaaaaaattatacaaatttgaatttttttaaccattttgccaaatttttattaaataaagtaatttgcttttgttcattcatatgtagtagtgatgtagtggttagtgcgttaacactaaacactacttttgtcaagagttctacctggttgacttcttttttaatttatttttttttgtgattaatagggttttctaaacaaaaatacccataaaaataacgcgccgcaaaaaaatgattttaaaaacaaaaaacttttcgggaacaagggtccggcagtgtctataagcgcggccgcgaaaaatttttgaaaattagagaattaggatgcaattttttaactgattttcaccaaaaataaccaattttttcgactttaagcaaaatttttttaaggaaaaataggttttgtgggtccggcccggaggaaaaatttgaaattttgacaatttttacagattttcattgaaaattgttcatttaaaaatgccttatcgttttaattaattctatacaaaaatatttatgataaaaagaaataaaaaagtacataaaattattattatgaataataaaaaattttaagctaaaataatttaaaaaatttgactttatgctataaggcaaaaattgaaaacccccgaaccccgaccccgaacgattttgtcgaccccgacccgaaccccgacgcttccaaccccgacaaccccgaaccccgacttttccaaccccgacggtcggggacgcaaccctagttcaaagtgttgtcactagggaatagaattacatggaaatccatatttttttcctggactgtgggaggcctgaaacgcatgaaaaacatgtttttagcttggtttgaagcttctaggaaggatttctatatccatattttccatatttttccatatttcgcgatttatgtccatatttccatatttttccatattttggcattttggtccatattttatgtccatattttggcatttttcaaaaaaacctctattagaacggcccccagcagctaaattagcctttttgagcccaaaacccgaaaaatttttcaaaaaatcattttttcgccaaaatttctcgagaatattgaataaatataaattttcttaaaaattaataaattatgtcaaaaataagcaaaaaagcgaaaatttcgcttttgttgttgattttgcgctaaaaaattaataaagtttagcttttatgttttttttcttttaaaatgatccaaaatggttgccgaaaaaattcgagaccaatttccgaatgtt

SEQ ID NO: 11074 - DNA, 1543 bp, Heterodera glycines
attttaaaattattattgtttttaatttaaaaagtttccatagagaaatcccgggggaaatatgaaattgaattacggaaaagtgtatgcgtatttttatctaaattgcaaatgccctgtttttcattattttaattattattatttgctcaaaaagaaaaaaggccaagtgagaaaatttcgaaaataaatgtaaataatacaaaaaataaataattttagatttttgtttttccagtcacaaccttgaaaacgacggccactgccaaacctacgcgtcctctgctccttctccaaaatttttcgctgccgctcctgtttctttacgcaaactctcctattcaaaaaagttgtctttttataataatgcatttcctactatcaagaacaattggttcttgtggcttatccgtattgacttaatccgactcccgaacccggattcgaacataaaaatcaaaattcgtttttcaaaaaaatcacattttatacacaaaatcgcttcacaatgccacgatgacgactcgtataacctaaaaatgccacggccaagacagcacaatcaaaaaaatgccacgaccaagaccttataaaaatgacatgttttgctgtgcgagtcatcgtgacattgtgaagcgattttgtgtataaaatgtgatttttttttgaaaacgaattttgattttttttttttgttcgaatccggattcgggagtcggattaagtcaaaatggatgccaaaattgattttcccggccctaaaaaccgccaaaacattttaatactaaaattttttttttgaaaatctgcgtacagataacccacaagtaccgaaaaattttgaagaatatttaaaaataaataaaaaatgatacaaaaaatgtgtttgttattcatgggttgaagaaaaatcaatagatagtgcaaattgtttatatttgaatccataatctgattatattagtgataaagcaaataatataattttatattatagaattttttattaatcatatttggtttattattaaatatttttatatttttgaaaacttcaattttaaggtttacttttttattattatattaaaaattgaataatggttataaatagggaagtaaaaaatttagcttattatcagatagtgatattgacccaactgatgctttttcttaaaattgctgtcgtattttaatggatttttcgatgaaattaaatagtatttcgaattgtaattcgatgtcaatgaattgttttcgtttaattttttatgtgctgtttatatagataatacagattgtctgaaccaggcaatattttaaaatttgaccaaaaacaaataattaatatccactttaatggcaaattaaaaataaacggccgtgttttctttaaaaaataatttataaagatatgcataaaaattgtaaataaaattaatgcaaatgaaaaaaggcccaaaagattttcatgcgagaaatgaaatgcagaaagcctcgaatttttagaaaaaagaaaaatttaggaaaatggagacgaaat

SEQ ID NO: 11075 - DNA, 626 bp, Heterodera glycines
aagcacacgttctgatagaataatatttgcgaagaagctattctaaaggaaatgtacctcatttgcaactgcaaaaagtgaataaaaaatttttttgctcatttttggatgaaaattatgtcattatttgtcactagttcggactttttgtcactattttggtatttttcctcactattttagctaactatttcgagatttttcgtaactaaaagttgcgaccctattaactattcatcatttgtctcatattttcctcatagttcgaattcattttcttcaactgttcttcaaatgatgtcacaattgtactcaacgattgctgagcaacggcagaaaaagggaagccctgctgatcacgactaaaaagttgagttttcgactttttgttcgaatttggtttcaagacaggaattggtcgaaatggatgccggattagtgatcagcgaatcagaaaatcctagaaacaatttttcgttggtgatttttgaaagcaaaaaacattttttttcaaaaagtgatatatgtaccaactagtgtcgataagcgacgccggggaaaacttagaaaattagagtgcaatttatgaacagattttgtccaaaaatacgaacaattttttgcga

SEQ ID NO: 11076 - DNA, 1379 bp, Heterodera glycines
aataatacccctggggagaagggagtgggaaacatgatttcaaaattttcaattttttctagtctaatctactcaaaacggttcagaattcaataaaaataacattcacggtgcgaaaaatggggtttgacaagtttattagggaaaaaagactttacaaaataatacccctgggagaagggagtgggaaacatgatttcaaaattttcaattttttctagtctaatctactcaaaccggttcagaattcaataaaaataacattcacggtgcgaaaaatggggtttgacatgtttattggggaaaaaaagactttacaaaataatacccctgggagaagggagtgggaaacatgatttcaaaattttcaattttttctagtctaatctactcaaaccggttcagaattcaataaaaataacattcacggtgcgaaaaatggggtttgaaaagtttattggggaaaaaaagactttacaaaataatacccctgggagaagggagtgggaaacatgatttcaaaattttcaatgttttctagtctaatctactcaaatcggttcagaattcaataaaaataacattcacggtgcgaaaaatggggtttgacaagtttattggggaaaaaaagactttacaaaataatacccctgggagaagggagtgggaaacatgatttcaaaattttctgttggagaagagcaaagtacattttctcatggtcacttatcgattgacatttgtccattccctcctccgttcctcccacatcacatttgttatttaaaggcgtggactcttccccccctcgttcacttcttctcctgtcttcacttttattattttattcattctccatccatccattcgccattttattattttattgttatttgactcttcgtaaataaattattttatttgttggtctttctcactcggacaaaagacacaacaaatttggcgcagtcagcagtcgtcttcaaccaaacagaagacacccggactgcacagcaacaaaaccaatagaccctaggcgggtgaggtctgcaaattctgcagtttttcgccatcgacaaaaccaatagtccctaggcgggtgaggtctgcatatattgcagttaattcgccgaaaaaccaaaagacctgagaaaggttgcggttccgcaatacgcggtttttcaactttggactctcaaattcggcaccggcaaacacttcggcatgagcgcggaccaaattaagcaactcctcgaggccatgcgtgtgcaatcggatgccattcaacagctaatgggccaagcaccacaaaacgccacgagtcttaaccacgcaaatttggcgagttccatcgacggccgaatttcaaaattcaatta

SEQ ID NO: 11077 - DNA, 1493 bp, Heterodera glycines
gtaaggagttcggaataaagcacacttttacgccgccattccatcctcaatccaacggacaagtcgaacgtttcgttgacactttcaaaagggcgatgatgaagtgcaaaggcgacaagaacagccttgaaaaagtgctgctctcctacagatcaacaccaaattctgccatcgacggatattcgccagatcaattgttccttggacggaaactgcgcaccaaattggcacttgtccacccaaaaggacaaattgatcagtcggaaaaatttgaaaaaggtaagttcaaacagcatcaaaaggactactctgccaaaatggcacagcaattcgatcggaatcatggcacaaaagctattgagttcctcccaacggatcccgtcctgctcttgaattatcgtcttggaaaaagccattggcttccgggcacgattgtggaaaggctcaacaattcgcctacataccgtgtccacgttccaacactcggccgaattgtccatcggcatgccaaccagcttcggcgccgattggattttgaggacaattcaaattgggaaccccccattcaggaacaaatggccattgagccaaatcaaaggacaccgccacgccaacacgcagccatcgatcagcgaactccacctgttgttgatcaggctaggcaaaaggctaaaagcccaattggcgtccgacgttcccaacgcgtgccgaagccggtcaaacgcttcacgccaggttgaaactgaggatgtttcaatctcgagaagggaggtgttggagaagagcaaagtacattttctcatggtcacttatcgattgacatttgtccattccctcctccgttcctcccacatcacatttgttatttaaaggcgtggactcttcccccctcgttcacttcttctcctgtcttcacttttattattttattcattctccatccatccattcgccattttattattttattgttatttgactcttcgtaaataaattattttatttgttggtctttctcactcggacaaaagacacaacattttcaattttttctagtctaatctactcaaaacggttcagaattcaataaaaataacattcacggtgcgaaaaatggggtatgaaaagtttattggggaaaaaaagactttacaaaataatacccctgggagaagggagtgggaaacatgatttcaaaattttcaattttttctagtctaatctactcaaaacggttcagaattcaataaaaataacattcacggtgcgaaaaatggggtttgacaagtttattggggaaaaaaagactttacaaaataatacccctgggagaagggagtgggaaacatgatttcaaaattttcaattttttctagtctaatctactcaaaacggttcagaattcaataaaaataacattcacggtgcgaaaaatggggtttgaaaagtttaaggggaaaaaaagactttacaaaataatacccctgggagaa

SEQ ID NO: 11078 - DNA, 4994 bp, Heterodera glycines
  misc_feature (2508)..(2508): n is a, c, g, or t
attggccaacttggcgagactcgcaacaacgacttgaacatttctggcgacgatggcaccgggaatacctcatgaccttgcgagagagggccggctggcatcatcctcaacgacgagtgaatgcacccggggcaccggaagtcggggacgtcgtgcttgtggaagacaaattccaccctcgcaacttatgggccatggggcgaatcgaggagctcagaggttcagacggtcacacccgcagcgtgctgatcagaatggcaaatggaaggatttgggggagacccgtaagcaaaatttgccccctggagagaagtccagaaatgggggaagcaccggaccaacgggtcgaagcagtacaggaagaggaactcggtgcggttgctgggacagaagccgaaggtcagcccggggaggacaacaatgctccccgtggcttgagtggcagtgagggagaaaaaactgtggaggctgaagaagtcgcgcaagacgaagcagaggaagggcccattccaccgagtttcgttcaaaacgaagtcgggagcacctctcccgcgtcgcaaacaaatgagcagatacgggaaaccgtgaaccaaaagacggaagcggagaaagctgactcaccggagggatcgaacagcatgcgagaagttgaaccacgaaggtcgcggagagtccgacgaactcgagaagtatggtcaccggaccgatgtgccacgaaaaggagggggattggtggccccctggtcagcttggccatgatgatcatgttggtctacccgactctgacatcagggtgtcagccgactatccgacccgaaattgttggacaacagtcacaggaattgccaacaacgatgttgccgtgccatatgcggtgtacggaacgtggagtgaaagtgctgagcgggcagcgactcgaaaaaatggaaatttgttgccctgatggatgctgggcaattgtgcccatttcgacggagatcagctacgagctaccaactgaactgctcgtccacgattaccattgcagtggtcaatgctggagggggtctggccccccttataacatcacacagcgatgtccagcgagagcagaatgcgatctgatcaattgctccttctgttgggagcagctggccaacccgacgtgcaacccgcgatgggcatcctcgctcttcgggtttggagctgcaattttgctcgccatcatcagctgcttctgctcaatttttgggcggtttttgtcaggagccaagctgctctcaaaagccgtggcatggggagttcgttaccccatcgggctgatcaattgggcaaccggacgcgattttcggaaaccgaccacggagcaaatcgaacggaaagtgaggaaaggagcgagaaaggcacgaacggaaatacgggagctgcagcagcaactgcaattgggaagacgggctcgggcgatggccagagcgtggcaaaatcccgacgggactcgaaaagcctttcccgcaaaggcagtggcagccctcatcccattgctgctcatcatcgatccggccttcctccaattttcaccatataatccatcgacatctcgcatataatcatccaccaatttttgaccattttatcatcatcatcaccaataaacattttgtcggaaaagtgttgaaagggtcagagggcaaaaaaggggggaaaattcgctcgggaacgaagtgaccaaggggagccaaagccccgagaatcgaagcgggggacaatcccccgcagagcagcagcaaacaaggacgggagccagttcccggcggttgacgcagttcgcggccggaagtccaactcttctcccgaacctcaaccgggagcgccggcagctcttcaaaaagtcggtggtgccgttacagcaacaacagccaaccccatcttgtttgtcctccccaccccctccccagttcactcccttgggcacggacccaacggcagcagtagcagtttcaggaaattgagtgaattgggcccgagggacgggagagaaactcccgcgcacagaccccctagccgtcagcgccggccgagttttctttgccacaattatatttaccccaaaattgagccaaatgcgtacagaaactgatacatggtcaacgcgaacaaataaccaccaatgttaatggacaaaatgataaccagtgaccgtagcagtcgtgtgttcgtctgttgggttactgtaaaaataatttgaatatttggcacaaaataaaatgccaaaattaccgccatttttgcatctgatgatcacaaaaattgacacataacagcaagtgctacccaatgaaataatgaatgtgccggcgaagaatttataaccaacggggcccagcaaagattcggccacaacaccggtggtcggactaaaataaatttggaaattataaataaaattaatttttaatttaaattgcgtcatactttcccgcattttcgaatgcataatcgaccacaaaatattgaattaatgcaccgtanattacacaaatgaaaagcagaccgagcaaataggagaatttgtatttgataaaaatggaggagtgtctaaaaaatcaaattattaattagagttaattagtatttgtggatataattcgatcaaacatttttttaaattaatttctatacttatgtggcgaaatgacagcaaaaaggcgatcaaaagcagcacaaatattgccattaagccacaattcaaagcaaaaatcattggctaaaaattaaaaaattaaatcaaaataaaaaaaatatttaaaattaaatttaccgtcataattaagtcagcagtgagcaaactgacaaaatttatgcccgaatgacaacaaccaggaaaaaagtgtgcccaatttggtggaccaattcacaaagacaaatcagtgccatcagaaaattgacggagccgcggagggaactgaaaaatagaaattgaaattcaattcaattatgataattaaaataaaaatgctaatggcatttgcctcgatttgaccgtgaccaccaaaactgtgccgtgcatcacaatgccaacaaacgcaaccaaatacagcgcaacggccggcacaatcaaatcggcggacggaccgacaaaacggtaggccaaataaggctgaaaacattaatttaagtcgaaaatttaataatgtttaaaaggaatgaattattttgtattcacttaaatatttattttataatttaaattctttttttaatatttattttaccgcattgtctgagctggtgttaattgagggcatttttttggtcaaattttgtgataattggttaaatttcaatgtgtttaaactgaacttaaacatttcttttatagcatttttccgattcgaaatgtttaaaaatcccacgtttaatgagcgaattaatttttcatcaaattcaaaactttcatttcttaaattgtctcaataaatttttaaaaatatttgatgtacttctaacatcaataccattccaaaacaggcattctattgtactgattttcaattttattattttctgtgctttagtattaattgtgaattttaagtagaagcggaaattgtttctttctttttttttttggtttaatgggaaaatttaaatattgtattcgctgagaaaacttaaataaacgataattttcactgttaaaagtcttattttcaaatattttcccattccaatataaacgggggccaataaactttcaattttcccatgcactttttgtcagtataattaatctaaaagttggcatccaatttttgtgccaatttcttttctcgaattattaattaattctcatgagattctttaaaccggggtcatatgccatttggcagcttgcgaaaattttgataacttcgctcaaaatggaacactttaaaaatttttttgaaattttacaataaaatagaaaaatttagagctatcgaatgatataaggaagtaagtaaatgacgtctcttccacagccaacggagagagacacaaaaaataggaaaaccaactcaatgatcggttgggcagaccacataatttcgtctcaaataagctaggcgagatgtccagtaggcgaaatgtcagattttggcttagtaggcgaaacgtccgattttgccttagtaggcgaaatttcatacagccgccacgaatcatggaacgtttgtttctaacgatgcatttcatgtgccaaatatgccgtgccggaatcctgcacggtaagacttgggtttaacgggggtaaaccaaaaacatgtttaatggttcttaaatggcgtatatttaataggctaatcaatttttggcataaaataggcgacttcttggcgaaatgaccgaaaaaattgagaaatgagggcacttataagtagagaccggcgcgggacgggatcccgcgcgggattttgcgggatcccagtctgcaatcccgcatttttggaaaatgcgggatttgcgggattgcgggatttgcgggattaatcccgcgggatcccgtcccgcaaagaattttgagttctaatcccgcagcgggatccgcaaagggaattttgtttgacggcggcgccaattccctatccgaccccgccctgaattccgagccccgaccctgaacaatttggtcagccgcgaataatgttgttcaagactctcggtctcgagtctcgactcgagaaaggtgtcgggtttttggagtttcggtctcggtcttaagtcttgaggtcaaatcggtctcggtcttcggggtcacaacactattatgaaggactagtgtggtcccatttcttttcaagtttcccggcaaatcttttcctagtgtgggggttggcactttcacttcccccactaataacttttgtgggaaagaacaggcataagaatcatcatcactagggatgggtatttaccgtcaaatgacgtttcttttgctgactttatatggccttatgattgaagctgcgaacatg

SEQ ID NO: 11079 - DNA, 1147 bp, Heterodera glycines
aatttgactatttttcttttcaaaaccacttttttgcggtgcaattttcaaaaaactagaaccagggggtccggcggtccttatcagggatggcattccgaggccccaaaaattttcggaaatcggatttccaaccccaaaaacgtcggaactcggaaatttttcaaaaaatatacaatataataaaaaaatttctaaatattttaataggctaaattttttaattcttaaccaagtaaaaggtatttcacaaatgtttttagtatattcgcttgaaaaaattattcaagtattttatcaaaatcttttttttatcatttttcattattttagaacatttgaaaattttagccaagtattaattggatatttggctagtggttcaactatatattacccatggagaacagtgagtataaattcgtatttttcatttgttttggatggggtaatgaggataaataaaagattcaaaataatgaccctgtatattgcttacaattctgaaaaaagggcgggaatgaatacggatattgattagaaaattttagcgatattcaagaatttttaaatgcatctggccagttttaaaatttcttacattctaattcgttttgtgcgggaagcttaaaaataatccctctttctgataattaccgttttcgtcaactggagcaaaacattgcgtgctattttttattttcgagaaatgtttcttgtgaaattctgcatttaaaaaagaaatgttatttaatttcatatgccaagaaaagggcggttaggactgtataaaactggtaataaaacagagaataaattaaaattccagaattctgaaagtatggtctgtaatgtgactctttctgagcagatgttcatgttgtttattaaaattttgaactattttaaagggtgaagttatatacctagaaaatgtaataatcgtatgttatatactgcagaaatgttaggcctagccgaaaaaagaatgaaaattttagccaagtattaattggatatttggctagtggttcaactatatattacccttggagaatagtgagtataaattcgtatttttcatttgttttggatggggtaatgaggataaataaaagattcaaaataatgaccctgtatattgctt

SEQ ID NO: 11080 - DNA, 2177 bp, Heterodera glycines
  misc_feature (2150)..(2150): n is a, c, g, or t
  misc_feature (2164)..(2165): n is a, c, g, or t
ttatttactctaaaaataaattcttcaaaagaataaccgttaattgaaaaaagtcagtaataaaaaaggaaattttatataaaaactttttaaagtatagtgcaaaaattcaatttgtgaataaaaaatgaaataaaaatgcttttttgactaattacggaaaagaataacattgaaaaaattttataacaatattaataaaaatcaataatggttgataaaatttctatttttaggcgttattttattgtaaaaaatgtacgaaactaagtttttttaaatttttttatagcgaatatactataaattaaatctgtacaattttttattataaatatttaatttatatatttgcaaaggaaattatattcacaggaaacagttgaagtgaatagaaaatcctttgtgctaaaattctgaaaggagcatatagtggaaatccatataatgagtaaaccctaatttatgaataatattataaaaacaagagtcaaagcaaaaccaatattctttttaagttaagacttaaaatgtaagcaccttttttcggcgcttgtcggcactgccggaacgtctcattctgttttttttaatttggttcaaaaaacaccaaaatcgtttccgaaacctgacataaattcattgatgcaatggataaggaaaccataaatgcatttgtagacagctcatatttctcacgtaaatgaaataattaagataccacttcacctaatctccgtgtgcaaccggactgaatttttcagcacattgtcatttttttcagaaaattttcccatgtttcaagcaattttttggttggccaatgaaaaataacaaatatattggtttttaaaggtttattttattaaaaaaaattattaattcattcttgttacttcagttaaaatagatactcgagtagtaatcaaaactttcgtcagttttaatgtttactgttgcggttagttataattatttataaattattgtatttttaattgtatttagcaatttatagttacttaaattattatagaatttttataataatctagttaattaagtttttttttataatacattctttattgttgcagcttatgtgattctctttttattggaatcatttcctattaaatcaatgcgataatttatatgattcaattttttaattttataaattttttgtgcgataattccgtaaaaaatcatgttatattttcaatttgtttaggtacaactttattttcgaaaagtaatttgattaaaaataaaataattcttggcccatttaaaaaagaatttacttatttgagactgtgtttcagtcgagtcgactttcaattacagacaattttggccacttaaaaacatattgttttgattccattttagtaaaatttaaaccagttgacctccaccgcacaaaaaaaatattaaaattacctaaaataaagctaaactgaaattatttaacgattgcaaacatacctcgttaatcatttttacaaatcttttaaaaatgcaaacaaaattttatataatctaatggataaaaaaactaaaagaaaaaaacctttttctatttgtcgcaggcgcgggagtaaacctagagtaattctaaaatataaattagtttctaaatgggctagataatatataatattgtattaaactgcaaatttcattatgaaatatataaataatgtgaaattaattgtcaatatcaattataatttattattactaatattattcatgtgtgtaaaacaacttaattattcaaactttttttatgagaaaaacataatttgactattttcctaaaaaaatttaaggagtccgagaacgcagaggaccttcgccgatcctgtgaacgtcttgcggccgaattggggcagaaaagaaggaaaacgatgcttgaaggttaatcaaaaaatttaaatttaataacactaattctatggtaattaatattgtaacaaaacatatatctcccaaagcataacaacaattacttgtatcatagtaagaagacgaaaaataaattttagtcaaccaaatggcgcgatataaaaaattaaaatatcattaaaataaaactgaatgatgaataaataatcaaaatatattgaacagaatatgaaaanggtcaataacaaannatttcataattg

SEQ ID NO: 11081 - DNA, 2989 bp, Heterodera glycines
tagtttctaaatgggctagataatatataatattgtattaaactgcaaatttcattatgaaatatataaataatgtgaaattaattgtcaatataaattataatttattattactaatattattcatgtgtgttattaaaacaacttaattattcaaactttttttatgagaaaaacataatttgactattttcctaaaaaaatttaaggagtccgagaacgcagaggaccttcgccgatcctgtgaacgtcttgcggccgaattggggcaagaaaagaaggaaaacgatgcttgaaggttaatcaaaaaatttaaatttaataacactaattatatggtaattaatattgtaacaaaacatatatctcccaaagcataacaacaattacttgtatcatagtaagaagacgaaaaataaattttagtcaaccaaatggcgcgatataaaaaattaaaatatcattaaaataaaactgaatgatgaataaataatcgaaatatattgagacaaatataaaaagggcaataacaaaatttcataattggatcacaacggacttgaataaaatttaattcatgtttaaataaaattagaaatataatctgtgcatgcattaaaaaaatatttaaaaaaataaaatgaaaattggatataaatactttaattaataacgccaaccgttacaattgttttggataaaaaattattattttgattttgataccagcaacaaatgacatttttaattggctataaattcacgaataaattaaataaaatacctaacaattcttttaaaattaagagagagaacttaaattttgtcttatttaatttagtaaaaatgatcgcaactttggcccgatttatccgcgtataaatattagaatttaaaaaattattattacattaaaattttaattacaaaattcaacataattaatgtaattcgttaaatatgaaaatgaaacaatggttatacaaataataaaaaagataatctacagcaattttatagaagcaaaaatataacaataaattaaaataaactttcaaaaatgttcgcctaatgcgttaaagcaattaatttacaggaagaataaattagtaaaaacatttagaaaaaataataaattttaaaggtattaatgaatgaattaaatgacaattaatattaaaattaaatagataattatctaaaaataataatccctttgaaagatatagaaattatttttatatatatgtaaaattaaagaaaactaaactaactaaatgaggagaagtcctggtcattaagatttgaatagaaacttaagtgaaaattagtcttgaatgatacagaatgtaacattatagccgccccgttttttatgagctttaatttactttatatatatatatatgaaattagtaaatcatttaagataacttacgattaataacttaattttttatggcatatgaacaaattcattttaataaataaatttaatacttatattagcttctttcaaaatagggtatttttcaatgtttattcaatggttcttggtttccaccctgagaccttcagaacgagttgaagaacttgcgtagttcatccatgactgatttgagcgcccataaagagaaggagagaagggttaaaggaatgagggagacggagcaaaagcggcgcatctcgacatccggaacaaatgaccagtggaagtgaggatatggcttgaaatggtggccaatttataggcgccatagggatggccagcttagagcaagaagcgagagcgtcagttgttcactttgcgttaaatttaaatttgaatttcccgccaaatgcataaaaggacaagtgtcacaagcgggaaagagagagagtagtgaatgatgtattttatttatttaattttcaattatttatttcatataattttttttaaagtaattttttatattatttttaatttttcatatgatttataaaaatagtatgttgtaattggtatttttttattcgtttcttgagtttttgtaattttaactatgtgaaattcaattatttattcatttctcttataactcttttattagtcttgagttcttgaatcgaaaggtccattgggtcagtactttttaatttatcattatagagttgttttttgaaaaaagtcctatttttgtattttttaccttacaattattttcttctaaaatatttattctagtcttgaaacgggcatgaaaatggcaattgagggtccagtatttaacacatttttgtcttttcagtgaagttataatttcttattcaattgtattatagaaaaaatttggtggatcttctaagctttttttgattcattttttaaaattatctttgtgtttgtttaaataatttgtttattttttattagttaaataataaattgctatcaacgatttaataaggcagatcatcaatttcatatgaatattgtggaataaagaaaataaacgaattttacggattttttctttacttctaacatgtgaagttcaaaatgacaaatcacaacccaaaaaacacaccgagggcagaaatgtttaagccgattaattcaacttttgtttttatttattttttcgtcaaggttttattttatataatttcaaaacggatgttttttttaatgttgtacaattataacattattctattgtattcattgtgacatagttcgaagaaatatttaatgcttgttaaattattattattatgtttggtagttagaattttgattatctaaaattatttgtcaagttgaaataagtgtaaaatttttattaatattcaaaactttatttaatcctagcacatgtattaaagcttaaaaattgaaaagaaactttgaattttaataacttttttttctcgctttctctcaaacgctgaccggtttataatcaagaagcgtacatagaatcggcgcataacaaggtggatgaaa

SEQ ID NO: 11082 - DNA, 2777 bp, Heterodera glycines
ccttttgctgcgttacgcccgcctgttcaagacggcgtcagtgcttgtggccaccagtcaacttgtccaagtgattgggattttgtttcttaaaaatcaataaatgccatattttttgaatttttggttgtgccattgctctcagaaatgccaatttcaaccccgcaagatttgcattccgaaattttgcaaacattattttcttgcgtttcggcaacttttcgattcataaagctcctctgatcactaattactcttgatcagttgggatagagcattttctcatattttaagtttgtaagtgccaaaaaaaattttttttgcttaaatccatagggaaaatagcaaaaattgttaagagttatatttttcttggaaaatgcttaattatacttaggaatttttcaattattcacattccttaattaaggaacaaatttttataaagaaaagagttcggctatttttcttatgcaatatttaaattacatggtttttttacaagaaaacattgaataatttttttaaaaataaattttaatagtttcaatgaaattcgaagccacaaattaaaattaaaatgttaatttaatctaaatagaaaaaaaaattgcatggcaattgtaaaattcaaaaaaaaagataatttggatggcagagaggagatttttatcagtaagcagcagttttattactggaaaacgaacgatgtttctgacttacattttatttcataattttaaaaacaaaataatttatttaaaaagaaaatttaaaaataaaatcattttttaattttcaagtttttagaaagtcaaaatggcgatcagtgcacatttttccgaagaaacagcacagtcgagtttgcacgcacttcaacgacttgaagacgctgtcgcacagtcactgcgcggggcattgtgagtaatttaatttaaaaattaaattaaattttttaaattattttatttattttttaaaacattttaacatttcatttaatatatctaagtgcatttataaattaactaaattatatttatgaaatttatatccttttttcattttataatttttaaaatttttttaattaattttttaaaaattactttaactttttaaatttataatttaatataaatgatatttataaaataatttaaatgaaatttaaatgcttttttactcaattttataattttttaatttttataattacaaataacttttttttttgtttcaataccattttatttttttattttttgagaaaattaatttcataatctttttttgtgcttttttgcaaatttttctctcttttttcatttatcttttttactctttattaattattattattattctttcatctttgcctctcccaatttttgcgttttgctcatttattttgtgattttgttttgtgcccctcattttgctatattttctcatgtcactctttcccacattttatggaccaattagtttgccattagaatagagaccgttcactactcactaattatcatcactcgctaattaataaaagcgatgttaattggctgtgtaaatgatggcagggcagggacgactctctccttaggttctgtttgttgattgttgtccagcagcaattctttcattttttttctatttattcagataaattatttacatgattttattatttttatttatttaatttaaatattttttaatttgccaacaaaaagggaaaatatccctttgataaacccacaaaatttgattttctagagcgctaaaatggcatttgacccgaactcgggtgacaataaatcctattattaaatatcctgtaaaggaacttttttgtcactattcagaaaaatgcttcagggcataattggaaaattatataaaaaagaatttttggcacttttaattattattctttactttagttttttatcatatattttgtcgctattttataagaattttgccattttaagcacttttctaaaaatttgcctgtgaaataactcaaaaaatcataatcaatttttttatcgtgattttttcgtgttttacgaaaaaattgattttataaaatttatttatatatgaaatattggaaagcaggctgtttgtttccttattatgctaatgtattttctgcaaaatttcaaaccacacttgcaataataaaacaaatttacaaaaccaattagccaaaatccgccaaattttcatgcttaaaaatctgcccctccctgctgatcataaatcaaaatacctttgctctaatcccgatgaatcttgaatataattattttatatcactgcattttttatgtataatttatagggctgctaattttatgtaagaaatttgcgaattatgtaaataaaatatgtatgaaatatgtacaaaaaccccaaatatgtactaaaatatgtaaataaaaatttttaaatggtcattttttgaaaaaattctttgtaaaaagtgaaacagaggcataaaatgccataaaaatgaccaaaataggtttagaatcacattttagtattttaaaaattaattttgataagtcattttttgaaaaaaaaattcgattttttagggatacattttcagaaatttttttaaatttttcacaaaaaatttatataattctcaaaaatcctcaaaatatgtaaaaaaatgaaatatgtacgaaaaaattgcgaatatgttaaaaacatgtataaaaatatgtacatatgtaaatatgtataacaaatcccga

SEQ ID NO: 11083 - DNA, 2054 bp, Heterodera glycines
aaactttcatattggtgtagtaatccgagtggagtcgggggcgtttgggcccccgtttttgtgcccccgtttttgggccccaattacagaaaaatgaaaaatcacagtaaaaacaactttttaaatttcagcataaaaatgtaaaagaaacattttaaaaataaattcaacaataattttaacaataaaaaatgtaaaaattaacagaaattcacgggttcattcgatagttgcgagaaattccccggagaaactccaaaataatgtgaaattgattttttgaactcgcatctccaaaattttgtcatcccatcagaactcattttagcgaaggtgtaaaggtggcctttgtaagacaattttactttttgttttttgttgcaattgggttaggcatttctgaaaaatgtgcaaatcagaatgtacagcaaattggttaactattaaaaaataataggatttggaataagtaaaattgtaaaaaatgagcgaatgttaattaaacctaacttatgccaagtggcgagggatccctcaggcttagtttttagaatcttaatttttaaaaaagcacatttttctatttttgggttggggcccaaacgaccccggggcccaaaaacgggggcccaaacgctctggtcccatccgagtgctatcatatgaatatgaaaccaatattatttaattttgtttggaaaagttatgacgtgttttttctctaaaaatctctaacattggcacttttacgaaacgcccatgcatgttccatggaacgacctagcaccatttttcttgatctcgattcttgtgaaaattttctggctttagggttgatcattgcatggcaaaaaaacggcctggcacccttccaaaaattgaaaaattttcaattattttttatatataattcattttcatttaaatttctataggaagggttcgtctgctctccgttctcgcccaataaaacaaataaacaaatttttggcataatgccatcacagccaaaaaaaaaaattgttgttgttcaaatcatttcatgaaatatttgacggagtttcttctgtgtttaatttatgtgtgttcgttcaaccgctgattgaggtaattaagtaattaatatagcttttcgagttgctgttaatttaattgcactgataatttgataagaaaagggcggtgacgaggcgcccaaaaactgataaaaatgtgtggtgatgggcccaccaccaaaaagtcccgagtctcgaggttttgttgtgtgtttccaaattgggacagccctccgccgccggcgtttcgttggtcactgtgtaaggagggaaagggattaatttcaaataaagccccaaattgtgtgtgttaagaaacgccaaaaattttatttttggtcttacaattagaaaatttcgggagtgggtaaatttttcaatttttatacatgcctaggtttgtaaacggttttccccattcctaaaatttttgaaagcctcggaatcccaattcccgaatcaatcaagaatttttagacttttctatgaattttaatgaaccgcagaattcctatttccgaattttttggaggcctcagaatcccgaatcccaattccagtttttttggctaggattatttccatcccctaattttttggacatccgcggcttaactaatctcatccatccctggcctaagtctattacctagaaaaacttcccagttaaaaatttaaatcccttacgggaacccgttctcaattctcgaccccgccctttcccactgatcggaaaatctgaaaaaatgggcacttccctcccgtgttaatcccggattttgcatatttttcccatccaaaaattccgataaaatccattaaaaactgtggaatttgtaccatcaaaacaatacttaatcaatcatcttccattcatattcttcttcatcatcagtccgtcaccatccatccactttattcattcattcattattcattgctcagctttgcttttcccatctttactcatcgccccccccctctataatatttattccc

SEQ ID NO: 11084 - DNA, 1072 bp, Heterodera glycines
tcagaactgtatgatttaaaaattagcgctcaaaatattctattggcgttatgtttatagtacaaaaaattggtttgatttttttgcttgaattccccttaccatggtgcatttatttttatgtttggtgtgtgtgtatgtgttactaaatatcagttcatctgtaccattggctcgttcttataatatggtaactcgccattcgtacagcagatgctttttaaacgatttttgaatttaattcaccttttacattggttttgagttgggcggaacgttgcgattcgggcattatcccgtatggggcggggaggtcggcatcggcaatatactttaacagccattgattctcctttgtctaggcttttcacgctgtttttaatacatccattaaattcaatttaatatacctaaatgaacttttcattcctttttcttttgtctagattagatgtcttcttaaagtattgtctaaaatcgctttatttgcttgtaatagattcttattgtatacaaagagggttctgtttacaatgtaagttgtctttcaaaattaaatcgcattgaaatgacataaaacttattaatgctttagtggaagagggttcgaaatgtcaatcgaagccacttataagaaggtatcacagcttgagcatgtgctccttcgaccggacacctacattggttctgtggaatatacgaaaatggtttaattttaagaatttcgcttttacttcctttttacaggcgtcgtgggtttatgactcagaggatgataagctcgtctttcgcgagatttcttttgttcctggtctgtacaaaattttcgatgaaatccttgtgaatgcagcggacaataaacaaagagatccgaaaatgaacctcataaaagttgacattgacaagtaaatatttcctgaccaattaaactaaacaaataattaagggaaaacaatcgaatttctgtgtggaacaatggcagaggcattcccgttgtcaagcacaaagaagagaaaatgtatgtgccagaaatgatcttcggcacattgcttacttcgtcgaattacaatga

SEQ ID NO: 11085 - DNA, 3175 bp, Heterodera glycines
aaatcaagaagaacagcatcaccgtgaagccgatgcaagtgaagaatcacatgtgggtgttcgtcaattcgttgatcgaaaatccgtcgttcgactcgcaaaccaaagagactttgacactgcaagccaaaagtttcgggtcgaagtgcgatgtgagtgaaaaattcatgaaagaagctgcgaaatgtggagttgtggatttggtgctgaattgggtgactttcaaagaaaatcagcaaaaggacaagacgagcggacgaaagacggcgaaactgaaggtaaattattactgaatccctattattagactgacaattatgtaaatattttccaaatttagggcgttgcaaaattggaggatgccaacgaggctggcacgaaaaactcgaagcggtgcacattgattctcaccgagggagattcggccaaaactttggctgtcgcaggactcggagtgattggtcgagattattatggagtttttcctctccgtggtaaattgctcaatgttcgggaagcgagtcataagcaggttcgaaaatgcatctctattttgctatatttttttcacaatagataatggaaaacgccgaaatttgcaatatgatcaaaatcatcggtctccaatacaaaaagaagtatgactccgagcaggacatcgaatcccttcgttacgggaaaataatgatcatggctgatcaggtgaaagaaattgctgaagtggaaacaaaacaaatgggtcatcatttaggaccaagacgggtcgcacatcaaaggattggtcatcaacttcatccattccaattggccttcacttatcaaacggaatttcgtggaagaattcatcacaccaattgtaaaggcgacaaagggcaaagaggagaaatgcttttattccatcccggaatacattgagtggaggaaaggcacggagaattggaagagttggaagataaaatactacaagggtttgtattcttttgggtttctcaaatatatcattttgctacccttagggttgggtacatccacctctaaggaagccaaggaatacttctcgaatatgttgcgacatcgaattccttttcgctataaggatgacacggatgatggcgccattgaattggctttttcgaaaaagaaaatcgaagagcgcaaagtgtggttgacaagttggatggaagtgcgtttttgatcattttgggtgaaataaaaactgaatttgtcaggagagaaagcagcgtcgtgaacaaggagaacatgacatttacttgtacaataaggacactcgaagtgtcactttcgcggagttcataaacaaggaattggtgttgttttccaatacggacaatgaacgttcaattcccagtttggtcgatggtctaaaacctggccaacgcaaagtgcgtgaaattatttttatccattttttgcaatccaaatgttctctgtttaggtccttttcacctgcttcaaacgtgcggacaaaaaagaagtgaaagtcgctcaattggccggtgctgtcggtgaaatgtccgcttaccatcacggagagcaatcgctaatgagcacaattgtgaacttggcacaaaactttgtcgggtctaacaacataaatcttttgctgcccattggtcagtttggcacgcgacttcagggaggcaaagactcagcttcgccacgttacattttcacgcaactcaagtacttttgaagcttttctgatactaatttaaaatattctaatgtttaagccccgtgaccaaagcgctttttccttcggtcgatgaaaacgttctccgttttctctacgaggagaaccaacgcattgagccagaatggtattgccctgtaattccaactgttcttgtgaatggggctgaaggaatcgggactggatggtcgacgaatgttccgaattacaacccacgggttttggtggccaacatgcgtcgattaattcactctgaacagcttgaaccaatggttgaatatatgtaacaatattataattgcatatgttttccagattccgtggtacaaggggtttaagggtcgcattactcgaatggacgaaactcggtttgagacccgtggtctgataaatatcattgacaatgggagtaacgacttggtggaaattacggaactgcccatcaaaacatggactcagtcttacaaggaacgagttattgagccgatgtatgatggatccgacaagaaaccacaattattgcaagactacaaggagtatcacacggaccaaaatgtgcattttgtatgcaaattgaaacaggacgaacttcgcgaagccgaacagaagggaatttatgatgtgttcagcctgaagtcatcagttaataccagcaacatggtgagtttcttggaattaaaacaatgaatgtttaactcaaaggtcctttttgacgctgccggatgtctaaggaagttcgactcgcccgagcagatttgcctggaattcttcgagtgccgcagggaattgtacaagaagcgcaaacgctacctcgaaggaatgctgcaagcgcaaagcgaccaactcagtgaaaaggcacgcttcatagtgatgaagatcaaaaacgagatacacatcgaaaacaaacggaaatcggctatcgtagagcagctgcagaagcacaagttcagaccggatccggtgaaacggtggaaggacgaacagaagcggaaagagttggagctgtgcggagaggcaaatgtgtcagacgacgaagaggacgtaagaaaacttaattagtaaattcattaaaaccctaactgaacgactggacacaacaggaagacgaacatgcggaccaagcagttgatgaggccttggagaagcgctgctctgattatgactaccttgttgggatggccatctggaaactctccatggaagacaaagacaaacttttggcagaaagtgaatcaaagaagaaggaacttgaagtgttgaagaagaaggaatggtcggatttgtatgaggaggatctcgaagcttttaccaaagcattggatacacaggtattaattcataattgggaaaacatagtcaaagtgttaatttaaggaggaaagggaacggaaagacgccggcggggaaaatcttggcaaagagaagggaggcggtaaaaagaagggcggtgtcgttttagac

SEQ ID NO: 11086 - DNA, 2635 bp, Heterodera glycines
  misc_feature (222)..(222): n is a, c, g, or t
  misc_feature (255)..(255): n is a, c, g, or t
aaaccgaaggcaccgaagagcacagcccgaaggccggagacacgggcagcgaagacgcacgacggccaaccaagaaacgccgggagaagggcccaggaccggggaagcagggagaacaccacaaaggcggcaaagacagggccaaagccgcaagcaaacccaagaaagcgagcgacagcaaccaggggaacggggaaaggagcaccaacgacgaaaacccgnaccgcaggggcgccgaaccccacgccggacagnagcacacaggcacgcgcagccacgaccgagacaccaacaaagaggcaggcgcccacacgcatgccccaagcacgggcccccggcaagcgctccttttccaatggtatgaaccgctgtctcgctttgtccatcttaagcgagtccaactggacaaactgagcagtccctacaccgacctgcaacacccacacaaacccttcaatttggtcttcagatccggcgctgccaattccgatttgcccatggtgtgcctctgttttttccctgaattgtcaatttgtttgccttaaggtgtgcattggcatttctcgggcgctcacttcgcctgtcggcactgcacaagaattgttgcgcgagttgcggaccaatctccaaaaggacaaattcgagctgcaactcgtcgactttaatggcactgacagcacagtcaacaatatgaacgacatgtactccgccgcactgttcggcgactgttcgtcggatgatgaaatcatcggaagttggcaacgaggcggccatgccgtgtccccaaggtcaacgagcagtttccgcaccatttggcgatggcgcgaaaagttggaaaatgtcgtcacattgaaacaattggacaaagaaacgcttttcattgcccatgacaaccaagtgaaattggacaatttatacgaattcattttcatggattgtttatcattaagataattatcactgatttcaacgggacggaaaaaaacactgatctgatgcaaacttccttctctttcgacttcagtctcgagtacgccattcctttgtccgattcggtgctcgcctttcacaaacatggagttctggtaagtgcgtttggtttcatttgtcaatcaggcctggaaaatcaattttacaaattaaagaatgggaattcgaattttttgtcaaactgattttactctaatttatgtcttcaatttccggtagtatcgccttcctctaggcagaaatactatttaaaaatctatgttaggcgcaaaatattattttttcaacacttttagggcaagtcgttgttcactggcgctgtcactcaacacttgaatgaccctaccaagctgtacaaattggttggacaagactcgtaagaacagtttatttaaagcttgactatatacattcaatctggcaatatctggtccgtgaaatcagaagagtctcgtaattaatgaattctgccccaattaactcaaattgtgacaatgtctttaaaaatcagctgtctatacagactcccaaaaacactacggccattgttccaaattacttgcttttctttttaacaccttttattttaaattatatatttctgtttacaatgcccactcaaatgccgttccccgtgtctccatttccgatgtaaatttttgctgtttagcctcgtggtgctgaaggtggccaaatgccggacagctctcagtccaaacgaatgcatttcgaccgatggatttgaagggaatggggggcaatcgtcggtgggtgaagaagtgagcatttgtgtgctgactgggcacgtctcgacgatgacgccgccttaaacaaagaccatcatcatcactttttgtgtcccctgatttgtcattaaattcattgtctctgcttttccgtgccgtcgcttctccgctctttccaattgtctcttttgccactcacttcctcctcttcctcctccattttctcttccgtccgttcttccgtttttcttttattttttctctacctccagtcaaaatcactcatttatttttgttttgcttttgcgttttccctcctcttttggtgcattctttccggtctgcccacttaattcgattctttttttcagcaatttgtgcttttgcttttgacagtctcattaaaatgcctgctaattgtataatctgctgactgtgcgtccttttgaagggactttcatttttaatcatcgcttcgttttgtcaattctctcgtatcttccacatttttgtacttttttcccagataaatgtattcgtcatcccaatgatttgatctcccttaagtcaacaacaatcaaatgattattaatcgtttccgcctatggcttcaaaaataattttgtatattttgtggcccaagtgattttgtactttaaaagtcattcgtccactctttttctctgtaatcccaactctgttcatcttcctacatctctccacgaattggtaaataattgtccaccatttctgtgtcaatacatatttcatattttcctgttctttttttgtgtttgccaagcgagtaaaatgtgaatatttactgaatgaatgaaaaggaaaaggacacaaatcggagacactttccacttcgattggttattttgtgtgcgcaattg

SEQ ID NO: 11087 - DNA, 1213 bp, Heterodera glycines
  misc_feature (615)..(615): n is a, c, g, or t
  misc_feature (649)..(649): n is a, c, g, or t
  misc_feature (1190)..(1191): n is a, c, g, or t
aaacgagctcctgtaccagaaaagatttgcatgtgtggctcagtggtttttgtaagatagtaaagggacaaagggtggtggttcgagtccgttgtgcaacatgaatattttcatttatttttgtccaaaatattaaaaaatgacgaattttgagaattatttttgaagctttttgccaaccaaattggataatcttggtatcattcgaaagcccttgatggggagaagctttttctaagcaaatgctaagcaatttgatgaattagaaaaaagatatgagcgttcaaaagtttgttttttgaataactttttaatgagccttatttttgcaaaaaccttctatattattcgatgcataaaatttttgtctatcggtatgcaaaatttggtgtaaattgtatgagtagaaaaaaagttatatgtggcgaagtaaattcagtttttctctattaacagagataaagaaatagtacgccaaaaagagagatgtttttttctctgcactctctatttattggttcatgtctcgttttttgaaacggtgtgtactatttcaattttgttttctcaatttggtggcatttttccctttttgcccattttccctttcctttntagcaaatgtctctcctttccgtggttctttccncctctttttgcctttgttctttgctccttttccttctcccctcggctcttttcgctgatggcttttcgtcgtctggccaaagaggtgggctaacaacaacacgagaaaggccagaaacacaacaactcaagaaaagcatattttcatcaatgacaccaaaatgccctcagaaaagctatgccgtcataaatcgaattcggaaatacctttgttctaattttgttcgcaactggacaagcgatcagctgatcagaacaactcttagaattcggaaatgtgtcatacgtacacattttaaaaggggaactgttttagcaccggtgtgtaattccaaaaagtgccctctgtctctttgcctttgttctcgtctcacccccccccccttcagttgttttggcccgggtgatcattttcaaagcatccgaaaagcaggggacgattgcttctcaacctgtaaattaaatgtttaattttcgccaattcttccacaaatccccgtccaacagttgggcactgtggacatatggcgagaccgttcccnngggaagacaacggttatttcag

SEQ ID NO: 11088 - DNA, 1539 bp, Heterodera glycines
gctcatcagagggtattcgtaagagggaatctctccgatcggagaaaggaagcggcgaatgctttgtcgacgcgcagaacgaaagaaagaaaatggagggaagcgatttgtaactccgttcgtccgcccaatcaaagcaaagggcggcgaatggacaacggacggactaacggacccctcagccccccccccccccctccgaaggtcgtcgttgtcccccgcgcccataacacggtccgttaattgtttccagctactttaaaaaagacaaattggaggtggcaacggtgccaaattcattcccttttatattgggtcaaagagggaaaatgaaacggacagacagcgaatgactttatttacaaaaataattcatgccaataaatgtgaatttggctgatccccgactgattgctctctctctgctcataaatctgatcagcagctgttgtctgtcttccctttccttagcaattcgctcgcctccctttccttcgcgtcctccggcaaaaacgcattgagcgcctccagcaaagtgcgcgcggtcagtccccaaatgcggaacttttccggacaattgaccagcgaagaattgcacaaaagtcgcggtttggtcgagtggaaaatgggcattcggaagaaaaacggcattttgtcatcggatggttttccagaaaatctaacggagtttggttcaattaatggttttgtttctgttgatcgtttgtctgttctgtcagcaccgaaatgtggtgtagtgaattcgggcgagcaaatccgaaacggatgccatgaaaatattctgcacttcggcgtcggcacatctcagcgaggccaaccgttgctccacgttttgcccaatggttgccaccacgggagtgacgacgcccgcctctccgaagaacagcggacgaagagtgccccacagttcctgaaagttaaaaacgaatcggtacgggagaagacagagcaagcgccgaattttgcggaatccaacgcgcaattcttaaaatttgatccgattatggcatggatcaccacgtcgttccggtccagtccgatctcctcttccgcctctctgatcgccgcagtctctacactttctccctgctcgatccgtcctaagccgatcacttttctttctgatcattggtcacaaatcatttttcacctccgggaaacgaaatttcgttggcatgatgcttcatccttttcgccctttgtgtgaagagaacacacctttcttcggcggatggtgagcccaactgacagaacagcacgagtgttgcacagtccgtcgccgtgggaattccctgccgattctcagccaaaagactcttttcattccttttcaaaagccttggtttatttcggttgaaattctctcttcgaatgagaattcgatcaccagacgatggaaaagcatcagaaaaggaacaaaaagaatgaggcaaagcagcaccaattctgatagagaggacgaaacgaaaggggaaaagcatttcgaagggaaaattatgaaaaggaaggagctctaga

SEQ ID NO: 11089 - DNA, 3882 bp, Heterodera glycines
  misc_feature (3857)..(3857): n is a, c, g, or t
agctccctcgcacaccgcgttgcccgcgcattccggcaatgcgcccggcacgcacagttgcacactgccgttgcttgcatggcgtaacacgcgctgccccgtgccgcacccttcgcctgggtctttgccacagcagcggtgctggccgtccagcgagtcctcgtagcacagggcaccacctaatggcatttaaaaaaaaaaattaaaagttgaatttggcgccaaatggcattgtgttaggcgctgttgtgaaaaaaatataaaataagcttcggggttttgagaacggcctgatctgctggctttgtttccacgattggacctctagacctgggttttctggaaaaaaactcaggaaaacgcaggtccataaaaaacaggttgccgaaaaataacctggacctagaatcaggaaaatccaggcctggatcaaagcacaacccgaactctagaaaaaaaaatgttttttagtccattttcaattttttgtctccaaggcaaagccaactgaggtattttgccaaattatgaaagaatcgaaggtaagctcattcggcctagattacgaatgaatcactgtgttcgggtgtcttttttttgtgagactcaaatataaggccgcaaatataggaatcggattctccgaccgtgaaaacctctaaaatgacttcactttgtgaaaaaaattgaaaaatttttttgagtaggggttggggtactatcggcactattacctttttaagtttttcacgtaaatttcacgtaactcacgttgtagctaaaattaaacgtcagattcgtgatcagcatcaaaaattagcctagaaaaattattagaaaagaaatttcagggggggtggcaaaacccggaaataccctttttttcatccggcggcgccatcaccgctacttgactccctaattactcaaaaacgcaaaagtggtcatttgggaatttgagcgtcgagactaaagagcagaattttggaaaaccccgttcccggacaaggatccagacacccaagatgggcccggacaaaatcccagattaaaagacctgttttaacatcactcgggccttggccaggacctgggaaaattctatagtatcccgccctctgtccggtctctagtcgagaatacgttagtgtccctccattgtcatttaattttcttttatccatttctgattcattttaataattttgtcatggacacttcgaatttttcaactccaaatgctcttctaccgtattgcaaaacgatcgaagaagtactgttgggctccgactattacgtcatgcatatccaaatgtttttgctgacttgcgtattaattttgattgttattttggttcgtcaatatttcaaacttcgaatttccatccacggaaacttaagggtattttattgaaaaaatgcaatttaattacaaatattaaaatgcgctcgcccattaatgagtttaagatcctgttcatcaacatcctcgtcctttacttcttccattctttgacttggttcgtctactttttgcgatatcgggtaatagttaattaattattaattaatgaattattaattaataaaaaatgatgacatcattttccaaaattaaaaaattcagttgcttctattcttttacaccagtacgtgtgatctgctgagccccgtttggatggtccccgtttttatgggcccttaccaagtgtattccgtcgcttatccgtctctccatttcgctgttactttcgaacgcattcgagcattgtttttggtgagaaacttcgcaaaatgccccaggctttctttgtttggtcccatcccaaaaaaacattcataaaaaaggcaaaaagcattcatttgagagattagggacacaatctctgagtaccaaatgagaaggatattcacatacaaaaaaggagacacttgcttggataattaattaggtgcacaattatgagcagatgggcccgaaactgatcatcgcaatcatctgcgccattgtctgttttactaattgctgttaattgtttcggttattaattaaccattttgaaatatcccaattcagtggcttgcttctttgctgtatttggcgtgcattgtcggcttggcactcgccgaccctcaaatctctggccacccccaaggcgttgtttacttgacctccgattacaatgccaacctgattttttgggccatgcttttcacgatgcttttggtcgttgcgacggcattgtgcgattggcgcatttatttgctgaacaaaaggctaaaccgggtcgggaatggcccatcgactgagtacaacctcagtctgaagtaccaaatcaacgaaaacaccctctccttgatgctgatcttcccgctggacttgctttacgcattgatttatcccatatacaatgttattgtgctggtccttcgcgcctaccggcaaatgctttcaaccgccaattacgtctcctattaccatatggcgaatacggtatggtagagacagaaataaactgacaataaagcatacggtaagtttataaaacaaattcccatttttcagttgcttttcctgcattctctggtcacccttgtggtgtatattcgatttatcaaatatgtcagccgcgttcgaaagccgagcattgtgaaaagtcaaccgaatgaagaagcaaatatacacttcaaacaattgcaagcgcaatggaaatgaatttttaaatgttttcaattataaaaagttgacgaattaaaagtcattaggcatttttcatttaatttgtttttgcaaaaattaatccattcgaatcaaagaaagtgccatttctgtcaccttaacaattgtttttgtgccgttctcaattcttttctgattggcattgggcaggccaaacgcattggtccgtctgcgaattgcgcagcattcccggcacacaatcgcacgagcaaaagcagtgcatttgcgtgcaaatttcgggcattgggttgtcgcaggtcggctcgcacccggcgcaacgcaattggccaatttgttcggaagaagagcactgattgaaaaatatgagggaatattataataatattgtttattattagtttataaaaaagattggatttattaggtgaaatgccgcaaaaaatgacaatttttttaaatagattacacgtaaataaacaaggatatttgaattaaattcaatgattcttaatttatggtcataatattttaagatagcaaaatcattcggaacaatttcatggagcttatttgttttttatgaaacttggtaagcctttttgcttaaacataaaatgctcattaataacaccaattacacttttttctttgcttttttatttattttagttatttaaattgttattaagttttaaaaatcggggccattacattgcatgctccgttttgagcagctaagggcagagcactgaataaaatggaaaagaaagttaaacaacgagttataattaaagtcattttgtatttaattatctaaatttatataatccaattattaatttaaataacaaataagtaatttttctgctaaaaatttaaataaaaaaaaaagcaaaatatttcaaacgcctctctctttgtttgatatagagaaaaagcgttttattcactcactcattggggcagcgttttaatatgtgaaaaatatatagttttctcaaatctcaggggtcagaaaacaatgctcataatcagccaaatccctacacataaagtccgaaagtccaatgggggggggtgttttggcactatatggaaagtgacagtttttgaaaagtttttcaaaaggggggaggaccattgtgttttgcaaaanttttttttgtgatagtcataaaaat

SEQ ID NO: 11090 - DNA, 539 bp, Heterodera glycines
  misc_feature (255)..(255): n is a, c, g, or t
  misc_feature (264)..(264): n is a, c, g, or t
aatcctccaattattttgatcaattgtgatttcaatggtggaaaagcggacaaataattatatttttgtaaagtaaaaagtataattattatttgagttcgggttagtgagtagaaattagtcaagatacatgtcagattagtgattagagtcctttaaaaaatcggataaaaaattatcatggttttttatattaaaaaaattttgcaaatcaaagagggtcctctccttttgtttcaaaaactgtcactttcncatatagtngccggtgttttttttctttttttgctttttaagtacccattaatttgcgtttttccgatttgacttttgtttttgccttattctgagcaaaaagaagaccaatttggggacattgttattcaaaattaacgaatgttgtaaaatgacaatggaaaaatgaaaacaaaatttaattgacaatttttgtgtggcagcgaaaatctgtcatcaccatcaaaaataacataaataatgacgaaaaaataataatcttctatgaatgaaaatcaatatat

SEQ ID NO: 11091 - DNA, 1334 bp, Heterodera glycines
  misc_feature (76)..(76): n is a, c, g, or t
  misc_feature (1313)..(1313): n is a, c, g, or t
tagaccgaacaattttgaccctaacttttttgaaattccataaagttttcgaactttaacaaaaaaaaagagaaanctttttttctatctaattatataaatacaattaaattggttctttcagaaaaaagttatgaaggaattaatagtattatatttttatggtcatccaaaaaatgtaaggtcgtttaaatgcatgaaaattgttcaaaccttcaattatcacattatttgatatgaaaagatagcttaaagatttctttatgatgcagttaaatttcgaaaaaacttattgaatttcaaaaaagttagggtcaaaattgttgagtctaaatttttcgagttttttttgcttacaactttttgtaaatttttactaattttttaaaaattacataagttgtagagaatatgtagagctacattctaataccaagatgaataaatttgattaagtttaagctaagttatgattaattatttagcaaataaaatttaaataataataaaatttaattattacgtacattgctacttttgtcacttcggctcaccacggatttatagcattgagttttttggctatttttcctatcatttctatagacatcaaatgttggaaaagaaaaggaattgtgccggggttttcttcttttgcacttccaaattttgcgaacaaagggacaattgtctgtgaaattaggcaacacctgcttttaaaatcaaacaccaaaacaaaataaatttatccaataaataattaaaaagacaatccaaattaaattaaaataagtcaacaacaaaataaattaaaacaaaaatcaatcgacgaccaatcaacaaaacgcctaaaaattatccccaacgaccaactaatccaccaacttcactctagaaaaccaaaatatttgggtcgaattcaaattaaacattatgccaaacaaattcaaacaatcaaataaaaggtcaaacagtcactaataccacacaaacaccaattccatcagacgttcattaatttttaataataaaaagagttgcttatctcaaaggaccaaaaattgttacggaagccaagcttatagcgcttgtcttgaggtgattcctcacacaatttgggaatattaaaaattaattatcaccatcgatttacgcattcgttttttctatttttgccgcctttgtttcgctataaaagcgaacttttaatcagccattcaaagcaatgaatatttaacggtaagatacatacggtgcgatggaatggcacttgcggactatcattagcggagcatggaaatttcataggcttngaaacacagactaactaatta

SEQ ID NO: 11092 - DNA, 2273 bp, Heterodera glycines
atcaaatgtccttcaatgtcactttcattgttgtgatcggtgcttgtctgctgctcaaagtctaatattttaaattaaattcaatacggaggatttgagggtgactgattctgagaataaaattttgggatttttgctgcaagcaaaaaaacttaacaaatttggcactaaataaccattttacgtggtttaagtcaatatttatttaactaattataaggcgtttgagcgctggtggcgccggtaagcgccgcaggggaattttggtatttaatgcgaatttttacatttttatagtcagtactcagaatcagaactttctgagaagcgaaaaattctaataattcagaacatatggaacccctgctgatattatcgcatatttaacaaaataataaaaataaaaaattgatgaaaaattaattggccaacatttttataatagcatgaaaattgaagtttagttaaataatttataaaataaaaattattttggaattgttactttttttaccacaattttgatggatttttcgcatatgaaagttaagacctaccaattttgaactgagagggttacggtatcaaatcccaggcgatctaccgttatcattaatcatacaccaatcacattgttaattttttttatacatttgttccagtgccaaactcagcagcagacaatgcccggcaactccgtccaacaattcaccactccatcagcgccggtggccaacaatcagacggtgatcaaagtggccatgttggtggcccaaaatgacacggactttggcctgccgagaaagaactcaatgctgcgcaatgcgggaggtgcaattccaatggcactggagcagttgtgggcagacgaagtgctgccaaaaagcgtcaatttctcgttagcttttgacatattaatacaaatttttaatttccaaatttcccctctttaattgtctttcacacggtccgtatttatccccgactctttggtgtcgtggggagggattgtagccgttttcggcatccctcttaaacataattaacggatccagaaaaagacgaaaaaacaatttagccttttttggtcaaggctgctaacactaaaaacaaattatttaattttttaaaaattaattttatttcattttcgatttgaaatttagaatatattatttttttaacttaaatttaggtttgagtgggtttatgaaaagtgtaatgaggcaactgcgatgggattaacctatcagtttatccacgattttggtgctgacgcaatcattccgacgacgtgcatggagggtaattggaaattttaataaagatattttgattttgatcgacaagcatttcttttataatatgattaggctaatatttagtggcgccacaagtgggtcatttggccgctaattttaatattccgatgatcgtttggggacagaatatggtctcaaagtgagttcagtttttttttttaataaaagttgtttttgtaaataacaattaacctttttttgataatgaatttaattttaaaattagttaattttcttaaaaaattgaaacaaaatcgcaaaattttgttatctgaattccagtagtcctatcccgacctgatgccaatcccgatcccgactttttcaaaaatcagggctttataaattaattaattatcctaattaagtcttgcctcctcaaacaatgccacttatccaactttgctgaacattgtgccgaactacaaatagtaaatgcatttatttaaacataattccgcattttgttcattattagcatggcatccggactgatcagtcttttacagtatttcaattggactcaatttgccgttgtgatccaaagtgatcttggcaatgtgagcggaggtgaaaagtgaaatttattttacatattttatttatttatttttctttttaaggctgtgattatctcgccaaatccattgatgttattttttttaatttttaataaatatttttaataagctgaagacctaaatgaatggataattaaaaataattactttttggctggaacccaaaattaacattcttcaatcatcgtcatcataactagggcttcaattttaggttatgaaaactgctaaaattgttagtttttaggttcaaaaaaacctaaaatagttgttaaatacgagaaatagatgccagaagttttaatttgggcgtgtaaaaatgtaaaattttatccaaagagcaataaaggtgagcccaaatcagtatgaa

SEQ ID NO: 11093 - DNA, 1191 bp, Heterodera glycines
gcgttcatttgtttttccatttgtctattactttttattatgcaaatcattccaatttaagaactttgtgtacataatacctgacaatgacatgactttgtcgtgtaagttcaaattaacgaatttcttattaaaaaacaaaacattttttttataagtcaatttgtcgttggacccattttgggtgcaaacgaggtatttttggcactttaattccaaattttaattataattatggcaataaaaaagtgtcaattcgaatggacttgacggaagagacgcggacgctgaagtgattggacgattggcattttgggtaggtcgctcggggggcggaggaggggaaatttcataattaattgcatgtcgctacctttgaaattttttctggaaagtgctggaactttgaaattaaaaaaagtgccagagaccccaattcctaattactaataataattggacatttcccttctcaagtggcattatgacatcactctttccgcgttatccaatcgcaactattacggcttttacgggagagtggtcaaccgaacgtacggttggcccttttactgtcccgaatcggaatgtaacacagttgcaaatgtgatttttgttttgatcaaaaatatatgctcaacagtgatcatttttcaattgaagggctccctcaattccgtccttttgtacgatgccatttataattatgggatggcactgaatgagagctttaagcaatttggcatccgaagagagacataccgtaacgggtcattgttagcggccaataacagaaggccatttatgggtgagttggcaagggataatcacagctaattggaaaattatgaggaaataaaataattcttcttcaaaggtttgaccggctacgcaaccgtggaaactgaccgtaacacgcgggtctttgtgttgtccaaccgaaaaagcgacagcaaacaaagtccgctgcgcattttgatgcaattggcatggacaaacggcgaattggtgagaaggggagcaattaaaaacattattgcactaattagtatgcaatatcactttcaagaaaaaacactcattttgcatatttaaatttgcaacccgaatttaatttgttatttatttacatattctcctcgtcagaatgtggcaatgagagatggcaggtcaatgatgtggttttctcta

SEQ ID NO: 11094 - DNA, 1646 bp, Heterodera glycines
tattaaagggctcctgagtgtcccttttacagacaatgataagactaagaccttttcttaatctttattcaaatttacacaattacaatttatgcaaattgcttggacagaaaactgccccggttgacttaatgctgagtacaagaagtgtcttgtaaaaatctcacaagaagtgaagcaagaagcaaaaagtgaggaaaatggagaatgggccgggcttttataccctcacaaatcaatgggggcggggccaggcacgtgaaaaaggtgcacaaacaaatggacaaaaaatccataaaaatatgaagaagagaaaagatgactcataattagggtcgcaacttttagtgacgaaaaatcccgaaatagttaactaaaatagtgagtaaaaatgccaaaatagtgacaaaatagtgtcaaaaagtccaaaatagtgacgaatagtgacataattttcagccaaaaaataagccaaaataatttttattcactgattgcagttgcaaatgagtaggactgggatttttaagaccaaaaaacccaaaatagttacctaaaaaatttttaaaattaaaaatttttgccaagaaagtaaatttttgagaattttttttttcatttcataggagtatattttgaaaaattttagctcgatttttaggggtgtatttttttgaaatttttttaggtcgattcttaggggtgtattttttggttttattgcatttttgttaaggaattttccaaaaaatgtcgaaatagtgaaaaaatagtgacaaaacgccaaaatagtgatttttaactattttagtgacgaagtcgccaaaatagtgatttctactgaccgatagtgacatcagaatcgaaatttttaatgcagaaatgcgttttttgagctcctttcttcaaaacaattgagcaaaaaaaaagttttttcactaaaagttgcgaccctactcataattaaggagcgagcgaatggaaaaattgatcgatgaaaatggacggaaaaagaaatttcaaataaatttgtgtcgcttttggcgacagtgatgaagaagctgatgataccgataaaaatgaattatggttttaatacttcactttctatgtttctttggtatttaataaatattttttgatttttaggctaatttttttagaccattttgacatttttgttgtaatacagtatacttaatgacagcgtattttattttagaaatattttatactgacacattttccgggagccatgagaagtgtcaacatttgacaatttccctcccaaaaatcgccaacataatcctaaaccgtataagaattttttggaagtaatctgggcttttatcccgcagaagattaaggaattttaagaaatcgatttgggcagggcgaaaccgactttttcgatcgatcagtattttaaatttacaaattgcaacaataatattttgtcatatgcgtgatcagcgacctcaaaaatacacgggtaatatgtttcagggcttctaaccgaagaaaaatttgaaaaaaaaaaactaaaaaagtgcaaaaaattttcaaaacacccctctttgcaactagcgccaaaaaagtcatgatctaaaaaagtgaggatggtcactgatcagacgcgaaaactg

SEQ ID NO: 11095 - DNA, 1075 bp, Heterodera glycines
  misc_feature (19)..(19): n is a, c, g, or t
  misc_feature (43)..(43): n is a, c, g, or t
tgtcactgatcagacgcgnaaactgggaatagagagcccttcnaaagatcaggaccggcacctgtcgcggaccaaggattcaaggctcggtcttccaatttcgtaaaaatttttagtcggaattccgttttccgaaaaatcttggagcctcccaaatgcccacccccctggtaggcgaagcaacaaaaaacattttaaatgcaaagtgacatcaataaaatacatagtatgcagaaattggggtttttaaaaaacaatacacgaaaaaagaaaatgtgaaatgaataaaataaaaatgagtaatttgttcgaagaattgcggccaaatttatcaaaaaagatgttgtcgtcatcggaatcactcatcgctggtcactgctgtcctggaaattttcgaaatattaatttttctaattgattaacattttgccaagaaggcgtctgaaaatcgtcgccagtgaatgcaaaaattggtcctttttgatgaaatctgataacaaatttcactcaaatttccaaaaaatttcccgcgttacctatcggccccaatgctcccttaatttcttggaaaaagcgcgccgcaacaaacatttattatcaatttttttcatttggaataaaattttcaaaaatgctgattttttggcaaacgaatattaagaaaattcaagcgacaaaacaaaaaattttttagggaattttttttttggaaaagagcgtgctttacccaaaaacctgcccataacaatgaaacgcccctaagcccacgcccaactgccacacctgctgtgccgatgaagaacaattagcaccactggcgccgccttcgtcgtcccgtccgcgcttgtccgcctccaactctttgatacgctttcgcaactgctcattttcagcgcgtaagcgttctcggtcatttgctttgtccagttcgctctgcagcactttgtttttcgcctccaatttgatgactttttcaaggagttcctgaacccaactgaattagtgtgcagcatggaagggtgtgaccatttcagtaccattgatcagtttataatttagcctaattattttttgg

SEQ ID NO: 11096 - DNA, 5099 bp, Heterodera glycines
  misc_feature (124)..(124): n is a, c, g, or t
gctgtgtctagagaaggatattttgttagaatttttttttaagtatttgaaaaccctttaattaaatgccataagtagggcttcgttttgaaggcaccaaaagatcgcgaacgaaatagatacncaaaaggcagaaaaaatcgcaaaataggcattaaataggcttaaaaatttgcaaagaaattttttattaacacttttcagtttacaaacacataaaaacttaatcaaaaaaaaaaactttattttgattttcgtgcttatctgtgcgtattagggcaaaacatttgtataaaaaacgaagtcttagccataagcattaaattttactttttacattaagtaatacataatttttaagctgaaatgatgaaatattatatcatattatttgtattccatttaactaattttgcaaatggaagcccttcccaaggtcaatccatgtgaataattatatatttataaatattatttttgtataaataaaaaaattaattataactaagcacttagaaaaaaaactttttagaagacaccgacgaaggacaaaaacagcagtattgtgtaacggaaattgaacacgacccaaaaattttgcttgaacgtagtcaggatgccacagattgggcactgtccaatgggctgatcaaattagtgccggcaatgtgccaaaattgcagaataaaaatgcaaaatgttaattaataaagaaattaaaataaaactttaaattacattttcagcaaagcttcgtcgctgaatttattccaatttctttgtatccatcgccatttcccggcaaattatttcgacaagccatggaagtgcacaaagtaatcactttaagggtgaacagtagattgtgcgggaccgggacctggtactgaaaaaacgtacaactgagtacctaagtccaggttttgaccgggaccgggaaaagtcccgattttttcgcggttttcccagccaaaaagtcccgggttttcaacccgaaaagtcccggtcacggtttttctcaaaattcccggtcccgtacaactctagtaaaaagcttaaattaattaaattatttcgtcatattcgcgatattttttttccgaataaaaattgaagcaaactttaattttcaaaattaaatttaaataaaaatttcttcaattctccgattgatttgccattgaatttcacaggcaatgcttttgctgtattttcgcgcctcccaagattttgcttttttgaaagaaacgcatcgccaattagtggaaagtaatgaagacaacaaaataaagaaaatgatctcactgcttgacggtctttatgaggaaggcatcaaacaaccggtggcaatgttttgccaaagatcggtaggaaaatgccaaaaattaaatgataattcaacattaatcaaaattatttttaattatttttacctaaaattaattatatttttaagtgaataatgttaaatagagataacatttataggcactaaaaaccgccaaaataggtaggctttaggctctaaaaaaccccaaaaataggcactaaaaaatggaagataggcactaaaaatcctcaaatttagggggtgtaaaatgacaaaatgtattcgaaaaaagtaaaaaaaaattaggccaatattgagataaataatttttaaatcacaaattcttgtcaagaaaataaataaataaaatttggagatgaatttttgaaaaaattttttatttcttaggggtgtatttttgaaaattttcgggtcgattcttagagatgtattttttgaaaaaaaattaggtcgatgcttaggggtgtatttttcgtctttattgcatttttattaacaaattttggactcaggaaaaaatagccttttgcctaaaaatgttatccctaattttaaataactaattttacatttatcaaaaggattacatggcgagtcaaaacgatgatggagagtatttgctaaagcaggtgattacatattaaaaacaacaattaatggataatttctttaaaagaaatttttttaaaaattattcactaagataaaaaactaacaaaataaaaaataaagaaatttgaattaaaacaactaaaaaatttaaattaaaaaaaaacgaaaactgaaaataaattttaaaaaaactcataacgtttcagcatcttggtcccattctgtccccgggtaacctcgatcgagatcaacctaggctttttggttgattctttttttaaatacatttcggttgaaaatttgggcgccggttagggatcagggctgcacgcatttacggattacggaaactatggtctttttgggccccgtaattacggattacagctttccgtaattgaaaacccagttgcgtgcagccctgataaggaatcctcctgttaaaatagcaggcattaatccttgcaactttgtcgggctgcaattctctcgggttctgttcttgatttttttcaaaattggctctaactttttgcatgggttaggttgaagtgaacaccggcgcactcggtggcgttggagcatgttcacgcgtgtccgagcatcataaacggatggtcgcaaatgcgggcattgacgcgtccgaggcggtgatgccattggaccaaactgatctgttgtttgccgaaacattgtatgaggcatggtaaggaaaacgggcattaattttaaaaaaattcattaaaaattccaattttccccaatcggcatcactggatccaaaatgccaataatttactatccaaattaggcataaatccagaaatgaccatttttgattaaaaaaaaacaattttaacaaaataatcaggcataaatctgtttacaaataacctaatttcataattttttaatgtttataactcgtggtgttttaaaggaaacaattcggtgacaaaaaagcggtcattcttttcgtgcacaaccaaccgagtcacataaagctcgactcacgaaaagtacagtatcaattggaaaaaattgcaactgaaagaataatgtgccgatttatcactctgtcggagggactcaaacggtcagtgacagaaacaaaattttaatttttggctaattttcttaaaatttttatttttttagcttaaaaattgatccgaacaattttaacctcattttggacgacaaatttgttgttggggttgtgttcgatcgacttggtgggccaataacaagggcagaagccgcacttaacttctcttttgagcgaacaacggccatcgtaaaaccaattataaataaacttttttaagataaataaactgggataaaaaattaaaatcattaataatggcaatatttaattattaattttagaaaactcctccgtatgtatttgctgtcgctcatacaaagaaaatgcaacaggtgaattgtaattttaaaaaaaaattattaataattagagattaatctagaattgaaatcaggccaggatttttcctggatcaaggtccaggctattttttttggcaacatgggttttcctggatttttgtccaggaaatccaggtccgacatggaatccatgttcagaaattttttcaaaatgcagaactctaataataactaagaatatccagttttcgaggggaggtgttagctaaaagacgagagatctttggcccaaagcaattaaaatggccaattaagattatttcggtttcaattttgattaggtgttcacaaagccgggcatggtggagcgcttctttcccgatcccaaagaagtccatactgttgaagcaattcgtagggtccaagcaaaaagttgggcactcggagatgacgaaaatgaagcggaggaaatcaaaaaggcaaattaaaatattaaaagtaattaattcaaaaatttaaaatttcgcagaaagtgtatgaaaacccacaagactatgtgctgaagacgaatgaatgtggttcgcctaatcaaaggatgttcttcaacgacgacatccccaaaaagttggcacgaatgacacccgccgagcacaattacttttacatcatggaaaaactgcgcccgatggtcgttaaggtgtgaattttttttccaatttaataatattaaaaagcgaataattcaataaaatgaagtattcaaataggaaaatttgtcaacctggatttttcatgggctgggttttccttggtttttgtccaggaaatcaaggtccaacatggaatacaggtccaggctttttcactaataccgatctctaataattatagacaaaatgctgtatagatttagcaaaaaaagaaaaatgcatttaaatacatatataaactggtcccgtattttacaaagaatcattttgtgcgcccaaaaattgggctcactgcgaatcttgacgtcacaccggagcttggcatctatggctgtctgatcggcaacatggtcaccggcgaagtgtcatatgtctcccgatttgggcatacgatgaaaaccaaaacggcggatgaggacgagggcggcattatgagagggaacagtgtggccgacacgccttaccttgtctagaagacaattagagcaccctaccgtatccaacacaattagcacactaccgtatccaacatattttcaagtgaatactgtattttgtaatttatagctttttgcactccttttctcattcatgtgatcatttaaaattttcgagcctatctattctattgcaatatgcaaataataaataaagtatatcacaatacatcaatttgttcgtcgcttgtgcatttaaaacttggcattttggtcaatgaaacagactttaaaaaaataattcgctggtttgagtccgcaaggattctttttaatttaaataaaaacagctttttatcaactatgatcgaaaatttcctaaaacaagagcattgccagtcaaaaataaggagattttaagccttcaattaaaaacatgcatttctttttttgatataactttgctcaaatgcaaccaaattttaaaataatgatagttttcgatagcactaagtgttttctataaatttgcaggtagggtgaaaaatggttaagtttcaagaaagttagacaaaa

SEQ ID NO: 11097 - DNA, 1265 bp, Heterodera glycines
ttcttttctttgcttccatcggtacttccatataagtttcaccagcgagtttcatcgcaaattcatgcacccgatcgccagagaacacctttttttttgttaagttgttttgtgatcaaatccctttgaaatggcttgttcccaccgggtgggaatgggcgtccgccatgcccggcagaacactccctcccccacagtccaccctcgtcacatcggtcaattctttcgagttgaatcgggaagaaatctgcgcctgagtttatgaattttacagcactttattttcgacctcttcaaaaatgccaatttgctcaattcgtccttcgatgcaaagaatggccaattcgtggccatctgattccattatcttttgaattaagaaatttttatgtgagaattttggaattagcatcactttgattttccccatttgatcacccaataaacaaaaagtccgatcatcgtccaccacttgaacaatctgtgtgaaatcaaagaaacaatcagtggcaaatattactgcaattgtctgtcctttcacccccgccccgcacctccaaacacttaaaccattcaatacaaatctcttggatctacctgattaatgttgtgcagaatgagcacgtctttcattttggcgctttcttttgatttttttaattaacaataattgaaacaaccaaaataattatggaacttaatgaagtccaatcaaatgaattctttaatcgactaatcttaattacctacatatctctcaccttaattgatttattagattgtttatttgcgctgtaattttttttaatgtgcgattaaatggaaacggacttgaccaccataaaacgttctgtagcccacttgataaaagaagttaaataattgatttttaaaagaaacactaaatttcttcagtttgactaccaaaaaaaggaattgaaaggggcgccactgaaagaactcgtctcagtggtcaagtccaatgggaaaatcattcccgcatttgtcgacactcttttcggccactttcgaagggatgacagcgacgtacggctggcagcacttttcattgccaatcactttttccaacgttcccacaatttccgcgcggaactgaccaattcaattcaggtccgtcgtgtgtttttgctgtttatttttgtgatttcttttaggatttcctcatttacactttggaaattgaccctttgcgttatcctttgcccaaacttcggaagcggcaatttgctgagaaagaagtctcg

SEQ ID NO: 11098 - DNA, 2447 bp, Heterodera glycines
agaatcgcgcccggaaattgaacgccttttggtggagtcgcgaaatgtcgtcgaaatgatttttccaaaattttgtccattggacgatgaaaatggggccgtttcaattatttcatcgcaaaatcaaaaagtaattattaacttttgacagctattttttcttttaaatgtttcataattttggtaaaatgcaggaacaattgcatggatttggaccgtcatccgcggtgactgtttcaataaatccaacggaatcgaacatcgaacaaaattacgaaaacgaggcattgttcagccaactcactgatactacggcacagctggagatttggtggtctaagcttggaaaatggcaagtcttgcaattaaaaggccatttcatctgtataaaaataaactgacgtttcaattaaaatattccaaaaccttttaaagtgaattagcaatgatttaggctcaaaaaattggcatcggtcggtgactcatcggaagtgatgcgcagaataatcgacgcaaaacgaaatttgggcgaggatttgcagaaatgtcgcgagttaaaggggaagcggaaaacggagggcgaagaatcgtccgccgacgaaggggacgacgattcggattttgtcgatgttgaggagaaagagggtccgagtaaaggacaattgtccttaaaacccattatttaaggatatgaacccgacttttcacataatgattgcaacaaaagcagcgacaaaaaagcgaagtgcgcaataattctcgatgaacggcctggtccgagtggattaaaagtgcaaaaggaaaagccaaaagaggacgaggaaaagggacggaaaagcgacgaaatcaatgggaagaaacgcattccaaaattggcgatgggactcgatctgaaatattggggagaggagcacataaagccggcagagagggtcagagttcaggcggaaggccatcacttttggagaccaatggacgagtgagtaaataatctaatttaatttaattaatggtcaattaagaaattttctttcccattcaagagacgctgacaatgtgcccactgaaaatgctgaagcgtatcgttcccgacagatcactttcgttggccaaatgcttccgaccaaaaaacgctgtcgagcgcccctccccagcggaaaattatgcccacgaatggaaagagagcgatgcgcacttcacggaccaatcattgacagagacgaaatgggatttccacagaaagagcaaaagtggggaaaacaaaaccaactaaaaaacatcgaacaatttaaatttcagagatgaggacgaaaacctgcaaaatagcacagacgaagcggacgaacagcgggaagaaagcgaggcggaatttttacaagatttacaagaagcgacaggggtaaaactaaccgaaaacagcaaaaaagtgaaaaagaaaacaacgaaaaggaggaaaaagaagacaaccacaaagaagaaaaagggaaaaaggaagaaaaagaaaacggcgagggaacggccaaaaccgaagagcgaaaagtcgcgggagagattagtggtgagaaaggggggggggcgggtagtttttgcgaaaagttaaatcccaaggccaaactgttcgacaaaaaaacactgaaaagggtggccaaaacactcgaacagatgcaaaaggcacgcgcaagtcgcaaattttctagccaatttaattatgcactggaaagacgatgataagacaaaaaaatttttacctttttatcattattgtaaatatattcaagttaaaaattttcgtcagaatcatattctccttcaatcgagagtataatcagagtactaaataagtaacaggaaatgattgcacaattacattaatattattaatttagaactaccatattattcgataaaagagaagaatactcggctcttatatggtttgtcccccataaatttgttgaaaaaattacaattttttaaaagagtcgagtagaacaccttttcttaagttttcggggtcgctgattaataatccggcatccgttttgacccatttcgaatccgaactttaaaaaaagtcaaaaactcaatttttatgccatttagtagcattgaatcgattttgtacaaaaaatgtgaattttttgaaattgaggttttgactttttattcgggttcgaagtggatgccggattcgcgtgatcagcgaccccaaaaatctaaggaaaggtgttttctacttgactcttaaaaagtataatttttcaaaaaatttgggtgtactatagtcaaccaaccggaaaaaaatggcacaaatgatataccaatcgattcgtcttgacgagctatgctcgaaaaagtaggtctccagttgcggaaatgccaaaaaaccggcttttgaaccggtttaaaactcgaaaaattgagtgaaaaaggtggcccctggccct

SEQ ID NO: 11099 - DNA, 2011 bp, Heterodera glycines
  misc_feature (1909)..(1909): n is a, c, g, or t
tcaaattaactttccaaacatttctgccacttaatctttttttagttaatccttgaaatccgattttttcagttgagttttccaaatttcattataggaattcgtctcggcgattgtatcggtcggtggacgacgaatgcgacgacgcttattccttcgattacggtgaacgtaatcgacaacggtacggtatgcgaggaatggcactgattcggggtgatcagcagcagcagcagcagcagcatgatgttcatcaataccagcatcaacgtcgctttttgcccgatttgccgaccaccagcagaacaatgcgaacacagatggaagagtgggatcatttttggaaatttcaatttgattttgggactgtaattaattcgcgttaattaatggacgatcacgggcgggcgatactgtaggcaaccattcggtaatgatcgctcctactgtaggcattgaataatatggactattgaccgctgtaccgtgactgatcaattcacaatcttccgagaaattttccaatcatgattggggtactgtaaagcgatagtttctgattggcgaagaatctctcacactctaataatttcatttttaggcagcaattccccgcaccgtcctctttcccccgtcctctacattttaacagcactaataataacaacagtacagcttggcgctactaccgtatgcctcccacgagtcgccgtggcgtcgccgaaccgccgccgccgtcgttggcacgcttcaactcgctgaatcgaatcgcagtcgcaccactccggcgcgacttctccgtggaccgtcgtactgagtcgctgtttcggcactttgtgcgccccgatccgtttgagatactgtagcatttaccaaaactatcgaacaataccaagaatgtaaaattttgttatttttagaaaaagttatgccataaaatgccggattttacgaaacgacctagcactaaactatcacaaaaccattaatgagacaaaaatgcaaaagcatttttattattatccaagtgccaaaatctagagaattttctatattcattatgatgttgcttctttattcaacgtaaaaatgaaaacaaattttcgaaattaaatcatcgaatgaataaaatgaattagaaattaaaataatagaaaaaaatagtaataataatagtaagacagggttgtcaaatgttctgttttatgatttgaatgatttggagggtcgaaatttttaagtgacccgtaaaatttaaaaaaatataaacttgacaaccctgtaataaaaaacaattaaaaacaaattaaaacaattaaaaaatacaattaaaaacaaattaaaaataattaaaaacaaatgataaataattaaaaaacaattaaaaacaaacaaattaaaaattattccaccttcgcggcccccactcgcacggcatgccccgccggccatcagcgcttttgctgcagaagcaatgcgtgcaactgaatttggaataatttaatttttaaaaaatttgggccaatttatcgccatttttttggtaaattactgaaacactttttgtagcttttaaaaagccattgaatttcctatttaattgtatcaaaaaattatgttaataatagtagttaattagttagtttaattgattagtgttcacctgaatgtaatcaggatggataattgaggggacggctaacccaagtcactctttagcctaccattgtgaacgggcgaggatgggaagaccggtggcattttcggggagggcagtgatttataaataattattaaaaattgttttttttaataaacaatttttgattaatgaagaatgaataaaatggaaaacgaattgcgttttaaatgggtgcgggttcttccaaaaagtgagggcactcctccncccattaacatcttaagctcatcaaattgaacagatgggaattagcaaaacactgtttaggtgtattgcgggtgcacaattacatggatgtagtctttggca

SEQ ID NO: 11100 - DNA, 3286 bp, Heterodera glycines
  misc_feature (33)..(33): n is a, c, g, or t
  misc_feature (45)..(45): n is a, c, g, or t
  misc_feature (153)..(153): n is a, c, g, or t
aaatttttcaaaattctttctaatgtatttacnctcagaaatttntaatattacagttattttttagtcatctgaagataatgttaaacacgtccattttcgaaaataaatgctaattatcgttttatttaattagttttaaataataatttnaaatttaaggaagaaaatttttttttcttcatccgaatggtcttgtgatttatttcgatttattcgatttatttattaatttttaattaattaagcagtaataatttagatgctgtacggaatctgtgtcccatctcgagtgggattttcctggaatcccgacttcatctgattctaatccctaattcccgtataaccctaacttggtgtataaaaatgcaattattttaataaaatttctttttaacttttgttgattatcttgttgtgctaaaatctgatttccgaaattatgttttatttataaattacaaatatatttttattatttctaattaaaccatcaattagtcatgtgatggaactgacaaacacttctttcatatgatttcattttatttgatataaattttagttaattaaacaataattatttaggtgagaactgaattgtcccggaatccctaccctaaccttcattcacataatacaatattatatattttaataatatttatttattttcttttgattcgcttattttgatgaaacacactcactcatttccgtaattttattaattatttttcaacaattttaatttaatttattatttttaaatttatttttattatttcttttttaaaccttcaattggtcttgtgatggaactggtaaacactcattaaacatcagcactcattcatcatttccgatcaaattgaagaaaaccaaaaattacaattttttccccaatttcccgcgtccccccataaaaaaatatttgaaggccattcattcgttctttcgtcgttcgttcattcgacgccaaaaattcatttaatttgcgcccattttaccgaagaaacatttgtgcccaaaaattgccttctcatctcacaaatcagcaacaaatgaattgaataaataatttttcaaaattcattgataatgatgaaaatttgtttattttttattttttgtaatttttttaaattgcaaaatgttgcatattttttacataaaagcatttgtgatgtaatcaaccggctagaatgaaaaaattgataaataattggtcaattaaagctaattaaggttgattccgtctgttctttgggttggtctttgaacctatcaaaattaattttctaattttaattttttttatatcttatcttaatccaatcatatcatcattaattagcaggatatcctataatttaaaactttattatgtattatgtaaagctcataaattgctaaggaaaataaacgaaataaaattaaaattttaatttaatttttaaataaataattttttgaaatgtcatttgtcctaaatgatcaagaaaatcacaattttactcaaaattccggtattctttgtataatgatggattggtttcgatcagtttgatggacctccgatcgttcgacacttttgatcaatttaaaatcattgattggcctttttaattggaattgacgggcattaatttgattcttacccgaccaatttatcttttctaatcatttccattattaactgttaaataattaaattcaatgtttatttttaaatttaaatatattctgaccaaaactcaagcatttttcgtttgttatgtgaacctgatcacttaaaaagattattccattgattggtcatatcctttcttagaaacaaccaaattaagattttcttggcataatttggtagccctaattaccctcaattagtatgaaaaattcaaataaaaaatttttttccacactcacaaaatgcatattatacacaatgcgaaatccattccagttccgtcctgtcctatcttggccaattccgtcaattcctgatccatgatttcatgacaaaatgccggtctttttgtgccgaacgcacaccctttttggggttggtcaaaagccagggcactcactcactgcttcttctcgttttgctcgcggcgaagcttcatcatcattagctgagggcatccaaaatgcgccgttttgcggggcgaagcagcacacaaattaatcattgttaatcagcggtcggttcggcggcttaattacccccttcccctcactcactcccgcccctttctgatcagtagggaaagcgcgcagcaatttttaacttaatttttaatcaatttttgaatttttttttgaattttatgaatgtttcattgcatttttgacatcaaaatttgctttggaaacattgatttgaataatctgcacaaatccaatccattcagcggcagcgcgtcacattttgtttaatccgctattttttgcaagcttaaaatctgctccgatcatccgatttagtttttttgacctcctttaaaatgatttgactttgtttttttttaattttgactattttttgtttaggtaattaaaatcaaagtttatttcgaattgccaaaatggattttttcttccaaagccctcccaagccacttcaggttatacaaagctatttttataaacaaattaattaattgcattattaatttttttaattaaaactaacatttaaaatatttacaatttttcaatttttatttttatttattaaactaatacatattgacatttaattgttaaattaaaatattttttgccatgtaaaattcagttttggccaaaccctccgcccgtgccggccaattttgcaaggccccaaacatttcgtgaaaaacattttggacaatggtgccgaaatttgacgctggataggtcattggaaatccaaatttttttaaaaaatccattaatttttattttaggcacattcaatgcccaagggcgtcgccatttcattggttcaccaataaataaataaataaaaatgctagagctcgacctggacttggcgccaggcctgggtttttttctgggtcatgtccagaccaggctatttttcggcaacctgggtttttccggacctgaatttccctgggttttgtccaggaaatccagctccaagtcaaatattaaaaaatccaggtccaggctaaacatgaaaaaacatggatttcctgggcaaattttagaatttattatttcaagtaaccaatatattatttgaattatcaaaaaaaaagttaaataa

SEQ ID NO: 11101 - DNA, 2186 bp, Heterodera glycines
cggccgcggtttttttttttgcgcgatgcgcggtcgcggccgcggcaatttgaatgcgcgatgcgcgatgcgcggccgcggtttttttctgtgcgcgctccagccctgatttgaattctccgcggcgttttcccaattcccttcccccaattcttttccccaaattcgcccaatgccttttcttcccaattctcagattgtggcccacccccaaagtggacctaagtgccgttgagccgagcttccgtgcccaattggagtccctttcctggtattcgtgcgtctccgattgggccaccgataagccgtcgccctttggtgccgctcgcagtacgcgcgtgtgccgttgctgctgctttccgttcaggccgaacccaaaaacattgaaatgcgaacacatccccggggcacccgaagcgccgggagaggagcaattggaggaggacgaaacggagagaaggagcagagaatggaaatgaaactatggcattttatgtgataattggggatggcacaacaaatggaaaataaaaaggaatttgctcttctctcgcttttcttagctttgcactttttcactgtctttggccgcgtcgcgtgtcgaattcggtcccttccgttcgctccgtccgtcgataggtcatctttcgccgcccgcctctccaccgtcgtcgtctccgtgccgttgctcatcgtccgccatccgtacgtgccgcacattcttccgcgaccttcccaccaccgttgtcattgcggacggtggtgccgtgccgtgttggcttccaccgcctccgctgctgttctgttcgtgcgtggccaccaactgcgccacgcggccactcttcgtcggcctttgtggcgacgtgcccgcctccgctcgtcgtccgtccgtttgttcttccgccgccgttttctcctcactctccagcatctttgactgtctctttggccttaaattggccttgccttttctctttcccattttttggcctttcacctgaaactgtctctgatcggctccaaaaatcgcagcgatttccttcttccgtccgcttttcttctcggcggagggtttgctccagtacagtaaacctaagcagcagacagcggagttttgattaatgaaacaaataaaagtgaaaagtttaattgccccccccccgcccgatttcgtggaccacacacatttaaatccgtgcgatttgtcctcagtttgtccaagcgacgggcgatgcgcaaataactgtcgtcggtttggatgaccaaatcctgtcaattaaattgatttaattttgcaattttgcccacttggctttctgttagggagtgccgtttttaggtttctgatcactccaccatctctcttcccccctctctctcacctttttctctctctccactctctctctcgccctttctctctgtcgccctttctctctgttcccctttatttctctctctctctctcccctctctctctctctcgccctttctctctgttcccctttatttctctctctctctccccctctctttttgctcgcctttttctccgctctgttcggatacgccatgttcagcagttcttccatttcgtctccgactgtcgctgtgactgattcggaccgttccctctgttcgctgccgttgatcgatgcttcttcatcttcatcctccattttttcgaaggtttcgtcttcttcaaatggctcgatgaaaggttgccactgatcagtttgggcgccgatgtcgcaaagttcgggcggcggagagcattgggccctgtgttttgttaattaaaatgggcactttccaattggcattccgttgccattgttcaattgcttttccctttttaccatgcgtctgtgactgcttcttcttcgaattccgcttctctgcccgtcaatgagaacattcgcctccgatgatccgcttttaacttctccgactgttcctcctcttccgatgggtacctttgggtgcttcgtttacttctgtctgatcatttcattatcttcgcgccccctccccctgttcacatcgtttgcactgatcgctgctgccgcgtttcgtccctctgatcagtttgtactcctttgaccaccatatttctgatcatttcgttcgttcaagccatgcgttcttccgttcggattaagcctttagtatccgtgcgcttattc

SEQ ID NO: 11102 - DNA, 2292 bp, Heterodera glycines
  misc_feature (1702)..(1702): n is a, c, g, or t
  misc_feature (1705)..(1705): n is a, c, g, or t
  misc_feature (1768)..(1768): n is a, c, g, or t
attaggtggggattatttcggatgttgccatcgtaaatccgtcttgttacttggtgccttgtataattccccaaaagtgccattcccaaaatgccctccctcactttttgtccgtcttccttttgttctgtgtgcgtcagtttcgtttgctcctccgcttcgtcctcctcctcttcctcctccgattgttctgtttgtgttcccctcgtgttctccgatttcgtcactttctcatagcattgcgtctttaaatttactaaaatgtgcctcatttcccttaatcccaccaaattttccaatttagccttctgcgtttcactgacgcacaatggggccaattggcgcatataccacggctccctggcgaacatttgggcaatgatttggtcgcgttctgtcggatcggtcacttcacggagcgctttttgatattccttctggacaacaaacaaatgaccaaaaaatgaaaggggggggtgatcagagtgatctgatcagaggagggggagcagtgcctgcatttggatcatcattttgtacagccattcctccattttgatttgaatcaccgacaaaagcattgacacaaaggacagtccgaagatgacgaaaacgaacctggcaaagagaaaatagaaaaaattgtaaaaacagcagcagaaaatggaacggacatgagaatgagcatgtgcggatggtcgggcacaacgtcaccgaggccaatggtaaggcaggagatgcaaatgaagtagaaggaggtgaagtaggaccaactgatcaggggcacaatttacatggcaaatatggccaaggggcaaatggaattgccaatggcaaaactaaattcccccgtaggggggggggacactgaccgactctcccaaatgaggaaaattgccgcaattgtgcacacgtaaccgctgacaatggacagtgccatccacaccggaatggtcctttgagcggagggagattagaagcgattgaccactggtcattgctgttttcttggccttcggactatgtcatggatcagctgatcaattggccttctttaggacggttcatccacagatttccccccccccctttttattcccccctttttattcccccctttttattccccctcttttatttccccttttatccccctcgttgaccccctctcccacccatccagtgattatctctctgatccctcatgccctttcccccgttcgtctgatcacctgctctccatcggctcttcctcctccttcgtccccctcccctcttctgcccctctctcccctcctttgccctcttccatcgctctttcgtctttcgtcggtggcaattccgtttttgatttgatgcgttcgcgataactttttcggaatcatttattcgttgaccaaaattcactcaccaaagccatttttcgctcaaccatttggtcatctttttgctcgtcttcaatttggggggggggcaaaaatcattttataatcactttttgattatccaaataactgtttcttttctcatttctaatcattttgtccttttctgatcacttcccgcaaattttcgtctcacctgattgaggatggccaacaccttaacaaattgaacagtttggtcatgccattgccagaatgattctgacaatgagtacagtataccagcggaatgccgacgatggcgtacaaaatgcggngtncgtgcccgggcgatgtccgcggagtgatgttaccgtagccaatggtcgtaaagacagtgccancttgaaaagcgaccgtaaccgcctcttcccactctctgcgcttaccgtaaaacagagcacccaaataggtccattctgaacaaaaataatgccattttaagccaatcgactgcattaaattccattggcacgcaccgagtgttccttccggcacttttaacctcgcaaaatctcgttcgtagtccgtcaagacttttctaaaatgctgaaatgcttttttcccattttattcactctctctctccccccccccccttttctctccctttttgtctctctgttcctctctctctctctctctctctctctctctctctctcttctctctctctctctctctctctatcttcctctctctttttctttccctttttatctctctctctcttttcccctctctctctccctgttcttgttttctctctattttccactctcccttccccctccctttgtctcccctagcttttgtgccaacttcgatttgctccaccggtcccttacgagccctcaatgtgccgtcc

SEQ ID NO: 11103 - DNA, 3604 bp, Heterodera glycines
tctccctctttctgatcacttttctttttctctctcctttcacttcgttactcctttctctgatcagtccatgtctcctgccattagttcccaaaattctgcaacatcaaattcccttctgtccctttacatttcgccaccttcgaattcgattttgcccgatccgtcctcgtcaatgtcctccaccgccgattggagctctttgtcactcagagatggctcaatttctcgcagcaaattcttcaaagtgtcggtggacaaatagccattgccctgggttaattagcctaattaatgacccgacgatttattgctccggggaatgaatgttttttgagtgttcaaataaaaagttggccttccatcggataaaccccctgcttctgcccacctccctgtcgaagattcgaaatgcctccctcagctctctgcgcaacgtctctttgtccaccgaatttgctaccgtatacacctgtcgttggttcatcaaacgtttccccccggtaccatatcgcccccccccttttttaccaatgcgcagaattcctcaaattccaatttgcccgacccgtccgcgtcaaactttctgatcagtttgcgcagcttcttctcctcaaagtcctggtccattgcccgcattatttggccaatttgcgtggccatgatgtacccgtgattgttcttgtcgaacatgtcgaagaacctttggtactctgcgcttttggcttttgtttttaatttattcaaataaaatttaaatgattttgccttcgatgcgcgacccgtcaatttcggccaaaatttcctcaatgttttctgcgtcataagctgccttaaaacttttaaaattcattcgaattataaaaatgccaaaaattaccatttcaattatttccgttggattaaatgaatgaattatgttcgaaatcggttcaatttatgggggcatctgatcggatctgccaacagatgtttctcccctccccccgtccatctgtcgccaatgtttctttattttttttcaaatttttcatcccacattttctcccgccaaacttttgccccttttttccattttattatgccattgcttttcgattggccaatttattcctttttgttttaaatgtgcaaaatatttttaaagttttttgtgtttccaatttacgaaaaaggctttcagagttggctgcacatggtaacggtggctttgttcttgttcagttatcacatgtggtccaactccgacagccaattcgacagacaacacaggacaaatggacaaaatgttaaaggaaattttaaggaagaaaaaacaaaaaataaataattaaaaataacaaaaataaatagtaattaattaaaaataaacaaataaataaataataaaataaacaaataaatggcgactttttctgctcccatcggacgccgcttaaataaatgcaacgaatgaatggcctcgacaatttacgggacgagaagagaatttattatcggagcataaatcagcggacggatggcattcagtgaaagcagtgggaaaaaaggaaaagccaacggagggaaagtgagaagcggcaaaaatggacagaaaaagcgatcggaaggaaagcgaaggaaatcaaaagaaagactttggccttttggggtccatcggcaggggaaaagacggacattcccacggactgtcgtaacaccgtaagccaacagtgatcggcggaagaattgccgatccaaagcgacccctcccccttttgtgaccattttcaatttctgatcggattaatcaaaggcatttgtcccaccaaagggatggcattcagtgatataaaatttaaatcaaaatgttgtctctaattaattcttttaaggtgtacaatttgtgaattgatcacttttgtttttgtctgtctgtctgctgtctccctcttctctgtaaccgttgtctttcgcgtgtctctgcttattcactgccctccccgttccccactcactctctctctttctctacacaaattcgatttcgctgtcctccgaaagtcctcccaatttcactttattttcgtcgaataatttccgcagtctttggcaatattccgcgtgtattctgtccaccgtttgttcgtcctcacaatttgcattttcttcaatttccattggctcgcccactaaatttttaaataaaaattctggttcttatccaccaggaattctatagtgcctactccctcatatccagggtagccagattaaaattttcaaaatcctcattgacctatcaaaaagccacaaaatgaggataaatcctcagatctggctaccctgctcatatcctatatgcgcaactccctttagcgcagcatcttacttttcatttttttgctgttaattttctcaccgattgttacaattttccgccggtacggaaagattccgacgcgaagccatcgcggcaatttttgtgccgtttcttccggcaaaagggcagcgatgaaactttggccataggccaacggaaaactgacgcgggttaatcgtttcaacaaattctgcaggggagggaggaaatggcattcattttgagggaatggcatttattttttggggaatggcattcattttgagggaatggcatttattttttggggaatggcattcattttgagggaatggcatttattttttggggaatggcattcattttgagggaatggcatttattttttggggaatggcattcattttgagggaatggcatttattttttggggaatggcattcatttttttgatggaatttcctccgatggacctgcgttttcttcaatgtgctcccctctctgctttctttttgctcataaacgtcggtttctccaaaatgaaacaccggcacaattgcgacaccaaaacggaaattatttaaaatttgaattattaattaattaattacccgtgtttgatggccaattttacgaacccctaaatttgctttcttttttaaaattttgcctttaaaagtccttttgcctttctccgtgacgtaatcagccgattcgtgccggggaatgattccaacgcttcggccgcccctccaggcacaatgccaacggcaaatccgcccccggggcgactcaaaacccattcgatggatttgctgtcactcggaatcattcctttcgattgtaattttgaattatttccaaatttgtcaaatcacccgaggccattatcatttctctgcgcaaaggaaaccaaaagttgaggtccaaagtgacggaatgcattcggaggccggggaaaagagaggcgaaatttgcaccatttgtagcgaagaaaatgaaactacttgagccgacgatgccgtgggggtgggcactgtaaaaagggaggggggtagggcaattaagtgccattaggggttaattaattgcctgaacaaataattacgatccgcggaaagatcagccgttttaatcaccgaaatcggaaaataagtggccaaatggcgccaaacgggcgaattgtaaaaaaacggccagaaatgggagccgcgcgaaggggtagcgaagtcccaaacgaaccaacaaaagtaaagcagcaaa

SEQ ID NO: 11104 - DNA, 1134 bp, Heterodera glycines
ttattttttaataaaataaaaatattttcaatgtaatctatattataaattttaagtaaaatcttaacgtggacatgagattagttttgatttagtattttttaaaatcaacatatacaaatttaaaaatttgaatgttttcatttattttttagtttcttaattgtggcagatcctccaaatttataaattcttcatcgacaacattggcaaaataatttctttattcatgttcaaaatttcaaatttgaattttagtgatttattttactcaactattaaatcctattttctccgagcaattaattttattttttcttatttactgaatttcaatttaatttttagaaactccaataaatttaaaaattcttagagtatattggcagataaatctttattcaaattttaataacttttatatttattcgcgatggcaattcaaaagcattcgttattattttgtaaaattccaattatttggattagattgctaaataatatttttattcgaatagaatttcaatttcaaataataatacaacaaaattctttaagcttttttaaagtttcaaaatcttagatttatttttctttgcttttataactttatattcaatttgcgtttatatgttatttggtaagtcaaattattttacacctttacatttatattttttaaaattcttattaaaataaatttttataaatttttcataaacacttcatcattcataataaatatattgcgtttgttatgagtactgtaacaacatcatactttttattcatttatttaaaaaatttaattgaatatttatttaactattttttacaaagaaatttttattttttggaatttcggaaatatttccgcgaatataataaatttaaaacgtcaaaacaataaataacggcatctatacataaatatcattaatctaagaatttttattcttcactcgtctgtaatgatgctcaggtatttggatggaattgacattatgtgatttaaaaattgagtatggcatgatatgatatttgctgtcatgggatgaaactcataaatatttcatatatgagaaaaatggaataatttaataaaatttacagaaagtttagtttgccaatgtg

SEQ ID NO: 11105 - DNA, 1874 bp, Heterodera glycines
ctttatcaatataaattaaatcatatatattttattataattaaacctattaaaaaaggttatcgttttttcaaggagtcaatgatggttttttttgagatgatgatttgagtcagcaccgtcagcccctaaaaataatttattttcttaaaatttgctcaaaatcacaaaatttggccatttttgtggacaaatatgttaacaaatcgaattaaaaattacaaaatttttcccggcgacgcctatcggcaccgtctgaccccttgtttccaaaagttctttggaaaaagcgacgaaaaaaaatcaacttcaatttttgatgctcagaatttaacaaaatgcttatttctaataaaaaattgcttaatttgatcatggacaataaaaaatataacatttgaacattttaagtttgttttaaataaattttgtaaaaatgaggcttttttgcctgccaaatgatattttttaaatcaatttgcctgtgaaatttttaaatttttttgtggttctttgggccaatgattctgaatttgaagttgattgcgtccattacgaattccaggccctaattcgaaccaaaaccaatttttaccaaaacgattgcacttttttcttcatttttatgataattttctgatttaacccacatcgttgtaatcacttttttcttgaaaaaatttatataaatttttaaattttgttcgaattagggagagtttgtaatggactaatggacttcaattcctgatcattgtcccaaaaccccaaaaaatttttagaaaaatccgagaacctcgagcataataatttatttgaattcccgaaaaaaagtctttatttaatgaatcgaattttctaataataaatatacatatcacaaaaaatggatctcttcgcattgaggtattttatacaattatttgaatctttgaaaagaagctgaaaattttaaaaatgcaacaccagagcgctttaaaaataatgaatacaaagcaaaaaaaattattacagacataaattagttgataatattaaattaaaaaataaattaaaaagaaagtacaataaatttctttttccgttgtcaatcaattgtttgagtgttgcatttatagttttaataaaattattaaagaaagaacgaaaaagccttaaaaactttaaagatttcgttactttaataaaaacctatgtgaacaattcaaacaaattaaaaataaattgcaactaatgtttataagttgggcgcgcacggttgggcgctcacggttgggtgcgcacggttgggcgccagcacgtttggacgccggcacatttgggcgccaatattccaacaatttttttaaatttgtttttttttatttaaaaatgttttaaagcgaccataaattccaatttttatgttttaaaatttattaaaaggatataagtaaatattattccgtacggatgcagcagcaaattgaccaaaagaaataggccaaagctagagcacgatggccatctctacacacttgacaagacaagtgccgatggaacgactaaattttggcgatgtgagttcaagaacagtggtgtgaacaagtgcaaaggacggatttggactcaggttgccatcagtttttaaattcaatgatctcaattttttttgattttaagcgttttaatacggagccaatttttgctgagtcagcaaaaatgctgatatcgattgcttttattcctattgccgatctcactgaagcagtcaatgtattggacgttgcgttccgaaattttcggacatgcaaccgatgttggattttatgttaatcgaagtcataaacagccagcatttaccaccgttcaggttgaatgaacaattaaacggg

SEQ ID NO: 11106 - DNA, 977 bp, Heterodera glycines
ttaaatgaaagaaaatattcattaaaaagtaaatatgaaagataatcgtttcaaattaaatttatgtaagaaacagtaaaattaaattaaaaaaatataagaaccgagattaataaaatgattttatctattggaaaactaaaatatgtcacctaatttaaattttattaaaaataataacaaattcaatttgaaatttttaagtgggtttttgctaaaacaagaaaaatcattaatatggggattgcgaatataaaagttattacccgattaatattagacctgatcttaatttaattgttgtaaaaataaccttgaataaattctacaaatgatgattacctagacagctgtattgacgctagaacagttgcgttgacgtgaaataaatttaaaattatagtaacaaattaatgaaaaaaaattataactatttatgtcaaaattagagacctttttcatcgatacaaaaccgaccggaaaagaattctgacgttaccgacagtgaagtagaaatatacgtgcaaaaagaaaattatcaaaaatcaaatacaaaataattttgacttttttattataataccttaatttaaatttatcacaataaacttttttaatacaattttatcccaaaaaatagcttgaaattgtacaggaaaatttaacgagagatttgaacacaactttcaaataaatatagaaaagggaaaatatttttgttgaatggtctcatgagtgctatttttaagataaattagaaaaagcctaaattatattataaaataaaatttaaaccaatggaaatgagcttgtatttatgaaaaaaataaaataaaaaatttgaattttaaatatgtaacagagtttaaattatttaagaaaagttccagataaatagcattatttccacgatgaatagtatttaattaagcaatataatactataaaaatgataataattcatagtccatgataac

SEQ ID NO: 11107 - DNA, 4158 bp, Heterodera glycines
  misc_feature (2458)..(2458): n is a, c, g, or t
cctaatatttaaaataaaattttaaatccttaaaacaatttccagagaccggggtagccgatcaggaatttcacgtacatttcgaccaattactaaatccagacataaattagaacaaaaagtccaaaattcaggaatgtctacaaggattttgtatttttgatatgaaaatagtttaaatgatcttttagaaacattttaaagtctttgaaaataaaatatatattattagcgctaaaatatgtatatgtactggaccttaataattggcactcgctttttcccccattccttccgcaaagacgcttccatttgatgtttccgaaacgaagacatatacgaacgaatagtgggagtatcagcattaacaaaaaaacaactgcttcggtgaattccaacaccaacatccgccattttatactgactgttagaaaagttggttccctaaaatggcaatggtgtaaatccaaatgttgtagatttagtgaagcttgagcccagtgtggttaactgggcggcaggccaactgggcggtatgggacacagattaggacccgctacaattagctaccgaaaaatactgagcgtgtataaaaaaaacatataataagttctgttaagtggctgatttttgtgagaccagaagcgcttaaaaataggaaaaccttgttacgttgaaagaaagctttcttactcaaaagaatgcaacaggaaccggagtcctgcattgtcatgaattctttcaagggaaatcagagttttttgaacaattaatgcttaattttttgtacatacctattttcggtaagtaaacgggtccggtacttgtttggtttagggtgtaaatttcaaataatttaatgatgattttcacttcagttacgtgtatttaaacaaagtttgaacaaaaatgtgataatcgagaatttaattactcaactttttgttcgagttcaggtccgggattcgaaattggtcggaatgggtgccggatcgttaccagtgaacatgaaaagcaaaacacaaaattcttttacatttataggcatctaaaaatgtatgtgaaatttatcccccaaaccacacaagtaccgcggattctatctgtgacccataccgtcaagctgtcccggtccgatgttagccctatatttacttacaagggaagggcgttccgaagaaccggcatttcccgaaaaatagaatttcagtgacccagaaaacctcggaaaatcattacctcgtgatcacttgtataaacccgaccaattgaagcaagaaaactaaacggttcctaaaataaattttgaattgtataaacgggcttaatcaaaagataactttgtgtttgtcatcgatttgaactttgtgcttcttcttgcgcatctcgcggaacattggatttttcgccaaatccataaaacgactatcatcttcaacgtcaatttgcttcttttttgctgttcgttccttcattttagtaacagactaaaggtcaattgtaagtaggcgcaaagatttcaaagtaaaatatttagcataaaacaacaaatttaaaatacatcttcatgacaccagatttataaaatttagtcgtggcttcttaagcctcgcatggaacatgcacatagaactaccaaaatcgatctgataaaattatcgcttttcttgtgcccgtttctttaattcagtgcactgctccatttatgctaagtcacgttccccgggttgttgcgagccaagttaagccttaaacagtgacatgcacaacaatggtattgaaggaaagaattgctgctgttacattgagtaggctgactccatagttatctcacgatcaatttcgagaaaatcgggcaaacgcggctcaggatcaccaatagggcgcgtggtgtatgtctggaaagttaatcgagctataaaaagacatttttaacaatgttttttgtctataaaatatggcaaatatttaattgcctcgaggatcatcagctgttcttcattgtacatcaaagctggaggaagaggtgcaatgtaaatgtccaggttaaaatactgggaaaggaaaagcatattcttttagcaatctagtgacttttgaaggtattcgatttaccacatttccgaagagaaaacacacacgtttcttgcgaattgcttgatagtctttgtcaagaagtttcaagtagatctgatactcatgccagtccaactgcttccgtgtttcaaccggttggggaagtctatatttgcaaaagagaattttttttaaaggcgaaaattacttcttgccatcagcgtcttcaatggttcgggtcgtatgtgtgtacgtgtactttccattttggctacgcgagcgaagtcgaacctgcaaagataaacttgtagccctaggtgtagcacaaagggatggggaactacagtttccatgttttctggtaaaaatgcgcgaaaaatntaaacgataatgagaaacgtaaaacgattccagaaatgaaaattgtcaaagaaaatggtgacataaatttcacgctgtaataagtaaaatttacctgactcgaaccctccatatggaggtaagcatcctcaattacaaatacctccttcttcattttcaagaaggcgctgtcatcgatactgctgaccaaccatttccgtttccttggaattttagatttatggaaaccaaatttataaaaatttacttgctatttggagccaaacgatccgaaatcgaaatgccaaaacgttcacaaacatcagcaataagtttggagatcttttcgtcaaacgaaccacttgaattatcaactattgatagatattcatgcccaacccatgccttaatttcggcattggatgctaataaaataataaaaatacttctttggtctttttgtcaagctgaattgcttcatccattgattcggttcgggcttggttattcgcaagttgataaaatgattgtgcaccatccgctgcggtgacgagatgacaaatcttattgttagaaatggatattatttgtaaataatgagcgaaaatgtctcacttggtggtatctttcacgcaattgttcgttggtcaccttacatgctgacaatacatctgaccaagattccatgtcgatataagcacttccatccatcgcacctaaactcaatatttgtttatcgaaaatgctcattactgatgctaatttaggtaatactctaccggtggtatcacacacttttgaaaacaattttttgttttcaaaattaatcaaagcttgtttctagaagtcttcagggtcgctgatcacgattgggccatttcaactaattgcttaacccggacccaaattcgcacaaaagatagagttaagatcttctaatttttgggtcataattagtttaaacacttggaaataaactgaaagcatcagtactaggaaggcaagattcgtgttcagcagcatcaagatcctgtggaaacacattttcatgatttttgaaaacaaaattttttttcaaaaggtgtgatacaatcggtagtattactctaatttctaatttatgttacctaccccggtctaaaatgatcataattttttccgcttcactgagttcggcctggttgaaaaatacctaaaaatgtaaagaaatgagttgtgcattagaaaacgcagtacattctcaatttgtatcaatgttttgagcaaatctatctggaattgagcagcctggtctctactcaggtcaggaaaacgaatgcgtccaggactcagcagaattgatgcagtctcaggaacggtgtacaccttccacccaatgctttcaaagaaacttgaaaggcgagcctaaagtataaaaaattgctgttaggtatgacatatggtaaaatagtaggttagtagtacctgtcccgttgtcttgccagcacacggacctccggtgagaacaactttgaatatttgtttttggtcgcccataaaactgtacaatatcctgtttatttgagttttttcatcataaaaccaaaaagactgggttctagtcggttttattggttctagtcggttttatgtgtcccatgacatattatgcgtcccatgaatgaccatcctcagtttcttagggcataacttttttcttactttttcaatacccatattct

SEQ ID NO: 11108 - DNA, 3204 bp, Heterodera glycines
ttcgaaaaaatattttatttttacataaattattatagattataacgatattatatattattaaaagtttgttctgtatagaagaaaaagacttgacaacagagtgttcaaatgaattaattgaatatcactcaataaaaacaaataggaaagattaattagaagcaatattataaaaattgagttgatgaaaattaattttttcaaaattatttgtatcactaaagaatttaaattagaaaattgaatatattatatgcgccgatgaataagatctgaaaattaatattctttcatttttcaaatgcaaaattaccatagtcggtacgagaaaaatatgcttaataactaagtccttttaaataattttaaattataattaattacaaaaaatagaattaggttaatttaatttgttcttttaaaattgtaaataagataaaaaaaattaattattctttaatttcaatatatttattaaaataatatcttttaaaaagatatataaaatttgacaagtgatagtgcaaaaaagtcacttaaataaatatgaacaaatatataagaagaaagaataatcatcaaaatgttaaattttctgcttttatgttaatatctttaagtttcattttttttaatttaaaattttggtaaataatgagatagttgtataattcagagtgaaaattttatcttgttttagattttgggcataataacaaatttaatatttatacatcttttacttttagttaatcttcgctatgcattttatataatttttttggctttaattgtttcaattttctaatttttatattaaatagaatataataataatttattttctcatttccttactttaatatggttttttaatttacaataatgagtaaatttatgtaattccatttttttggtcttaagttgaatgtttaggtttttagttttaattattttattaatctcatgtttcatcctcattagcatgttaataaatagttactatgataatatttttataaatgaatattatattttgcgcatgtcattttctacgtgttgattaatctcaggaagtaactcggattttaattgtaatttaattatttcaagtaaaaaaattaaaataaacaaaatcgttttccatttcttttttaaataagcattattgtattaacattttaaatttttattgatcgaataaacagtccatataatgaagatattactttatttattaaatttcggatgaattgcccttataattaaattatttaaaataaaatttaaaaattaattttagaaaaattattcattttcgttgtgtcatcgattggcatacagagctgaatgggatagaaatgtcacgacaactttggaaatgagaggggcaggattggcttgggctaagatgaacagacagacaaatttatgacgggattgggccgggggaaagtagggcaatgtaattatcacaagatatggaaacttgaatgttgcggatataacagttttaccgaaatttcttgtgaaaattaaatttttctcaccctttacgaagaatattttttccaaaaaatcaaatatttctttattaggccttaaaattataagaaacactcatgttcaagaaaaataatgctatgagagaatgatacaaaatttgagcaaaatgaaatacaaataatttataattaaatataaattttatataaaaagagttatatagttgtaatatttaataaaaaattaaattttggcaaaaaaataaagtcattgagctgaaattattaatatatataaccttaaaattacaaatttaaaaaatggattttttagcggatcagtattacataaaaattttaattaaaatgaaaagtatacgaaaaagtttacgaagattgaaggagtaaaataaaagaattaaatatcaatattagcaaggggtgcaaattaatttaaaaaattttattcttcataaattttatctgttgtttttgtaattgcaaatcaaaaatttctcaaggttttcggcagtgaagctcactgttgacccactcacgcatccattcagatttggatttaatttaggcataagcaaatatttattcatttgcatattttacaaccctggttataaaccttatattaaaatgagttacagtttaaagtataataaaaaatatttattatcaattcctttaaaatattctttgttctgttgttatttttaggattatttcctcttataaattatttttaaactcttttttgttttttaaaactaaaatttttacgaatttgttatttttaattataatttacaaaatattcttaaatattttaaaacatttattttctattatattaaatatcgaacatttatttttttgtgtgtttttataattaataaattttgaaaaaaaatttcattttaattattcattttgactttatttactatatcaattgtctgatctcgattattcgccatggcatccttttatttttggcttcaatcctttaaaataataaaatgattaattagttttaaatccatgtccactattcaccaatggtatcagggaagtgaacacctttaaattaattaattatttaatttaatctttgtgtttttttttaaacttatattgccaaccaaattatttttttaatttgttataaaatttattaatttatggtttgtttggataactagggattggtttggtaactttaaatttttccctttttgaaaaaattttttagacaccttagtgttttgttaattttgtgatcgtatgctaattaaaaaaaaattaaattgttttaatcaaataggaatttcaaaaaagtagaaatttgtattttataaaaaaacaaataatctttgttctaattatttggtcttgattctggcattttttttgtctgaaacattcctgcttacgaggccaactcttccatttattcttttcaaaattttttttttaatttatgcgaattcttcatcactttaaaaaattcctttttaaagaaaaagtcagtgtaaaaattttcattttttaatattttgctgtgctaattgcccaaattcggaagcgaaatgagcttacacccctgctgcactaaaagtgtgaagcatccttacggatcaccagaagattttctaaaaaatgcacctctaaaccttatacaaga

SEQ ID NO: 11109 - DNA, 3067 bp, Heterodera glycines
  misc_feature (116)..(116): n is a, c, g, or t
cagaataaaccttttttcttattttatttattagctcaattttagacttttgctcgcaaataaaattaaaatgtatggtatatcattaacatgtgtttcgatgttatttttattgnaaaaatatgtatgacaaaaataataaacacaaataattgtaattatttcattttattaataaatcttgacaaaatgttcgaataactaaaattaaattttatgctgtgccattatgctttacatatttaatttatgtttccattattctggctgttgtaatttttttaaagtaaattattttaattttctctttactttctttaccgtgctttacttttttattgattataatccatttaaataaatattttctgacacttacggctgatggaggaagcaatgacaaatataagaatttgcgcgaaaacttaaatatgaattaaattttaaaaaaacttttctgaaaataacaatgtataatttttcgggtcactgatcacgatttatttatgccaatttctgatttataattacttgtttaatgatgccattttgactttgactaaaatttatttattttcacacataaatttaatttgtttatatatattagattattactcacaaaattaaaatttattttcaaaattttaaaaagtattattaatattattcacaaaaaatgaataagaatttatttgttggaaattatttgttaatgtttgatgaataaatctggatttttgcccaaattttcttaataaaattaatttaattttcttatataaattcatttttcagaaatttattttgttatttcgtttataaatttaaatatcaggcaatgacactggttagtttgttaacattgttgttggtctttctcattattatagtcttatttgttagctatttttcttttttatgttccataggtaattaaatattttagatttatttaatagtttctgactatttaaggcaattgttttattatttctaatataataatgctttaatattcctattttttgaatattataataaaaaaataaataattagttaaattaattagtattttttaatttattgaaaaaaatataaaattctattcttggtcttttggagtgcttttttaaatgtggcttttttggcaaatattttaattaataaagtttatttaactaattgtgttttttctaaatttaaaattactttaattaaacattattcttttttttaatttttgatctattcaattttttaatgttttttcagctttttattatttttttaaaattattaactccacaaattaattttttaattgaattgctaatataaaataataataataataataataataatataaacacgtttttaattataatatatgtttatcataatttattattgagatttgattgttttttcctatggttttatttttataaaataattatttaaatgacggtcgagaatatcttaaaatttattgtttctcattaattctcgcataaatgcaataaatttataactcaaaattccaagaaaaaataacgaactataagaaggttttcggcttaagaacatgagatatagagaaataaaaaatatagaaccaaataaatataaaaaatttctaaataataccttttaagaggttgtgatgctactataattttcaaaaaagacattcgaaaaaataagataataatatttcattgaaagaaatttaataaataaaaatggatttaatactggaatttaaactgtatataaaataaaactttttttatatttactattgtttgattaattatttaaattaattttaatttaacataatcttttgcggtttgttccgaaaataatttttattcaatttgattttactatttttattgacgagctctgattaattaatatctctttttatatttaagattaataaatatatacaaatcaaattcgatttgtaaaaattaatttgttgtatatttattagattcacctggttccttacgtatcacatccttctgttgtgttttgttggcaatttattattttttatatagtttaggatttattttaattttatgttttttatttaatttcatgacttgagatccctatttatgccaaagcattgaaatgattttaattagcaattatgctaacaaagtgatgaaatttttttgtgaaattcacattttttgaccagtttttttttaatcaaattttcgccaaaaagttttggcctttttagcatttttaagaaatgttttgaggggtttttgcaaatacatttgtatttattagagccctgatttggaacattttcacactatgaacaacatcaactctgaagtattgagaaaaaatttttagtatgctattttttttaaaaatatctttccagaacagtgatagtttttgaataattttcttttaaatttggggggggcaaaaaaacgaagaaattttcaattccaaaatacaaaaatttgagatacaaaaaatttttggggggggggggcttatattttaggaaatacggtaatttcttattattacgagatctaaatggaaaaattacaacaaaaatttattaatttacataacggtggtgcctatcactatggcggacctgaaattcacttagatttttagaattagagacgagcaattaaaaaatctgattttcttggtcccacatccaaaatttattcatgttacgggaatcaaaagaattgccggtaatatataatttcaataaaattgtaaaaattcaaataataatttattatttctatatcatttgatacttaattatacacacattttaatctgataaaagaatagaaattttcgattaggtatggtaaaaaatcctcaaatatatctaaaaaatgtgtaagaaaaatacaaaacatgtaccaactatgtacaaaaaaccccaaaatttgtaaaaatatgtaaataaacctacttttgttagcaatacaaaataaagacttttcctacaatacatcagataataaaaaataaaatgtttaaaccttt

SEQ ID NO: 11110 - DNA, 1384 bp, Heterodera glycines
  misc_feature (10)..(10): n is a, c, g, or t
attaaaaaanattcctttgttacatttatttatttatttatttttaacatattttgcaatttaaataaaaatatttttactatattaaaatatgtaccatttgccgggctggtgaagtgcacatttttgttgatgttgacattaaaactgtgtccaactccgtcaaccacatcaatttgattcgtgaaattgttgctcaatgtttcccattttgcgcttttcaggtgccccgtcgcttttgcggctaactcaaacaaagcacggacaaaactgagcgcataggcacacggatcttcaatttaaataattaatttaaaagtaatgaaaaaaaatatttcaaaaagaaaaatattttccaattaataatacaacaagaattttctcattcattggacattacatattaatttttaagtcatttatagattggaatttattttttacaaaaaaatacaaaattttagaaaaaacaaaatttgatcatggttaagtggcttttgattagcgttggagcggatttaggtataatggatttctcgtttttttacactttttcgccaaaaaataaaaaaagtcattaactttttgaagcttttttgttgcattctttatttttaaatatttcatttttttgtcaatatttccatattttccaaaaatttttaattttttaaagtgaaaaaatgagaactgacaagtttttttctcaatgaaataaaatttattttcatagaatttcaattgagactctaattatacattcttttcttttaaaattaaactgatttttttcgtttttagtctcaaagacaaaatggtttatgatttttcgaaaatttgaactccgttttttgatttttttttctaatattttggcaatttttatccatattttagctttttttaatcaattttcgtttataaatttgcttcctattgattaacctacccattaatgtcaattgcacgtcaatttcgcgcacaattttggcaccaccgcccgccacacatttgttcattgtggccaattgttgtttaatgtatttgacatcggaaatcacattttggcacattaactctttctgatcagtttccactgagctggtgaagccgacgatgtatccgtgcatcagcgcggccaattgttgactgcccggacagcatggaaagcctttaaaaaaaattaaataaatatagttttttaattaattaagttgtttaattttagtgatggtgagcttggcatggcatagatcatctgatcagaatggcaattctcgagagtgagggacagggggacgactcttgtccaaaattgtctcactttagccctccatgttcgctcctctctcttttctataaccgtttggctcctctctctctc

SEQ ID NO: 11111 - DNA, 3893 bp, Heterodera glycines
  misc_feature (701)..(701): n is a, c, g, or t
tccctcctatctctccttcttccctctctctctctctttctctccttctcccttctctctccttctcccttctctctctctctctttcctctctctcgttccctcctatctctccttcttccctctctctctctctttctctccttctcccttctctctccttctcccttctctctctctctcttccctctctctctctctttctctccttctcccttctctctccttctcccctctctctctctctctttcctctctctcgttccctatctctccttcttccctctctctctttcctctcctgtctcactttctctatcacatgctcgctcactctctgattatctcacactgactgattcagtttctctccctttcattaaaatatttgcgatacgaaaaggccaaattcaagaccactaaatgtctcagaatttttgacaaagtaataaagactgccgattttttaaacacacccgaaagtgtggaccggtgccaaaacaaataattcgagacaggcctagaacccatggcgaaatttttaatggtacagtcatttgaaacgatccaatttacttggggcagcccaagtgcccaaatggtgcaaattgcaagcagcaacaataatggccataattgctattttggaaatggacatcatcgtagtcattaaatgaagaatatttttgggcaaatttggngttaaattatctcaatttaatttggtgattatgtgcctgctccgctgatttaaataccatttttttacagggcgacagaagagtgccatcgcaaaaaaaaaaaatggaaatggaaaacggatatgaaatagcaacaaaaatcgttgaaaatggtcgtggaatgtgccgcgtaagatgccgcaaaaaatgtgtggaaataataatgtctaatgacagacagctggggcatcaattaatgcaaacatcatttcctacaatcggaagctgatgtaattattttgcagcattggtgcatgtgatttctatgcggggctcccaaccgatatttttcaaaatcagcatttggccgacaaaaaatcattatttggagtcaaaaatcaacattttggaaaattttattccaaatgaattaaaatgtttttatttgcggcattcagcaaaatcagcaaactttctcaaattaagcagcaaaaatcagcaactcatcagtacaaataaatcatcattgaccccttgaaatgcatcaaaatgatgataaatcagcagagtcgggttggaagccctgtttctatggcttcttaaataaaaaaaattacaaatttttgataatttaactgtccaaatcagcgatgtattggaatgctgatttccgcttactgacatttttgtgctcggatttgagacttccaaaagccaaatttttttgagagcgtcggcacacatttctggtccaaattgcttctgtaaatttaggagcaccgttcagtaacagaacgaaatcttgtgaataataaaatagattgaaattgactattaattttttttgattaaatattttatttattttaaattcaaaattcgttcatttatataaaaaaacaaattctttttggatcatgaatagagttcttgacatccacaacaagagagaccagaattaggtctcgagaatcattccagaataggatttaaaggattaaaaccactgaattgtcgggattctgttcttgagcttctcaaaaaaaggaccaggataaggggacctggaagttcttaatctgttagggcactcttaaaacacaatacttttttgtccatcttactggatttgccgatgtgatgccagaaggaagggagtgtgggataaaggacatgggaggacacccaagggagcgcccgtagctcagttggttagagcaggccacggaattataaaaatgagaaagcaattttattttcaaaattcaaaaaaaaaatgaagtaaaataattatatcagtcaaattgcatattatgtgtaaaagtgagagtggtgtaaataacagtgataaccacaacaaaaaatcatgaatgttcatttagaaaagtttaatatatcatctgcgtttcatgctttgatccatccgccaaatgcgctctccatttcctgcgcggcagccatcagcaaagcttcggcatggaacggcgcgactaattggacggacaatggcacatctgttgaacaattaggctccatcaaatcaaatttttaatgcaaaaagcaaactcaaaataaatttacattaaaaaattgatttgttaacaattaaaaataattttatttttcgaaataataacatctcctttttccaagaaattttgcatgttgcaataatcttatagaaatatttctttttaaatttataattcgcttactttttaaaagatcttatagcatgtaaaattttttaaaatttccatgtcgacacttatcagcatggtcaaacaaatttgagtgttatagtccgaattgttcgaaacctttcaaattcgataaagttggtgttttttgattccgaaaaaaattcgatttattattttttacccaaaatatttcttttaacaatttgttgaattgccctcaccgtccccattcaatccgacagggcacaccagggccgggaagccgagcacgttgaacagctgtgtgtagggcatgttcatcggggtgaacatgttctgacgatggaacggcgcaacggtgggccacgggggcaacaacaaaatgccattgtcaccaagcgcggtggacagttgggcacgcagtttggccaacttggccaattgctataaggtttaaaaagcgtcggtcttgttatgtgcttgacgttgaaattgttaattgattgggaggggatcggttaattgggctaatgagtgcgagttaattttaattgatcaggagagaattgactaattggactaatgcgtgtgagccggatgaaagcatagtcgtttttcataatttaaatcggaattccaataaattaatttctatatactagtactgctcgagagtctcggtctcgactcgagaaaagtctcgggtttttttggtatcgaatctcgggttattaagtctcggtcaggattttcgagaccgtgacttttttacacccctaatgactggcttttggttaacttctatttttataaatttaaggttttcggtctcgagcagcactataaatcacccaaacacaaaaaacaaattttataaaattaaaaatgatatgaataaaataggctaattgtaagtattgcttctattttattgcataatatttccaaacgatcattatcaattgaaaatgagtgattggtgagcgcttattcatcagccaattcgcctttttcttcttcaacagttaaatcaatggccagcgtcactttgtcctcatttttgtcgtaaaatcctttgctcggatccatcaattgcttaatttttacagtttattaatagggcgaggatttttaagggcagaacttattttaatggctaacacccaaaataaggatttctaaggtcaaataagggcgctaaacgcaaaattttcgaaataaaatgtttttcgtgtattcttgttgagttaaagccgcagaaaaaataagtaaaattcttagaatcctcatcctatttattaagccactaaatgaagttttgctgccactcaccgtaaaagcaatgaaatttgagaaaccccaattgtccacttcgttgttaaaaactctgtcatattttcccgtcaaatcctccgttccgttcttttgtgaaacaattcgaagggttgccgaacatttgcagctccaatttccgtcttaattgaataagaaattgttaaatttatttatctctccaccttgatttggagcg

SEQ ID NO: 11112 - DNA, 2093 bp, Heterodera glycines
catagcaatttcgccattttcgccattaaattacaattttacgctttattaaaatttcataataaaaattgcaataattttaaacaatttttattaaataacacatacataaaaccctcaagatattaaagttcaaaaatgttcatgcttttcaactttctaaactgaagccgggcgggagttgagcctgaaattttccataaattaaaaaatatttgcagaaaaaatgacttttaattgataatcgatgtacacgcatccgttcattacggtcacctgaaaatttgttaaattcaatttgggatgacaaatttacaaatgcattttttaattgaatttccggaaatatacctccagtaggcaatgatttttgaataaccaataattactgtgctacaatatgtactagagtgccacgggaccgggacctggtagcggacaactgagtacaactgagtaccaaggtcccggttttgaccgggactagtcccggttttttcccgggtttcccagccaaaaattcccgggttttcaacctgaaaagttcccggtcccgggtttgcccaaaatttccggtcccgtggcactctaatatgtactattaacaggcccgtagccagcccaccctaaataaaaaattttcaagaaaaaattggcaattttcaaaacaatttttcttaacaaaatgccttaaaattaaaaataaaaatgttttcccggcggatctccatttttctttgattttaaaatttagacccaaaatggcaaaaatttgtccttttttttggcgaaaaacttctttttttttctaggcgctgattattttggcctgaaaagcaaaaaaaagaaaaggtcttcgtgttcccccctcccaaatttttttctggctacaggattgactattatgatataaatatgtagttgaatttggtgtaccgtcctcccctccgcttttgctaaccaataattactgtactctgtacaattacggtacgtttaaaaaattcaaattttgtaccgtcctcccctctgcttttgcctttctgatttggtcacgcaaactgcccaaatcgcctccgcccattgatgagggcgccgcgcacccggccaacatgccggcctggtacatcatcatcgagatgccaagcccgacacctttgctgctgttgaagctggacattctggaaggaaaaggcgccgattcactggcatttgtactgtggattgaatgcatgcacattttttccagaaaaactgccctaaacttttggacagtgatttttttttcatttttttatagctgagaaagtttttcagaggtctttgcatttattgcgtcaaaatagcgatttgaattaaagcagatttttatttaaaaaatgtgtatttttgaaaaaaaattttgaatagcgattttttaaattaattattttatagcaaagaaaatcttttgttgaaaaaacaaaaataaataatgtttttttaattttcattgtattttatttatttctgttggcttttaacatgaaaattcaaaaaatttatttagttaaaaaaaataattttttttaattttgtgaccataatttatgataaattgatgcaattacgaatgaatttaaaaataaaaaataatagtaaactgctcagacttacgcagaaagtgcctgcttttgctggtgctgctgatcagtgccacgttttttcacataatgtttactatcagactgatcagttttgtcgccggaaaagcacgaacccattgtggctgatcaatgtgttaaatgaatttgctcagaagcattggataaagccgagaaatttttttttgaacatgaaagaggacttaaattataaaattgaaataccattcttatgtggtgagttataaaaatattagaaaatgcaggaaaccctgagctttgtgaggaatttatttattttttattatttttaatattttatttaataaatttaattaaaaaatctttttgtcaattaatattccaaaattaaaaatactaaccaaaaaaggatcaattaaaaaaaggtaattaacttgaaatttaattttaaatataagcatcctaaaa

SEQ ID NO: 11113 - DNA, 2791 bp, Heterodera glycines
gaaataaaagcccccttttgagggggttgaaaaataaagcccccgggggctctattttaggaaatacagaattaaaaaagatttttttttaatttaaaatttaaatcccatttacttgaaaagaaaatttgacacacattttttttggtgttgaactaaaaaaaggcttaaaatgcatgcgaaacaatggccaaaaattttgggggctccccccatattatggtacaacaaacgaaggacaaacaaacaatgtgtgaaaatgaatggaatttgtgtccaaaggatagggcgggggaggggacgagaaatttttgcgtgccctccgccgcacccgggggcaacgagcggaaaagaatttcgcctccggcgacaggcagcaggcggcacagccaactcggagttgtcaacttcacatttggcacataaaaacaaaacaaaaccaaaaaaaaactcacattgtttcgtgcgcaaagaaatgtcaaaaacacaacagaatgccaaaaatgtggggaggaagcgaaaaattcaaaaatttaaatattttaaaatttattttagaaatattatttggaaaaataatttaaaaatcataaataattaaataggtggcatatttatgcaataaaaataagaaataatttttatcagaatgccaaaaatgtggggaggaagcaaaaaattcaaaaatgttaaatattttaaatttatttgagaaataatatttagaaaaataatttaaaaaacagaaattattcggaacgggccaactccgtctggccaactccgtctgagccaactttgagtcaatataactcttgaagttattgaccgaatcaaacaatcttgatatcattcgaaagctcttcacaggctctattagcctactaaaaattacagaaaatttcgaactataaaaaaagatagaaataaaaaacttcgaaaattctgccttttttgcggttttcaactgacaacttttttgagagctgattaatcactgcgaaatagcttataaatatcttctaaacatctagggctttcgaatgataccatgattgtgaagtttggccaacaaagaaaaaagttatagctttttgaacattgctgagacggagttggccagacggagttgaccctaccggaaattattaatgcatgtttacagaatgccaaaaatgggcggagtgagcgcaaaattaaaaaaaaatatttaaatatttatttgaggagtattattttaaaaacgataattaaattgattaagataatgttcaaatacaaaatttgaaaacattaaatttatggttatttttttgtcaggatgacaaaaatgcagaaatttgaaatttactaccttttttcaaaattatcggcaaccaaaaaatttataatattgcgaaaaatggcacgcattaccacagtttcactcttctgagcctatccaatttaaacccttcagcagctgtctcggtggggatagttaaacagaatgccaaccaccccataaatatttaaatgcatttgctcgtatttcaccgacgcacgaaaaccgaatgaatgaatgaaacgtggaaaatgccaaggcttttctgcatttccgctttgctattacaaaaatataaaaaggatttggaaaaaattaccgaaaaataaaaattcactaataaattggtttacaatttgacgaccaaataaaaaaaaatggcccacttttaccatttttttgtactctaccctcctaaaagggccaagagttaaagagagagagagagagagagagagagagagaaattcggtggatgcaattttcgccgggggcgggcctttgagtgccaaattgaccctttccgagggcgggggacggacaaaattcacttttcgcgtgccctccgccgcgcccccaagcgccggataaacgatgcgccaaggcgagaaattggcgttgaaaattggaaatatgccgtgcgaaagtgcggtaccccgtgccgtcttaactcatccggcgaccacacaaatttcggtgccgccgccgcccttcccccgcccaaaaattgattttggccacttcagttttgttgaaattcgagaacaaaaattgagcctaaccgcttattctagtcgtgaaaatggggcttaaatgaaagttttttgtcacattaaaaaggtacagtattcttaccatgttactgtacataaagatggtataacactcatcccatgttcagaaatatttcaattatactataaatttaatatattatgagccaaaagtatgaattaaaattacgagaatccaagccaaaatgtgggaaaatttgcatttttgtagggctggaaatttatttatttacagtatttgttagtttgtcaattatacagcagaagggcttcatttgtcaagttaaaaaaaaatttgcgtgccatcatcccaaaatgccaaaagtggaacgaaacgactttttggtgctaaaataaacaaattttaggcacagcattgacgtagaaaaattgttccaaaaatattctcgaatttttgtcctgacttttgtctaaagattaagcagcaaaattctttttttcgttcacacaacgaccacattttattttattatgtttgaatgatttatttacacgcaaattagcattaattaattaattgtccaattaaagggggtgggtggaaaacgcctcaggcgcctgtgctaggtacggccacggcaacaaaaactgcgaatttggtcatcagtgcatcgctgcacacagcacatttcggtcaaccgttccttagaga

SEQ ID NO: 11114 - DNA, 3279 bp, Heterodera glycines
ccatgcgatttctgtgctcgaaaataagcacttgcaacagtggactcagcgaaggcggaagccaatgctttgtgaggccattctcgcgaaatctgttgacaaattacttaattgaattgctccatttttttaattataaattattgtaattaatagttttaataataaatcgaattattatttattatttctcattttaattgtaattgcattccattcgtgctggtcttctagatgatactgataatgtatttattattatctaatgttaaatttaaatatatcaaattttaagatctttttaaaacatgaaaaaatatggccgcaccattctatgcatgaaatagatgggtgacaaaatgcgtctgaaatgcataatgttcttggttgaattgaaaagtgggggaaagaattgaaaagaaaatggacgaaattagagccacgagggaaaatgtaaacattgtcaaaatttgggtggcgaaagatggggcggctggcaataagcttccacagaatgctggtgatggtgacagccgattaaatttattggaaaaacaaattttttgggggaaacaaattaaatcggagcagagaagacgaaaacttttgcaaattcttatttacattatataaatttaaaaatatacaagaaaataaggcttagaatatcggattattattattttatttaggcctcagaaatttcttttttgaaaaagcgaaaaaataataatttttttaatccaaatttttgcaaaatttccatctccaaaatggggtggaaatatttttttcatcgattctcatcattcttttgctgaagcgatgaaaatgaaaaagtgcataaagaaatgcgccctaggggctattattgaataatttgtttggattatttggttgagagagaaatgcacaaaagaacaacaacacagctgaaattagtcacatttttctgttaaattacctttattagtaaaatttttttatttattataatttaatttaaaattatttaaaatattttaaatcaaacgaaaaattttatcaaaaattttcgatttattaaattaaattaattcaaacaaattaaaaatctttttaaacaacaattaattttttttaaatgccaaatgccattcatttctttccctttgttgcttcatttgccttttgtccataatcctaaatacatatacaaaatgaatttataattttttttggcatcttttcaattttatgggcaccaaaaaactagtgatttttttttgaattcctcccccccccccccttttatgaggagatcgaaaaataactccccatgggggataattagagaatatacggtatatatgtttttttgtgaaatccgaggtgcgcgaattcatctgccctcggaaaattacggcactaattcgtatataaaatgatgtcattcaatgtcaaacttgcctgttgcacttcctccaaatattccatcatttcctcattttgattggctgccatcaccgcggcaccataaccaccgccattgttgttgttgttactgtagccggtcccgacaaatttgccactaacagttaccgttggcattacggtggacggcggcagttggccaggcggtgccattggcaacggaattgctggtcggccaatttgtgccgctgcttttggcatatttgatgaaataggtgccgcatgtgcctgtgccttatacacttgtgttgcttggacatctgagccttgctgtctaaaattgaaaattttgaaaactttaaaatttatcagttctccatcagcctgcaaaatttcaaataatttcattaagcttgaacaaagttatgatcaaatttgaaaacttggtaactgtgtacttttgaccacattattgttcagatttaacgaaattttttgcaattttttaggctaatagagaatagggcgatatcaagaattaaaaatttagttgcttttggttgggaaatcccccggaaaactgattcattgttgatgtaatttcattttttttttaaattctggtgccacaaattttttttttttttggcattctgtttcacaccctaaggcagcagacgacgactgttcagcatgttgtcggaatggttgtggttcttgcaattcttgtttctgttgttgttgtacttgttgcggttgttgttgctgatttgtcatttgaactgcagcattgacaggacggccttcattgtttgtagcggaagattgtggcaccggcactggtgccacgttgttacgctgctgaccggcttgaatggcaccgccagcagtagtactgcccctctgacagtgtccgcacccgccaggttcgccgagcaagccgggcatgccggcagggccctgcgggccctgagagccatcgtcgccgcggtccccggtcggcccgcgcattcctcgcgcaccatcaccgcccggctaaattaacgcaaattttggtggcataaaagatgttggcatttgtgccagtttcacacacctgtccgtccttgcccggtggcccaggcgttccgcgtggcccatacggacccatttggccggcccgtcctggcgccgcgccgttcagcaagcggcccctgtcaccagcaggcccaactttacctggttgtcctggcttaatacggggtatatttagttttgcgatcatgatttattggtttatctgctcagatcagcgatcacgatttatagtataaaagagtttatcaaaaacaactaactgatccagtctgaaattataatttttgtcattttatttccgattttctgatcagccggcataaatgaagttaattttgatcagaagttaggtcaagatcaattgatggggggggggggggtgataaaaaaatgattgtgattcctatacactatcactcacaaaaacaaaaccaacctctccgcgggctccctgtggacctggcggtccttgatggttgttttctggaattttttaaaattttttattacgtatttattcgtcgaagttcgttcccaacttccctaaatccgggactttcccattcccgaacagcacaaacacccacactaacaatttatctattgtgtacctccatgctttccagattttcctggttggccggcgtgtccacgagcgccttttggaccaggcacaccgggcgggccttggggtccaggattgcacttaattaaccaattaggcatataattaattgaataattcaccaaatggcatgaagtttgctcaattggcggtgccggaatgta

SEQ ID NO: 11115 - DNA, 1125 bp, Heterodera glycines
aggtggatgttgaagcattggcggacgtacatttaatatagtgtagataatttttaaaaataggaattaaattgaaaattaaaaaaatttgaataaatagttttctcgaggagaaaattttgatggcgttcggaagcataatagattttataaaaagtaataaaaaaaagctacgaatttcgaccaaggtcagctacaaaatgacacattgtgtgcatgcacaacatgagcctcggaagcctcccgtgcttctgctttcttcttcgaatggcatgccgttgcgacgcttttgcctttccgttgtgccggacaacaattgcgcatcatcgggcgtgatcaattggtgccataatttggcagattgatgcttgagcaaaatgatcattttaaattctaatgatgtttaagcgaaatttaaatggcattttttgttttggcataaaaattcttggcatttcaatctcacctgacattgctggacattggacagcatcatggacattttgtgctgaaaatgctgatgcgcgatcgggagcagcacaacaacggccatcagtgaaacggtggacaaaacgctggccaaaaaaacgccatgccgttcattatgagtaaacattaggccgtaattaaattataattaattgctttaaaattgccccaattatgtgttaatgtggcaaatataaataaatgtttaatttagaaaaaatgaaataatattattgagtggaacaattttggaagtattaattgttttttttaaatagttaagtgaattttaaaacttttaattatagcccaaaaactgcacataaaaaattgaaataaaaaatttaaaattgcacccttaattgatgatgtcgaaagttgtcgaaatttaaaaaccgaatttcagacttataaaaataaataaatggatggaaattcgacgttttgatcaatcgcaaaaacccatgaaaaacttggtcattgcatttgaatatatccattcccaaaaaaataagtgtgtcaaatgcatcaaaaacttcactttttaaacacattcattcccattgacttgatcaactgctattcctcgaatgtcatgatcaaaaaccagttgaatgaatgaatgattaactctcg

SEQ ID NO: 11116 - DNA, 5442 bp, Heterodera glycines
gcctccgtctagctttgctttggcaattgcgatcgccggtctcgtcattctgctgtgatggactgatcagaaacagagttgaagggatcaaggaattacgaacagcgattttttgggattaactaatcaattatataattaatcatgccgtttacatttaaagatggcagtttttatattaaaaaagcatctgcgtggtaaaaagcataatgttcttaaataataaaaaattaaaatatttttataattaaaatattaatttatttaaaatttaattttctggagagtaaaaataaagatttagcaattgtttaatattatggtgagaatctttataattggttttctcatttaagcacttttaatttaatttttatgaactcctaattaatttgtccatttataaattatatgtatttactaaataagatattaatttacaggataacagagaatttttatggcttcctatattctattattgtttatacaacctttttggttaatcaaaactaacaatttatatgtttaaaattaaactcattgacttcagtaatactattaatgattacagcattatcaattgctatttagattaaatatattatataataaaactaaacatttttaattatttcggtttaattaaatttcttgtttagtttgtcagtgaaacttcgttcttttgttgaacatcgatcaattcgcaattttaatggacgaagctttgtatgtgcaagaaccagtgcccgattcggtcggcttaaaactgctagcagcaaacaattgagcaacataagtcaatgcgttaacattcttaaagaaataataattaaaaaattatttcaattttatttgacagaattaaacaaacaatttacttggcaagcgtatttagttgcggtgcttgacgagctttggccgtataaagtcagtccagaaaagagcacagtgtcaccgtaatttaaattaaccgctgaaaataaattcacatatgttttaaaagaatgaaatatttacatgtttctgcgtgattcaaacatttatattttttatgacttaaattatgctgattttattgacaaatttcttttaaatttttaaaaggttgttttatttaaaaattgtaaaattcgattattatccttgtgattaattatgctgatttgaatacaatttattttttttaatttctaacatatttttttaataaaattatttttattctttgatgaaaaattgttcaatttttgttaatttagtaaactttatttttttacaaaaattaactaacagacaaccgattgtccggggcccttcatgaccgtgttataaacttcgacgctacgcttcggttgaaaaggacaatttccgcatgaacaccacaatttgccgtatttgccttggttattaaagatgaataaatttgtatttattaaaagcattttgcatttttaaataaaaattaatttaatcataccttcgccacagaaattttgaatgattgttgtgcctttgcccgattgggtgaaatactaaaaatgaaaaattcgtgtaaatattaaatttaatgaagttagaggtatatgagtttatatcgagaacgttatgtggatctctgggattatgagataaattagttaattgtttactttgtctgcagtgccttggccagcgccaccaatcactttgtatgtgtacgatttgcttgtgtctgtgtatgctaatccaacagcatgataacacagttttttgtagcttcaacattttttaaaattaaatgattaaatttaaacttaaaattttttactaaatgttctttaaggtgcaactgcccttgcagtaaatgccataaccgggcgtgtcgaaaatggcattttcaatggtgacaccatcggtcagaatcattaagttcttcagtttggcgtttttcacatcacaagctccgttcaaaaggccggaaccgctaacaaacaaagtgttctgatagtcggtattctaaaaattctgttgaattcttatatttttatatttaaatttgaattctttttttatagttttactggaaatgggtggaaaatgattaaaagaattcccgttttgcccggtgtttgccccaaaagccggaagtggaagccccggcaaagtcacgacgaaactctagtcccattttcggggttgggaatttgcataagccggcattgagttgtgaaatttgggtaaaaattatgcacaatgaaattaaaggcagcatttaagagtaatataaattttaaatttattttgatttttcgaattatcttatgacatttccattgataattgcacccttttatatgtcaaggaatgaaccgagtgaatctttattgtaaaccaatttgtttgatcagatttaatttcaactaaaatttgtctgaatttttgacaaatttcaaataattccacaacattttaacattcgccgccccgtaaaagaaaaaaaagtcagaattgatgtgttcgtttaattaactttgtttcattaatttttatacgaattattagacaaaccacaacaatttcataaattattctttaccctttgcaattaaagtcagaaattgatacgtttattgaaaaatagaatgttatttgataatttttttggcattggaagaaagtttcatgttgcgggacacctagagctattgctcaataccaacattatttaatttgactaagcttgagctaattcggcaaaacttaaataaattttgaaatcttcggggcataagaaatggatataaacaaactaaaaattgagcaaaaggaccaaatgaagaaaatgacaagaaattacttaacaatttgctaaagttgtgaaaaaatatacaaatgaaaaaaagactggaaaaaagatttaatgccagtcatcataaaagtaaattccattttaattatttttcattaattacgtttgtttcagcaccaaagacaaataatgacgaattaagaaggatgaagaaatatttaaaaattaaagaaataaatccaaaaattagtgataaatagagatgcaatttatcgatgctaaaaactgccaaaagaattaatttttagtttctaaaaaaccccataggtgctaaaaatgggaaaatagtttctaaaaacttaaaaatttaggggtgtaaaatgacaaaatttattcaaaaaagtaaaaaaattaagcaaaatcagtattgagctaaataatttggaaaaactaaattttgtcaagaaaataaaataaattattttggagaatgaatttttgagcaatttttcatttattaggggtgtgtttttgaaaaattatgggtcgattctaaggggtgtattttttgaaaattctcaaaaagttgatccttaggatccttagggatgtattttttgttttttttttttgcattttaatgatttatttggcttttttattttgaagtaagtgtgttttttattttttgttttttaacaatgcgattaaacaatgttttttaatgcttaaaaacaattccctagttatatgtcgcccaatcataaatataaaatgtattcatgcgaattgttctatatttttttggacctaaaaataaacctaattccaacttcgtgtctaagaaaatctattttgtttatgttaacctttttgttatattgaataaaataaatgttaataattttctttcatcaaaatgtatttatcatcataggaaattacgctttttcggaatgtacgggaaaatttttgggttatatcctattttataaatatattttcagatttttccacaatatatagtagggttcggacgccgcccccgtcacccccgcccccgccgggggcgggagcaggttttttggcctctcccccgtccccgcgcccgcgactctgaccttagcaatccccgcgacgttcgcccccgcgggggcacgggggtgaaaatacacccctaagaatggcatattcgtgggataaaaggcaaaaaatttatacaaatttgaatttttaaccatctttgacaaattttttatgaaataaagtaaattttgctgttaatttccaatatatttgtggtttagtggttagtgcttcaatactaacagtatttcttgttaggagttcgacaccggttgacgttttcatttgaatttatttttatctgatatatgcagggtttctttttatgttcttatttctaataaatgttctgattttagggcgtattttcacccaaaagaatgaaatttctgaaaaatttggctaatttctaacaaaattcataaaaaaaatttcccccggcggcgcctatcggcaccagcggcccccaaaaaacctattttttcttaaaaaattagcataaatcaataaatttggtcatttttttacaaaagctgtgtaatttatgccaaaaggaattgaatagaggcgatacatcgactaaaggaatgtggagccaacacatcattcataaaaattaattttttttgtgagattttttggagctaattcaaatcaaacccccgctcccgtccccgcgggggcggaattatcgtgcccccgccaccgcgcgactctgacccacgccatcccacgcccccgcgaaaagccacccccgcccacggggtccgaaccctaatatatagaagtatttttaaatgtttggtcctaaagacagtatttttttttaaatctttgattttacattttaaaattttgtgtcttcttggccgccctgtcgcctttgagttaagaaaaagaagacttattccatttataacaatggaaaagcaaaatttttaatcaattataacttgtatacttattccaaatgaattttatctgtggttatccgcttacttaacacaacaacaatatttataatcaaagtttctatagaaaattgattttcaatgtttctttgatttgactgccacagcccgggcattgcttttccgttgagtccaatattttcttggcacaactgtcacaagttcccaaatgtttgcatggcaaaaagacgatatcacgctaaattaaaaatccgaaaaattctttttggcattctgtcacccacaatattttccaagcattcaatacagttgatcttttcatttgattgttcattcgttgacggagtttttgcgttttgattggattcgttaggtgatggcaactcggatgttaatgttgacgaggctggtgaagttaggctttggctccctatgctcttaaattagcaaatatgacaataatttaaaaaatggcgccgagaatccgaaatttcgttcaggaattcgtaattgagggcgagaatttttctaaatttgaatggactgccgggtaagcagtttgagtatcaatatcaattttgaaaattgaattcaaaatgaactcattttccttctgtatgttgcatccgtctg

SEQ ID NO: 11117 - DNA, 1479 bp, Heterodera glycines
  misc_feature (1335)..(1335): n is a, c, g, or t
  misc_feature (1429)..(1429): n is a, c, g, or t
ttatattattctttaatttgtaaaagacgggaatttttgaattaaaataaattgagtaaaattccgactcaaaaacgccaaaaatgccgggctctaataaataatccaatgcctaattaaatttatcgaaatccttcaatccttaaagtacttgttaacaataattgaaggattacaaattaagacgggacgatttaacattaatttataaaaccggattatctcattatctgtagaaaaacaattttttttgtacgtccaacaatacaacaatagatgttaccccacatttgcgcctatgtccaaaatcgggttccaacttaaatttttataatcctacaatagatggactaaaaagcttaaaaagcaatttaaagtgatagtttgcgataatttgatcgtcagcaaatttttcaaataataattaatctttcaatcatcgtaattattgttcctaataaactaaaagaataaattttattaaatttaatgctgtttaagacctctaaggcgcaagggccgcaaataaggaaaggtggaaacggtaattaatggggatacggtggctttggcgttaacaattttaaaatataaaaagtatcatttttagccttttggtttcctcaaaaaaagaacaaaagatgcccaaataggccaaaatctcacatttggatctcaggttaagcttttggctcaaaaaagagaattggccaaggcaagtgtcagaatttgtttaggttccgtttttaattattgttttttgtaatttttgtcgaatttttttatttttttttattagagtcgctcaccgactcttgaggaagaaaaaaaagttggtgatcgtggacaaaattggcagaaaaatttttgtcggaagaagtttaaagtgttggggagcaacaaatatcctcgtcgccgagagattttcacaaaaaccgaaattaagacttttctcgagcttaaactctcgggcatcacaaaaatttattcacgtgtcaagttttaccaccttctaaaattgttttcacagctttcacaagtgatataataagctttattacaataaatattacgaatataaaaatttttttttggtattttttaatgaatgcctttggcactgatcaaattataaatcatttttcctttacatcagatcatcctcctcctcatcattattcttccttcattcatccagtcaggctcagaaaagggctaaaaatataaaatgttttttttaattgattaaaaaattatttaaaattaaaatcaaaatataaatccaaaagatcaagcttttttaattccatcgaaaatttacaaaataattacatnagttttttttattaattttctaattgacacttaatttttcggatttaaaattatttttcgccattttacctgcacgatgcgccaccatcatcangcagcgcagcgttgacaattgcggcaaccaccagcttggcactgatgcca

SEQ ID NO: 11118 - DNA, 1921 bp, Heterodera glycines
cgctctctctctctctctaattgatggtctgggtttttctgttgaattttcttggttaaaattttcaaaatttttgttggattttttgataggcagttttacgaaagtacccctagcatctgcatatatatataaatttatatatatatatcttatggacaacaaacctctgacacagctcgctgtcacacaactattcccgtcaaaacaaccgcgcaatctctcatttactatatcagctgaattcaaatggggaaatgtttatagtttctaagcaaaaaaaaaaaaaagtaaaaataaaaaaaacattttcaaaaatcgaaatttgctgtaccataaaattcattacatttttaattgatatgttattaccactcacgaactccaaaagtggtttgtactccgctggcaacggttggcctttcgtgtgaccgacagcccgtaaggaatgcatgcagccaaattctggtagtgattaggtatcatcatcatttattgaaaaagctctgctgtgcttttactacaacaacaacaacaacaacaacagaaataagcaacaacaaaaaaatagaaaaaatatttaaaaaaaattattttcaaataaatcagtcaatttcgaaaggacccatttttagctcattgggtttgtcagttgattaaactggcttagctgaagaaaaaacaaaaacattcaccccaaaattttataattatttttatttttgaaccaaataccgtatacatgagacttctcacgcaaaattcggtacaaaaaaccaaaagacccaaaacttttgtcgtgtcgctcaagaaaacgagattctcgagtaccattagaaaatgtgcttccccagtgtttgtataataaagccaaaattaccgtacgacagctgcacaaccgtgccaagaataagcagttggagaccgattgaggcgacagtggtggccattgatcagatcggatgagtgggatggaagggattgaggaggattgaagaatgaacaagaggattagctaaatttatttttaagtgaaagatgaacatacaatttggcttattgggcccaatttgtgaccggaatttgtcaattacagtagtcctacacatatttgaagagacaaatcttttatgggtccgcggtctgcaaaatgattgcttcgaactgctttctggtggcccaaaaacggctatttatgcggccattttggggcggagttttcggcgctaacgccgacaatccgtccgcccatcgttcgtacgtccgtccctcggtcgatccgtccgttagccgaggcccgccccaattgcccagcagcaaaaattggctttagcattgtgccaaaagtggtgaatcattcattcattcattttgcccattttgtccatttttccaccaatttttgtacacttccgcccatttcgctgctcattttgttagcatcggtttttctgttttcacaattcattctgctgttactgagtgattcattcatcatccaaccacataatttgtccatcaaaagcagtgaaaacataaaaaattagctgtgctttcccagcgatgaacggaaatgacagaagaaaaaaaaatgaaaaagcgaataaattaacaaaacgaatttataaaaataatttatattaaatttattgtatacggtatgaaataatgttttatggtaaaaagtagtgaatttccgcttcagaaaatgtacagatcatatgatgatttttggaaaaaacaaactgacagtaaaatgaaacggagaattgaagagaggaaaaatgttttaatttccatatactgtatttgcaactaaaagtcgaaattaaaatttgttagtttctctaccgttgaaaattagacaaaagccgaaaaatgaccatttttagcaatgtgccataatttgttttgttttttt

SEQ ID NO: 11119 - DNA, 874 bp, Heterodera glycines
atttgcctttttaataaaaaacaaaattgttttgttgtgtgaatattatattttttgaattaacatatttatcttttcgtattcatacgtccgttttttctaatcaaaatttgatggacaaaatgaatgaatcatctcaaaaaaaagagtaaaagcgatggaaaagccaaatgcagaaaatgaattatcagatcagtaacaaaaaaataattggagagaattaatgaatttcgactgattgatatggaaaaaaaataataataataatatatatttctattttgatggacgaagttcgataaattaaattaggaattggaattattatcgccggcacgggacgcttcatgcacaattttgcgggatccctactcgcttttttaattgggctattccaataaattagaaaaaaaacagaaagtgtgtaggtaatgttaaggtggttggtatacaaatctaagctttaaaacacaaaatttgtaagcttattcttatccttacttaataaatgtctataatctgctaatctttttcactactaattaatccgagttcatctgatcatctccttataaatttgtcccggcgctcagttagcaggggcgcctgtccttacacttcgaataattttcaaatttaaagttgaatttctcgatatttctccaatttaactaaatgtgagccaaaagtctcaaattggcgaaatatgaaaaaaaaaaaagactttccatcaattctttctcgatgttttcctctttaattttttctttttaattaaatttattttcttgagaaatttttaaattttatatatcaaaaaaaaacattagtaaaaaaccataatgaccttttatattagcgttcaaaaatgata

SEQ ID NO: 11120 - DNA, 3367 bp, Heterodera glycines
tatgctcgtctttcgataaccaatcgccaaatccttatcaggctcggcatttattcacagtgccaaaacagaacaaagcttggcaatcggccgccaaaaaccaaagctctaccaagcaggtgatttcaattgaatgagcctctcatgatctgggacccaatatccaaatttacctgttttcatttcaactcattccgaaaacacactcccgcgaaaaaatcttgaagctatccgtttattgtcaacgaaacctattataagggaaaataactctcctaattaaggatacagacagaaaccatccttccgttgccaaccaccttcaagcgagttggcacgcgccatcactcgagcaaacgcccgccatcaggcgagcaaacgcccgccatcaggttggcaaagcacccaccatcaggctagcaaacgccctccatcaggcgagcaagcgcccgccttccagtgagcaaaagccctcgttctggcgaacaagcgtccgccttccgacgaacaagctcaacggtgtgatggttgggggagcgtctgatcggtcgagtgaagagataggaccgcctatcggcggtaaaaggagggcgaaccgcctgatcggcggtgtgaaggttggtaccgcctatcagcggtgaaaagcataaccgcctgatcggcggtgtgaaggtggggaccgcctatcggcggtgaaatgggggagggaccgcctgatcggcggtgtgaaggttggtaccgcctatcagcggtgaaaagcataaccgcctgatcggcggtgtgaaggtggggaccgcctatcggcggtgaaatgggggagggaccacctgatcggcggtaaaagggggaggaccgcctgatcggcggtgtgaaggcgggggctgccgcctatcggcggtgaaaaggaggggggaccgcctggtcggcggcgtgacggtgcggaccgcatatcgaaggtgaaaagtggggactgcctgatcggttgtgtaaaggaaggaccgcctaagaaccgacttaacggcgatgtcaaaaaaaatcgcttgattaacgcaaataaagatatacatttttgaaaaattgcgaaaatgataatttattcaaacattatcttttttggtgagaatttttcatttttaattgagtttagttgagcagattttattttaaccttgtccttccgcaccaattattcataaatttggccactgttttaaacagcgaacagggttaatttgggtcggtgttaattggccacaacgtgcgatgcgactttggccacaaagcaagatgcgactattaggcagggggatgaaaaattgatgcggtgggaaaattaaaaatataggctcaactaaactccacagtgaacttaaaattcgggactataatttcaggaaaaaggacgtaacattcgtgatcagcgaactagaacccccgaaggttgagacttaagattttttgttattattatttgggatactattttaaaaagttagataagatgaatttctctaattttaaaattttgttgactaatagtaagtataactaaatgatagcatgaatgcttattcaaagaaattatagtaaattgggctctcaagtgcctgggaggcagagagtttctaatttccaccatccacaaattcattacaaaatgcgaatttaaataattttttcagaaacgaaatttaaaataagcacctgtttaaatatttagaaatgattgggaaaaaatgtagggtgcaatggaaaagatcaacaaaaaagttattttgaatcaaacaattattattattgtcaagaaaaccttaacacaaaaaaaagggttgggtaatttcacaaaagaacggggatgatgggctaatgtggggaggaaatttttttttggtttttcttaatggaaaaataaattccaaataaatttttcagataatgttttaacctgcatattattaaataagttgtgaaaataaaagattaaattatttaaaggaaaagaagcgaaagaaaggattgtagatgtgtaggtaaaaaaaagctttattgaagatatgatatagatgtatttgtagttaggggctgagctaaatttataactcagttaatccttcgtacaaacacgacgctctaaaggtctgagctatttaataataactcagattatcttaagagaaataaaagacaaataaaattttaaaaaaatttacctaattgggggtagtgcgctctcgaaaaacgtaaatgacaaaaagttaattttccgttcaaggtcgaaaatgacgaaaaaattaagtcgcattgcatcgcaactaaataatctatgaacaataatctttaaacttttattttttaagcgaaaggtgttttattcctaggtaagaaacggataagaaagggccatgaaaaaaataaatggcaaaatgtctgaagaaaaaattctaaatatatttgttaagcatattttaaaatattaaatttctttatcaaaacaaaaaatattgttaggaaatgtttcagtttacagcaaaataaacaaaaaaaaaatttgggaataaacacattaaaaacttttatattttgaaatgatacaaattcaaaaaaatgaataggttaaattttaattaaaacgtcattaaggaaaaaaacgaaagaaatatttggacgagaaaaattaattaacgattaaaaattaatcgatgtttaaaaaatttgcataactttacgcagaagcacagccaggatttggatgagaaaaattaattaatgattaaaaattagatggaaatttgaggagggcgggggggggggggtccaatattaataactaatctgcagggagatgaaggttatcattgatagattttgttgtagaaataattaaattaaaaatcaaagttgacaaggcacttaaattttagcatatttaatctttaaataagccttcgtaatttaatcatttgagcattcattccgctgaagcgcagaaggaaggaattgaaaattggaatcgattatgcgactcgggggaacggaaagggagggaccaaagaaagtctgcaaaagagcggggagggagatattatcaacaaccaaatgcgtagctgtatattgtcaaaaatgcactaaaaagtgggatctgcaatttggacaaatttaagtgaaagagaatccccaacaaaaagcaacaattaatttatttgaatgagaaaccccctaaaaataaattagccgtatttaatttacggaaataatttgtcagaataaataaattcaattttaaaagtaaagggaattttggtgacaatttttttttgtcataggtaatatttgcaaaacgaaattttatggtaaagatgaaaaccct

SEQ ID NO: 11121 - DNA, 1674 bp, Heterodera glycines
aaaaatcagaaaattttttggtagatattaattcgaaaaatactcattgtcaatttattttttcctaatcaatatgcgcaatcttttcatagaagtacagccagggcagcggcaggtgggggggggggggtgtcggggaaacattgaaccggaccattaaaaggtgaacggaaatttagtcggggtcaaatggttaagcgaatgagtgggcagggggtcagggaaagaaaaagcgggaaatggcggaggggggagggggtttagccacttgctaaatatggggctaaaaaatggattaaaattaagttcgctaaataaaattaataacaaaggttttaagaaagcctttaaatttaagtacattattcgttcatggaaatctctttgcgcaatcattgcgcagcagcgcggaggcgggaggaaatagccaacaaaaacaataataatttatttgaaagagaaagccctatcctaagcaacgtttatttaaaatttgtgaaattaaataaaaaatagagtacgataggaaaaaaataggttcaaataaaattaaaggaaaattatatgaatcttttttttcgttattattttccgtatttccatgcgtcaaaaaatgggaggggaagagtcaaaaatttgaatcgattaaaccccaaagaatggagggcggcgcgggcaagtggtcggatggcaagggatgttcataaaagggagctcggtaataattggacgggtggggggtttgtctaggaagggccggaattttacaccgagatttgtggacatatactactcatattatataattagtaaactatgaatattgaaaactgtaatcaaataaaatccgttatttttcactgttctttaaaacgttctccaaaaatatggactgaccagcataacaaattctaaacataagaatctcattaaaaacaaacaaaacaaacttttgttagcaaacaatcaacgttttcatataagcaattgcaaaattttttatcacaatcatagcgtttttgtccctttagccgcaataagtaccacaatatttctttgcaacttacaaaagggaaaaaaatttatttagaaaggttatcacacaataatttaacaaaaaatttaatttatcttcattggctgtttaatcagttcaaaatgtccatcattaaaatacaaaaagattgatgctgttgattctttttgactcaggttcgaaagctaaagtttcaaaatgaatttacacaatcaaaacgttctaaccgatgtttccaaatctggtgaataaagttgccaacggaaaatcctttcctgtaaacgttcgcaaacaattatattaattcgaaacaatttgctggctgatgctatgtctaaattgttcatccatttctcagtttcatgtgctcctgttgctggcgcaacagcaatttcaatgtgttttctaatattttcaatactgttaaaaagcacttaaattgtttagttaaaaaactcttctaaatagattaacacttacaccaccattcattttcattatgatttatatgcgtgtgttgatatatagattcttccaaatattcaataacatctcttcgaatatcagagtgattccattcacttccagttaaagcgagagagatgctacgccacccacagtttccatcacctattatt

SEQ ID NO: 11122 - DNA, 3282 bp, Heterodera glycines
tctctctccccccctcttttctctttctctgctccacctgtgtcgttgtcacactgtccgccccgaaatggcaccgtttgttcttgttcttctctcgccgacaaaacagcacaaaaatgaggcaacagagcaaaaagattccgctgaacattgtcaacagaaacatcaaagtgtccgcaaaacttcggacgccgaaaaagccgtaggaacggagcacacaaagggaccgaaagagagaaaaggaaatgaatgaaagcaaaatggggacaaataatggcattttttaaatgcttggaaatggcacttttattgccctttggtttatctttcattggcattttgtgccctcctcccgccccctccacctgttctcctcgcgcagaaactcgagcattggcattgagaagaggtggtcgtccgcgtggttgggcaacgcgaacactttggccaacactgtgctttcgttgcgttccttcgcccgcgtcacattttccacgcatcgcatccccggcgcgtctgtcacgcgccctctgttgccctccagccaatgggccgcgtccatcggccggcgcttccgccgctccgccgccgacggttcgacgctggcgcagtcgcagcggaacggattgcccgcaagcgaaacgcgacgcaaattggcagaggagggactctgaagggtaattagcaaataaataattaaagaataattagcaactaattaattaaagagtaattagcgaataattaattaatatgggttgtttgcctggaggtattctggcacttcctccattgcgttgtccgctaaaagaagtgtctccaaattgggcagcacttcgcccaattctgtgcccatttcggtcaatgcgtttccgctgaggtccaacaaacgaatgttttctgtttctgtgcattcgctgccattgaaatgcgtcagtcggttgttcgacaaatggagggactgaaaaggaagcggaatatttaaaatataatttaatgggtcaacattatgtctaatttatttgtcattttccaatttctgttttttgttgttggccggcactgatcagcgatcacttatcgattaattgactcgttatcgattgatccgttgattgattcatttacccactgaacagtggttgagttccgatcaggcgtcgcttcgttctcttaccattaaattggccagcgattcgaatgcgcttggctctatcctccgaatgtccgatcggttgaggtgcaactcgcgcagccttttccggccgaaaaattcgctgctgctcagcacgggaagattcagtcccgagaggaaaacatgagaagcatgcattggcaaagccctgaaaagaggaaaatgacaatgacaaagaaaaaataacaaaggcaaattgtgaaccgaagactaaaatcggagccgacggaatcgccggaacatttgacgacatttgtggcggaactccgatcgcggaaacagtgacagccggggggacagcgggactaaacaaaaggggtaattagggccaattaagaaggcaactagcaattaagcgaaatttgggagaacgcactttgcagtcgcatccgttgaattggcagcactgacagccgatggcacagaaaagggaataggtgcacagaaaatcaaaggcctgaaaaggaaaattacgacaattagcaaatccttcctatttatacccgcataattagcatcaattcctaattaccccccgataatcagcatgtaaattcctaattacgccctccccccaccgttgtctcaatgatccttttccgctgcccatccaatggcaccacacatttggcactttctatgtccattactccgccctttgcggcattgatttgcttgcgcgaaatggccgtgccaactgcggaggccgaggcgttcagcagccaattcatctcgcaagaacattccaacggattatcttaaacggaatttaggttttggaattaattaatgactgatttggttttgctttaattgactctaacctccgacccaaagttcgccaaatggtgcatttgcgacaacaaatcgttcgtaaagttcgcgcggaattgtgctcaatttgttggagcgtaagtcgacctaagaaattccaccaattgttttaattttgtcttttggcattaaatgccaaatcattcggcacttttttcagctgtgccattgccgtgtctgccaattcgtaggcggtaccaaaggtcacttcggttagccgattctcgcgcacgtccaattcctccaaggacggcggaagcgaatccatggccaaattggccaagtgatttcgtcgcaacttaaatttgaaatttggagatggtcctcccctttttgtcagaagaatgtcaaatgcctcgagtttgcgcagttttcggcccctcctcgcctcgtcctccgtgccaatgcttcgcatttcgtttccgttcgcctcaatttcgagcagttcagcttcggccgggaattgggcccattccaactgaattttcacttggattttatttttctattatcttttcccatttttttgcctcttccattgcattttcgctgacattgacccattggagggaggccaaaccgagcagagatttgttcagagatcggattttgttgccggataagtcaattttgcgcagccgaggacatttggcaaatgcatcggagctgaaaaataataattaaaattgtgttaaataattaaattaaattaattattaattttaatcattagttattgtcttcggattgccttagcgtttgaattcgatttttggccagcgaaatctcggccaaattggcgcagtcggaaaacacgaaactttccaccgattccaacgaattccccgccaaattcagcttcgacaaatgtgtcaatttgttgagcacaaatttgtacaaataactaaaaaatcgtttaattgtccgattgttaatttctttttccattttcacttttccctcttcccccttttattgcccccccccaatttcggatttgtcccctcaaatgcgtcgtctttgccaatccatcaaatgtccgtcccccggagggacggacatttccatcggaaagcttcgccaatttatttgcccaggggtcatttgtcaaattgaaaataaaattcaaatgccaaattttgcgtcactcttacgaaattcggctggtgggaaagtccatccgtttgattttttggagtcgccgcaccgccacgggcatttccgtcaacgcattgttcgactgatgggaaaaa

SEQ ID NO: 11123 - DNA, 2240 bp, Heterodera glycines
cagttcatttaatcgctcacgaaaggggggattttagtgaacaaattgtcgctctaaaaaggtattataacataaaaaaaacaaaaattcggacgaacgcactaaaaaataaatgggaaatattcgggggagggcgggggagcgaagaaaggcgattcggggagaggtccaactgctgaaggaacggcacatggccaaaggcagcggagtcaatctgagccaaagtgttgttggccaatgccaatttacgaagtgccgggaaagggctgaggtcggactgccgaagttggccgatctgattggaggagagatcggcgatgatcagttggccaagttggcattgggacggagagagagagagggagggggaagagagcgaattggacgacacatccaacacctgagcagagattggccattatgggagtggtcgaatggcataatagcaaattaaatgcaaagtgaaatgattagtgcccctttccctcgcctgaagtgcccgcaggggacaaagcgcattcagcgggaaatgcgtcagtgccgtgccggtcaaagtgagccgttccaacgcgtgaagaccgtcaaagaaatgggcactcaaacggaggagagacggcatttgggagagatgaagcagccgaagacggggcgtggaaaggaaaagccgacgcggcggggagagaagccaacggaggagaatgggagaagaggagcaattctgaacaagcacaccgtaacacgggctatcacataacgcatcattccgaccaacagcataccgtaacccatcgtatcccttgcctttttgcccaatttttgtttacagtactctgtcgttttcccaatttattgcttgcacatttttagtttattgtactctgcatccccaattctctaccgtaatcctcaactcctgtagctcgtcgaacccgtcaaacggtgcttcgtcctccccgtccccgctttgctcccccgcgtcgtttggctttgtccccgtgcattgaatgctcagtgattttgtgccgccgcgcggaaattggccaaacgaacgcaattttggccaagcacagatgacaatgagcagttcatgcttcacatcgtcgggcatacagctgcaactgaaaacggaaagggaagtcaattgcattaattaatttttaagtgccaaatttggccaatgaattggcactttccgtcaaattttaattgcctttttctcggccaatgttcggggaatggcattcgtttggcacacattcatcaaaatgtctctctccctttcacatataaacaaaaatttgtttatcgttcgttgacaatggagaaaaatttaaaattaaaaaattttccgtctcataaaattaggcgaaccaaaaataaaaataaatggaaatggaaatttggcgcgaaaaattattattgccaaaatgagaaaaatgtgaaaattaatgaaggggataaaattttaccaaaaaagggtttaaaaaaagcattttaaaggggatgcaaaaaattatcagaataaaaaagtgagcgaatttttcggttcaaaacgtaaaattcccataaaaccccctaatagaccgccccttcccggcagtgtctgagcaaaattgcttatgttcattaagtttttttcctaaactctgaattgcctctaaattacctaaattacccctctatttgctgctctttcgttttctctctctcccccccccccccccattttccccccattttctcccattttcgtttatgacgcgccaaacccaaaagcattcattcgtttcattttcttttattatttatgttttattcgttcgcttttcggcttcttttatcccccgggggaaagtgcagtaaaaagaagcaaaaagaaaagggaaagaaactaatgacaatttgggaatggcacactaaaaaataatcagtccaaatttggttggtttttccttgcccaccccctttttgccccccccccttccccgtttttaaaaaattccctctcccctttttttactgactcatcagggcatcggtagcgaaaaacggagtattgttggtgttgttggtgttgcggttggtcgttttctgctgctcctccgtttggcgttgtgtcccttcgccggtgaatgtgccccgaggcgattttgcccgcagggaatgccaaaacaaaagccaaaaggcaaagggcaacagtgaacagcttggacttgtcgaatttgctgatccgtttgaag

SEQ ID NO: 11124 - DNA, 1791 bp, Heterodera glycines
  misc_feature (31)..(31): n is a, c, g, or t
tctgggctaaattttcagtccctctaaattncggggcttccctttctcttttttcccgtttctgacagaaatttcaacgcgtacatagccgttctaatcagtttttgtcatgaactaaaccggtcaatatcgaacactgccggcggagtggtcaacggagcgcagacaattggctctgaaatggcgctttcctccggtgggaggctgacggtgagttcgtccggccaattttcaggtgtttgccgagccaatttggccctctccaccataattctgataattttaacacatcaggtgtcactggccgtgtggcgaggtccgcgggattgtccgcggatcgaacatagcggaagattatgtgccgattggcgcgaatctctcgaacacgatttgctatgaaaatcggcattttatcggtggatgctagccacgaaagcgcaatgcgcgaatctgaccaaagattaatttgtccgatctcataatttaaatgtttatgcacaaattttactgcccgagatccgattaggattccaagtaactctaatcgtgggatagttagaccatccgcctggtccaccgccattttcttcgggcggagacgagaacgagcgtaagccaacgacgagagaattccctgcggcatttcagctctcaaatagatcgtgcaggcaaaagcattaggtgatgcatcggtgaaaacatgcaattgaatttcgccagtgttaattcgaggcgtgaagcgcgctatgcgcatcatttttgctgcccagagggctttaatttcatcccattctttggtctcttctactgggattggatcgtcccagctttttgaaccatcccataatttttggaaaaacaatttcgccccaaccaaacagggcgaacataaccccaaggggtcgaaaaatgacgcaactgtttttaggaccgttctccgagttaaaccatccggactaagaactgtaggaaaagtcaaagacaaattgtcctcacaaatagtccattttactccgagaaccgttggtgcctcattttggaggcgatcattttcaggtatttcgtccaaacttgacggatcagccacaatgaattcgcacagacgcattttagccgcggcgaaaatttctgtgcttcggctgcctttctgcgtgcttcctcaggcgaatcagccaaaagcagaaggttatcaacgtaaagcagagatttttcccggatttcctctgctaactcactgggaaatgcttccaaatgatgttggagtttcgctgccaatagaaaagggcaagacactattccaaatgttatcctccgaaagcggaaaacgagaagattttccccagaaagtggtgcaaatatattttttacccacaaaaattttgaaaattcacggtccgattctttcagacttaccatcagaaaagccttttctatgtcggcccaaatagggcattttgtggccctaaactgaatgagttttccggctaaatcaggatagagatttggccccgaaaataacatttcgtttaatgattgggcacccttttcgtgggatgaagcatcaaaaacgattcgaagctttttgcccatcactgtatgatgggcaagaaatgttgtggtcttttagcgcgatgggccttttcaattattcctttctctaaatattcctgtataatgtcgttacaaccgctaaaaagttgtggcgattccttcagtctccgtataagtgcagaaagtcttgaaaatgctaatctgaaattttccgccgagtaatctccctcctccttccat

SEQ ID NO: 11125 - DNA, 2011 bp, Heterodera glycines
  misc_feature (1974)..(1974): n is a, c, g, or t
  misc_feature (1997)..(1997): n is a, c, g, or t
aataatgtgtgaaaagttaggagctaacgcttgaaaactaattattttttaattaaaaaaaatttgggacgaaacgactcattttggcttaggggacgaaacgacgcgggacgaaacgactcattttggcttaggggacgaaacgacgcgggacgaaatgacgggcagcgccttcgtcctcggcaggggtcagctccgtcccgccaactccatcccaagcgccaaaattcagaatttttttattaaatagaaatttgtgcttttaaaataaataaatggctgttttttattttgaaaataatttaaattaatctaaccaattttgcacgtcgtaagatgtcagaagagcaaaataaatttgcattaaatttttttttaattttcatttcttataaccaccgggtcaattttgggctcccagttcaaaaagtaaatgcatgtgtggcgaagtggtttttgtaagatagtaaagggacaaagggaggaggttcgagatcatttgaaagttcttgatgagaagaagctttttctaagcagttaaccaatccgatgagttataaaaaaagttataggtgttcgaaactttgttttttataactcatgaaatattgtgtaagccaaataatggctgtattacaggatgtgttatttctggggccaggccgttttcgtacgggccgttttcgtacgaacacaggtttttggactataacttttttctttggcaaccaaatccaacactgttgttatcattcgagagcccttcagatgctctattagcatgtaaaattccaaatatttcgtcaagtttaaaaaaagttagagccaaaaaagttggaaaatttattttttgactcttctgaccataacttttttgaaccttaacgaaatttttccaaattttgcagagtaatagaggacacatagggctatcgaatgatactaacaatgaaagctaaacgtagcgaagtaaattcagtttttctgtattaacagagataaaaaatagtacgccaaaatgagagatgtttttttctctgcactctctatttattgacacatgtctcgttttttgactcggtgtgtatacataggtctatttttgaaaatattaaggtcgattcttatgggtatatttttctgaaatttttttagtcgattcttaggagcactatgggtcaactccactgtgcagagaaaagcctagtattttgtttaacactgggcttgacccatagtgtaggggtgtatgtattttcttttttgggtccatctcgtttgggcgccagcccatgttttgggctaaataacttcttttttttaaccaactccaacatttttggtatcattcgaaatgattttggattttggtatcccaattctttgcttaaaatcccttcccatcagattttgttggcacttcacttgattttggattttggtatcccaatactttgcttagaatcccttcccatcagattttgttggcacttcacttgatttgggattttggtatcccaattctttgcttagaatcccttcccatctgattttgttggcacttcgcttgattttggattttggaatcccaattctttgcttaaaatcccttcccatctgattttgttggaacttcacttgattaagcaaatgcagatttattaatacattagacaacaacagacatcgttttatttgtcaacaataatcagaagttcacttctattctggcctctctcatttcagaacgcaattaccacatcatccctttgcttttgttgtacagcgtcaaacgggcgcagccataaccctgaaaatcgtatttttgttatatttagattatgattttgtgagaagtgcaaactgccacccatggttatctgctattttggtacacttacatagtagtcgaatttgatcggcgattgcggttgccattgaagttgccattgtttaaggctccaaatgccccanaataagtgtgaaactggaacaanaggcagagtttcct

SEQ ID NO: 11126 - DNA, 2563 bp, Heterodera glycines
cccttacccacaatttttttttgtaaaacaccgcaaaaaacgcaaaatgtgatttggtaagcaaaaaagaaaaaaaggtcgtcagaaaaaaattgagaattttttcaatttcttaaaaattttggcctttgagggggggggggggtgggggtatattttgggtagcaaatttttgacccccccccccccctgtccgtgtatgatcccaccgtttagtttggacgaaatgacctctacttcaagctgggctatttctcacttatcggtttgccctttctctaaagcattgttttttactgtccaattgttttgggtctgctgaggacgcatgttctgcttggggattatcaccaggcgctgcaaactgttgagtatttggaaatggatgctaaggtttcgtgccattcatcactgatgtccggtgaagtaaaacgtttcagggtttgtacaacaccgtgccctcctgtctggtcaccctccattacttcgtcggtttctcccacttggtcagtgcgtttgccctccgtttctgctttgatttcctttcgctttcagatgatgcgcaattatgccgaggctgccaaaatattcatcatctgtttgtcgtacattcagcgaacccaaagtttgcagcaacaaatgcaaccgcagcaaaggaacaaagcgagcaaatacgacgtggtcagtcaacggaacgaatgattcgcttcgtctttttcattttgtttgcctcgacagattggcaaaacgaatgagcagctcttccacctgctgaccatctgtttgagtctgcagccgcaacgcatcgacgagtccatccaatcgcaacttcaggataaatacggggaaagaatgctgcgtatggccaacggcgacatcgacgagttccgaaacgccttccagcagggatgtcccaagttcttgtcccccaccactgttgtctacgaagggagcagtgtggccaaagtccgacagacccaaacaacttgaaaatgccactttttctttaggagcctttgcttcgccaatgcaatgcgtttttggaaggcatcgaaagtcaaattagtctgccaattttacgtggctatcttaaactgtagatgaactaaaaactgcattgaattcatacactaatttcagctacacaactcttcccgtccaaaagttggccagtttcatggatattcccgactcggagttggactctttcatcggcaagctcctaacctacaaaatgattgtcaccgaattgggcaaggaaaccattgacaaaaccgaaggggtaagcaactacaaacagaaacaaatcccttcaaaggatttaatctgtctgacttaaggccgatgagaccaccgatttggatttctacgttgataaggtccatacggaatgtttttcttattttcatttttagaatattatatttaggacatgattctgatcgctgacactaaagtggctcgtcgcgtcagcgaatatttcatcaaacaaatcggaaaacttcgtgaggtgaatttggagggggaaagaatccttagagttctcctattctattttcgtttctttctcttttcagatttctcgaaaaatcaaatcatctgtcactcccgttggtcaaatacacaagaattgatgttttgtcactgtaattgttaattattttagacattcattcgttttcgcttggcatgatttgttcttacacattttctgttgtaaaatgttaattcaatcatatcatttggcaccattttatctgctagtacaatgacaatcactgtcaccataaaggtaaagccattgttcccttttctgattttgagggtccaaattagacaaaataaattactgtttggaaatgccccgataagggcggtaacgtaaatttatcgggtttttgtttttctgtccaccctcaactgaaaaatactctctccccttttaagacagcaattagttaattatttggctattgtaaaattcaatcattttgagaaaataaaatagtctttccgggtaattctcgccaattcaccttcatttgtcccgtctttggtgtccccaccacgcccatcggtggggtgggggaaggggggggggtttcattgatgatgttctgtcggggacatcaagaagagcattataatcggtgcgttgttgctgttgcctctttcggttgtaagcacgacgaactaatatccatgaaggataattattcgaaatcgaattttcatccaacggatctgtatcgttttttaagtcagtttctcgtacctttgataagccttgacgccaaatgactttgccttctgactcacacttcaaatgttcattcctttgttctctatcgacttgatctgcttcaattaaatctcgtgagaaacatttttcagctttgatcacgggtattggggcatcagttgtgtaagaatcattttttgtttgtgtgtgcggaaacgacagttagttttggccaagtaacgtttccacgtaaataagcttaacttaatccctttcaattgcatttgttcttggagttttatggaattaatttttttattt

SEQ ID NO: 11127 - DNA, 1009 bp, Heterodera glycines
  misc_feature (951)..(951): n is a, c, g, or t
aattccgaacctctgacccggattcgaacaaaagtcgaaaattaatttttcaccaaaatccacctttatgttcccaaaattaatttaaatctgctaataaaaatgcaacaatccataaattcaagttcgcacgtaacatataaaagattagcagatttaaatcaattttggaacataaaagtggatttggtgaaaaattaattttcgacttttggttgaatccgggcccggggttcggaatcagtcgaaatggatgtcatattcgtgatcagcgatcccaaaaacctcatggttacattttatatgtcttgtaaaaaaaaaaaaaattatgtggcctaaactgtataagtaccgcttggctaaaaactcgccacaattttcgcatggattgccccccccctttgcctttggccaattgtcacttttctctttcttttctcaattttcggtctttttctgattctcaacatttcctttcccttttgcttattatttttcttcattacctcacttttcttcccctcacttttctcttttcattcttcccaatgtcctcccaaaatggcactgattcttcccttttggacgatggtcaatggttggacgggcatttccccctgcaccacgcagtgtttgacaacgatgtgccaaggctgggacaattgctcaaagaggcagcagcagcagcaggtttggacattggaaaatgggaaatacgcttaaaactccgtttttattggccaatccttttcagctgaatcttcggtcatcgacagagaagacacccacgggaatacgtcagttttccatagataacatttaaaatttgtttgtccttcctttatatttttaaaaatttaatttttttgtatttttgtttattttagggccatgcacatcggctgtatgcttggccacagaggttcctctgacaatcatttggttgatttngtaggttttaagagtgtgtaaaaattgctgttggaacatggggcatccgtccaatccg

SEQ ID NO: 11128 - DNA, 1020 bp, Heterodera glycines
acagacttgaaaaattagaaaataaatcggataatttttgttactgtacagggagttctcctcgtggattcgtacgtttgttccccattttcctttccatcgcttcgttttcagctcttctctcgcggattctcccctccgacactttcaaaatttacaaaaaagggcatcgccttcgctttgacttttcgcttgtcgattttaacaacaatggcccattgccaaaatggtatgtcggaaaaatgattacttttaccacttttttatatattttttgtttgttttctaagggaacgtggcgatgtgtctttgcttttggacattttgtcaaccgatggacgaaaggcggtgctaatggacaatcggaagagggtcagcagttggatagtgattttcagcataaccaaatgggactttgaatgattacaggtttaccaagtgttgcgggaaaagaaccaaaatctgagcgatgaattggacttgctgatgacgtcggacatcaccaagttggccatggccaaacgacgccctaaaatattggctaattttgtatttcagcactcacatgagcaccaaacccatccattttgtgcaggcgaaaaattttctcaatttcccaaaatgggtgggcaaaacttaaattttatttcgcgctctttaaattttcattatttaattttttaggacaagatcgacaattataaagcatttctctatcacataaagggaatgcagctaattacaatgaaaaggtgcattcataattgtaaagtaatttaatccgttttgatttcagacgcgagcatttgtcccgtgaggatttggaaaggaacaaaaaaatgcaacttttcttttcgagcggtaaaatgccgaaaggagatgacaacactttggaggatataaatacggaaatccctgagcatgacccggtcaaattcagtgaaatataatttaacgaggaaattgcagaaaaactcggacgccgattcatcaaatttggacgacataagcacagacgac

SEQ ID NO: 11129 - DNA, 1251 bp, Heterodera glycines
  misc_feature (1150)..(1150): n is a, c, g, or t
taaataattatttttggtaattaacaataaataggtcattgacaaaaaaaattaataaataaatggcacttcttaaggaatcaagccaccgcaagtcaatgtgtccagattggggcagccattacaagacacagatttaacattgaatgttgaaccaatttggtaagcgcatacggtagtgccttgccgtgccaaacagccccgtgtgtttgggcttgtgccacggaccagcgcttggattttgcaaccttaattaattgattaatgatataattagagtctcggtctcgtttaaggcatatggcaaattaagcgacacgcgttgaaaatttgtttaattacagtttttcagtactgtcttggcgtcggtttttaagaaaaattccttatatggggtgggcctcacgccccatttgcccaattaccgtcagtcgtggcacagctatccggacactgagtggtcagtcggaccaaaatgtccccgttgcgctccccggacggctgatagcacacattggccgcgtcgcaaacgcacggattcgcgcattgtgcgttttgctgaacatcaaacggtgtcgtcccgcgcggcaacggttccgcgtttgtgccgcccgggcaagcggtcactgggcacgcgggctgagttggtgcagcaattccgccttgctgacggtcaaagaccaatgtggcagtgcatgccgtacacactacaattaaaatccgcatttctatcgctttaaatatccggaagatatccaaaatataactccggagctatattatatataaaattatcattttaaacatacgagttgttgttgttgttgttgtggttgttgttgttgtagtcgttgttgttgtactggttgtcgttggggtcgttgttgttgtagttggagtggtagttgttgtagttggagtcgtagttgttgtagttggagtcgtagttgttgtagttggaatcgtagttgttgtagacgttgtagtcggagtcaatgttactgtacttggagtagtagttgctgtagtttgtatgggtattgtagttgttgatattgatgctattgtcgtagttcggctaattgttgtcgttgcagttctcatgcaaccgttgacaaattgttgttgtaccgctatgaaatatactacntgcatataattcactgttagcataatagctttaagcctttgacatatgtttcattttgttttccttaaatccaaaattgtttattgactaataattttttt

SEQ ID NO: 11130 - DNA, 2836 bp, Heterodera glycines
ttaaatccagaaaagtcgtggaaatatgctaatttttctccactggcaactttttattttaactttttttatattttgcctaaaataaaactatttatttaaaattcagctataaatcatatagttttcttctctgtataattaaataactttatttggatgccattttcatataagttaaacagctgactgaccaactaactactaattacctgctgctggaggaagtaattatgtgtgaaaaaatttccactccaaatcaatccattaaaccgcttttgatgataaattgggttgtcggtgaacaaataaaaaaatttgcgcgaaagcgcaatgtcaaaacatttataaaatgtgatatcaagagacgtaataataaaagtgcatttttttgaaatgactcgttgaatcaaagatttattaaattaaaattgattcattcgtcaggtacattaacattttcccaaggctaaaaaaattggacaacaaaatttaaattgttttataaattataaattagaattgccaaaatacaaattatgccatatgtacaaaagatataaataggaattttatattactatttttgggcaataatttacaaaaaagcatggaaacgtgcataaataaataaataaattattataaacttaaaattaaaagttttgtttttttccttttaaaaatttttgatttcaaaagaaatcctatctaaaagagtttctcaaatttttctaaaacatgaacattttgaaaaggcctttattttgcttaaatttctcttgatgctcttttgtcatttcaccaaaaacaggtgatcaacaacgacctggaagaattaatggtgcggaaaatcatttacttccactaattatttccactaaacgctcagctaattggcttgaaattcgtttgaaacctgcatccggcggtgagtttgtgtgaaccaacaaaaaatttcgccaacgatttagaaaaaatttaacaaagcttttttggtagatttatatctgttttttttttgtaaataagagtattttcagagaaatacatacggtaatccgttttcatatactttttacttaaaaaacttttttgatttatgccaagaatttagtttttttttcaatatgaaaaggtcatattaatgtattaaaattggtagctcggacctccattacaactcgcagaattggcactgaaaatgccaccacaatttcaaatcgttccttatattttttgaccttacaataaattataaaaatgattatatttaaaaattgaattaaattattttgagtaattaaaaatttctgttgccacctcttatctaaaaatacatttattacaatgttgatttttcttttttccaaattttaaaattacatttattattttaaaaggcgagtttattagagaccggacaactggggtaggagggatcccgagtcgggatatcgactgaatcacgaacattttggaaaaaagatcgggacggatcccgagtcgggataccgactgaatcccgatcaatcccgaacattttgtaaaaccgatcgggacggatcccgagtcgggatcccgaccaaatcccgatcatttagttaataattttgtttttattttcatgtgaaagtttatgtgccatgaataagattaaagaattatttttggtaattaacaataaataggtcattgacaaaaaaaaattagcgcattaaggaatcaagccaccgcaagtcaatgtgtccagattggggcagccattacaagacacagatttaacattgaatgttgaaccaatttggtaagcgcatacggtagtgccttgccgtgccaaacagccccgtgtgtttgggcttgtgccacggaccagcgcttggattgtgcaaccttaattcatataattaaggatataattcgagagtctcggtttaagacacaggtctattccctatatgggtgggcccctcatgccaaattaccgtcagtcgttgcacagtcatccggacattgagtggtcagtcggaccaaaatgttcccgttgagtaccccggacggctgatagcacacattagccgtgtcgcaaacgcacggactcgcgcattgtgcgttttgctgaacatcaaacgctgccgctccgcgcggcaacggttccgcgttagtgccgccagggcaagcggtcactgggcacgcgggctgagttggtgcagcaattccgccttggtgacggtcaaagaccaatgtggcagtgcatgccgtacacactacaattaaaatcctaatttcattttttcatatcgctcttttaataggaatggtcgagaatatttaaatgttaatttgagttctagtcaacattaaactttttagaaatgaagtacccaccggcgcttggtcatttagaaaatttgcgcatttacaaataatttaatattattttgctaaatataaatattaggaaatccaagttacccgcactactcaagcaattgttcagttgtccaaacaaaactaacatgcaaattccccgaattccaagcccggaactatattaataataatttttaatgtacaagttgttgttgttgtggttgttgtagtagtggtagtagtggttgttgttgttgtactagtagtagttggagttgtagttgtagttggagtcgtagttgttgtagttggagtcgtagttgttgtagttggagtcgtagttgttatagtcggagtggtagttgttgtagttggagtcgtagttattgtagttggagtcgttgtagttggagtcgcagtcgtagtcgttgtagaagtagtagttggagccaatattgctgta

SEQ ID NO: 11131 - DNA, 1366 bp, Heterodera glycines
  misc_feature (1357)..(1357): n is a, c, g, or t
gggggggggaaggccccaccacgaggccgcgaagaggccgagtgagtaccttcggtgcaggaaaattattaaggaagagagttcattatttatttgttttttgcataattaattcataaatatttttttcagaaagggttctgaaacgcaccaaatttatttacaagttgaataaggctctctgatgcttttactatcaaaaagggagatgaataaaatttttaattgctttaaacatgccaaaaagtttaggcttaaattaaaaaaattttcttcggctctagctctttcaataagcaataaaatcgtaccaaattttataggcatactccccggaacaggactaacttaacctgaaaaaatgacaattgtaattggttttaaatttttttagaaattctgagtttttcactgtttattattttttgcaaaattaattcataaatattttttcagaaagtgctctgaaacgcatcaaattttatgtacaagttaaataaggctctctgatgcttttactatcaaaaagggagatgaataaaatttttaattgctttttaaacatgccaaaaagtttaggcttaaattaaaaagattttcttcggttctagctctttcaataagcaataaaatcgtaccaaattttataggcatactccccggtacaggactaacttaacctgaaaaaatgacaattgtaattggttttaaatttttttagaaattctgagtttttaactgtttatttattttttgcaaaattaattcataaatattttttcagaaagtgctctgaaacgcatcaaattttatgtacaagttaaaataggctctctgatgcttttactatcaaaaagggagatgaataaaatttttaattgctttttaaacatgccaaaaagtttaggcttaaattaaaaaaattttcttcggctctagctctttcaataagcaataaaatcgtaccaaattttataggcatactccccggtacaggactaacttaacctgaaaaaatgacaattgtaattggttttaaatttttttagaaattctgagtttttaactgtttatttattttttgaaaaattaattcataaatattttttcagaaaatgctctaaagcgcaccaaattttatttacaagtcaattttagcactctgatgcttttagtatcaaaaaggaagatgaagaaaaattttaattgctttttaaacatgccaaaaagtttaggcttaacttttttttcagaaactgatcagaagcgcaccaaactttgcagggatactgaaaggaagagaaataacctattttaaatattaaatagtcagttcattaaaataatttttatccanaaaaatttt

SEQ ID NO: 11132 - DNA, 950 bp, Heterodera glycines
tttaattcacagagaattttcaaatggctattctacgccagaaaatggctacctctttttctgagtaattttgtgttcaacaaatgctccaaaaagcgagccaagggccggagagcaatgaccattttaattcacagagaattttcaaatggctattctacgccagaaaatggctatctctttttctgagtaattttgtgttcaacaaatgctccaaaaagcgagccaagggccggagagcaatgaccattttaattcacagagaattttcaaatggctattctacgccagaaaaatggctatctctttttctgagtaattttgtgttcaacaaatgctccaaaaagcgagccaagggccggagagcaatgaccattttaattcacagagaattttcaaatggctattctacgccagaaaaatggctacctctttttctgagtaattttgtgttcaacaaatgctccaaaaagcgagccaagggccggagagcaatgaccattttaattcacagagaattttcaaatggctattctacgccagaaaaatggctacctctttttctgagtaattttgtgttcaacaaatgctccaaaaagcgagccaagggccggagagcaatgaccattttatttcacagagaattttcaaatggctattctacgccagaaaatggctatctctttttctgagtaattttgtgttcaacaaatgctccaaaaagcgagtcaagggccggagagcaatgaccattttaattcacagagaattttcaaatggctattctacgccagaaaaatggctatctctttttctgagtaattttgtgttcaacaaatgctccaaaaagcgagccaagggccggagagcatgaccattttaattcacagaaaattttcaaatggctattctacgccagaaaaatggctacctctttttctgagtaattt

SEQ ID NO: 11133 - DNA, 1210 bp, Heterodera glycines
ttttctgagtaattttgtgtcaacaaatgctccaaaaagcgagccaagggccggagagcaatgaccattttattcacagagattttcaaatggctattctacgccagaaaaatggctatctctttttctgagtaattttgtgttcaacaaatgctccaaaaagcgagccaagggccggagagcaatgaccattttaattcacagagaattttcaaatgtcaagggcttctattctacgccagaaaatggctatctctttttctgagtaattttgtgttcaacaaatgctccaaaaagcgagtcaagggccggagagcaatgaccattttaattcacagagaattttcaaatggctattctacgccagaaaaatggctacctctttttctgagtaattttgtgttcaacaaatgctccaaaaagcgagtcaagggccggagagcaatgaccattttaattcacagagaattttcaaatggctattctacgccagaaaaatggctacctctttttctgagtaattttgtgttcaacaaatgctccaaaaagcgagccaagggccggagagcaatgaccattttaattcacagagaattttcaaatggctattctacgccagaaaaatggctacctctttttctgagtaattttgtgttcaacaaatgctccaaaaagcgagccaagggccggagagcaatgaccattttaattcacagagaattttcaaatggctattctacgccagaaaaatggctacctctttttctgagtaattttgtgttcaacaaatgctccaaaaagcgagccaagggccggagagcaatgaccattttaattcacagagaattttcaaatggctattctacgccagaaaaatggctacctctttttctgagtaattttgtgttcaacaaatgctccaaaaagcgagccaagggccggagagcaatgaccattttaattcacagagaattttcaaatgtctattctacgccagaaaaatggctacctctttttctgagtaattttgtgttcaacaaatgctccaaaaagcgagccaagggccggagagcaatgaccattttaattcacagagaattttcaaatgtctattctacgccagaaaaatggctacctctttttctgagtaattttgtgtttcacaaatgctccaaaaagcgagccaagggcccgagagcaatgaccattt

SEQ ID NO: 11134 - DNA, 901 bp, Heterodera glycines
  misc_feature (19)..(19): n is a, c, g, or t
agtaattttgtgttcacanaatgctccaaaaagcgagccaagggccggagagcaatgaccattttatttcacagagaattttcaaatggctattctacgccagaaaatggctatctctttttatgagtaattttgtgttcaacaaatgctccaaaaagcgagtcaagggccggagagcaatgaccattttaattcacagagaattttcaaatggctattctacgccagaaaaatggctatctctttttctgagtaattttgtgttcaacaaatgctccaaaaagcgagccaagggccggagagcaatgaccattttaattcacagagaattttcaaatggctattctacgccagaaaaatggctacctctttttctgagtaattttgtgttcaacaaatgctccaaaaagcgagccaagggccggagagcaatgaccattttaattcacagagaattttcaaatggctattctacgccagaaaatggctatctcttttctgagtaattttgtgttcaacaaatgctccaaaaagcgagtcaagggccggagagcaatgacccttttaattcacagagaattttcaaatggctattctacgccagaaaatggctatctctttttctgagtaattttgtgttcaacaaatgctccaaaaagcgagccaagggccggagagcaatgaccattttaattcacagagaattttcaaatggctattctacgccagaaaaatggctacctctttttctgagtaattttgtgtttaacaaatgctccaaaaagcgagccaagggccggagagcaatgaccattttaattcacagagaattttcaaatggctattctacgccagaaaaatggctacctctttttctgagtaattttgtgttcaacaaatg

SEQ ID NO: 11135 - DNA, 3643 bp, Heterodera glycines
  misc_feature (21)..(21): n is a, c, g, or t
taattcaattcgactataaanttaaggaccttttgactatctacatatacattgggtaattagataattaagcattataattggactaattattcaattaattagcatgcttcgatttcgttgggcgtgaaaaatccggtgtccaagccaacttcccatctgtcacgaccatcgtagattgacacaagttcgtcatgggactaaatttttaaaaattatttttctgcgtttaatttaaatattttaattattattttacttgcaatggccaatcccaaagtttggtgctttcttcctgatctactttaatttgattcatttaaaagaattggtttttcttaaatttaaatattttatttaaaataaaaattaaaatatttaaaataaaaattcttttattatttatataaaattgactattttattattcattggccatttttatataggccaaattttacgagagttcatttgagtaaacaacattttccatcaaagaatttgctcgaagctcttttgtggccataaacaatcaacaaaatttggccacgatcaacataccctaattgttgtcgttcagttcagcaacaacagttgtggacctaaaataacaaattttttttgtttatgtttaacaaaaaaaaaatgtaacgaaataatgaacagatttcaaaaagaaaattcagcaaaaaaaaataaaaaattttgttttcataaagcttagcatgttgaacagaaacaactgctgttttattttgaggatgagattgtttgtgtaaatatatattatgtccaaaaaaattttactgatcacgggagttttttttattttggcaaatttttttgatatttttgcgttgtttttgggggcagggtcgttttcgtacgggccgatgtcgtacgagcacaagtttttggctataacttttttatttatcgaccaaatccaacattgttggtgtcattcgatagccctatgtatcctctattagcctgcaaaatttcaaaaaattttgtcaaggttcaaaaaagttatggtcagaagaattcaaaaaaaccagattttccaacttttttggctcgaacttttttttaaactgaacaaaattttcttggaattttgcaggctaatagagcatctaaagagctttcgaatgataccaacaatattgggatttggttgacaaagaaaaaagttatagtcaaaaaacatgtgctcgtacgaaaacggtctggtccgttatttttgtgcctctggtaacacgaaagtgtacatataaattgataaaaaaaagaatataggaaaattgaaaaaaaatagcgcacgttttgcttaatagcttgaaaaaaacgctaaaaaataattttataaaaaaataaataaataattcattatcattttgtgtcctttttatttaatttccttggccccatattttctttttaaaatttgttgcgcttttgaccacttttagtagagttatggttagtctaaatttttaaaaatcgactaaaatttcaaaaaaaaaaaaaaacgaaattctcgaaatattgtagtttcttggtagaatgggaaatgatgataagctaatcaaccccacttttcagtggcaagcaatgtcacagacctaatggcaaaatatttatcttaaaaatttttaagttgtatttttttaaaagtttttttctgaatagtgttggacatttttagaacggatacttccatttttactccaattaaaattttgccgacaatttatctgatcaaaaagtttgaccaatgatcacattgatttgccgatcaatgaatgatcacatagtttttgcagattccatccgatcattttttggccttcttgaacttcttgacgttgagccctttctccttcagttttgcatctttttgtgccaccggagtcattgcacaacttccggcatggcccgaacaatacctaaaataatttataaatttatttaattaattttaaatatattttttaattgccaataccatcgtggcccataacggttgtagaatgacagttccattgcagcagctcctggctgcaattttgcgccacaaaagcaacagttgaagcagtttttgtggacttaaaaaatatgccaaatttaattgctttgaaattttgagtaattaatgattaattaattcaaataattatgataaattatgacttgtctcccggtcgaccatcaatcgatcagtcaatgtcactttttcaccacaaaatgcgcattcttcaagcaccggatcagcgccagttccgaattgcattttaaaaagtttttggtctaatttaataaaatatatttaaacaaaataattatttaatttaactaaatgatttgctttcatgcttctgatgaatgtggtaaaatttattgaagagaaaacatttgttttcccgaaacttctttgccgagaaaagcacacatgcgatggattatgtgtaatgggtgacacctgctgctgcaagcaaaaaaaaaataataaaaattattttgaaaaagatttttaaaaataatggaagtaaattttgatattttgaaccgcaaaatgacaaatttaaaacattgaatcgcaaatgtcaactttttaaaaaatctaaaaattgaaaaatatttggaatctcaaaatgccaactcaattttgaaaaataggaaatttgttctttctttaatgaaaattaaaattttgcattgttttattaattataaaaactcggatttaatttatcatcaaattacaatagccaaagtatattcataaatgaaagagaaccaactaaattctaggcaaagtccgatttcgaaaaatatagtatcatcactaccgtaaccaattttaaatattacagtctgggaatactgctgtttgtatgtacgtgacgtatctcatttcttcgcctttttgaacttcttcgtgttcatccctttctccttaagtttggcatctttttcagaaacgggcgtcaacgcacaaccgcccgccgaacccgagcagtacctggagatgaacagtataaatatgattgttagaaatgtgtttttcaaaatggaagttttaaaaaatgaaaaatatgaaatttatgtattctatttaaaatttcaacaaattttatgaaaaactcgaagacaaatattcaacattgaactttgctgactaaaatggaaaaaaaaccttttctaatacggtttttaaattattttccaaataaggaccaaataatcgtagatttagtagtcgatgatgaaattattcgtcaaaaattaataaaatccattttttaattaattttcgctcaaaatataccatcgtggaccataacggttgtagaacgacagttccatggccgcgtgaccgggctttaaatttgccccacaaaagcaacaagcaaagcaatttttatggactgataaaaatggaatgaaataaatatgtttttatttaaatatttataatatttaatatttttatataaatatttttttcaattaaaattattaattttaattttaattacttgtttctctgtcaaccatcagacgatcagttagcgaaattttctcaccacacatcgggggggtttttgatccatttcgccacccgtgccaaaacgga

SEQ ID NO: 11136 - DNA, 5307 bp, Heterodera glycines
  misc_feature (9)..(9): n is a, c, g, or t
acaaatttntgggtattggatgttggtgtattcaatttcccttctatcgtttataatcaaatgtatttagccttttctcgacagtgcagttcaagtattatgataccgtatctcaaactcatagggtccaagtatttttgcatttgttataataccataccagcgtcgatgtccaatggtaattcgagcagatgtccagcggtgttcaccaccaaaacgatggagaaaatggcgaccatgatcagcgaaaagtgccgtttgaccgttgacagaggccatttcgcgcaaatacaacgctcaatggcgagtagaaaaacggtggacgggatcgtaccgtaatagactagttcaggcatcgataaccaatagagagtcttgggatgaaattttataggtatatcattttgattttttgtttcaaaatgaaaaaataataattttgcattaattccatatatataataaatttaaatcaattcagcaaaaaagaaaattattttgttaacattttttttcgtttctctacttgggtcatagaaggaggattaattaaaataatgtcatcggtaataaggttagatttttttgcactgaatttaaacaaaaatgaaatgccatattttggaaatttagcacaatttcattttcattgaaattcgtccgagtttttccacattctgaaaattttacgcttttcaaaatattataatccagaaattttccactgtgacgtcactttggcgcaaacggatgtaaaattaactatcctaattttcgaaataggtattaaacttctgaatttttgggcttttgatatagacaatataatccctccctttcctacttaattatttttttttctttgcttttacatatggtgaaaagttgttctgcgtgaaggtgccgggtgttcgccattggatcactctgtaaatttggtacggcgtggagagtatcgaaaaaacgaagtgcgcatagagaaacaacatcagggttggtgccaaattctgaatgcgcagcaactgaggtagacagtgaagaagctacaaatgatcaaaatcatttaatatttttatattaaaccattaatcgagtctatgattttgtgcctgataaaaaagacttgatcacaactcgtcggattttttcgaatcatatctttggcgttcgataatttgatcggatttataatgtttgagactgaaatagtacataatatttgtcacaaattccctgaatagacaaagtttgtcttgcttattgattttgatctgaatatattaatctgatctggagtttgatcaggttgtgaacaaactgaagggttggaataatgttgacccgacccaattatgtcttaatcggttttaagtaaaattggctcaccaaaaccaggaaacccatggtcaatgcggtaatgccgtgcgaaatcagcgcaatccaattcaggcacaactccaagtagggcaaatagtcgggcaattgcagaacgggcgagttcagtacggtctgaggatctgttgctattgtgctgttatccatcttgaaattttacgctataaaatgtaattaacccactaaaagcaacgtaatgattatgaaaaaaggcaggagtccgtacgtttttttgtgaatctctattttcgaaaaattaatttaaaaaatttacattttttcatatgaataatgaatgattaattcgcaaaaatgcacatagcagaaaggtggatttcgaaaatttataaaagtagaagcaccgcaaaactcatgtcaaacaaaacctcataaaatctgttaaatacagtcaggtgcacttctgaccaattgttgaacaacaattaagcgcttttataaaatggagttaaaatgaaattatagcttaattgtttatgaagcgggaaaactggacggaaaattaatttaatttgctttacgctttagctaatggaaatgtccttataaaatttgattaaaaatatttgttaatatttgcgcattgggccaaatcaaagtttaatcagtataaataaaaaattgtcaacaatggccattgaccactgaaatgaaagttttttaatttaaacaagctgatattgtaaaacaaataaagaaatttagaaaaaaaattaaatatgattttggtgaataaataatttgcagcaatgttaagaaaacttaatttacgtattgtatatgaaatatttgcaggaatgtcattcaattttaaatctgctgaagttcatgaaagtttgtaaaatgggaaaaaggcattcatgtaattttttttaaattatacttttttaaaagatttaatttaatataattcttttgttttaatattaaaaaatgatttttttttataaaaatggagaattatgtacaaaaaaaaattttaaataataatcaaaaatgaaaaattgctgattaaagtaagaatatttatgttttattctatgtatgaatataaaaaaataataataacatctactgaacaaacaatagcaataaaagaaattttaattaaattaaaattatttttttccactaattaatgaactaaaaaatttttggcttttgtccgtgccaataaaataatatattttttcctgattgtgcttacatcgtctatcatggttaaaaaattcagaaaaaaattataaaaccctcgatagaatttttgcaagatcaaaaaagaggcaacgattgaatttattaaaccttttttgtaaattcatttatttccattttgtaatttttctcgattttctaaaaatgctcatttgtcatcgattattttgtcaatcatttttggattttgtcgttttgtttttcaattcacttttttcaatttttctgttttaatcattttttacggcttaaatcaattgtttcttccatttcgaaattttattttttgatttgatgagaaaaaataaagggatttttgttttttaggattaattccaaaaacaaaatcagatatagccaatatgaaattctacactgatccatatattttcaaacgtgtccttatttttatttcatgtttgtcctgggaataggaattttagagcattttttaaaattattgtttttgttgtaaattaatgtatatatatttttaaatttgtcctgttttggagaaaattatcaaaggcatttattatataaaagatttatttaaatatgataatattaaattaagttatgcttttaataaatatactcccgtattccctctaaatgagccgctcatccaaaataattttgaattcgcgtgtacaattagttatacggtatgtaggcatatatggcaaaaaacaaagttcatatgcatattgatacggtatgctgatcacatccaacgattggcattttctacgatatctgcgttagcatcgctgatcactctccgatcagcaccctctaccggcccatgcttcttcaaagctttgatgtccttcgtttgaaattgccgttccaattcctccaatgttttgcgtctcgtctccggcataaaatggaaaacgaaaagcatcgcgcagcatccgatcacggcaaacgcgtaaaaggtggcggtcatgccaacccaactgatcagaatgggaaagccgaacgtgagcagacagttgaccttgggacaaaaagtaacacaaatattctatgacacagtatcatcagataataaaaataattaattaaatttttttaaaattttttttagggttcttctccgacttaatttggggaatttcgaatgttgtcagttgcacgcccaaagagtatgaaagtttctttaaatgagttttgaagacttatttcttttagaaaagttctgttatatttttggctttttataaaaatttgctcccttatgaggtggttgctccccgacatttttttaatttctcagccatccccgacaaatttgtcgtgaattttcttcctgatctacgggttcggacaaacctcagtttaaatgagtttatttgaatcatgagaaataattttagttataaatttcataaaaattatttttgctttttaaatattatggaattaatttaaaattagttaaaaacataaaatttgaaaaaaaactcattatatttatttaaattaatgaattttttaaaatcatttaatataagtaacatcaatatattgatttttaaaaggtcttttaaaattacttaaaaaattattgatataaaagtttcagaccagccaaagtatggaggtggacaagcccatggcgagcccgcgaatgcgcaacggaaacatttcggattgcatcagccaagtgattggggaaatgccgcactgttggaacaggaggaaagtgacggtgagagaaaggaccacaaaagccctgggaaatggaaatttttttttcaattcgttcatcaattttaatgaatggaaaacaaaatcgtacagaaaaattattatttaaaatataaataaaattttgccttgccattcccttggccattaacaatgagcaggtgccaatcgccaaatgtgccaaaacagtgccaatttggccagataacagcattggacgacgcccaatttttccaatcaacataatgccaagcccagtcgccaacaccgaaattgcctagagaggatttttttaaaagaaaaaactaacaatattttttttgatgaaatgatagaaaaaacgagtgaaaagatttaaaaaatatcattcattttgatttttcaaaaaaagataaaaataaatttctaaattttttgattatttttcagaaaaaattgcaatcttgttttaaaaatatggtgtacaattttgcgaaatacaacgaaattgattaaattcttattaaattaaatttaaaaaataatttaattaacaattttttattaatttgaattatgaattttactccattagcaatgttggcagtcagtgccacatttgtcatcagtccttgctcaattagaatgttggtgccgtagtacatgatggagttgaccccggccagctgattgcacattgccacaccgatgccaatgaacagacagcggcgaagccacggttcacgcatcacatcccttcattgataggggtaattatgattaattccaacaaaattagtaagaatatttttattatggtagtataataaagaatactgtaacaatccaatggtgcggtacataaatgtgtatgttagagtgttacaaaatagggttggggttcaactggcgtcgggggcaggcacgtagccaaggggaaaggggacagaattccctaaattccccacctcccccgcaaaa

SEQ ID NO: 11137 - DNA, 3313 bp, Heterodera glycines
cgccctgttgtgcctgtccgctccgctgtgcccatttgtcctgccgtgcctgccgctctgcccgtttgtcctgccgtgcttgttcgtcctgttgtgcccgtttgacttgttcgtcctgttgtgcccgtttgacttgcttgtccttcactgtgctgcctgtttggtctgcacctgttcgttcaactgtgctgcctgttcggtctgcacctgtgccacgtcaaaatcgccgctccccaactgctcgtcatccggaagtataagggtcaccaagcccatacaaaatcaagggttgacaaacccaattaaaaaaaacaaacacacacacacacacggatcgccaaacccaatcaaaaaaaccgaaaaaggacaccataaaaagccaaacataattaaaagtcataataaaccctacaacaaacccatcactaatttaaataattaagtggacagagcgactcctaattcaattactccgacgaccaaagccaacacgaaaaagaaacaagtggcgaaaagcactacactgactgaacttataaaattaaaaacacaaacggaatacaaattaacaaaacttcgcccgaaacatacagagaatatactgaaagaattttacaaaaaaaaggagcaaataattaacaaaaacaaaaaaattctgtgattatatatattttttttaaatttcgtaacaattgttaattctgtgatcattaaaattataataatatttattaacttgtgataaatacctaattaaaattctcatttttctgattatccactaaataaccataaaaggatacttagttaattattttaaaatacaaactatgtccggtacgcttcgtagcaaaatacccctccttaatcgcgtattaaaaagggaaatagaaacgatcaaaacaaaaattgaggaaaacaaattcgaatatgatcaaaataatcccggagaatgcatgcggatattcaataaaacaaaggaaattatccaaaaaatagagccaaattttgaaaaattaaaagccttaaataaaaggtggcaaaatttaatgagaaaaatgaacaaggaagaatggaataatgaatggaaagttcaaaaaatctttcgtgaaaaacacgactaccttaaaaccattaaagaaatagatgaaattctcgatacattaaaagacgtaaatttggaggtaaaaaggagattaaaattacttaaagcaaaatcatcttcagactcagacctggaagatgaatcaaatgattatgaacatgaaaatgaagacgaagtagaagaacaagaagaagaaaaagaatatgaaagtgacaatgaagacgaatcgccagaactctccttgaatgaccaaatacaccatgatcgtacaccatttgtcaattaccgatcaagaataaagcttccaccccaaacgcttacgcattttaatggcaaattctcccaatggcccagtttctgggatgatttcaaatcctcagtggacaatgacccaaatttagaaaatatacaaaaactcaaataccttcgagggctcttacatgatgaaccgtacagaatagtgtcaccgtatcctcttacgaataaaaattacactatcgtaataaaattactaaaatcaaggtacggaaacccccaattaatcagagaaaatcttcatagcgaattacgcaacctcaaaagacccactgaatccacaattgaattaagacgatttattttgttaattgaccgaatcattttacaaatgaaatcccaaggggaagacataaatcaccctcaaatcaaacaatcaatcgaaacgaaactcccctataacattagacttaaattgaaggaaaaattcaaaatctattcaacaaaagaaataatggaatttttgaatgatcatacccaagcacgtgaagacatagaaagaatggaagaatcgaatcgccaaatccggaatttcccctctaatagaccaccccaaaacggagtacagagacaattctatccaaatttcccacacaatcaaatgaaaccaaacccacggaatcaacagaacacatcttcctctccttttccatatacttctgcatttacaacgaaatcaaacccagtacgcctggcacagtttaaatcaaatccaacacaaactagaacacaaaataaaatattttgtcgcttttgcgaaagagaaaaccatgcaagtaaagaatgcaaaatttattcaactcccgaaaaacgaaatgaacgtgtacgtgaactcaaactttgcctaaattgtctaaacaagggacatatggtcaatgattgcaaatccacttatttatgttttaattgcaaatacaaacataatactctcctttgtacccgcaaacaaactcagtacaaaccgaaagagcaaaaaaccagagtgaatatggctaaaaattacgaaaatcatgaagagacacaaacattcatgacaatggattatgataaaaatttatctaattatgaggaagaagaattacttatgactgctgaagtaaactgcataaatcccgacaaacataaagtaaaaaaggaaataattttatttgataatgggtcacaaaagagctatataaccgaagaatgtgcccaatctcttcaattaactacgattgaggaaaaattattagtaatttccactttcaatcaaaataagccaaaaatcattaaatcgagactagtcaaagttggcattaaaacattaaaaggtgaagtggagtacataatactacaaacagtggaaaaaattactgatgttacaaaaatggttaataaagaaaatgttgatgtactcggagtaaaaatcccaatcagtcacgcatctcctcaaattctaattggaatcgaccattattggcatttcatgttaccaaattcacaaattcaattacttccatcaggattttactcgataaatacaaaattaggaaaaatattatcaggaaaaggaactattgaggacacaaattgtaactcagtgaccgaaaaaagaaaaaaggatgaaacaaaccaaatacttcagaaattttgggaattagaaaacattggaattatcgactcaccacatatgacggatgaagatgcagcaatgatacactttgataaaaatgttacatttaaaaataatagataccatgttcgatggccttataaaagagagaacccgaatttactaacaaattttggattatgcatgggaagactaagaaatgttgttaaacaactaattaaaaacaaacaattggacaaaaaagacagaatatgcaagaacaaatggatactgatgtaaat

SEQ ID NO: 11138 - DNA, 1107 bp, Heterodera glycines
agcaacattggggcatggatctgttggacattcactcacatccagcagcatctttcaaagccaagctaagccccccgggcaattcgacgacgcttttcccgttcaaatccgtcaaaatatcctcgaatcgttcggtggtgaaggtgtcgtccagccgcgccaaccgtttgtagtctgtcggcgtgatcttctcgaacagttcgctctcttcgccctcctccaatttggccaaaaccgttttcacccttcgcttcgcgttgtcctggtcctcctccgcactgctcgtctctttgtcatatccctccgaccataattctgctcgtttgagttgtccgatcacagatcagaatgccctctcctggcaactcactctttttggccctcaatgtgattttgggcagttcggtcaatgtccgcacccgtgggctgtccactccgcctttgatcgtgctcagccgtctccgcgccgcttcgtccgccccgtctattccgcgttcgttcgccgccattcccaaaatttgcttggagtcgctgctgctcagcacttccctaagtgcgttaaatgctccgagttcggcttggccaagtcccaatttggccgcgtcttttgcccatccgtccaatgtgtccatgtcttaaaaagaatggcaaattaagcggatgaacggtattttttcatgccgatttccattcattcacctgaaacggcgtcaatttggcacacgaaaaaggacacaaaaagcaaatgaaaaaatgccaaaaatgggaccaaatttggcaccagacattgacttattgacataaaatgcttaaatgcccgtgaaagagtcaatgaattgagaacatttgaacaatttaatttcattccgtttttataccgctgcaaataacgaaacaaataaatgaataataaaaaatgcaaaaacaataaaattggattttttggatttatttataaatgttaactgaaagtgtttgatcagtcatttcattattttctgcggaaaatgcaaaagcagaaattgtagccataaataaaacaatgagacaaacttagccataagaatttttaatcagcaagtttttatttattttttaattttttcc

SEQ ID NO: 11139 - DNA, 1638 bp, Heterodera glycines
gtcattagtgcaaaatgcgctttttagaatgtgcagcacatgttcaaccatatgaacaaggcgaaggcgcaattattcgtcgccgaagggatcgtcgacgtcgtcgcggaaacggtcagcggcgattcaaatatgctttttggatacttataacaattaagtccgaatatgttgccaactcggtcattttgttgtgccaacgccacggactcttttcggatgtgactttgccaacaattaatcaacggagagacgtggaaagtgccacatcgccataggataaacgttgtgctgaagaaagcgaaaaagccatcgtgggtcggattatccagtctctgatttgatttttaaagcttacaatcgaataaatataatattttgtattttaacatgctaatacattactttcgaaaatattttagttttttaaaaataattagactttgtcctatccctctaatgtcattgggcggtccgttcccgatcactatttaagcttgtagcgttccctcaattgttcatcccctggttcattttattccaccggtctacaattgtgcagagaacagtcgacagttgttccccctttccccttccgaataaaggattttatttgaattacccctacacagtgttttgggggatgcattaacaccaaaccatcccaatcatattttattcaatattcaggaataagaaatgatgcaaattacaattatgatttggtatttagcgttgaaaaaataataattttcggtgtttaatgagttaaaaccaattaaaagggagaccaccgaagtggccattcccatcattcctgggcagtttaaatggccgttaattcgccaattgcctcgccccctttttcactcgtccgttttctcattgatctgttgccgtccgtctcttccgctccgccgccgcctcggggaaacactcatcgattttcgcgtacaattccacccgatatttgccgctgttatgctcaaagtccgtctccgctctttccgcgtgttctctccgcatgtgccgaagcatattggcacggctgaacttgtgctcgaccttccagcagtatttgcacgagaaaatgggcaatttcaaatgactaaaagaaaatgaacggaacaaaagaggaaaagcattaaggaaggacgacgcactgcaaattgacgtgcaatttgaggctagaatgctcattagtgacgccggcaccgcagcgagtgcaactgatcagccgggcgacgctcttccgattggaccatattcgatgacccaacttggtggaaattgcattcatttgaccaaacaggtcaaggggagtacgttttcgatcccccattaaaaaattgttcgtcccttaatcggaatccctcccccatctcatcccatccgtttacatccacaaaattgtttccgattggcgttgtgttgtcgtccgtttcatttggcccattttctcgcacaacatttgttgttgacatcacttctccgtcaagtggccaagtcaaattagcgtgaaattctgacgggccgacgaaccacgaagaatggcccggctggtgggccaagtcgatttgcttttggtgcgaaatgtggcatatgtcgtcgtctattttgaccatctcccgcataaat

SEQ ID NO: 11140 - DNA, 1816 bp, Heterodera glycines
ggctgcaggtccgtgccatttccatcggtcgttcttcgcttctgccggtggtgccaatttgtgccgattgcccctcggcctctcccattacgctattactttcgtcggcactttctaacaattcgatcacttcaattttatgctttcgttttgccagcgatgtcgacgaagtgaccgctggactttctccgggatttctgtcaccattttgtccatcttcaaattaatgcttaattagcgcctaatgcactttaatcccagccccgttcgcattaatcaccgttcgtttgtattttaatcactaattcagaattgcttcccgcgctttttcttttaaaatatttcaccatatcggcaaaatccaaatcgcaagtgatcagaattttgtcgccttccgcgtcttaaacatttggtcagacaattgtttaatttgacaatttcgaggattattccacaatcggcaaaatcccaccagtgtagcacagtccgccttggaatgttgcgattctgcttctgatagccccaacaagcgcagcatacgttggctcctctaattcaaagcgccgaaatccatcgcaatggagccatttgatttggatgggagccattgccaatcggaaaatcgaatttcgaggaaattaacgaagatcaaaaataggtataattgccaaaaaacaataaaatgcatacggagaaaccattactattgcaaatttattattagataaatcaaaggatttctttatacatgagattgtgaattaagtgtatattaaaggttgtgattcgtggttttaaatccaaggggtgtggggggtaaatacgaaaatttcttacaaaatttcggagatttgccaggtaagcccccccccccccccttatgttgattaaaaccattgccacgaaaggaaaaaatggaattagaatagttggataagaaatgaagaatcatctgtcacattatcaatatcatcatcaattttatgtttgtttcatcctccttagcttttggttcaacagaaatcaaaattgttggctctgaaaaatgacaatttgttccattccactaaattcccattcatttaccacttcggcatttcgcatcgggaaacattcggccaatttgtgatggattttccttgaaaatgccgggtaattgtagtcgaactcttcgctgctcctccccgggtggtccctctcaatatgccgtacaatcgacgctttttgcagctgtgggctcatttggccacacagccgacaattgtaaatgggcaacttcaggtggtgcaaattcacatgggacttcagactcgtgctggcgttggccacgagcattccgcaatccgagcacggaatgaccgcacttcggaggggacgtctcttgcgcggattgtgagtctggcaaaagcaaagaataaatagacgaggtgaattggacataaaataacggagtctaccgctgccgaacgccgcacgatggttggaggcaattagcaatacaattttagacaccgaattccgtcatggaaattttggtaatatttttttgtgaaagaatcaaaataatacatttttatatatgactcattttcaataattataaaatcagtaatttaaagaaatcccaatagaaattgtctcaacaaaacctacatacatggaaaagggggggggtcaaccaaaatttttgcgaaggggtctgggatagtgatgttcgagactctcgatctcgagaaaagtctcgggtttttttggtctcggtctcgagttttcagtctcggtcattgagactttcgagaccgagacttttttacac

SEQ ID NO: 11141 - DNA, 3462 bp, Heterodera glycines
ctgcttcaacttctgctgctgctctcccgttggctggtgctgtcgctgctgctggagaccatcgccacaacaatttgtgtgtgattttggagaaaacgcgctcaaaactggacaccaccgtggagtgtgttgcggaactgtggcgcaccacggatggcacggcacaggaagtaggacaaaaaacaaaaaaaaaacaaatgccgacagttgatggcttacaattagcaatgttgttatatgatttttgtgtccggacccctgctaaaatcggggatatctgcggccgagttttaagggccatttccaattactaacggcaaaaaaatttgggacttgacatttcgaatttaatcaattttcgtcatagttttgttgacgtgtctagacaaatacaatgaataaaagattaaaattgtaagcacgtaaatcgaccattttataaaggcttttattatttttttaaaatttttttttgatgagtttaagccgatttttattttcttgcagtttcatctttacgagcccgtccacaggcacttgccgtgtccggcacgaaatgaccaatttgtggccaaagcggaactgttggccagaatacgaaggtacatatattctttgttttttttattccggagagatttcgaaaagaatttggaatttggaattttaattttttttttttttttaattttcagcgcggacgaattggcacaaaatcgaatggcacgggcggcgtacgacacgctgtgcagcttctacaaactggcggagagcaagatcaaccaggcctatgttgaggaggtgggtcgaccgagagccgggttaccctaaagcgcagatgccggtccgggccgtagtttgaaaaaacataccctccacccctcggatttttttttgagcgattgaaaaaaatttttgacaaaaacttagtattcctcataaacatgaaaaaatcgttaattttttaaatttcttatataaactactaaagatttttgtttaaaaaataaaagttataaaatttaaaaaaaaaaaatttttccgaggtgaaatgatgcggaaggaggtgggagaactatttttctactggaaaaaactaagaaaatttaaaattgaaattcaattttttttttaaattccggaggtgtggggaaatacggcaaatctttgttcatgaaatatttctttgtatttgtatcggcacagattgtcgacgagcgcaagtggcgcttggaattgcgctggaacggcttcatcaacgtgtacgaggggccgcgcacggcgcgcgagttggagctgaagcttgtggccaggcaaaagacggagaggggcccattcgacgaggtcaaaggggccgacccgttgagcagaggtaacggcagaaagtgcaaatttaaaattcggaaatcctttttctctcgtcgcacacactatctttttcttactctcttaatctcaactcctctctctgtctccttcacttactctctctctctctctatttctctttgtctccgctcctctcgcttactctctcactcactttctctgtctctctctccatctctaacactctctctctctttctctctcgcactctctctccccttctctctctaccgcacgctttatttccgctcccctctctctctctcgctccctctctttttactcttcgtccattttgtcctaatcgtctctaatattttatccgttttttcagcggatcggtcccgtttggatgaacttgcctctttgttgcgtacggaagtgaacaaatcggtgagttccgctgccgaccgatcaataaataattaatttactaattaactcttttatttgctaatatgccgtctgttgtcacaggtgtggcgtcgtcgtcagttcgattccgacttggccggcggtgcgggcggcggcggtcatcagcagcagccgcgcaatctccgctgtaccatttacacgcgcggctacacatagcgtggtcgtggacgtggcacggcactggtgtgccgctccgcatcatcattctgcacaaagcccaaaaaaaaaaataggaaaatttaaatcccacaccatctgattcaatatttcatttcattttacctctcaccttttttggcacattacccaaaagtacatttgcttttttttcatttcttgattgatcatttgttcaataaagtttgatctcgtggctgccatcacaggatttttatctcgatgatattggtctcgcattggactgacccggctttctggtcagggttcggcaccaaatcccgatcccgtttacctttttaaaaatttgatcgacacacggcatgggatcccgacgtggctgacccctggctttttcgagcccggttttaccccgaaaaccctatccccatgcaaccctaaaatatattagccgttgtttctggattcatattttcaatcaaattacaatcattaagcacattttgccaaccttcttttatagttacaaagatagcaaaaaatggtaataataacaataaaagaaattgaattaagacagaaaattaaataattatatgttaaatgagttcatcaaaaaatgagtgtgttgttttttgtgtgtgtggcgcctctgatcatccgatcattgattgctgttattttgccacgatcgcttctcattgcgcggattgtccctttggcggtagaatgccgggctgctgcggtgcgcccttctgcaattttaattttgtgacgcattggcattatttttttttttggcaaattcggccaatcctcggggggggggggtccaattttgtgatggcattttaaattatgaaaaattcaaaaaaattagcggtacagcaataccagaaatggtgccctaggatgtcagttatcaaaaactgcaaaaatctatgattttgtcgggagctgagatttttttaaatatttttttccaacatattttttcggtggggggggggggaaattgaaaaaaaaattcaaaagggttttcgaggttgctgatcacgaaaacagcatccatttcaaccaattctgtacccctgacccaaattcgaacccaaaagttcaaaattttcgaatttcgagtcaccattgtactactaaaactccaccttgttcatcaggtagcgatggatgtgcgggatcactccgccgccagcaatggtcgccttgatcagggagtcaagctgaaaagggggaagagagacaaatttaaatttgtataaagagactcatttgtcagataaatgtacccaccgtttagtttcgtttttacccgaaaatttaaaacaaaaaattcagacatatataaattcttttcgaaggaaatttcgagtaaattgtaaaattttccaacgattttctagaaatttcattaagaattactaaattttttccaaaaatttctggaatttttttttttttttttgtaattcttattggtagaaa

SEQ ID NO: 11142 - DNA, 1189 bp, Heterodera glycines
  misc_feature (158)..(158): n is a, c, g, or t
ttcaatcatggcactgccgtgccgtgcacagcaaaattttgcccgaggcaatcaagcatcaggagagagcaatccttgcctgccagtgtgtacaccgacctcatggcatcatggaaatggcttcgtcaattttgctgttgggggcaccaaaaaattcncagggggtcccttttgtagccatatgtgacaaatcaatttttttttttgcatataaaagggtcccccctttggcattttttcgtgggcccccaacagcaaaagtgccaaggcgattcaggaattttttccggccccaatgccgggatggcgcaccctctcgctcacctcctcgtcgccacggatggccaagtgcaggtgccgcggtgtcacccgcttcactttgaggtccttggacgcgttgccggccagctccaacacctcggccgtcagatactccagaatggctgcgctgtacacggcggcggtggcgcctattttttttttaaaattttttttcaccgaaaattcgccaaacattaccgactcgtccggtgcttgttgtgcgtttcttcaagaagcgatggatgcgtcccaccgggaattggaggccagccctggcactgcgagagatgattttctgcaaaaaaaaaaaaaaaattatgcgaacatttttgaaaagtttttttggcgcgctttaaaatttttacccatcacaaccttagactttgcttttccgctgtccttgcccgcttttcctttgccaccagccattgggaattttagaaaatgtagagtaattaggctaaattaaaaaaaaaaatttttgcaggcccaagccaaaaaattgatttttataaaacaaaatttcaaaattttggcgcgctcccacaacaaatattcatacgccatataaatgaaaatgatgcaagaaatgaatgggggagaggaagggagaagggaggcgcaggcagcacacataataatgccacaaaaataagcgtcttttcctccctgtctctgccccctctcccccttttccgttgtctcttcggcagagagaaagaaggggatttattgatggggagcaggcagagagaaatgctctatgtttgccaaactattttttggtagagaaatgggagcatttggcgggcaaggcaagcgcagagaaaaatggaaaaataagagagggaatagggatagaacaata

SEQ ID NO: 11143 - DNA, 3978 bp, Heterodera glycines
  misc_feature (305)..(305): n is a, c, g, or t
cttttcagagaattcggagttttcgtgaaagcagtgaagatgggtgtgcaagcttttgaccgttcctttggtgagcttgaattcatatttcggcttttcatttgattggcactcgagacaaattgctgtagtcttggacgtttttttaaataggccaatttgccaaataagactcatttgcataaaatctaaacaaaaaagacattatttaataattataaagaagcaaacattagaattaaaaaattcaacttgaaactacaatgtacgagtactttgattatcgatttttttcaatccatatnttcggaccccccccccccccgccccatacctattggatgatctttgatcccttcagccgaaacctattggatggacttgtgcgcgagaatttaattaatttaaattaatttaaatttaaattaattaatttaaatgcgcgagagctgcgcggactttttctgataaattgtggaaaatcaaaaacatggtcgcggtctcgaaccgttgagagtggaagcgaggagcttaaccacttggccacaggggcagttgaaaggtatgggataattgttgactttatgatgaaaattccgaaaaattgtgaaaaatcaaaaacatggtagtggactcgaaccgttgagagtggaagcgaggaacttaaccacttggccacagggtgagttgaaaggaatgggataattgttgactaaatggtgaaaaattttccctttgcttcaccacaagcgctgcggaggcggacgtgtggcggcgagagactaaactttttttttaataacaggaattaagttttattataaacaataatttattatttttaaacagttaaataattaaaaatttgtctttaacaaaaagtttccaataacaattaaaattataccaaattcttataagaaaaaaataatgcataaaaaaaagtaagttacactactttgattgaaaaaatattggtggttgtctttgaatatttttcatttcttcaatcatggtttccgcttcgcttggggatatatgacctctcctcttgaggaatttaattaattgtaagcacactattccaccggacacataccatctgaatgacattagaaataaataaaattaagtgtattgtaattaactttaacctgcaaaaggtgtgagagggggcatcgagtaatttttgaatttttttcaattcgctgaaggctgtgttactatgtttgaaacgtccaacaatatgacgacttttggccaataaactgctgattgattcatcctttttcaatgcctcctgtacagccaaattcaataaatgagcagcgcaaggcccgtttggcatcggcaaaattcgattttcattttcatccctctcaacaaatgcctgcaaataagagcaagtgtaaagaaaattaattagattatcactcttttcatattggctgctgaatccgagataattgcatgcacacgttccttaggaataccccatttgagcaataaatcctcaattttgagcgcaatatttttccctgtgtgtgattcagaaaattccgtaattgccaaaacacgtgacatagacttccatttagaaattgagtgcgcggttaggctgcagtaaaacccatgatgattaataaacaaagtaataatgtaccacagaaggttgcaagtgcttccgctccaacaatcagttgtcagtgtaataaatgcttattcttttaattcatctttgattttatgtctgacacgttggtaaacaattggcaaggcagtttttctgaaaatttcaaaaatgtaattttctcataacttttaatgtaactcatcacctatagaaactttcacttttcactttttgatggggaaataaagaatgaaaagtttggtgatccacagcgccgaaggaaatgttttttgtcaccaaaaaatgaagaattttcttatcaaacgaggagagttgtgctgaaacaaaaattaaataatttaaaaaaatttggctgaattacagtccgaaaaagtcggtccgcaggacgactgaaagtctgagattggcttctgtttttgtttctccttttcagctttcgattcaagagcattcagcttttcagagaattcggagttttcgtgaaagcagtgaagatgggtgtgcaagcttttgaccgttcctttggtgagcttgaattcatatttcggcttttcatttgattggcactcgagacaaattgctgtagtcttggacgtttttttaaataggccaatttgccaaataagactcatttgcataaaatctaaacaaaaaagacattatttaataattataaagaagcaaacattagaattaaaaaattcaacttgaaactacaatgtacgagtactttgattatcgatttttttcaattttatccatattttcggacccccccccccgccccatacctattggatgatctttgatcccttcagccgaaacctattggatggacttgtgcgcgagaatttaattaatttaaattaatttaaatttaaattaattaatttaaatgcgcgagagctgcgcggactttttctgataaattgtggaaaatcaaaaacatggtcgcggtctcgaaccgttgagagtggaagcgaggagcttaaccacttggccacaggggcagttgaaaggtatgggataattgttgactttatgatgaaaattccgaaaaattgtgaaaaatcaaaaacatggtagtggactcgaaccgttgagagtggaagcgaggaacttaaccacttggccacagggtgagttgaaaggaatgggataattgttgactaaatggtgaaaaattttccctttgcttcaccacaagcgctgcggaggcggacgtgtggcggcgagagactaaactttttttttaataacaggaattaagttttattataaacaataatttattatttttaaacagttaaataattaaaaatttgtctttaacaaaaagtttccaataacaattaaaattataccaaattcttataagaaaaaaataatgcataaaaaaagtaagttacactactttgattgaaaaaatattggtggttgtctttgaatatttttcatttcttcaatcatggtttccgcttcgcttggggatatatgacctctcctcttgaggaatttaattattatgaaccaacagagtagaaaaacagggaaggcaaatgcataatgtgaaaggagcaaaagatgaaaaagagtgtcattagtctcatctgatgaacgtaacacctcaattccttctttcgtcgtgttattcattttttctctaatataattttgagctttatttataaatttacccaagctttgagtcggagacaatgtgtcgattataatcaatcataatcatttggtcaaattctccgagaacaatcatttccactcctccctttggaattggtgaatcaaatgtggccctaatactggttgtaccgcttctcaacagctcaaatccacagctatcgtctaaggttgaattcaaagagatgacaaaaaaggcccatccatttttgaattgatccattgaaacgtcaaatgaacgttctgaattagccatgcccaacgcttcatacatctccacgaatgctcttacatagtaattctttgaaaaatttaatttatgtggtacaacgggatagaccatgcccccagcatgtactgaaatttctcgcaaatcaaatggatcaaacttgaagggcgtcaatttgtaatcaccattaaaagccgagttactgaccaacgctattgttacacgacgaggtattgtcgagctgaacacgttgtattcaaattcgtagcgcccactgctaatgtatgaagatttgatttcggttttacgaacagcataagtagccggctgcttttctagtgtcttgtaaagattcatgttgagtgagggctgaacctcaatcatttttgcgtaaatt

SEQ ID NO: 11144 - DNA, 953 bp, Heterodera glycines
gaaatagtgctctgtctgactgtctggctacgcttttgaaaaatttgcccaaaatataggacccaaacccaaagagtaccgtaacatgatcggaagatttaaattttatttgcaaaataataaaccatatttgcgctaaaactcagtcaaattaataaaacttggtattgagctaaagctttacgtgtcctcttcatcttttgtaattaaaacctagcaatttttttcacaaaatgtaaccaaagagtttcaaaaaatttataatcaataatgctacttttttgaaactcaatattttttttttgattttgaacagaataatagagaaatctttgagttatctaattatatgagtggtataacttatttaaatcgcaacgattttcacaatttaaaagaccttacattttatatgaccataaaaatataattgtgctcgttgttgtttgagttgctgttggagttccgttgttgttttccccgtcggttgttgtcgcaggagacggcttttgctggcgatgtttgaaagagtcgaaaaagttgaccaattgggacactttggagacgaacgctctgcaaaaaaattctatcaattagcatttttcaatcccttttaaataaggaaatttttgaaaatccgggctatttacaaataaatttaataaaaaattatatttcccaggatggcaccatacataaaaaagggggggggggggtgggtcggaaaaattttttgcgaagtggggtcggccgcccgatgactttttttttttgcttttcaaaaaaccgtttttttcggcgcgcttttttcaaaaaaatttcgggaacaggaggtccggcggtgccgataggcgccgccgtgaaaattttgaaatttagtttccaatttgtaacagattttgtctaaaaaacaccaaattttgagattttaagcccattgttgttaaaaaaaa

SEQ ID NO: 11145 - DNA, 1984 bp, Heterodera glycines
tgtgaaacagcagcggctgacctgaccacgtcgttgaccatcaaatgcaggaccggtgaccagaccaactctaccggttgctgcagctgaacttggagatggagttggcgcggcacgggcctggacaaatgaatggacaccgagtcgagcacaccgcactgaaaaaatttatatttcctttatggtccgtaattactttttttgagttttttgctttttgtccatcatatttaccaacccaatcacatataacaagaggggtattaaaaataaactttttgcaaaaaaaaaaatttttttttttaaattttgagctttttagctatgaaaaaacataatggccccactcgattcaattaaaaaatcgctaactttttcaggatgatgaccataacaaatgtcctttttattgctgccgttttcttcgtctgtcaactaaacaattgaaaaaaattttggggtataaacaagctcttgtttcacacaccggtttgccaacacgaattgtgccgacggacacacggacgttcagtgccatgcgctgaccactaccgcctccgccgtcgttgtccaccaccaattgaacagcgaatggacgcgcaactcgcgcacctccaagtgcagtccgttggccagcaacagctcaccatggcgcaacgcgaaccagccgaggccgtcaatgtgcgcagcgcgggcgtgtaacagtcgctgcaacaccgccgccaccagacgcccggaatatctgacaaagaggaggggatttgacatgccaaagacgatggctatgggataaaaacgaaaataaaaatagggtccagtaccagatacgctgactacttcaagaaagttgatttagggattttatggctggaatataattctaaaaaccctttcccaacacattggaacaatagaatcttttgttttatgaatttcaatttcatattgatgcgacaaaacggcttttgtcagaagaaaaaaacccttttcaaaaaaggaggccaacaaattaccttctgaataaatggacgagcataacaagcagtacaagaaggatgttgaaatataagctcatgacagacaaaaagcgaaggaatgtatgtacaaaaaaacctaacttttcggtcagaatcaaaatattatgggttaagcccagcgctgacccacgaaatgtccaagtctcgaatttgagttttttattattcagctaaattagactcattttgtttttataaattttgaaaaattttggacatttcgtgggtttttactcttttggacatttcgtggcttggacactttgtgggggtgccaagcccagtgttagacaaaattgttcataatgccaaatatgataattggcgtaattttttgcgcgttaattcaaaatttacactgatcattgccatttttgtattgtttattttgatcagcaataactttcttcatctccaattaaactgcacaaaataggtatataaaaattgtttttaatgaattgtggacggcaattgtgagaccagttcgaccgcttggcttaatgcatgtgaaaacaatttatgcggaaacatacgatcacatcgatcgcaacagtgaccgcgacacgggagagaatcttatttaaaatcaaataatttgaattttttggaaattaatcattcgtcttttcaaaaaaactttaattataacataattaattacaacaagacagtagtactgaattgcagatttattggttccattttttcatggtttatcatttagtatatgtatatgtttaaattgtatgcaaatttatgtatttctcatgcatttaaagaaagtcgtttcacatttcatttttaacttacaattatgcactggatgaaaaaaaacaaacctcgttattcataaaaaaaatagcgaaaattaaaaaaaaaaaaataccagggcccccttggctccgcttagaagagacggctaaacgaaaattttttcgtggttt

SEQ ID NO: 11146 - DNA, 866 bp, Heterodera glycines
aaggaaaagccgaaagggaaggaaaagcgaaggaaaagccaaaggaaaagaaaaggaaaagaaaagcgaagaaaagccaaagtaaaagaaaaggaaaagccaaaagggaaggaaaagcgaaggaaaagccaaaggaaaagaaaaggaaaagaaaagcgaagaaaagccaaagtaaaagaaaaggaaaagccaaaggggaaggaaaagccgaaggaaaagccaaaggaaaagaaaagcgaagaaaagccaaagtaaaagaaaaggaaaagccaaaagggaaggaaaagcgaaggaaaagcggaaggaaaagccgaaagggaaggaaaagcgaaggaaaaggcaaaggaaaagaaaaggaaaagccaaaagggaaggaaaagcggaaggaaaagccaaaggaaaagaaaaggaaaagaaaagcgaagaaaagccaaagtaaaagaaaaggaaaagccaaaagggaaggaaaagccaaaagggaaggaaaagcgaaggaaaagccaaaggaaaagaaaagcgaagaaaagccaaagtaaaagaaaaggaaaagccaaaagggaaggaaaagcgaaggaaaagccaaaggaaaagaaaaggaaaagaaaagcgaagaaaagccaaagtaaaagaaaaggaaaagccaaaagggaaggaaaagccaaaagggaaggaaaagccaaaagggaaggaaaagccaaaagggaaggaaaagcgaaggaaaagccaaaggaaaagaaaagcgaagaaaagccaaagtaaaagataaggaaaagccaaaagggaaggaaaagcgaaggataagctggaggaaaagccaaaagggaaggaaaagcgaaggaaaagccaaaggaaaagaaaaggcaaag

SEQ ID NO: 11147 - DNA, 3556 bp, Heterodera glycines
gtgggacaggacaaatggcaatggcagtgacaatgcctctcattccctgcccaattggcacgattccccccccccattgaaatttaaattacttgcaatttggcgcaaaacatatcgcattcagtggatgttttgaagttctgcaaagttcaaacccaattatttgagtgaatcacaaaccagacaacaaaaagagaataaatacattaaaattgcccaatgcgccgttgtaagtgaacgaaatgcaacgacctaaaggggacggttcttctttgatcactcaactcactcgtcattttctgatcatctctgttgaatcactcacaaattaattgctcgttcatttactgattagtctgttgatcactcacttatgatcaactgaccaatcacttaagctgatcactattctccctctctctctctctttttctctctctctctctttctctttttctttctctctccttccctctctctctctctctctctctctctaatcatcgtttgatcattgctttcctccatttgctcaccttgctctgcgtcgtaataatagcgactttcgatgtcataataagtcgagtaacttttcttcaccagcactcccgggtcgaacgcgttcgaccgcggcaaagtgtaaggacgggcgccatggttggaacaaatgttttgtacggtgggacagcacaaatggagggaaccgatggcagtgcattcgaaatggggacctggcaaaacgtaaaagcaacagaatggcaccgctctttggccctctttttggcactttctctccgcttctctcccattcctttgcttttcttttacccaccgcatgtgctcgtcgattggcatgcgctgatcggttcgtcatcgttctgcgtgttcccgtgtttgtactgtggtgatccgcgtttgcatgctgtaatttgtgccatttttggacccttttcccatgccattaaacgcactgtcgcgacaatacgattcgcagtgttcgcgcgttttgaaattgtttggcgattgcaatctgtcaaaatgaccgaatttgtgtcgcttttctttgtgagtttcgcttacgttttctcttcccatgggtcccacataaactaaaagagagaagcgaatccgccaatttcaacagattcccacctgttcgcaagtgccggtcaccgaattgaaccaccaccgcgcccgaacgcccgccggcgtcgccgcgccattgtcagccacgcgttttggttggatgcaagtgaaagctgaaggggagcatttgtcaagcttggatccatctctcgctcgaggtggcattttgaagggagaatggtgcttttggcttaatctcctccatttggtccagtgttttgtctttttcgtttagttgcccaatgtttcgcccatttgtccaatatttagtccttttgtcttacaattgcctttttgtctttttgacctctgttatggcagcaaatgccatctgctgatgggtgtacgtcgtaaactccgtccattgcgtttttcacgttgtccattgactgcggcgcatgcacacaatcgaaaaggtcggctgcgaattgtccgttgcccgcgttgaatggttccaatccgtgcacacacgcgccgcccccgttggccacaaaatttgtgtactcagtggaagccgaatgacagaactgcagcggattgatgtgctcgcccatcggaatgtccttgtcgtccgggtcggtcattgccgaatttctaagcataaaacagcaataagccaacgaatagccgagacaaattatggtgataatgtacggtaattgtcaccctccgtcccccgggacacttaccgcatttgtgagacgggcattgttaacaaatcgtcgtcatactcaggcaacgggcacttcggcacctgcacgggtcacaacatcgaatgccattaatgcctttaggctttatcttaccgggtccccgtcttctcccgagtgcaaaatgcacacgacgccgtcccgtgtcttggactgaacgtacggaatgccattcacatcctctggacactcacaacggctcttctcacagcgactttccggccaaaccgcggcacattgttctgaaatgagaaagaaagacaaattcacccaacaaaccaaaaatgggtcgaaattaaccagcatattggcagcctgattcgcccgggtttttttctgaaatttcaattaaaccgaagaattatcctcagaaatgggttatactcaggtaacagtatccctgaatggccacaaaattggacagacaaatgcaggtgccgacagaacagaacatgccctgagcaattgagttgaaaaagcaattacagtaacagagtaccgtaagacaatcggtgttaaaagaacagaaatcaccgacacgaccttaattagtttttatgtaagagtttcattaaatgctaacgttaattaatgacctccgatgtttttcgcctttaatcccccattccgctaattgtcttgccccctaattgcctcgttccttaatgacctgatccggccactccctgtcttttgtagcgactttgcgggtgcttgcatcgcccattcatgaagatttggcctatcgcgcagtatcggacttccaaatgcatttggtcatttttaggggcggtagggacacagtcgagaaaggcattttcgcggatgtccactttgcttaatacattagggttgtcatttttgtcatgttggggattaaagggctaactttgccagagtgtcgcagaataaccattcggtcgccctttggcaatggtcgcccggcgatggcatgcgacaagaagcgcaggagaagccaatggaacattgagggaacagcaggggaagtggggaagaagtatcggatgaagagaacaaaagagggagggaggagggagtgatggccaacggggagggcatcacgaagcagacgagcagagggacgagagaccgaaagcagcagacgagcagagacaccaggaagcacacgaaccagacgagcagagtggcgagccagcgaaggtgccgcgtcagaaggaaaagtggcggaaaagttcgcgagacgtgcgacggcgcgggcatcacccaacaaacataaagaaagagccccaggggaaggccaaatgggccaattggagcgacgaatcagcaggaagaaggggaggaggacgcagagtggaagaagcacaccgaaaagcgcaaagggagcataggaaaagcggaaaacttttcagtgggaggcgcgacaaacggacggagggacgacggaagaccagtccaaactcggctcacagatcagctcagcgaccccttctcattctcttccaccgcttcggaatttttgcattttcatggacaggaaatggcgaacgacgcaagcccaagaaaagttcacaaaaacaaaatttggactgttaggaggcgaaaggacaaaaaacagaactgtgtggggtcatcggccgatcgacacggcgggtgggcggtgaaaagtgcttaaagggggattaaatggggagaatggggggaggggggcggagggg

SEQ ID NO: 11148 - DNA, 1856 bp, Heterodera glycines
  misc_feature (44)..(44): n is a, c, g, or t
  misc_feature (138)..(139): n is a, c, g, or t
ggaggattcaatggaaaagtgagacggggagcggacaaagcacntgctaataggctgacaatggcagaaaaacccgcgaccagtcgtcgcaacggaaagggcgtagggagaggggagggggattagattagcccccgnncctttcccccgcctgtcccccggtgggggggatttggtaaggcccttggcaatggatactcacttttcctcgacccaacaaaatgttgttgcgcattcgctttggtctccgttcgccgttctgtcggcgattttattacaattgttcctatgaccgccgaagagccgactcgaacgtccgccaaacggcaacaaatgtaaaaatgaagcaaaggcgagaaaacgcagcggtggggccacagacagcgattggaacgcgagacgggaacggcacatgggacgacggtgccaaaagggccaaattggggcgaatggaagcgatcacagacatttcctattgcggaaagtggaatcagcaaataataaccaagagccaaataaatagactaaattatgctttgattgctcacttcggcatcggtttctgaatgccgcccttccgccaatgcattggcactttctccgcacacattttgccccgttccattggcactgtccgttgttgcggcatgtctctccgatcgccctcctccgcagtttttccccggctttctgtttttgcttttccgctcctcgtcgttttccctctttgtgtctttcccccgccaattcgcattgcttttgctccccaattggcttcttctctctttcgcattcgcatttattgtcaatgcattcgaaggcgggtggacagtcttcagagacggagcagaaatcgccaaattgacgtaaccttaatgaaataggaagtaaaagttgttggcaacgccagtcataataatgttggcatttgaccctttcccccgttctcccattggttgtcccccatttaaccctcctctgctcccgtgccattccccattggttgtcccccatttaaccctcctctgttcccgtgccattccccattggttgtcccccatttaaccctcctctgttcccgtgccattccccattggttgtcccccatttaaccctcctctgctcccgtgccattccccttgtcccccatttaaccctcctctgttcccgtgccattccccattggttgtcccccatttaaccctcctctgctcccgtgccattccccttgtcccccatttaaccctcctctgctcccgtgccattccccattggttgtcccccatttaaccctcctctgttcccgtgccattccccattggttgtcccccatttaaccctcctctgttcccgtgccattccccattggttgtcccccatttaaccctcctctgctcccgtgccattccccttgtcccccatttaaccctcctctgttcccgtgccattccccattggttgtcccccatttaaccctcctctgctcccgtgccattccccttgtcccccatttaaccctcctctgttcccgtgccattccccattggttgtcccccatttaaccctcctctgctcccgtgccattccccattggttgtcccccatttaaccctcctctgctcccgtgccattccccttgtcccccatttaaccctcctctgctcccgtgccattccccattggttgtcccccatttaaccctcctctgctcccgtgccattccccattggttgtcccccatttaaccctcctctgctcccgtgccattccccttgtcccccatttaaccctcctctgctcccgtgccattccccttgtcccccatttaaccctcctctgctcccgtgccattcccc

SEQ ID NO: 11149 - DNA, 3769 bp, Heterodera glycines
tgtaggtagaattgtggttccgccggaaaataaaattaaaaatgttatttttgtttttcctggggcgaaaaaggtgctgattacgaatctgagcttagattttgtaaaatcactgattttatctttgatttttcatcaagtacttgatttttttcaaaatttttaaaattttctttacaaaaatttgtgctgaaaaaatgtgctaatcacgaatatgaactcagattttgcaaaagccatcattttgtctatgatttttcatcaattctcacaaaaaataaactgctgccaagcgggctcgaaccccagacccgtctcacatgacccgtaaaggccagtaattaaatttcaaaaaatcgtaaaaaacgaataacttaacttatccaatcattcaatagctcattcgaaagctctttttgagctctacaaattctgtgtataagttttttacgcccgattaattaaaaataaaatttttaagtttattttccgtcgggaccacaattctacacctttgccaaaacaataaataataatacgacaaaaacaaatctgtaaattaggaaaatcggagtggaaaaaatcaaaaacatgaaattttgatgagggaaaaatctgagtcgccttgatttgatttgacttggcgctcctctacttcggctgctatagaacaaaaattcaaacttttggaatattttttttgggacggtgtcccgcctcgtaatgggatcccgctaaaatcccgcgcgtgatcccgtctcgctccagtctctatatcttctgcctctgctttttttattttttcaaataaagacacaatgccaaaaggaaaatgttatcgtgtcaataatcaaaaaaatttaaataacaagaaaagcgagaaatgctaaaacttttacatcaccacaaacatgactggaaaattgagtacatataattttacaaagtttatgaacaacgcaaacacaccgcgggtatacagaattaggcgttaaaagatgtatccgaccttaaaaattaacatacagtacccataaaaaaactagggcaactaaaatccaccatttcttggtacctttcagatctatgagtacaacatatgggttccctcaaaggtttcaaaacatgataacaaaaatgcgaaaaaatcgggtttttgaattctttcgtttttcctgtccaattttttccggtgaatttttacggtcgggaaaactgcaatagaaccgccctcaaattctgttttccgaattttctggttttcccattttttcagctcaaaccacatacaatttcacttcacacactcaacactgctcccatctgcttcaccaaaaacgcaacgccatggtgctcttcgcattgctccctgtccagctgatgctcgacaaatgaatatatttgaaaatttaattattaaaacgaatgcttcagtttattattttctgttaacatattacactcaaaattgcataatggaaaaattcttcgaatttctccccacaaatgagaattaaaaaattttatgggtacatttttgaatataggcaatttttcgtaacaaagtgcactcaaattttcaaattttttttttaaatttcacgggaaaattcccggttggtcccagtctcggacgaaaatcgaggtcccggtcccgacttttctggtcccggtaagtcccggtcccggtttttgtcaaaattcccggtcccgtgcaactctaataattaccttttttgctaacttgctatagcctaatatgcacgaaaacgagtttttaacttggtttgaagcttttatcttgaactttttggtgcattttttttgccttttttgcgatttatttttttgaaaaaacggtaaattttttgaaaattttgcaacttttcctaccatattttattacaatttccaaaaaattttccggcggcgcttatcggcaccgccggaccttcattttaccttaatttttgaaattttaaccacaaaatgagtagaatttgtcattttctatctgagaaaaagatcgaaccggaaaatgcagattttttttttgcatcacaacctcaagctattggcaaaatttttaaaaaaaatttcgcttttcgcattttcgcatattttggcttttcgcatttccctttttttcatttcgcatttttcggtttcgcaaatttcgcatttcgctttttatttttcaatttggcccatccctgggaggtagcgatgtttcacccatgaactgatttttttaaacatcattcccctctttttgcaggaggaggagccgcaaaagccgacggaactaattgggcgatgaccgggaaacatcaacaatggcacgaccgcccagatatagtgtgtcgtctttttattggcaagcgtgatgaactgctcaatgctctgaacaaaaagatgattcttggttacatcacagcctggttcttctcgctcgagttccagcttcggtagtattacattggattgggaatgcatccgacttcatggcgtaatccagagtccagaagattacatgagtgagtacatttgtgcggacgtcccttctatgccggaaacgcgacttcagtcagcagaagaggcaaagaggatgcgtgaactctacaaaacaatcaccacaaagcatacccattcatactcagcccaacgttatcttgttgatggaaaatgcaaaaaacattttccggctggaaatccttctttgggtaaaagataatattctgtatattaaagaagccattctcttatggctatgtctactcggaaatgcgtatccgtgttatttacgccgaccgccagcaccaaacgaaaccatgcgtcaaaagcatccacattgcatttctgaagtcgaatgactttacatttttgccaactgcgacaataggaattgctgcagaactactgtatgagggccaaacagtacataagcgaatttgcatcacaaacatgttgattcttcaacgccgattatcttggactacgacagccaatttgcgaacttttacgtcgaacccatggcatgaggaaagaagaacgaagaaaaatttaaggagatgagattttgagtatttttgcgttgtaagtccccattagtttcacaatgtttgtttgccttgttgcccgaaaacactcgccactttttacacagaatcactgaatgaattttcggaccataacttttttctttctcaaccaaggtattttttgatttttggaaattttttgaaatttaattgaaatttttcgaattttccaaaatctcgcaatcccgcgcgggatcccgcaaattttaaatgcgggattaagggtatttttgcataaaaaatccaaaaaatcttatttttttatcattttcgcccgaacaattgcaaaacaaatacatttcaaggtgttcgaaagtaaaattgatattttttcagttaaaaatttttataaattaaaaactccagcagagaatttcgaaatccaatgacaaaataagaatttgagttagttactatcagcatttgaaataaattttaaaaaatttgaaaatgttgtaagcaattgcaagaatgttgatttttaggagtgtatttttcaatttttttctgttttttcaattttttctgtttttcttacaaaattttcctaaaatgtcaaaatatgtgccaaccccgaaatatgtatgtgccgtgatgagacatttgcgccgcgccatttgcgccgcacagcaaaagtggacacttgcgccgcgccacttgcgccgcgc

SEQ ID NO: 11150 - DNA, 2759 bp, Heterodera glycines
cttcaataaaaaaataagtaaagttattcattttagatttttattttcaaatccaaaataagaacgaagtatgcacgtcgagccaaaaagaagaaaaatcttagaaataaggacattttcattttctaagatccggcccttccaaataaggacaaatcgtagaaataaggacacttggccaccctgaacaaatctcatcaaaaatttttgcacctttttttgcttagaacatgaaaaattactaaaaataaatatgcttttaaatcagtaaacaatactctcaatttgggggggggggtttaacggtaatggtgcgtttatcgataattgctgctggtttatttaaaaaataaaaagctcatgcaattgtgggcgaagcgttttttgaaacagaaaattctaattcataatcaccatttaaataattaattatattcacatccatataaattttactttgtttttatatcattttcgcttcctttttttgtatttagccggtccaatgtcacccttttggctttctcatttgtcagcagcaggaggaaaggccataggacttcgtttgccacgaccaaatgagtttcgattgcgtccattcgaatttcgattacgtccgtaagaatttcgttttcgacccgtcgaatttcgccttcgacccgtcgaatttcggttgcgtccattcgaatttcgttttcgacccgtcgagtttcggtagcgtcccattaaacttcgtttgtgacgtccttccagcacagtacgaaagttttgtagtggtcccgattcatcggcggaaagtactcgcttttcctcctgattatctaaagccggtgaaacatcaccggctgcagcagaagaacattggacgacgagcaatgccatgaaagccatcaccagcaggaacagtggagtaagaagcatgccttgaacattcatctaaaatggaatcaatttaaaaaataatttggtgttttctcagctgtgtatagaattggccgcctaaaattagtccaacaaccatgaaacattttaaataaaaattttcgaacaaatttggtatcattcgaaagctcctgacgagctaagtctaaaaaatcaaggatgaagccgaaccgacgcgtgttatgggtcctcaaaattgttaaaactatttttaaactagtagtcagaaaatggtaaaagaacgtcaaatataaaagattgaattgcgcgtgatccgaaataacgaaatccttcacatttcctccacctcatttggcggggaaaataaatatttttttcaaaatttactaaatataaagaaagtgatggacagattgaataaaatggaggggcccaaacttgtctcattcttttaccatgatcagacaaagaatgcagcagagaagcggcagaaatgaggtggagcatacggtaaatgcttgtaattttttgcaaaaataaatataggtaattgaattttcttctacacaggtggcaatgaacccagacagaaaaacgaatgcaaaacgttttaaatttaagtaaattattaattaggccaacaaaaatttcaaagtccctttcacccaaatttttaatgaagaaattggcaaaaagttggaaaatttaatattttgatattcttggatatgggcgtagagtcaaacaacttttttcactacaaattttttaaacttgggctgctctttcgtatatgacagaaaaaggcgaaattcaagacacaaaaaaacaatcaaatttaccaaagaaaaaaacgaagcaaaagaatgaagcaaaagaacaataaataataataataacaaaacaaaactattcgggcgccagcttcatctcggcccaataatcaattccctccggcgcttttctcttcaactacaaaagataaagggaaaatgtatataagccatggatcggatcagaggacgatgaatttgagcgtgatcgtggcattcgagaattgcgctgaaaagacttctaattgtgtgctggcgaaatgatagacaaatagcataatcggaggttttaattgacttcgatttttcgtaatacgctaaaaggaacaactaagaatttttcctagaaatttagtatccttgaaaccaaaatgtctattaggccctgatttttggctttacttttttccttttcggctctaattttgaaaatgcttagtacttaaggcatttttgccttacttttaattttcaaaaatgagacattttcaaagccaaagaacaaacttgtatatttcccagtcgaattgaagtcgtaagtacgtggcgctgatgttccgcacacagtacatacaacagtcacacgaacggcacggtgccgaaatttcttgaattgatgatgatatgtacgtattatttgacgactaataaaaataaccgttggccataaattctctcgaccagtcctgacaattgaatttgcacaggttatatgtgtcaagtccgcccatgccgcggaagatgtcctccatcgaagcgtatgacagtgtaatgggctggctatcaatcaccgctcgatgtttggcatattgtccgaagcttaaccattttatttcttttttaataatcattaaactttttttcactttccattttaagtatgccattttttctattttttgaaagaagacgctattaataatcaacaaataggcgatactttttgttgaccaaaatgaagcaatttgtgaagcagaacaaactttgcatgctttccggatccgctgaagtcggaagtccgag

SEQ ID NO: 11151 - DNA, 1675 bp, Heterodera glycines
  misc_feature (1642)..(1643): n is a, c, g, or t
  misc_feature (1655)..(1655): n is a, c, g, or t
  misc_feature (1664)..(1664): n is a, c, g, or t
tcattactagggacgtgaattttaggttttaactattttttttgctcaattgatttgaagaaagtagctcaaaaaacgcatttccgcataaaaatttttcgattctgatgtcattatcggtcactagaaatcactattttgggattttgtcactaaaatagtgaaaattcactattttggagttttgtcactatttcgacattttttggaaaattctttaacaaaaatgcaataaaaccaaaaaatacacccataagaatcgacctaaaaaaattcaaaaaaatatacccctaagaatcgacaaaaaaaatttcaaaaagcgctcctaagaaatgaaaaaaattttctcaaaaaggtattttcgtggtcactattcgtcactatttcggactttttgacactattttggcatttttactcactattttagttaactatttcgggatttttcttcactaaaattcacgtccctaatcattacaattgtacaatatttatcgaggaatttatttctttaaaaaaccttaatttctttgatcttgtttcaaatcaagcacatatgttttacctgtttttttcgctttaaattttaagtgcttagcatgattcccggtttggattgtttaaaaaaccaaaaacatgacatagcatccccattaattatgcatgaaaatgagggataaagaaagcaataaaattttcaaaatgaagagaagaaccaaatgcaaaagggaccaaataaattcatgtgtcaattaatggtaacactcgagagttgacttttggcactaggaggtaatttttgcaagccgaaactcgggcaccacaacattaaatgcaaggcaaaaataaataaataaatcgatcttccaagagcacaaacgctaattttaaattagaatcgactcactctcgaccgaataaatattttctttcattttatatcccttataaaatgctatttttagaaacgatttccgaagtattcgaataggtaaaatttaaaaaaatctctggcaaggctatcgaaagtgatgaactaataaatgtgattatattaaaataatcaaattgcagcatataatttgattgatcagcaaaaaaaaacagcaaaaaattgaatggtctgtaataaattcgttatgcaaatgtataaaatacaaataatcgccccaatttggcattgagtcaatcaacattttaaattacaaatcacaatcactttggaattaataatcgatcggtccaacaacaaaaacaatagccaaaaccatcccccgatcaaaacaatcaatcaatcaatcattcatcattcaatggttcccatttgcaattagagcagttcctccctccctccgtcagtcattcagtcctccgtctccgagtcggtgccctccgtgtagtcgtccgtcgacacgggctcgtcatccttgtccacctgcgcctcgtcctccgtgtcctcgtatttgacgggcggtggctcgcgtgccgggtgcacttccatctgcggacggagggaaaaggatgatgggattcaaaataaaatttataacaaactaacaaaaaccctttaaataatgttttgctatttcttggttcattcgcaaattttaaaaaaaactgaacagccattagagggctnntgaatatgtaanaattagtcnaactaaccatt

SEQ ID NO: 11152 - DNA, 1747 bp, Heterodera glycines
ctcagtgtgggcgttccacaaaaagctcagtgtgggcgttccacaaaaagctcagtgtgggcgttccacaaaaagctcagtgtgggcgttccacaaaaagctcagtgtgggcgttccacaaaaaaagctcagtgtgggcgttccacaaaaagttcagtgtgggcgttccacaaaaagctcagtgtgggcgttccacaaaaagctcagtgtgggcgttccacaaaaaaagctcagtgtgggcgttccacaaaaagctcagtgtgggcgttccacaaaaagctcagtgtgggcgttccacaaaaagttcagtgtgggcgttccacaaaaagctcagtgtgggcgttccacaaaaaaagctcagtgtgggcgttccacaaaaagctcagtgtgggcgttccacaaaaagctcagtgtgggcgttccacaaaaagctcagtgtgggcgttccacaaaaaaagctcagtgtgggcgttccacaaaaagctcagtgtgggcgttccacaaaaaatgctcagtgattgataaaataaaataataaggttaaataataattttgaactgtaaatgtaattttgatttaattttattgcatgcttttaaattataatttttattacaaaactaaaaaaggaaaaacaaattaattgaagacaattgataaggtgctaattttctttgcatttcatgtaaagaatttataattttattacaaaactaaaaaaaggaaaaattcacaaattaattgaagacaattgataaggtgctaattttctttggccaaataatcttgccttctgactcacatttataattttctcttctttgttctctatcaacctgttctgcttccagtttctctaatttttcgggcttacagttagcattatggtttgactgcaacataacaagttgtgttccctgtcgcagaacagctgatgcgacgatcgatttgacattaacatttttttcttgttcgcgaaaataacgacattttgaacaagaaatatatatgtcttcattattctcatttgtttgaacatattttctccaagcagattcatttccaattataaaaacattttttcttaaagtttttgaaaagcacttttcaaatctaagttcatgttttggcatttcatggcttgaagcattcgagtttgaagcatcatttttatttgtatgcgcagaaacaatagttagtcttgacacgtagcgtcttaaggtacaaaaacttaagtcaataccttttagttgcatttgttcatggagtttttttaatgttttaatttctttattttgatagcttttgacaagttctatagctttgtgattttttataaattcttcaaaaccggaattggtagaggtcgaatactcaaatcgaaataacaaaaaaataaaaataaaagtcttattcattttctaaattataattttattaaacatataaaaatttattgtattaattttacattttcagtggtagcccaaaattatatgtattgatggttattgatttcaacgtggatgttaccaatacaataattaaatttattattttaaatttattattttattttatcaatcactgagctttttgtggaacgcccacactgagcttttttgtggaacgcccacactgagcttttttgtggaacgcccacactgagctttttgtggaacgcccacactgagctttttttgtggaacgcccacactgagcttttttgtggatcgacctagcacc

SEQ ID NO: 11153 - DNA, 2089 bp, Heterodera glycines
aaaaagcatgataaaatcaaataaatcttcttttttctccctatttaaatggtgaaaaaataaaatttattcattttaactcttggaaaaacgagttgaaaaatccgataggaaatgtcattgtcatttggcacacagctcttttttgaaatagcaattcatttgttcatcgccttcaaaatattcgcctactccaaaaaaccaaaagtcagaatttttttacatttaatcccaatcatatgacacattttcaaaagttaaagaaataaaaaatattattatcatttgcttagttatgatggaatttctccccattttaacacccataaatgccgttaattttctttccgcatggatggccctttttcagtgattcgtccattaacaaatccacctaaacaattaagcatgtcaatgtctttaattatatttttcaccgttatatttgtggacatctcatccgttgtgctcagatgcgcataatttaagctggatagcccatcaggtttccaagtgctgggtcaaattgttgatcaaaagctgccgacatgcgcagtccatctcggcatttgtcgtgtcgttgtctttatgggccaactcaatgcttttgtaatggccgatgggtccgtgaacgaaaagcaccgatttattgctaatttaaatcttaaaaactggaaaatgtgtgtggtaatgggaattataaatccgccaaaataagcacttactggaaaaatttcataatttcttagaagcaacataattagtaaaagaaaaaaaaattaacaatttgttgtcgaaaaatgtcctgtcttagctgaatagaaacactctattttggaaggatttagcaaagtaccaaaaaatgaataaaaatgccaattttttaacaattttcattaaaaattttaatttttagtaaaatttgaaatatcaatcaaaaatgtttaatattatgattgtacatgaacatgttaacattcgaaattaaactttttggataaatgtgctctgaatatttgtaaattgaaattctaagtaataattaaagctgggattttcatgtgctaaaaatcccaaatatgtaataatatgttctaaaaattaacaattttctcactggtgtttcccgaaactatgaaatgcgaccttagtttgttctgaaatttgatattttttgttatactatctatgtgtttttataaaattttaattatttttttccgtttgacgcacatccgaccaaactgaccaattattgtagaagatactagccgcaagaaataaaaaagttaagaaatttgtccgaattcgggttcgggattggaaacatggatgttttgcacaaatccgaccaatttcagtcctaaacaggtactcacgcgaaaacgtccccacgcgaaaatggccacgcgaaaacgaccctgaccgccaaatatgtaataatatgttctaaaaaatgctgaaatatggataaaaatcccaaaataaaatatgtgttaaaaattggatttttgcataaaaacccaaaaattctcattctttatcattttcgaccgcacaatcgcaaaccatatacatttcagtgttcgaaagtaaaatttaccttttttccgataaattttttaataaattgaaagatccagcagagcagttcaaaatcaaatgaccaattaagaattcaactttcggcattcgaaacaaattaagaaattttgaaaattctataagaaatggtaagaaattttgatttttaggggtgtatttttcaattttttgtgtgtttcttacagtttttctcaaaatgccaaaatatgtgccaaactccaaaatatgtattttatgtttttataagtgcactaaatcaaaaattgttaggtcaaaactatttttgggcttctcttgacataactaagccgcgtaaaaaaagtgtaacaacataaaaacccagctctaataataatgcaataatttataagttgatttgttgtttctttggcatttgattgatttaagtaattacccaaattaatttataatcgtttaatatgtagaagaaaagcattgctgactgataaaaagaggaataaac

SEQ ID NO: 11154 - DNA, 2772 bp, Heterodera glycines
  misc_feature (10)..(10): n is a, c, g, or t
tgcaggtccnctttgatcattttgacaataaaaaacaaaatttggaaagtcgaaagataaatgataaaatcagacgaaggcataacggacaaagcatcgaccgataacaaaaattaaagattttgtccagcgccggtcggattcgaacgctcgcccacccaattccaaaccgcggatttctcctccgctagccaattgtcctccatttcccctcattttactttcatttgtcattgttagtgggttaataatcaattaattattcaatgatgaatcaaaaaccgggaagtgtcaacagttcggtctctccgttctgtcagcagctgaccgttcccgcgtcttcccacgccgccgcctttttctgctccgcgcgcttttccgcgtgccgtcgtccgtcgcgcggtctccgctccgccgttttgtccgcccctcctctgtccgtctcctccgtttctgtgcccatttttgttttggcatcgttcgtcgcattttgacggcattcggctgactcgtcgctgcctcctctcagtcttctgtacttgtcgccccttctccgctgtcttatcgcccttatgctaacgctcgtccccgttggaaatgccatggtttccgtctcaaaattgcgcgtcaaaagtgtcccccaaggccttcttctctccaaactgccgtaatttgcaaccgaaccgccccagtgtgccattggctgttgcgtcgttggcaatgttgcaaattcgccgcttttctctcccccaaattcattgcctttggcggccatcgattccatttttgccggcacagaatgaacaatgccaccaatttgaaacggtcttcctgaatggttcatttctcacatcttcgctttcattgcctttacccctttccattttttcgtttcttcctccatttttttcggtttgtccactaaattcgcttgggtcgtcccttgccgaatttgggcccatttgctccggcaaatttgggattgcccttttgctaagggaaagggtgggccatttattgccaaaatgagggaatttgtttcccttttccccggcctgtttcggttggccgggaaaattccatttttctcttttaccccacaaaacaaaaaaaagggaaaagggcggggcccggaaattgttatggggggagagaaaaaagacaaaaagggggggaaaaaaaaaacaaaaaagggggggaaaaaaaaaattcaaaaaaaaaatattttacccgcggggcccctcttttaagagggggggggggggggggggggggagggggagaaaaataatttattataagaaaacaaaaaagaaaaaaaagagggggggggggggggggggggggggggggggaaaaaaaaaaaaaaaaaaaaaaaaaaaaccccacccaccccccccctcctcttctctgatgagggagggggggggggtgttgttcgccccccccccccccccccccccccgttgtggtgggtttccccccccgcggcgcagcaccccccccccccccccccccccgggggggggggagaaaaataaaaaaaaaatattttctcgttttttttttggtgggtttttttgtttttttttttttttcaaaaaaaggggaaaaaacaccaaaaaaaattttttttttttttttttttttgtgtttttttgaggaaataagaaaaaaaaaaaaaagaagaaaatattttttttttttttttttttttatttttgcgccggggagcaccccccccccccccccccccttaaaaaacccccgaaaagaaaaatttttcccccacaaatttttttttggggttttttttttgggggggggcccaaatataggggggcccccgggggccccctcccttttattgtgtcaaagaaaaaaaaggaaaaggcgggataaccttggcaaaaaaaaaaaatggcaaaattgtcccttttgtttttcccccctaaaacccctgaacaagggaatgaaaaggacttttttttttcaattttccccaaaacatgaacaatttctgggttcacccgccccagctggggcatccatggccagggagggcccccccccggggggggggggtcagaaatggggaaaacccaactcgtactgccccaactcgtactgtttttctacaaaaaaatcgtcataacttttgttaaagacgcaccaaattaaacatttcttggtctaaaacacacacatttgtttgcagatttcttagaaaattgttggaacaatataatgaaattggcataaaattggtaccattgtcaagccagtcgttgcacacatgtggccgtataaggcggcacataatcgctgagcattttggaagagcacgtcatccgaacgcctttgaccctaaaaatttggaaagttgttaaacaaaatggcagactacatgatcaaaggatctgtcgcggttttagagccaaaaaaagcgttttggcattccaaacacaaaaaatttttcacgaaaattttttttttttgcggacacatggcaataatatgcatttaattaaattgaaagcttaacgcataattgtccttgatggtcataatgaagggacgctggcgctttttgagcgccgtttcccactgcgcctcggccaacccaaacgtttcgctgatcaaaaaattcaaatggcgaaagcgacgagcgcaccccaccgattgcttgacacggtgcgttaataataagcggggctgcaaaaaaaatatggatataaaatggcgaaatatgatcaaaaatcgcaaaagacc

SEQ ID NO: 11155 - DNA, 1252 bp, Heterodera glycines
agagggagagatgatgagtaggaagacagaggaagagaggaggggagagaggagggggagagagagaaagaagagaaggagagggaggaaaacagaggaagagagggagaaagaggaagacagagggaagggagagagaaagaagagaaggaaaaaaagaagacagaggaagaaaggaggggagagagagaaagaagagaaggagagggaggaaaacagagggagagagggagaaagaggaagacagagggaagggagagagaaagaagagaaggaaaaaagaagatagagaaagagaggaaggtagagagagaaagatagaagaggaagagagagatggagagagggagagaaagaaatggcacagcacaacgccaatttggccggattgaaccaaaaaacggacggaccacaattgggtcacgaaggccgaccatgtagaagattgagcacagaataacagcagaacacatcaaatagatggcttaatacaaataatgatcagtagagcctggatttatggatttttttgcataaattattcgaccaaatatcaaataaaagtatttttagccttggtttgatgcttcgatgcttttattttttccacattcatatttttgtacaaaaatatttccattttttatccataatccggcactttcacaaataaacctctaacaaaaatttaaaaaaaattcaaaaattaccaagacttttttcatgttcaaaattcctattcaatataaattttatttaaaaattattttaattaatgagaaaaaaaatattttctcagactacaatatgcgatattagggttgcaaccccgacgtcggggttggaagcgtcggggttcggggttgccaaatcgttcggggtcggggtttttcaaaaaactggattttcggtcaatagcacctattttggcctttttccagaaatttcatagcaaaaatgcaataaaaacgaaaaatgcaccccaagaatcgatctaaaaaatttcaaaaaatatacccctaaaaattgaccaaaatttcagaaaatattcccctaagaatgaaaattttccccaaagattcgtttccaaaatttttgttcttgataagttgcaattgtaagggcgaaatgaataatgaatgggacttaggtaaataagattttttgcataaatatacttggtttttccaatttttaatacctattttagtacctattttgggatttttagcacctaaaaatccgggctcta

SEQ ID NO: 11156 - DNA, 4860 bp, Heterodera glycines
  misc_feature (40)..(40): n is a, c, g, or t
  misc_feature (4787)..(4787): n is a, c, g, or t
ttgtagaaagctgcacagcgtgtcgtacgcccgccgccgntgccatctgattttgtgccaattcgtctgcgctgaaattttgaaaaaaaaatattaaaattccattcaatttttcatcagacaaaaaaaacactatataccttcgtattctgtccaatagttccgctttggccaccaattggtcatttcgtgccggacatggcaagtgcctgtggacgggctcgtaaagacgaaactgcaagaaaattgggagaatgattagatatgcccttcaaaaaaaaaatttttttttgaaaaaaaagattcaatggaatttttaaggccaccggcgatgcgccacagttccgcaacacactccacggtggtgtcagcagttttgcgcgttttctccaaaatcacacacaaattgttgtggcgatggtccccagcagcagcaacgagggcaccagccaatgggagaacagcagcagaagttgaagcagtagcagcagcaggacgacgaaagatgcactgtaaaatgacaaaaaataaaaataaacaaaaaaaatcagaaagacaatcatttttggcacaaaaaaataaatcaataacccaatttttaattggttggcaattaaaaaatcacgcatattacgctttaaatggtccaaacagttatgaattgatgagggcacaacagagtgccacgggatgcccgaaaaaccctttaggccaagtcgactcgaacccatcccaaacgattgtttttggaccaggcaagtttcgtccgtcccccccccccccactcaccgtccgccaccaattgccgctttggactgtccgccgttgtcaatgatccgcgcacgccttttgcgattccctcccgcgtgacaatgcccggcgcttgccccaacgctttgcacatttgacgcttgaagagacgacccgcgccgacaatgttcactaaaaattggtcgaaaaaaattaaaggaggtcacaaaaaatgattattttacatttaaataaattaaaatttaatttaattgcaaattaatgtcaataacaaatattggcacacgtttaagcaaaatgaatgaaacgaaagagtcaaatcgatgaagaaattgcggggggaaaaaaagaatgatgaaagggggggggcaatgggattgtttacgcgtcagtcgcccttcccctctcccccccccccgccccatcggtccgccattatcagccaatcgtctatcattttttattccttttttgcactgccgttatttaaatagtgcactctttctctcttttctctctctcagtgtctcctgttttctccccttttctctctctctctccctctctctctgcctctcctttttccaccgtctttctccttttctcgccctgtctgtctcttttctcacaatgtttttttcagtttgtcacttctccccccccccctctcgcttctttctcaatcattgattttacagtactttattgctttttgcatactgtatggaaatgtcgagctgttttctgtacaatattcaaagtaatagggaattaatttacaattttattaaaattttatcggtgaaattgtgatttttttatcaccgtttgactggcggcgatccccccggcttttaccctaattacctaaaattgaatgaaaagggatttttataaagcattttggggagagagagtgcaaataataaggaaaataaaataggattaggtatatatatttgtaaattttgattcaattaaagagaaatcattcgacggaggaggggtaaatgacaaaaaatgattttatcagcacaatttgttgatgaacccatctgtttaagacaaacaaatgaaagaatgaataaacaatatatatgaaaataaacgaatggatgaaaaatatgtaaaaaatggacaaataaatgcaaatgaaaaggcaaatgcaaaaaagggaagaaaaacggtcgacgccaattgactcaaaatattatttttcatttcagctgggaaagatgaaaatcgcccaccaacaatccgccaaaaaaaaatttaaaaaatcttattgaaaattttccatgaaaatggattaattttttaaaattaaaacattggtgtgcagcaccaaccaccacatacatatacacctacctcaaaacgaacagaatgaggttggagcgcacgcgttgaggccaccaccgccaccggacgacccgagtccatcagagtggcagttgctgttgctgtacgggttgaacttgttgggctggaatggagagaaatattatttttatttatttaaatcacaaatgtttgtcttttgaaaaagatcagttgaaatttgtttctaacgaagttggaaaaccaataaatcacaaggaaaattttaatattttagaaaattaaaaaaaaaaaaattaaattcatcataaagttttgaaagaagaaatcgctgatattttcaagatgccttttctttaattttccttaaattcctgtttgaaaaaaaaatttcgggaggggaggacgtactgttccccagatgaccctctgttcattctgctcaccggtatgagcatgtccgacatcgtccggtgtccgggtcaatttggggatgccgacaacggatggtgccacttctgctggttgggttctaaaaaaatgaataattttttgacgaaatttcttcaaaattaaaaaaatttacaaaaaaaaaaagtaaaaaatgaatgatatattttgttgactcacaagtgctgattgtgagtgagagcacatcagacaaactgagtaagaaattttcaaaaaattgtcctgtggatgccctcggcaccgccagaaacactcaatttccaaaacaaaacaaaaaacggcacaaaaaaatgaaattactcacatcgctgcccagtgccgagtcccggttgttgaagtcggcaccgccgccgcaaagttccaattgtaatgcggcaccggcatccgccgtatgcaatgcccgcacctccgccgcttcggctctgccgtcgcggtgtgccaacggcaccgccaaccgccgccctgaaaccaatggcacccccacccaccgaaatgctcaccgtgcccgccgatgtgccgttcagcgacgcggagcagtacagctcgtccatctccgggtccaacacgggcaggttcagccagtaccatttgatggactcgcagcagtcaatttctgtttgtttggaaaaattggtcaaaacaaaattcgagagggacaatcatttatttatttatgcttttcgggccaaaaaaatatttttccattacaatttttcaaaaacttttcggcgccctgggagataaataagaaatttttacatatttttaccatgtgattgagaaaattttgaaaaaagttgggaccctgtgattccgttagacgccatgagggaaattttgaaaaaattttggtcaaatgcatagaaatctcagtttaaaaagttttggtttatccacacatttcggggttgggccggagactgaccgtccaacatgattcggttgtcctcccggcacaacagtccgaccatgaacgacttgagcgagacgtacactgccggagggtaaagggcacggaccgactcattctttgaccacacattgttccaaatgcactccaagtccaggtactgctgctgcaactgttgttatttttgttggattcgattgcctaaaaaaattcaaaaaattattattttttctaaaaaattaataattttcaaaaaaatttatcttcggccgcggtggaaaaggcgcgataagtggcaaagaaaacgttgaaataaaaaaaagaggggggggggagggatttttttgaatttaggcgccgacaaaaatttgaaaatttatttttaataaattggaaataaaaaatagtgccgtctttatcttgacaaaatacattaaaataaaaaaattctcggcatttccgtgcccccattttaccatatttgaaaatttaatggcaaaaatggtcattttttggcaaaaaacggcttcaaatgatcaatttcagccaattctggattcttaatcaaatttcgaaaccaaattcgatagttcgaaaagtcatttgtcgactctttgttcgaattcgggttatgccatctcaaaaagccacgggaatacaatttcaagcgcatttttctaatattaaaaaatggctacccaattttaaagctgggccaaatttttccaattttttttttttgtaaaacccaaaattcccccgcatttccaaaaaaacctgttttgagtccatttgtccgtccgcgtcgatcagactgtccaccagccttggcacagtgtccgctttgatcacccactcccggatggtctcccattggaggtggtccatcgccacggcagaaccatcagtcagcgctaactgttgttggccaagggctaaataaatgacaaaaattgggatttggttttttagtgggaaaaatttgtaaattattattaaataatatttattaaatatttgccataagtaaaaagtagcacaaccaaacaaataaaaaaggatttaaaggtaggatttgtgtgaatttacgcgcattttttttttttgttttttaaaaacaaaaaattccaatttaaaaatacgaattcatttggttaaaaccgaaaaatgaaaaacgaaattccgctcgtaaatttaacttatgacctcctggattaacactgaattaacagacattaatggtagaaaatttataatttttttgagtattttttgttacttactaaccctccgnagacacgacaccccctacaaaaaaaaaactttgtggaaacaaaaaaattaaaatatttttctaaagtattatt

SEQ ID NO: 11157 - DNA, 698 bp, Heterodera glycines
acggaaaaataaaaattttgaaaaaaaatcaagtacttgatggtcatagacaaatcaatgatttttcaaaaatagaattcagattcgtaatcaacacatttttacatcagaaaaaattatttttaaattttactatttttttccatcgaacaattttaaatgtgctttcgtgtttattggtgctggtggtggcaaggcaatttgacaatgttttgcaatctcacacaaacaaaacgacgctgtgacgaacacaaaaagcgtagcggaaaagaaagagagaattcaaaggggaagtgagtgagcgagtgagtgagtgagagaaaacaacgaacagacagatagctacagctacagtgtgcattcaaagggaatagagagagagagagagagaaaataacgaaaggagagagaaaggtggcagacaaataaaagacagtgtgcattcgggacagtcagtcttaaaggcccgtgaagaagagagaaaaattgaaaaagttgttctcgctcttcctctctctctctctgccccgctgcggtgtttcacgcgcgtccttttgctgctgcattcaaaatagggagggaagagaacaaaaaataagaaaacactaatcattcacgttggaaaagaaagaggaaaacatgaaatacaatagaatggtgcagtgcaaaaacattcgtttctctctctgtcacttaaa

SEQ ID NO: 11158 - DNA, 2345 bp, Heterodera glycines
acgcattagcccgtaaaaattcatattggtcgatgaaattatagattacgggtccaacccgtattcgaaatccagatccaacatagaatccatgttgtccagactttttgcaaaatgccgaactctaatatttacctaaaaatctaatttcaattttaatttgctgtggaaaaactcattgtcatgactacacaccacatacataatgtatgttttatgagctcggaaaactttagaaaaatcaaattagttgaaaaatgaacaatttaaatatttagttatgttcaatgacaaaagcagggtaaataatcaaatgaccttaataaattagtggatgattgatagttaacaaaactattaaacaatgaaatttgcatagccaattggtcgtgaaaaggaagtgaatggaagagagaaaaaaagtaatagagagaaaggggagagagagagagagagaaagggagggagagatagagagagagagaaagagagagagagaacagagagagagagagaaagagtagaggggaagaataaagatagaaccagagaaagtaaagagagagagagagagtgagagacagggggagagagaaggggggggtgagaagaaagagagaaaccgagaaaaatagatatatatagagagagagagagagggaaatgccagaaaataaagagagagtgccagagaaaaataaaactagagaaagagaatataaaatggattaacataatgatgagatagaagaagaaagagaaggaatgaatgaaatggaaaagagaaagaaaatagagaaagcgagagacccctcgtattcaaaaggaatacaaatccgtatatatccctcccatcgagctgtgtggctctagggtaattgcagatcgagaaatctaaaaacattcaaattaaattcttttaaagaaaaaataaaataaatttgtaagtttaattgaatttttttttgaaaaattaattaatttttcaatttattttgcttaaaaaaatcaacaaataaatttacttcattagtaatttaagtaatcaattaattaggaaaatgctaaactatttcccatttttttgtacacaatttacaatttattttgtacatatatttttagttcgaaaatctgttttaaaactttttttttaaattttgtcaaaaatattttttgtataaattctttaactcttactaaaaatttaaatttatcgtcgatacctacagcttattagtgggaccgattcaattaaaatttcttaatttttttattcagtacaatgaatacatattcaggattttaaaaaatcttgaaattcactttttcccactttttgacagccacataataaatactattttttgtttttaataatcgtaagccctaaggaattccgaaaaagaataccatgctgactgttaatcgttttatcaaagcattcactccaattaccataattgaaatggatgaatttgtgagcaaaatatacaactgcatatacatatacataaataatagtcaaatgacaacatttcgggatcacaaacacttcgcatcaattaattattcattcacttctttctgatgctgaccactcggcccagggaaagcgttgagaagtctgaaaaaaggacaaaaaattgaaaccgaaaatcttttggaattgttcacccattttcaatccgtccgctccaatgccaatgaaaattcggctccctcggctagtccctgctttcttaaactgttccaatgccatctccttctgcccaattgggcaacggatgagcacaaaacattgatcaaaatcataatattgtgacagtgtcaattgctccccagtcaatgcgttggtcaactcaaatggcacgacgaagtcaagcgaagggaacgtcgaaaattcaaagtaaatgatgaagcaaacatgagaagatgcatcggaaaatgcctaaaaatggggtaaaatcataaaaaatgtaattaaaaatggcgtgaaaatcaccgttttgatttgttccattcttgacgaccattgcggaaccgaaaagtcatgacaatgtaacaaatttggtacaccgtccggacgaggcgagaacagccattttgccaccgcttggccatccgtcgcattggcactgtcatcgggcggaaattccgggagaatgtcgccttcgaaagagacacagcgaagtggtggacaatcgatgagcatcgacggggcaaactgacgcatttgatgaagagccgggaggtggtcgaccccgtccacatgagaggagtaaccgaaccttggccgagatggtagaaacgaaaaacaccggaagtggaatttttccagtgac

SEQ ID NO: 11159 - DNA, 1121 bp, Heterodera glycines
ttttttacattcttttttgtgggggcgtcgtcgttttttgacgttgtcccaaaagaaccaaagaatggtgcaacagccaaccaacagagaaaagaatcataaactggaattttttatcgaaaagcaacacccacaaattaaatcctactgtatttgtactgcccctagttcaatgtaattacatttttttataaagtgtatttcgccgaatatttctaaccatacagtgccacgtgcttggcattttttttaaaggagtacaccccctgattctttgcagaaaagtgcacgcatttcgtcatttccgatcggtactaatttcaatggatgaattaaaactttctgggcattaaataacaaaatttaaaacattttaagaaaagaatcataaactggaattttttaacgaaaagcaacccccacaaattaaatcctactgtatttgtactgcccctagttcaatgtaattacatttttttatcaagtgtatttcgccgaatatttctaaccattcagtgccacgtgcttggcattttttttaaaggagtacaccccctgattctttgcagaaaagtgcacgcatttcgtcatttccgatcggtactaatttcaatggatgaattaaaactttctgggcattaaataacaaaaatttaaaacactttaggaaaaaatcataaactggaattttttaatgaaaagcaacccccacaaatgaaatcctactgtatttgtactgcccctagttcaatgtaattacatttttttatcaagtgtatttcgccgaatatttctaaccatacagtgccacgtgcttggctttttttttaaaggagtacaccccttgattctttgcagaaaagtgcacgcatttcgtcatttccgatcggtactaatttcaatggatgaattaaaattttctgggcattaaataacaaaatttaaaacattttaagaaaagaatcataaactggaattttttaacgaaaagcaacccccacaaattaaatcctactgtatttgtactgcccctagttcaatgtaattacatttttttatcaagtgtatttcgccgaatatttctaaccatacagtgccacgtgcttggcattttttttaaa

SEQ ID NO: 11160 - DNA, 2497 bp, Heterodera glycines
aaaatgatagaattacctgcctacctttgttttgcctttttctcaatttttaatatattcgtttgctcatgttccaatatgaaaatgaacaataccgaatgaaaaaaagaatgaaactccgcatatattttgtgagtcaatgaagaaaaagtacaaaaagagagcaaaaagaaaacaaagaaattgaggcgaaatgctttaacatccgtcagcatttcatttgcatgcaatgctttttcgtgatgttgcgatgataaaaaataaaataaaatacacacaaattattggcctctgttctgactaaaggtaatttcagatgcctccgatgatttgaatttgatttggcaaaatgtattgacaagaaacagaagggcagcagcaaacacagcttttaccggcaaatgcaaaggcagtcaaaaagacgtaccacacgaccaaatcctaaaagttcgaatgtttggctttggcgtcccctcccctcccccccccccactttatggttccgtcatcgctgcccgaggccaccattgaattgtccaccgggttccaactgaccgcgttgaccgtgccttaattctttatttaataagtcatttcttccgctttcgcccacttgtgtggccgatcagtcgcttgaccgggtgagtccgacgcgtattccaaatgaccacagtgttatctgatgggaagcaattaattgggaaagaattgggcacaaaaacaccttcggagccagaggcaatgaataattcatcaggaccaccgaaagaagaagtgatcacctgaagaagagaatgtttcaaatcaacaggtttctaataggcattttcctggttatttttaaacaattccattatcaaaaagggggggggggctgatgcaatatgaacccgttaaacccaatttaatgaaaagccaacaaattcgttgtgttttgagccgaaaaaagagcggacgaggtcatttgtccgcaagtcccacaaccgaatgccctcggttttggtagtcaccagacaatacttctcttttcggtcaacgctgaagaaacgatggaaaattagaaatggaggagggaaaatggcaccaaaaagtgatgatttggctggcctcttgaatcagcgtttgctcgtgcatcgtttcgaaatcgtaggcccttattctgaaaatcgtatatggttaaaacttactttcacgttgtccagcctaccacaaagctattttgctttcggatcaaaaatatttttctcaagtggattgtagtcgtttttcgccaaaaaaatatatcaaaatattttatttttgggtcaatttcaaaaattatggttaagtgagaccacggggtaccgataggtgccgccgagtaaaatttagtgaattttaatttgttaaaaaattgaatataaattagcagtgtcccttcccctttattcggggactggacaaaatctcgccgccgaaatttcgccgcccgaaatctcaaatttttttttctaacttagaaaattttcaaggaaaaaattcttagataattttgaaaaaatttaaagaaattattttttcttaatttttatgataattactgttttttcgaaaaatttcaaaaaaaacttaataaatatttttttttgaaattttcttataaaaaactttctaagaattttttccttgaaaattttccgtttgaaaaattttttttgaaatttctgcggcgagattttgtcccggcgagatttcggggtgtacccttttccttctcccctcctcccacctgttgtgagtgtccgctgccaaaacagttttcccgtccatgcacgcgtataaacaacgaattcgaaaaccttcgaacattttggcactgtcctcgggccgatggatgtcctaatttgggaaagtaccgttggtcagtcagtggccctccactttacggattaaatttattttgaaattgattcgctcacataaacatgaaaatggcctttttcgccggcacatgccaatttgtgggagccgtctttgaaaaaggcgacggtggtaaaggcatcgccggtgtaatggacgtactcctaaggacaaaaagtcttgaaagggaagagaagcgggggaacgaatgccttgacgagacgaccacttggcacgaagtaaatgaaacacttaagggggggggggggtgaaacggacgaagggactgaaagaccgaccccgactccgttggcctgctcagtgctggtcaccgccaagtagcgactgtcctgactccaggagagggaagaaatgccaacaatttcctgcagaatgtggatgttctggtggatgtgcacttgggtgggactggaatgtttcggtcggttgattggccattgttgcactcgcccacctgatcacccgccagatcagcacctgattgcctttggcccccgaggcaaggtaattgccgcaggggaaaaatttgacgcaccaaacttcggcattgtgcaggtaaagggtctgaaaagggggc

SEQ ID NO: 11161 - DNA, 1785 bp, Heterodera glycines
ccccccgaaaaaattaaaaaaaattttcgtccctagaaatttttcataaaaaatttcttagtaagaaaatttcattttcagcgattttttggaaaatttttgaaaaaacttagtagttcatcataaaatttcgaaaaatcgctgaaaaatttttcaaaaaatttttttcttgaaattttcatattaagaattttcctaagtttttttatgaaaaatttttttaaaaatttttcgggggggggaacgaagtggggggggggggaaccggcggtggggaaacgaagtgcatcccccaaaatgaatagcaaaaacaggtgcttattttgcggtatttaatgaactgacattgcttcatcagttcctgcagtctgttcgggggcagcatcagcgaaggcggaaggacttttctgagagtgctcagcacattctgtgcacttccgcccgtctcggcgccctcccgcggtgcttttgggccgatgtcgcgcgagcacacaacggtggcccaatgttcgtgccggggaagtaactctctgcatttggggaagtccaactggagaagacgaagtgccaacagaaactgagtggggttttgctcttatatttttcaacaaaaagaagaaattaggcgatgcgaaaaaggccgctgggattttaatcggaacaggacaaaattcgccgtgaatatgaaaattttcagaatttttgtattcaaataattaaagcttaagaaatttgaatttacctcccaataacataaatagtaatcccttgtctaccaaaataaaccatgtatcgtacaaaggcaattcgtatataggcaggcctaagcttaggctttattttttggaattttttattgtaagagttgcctgtgtacagttagttgcctttaactcaaaatcgctgaaaatttttcaaatgtttttttcttggaattttcatataaaaatttttttttttttgaaaatttttaagaaaatttcggcggcgcaattttggagcgccctttttaatctgatcatctgataacaccgtgttattcttctgctaattcaatttcgctttccgatgtttttccctttttttcttcgccctttccaaagtgtccctttgcttttcgttttttacctcgccccgttcgatcagctctttgaagcgttcctccagcaaaagcactcgcaccgtcacatattggcgttggctgagttgggcccgcaacttttccacaattccgagtgccttttgccattcggccatttgcactaaatgttgaatgccaaatttgcctacatttctccgccccaaatttctgcaaatgattaaactgaccgtagtcgcgcagtttctgcgacaacggattttcaatgcggcatccgctctcctcgaccagcgaatcgaccgtttcccttaattgggttggccatccattggatccttcgcctattggtggtcccttccttctcacatcattcccaactcgcgcagatactgcccgatgatacgcacggtgttcttctgcagctcagtcagcgcaacggactgatgctgccgcaaaaattgcgttgtctgacacgtgtggagagcagagactgaaaaacgaaagcaattaaaaaataccaaattcaacaaattttgggatatggggggattagtcacttcactgtttgcatcccgatttttaatttgtttttttttcactggaaaattggcccttacgaacgacaaattggtgggagcgtgggagaactcttttcgacttatattctggtttttgtcaggaaaaat

SEQ ID NO: 11162 - DNA, 1861 bp, Heterodera glycines
tacaaaattacccatattttgcccatttccaaatggccttaaagccgtacaacgaatgtgccgaattcaattttccaaatttccaccccctcccactaataaatgttgaaattcgccttagtccggtcacctcgagattgtaacgcatcacggactgctcatgtattttcttgtagtgttccttgcaactgacgccgagttgcagcatttcgctttgcattttcaggatttgctgctgctcttggaacgccaaaggcatccgcgagtcgagcgactcgaccgcctaaaagagttacggaaaagtaagtgccaagagctgaggagtcaaacctcgatcaaattgttgacgaccgctggagtcgaagtgacggtcgggtcgatgtcgggcaaaggcaatatttgaaaggcatcgtcggccaatttcctgcaaagaaacaaaatcagaatccgaaccaaatttctcattttgccggacttgaatatttctggcacttcggcacactctttaacgctgaactcagactccgctaccgacgatacattggtggaatggacatcgtctccgatactcggagtgaacgtgacgtgttttttcatttttaaaaatcaaattgcaaacttaaatggttaaaaattcataggttatattgtaatttgcaataagagcgaaatactaaaaagttataaaaatacgtcgcactgaaatgtaccgcactaaatgaccctaaccgtaatcttttgattgactaccgtaagaaaagaaatttaattttggcagcgccaaatagataatttgagtaggtggtatgcacgtctaatgctactgctactacgactgttacatttatttcttagtgtttaaatccgaacagggggggggggggggtgggggcaaaaaaagaacccaaaaacggggtcggttacataaaagctgcatttagcggtttcttgtttcttaatatcagtactagctcatttcttaaattataaattacagagaaaagtcagtattaccgaatgtctgatttgaccacaccatctccggaagtgacaactgatgatggcaccacgccacaatcatcgaaggtagcaggtttaaacttcacgcaacgggctgacttgtcctgtttaggctgctgagaagaccggacaagatggatgcaactccgccgccgcctctgttgatgatgatttggcatgtgcacagatggtaagaaaaggcatttaatataaacgtttgcccccccctccctctcgcatgtaactgcatatagccacgaaatggggactccttcgaatcaggtgtagaggtgggggtaatttttcataaaaattgtaattttttctaaccaagctaggtaacaaaaattttgatttaaaaaaaaaatgatgcggcgacgttttgtctacccacgcctctccctctaccccgctagccttaattcataaacggccagaccgaccccccccccccccccaccccatttaatccgttatccattcaactgccaaacccaaatcccttttcgattcgcattcatattccatttccttttataggttctgtcgccagcattcgagaacatttccgaagattcatcaagtcctacaactgattctgcacacattgtcgacgcgcatgctcagaaggttgttttttgcgattctgagaagtactcgggggtatcgagggcgctgatcacgaatctgacaccaccttgtcataaaaataatctaatctatgatttctcatcgtgatttttcgtcaaaaaattgttttgatgggtttttactttttttcatcagttccttttttagggctcgtcggcagcactgaatttgttcagtattttggactttg

SEQ ID NO: 11163 - DNA, 4325 bp, Heterodera glycines
  misc_feature (23)..(23): n is a, c, g, or t
  misc_feature (26)..(26): n is a, c, g, or t
  misc_feature (39)..(39): n is a, c, g, or t
  misc_feature (56)..(56): n is a, c, g, or t
aaaggtcatcaaaatattggcgncgnaccatcattcgcnaaaattttgacgaccancctttttttaatgtatgaacgggacatttgtttatatattaaaaaacacttaactatttcattataatccctttttatccctttcccatgacttctcttctcattctctctctctctctcccccctatctctctctctttctctccgccttttttctatttgaaaatggcaaatgcgccattctctcccactattttccatttaaaaaatgggccataaaaatgggcgaattccgtccgaattgcttttcgaattaatttctgctcttccgtttgacattcgatgggccgttacccgggtttcccatgcttttgatggttttttgtggcagaagcaattttcatggattaaagctgaactgatccgcaaaatgcaaaaagttggctgattactcacaaattactggcattttacataaaatttaatattggcaaaataatgttaatattgagcatgtttgaaatgtttttttcatttagaaatccgtgtttcttcaatcactccaatcgctctccaattcggccaaacttttgccagaggaaattttcgagcaaaatgaagtgctcttccacgaccgtattcagtgtatgctgacatttatttatacataattgttattttcttctaacaataactcttatttattttcagatttccattcggtacgtaaagcgatcgacagaatggcagcaaaggttggcaaatctcagatattcaggattctcgcccatggctcccctagttgtttcatttgttttccattttctcgtgtttaggtcgcaggggccttaattagaaattgaaaaaaatgttttattaccatcacattatcaattatggcttcattagcattaattgtcgtaaattacctagttcttccccatgcccttttcagaccactcttggctccggcttcccctccgacttgggcggactcggcacgggcaccggcaccaccttcgtccagccccacaactaccaattcggcaccgcccttttgggctctttccactcgtcggacgacagtctgtccgtcaacatgaactgtgccatgtttgcgcccgaagaactgacggtcattcatttgttgccgttggcattatcaatgaaattttctattttaggtgtctgttgtgggcaaccaaattgttgtggtgggaaatcacggcgaaaagcaggactcacttgggtcgatgtgagtgtcaaattgaaattagccaattaaaaccatttaaatttaattcgtcggattagtgagcgccgatttgtacacaaattttccatgccgcgcaacgccaccgccgactcagtgaaaagcaatttgaccagcgacggcgtgctgacggtgaccgccagcgcaccaatcgcaccaaaaacaaaggcaacaaactgggcgagatgggatggggggaatggaatgaaaataggaacaatacatctgttatatttagagttgctcggtaccggtaccggtactggccggtaattaccggttttttagcaattaccgattaccgagcaactctagttatattatttaaaaaacaaatcttttgatggtttatttggcattagcaatttgtatgggttggtgctaatttataagctaatccgcagcaaaaagtgggctaactcggtaattacggccatttttaagatttaatattggcaaaataatgttaatattgagcatgtttgaaatgtttttttcatttagaaatccgtgtttcttcaatcactcgaatcgctctccaattctgccaaacttttgccagaggaaattttcgagcaaaatgaagagctcttcaactaccgtattcagtgtatgctgacatttattttgacaattgttattttcttctaacaataactcttattttaaccattttcagatttccattcggtacgtaaagcgatcgacagaatggcagcaaaggttggcaaatctcagatattcaggattctcgcccatggctcccctagttgtttcatttgttgcatttttcaattttcccgtgtttaggtcgcaggggcccagcacatcggtggagacggcgccggaggaagtgggatcggccccaccgcaccgaagcagacacgcttggccagtgacgaatcgatttaagcaacgattatgttgagaattttcgggaacggctttccataccaattctcgatgtcctatttcaatgacttatttggttttttacgatttctttaaattttttaagtaattgtctcttctcataatcagacgatgcattagagacggataaattatttcggtctctgtccatttaatttgcttcggtaattaatctattttttttactattttttattgtttttttaaattgttttttcaattttgatgccattgaaaattgttacaattgccgtttcgccctctttcaactttctgcgtcgtccgttgccttcgttggactttcgtcgttccctttttaaaccgccattggactcgccgttctgtggcatttacaggacaaatggcgaaatttgccggacggatgacattttggtgtgccaacgcaagatgaactatcaccctggagcaaatgtacccaggatttttgatggattgaacacaaaaattccacattaacctcaatgttcccgtgtttcaggtccgccatcaacgggaccggaaccagcacttgttgaaagcggtctgtgacggaacggttgtgatcacacgcgagcactgcgaagtgaacccgaagaacgagtggatgtacgcgcagtacgcgtaccgcgactttgagaacatttacaagctgaccttcaacgtgataccacgacggatgtccaacacatttaaactgatcagcgaagaatgaatgaccgacccgaaattttgtgtattttcgttgttttttatgaatgaatagtcactgattttacactttattcctattttcattcgggcttttcttgccatttaatttttgtttatttatatatatatatttttgctaatttgaatattttccattcattccaatggaagcgcctaattcgccgatggcatcggcacagaacaggggccatggcgttgacccgtccactgtcagtgccgatttaaacgacatttgtggggacaccgacggaatggcaaatgaagaagaggcggacgactctattgtgaaggaaattgtgacggcattgttgtcgggcggaccgttcccagcagcggaagagaacgacgagcaaagccaagccatggagcagcaacagaccaatgggacagcgatggatggtcagagtttgttggcacaccaaaatggtgtcaaatgaaatttgtttttttttaaatagaatttggttggtcggcttgcctaagtttatgtgttcagatgcttctttttcatctgggctctctcctcttgcgtccgatgctcatcaaccagtgctatttgcctcatttttcgagttaatttttttttgcaattcgttttacaccgaattagccgacaattaccgagtgatttggtcaattttcaggtcccaacttggtggaaaaaagttggagtgcggtggccatttgtatcgacggagtcggcaccggggcgacagcatttattggcgctgtgaccaaaaccggcgctaccgctgtgccggttcggcgcggacagtgggcgaaacggagggaaccgaggttggcacaaagctgcaaagaacttggcactccgctccgttctgaaattctttatacttttgaacccatccttctgactcccttaccaaatttgaaaatttatgaaaccaaaaaagtgctgcatttgtttcccgtcgtctaaaggtggagctgggcaaaccgcacaaccacgcgccgtgcccggcccgttgtgcggcacagcgactgacgcgtcaaattcgccagacagcactggctgcaggcggatgtctgcctccccgagcagtgatcgacgaatgcctcgcgggtgcgtcggacgatgtgcgtgccgcgttgccccatgtgagtgtggcacaatgttttatggggggacgggggtagagaaaggcggcacagtctaaaacaccggtggccaattcaatcccatacaaaatcaatgcatctgcaacacaaccacaaggttgagtcgctgaaacgtgccgtgtcccggaaacggcgcagtgcggacaatctcagcggcatcaatgtccatcggtttcagcaaccgacaaaacagcaacagcagaaacggcatccgaccgttgccgaccaaaaaactgattttgcaatggttc

SEQ ID NO: 11164 - DNA, 1199 bp, Heterodera glycines
gacaaatccatgcatttgccaatggatgaaagagtgccaatgcgaaagaagcgatgggaagcgatgattcatggcaatgccatgccaatccgccggtggaccattcattcatttcttcacccaaactcagctgtatttgtttctcatttgtcagtgttttctccttctcctccttctctccctgtttgtctttttgtccccctcttccttttcctcctcttttatttcacttttcttttctcctcttatccttaaattaatgttccttctgttatttaatcttttggaaattaattaattttcttttctttgacacggaagactctctttgtctttctctctctctttctctctctctctctttatctctctctccctctctctctctctctttctctctctcttttcttttttttcgttcgcttttcacagatgtttttattctgtccgttattcattcgattattaaattgtcagttcaaattccctagggcaatgttttgctatatttaccagtgttccaagtcaaaagtcttacagtttaattaattaattaagcaaaagtcagtcgatggatggaacataagtcgaatcattgaaaaaacaaacaaacaaaaacaatcaaatggaaatgaaaataaaaacaaatagccaagggaatgccatttgaaaagaggacgaacaaatgccatcccaaaaggggggggggggtgggcgtcgaatatgcttttcttgcaatccgatgcttctccgaatctctgtcccaataaaaattatgctaaatttcaatggcattctcttttatggcatttccctctgctgagaagggcggcactgatttaagcaacagcacaaacattcattttggtgtgcccgacattcattcttttcgtcatttgtcctcctcctcccattgctttggcatccgttcgtttgtctgtcattttcgttaaatattacctccctttttttgctaattttgataagctaattattatccttttcgatattttttcatttttttgtcattgcctttttttaatgatttagccttgtaaaaccctaaaaatgatgccgattcttcgcttgacaaatgggcgagggagtgagtacgttttgtttgaaatccttgcagcactcattatacaataattatccgctttttttcctgtcgctgatattacttcgctactggacgt

SEQ ID NO: 11165 - DNA, 2527 bp, Heterodera glycines
tttaatttcagcaaatttttcactatttgcttatcctcctaccgtttctttagcaaatatttctctgatttcacttctaaaatgcatttgtttcggcttaataattctcgcgaaaatttatgtgctttaaacgatggcatttttgacagtgatttacgactttttctcgttggattcattggttcctccgtttccattgtgagaattaattgttggctatcatttggccaatgttttttcccaggcgtcgattttgcagaattcgcttctcttttatgttttttccacttcccgcaaattgcggcgacaaaactacgtgaatccggtgggcactgttcaatcaacgcatccctttaacaaatttttctattttgtttaattttccgttgggttactattattagagcttggaattttgaaaaattccggacccgatcgggaccaaaattcgagaaaactgcctctgctagaccggatttcgagattaaaatccatttttttgggatctcggtccgggtgcatcctttaaaatacacccgggtcccgaaccgtccggcctcaattaattgtagtcaaaagggggaggggcgtgtttgtcagcacattaaattttaatttctggatgtttcgccaattattgacctctcttttttcaaggtgttgttggcctttttcgacattttcgtctctctcatttatttgctcatttcgcctgtccatttcgtcgctcatcgcctccgttccccctttttggcctccttttggtcgtggcatgttcgggttttctactgccttcaggcatttccgcttttaaacattttcaaaattcaaaatcattggcaccgtttgctttcgcttcagcacttcgcgctgaccgtgtgcaactttctgctggttgtggccagtttggagcggtttttggccaatggtcccctccagtcccaagtcctttggccaattagcaaatttaattgacttggccatttcaagatgtgtgtgctggtgctgatcgtgcgcaacaaatcttgcgtgatcatttccattctcgcctttgcttttgtgttgaaagcaacactttacttcgaaattgaatttcttccgctgccgaactgctcgaatttgacggacatcagtttggactttgagcaaaggtgggacatgcattctgatcactttggctttctgaattgattcattcaccgatcatttgctgtttctccgttttagcgttgtttccgtttgggtgacggaaagtggcggactttttcaaatctttcgcttttgggcccgaaacattcttacggtcattctcccattcgtcgttctcgcctattgcaactgcaaaattgtgcaaaaactgcgcagacgccgtcggctgactttggggggtggggagagaaagtaaaagttaggaaagtgagcaaaattcaggggaatattctgagtcggtgataattagccaaacaaacgaagttggccaagggaatgagcagcagacgacgaggagggcagagacacaactgacaaggagcccaaggacactgatcatcacgcagagaaacagcgaaaagtgagtgagcattgacagacggacagataaaatggccaattaacgatcagagaattaaaggaaccctacactccgaataatgccaaaggacacaacggcatcgaatgggaaaggcatgctggagccgaaggcaattgcgagaagcaatcagcagaaggaacagcaagcagacagaagaagagacgaaaagccaaagagggagagagagaaaaggcagaagtgagagagcagagagacaataaaaacagagagagagagagagtgtgtgtgaaagagagagagagagaaaggggggagagagtgagacagagaggggggggcgagagagagagaaagagagagaccaaaatgaattaaaacttggaaaaacattaaaagcaaaattatcatagcttgaaattggagacaacagaacgaatcagcttgaattatttaatgaaaactccggtagcgggtgataaaccaaaggaaatggccgaaataatcgaagcaaaacgatcggcgaagaatagcacggggacggcgcccatcacaaacaatttcggagttcgggtggcaacgcgaacgctggtcatggtgggaagaagcgaacaattaattagggggtcattaagagcaattagtgaaggtggtcggctgctatttgatctccaattcgatgagcacttttctcaacatttgggaattttttgacgcacagtttttgcggcataaaaatctgcgcatttatttgacagtttcggacgttgcggcattggtcggttttcagggcattttctggattaaacttgtttattgtcgtcagttgaccatttgtggctgtgcccttcggctgcccatttacgtatgcaacgaccggcgaattcgaagggccatttgcagggcgatcattcgctttcgcttttgctgttcgaaagcgaagcccgaagaaattgtgcggggcgaagaagccgaaca

SEQ ID NO: 11166 - DNA, 1859 bp, Heterodera glycines
cagagagagagagagagagagaaattggaacgaaaaaccgacagacactccccggggacatttggccaatgactgagtcggcatgggaatagtttcttcagtgggagcgatctttccgcttcgtttcacggaagaaagagcactaatcagcattagtcctcataaatcacttcatcatctgtccagcaacagcaaaagtcccactcattccaacgacggacggattagtcattagtcgtcgctctcaaagatcacaccgcccccccccccctctccccatttttgcctgttgtccttttaatttgtcattaattacataattactctcttaaatggccactccgctcctcaccattgatgcctgttagtcaatccttcgtctgtccgtctcctccaattcgtttgccattggcaaataaccctatttttgtgccctgatcacactgtatcagcttcccattagctaattgtgtccacaaaaatgttcggtcgtcgttggatttgggacagttctaagccgacgtgagttgccttcgttcgttgggtgcttctctctgctgatcagttctgtcaggaatcagttggaatgggctcctccgatgcgaattatcgccgtgatcactttgctcgcctccactttggatctgatggcggactttctgctctgcagcagattggccgagtaccttcacaacttccaggtttctgtttccctttgtgccctttgcccatttcgactttctttgccctttccgacggaattcgcccgttattgcgccctcggctatttctttttcaccggtgtttccattctcgtgtacgtcttcgaaatggtcgacgtgtgtctgacgcttaaatacgacgaggagaatgttttcttcgcgcgaatggccaagtcaatggttttggtgctggaagaggttagctttggttggtggacagggcagcgcatttctggccaatttccaaccgattggtctctttttgccggtttttggtgccactgttttcaaatggttgctgatcaatcgcttgttcggtttcattttgcttccctcggcaggtgccgttgcccgccctgctttaccttctgttcacttccgagccgcgtctgtccctggctaatccgatgcatatcgcctcgtggatcaaactgatcactctcagctgggccatagtcaaatttgccaagctccgtttcttctggccactgctccctttcaatccgaaggtgcttcttccaaccccccccccttttctgttttcccttttttttagcatgacaaacgcgaaaacattcggcgatgtttccatctgaacctttacagaatgacaatgatcgtcgtcaacgctttccatctgttggccattttcattgtgattaacaatttggtggtgtcgcggaggggcggaaggtcaatccaagcgcaaagttcgctttgaatgaacgcccttttccgtccgtttttgtttatttggcgatgagttgacaacaatttgtccaaattaatttttgttaaaaaattcgtaatttttaataaataaaaattgtttccttgccaaaaacactgacaatgagtaaaatgaaggccattttaatccaaaatgtttaaaatagaaggttgcgttttaaatttatgagataagaatttaattttattttttattcgtccgtcgtttattttgtttatttatttttacccgcgtcaaacgaagaaatcacaatgattagcgaattggtgccattttatgctgcttaacactacgtcaaattgaacattcgcttcaaattatccccaatttcctccacgttcattccgtccaattgtaatgattcaacctgaaaaatgaccgattca

SEQ ID NO: 11167 - DNA, 4699 bp, Heterodera glycines
  misc_feature (4591)..(4591): n is a, c, g, or t
  misc_feature (4619)..(4619): n is a, c, g, or t
  misc_feature (4638)..(4638): n is a, c, g, or t
  misc_feature (4651)..(4651): n is a, c, g, or t
tggtttgggatgcgtttggcagccacaagagcgagagaacgacgaaggtggtgaagggattgggagtggaaacagtttttatccctggcggctgcaccaaattcatccaggtaccaaagcatccttctcaatgaaattcacttttcttccctaggctcccgatgtctcgtggaacaagccgttcaaggagcgaattcggcatttctacaacacttggatgtccaatgatgcagaaaaagagttcacaccggcaggcaacccgaaggcaccagcgcttcacatggcacttgactggatccaccgatcgtggcaggaaatttcgtgatcatcaaatcattcgagggtcagtttaaaaaataaaaatgcctacgaaagacgcagaaacttttaagtctgtgggttgactacgccattggacggaacaggagacgaaaaaattgcttgtttcaagccggaaggagcaattggactgattgggatcaaatttttgcgcgactttagagcaaatgagacgatgaaagatggacgaaatgatcaggaggacgccggcctatctgttgatgatgatgtagagttgtatgcagtcggagatgatgatgaatttttcgtttgttaagtttttttatttactgttgatttggttttgttttttgaaaaaaattggtgccaaacaatttcttaaaattctatttatatcccatgggggataaatagagactgggggattatttttcgaactcctcagaaaggggggggataattggagactgcgaaattaatagagactgggctataattagagcaaatacggtaagtctgtttgacaaaaccaacctgaacaatttaaaaatttcctatacatattaacattataataattctcttggaagcgtgtttttccaacaaaaactttttggaacgtgaaaaaaagaaattttgggggtttgggtggtgcttatcactgtcggtggtggaaaattggtaatttttgacatttaacagatttttactaaaagtttgcaatttttaggtcaagttttgaaaagtttaaggaaattttgggctgattgtgccaataagctaaaaatggccattttgaggatttttccaaaaaatcagcaaattttcacaaaaaaatatcccgaatgcaaatttaaatataatttttttcttataaataaataatttttataatgaataaatatggcataaaattaggaaacaaattcataaaataaacattgatattatttcaattatttaaaaatgcaagaaaaatatcaattttcatcaaaaataaattaaataattaaactttcttaaagtaaaagaaataataagtgtaatttcatttataataatgtcaacttatttaatttttaattattatttttttcaataaaattttatatttttcgtttgattaatttacttttgtattttttcatgtattaatattttttattatgtgtcattcaaacattgttcatagattttgcacttcacatttaaaaatttggaaattgattgatcgttctattttgaaataataaatgaataaagaaaaaaaatattacaattaattaacaagttcactaaaaaacaatttcattattatatttttgaattaatatcaaattaattatagctatagttggctcttatgagtttctctttgtcaataataatttcaattttttggcatttattataaaattttgttcgggcggtcctcccctctgctgaatggttgagccaatggcgccgcgccttaagtacaatatggtctaaaattttactttatgattgttgaattgaattataaaatttaattacttacattatattataattatatttttccgaaaaaaatagataatagtcagtatattataaattagatttatcaaaaaggattattgagtaaaaaaaaattaaattaatttgttaaatttataaaaataattgtcttaaatacttttagtttgctatcttttttggttttattttttaaattaatcttttatttttttattgataatacaaaagtattaatctgattctttttgagtcagtattcctttttgtaattcattgctttaatattcaagttttacattaaaatcttttttttttttgtataaagacccaaaacatagtttttagggaattatcataatatcaattacgtgaaataaaaagatataatattattttttcttttattatttttatataaggcttaattgaattatgtaaactcattcgaaaattaaatttactaaattttttatgtaaaaagattataattagtttaatttgtatttttttccgtttttcaattgaaaatatttaattttatcgtttttttttttgttttacttcttttctcatttctcgtagatgttccgttttaggagtcaagtctacttcgcttcatacatttaatatatttatgtttaatagatatttataatttaaaaccaatcgatcattcaatttccgctacttttttgtcattattttagaattttgctaaatattttaatcctttttagattgaataaaatcattgttaaaaaacaaaattaaaaattaaaaatttaagcttcaaaaaaattaattttaaacgaaccgaaaaaatttctaaaattaacataacctttaaaacagatttaaaaaaattcaaataataaacattttctataattcaattattcaataaattctttaaaaaattaataataactgacaccctcttgtataatttgtgtaatgcataaattactaataatattaataaatatttttgtttttaatagataatttgaagaaattagtttttttatgctgatgacaatatttttaaattgatgttaaattatattatgcccatgaaaacgatgaccattcaaatcagttggataaagcaattgaggctttggaaaaatggtcaaaaataaatgggttagaaatttcaactgaaaaatgttttgttctttatttagggaaaaataatatgaaaaaagaatattttaataactcaaaaaaagatttcagaatcggataatgttcgtgacctaggcattataattgactcgaaacttaatttttcaggacatattaacaaaattgtacgaaacgcttatcttagagttttccagattttaagagtcttaaaaaccagggaaataaagactctaacagcagcttataaaacttttgtccgacctcaattagaatacgctaccgaagtgtggaacccaaatttaaaaaaggacattgacaaaattgaacgggttcaaaaatttttcacaagaaaagcatttagaaaatgtggtttattgtacaaaaaatataaggaaagactaaaaatcactgatttacacaaattagaagaaagaagaaaaatcaatgatttaacaacagcttttaaaataattaaagggttcaccagcctagaggctgagcaaaatttctttttctcagaaaggcccaggaggcctttacttttacgggtaaagcgccacacggccaaaactcaaaataatttttttcataggatagtaagaaactggaataaccttccagtggtagcggtgcaaattaataaggcaaaggaattcaggggtttactaaaagcaatgagttctgagtaggattttccatgttgccatatttacactatattttaatcacctgtgaatttttaacatttgatttatttttattcatttttattacggtattcattttgtattttttatttgatcacttttatttgtttgtttttggcaccatataagagcactaatgtgcctttggtttgctcgataaattaaattaaattaatatttttattattatttttttttaatttgcataaataaacctactttattttgaaaaattttaatttcaacaattcaaaaatttttgttgaatgattaatttttaaatagggtcggatttttatattttaaaaattcatagagactttcgtagtaggtgagtaggaagataaaaataccagaaaaaagtaataaaagcttttctgaaccataaaacatgtgaaggaattacttttgaaaaaatttaaatgaaattatgaaaaagaataaatttacgaaccgaataaatgttgcaatgaaaatgaatgagtcttaaaaactgattaaaaaacttcataaataaacacccataaattctttaaaatgatacattatgagaatgattattgatctaatttatttgatgaataatttataattatttaaatatattttctatttaattaatgaagtaagtttttttttaataattatgctgatgaaaataattttttataattatttaaattataacttatttttcaattaatctatttttgttcctattcaaataataacgcaaatattttgttttatttattttcacttcttgcgctcagctgtttaatatctttcaacagttgcactcaattgctttattttttgtgttattttgatttataatttttctattcattttcattatttgagcattagtgctttttaggattgagaataataatataagaattatttattanattgaaagttttcatttgaatttaattntgttgacaaagaacccacnaataatcatcagnttgggcgtttttgtatttaaatttttgtttgtgctattttactttagt

SEQ ID NO: 11168 - DNA, 1726 bp, Heterodera glycines
  misc_feature (23)..(23): n is a, c, g, or t
  misc_feature (1470)..(1471): n is a, c, g, or t
taaatatgtgttcatattttacnaaaaagcagtcttgaatgtcgtcgaaatttgtggtaattccatggctatagccccgaccaattgcgctggaattttgccatgaggcttattttttgtgctggtttcgaatttacaggcgcccatgcaattggagcgcattaaattttttgtcgatttttcttcaatacccaccttaaacgataagcatttcctcgcacaccgctctatttgctctgttttaaacaacaaaattttcccaagcattcatacctactttcttaattgcactgggatcacatctaaacgactatgctaaaacggggaactaaactgtattaatatttttaacaaattgcagcccttttcgcctaccctgttaagagaaatcttaatttcactaataatttctcaattttcttctataacagattaactcttctatggtgagtactacaatgtacgagtactttgattatcgatttttttcaatccatattttcggacccccccccccccgccccatacctattggatgatctttgatcccttcaaccgaaacctattggatggacttgtgcgcgagaatttaattaatttaaatttaaattaattatttaaatatttttgtgcgcgactttttccgataaattgtggaaaatcaaaaacatggtcgcggtctcgaaccgttgagagtggaagcgaggagcttaaccacttggccacaggggcagttgaaaggtatgggataattgttgactttatgatgaaaattccgaaaaattgtgaaaaatcaaaaacatggtagtggactcgaaccgttgagagtggaagcgaggagcttaaccacttggccacagggtgagttgaaaggaatgggataattgttgactaaatggtgaaaaattttcccctttgcttcaccacaagcgctgcggaggcgggcgtgtggcggcgagagaccaaacttttttttaataacaggaattaagttttattataaacaataatttattatttttaaacagttaaatgtttaaaaatttgtctttaacaaaaaaaattccaataacaattaaaattataccaaattcttataagaaaaaaataatgcattgtaaaaaaagtaagttacactactttgattgaaaaaatattggtggttgtctttgaatatttttcatttcttcaatcatggtttccgcttcgcttggggatatatgacctctcctcttgaggaatttaattattatgaaccaacagagtagaaaaacagggaaggcaaatgcataatgtgaaaggagcaaaagagtgtcattagtctcatctgatgaacgtaacacctcaattccttctttcgtcgtgttattcatttttctcaaatataattttgagctttatttataaatttacccaagcttcgagtcggagacaatgtgtcgattataatcaatcataatcatttggtcnnattctccgacacccctcatccccactcctccctttggaattggtgaatcaaatgtggccctaatactggttgtaccgcttctcaacagctcaaatccacagctatcgtctaaggttgaattcaaagagatgacaaaaaaggcccatccatttttgaattgattcattgaaacgtcaaatgaacgttctgaattagccatgcccaacgcttcatacatctccacgaatgctcttacatagtaattctttgaaaaat

SEQ ID NO: 11169 - DNA, 2131 bp, Heterodera glycines
ggtagagaagtgtcattagacaagctcccaagccatccgctggagagcttctttgcccgtcggattcgtgaggcccaactcatcatcattgatgagatcaccatgcttcacaacacggtgattgaggtcatcgaccgagtgtgcaaagagatggcaattcgccagcacaaggatctcctcttcggagggaaaacagtcattttcagcggtgacttcaaacagtcgctgccggtcgtgcctcatgaaggcttaaccgctcaggtgacagcctgttttcaaacatctccattgtttggtcaattcaccacgatgaaattgaccatcaaccagagattgggcaaaggtcagcaagcgtacttgcaaatgtgccgccaaattgggctcggagaaaccggagagcacttctggattcctcggcagttcctcgttaagagcaaggaagagctgatagactatgtctatcctaacttccaacaactccttggcaatgacaaggagctgctcaatcgtttgattctcgctccgcacattgacacgtgcgacgaagtcaacgacatcatgatggcgaatgtgccaggtcatatgcgggaatacttgtccacggataagccccttgacgaccgcccactggacatcgatgagatcgagtccgaagtggctgcgttgaaccggcgcacagactcgggcatgcccccacacagtctccggcttaaagtcggatgcgtcgtcgtccttcttatcaataaaagtgataaggaaggactgatcaatggcacccgcatagttctggaagaacttggcgatgatcgcctcattggtcgtgttatcaatagcaatgctattggcggccaagtgaagttctttcttgaaagaacacgaaatgtctatgaagacaaatcgcctggcggcataaaatatgagcgtttgcagttcccaataaagcctgcattcgctatgaccattcaaaaaggtcagggccaaacaatccacactgtcggcattgatcttgaaagggaagtattttcccacggtcaattgtacacggccttttcacgggctacggacggaaacaatgtccgtgttcatgctcccaaccgggatgttgacgcccaaggccaggccaaagtgcttaatattgtagctactaatatgctcaagttacaataaatagctatagtccagagcagttgggcacatggtttttggagagatgccaatcccattcccatctgcactatgttgggtgcgaaaatggtgagaagcttggatccgggacatggaccggtcagccctctttagggcctacaggtgaattgccatttagcgctcaacccaataacgtgccaacgcctggactaagggagggaggagggccatgacgtgcaacgttagggcacttccggtttgagtaccggggactgatttgtcacttttgtttgcatttgaaggcccctaactttttttgtaaaactcgaatcaaaaagtgcccgctgaaagggcactccgcctaagggtcctctacaaggtggtattttttaaaaatttttttgagcaaacccctggcctgcaaaaaatggcaactgaagcgtgctcaaaaagtacacttcagtaccaggtgaataccgcgccagggtttgatctgagcggggggtggtcagcgaacttattgtagagctttcaaagctcgattttttgaaattttaaaatttcgaaaattttcaaaatttttcgagttaggcctaaaaaacggttttcgggtttttgaattttaggattttttaacgatttttcccagagaaacggagaccacttccaaaacatagtttttcgagctctatcgactggtatttttttcggaaaaatttcgatttttttccggaaatagaaaaaaattttggcctgagcgggacatttgagtcccgggcccataactcgtcaggcgtcggttttagacaaaaaatgccttagagcaaaattgtagagctttttaagctctatctaatggtatactatatgtagggaaattttcaaaaattttcgagctaggccccctagaaattttcaaaaattttttttgggttgaaaaagagggagaaaaatatttttctggggtaaattagggtcctgagca

SEQ ID NO: 11170 - DNA, 2071 bp, Heterodera glycines
  misc_feature (2034)..(2034): n is a, c, g, or t
  misc_feature (2061)..(2061): n is a, c, g, or t
catccactcgttcactctcatttccccctatctttggggcgaaatcactctctttatcccacactgccacataggcacaagggggaagagtgccgcatttatcacaaaatggaattttattgcatgatgagtcaaaaggtcattttcgtgatcagcgccataaattaccctagaatgactttttatttgaaaatttcaaggggagtgggtatcataacagaaaagtaccaattctctctcgcatcatatttacattaattttttttttgtgaaaaaaaaaattcaatttatccattaaatatgtaaagttaaattttttgatattgtttcttatagtcttttacaaaaccaacataagaaattttcaagaatttaaccatgtattcgttgtaaacagtgtactttttgatccattttgacccggactacggaactactgagtcgggtaccggctattggatttgcaaaaaagcgagtcagggtccgggtaaaccgtgtaaccgggtctggaactcggtcgggcacccggacccatgtaacccaatgcaatttttaaattttgagactgcggaaatctggatatattaataagtaaagttatttgaatgcagatttttaaatagtttgcggcctgggtgtaaacgcaggccaaaaaaaaattggaaaattatgaaattcgggccaagtaaaaaaaggatggaattgtgctgggtcatactcagaaaccaaacaaaaagagcattactcaaaaaacatcaaatggaacttttttgacaaaaaattaatcataactttgctcaagaataaccaaattgttattcttgatacagtggcggaaaaaagtcttgactcaagatgataaaatttgtagaattttaaatttcgactggaaatttagctgattattttttgtttatgtatatttatttaccccgatatatgggcctttcatataccacaaaatcatttcattccgctttatcattctcgtgaataagtctcctaatcagaccttgctcaaaaaaggggcggaaaaaagtcttgactcaaacttgaaaaaccaccttagagttcatttaaaaacctgaaataattcatgctagcttatcttttgatactgatctaaaaaggcttttacaccaacttgatcagatcactccttcatggtgatcaggaaagtcaaaaatggcttgaaattgggaaaattttagaaaaaaattcctagggggctgggaaaatttttctgaaattttttgattgggctaccagaaagagcacaaaattctctaccgaattgccttttgaatggtgggtctacgacttgtagatagaaagttatacttggattgaatttgatgacgataaaaatcactattttctaccgtatttcaaaggaaaatgatcaaaaatttgatcaattttgagttgtccaattttcaacccaagtataactttttatgtacaagccgtagccctagaggaggaagaggggcggagggagagagggaagagggcggaaaagaatgaaagaagaggaagggagtaagagaggaggaggggagaaggggtaataaagtgagaggaggaagggggtatgtgcagggttcccagatcaaaattttcaaaagcctcattttgtgtcaaaaagcctcatttttataaagtttattcaaaacacgcttaaaattttcaaatgatatatttttgagtgcatgatcaatttgagcaattttttgttagaaataagcattttgtgaaattctgagtatgaaaaatcgaagttgattttttgcggcgctttttccaaaagacttttagggaacagggggggttcggcggtgccgataggcgccgccgggaaattttttgtaatttttaatgcgatttgttaatactttttctacaaaaatgcccaaattttgtgattttctatcaatctttaagaaataaaggttttagggtccggcggtgacgataggcgccaccagtggaaaaatttagaattttgaccatatttttagcagattttcattnaaaattctaatttttgtggatttttgngaaaaaattg

SEQ ID NO: 11171 - DNA, 1874 bp, Heterodera glycines
  misc_feature (73)..(73): n is a, c, g, or t
gcaaatgtccatttttgctgtgcggcgcaaatggcgcggcgcaaatgtcgcatcacgctctaatagtgacatntaatatatgtacaagtaatccgataaaattctgtcagatgaggatcaatcggcaaaagaatgtaatacatttttcaataaaaattaaggtagaaactctccttttttatttcatggactttacatataattttaaatgaaaatgagtgtttgtaatcatttttttgtactgcttgagggaattttcccatagattttccgattctttttatattattttttgttcaaaagtttgaaaaagatctgggtcattcattcattacataatcataaattttattggatttacgaaaatgaaaatgtgttaattttattttattttatgtaataaatcaatgatagaaactttgatcgtatgcattttcccaacatttcttaatccatttatccactgcttagtttctattatttgttattttggtctttttgttcaatttttggcttttttcccaacctttttttcttatctttcacttttgtccgaccattgccaatttagcagcaaaattttcaaaaaattatatggccataatattttgggtattatttaacgaatttaatatgagacaataattaatgataattttccatttggtagaaaaagaattgactaaattaaatataatttttttgtactataaaaaaattaaataaaattaaaacatcaatcaatcagttcactttctcataattgtgtgcttctgatgctgctgccactgaatgacaattgtttcacaaatgtcacccgataaggatgataaatgatagcagtgatgaacggattgatcacctaaaacaattttttatttttatttaatatttcaaaatattttatgagattttttaataaaatgaatttaatcatttgcaattttattgagaaaaaataaaattatcaaagatttcgaatttctacgttaatcccagatatcttaatccattttcaaacccaattatctcggttttttaaattttttgtatctaataattactgaccaatgtataaaaatttaattaaaaaaactaaattgttgtattttaaaaatataaattattaccggagaaagcatcaaaatatagtgcagaatccaagcagcaatcaccataaatcttaacagctcacagttggacaacagtgaaattgcatcaataaaattgagtcggattatgatcaaaattcggaatggaagcagactaatcgctgtccaaacagttgttgtgaaaatgaaaaccagagatcggagctgtaaaaaattaaatttaaaattgtaaatattttaaatttgtattttatcaattagtctgtttattactatttttcttatttattttattataaatgctacattaaagttttaataatttatgttgtccatattcatttaaaaaaatttttaatttaaaatatggaatttttatttgtgttattatcgaaaaaagaaattttaattgcctaactaaaacaatttaataaaaaaaatatttacaaaatcttcattaaaaaacttttaaagaaatctttttgaaaaatattttttaaaagtttactttgtgtgaaaatgctggtgccaatggtacaaaattggcatttttcactgtcctctgtgatgaagaatttgactgaatggaatctgtccgcaactgttggccccgcttatagcacatcaatcgaagcaaataacagctgaccagcagcgatgaactgatcggcaacacgcaggacaacagcacaaacattgagtagtagagagggtcataaatctaaaatttaattattgaaagataaatagaattttgtgtat

SEQ ID NO: 11172 - DNA, 1490 bp, Heterodera glycines
tcccggtcccgaaaaaaaaatcgaggtcccggtcccggcttctcaggtcccggcaagtcccggtcccggttttggcaaaaattcccggtcccgtggcactctattttgatgctctattaaaaacccaaattattaaataattgtcaaacattatgccaacttatcaaaattaatcaaaatttaaaaaatctgacgaattttcccccaaaacatcaaaaatcttcagaatttctcaaaaaaccacaaaaagcctcaaagcctcattttgaaaatttagcctcattgacctatcaaaaaaccacaaaatgaggctaaagcctcagatctgcgagccctgggtatgtagaagaagagggtaaaacgaaaaggagggaggaagaggtgaagggggttgtgaatttaaatattcgccgatttcgatttaaattaaagacttgcgcattcacttttttattttatttttttaactttcacattgctgctgatttggggtttcatcacaaaatgttcttcatcttcactctgtgctgctttcattcttctcgtctacaccatctctgatcagtagatacccggatttatagtttttaaacaaaactctttcggcattttcgcgtttattagcaaatattttgcactttttttggcaacaactattttagtaccagttttggaatttttagcaactataaatccgctctctctctctgatcagtcatggcgccagcgaaggcgaaagcgttggatgcctttgtacgcgtacaagctgatcattgcgtaaccgttggatgcggtgatgctcagcgttttgttggggcccccgaggtcgtcttggcaacacaaactacgggtggtaaaagaccaacgatcactagggctaacaaaaatatgcacttaaatcggcaaatatttgcataaaatttgcatccttaatatcaaaatatgcagcaaaatgcagaaaaaaatttccaaaattagggattcaaattttgaaaaaatcccaataacatttattcttaattttcctaccaaaaacaaacaaaacacaaactaaaaacaagttttcgtgctttttaagccattaccggttcaggaaaaaaaatgcatttgcatttttgcaaactctccttatcagtactgggttttacttttacaaaaacaacaaattaaaaaagtgtgtgttttgacctaaacgtatgtataccaggggatggaaccggattccggagttccgggcctttttgggtccggaattccaattccggattctgggcggcctttccttttcggactgccgttggtgacccttcaccaaattgtgtgctgttatttaactgtggagtaaaagtggatcatcttggattgagcggtcctcccccatttttaccacgtgaataaaaaattttcgaataaaaaaacgaggctactggaaaccttccgcttcccgtttttttggagtccgctccggccaaaaattcctcttatctttt

SEQ ID NO: 11173 - DNA, 1626 bp, Heterodera glycines
  misc_feature (43)..(43): n is a, c, g, or t
gtcctttatcaagtgatttccataattttgttacccccccccnccagcaaaggaaatgattttttgcctagtttctattttgtgttaaatctgtaaaaggggatgttaaagcgcgttgagggattaaaaatagaaaatagtttcagatctgttcggccataaacaattttatgcgccatgaacagatcaaacagctttcgcctattctcaagtgttggcagttgcaggtattctaaccgattttggtatggaattggcggaaggctgcatttaaaaaacattctcgatttgtgtcgttgtgagttggtcttttcttcgaaactcaggcttgctttttacaacttcgtaatttttttgaattcatttccatttattcacaatttaatatcagtttaaaaatattgatttttcgtttataacttaggaaaataataaataatgagtgatttttggcattttcacttatgagtgataattttaattaaaaggtgttctttcccccaaataaagctttcttttagcatggggcacaagtgaaaagtgccggagattcctgtgttatgtaaattagtttttttgggacaattccatctcgccgttttgtgcttttacaatgccatgggctgtttgccgcgtgaccatttcttcaagccgtcttcgcgtccgctgttcctgttccaatgcctttgccattttgcttacttcctgctcacccgtggggaaagagggaacgaatggcgaaggatgggcaaataaccgttgcccaccttcgtcaaaacggagatttggtcctttagcgaatagaccgtgtccaccaaactcctctccttcactacaaattggtcgccctccaactcttcggcaaataatttctcgtcctccgcaacaattaattgcggtctgacggatatttcgtgttggtccgggtaggaagctgaaaagggacgggatgaatgcacaaaatcgaacaaacacaacgccaaacttcacaaaacaatcacaatcgaaaaatgttccaaaaaatcactaaaaaaatgttctaaaattttttacttggaatttttatataaaaatttggtctagtcggttttatgcgtcccatgccatattatgcgtcccatgacagattagctaaaggcaatatacaaaaaattatactcggaaaaattgaatttggtattttttcattgtaatttctttttttaatgccagtatttgctcttttcttgcatttataaaatctcgagacttttgtctttcgcttggtaccaagaatatgggtattgaccaagtaagaaaaaagttatggcctaagaaactgggtatggtcattcatgggacgcataaaaccgactagaaccaaaaattttttataatttgtaagattttttctttaaattttattatttttttaatttctttagcaaaattatgtctctgcgaaattttggggtgcacccccttacgcacccgacaaagggagggggggggggtaaagaaaaagattaattgtaatctatgattccaacataatttgagtcttgtttttttctctcaggttcatgtacagtcactgtgtaatttctctgtctcgcactacgaaaggggtgagacagacaaatagaa

SEQ ID NO: 11174 - DNA, 1122 bp, Heterodera glycines
aaaaacgaagaccaaaaaaagcaaccggccaaaatcatttccaaatggtgattcagccgtatattcacaagttctgtcgtaacattccgtgcaccatcagcggagtcgacaatcttatcatgccccacttcttccttaatttcaaaacccatatggttgttgttggttttttttgcttatgatatcttctgtatcggacttttgggcatttaaatccctccccgcccccctcacaaatgctgctgtctgctgttgttcgtcgctttgactcattgtcagatggattccctcgcattttttcatcgcatcccaaatttgcttctgttcgtctctcccaatggtccgtagtgttaatttcgttcccttttctgacggtttctttcttattaaaaatgttcgaccagtggttccgaagatgcggtgattcccatctcccaacagcttttagctttgaattaggacacttacccgacagttcatccatttgtatttcattgtttgaatttctcctccgaattgaaagatttttcgtctcaaattggtttctcaatgcgtttttatccgttgctgaacaatgctccaccagcaaaagtgttcgtccaaaaatggccacacatcttcaccaatttgggtttcggtgtccgtccgttcgctgttttaagccccagccccctcccttctcccacctgtccacttcagtcccttgttttttgtccgtttcggcaacggttactttgccgacgaaaaggaacgggccaagcgaccgctccaaatctctgccaaaatgctcctccaatccctcactttgcataaagtaaagctgcgcttccctttgtcttcgaatgcgttcgcattcggactaaatttactaattccgaaagaagctcaaaattctcacataaaagtcggcatagactaatgaagctctgtaaaggttgcctttgtcgggatgtccttcctaaaaaattgattaaataaattgggattgaaatgttcgaatggagtgagataaatttgctatgtaaagtacaaagcccagatttcctttctcccgactttttttttaaaatagtttggaaaaataaaatcaccaaccaggggtatttctttcaatttcctgca

SEQ ID NO: 11175 - DNA, 1814 bp, Heterodera glycines
  misc_feature (1704)..(1704): n is a, c, g, or t
  misc_feature (1727)..(1727): n is a, c, g, or t
ccagccaatttttccgtccagcgacccttcccaccagaaataacctcgttattcaatgaacatttgtttctcacttaccatccgccgtccaatttttgtgttactgatatcacattattcttgtcgaaagaaagctaaaaacaaattccggttaaataaaatatgtaaacagcaaacttcgtcgttgttgcgtcccttaaagctatgctttgcaatgaccaacaaagggttgcgagctgaaaattcgtgaggatcacttgcattgttatattcattgttagtcgatggttcagttgttaagcatgaatcctttttcatcaagaatatgaaaatgaagtaatattaatgtaaagccatgcgcatgcgtaggatcgaatgatgatggctcttataagggacgaaattgtgttaggattaccgttcattagtccaagccctttctgatttatgtaaatattttgtcatttcgtttttaaaacatttttagttttcgtttgtaacttcgcgagttttattggttttttctttaaatcacattttgaacatttgtaggatttacctagtctattgaaatgtcataaatatgtaatactgttacacaagtttccgtaaaaatataaaaaaagtttcaaaaatttcttcgtactttagcagataaaacactgtataaaaagtggccccataattattgaggaaaaacatttatatacatatactaattgtagtaatcatacccattaatataatcttacaaattttagtatacgtattacgctgaacaaccctttttaatcgaaagctttgacttgacatgactgatgcgaaaactgagtattttgtttttaacttcattaattcatttttaataatttttaatttctttaagccaaaaagataatgtgaagagtgaagttggagatgtgcccaatggcgggacgtcattcactgcacagcttagcgacgatttcactatccaagtaaattgggattgggctgtgtgttcactttcattgtggaaatacaaaaatttggagtttcttttcttcagcctttgaaattaaaaattcataagcacttgcctttttaaaattaattttatattttgagtcgaatacgaatgaggtggtcgattcattcgacaacatgcaactcaaggacacattgctgcgtggcatttactcattcggttttgagaaaccatccgcaattcaacaacgtgcaattgttccatgttgttcaggttttttagattcgctttttcattcattccgattcttcttgaatcttccttggctggcccttttttattttttatttttagggcgtgatgtgatcgcgcaagcccaatctggaaccggaaaaacggcaactttctctatttccgttcttcaacgtgtcgatgagaatgcaccggatgttcaggcacttgtgatggcaccaactcgagagttggcccaacaggcaatcccacccactcttcccattggcactctctggacttacttgtctccgtttgacagattcttcttgttatgcgtgcacttggcgagtatatgggggtcaagtttcacacttgcatcggcgggacgagtgtgcgcgacgaccagcgcaaattggaggggagcgttcaagtgatcgttggaacaccgggacgagtcaatgacatgatcctgcgcggagcactcagttagagctttttgtaanatataaatttgcattttctattnagagactgacaaaataaaaatgtttgtgcttgacgaggctgatgaatggtgtctcgcgggtcaaagaccaaatttatgaagttttta

SEQ ID NO: 11176 - DNA, 5066 bp, Heterodera glycines
ttttcttgaaattttcttataaagaaattttgtaagatttttttcttgaaaaaattctgtttgaaaaattttttaaaaatttctagcggcagattttgtcccggcgtgattttggggtgcacccattcaaaatttggattccttgtgcttccccatctttttccttccctttttaccctgcactgttctgttgttgaattgtacgtccaccgtgtaaatgccaacttcgtggggtctgaacgaaatttcggtgctgtcgtcgggccttcggtttgtgttgtgtttgaccttcgcaccggacgggtcatggacatcgacctgaaaacaaagtgaaatttaaaaagattactttaattgcattgctttttaaaatgtaattttggaaatttgtcactttcagcataaattgtcacggactgacctttagcccacccgaatgattgttcgggtcgaaaatcatcgatgcttgctgaccacgctcaatggcataatcttaaaattattaataaaaattaacttttaaaaaaattaattttaaaatgattccgttaaaaatgccggaataaaaatgggattttgatttttatggcgattgtcttaaccaagtgccgctccgtaaacacacggctccttctgctcttcgaccaccagcgaaaagggtgagcctgaaattatatgtttaaatttaagctacgatcatttcaaaccatgcacagcaaagccggccaatttgagtgccaatttgtgaggcccaagacgagtgggcacaaaagtgaacgactcatcgccggatgaattcagtacctgaaaaaaacagcaaaaataatcaggtgattttaaagcaattgtcgaccctgtccagcttgatgggctcgttctgagggtctgtcaattcaactgccaatgggccggtgccagcaccttttcgactgactaaaaataaaaaattaaaatgaattaagcaaaatttctattataattgttgaaaaaaaaattttaaacttgccaacaaaattggccatcgttcgtattgtgaatggtctgtccgcaccgtgcacttggactcttcgtgggtccacaacttcgcaatggaacggtgagccgggcacgggctgatcgccgaacatcacttcgatggaatgggcacctaaaaaatattgaaaataaattcgaaaaaataaaatgataaaataaatattataaaattgtataataaatataaaataaatttaccacaaatttccggagtgaactcaacccaataactgtcgtcctgctgtttgtagcaacggaccggcaaaggactgccctgggggtctaaaaattgggcaaaattaattgcataatgaaaggcattaattaatacaaaattaattggtatagaattaattaaattaaaagggacaaaagacaattgcaaaagcaattaaaaaaagttaaattaacacaaaaaaaaagcaattagctgaacaaaatggcaaagcaaacaacaaagaaattgttgtgtagttagttaattagtaaagtaattaattaattaattgaaataacatcagaattaaatgattttcccaaaatgtaaatctattgaaaatctctatagatttgaagttttggttttctaaattttatttttcctaaatcgcactcgtcacgacgacgtccaaatcgcgcgacgcgctcgttgtgcccggcgacacttcaaagcgtgccgttctgccgcgttgtgctttggccaaagcgtcgccgcgtgccaacggcgccccctcagcaccaacaacgcattcgtagggacattctgccaaagaaatgaaaaatttaatagtaattcagggtttaattgatcgtttcacctggtaacatcatgccatcaatcaaaattgtctaaaattaataaattgttttattatttccaaatatattttgctaaaattaaataaaaaattttatattcaatttaatcataatataagtattaaaaaaatatttattgactttttaaaataaattttattatgtgcttttattttttaatgttctttttcatttcttcgaaatatatattttttttaaataattgttttttattttttcaaaaatcaccaaaaagtgtagcccgggaagtcgcggagtgaatgacacggcgttcacaccgcgtttctgccgtttcattgtgcacttcacctgaaaaggagggaaaattaatttatttgagttaatttacaaaattaaagtgcgataaataaaatggaggtcattaagggaaatttgaaataaaattcaatttcaagaaaaattttaaaaatagaaactttttcaatgaataaatttaaaagtaaaaatggtttttattaatgttattttgatttcttctaggttgtataaaggaaattaagaaaattatgaagaaattaattgacgagagcatgaccaattgtcaaaccaattcatttaacaaaggctattttcattgggcaaaaatgaaaaaaattaacggaaagcatattaaaaattattaccatttattacaagggaaatgaaaatttggtccttttataaaattaaaagaatataaattttaattttttgacattattgtacaattttaaatccattccattaatggattgattatatgaacgtttaaaaatgctaataattttcataattacaaattgctaaccaattcgccgctttcgtgttgcacaccgacggatgcccattggccgccggaattggaccaatccacttgaaaaagaggggacagcaaacattgggcacaacaattcaatattatgggggggggggtgaacaatgggacagcgaatggaagaatattttgtattttggagagaggggagaaaaaagggaaaaaggaaaaataaattaaaaaaacaaaataaattacttaaatttatatttcaaaattttacatgaaaaattctgctcaacgccggcattggcattccgaagaccaaccaatcggacggcggacaaatccaacacggagacgggcagcggagaaccgcaaatgtggcgggagccatcgcggatgagcacctaaaattgggggaaaaaattaaataaataaaaataaataaataccaataatttgtgtaatatcagtgagaagaaatgaatgcaatttttcacaaaattgagcatggagaatttaaatcgaagaacaaaaatcaaataacgtaaatatgttaatttggatattttttttatttttgaaaaaattaatctaataaatcaaaaataaaaatagaataatttcttcatattgttttagcaaaaagttgtgcgtgattaatattaatttgaaacatcggaacggaaaaaatagaaaaaatgtcagaattatcagccattcatcgaaaacattcaaatgggggggggggggggatgatttgttctcctcaaactgattaaaaaattaggaaaatggaaatatatggtaatataatttaaaaattttcatttgtattaatatccttaaaaataccaaaaagtaatttataaaatactaaaagtgattctaagcttattgaagtaatttttatggcattttgtgcctatttcatactttaagaaaatttttttttcccaaaaaataatcattttataaattttatttacatatttggggttttgtacatatttttgacagccctatgcattagaaatgctaaatatgcgcataaaatatgccctaaaaacccgaaaatgcccacaattatgcatttattctcggaaaccccaaaatatgcttttatatgcgctaaaaattaatcaaatcaaaaaatttttaacgtagaaatgccttttttgaacagttttcttcataacacatgcgcagaaaaatatatgtaagtccatacaatttatatcactggtaattacttacccggtgacggccttcgctggccggttgccattctgcgcgcagtgtgccgtctgcgtaagtgcgcgaaacgaccgcgatttcgttgccggatggttctgaaatgaaaaaataaattaattaattaaatattaaacgcttaatttaccaaatatttggactttgactctgtccacgggcccttcaccggttgtttccaatttcagctgtgccacatgctcaacaagaaggggctccggaaacagcaccagtcgcatcggttcatcagcagctggcgcctgtactgcttcaaaaacgcgttcctccaccgctgcaccgtcacgaaacagagtgaactttaaaggggacaaagatatacataattggcaatcaataaatgctaatttatttggccattattttcacctgatagcgttggggcttggccaatggcctaaaagtgcacacaatccgttggtgctgatgttgctgttcttcggccgacgtcattccgttctcgtcaactgctgacacttccaccggcaccgccgtttgtcctccgcctgacggcgtcattttggtgccgtctccaatggccaaacattcggcacggagttgggccggacgaattgggcaaggcaaaagcactgcaaaaatgcatttaataaattaattaattgaaaacaaaaatggcataccatcaaaggaatagtcatggccacagattgggccttgacgcgccgatgccaaataattgctggtggccacacagcgacacaccaccggacagatcgccaaagatcggccgttgatttgaatgtcaatgtgatgatcgcctagggaaaaataaaaatgcaattaaattaaattattttaatatgaaattttactttaaaattaaaattcgataaattttaattgcttttttaaattgttttaaaaaaattacagtaatttatttgcactgtattattaaataaatatttattccgttcttattaaatcaaaacttaatcaatgtttaccgggctgtgttggtgtgaaaccgatgtcgaagcttcccccgtcgacgcgttccttctgcacgggcacacgccgttggtcgggccctttgtatccgaattcaaattggcgccaaaattgttgccgtggctttctttcagtattattttttttgtgc

SEQ ID NO: 11177 - DNA, 1071 bp, Heterodera glycines
cccagtctctaattatccccccttttctgaggaggttgcaatataatcacccatgggctataattagagcatatacggtaattgggattatttttgtatgcatttttgaaaagaggaacaaccataaacaagaaagaaaaatggcaaaaatgtgaggaggatcaataacatgtaaattgaaaataatgtgaaaagggattaaattcgaattaaaatcaatctaatggttgtgcaaacgaattgaaatgccaaaaagggaatgataaaagcataaggctgatgtgtgaaaaataagggaatggtgctgttttttaatctgttaaaaaatgctctaattcagtgataaaaaaagaattgcaaacaacaaattacaattattttatttttttgccatttttcgatttagagcaactttctattaattttacgttacaaatcccaaatattttcgagtataaaatttgccaatacagtacacccatttgatgaaaccaccaaaagaccaattgtgtgactctatttttgttctttttttaactattccaaatttgggagcctctgaaccttctcccctttccgtccgccgtttgttggaccaaaaaaaagaacagaaaacgaaaatgttcagtggggacagaggccaaaattacaacacacgcacagccgctaatgattgatatcagtgatcactgattctgtgattttcaatatcaaaataatttatttttaaaacataattttcatgtatttttggacggagttgtctcgttaaactcaaaaaaccaccaaatgagaaatttttgacagaaaagttttcataactttgcttaaactatattttgtactcgtgagatcattcgatagccttaagtaagtaagtgttcctttactctataaaatttccaaaaatttcgttaactttctgaaaagttatggccagaaaaactcaaaatccagttgttttttttttttgaaatttattttttaccgttaaaaatgatatgaacaaataaaaattaaagttgtttatgagcaaattaaaagcaaaattttttattttgatggtttttt

SEQ ID NO: 11178 - DNA, 1641 bp, Heterodera glycines
  misc_feature (1621)..(1621): n is a, c, g, or t
cccccccccccctcgtcagcccctttacagccataaattttaatttaatttatttggttaaatatcttttttaaatattttttcaaattccagttgaaatgttaaacggcacttaccatttgtggtcgcgaccatttgcaagtgcattctgtcgtttgacgagctgagaattttttaaatgccaaaatttcaaaaacttaattttgctaatgataaaatggcactaaaatttggggcaaaatatattgattaactgatccatacagtgataattctttaactgtttggaaatgggagaactgagaagcagcgccactacatcataattaaatctttttaaatttgggcattaaaaataaaacaataagaatgatttagtaaaataatattgcattttttttaatataatattttaaaatattttcacttaattctgatcaatcacaaatcctcccccctccccccggaatactcactttatttgaagaaatgagtgcctcataaaggggtgagttcgttttatgtcgatcagcatcaatttgattatttaattgtataaaatcagttcttgacgatgacgaaggaatttggccaatctcagggccaaatgattgcacaattgaaaagctaaaagtgcgcaaaatgagaatgcatttttaaacataattttcaatttaattggtaaataaaaaaattaatttaaatacaagaaaatatatttataaaaagaaaatacaaaaataaattcccttaagcataattgcatcagtgtttcggtacttgttcggtttgtaccacataaaaatttttctttgtttttaatgataaaaatgtgttttccatggatattcggggtcgctgatctgatcacgaatatgacatccagttcgaccaatttaaaccccggaccggaattcgaatgtgaaattctgacttttttaaagttgagtttttccccgaaaaaggggggggggggtggtggcaccatataaccgcaaaagagggctacacatgtccgtttttggatggggccgcaaatttttggggcactttcttagtatcattcatgtattatttgccaattttaaaattcgaaaaccattttaaagtaaaggactggcaaatttagaaacaacataaattattaatcttttgaaatgaaaacgtgattattaattgaatggaaaaataatttcattttaaaataaagtaaattataattaaattaaaatattattttacacaatattttttaaaattaatatttaacaaataacaaataacctttttaattattttatttattaagaacattttttttatttaaaacaaaagatattataaaagacagaaattattttgattaattgaagatgaattaattttaaatttgaatgaatgccccttttttctttctctgtctgttttttgtggccctttccttctcctcctccccttttctctgctctctttgctttttctgtgaggcggcgaacaaaaaaacgacgtgccattttacaaagcattttacaaatttcaaaaatgcttctgtttattctttaaatatttagttttttaaaaacggaatgtgttccatttgagcatcacacttaaagcccanaatttaataaattttcaaga

SEQ ID NO: 11179 - DNA, 1939 bp, Heterodera glycines
tctctccttttcacaaatctcttcccattcacaaaagggacaaagtgattaaaatgaaattcattttattttaccagaggcaagaaataattgagaaaaattggtagtaattaattaatgacacacacaacaaattaattaattagacaacgaaatttgaagatgctttttggctgggacttgtctttctctgctggtggtatgatctgtcagcagagcaaacattggacagatttccgagtgtaccttttttctataagaatttttatgtcaatagacaaaagaatttgagagaggaaaatttcgaaattttatttttattttttatttcaaaatcaaattttggaatattgttgtgctttttcatgagctatattatttgttgggtgtaatttttaggatttgtcctatgttatttttgagttcctagggcctgctgaaaagtatttatgtttggctttcgaattttttgggtttattttcgagtaaaatttaaaatattttaacatttaaattttttagtctaaaagcaaaaaagctttattcacgaaaaaaatatataattcaatatttgatgtcttaaattagataattcgaaattttttttgatttaggagcttttcacaattgccgaaatatagaagaagaatatacaataaaatatggaaaaaatctggaaataaaaatgcatctttgaaggttcaaccgaagataaaaattgtatttatttgatttttaggtcgaaataaagtgcaaaaaatatggaaatgcatgcaaatcaggccttattaattgtttttattttttcatgattaaactctgcttcatgttttagtgacttttccctccgtcgtatcattggcattttctctctgctcactctttttgttgacaatttgaacacagcacgaaatttcagcgaccggcttcaaaatattaaaatgtatcttttttttttgaaaagtgaatgttcttaataatttgttagaattaaaaaaaacaaaaattttgtaaagaatttaaaaatctaataaataaaaagcatttataaatatctgaaatattctcggcttaagattaagcatcggtttggtgtaagccgagattaaatttcaatctttttaaacggtaaggaattaaaacagagaagaaaatatctcacaaacatccacaacatttgaatttaaatttgcaaggtgccctgggtcctttttcaattcgggtcgtccctcgacttgattaattgaaataggacttgatgacaaatcgagtgaggcactcaatttaattggaacagaattttcgagttgcaaaaaacgattgatcaagtcgaggatttgatcagaattgaaacagcccctggccaaaactgtcccactgttttgattgtccgtcctacgccccccccccttccctccacaaaatgccgtttcccaattctgtttcaacttgccaggtcatcaccattttggcaactctttttctccgtctgctgctctttcttcggctgttccgtgccatccatcgatggattcattgtgccgaaatttaaagaaaataaaaagaaaaattttaattctcaggaaaataattggaggattgattaattgatgggatccaatggttggcagctgcttgcttggccggccattcatccgtttggccaatgcttcagcaaatatttcgtgctctttgtgtgtcccattgggtgctcagcggcagaagacgccgatcaatcaatagcattaatcgacaaaccgaatttacaaaaataaccctcaaattcaaattcgggaatttctcactcccgagtaggaattattttgtctatcttttaacagaattattgatgttctcaggtgaagtaatgatccaattggctgcaattcgccttatataggaatccatattttttttcctgggatatgaaacgcctgaa

SEQ ID NO: 11180 - DNA, 150 bp, Heterodera glycines
gaatgggggagaagagaagggggagaggggaagagagagggggaatgggggagaagagaagggggagaggggaagagagagggggaatgggggagaagagaagggggagaggggaagagagagggggaatggggggagaagagaaggggg

SEQ ID NO: 11181 - DNA, 5268 bp, Heterodera glycines
cgctcggagaagcggccaaaactgacagtttcctgcgccatcagttggacattttggaggatgtgcagcggaggggcagcaaacagccgatcactttgcttttgcaacgatctgttggttcaaaatattttgaaaacgaaataattggctgttattttaaggattacatgtgccatgttaacggggaaagtggcgaatatgagctaaaacaggtgaacgaacgaaccaatgggagggcaaaatgggcatttattgcgcatgataatatggcaaattaattcattatttgccaattatttttaaggtcgaagtgaacattgggccaattgggggcaatgtaagtgcgcaagcagttcgccaagtgcacggacgcgtgttttccaaattgggactgtccgaggacaatttgcccgagaatcgtgcaagcactgccattggcgaggcattggtcaaggcgtggtcagtcagtgccaaattggccgaccaatttggcgtcaattaactttatgtaataaattattagcatttccgttgtttcagggaactgttcgaagatcccagcgccgtcgttgtgataatgtccatcaaaaataaccatggccacttcgcacttcggcacatccaatacgaaattgagcaggcatcggcctacaaaatcaaagtgattcggctcacattagcagaatgtgatgaaaagttcgttagtttacacagttttattgttaattggtctgaaaataaaatcattcgagagtctcgacgtaatttaatttatttatcaaaaaaaacattttatttttagacttattttggatcccaacgattcttcgctgcgtttcaatggcagaaaagtggcggttgtctaccaaaggacctatctgtccgagaaggattggccaactgagaagcactgggacattcgacgcaaaattgaacggtcgactgccattgtgaggaaattgttaaattaaatttgaattaaattagaattatgttgttttttactttaattaattttagttcttttgaaagaatggaggaggaaattaattaatggatttgaaattattaatggattgaaatttttaaaattaaggattaaaattcattaatagatttgaaattaattaatggatttgaaattaattaatggatttgaaattaattgatggatttgtgccaatggcaattttcatttaggtgacattcaatgtgaacattcatctcgcgggttccaagaaagtccaacaggtaatttattataacaaattaagcgccaaatcccctccgttcgacttttcagactttggcattgcccggaatgttggaacaattcttgccggacgtcgacgaaggaatgatcagttcaatccgaaagacattcgccgaccttttggcattggacaaagaggacgaagcgacagaagcagtgattagggtaaaagcaaagtgaaagttaaggacacgcacttgagaaatggggaagaaattcaccaaattcaataaaatcgaccattttggacaaaatgacaaaagtctttagaaatcacataaaaatatctatgtttagggtagttttttgagagattttaattgcgaagtaattagaaattactaaaaatgaaaaatttaagaaagccattgaaaaccctgaaaattacgtgttgaaaacgaaccgagacggaggcggaaacaatttctttggagaagaaattgccaaaaaactgagcggtttgccgctggacgaacgctcgtcgatgattttgatggaaaaattgaaaccgatggaagtgaaggtaattgggaggcaatggctaactcaacaatggcatttcgacatttgctataataaaggcaattttcacatattttcagaatttcccaatacgacggttaagggaccacaccgtgcgaaatatggtcagttgccaacaattatcaatggtttgggaccggggctgggctagcccaaacttcggcttctaaaacttcggggttttgagcttcggcttctgatatagtataaatttcagggaaaaacataactcctaaagattgagttttcagtgttaaatacaccccccccccctaatgatgggctcaagaactgagaaagatagtttttaatttttttttcaaaaattattccctttttgaggaaagtttcaaaggaaaattaaccttttttcctctaaaaatctaaagaaaaggaaattcaaaaaaatgaagaacattttataatgttaaaaaaaattaacggtgcgggaggaaacggcgtaagaaatttgggggggggggatgtattgcacccttttggagcaatgaagctcctgctctcccggtcaaattttaattgatactttcgaatgttcatccgggtgcaggattttgtaagtgagttaaatgcttatcaatccaaaaatataaaacataaaattcaatttaaaactgtacattttgcaggagaggggggggggagtaaataggtttaattcttaccaaatttatttaatttctttgttttcccgctttttagagcagtgaattgggcatcgtcggttactttttgggcaatggccaaacgatggcaacgattgccaatgttcagcaggggcatttgctgcgcacgaaattcgccgagtccaacgaaggcggcgttgggttgggcgtcgctgtgcacgactcgccctttttgttctgatgagaagcgaagcgaaagcatttcgaaaacaaaaatttagcaaaatatattttaaatgtttattatttatttatttactttttattttattattgcaaacattggaaaaatattatttatttcgacaaaatgaactaaaaagcaaattggcactttttggctcttcgtcttgtttttctaattgttccgattggacttgaataataccggtacctttcaccaaaggtaaggaattttatctattattattattagtaaaagttggaattatgcggctcaaaaaattcataattaatgactttggaagatcaaaattgatcaaaaagggctgcttataatcagttaatggaaattaaatacaaacttgttttgcgatcactttcttcagtcattaattttgatgagtttctttgttaatttctaaatctaaggcattttaaataaattttttaggtataaattacaataattagaattacagcattaattggggaaaacaaatattgtaataccgtatccccaaagacccactaaatctgctctggtgagtttaattttgccaaaacaaatcaaatggagaaaagcgaaaaatggcacaatgccaaaaagttacggtattaacattggagagacattcactttatcgtatcgtacacacacccaaagaaacatgcagttgtaggatggatgcctttcctccacattttgctaattttgttctgagtcgtcagtttgtgttaccatgcgtttttctttcatccgtcgattttggaaccaaattttgatttgctgaaaattttttctcccagttttttacaaatgccaattttgggaattttccgttttgatgccgcaccccttttgaaaaaataacgacaaaatgcgcccaataaacttaataaattaactgtctaaaagctgttacgaaattcatacctccaaaataaacctattaatatcgacgctctttgttgttgtccttttttaatggggttcggcgtaaaacgaaaaattacccaaatttttaccgtttcattcagtgaaagttcgtgcgctaattggtagcgccggggccgtgaaaggtatttggtctgggcaaattggcgctccaactcggccaactgatgggaggagaaagtggtgcggggacgacgcatgccacggctcaacgtttgccaatgccaaactgaaaaagagtcaatttgtgattttggaccaaagcaaattaacgaaaatgtgccgaagaattcacacaaaaaatcatttgaccgaaaaacttaaaactttggcggaatgaaaaaacaaaacaactaacttttgatgaccatttatttgattggtctcatttcattttcactcttttttctctttttgcaactcacgtgtcaatgccatcagttggtcaattgaaatttgcttctgcgaaatttgcaaagtgccatcatttaaagggggaagggttgtgccattctgctcaattggacgcggtggtggcactgagaagctgaattattggaagtacttagaattcaaaagcatagctcattaatcgccacattatttttaaaaaaccacagattttaaaatgccaaatttaaaagttttacccttttgaattgtcccattttggtgccttttcttccttcccatttattttacaatcaatttgatcagcagcagaaccaatcaaagcactgatcgaatgaaacattggcaagagaaaaagcaaatgccaaaatgggaggacaaagggaaaaggaaatgccaacgaatgaatgcctttctttctttctttgtgttactgtggcaccccttttcccctcccgccacctcaaaaagtgccaaattgcgctcgccaacattttaatccatcattcgtccctcctccctcacattttggcggaattctttcaaattttcccctgggaacagtgcgagaggaggagaagcgaagcattggcgaaatcggcaccctaaaaggcgctaattgaattatgcaatatgcccccgggggagaacattggcggcattcatccgcccgccaaatatcagctgccgaaggattatggccgagatgaatgggtggcattggcatggcatttcactttctttttggcaattccaaagggaattttgtcattgaacattttggtcaatcagccggtaaaattacggtaattttgcggaaattcactttttcaaacaaaatatttcacccgaataaatgaaaaaggcacaacaaatgcatttttaaaccaggtaaaaattctcattttaaaacccatattaaaggtttaattttcttacttattccttttgtacaggacaaaacgtcggagtgatcagacaggacgaaacttatcaaagtaattaaatatcgtaattaggcagacaaaaaaaaatcctcatttgattgagaaccattatttacaatattcaaaattaagtgttattaaacatttaatattattctcggttttagcatataaaaaaacccactcaagctttaatttaattattcttcagaagattttttcaacatttatataacattttgtcacttttgg

SEQ ID NO: 11182 - DNA, 842 bp, Heterodera glycines
tgattattagagaccggaattttgaaatggccgggaccgggacttggaaaatcgaccgggccgggatcccgccgggaccgggattcagttacggcatattcctatctgaaagcgcatattgtaaccaaatgacctactttcccttagtcctcaaattcttggaatttgaattcagaaacttatacaggagaatcaaaaaaatatatatttttgagaatttttttgtttaaccccttgcttaaatggcaaattttgctggcgaaatgaccaatttttgcttgggtagcgaaatgcctacggcacatggaaatgcgatgaaagggacgaaagaatgagaggaaagagagagagaggaggaggaggggggggggtcacaattaaaatacgattaaaaaaagttgggataaatatttattatataagggaaagatgaggaatttaataaattaatttaaaaatgcacatttatttcaatgggataaatttggaagggatatttttgaaatgagacggagccaatgaatggacagagagagggggggggagggggcggggcgggggatttaacggagagcacaaagtccattaaaaagcaaaaaaagagcccgccaattttcgctaattttattttgcacaatttctgttcatttaaattttgcagatggacaaacaaaagaaacgaacgaccgaaaattatgggaagggtgagagagaagagagggacagcagcagagaagaaaaggacgaagagagcggaggaagagcgaaaaagagaatagggcagagaaaattggcaaatcccagcggaaaaacagacattttgaaaattaattgacacaaaa

SEQ ID NO: 11183 - DNA, 2479 bp, Heterodera glycines
  misc_feature (2355)..(2355): n is a, c, g, or t
gctttttaaaattcaaaaacttctagtgaaaatgcatccttttaggtctttcgccctcccgtcgttgcggtggcttccgcggctgcgtcctttccgtcccttccgccggcctttgtccctacgagtcggcccatctcgcccaaacgtacacttccctctgcattttgctcattctcggcgatgacttttcccgtttggatcgtcgcgccattctccgcgcagtcgccgattcgcaaggggcggatggaaggtggcatttttggaaggggcgggggtttggtatggacaaaaaaaagcaacggaacttcgaaagaataatttttaaataaaaatgtttggtttcaaattccattttccgttttcagcttttttgacggcgatcgaagcaatgaaaacgatatgcgctttctatattgtgcctgtgctatttgttaccttctcgacgatttctcgccaattagtccgtcccaaattaccctttggaattttctcatccaatttcccgatttgttcagacattccctctctgttggactttgtccgtcgttccgtcagttacgacggtggcattgcccaagggccgtccctcgaaagccatggcgggtccactttctgtgccgtctccgccctgttgctgaccggccacctttgggacggctccgtgttggacagtgccaaaatggaacggctgaaaaagtgggcactgatgaagcaggaggagggcttccacggccgaaccaataaattggacgactcgtgctacgctttttgggtgggcgctacactttcggttcgttcgaactcattcattatcatcaaattaaattacatacattttgaaggagcgctgctggccatcccaccttttccccctttccctgaaataccgaaatttgaatttagctatggatacatccttaacttaattaaatttaaaaaaaaccctggtgggtctaaaaatgtcttcgtctgttgcgtgggtggaggcgttacaaataaataaaaatttgcatgattctgctgctactatacttttatgtttattgtgcattttcagatgctcaacgccctccccttggtggattggcccgttttgcgttcttttctgctccgtgttcaggacgcgaccatcggcggctttcgccgggacgacgactcggcccactccgaccttttgcacacgtatttctcattggctgcgctcggaattttcggcgaaccgcccattcgtccgctgttcgttccgctgaacatttccgcacggacctacgaacattggcaacggattcgacgccaatggcacgacggaacggcgacgggggaggaaaagcaggaaagaagaaaatgaacgggggaaaagcggcgccaaagaccgaccgattgactgctttgttttcacccgaatgtcttaagattgagtccaatttctactgacttctcagagcagatcatttatttttatttgctcatatcattctttaattgtcagttccctttgggttttgattgttttttaccacaattttattgtatatgctttatccgaattgcgattttattatatttattgttaaattctttttatttcatttattcctctctttcgcgtaagttttgacaagcttcaacgtatgtaattcgtagacacataaaaatgttctaaatgcattcgtccttttttcaattaaagctggtacacacaaaaccactccccaattgttggacctcgatttcctggccaaaaatccagacctgtattcaggtcgaactttagtcatttgccgtattttcatttacattttatcaattcggttgggtaaaggtgcaacattctctgatcaaaagggtcatgtcactttacatcctttctttcttaaaatgattattcttttgcttctcccacttcgccgccgtccctttcactcctttttctgcgcctgctcatttgccatttcttgctgcctttgcgcatctgaaaatgccggacatttttatttatttttggtcattattttcccttgcgccactaattcccttaattagggccatttcccttcgcttggccattccccccgcctccccaattttcccactgaccccttccgaagcgaacgaatgtttgtgcccgctttccgaaccgcacaaatgtttgtgcccttttgccgaatcggacgaacgtttgcgctcgcttcgccttcgcttcctccgccaattcgtcctcaatggcactatcattttgatcgtaaatgggccgctccaatggcacatttgcagggatcacgaaataggctggggggagggtttggcaccaacgaaatcggtggttgccatggccggtcgacaccaatggcatgnggatggatcatctggacggagggggggggggaatggatcgactgtgccaatgccatgctcaatttcgggatttttctcccttttgaatctggccctttggtttctttttggacttccccccccc

SEQ ID NO: 11184 - DNA, 2716 bp, Heterodera glycines
  misc_feature (2682)..(2682): n is a, c, g, or t
gttttgattgttttttaccacaattttattgtatatgctcccccgcgccccgcgattttattatatttatcgttaaattcccccctaccacatttattcctctctttcgcgtaagttttgaccagcttcaatgtatgtaattcgtagacacataaaaatgttctaaatgcattcgtccttttttcaattaaagctggtacacacaaaaccactccccaattgttggacctcgatttcctggccaaaaatccagacctgtattcaggtcgaactttagtcatttgccgtattttcatttacattttatcaattcggttgggtaaaggtgcaacattctctgatcaaaagggtcatgtcacttttcatcctttcttctttcaaatgattattcttttgcttctcccacttcgccgccgtccctttcactcctttttctgcgcctgctcatttgccatttcttgctgcctttgcgcatctgaaaatgccggacatttttatttatttttgtatttttggtcatcattttcccttgcgccactaattcccttaattagggccatttcccttcccttcgcttggccattccccccgcctccctttgcctccccaattttcccactgaccccttccgaagcgaacgaatgtttgtgcccgctttccgaaccgcacaaatgtttgtgcccttttgccgaatcggacgaacgtttgcgctcgcttcgccttcgcttcctccgccaattcgtcctcaatggcactatcattttgatcgtaaatgggccgctccaatggcacatttgcagggatcacgaaataggctgggggagggtttggcaccaacgaaatcggtggttgccatggccggtcgaacaccaatggcatggggatggaatcatctggaacggagggggggggggatgagtcggactgtgccaatgccatgctcaatttcggcatttttctcccttttgaatctgcccttttggtttctttttgtacttcccccccccgccttcccttcgctttatttgtcctccatttccttctctgtgatatcattatccattcctcctcatcctctcctttctcacctttttgttggattaatgggctggcttctgtcatcccgaattgttggacggcgaacaaaattggcaaaagaaacagaaacaatttgtgtccaagtgagaaaggaacgcagacggaggaggaggaagagaagaacattgtcattctgctgatgaaggattttaagtgatcggagagaatgatcagtgaatgatggggagagaatggcaaatgatcggagtgcctaaggaagaggaggaggaagaggggaattgactgaatgagggggcggggcatcaattacccattcaaatggaaatggaaatgagacaaaaatgtacaggaaagtgccttcttgactaatgtcctcataatgagcagggcaaattcagtggcattggcacttaaaagagttggcaaaaacgacgcgtgggatcaaagaacagtgccgagggggcaaattagggaaattagcaaaacgaaaagaaagattgatgcgcgaccgatgaatcatttagtaaataaaaggaaatccatgtaaaagaagcacatcgaaacagattggcccatgtgtccaaatggccaattttggcacttttgttacgatttatagggggaatttattccaattttagcaacacgaaaaggaagaggagaagcactttcacgaggagcacagtccctaattgacaattttctgaatccctttagagaattattaataatcaaatttggcacatcggaaaaagcgccgaaaatggagaaaatttgtgggattttattgtgaattaccaatgtgtatattaaaataaagcatagaaaccagggctgggcgtaatgacggattacggaaattatgggggtttttggacccctgtcattacggattacggaataccgtaactgagaaaatcgctgtaattacggattacgaatttcgtaattgaagatccagttacgcccagccctgatagaaacccccgggttcccggctaaattgtgcacaatttcccgggttttgaaaagctcaggtcccggttcccggtcccgggttttgaaaagctcaggtcccggtcccggtagggcaaccgggaaccgggaaaaacaagcactggtaagaatggggtctgagtgaaaaattagtaaagaaaattggagtcaaagggaaaaataaaaaataataattaatatattctttaaaagtaacactgcccaagtgtgcaaatggcttaatggctagtctccttgactttcccttcttctttccctggttcaatccctctacagaaattaaattattttgaattttctttttgtatactcgtgggtttcctataaagaaaatatgattccttatagttttttttttaaatgatacatattttatcattttttaaatgaaaatcctaccaattgagcttaataatcgcaaaaaccaacctttttttgttgaaaatctgttaacaaattgcacccaaatttttaaaatttcccccggcggcgcctatcggcaccgccggaccccttctttcccaaaagttttgaaaaagcgctccgaaaaaaagtgatgtgaaaatcaaatctgaatttctattaatattcgatgatttagtccanaaaatgattaattgtttgaaataattgaagaaaa

SEQ ID NO: 11185 - DNA, 233 bp, Heterodera glycines
aattaatgcaatatttatttgacgtttatttgagctgaagcgccattcctccccctgcttcacatagtcatttaccgctgtccgtggtccgtttgtccatttatccaatttaattttgcaaatttgcacctttcgcgcgggtggtgcgttggtagaaccatccgtccgtccatcgtttcgtcattggtccttaatagcctgttttgatcatctgctgatcactctctgtccga

SEQ ID NO: 11186 - DNA, 4650 bp, Heterodera glycines
  misc_feature (4545)..(4545): n is a, c, g, or t
  misc_feature (4550)..(4550): n is a, c, g, or t
  misc_feature (4559)..(4559): n is a, c, g, or t
  misc_feature (4583)..(4583): n is a, c, g, or t
  misc_feature (4586)..(4586): n is a, c, g, or t
  misc_feature (4589)..(4589): n is a, c, g, or t
  misc_feature (4592)..(4594): n is a, c, g, or t
  misc_feature (4601)..(4601): n is a, c, g, or t
tcaaagctaaactttgctaacaaaaaaatgaacaaaagctacaattatagtagttatttacaaaagtctttcatcttttttttgcttaatttttcaatatttctttatgtaagtatttttaaaattaatttaaaaatatttttattcaaattcattatcagtaaatttttccagctaaatttacttttcttcctttattgtttttcttattttttaagaatttggtgtaaaataatttaaaatttcaatataagtccctatttttctcttgcgttgcctaacgacagaccaacaccgctggcctatgatttttcataatttttaaattaaagacaaaaaattagttatttttttgttaatctgttcacaaattcccccccggaggtgtctgtcagcaccactagatcacaacattcctttaaaaatttcaggatctagtcaaaaaaaaagaaacgacaaaataccagaagaacgtgaatgcagatttattccgcccattggtggacattcgtgacaaaattttgtatttggcaatcaaatattttgggatcgacaaaacggaaaatgaaggaaattgttcaatggtgcagaagtcgaacagcttgaatcttaagaaacgcatcaatgatgaattcaaaaaattaattcgaaccacaagcgacaaagtttaatatatataaatagtcaatcattaaaaaaaatattaactaaaaaatatggagattttacaagagggttcggcggggggggggggtggattcaaattcgattttttagggagagatttttttttttgtgtaaaaatgtcattcttattgggttaaggggggttttatttttctttttttcagaaatcccgaattagatgtgttttgcaaagatttatagctgttttttgccaaaggtccggcggtgacattaggcaccggcgggaaaattttggaaattttaacacaatttgttaagaaattatctaaatcttcaaaattgaaatttttttttgttatttgtatttcgggcaggggctttagcccatcagctgctccccatcctaagcccttgagatttgattgccctaattcccattgaatataatagtcggattcttaattaactttgaaatagcattttacattttaaatccttagaaacaagaacagcccagcgaaatgaagaagcttgtacagaaagcaatgtgtgtgtatgcttcaattgagggcgcaatgcaaaaaagtgagaaggaaaaattgaacaaaatgctaaacaaagaaaaagaagcgaacaaaaacaaagaaaatattcaacgaattggtgaagaagtggaccaagaagttgaagcgagaagaaaggcactgatcaaacaggaaaatgtgagagaatatcacattgatcagctgctgcttgatcaacaacacgctgtagctgatcaccagccgcaacagcaaccgttggcggtgatggagcaaggcgaatcatcggcaattaaagaaattgttgctgttggagaagacggagcagggaaaaaggtaaaagaattcaacaacttgttcagttgagctatagaagcgcgtcgttgagcagcggaagtgttggctaaaggacctttttgggcgtaggagccaattggagttggggacaaattactgaagcttcggggttctccatatattcattcccgaaggaaaggccccaaggggtgattaggcccagggatcccatccaactcttgatggataaatagggaagactaaactgataacagcttgaatggcgaacattaaatgcatgtgtgaaatgaaatgtgatcgataatgattggtcgcaaaaggagcggataaacaaagatatgaaattctaaataagtaaaaattctagggcttcggcaagtataaaacaagaattgaggccctcacttaaacgttcaaaacttttaattttgaaaagattaaaattaaatattcttctgcttatttttaattccatgaagccaaattaagacttttgcgagtttttaagggtatttttgtgaattttccagtcagattgaaagaattgtaaggaaaaaaccaaatgctagcatgagtgattataaacgagagattaagcgcagacaatgccaataaacacatgtgcttcggggtgtaatctttaaaattcgaaaaactgtgattttttaaatacggacttcaaataaataaattgttctgaaaaatgattgaagaattattattaggctaatcaagcactgatcactgaacaacagcaaactgaaaatgttcaggcccaagccgaacaaaattcaaatggaaagaagaaattacatcgtcggaatacgttaaaagatatttttgaggaaacgaaaagtgatgaacacattgttgatcagaatttgagcagtaaacgatcggactcaatcaaaagcgaagcgattagccaagaattgaccaaggaaacgaacaagccagaaaatgagagatccaattcattgcgtatgaaattagtagaaaccgtggacacaaaatgctaaaaagcatatgacactagttcgactgaaagatcaaatcgcgcattgatcagtgatcacttttctatacctatgtaatcccttttcattatgtaaactctttttctagtgatcatagtagtgttctttttgtagtaaacttgttgcagtattatatttggattagataacaggactaaaaatgatctgccgtcctttattgcaaatgaagcatcatcagttggcataaaaatgtatgccgatgatgttaaattatattatgcccatgaaaatgatgataaaacaaatcatttagaataattaattggactaaagaacaagtttaatttgtgtcaaatcattccatataaatgcattatttgtcgtcattattttattctgcacattttatttttttgaatgtcgctatttaaataatccatttcaatttaaactttaatagctaattaatttatttttaatgtttcagttaaaatgaacaagatcctttttttatttattgctctttttgttgtgcaaattattgccgcttatgagccaagttgcaaagtttgtgatcaaaaaaataataaattaacaaattttagtgccccgaaaatgaggagccgggccaaaagagttgcaacggatatgagccaagttgtgacaatccgaagccggagatttgcactgcgcgcttttgtgactgttcatgcgactgtgtgaaggaattgttccgcgacaaaacgaaaaaatgtgtgcccaaatgtccgtattgaggaaggaaattgatactaacgatgtaatgatatcaaattatttaatcattcattaatctaataaatagcaattatttaaaaattgaaaagaattagaatttgttagttttcaataaatccgttaattatgtgtgtaaaagtcaacacaaagcatttcttagtgaatcattaagcaacaattgtaatttgattcaaaaatgattcattccctggaccatatgaacgcatttcactatcacaatttatcagtattttgctgaattttttgagaaaatttgctgatttatgctgatttttagaaaaaactcaccaaaaatggccatttctatgtaaaactgttaccgaaaagttttcaaaatttacttaaaatttactaattttttcatataaattagctcaaaatcgcaaaaattgatcatttttggtcaactctaattaacaatggcattaaaatttttcttagcggcgcctgccgatgccgccggccccctgttcccaaaaaaaagtttaggaaacgcgtgccgtaaaaaacattttttttttgtgtttttatatttggaataaaattttccaaaatggtgattttgaaaattttcatctagcagccctgtttaaatattcatttcgaaaatccatcgttttagctatttttcgacaaaatatgatattattttgctagaaaatttccagaatgggcctaaaagggggtgaaaatatttgtgctcatttgtgagtactaatttgttctgtaagttttggagttttaaaatttttaaatttttttggcccttgggaattttgtttaatttttgaaaatgcataactcatttctttgctgtcattttttgtgtaattttaaagaattaatgctttttatttagaatttctatcttcaaaaggaaaaaagttattccagagacttggaaaatttcgatttttcaaaaaattcataacacccttccgaataagtctttgtaaaataaaaatactaaaaaaattggcatctgtgaaaaaatgctttaatttatttataaaaagagtgttcactaactacttcatgtccaactacaaataaatatcaaaaataataataatcttctcaattcatcatctaatttcaagcaatgttatttcggttcagcattcattgggtgtgtgagccggccaatccaggcatagaaatcacactttccgagttgggcacattttgaacatggacaccttaagagattaaatggatttgattattcctttcttaattgnctttncccttgggnccgtttatgggcacatggccaatnctnatnccnnnctctgcncatttcgactctgaagacagtgactttctgaccaaactgcccactcaat

SEQ ID NO: 11187 - DNA, 1510 bp, Heterodera glycines
  misc_feature (1379)..(1379): n is a, c, g, or t
  misc_feature (1439)..(1439): n is a, c, g, or t
  misc_feature (1480)..(1480): n is a, c, g, or t
gtaaattcgaggcactgaaaaacaaaatcatcgacctcgtcgacggagcctgcggcgaaatccgcgttcgcaccgcggcggataagaagaccacctacgattgcaatcacatatttgttcgattggattacgattcaaagttgagcatcaacggatacctccacgggtgggcgacgagcatcgccgaagcaatcaaagattgtgagaaatatttggtcatacaccgcgtcacggaattagagatttgccatgcgatgagttctcccgacggaaatggtcaatcacaatctcaccaaaatcagccagaaactgtccgagtgatttacacaaacgaaactggtgccattcccgaaatatccatttacaaggtaatgccaaatggtccagcaattaatcacattcccttaccattagacttcaaacgatgaactgaggcccttttctgagtgccaacatgcgcggttggccggacgcagcgctcaattgccccatcacagcattcaccaagtgaacattcagaaaaagcgttttctggccagtaaaattggaacaacttacgtgtatgaccttccgatgttatttgggaaagctgctttagacgaatggattgaattcatgaagtccgactcggaatcatacgaccggtagtgataatttatgaaaatttcatcagttttagttttttacttaagtttattcccacaacttccaaaagaaagacaacaagcaattcttaaggaggatgtcgccgcatttgcgaaaggtttcatcaaaaaaaaattaaataaaaaaagggatttagcgttcgaaatgattctacacgaggaagaaggcgaattggaggtcttacgtgacgaagaacaaatgtacaaaaggatggcccggggacgcaatgacaggggaatggtggcatgggaaatgcatctgtgcactccggatgcccccctcggacgaaaggtgatgatctgactccgtagtactatgtatgggcatcattcattaatttgggtagaccaaaattttcgcgatggcttccggggggggggaagtctgaggctgaatttgcaaggtgtaaactttgttatcacttgtttattcaatctcgtttgttatattcctctcagtttcaactttgcagttttctattttttattccatcccatcttttccagattgttttgattgccaatgacattaccttccaaatgggctctttctcaatgcgcgagcatcggttataccaaaaagttcgtgtcttttccctttgcttattacggtgcccactttaaggcaagtgaatacagtcggaagcatcaaatgccacgcatttatgtcgcagcaaattcgggcgctcgaattggttttgcatcggacgttanaaatcgcttgaaaattgtgtggaacgacgaagaaaggcccgaggacggcttcaatacctntcgatggattgtgggggagggaggaagcgacattctctccnccagtgagtcgaccttcacggatggacgca

SEQ ID NO: 11188 - DNA, 3466 bp, Heterodera glycines
gaaagagaacgacatcggagttgagaatttggtcggttcgggatttatcgccggggagacaagcgctgcctaccgcgaagtgcccacttattgcttggtgagttgttcctctctccgcttatataagccacttccctctccaggtgtccggtcgtgctgttggcattggggcgtatgtcgcacgtctgtctcaccgcatttgccaagtggaaagttcacatatcattctgactggcgcgggtgcgctcaattcagtgcttggccgtgaggtgtacacttctaacaatcagcttggtggaccgcaggtgcacttgtttttgcttcacttttatatcactcttttgattcttaagattatgttctacaacggcgtttcacattcagttgccaaaagtgatctcgacggagttaaacggtaggccgagaaggataaattgttttaaattccatttaaggatcgtccattgggtgacttatcttccctctcctcactctgatgaaaactgccagaaaatgattaatctttccccattgaccaaagacgactatgcaagacttgtaaatactcacccaaccaaaagtgcctacgacccgaggacaattttggactctgacgacgaaggattgtttgaccgggggacttttgacgaaataatgagcggttgggcgaaaacgatcattgcgggaagagcccgtctacgtggcatttccgttggagtgattgctgttgagacaaggaccgtggagtgtgaattgccagccgacccagcaacacaggactcacaagcaagattggtccaacaagctggccaagtttggtaccccgactccgctttcaaggtcggtttggtgacagccgttaaacttattgttagtttcattgtcacattttgaagacatctgaggcgataaatgactttaaccgtgaggggcttccgctgattattcttgcaaacattcgtggattcagtggcggacaaaagggtatgcacagtgttggttgcatgcagtattatttttatattttacactttagacatgttcgaaatggtgcttaagttcggtgccaacattgtcgatgcacttcagacgtacactcaaccgattgtcgtttatttgcctccgtttggcgaacttcgtggcggtgcctgggcagttcttgataccaagatcaacccaacatgcattaccatgttggccgatccgaattgtcgtggcggtgttttggaggccagcggtattgtggagatcaaatttcgcgaaaaagacctgctcattctgctgagaaaatgcgacccgaaaattaaccaattggaagaatcactcgccactgcttcggacccaacagccaaaggacaacttcaagacgaatacaaaagacgtatagaaaaacttcttccgatttgccgcgcggccgctgtcaaattcgccgacttacacgacacaacggcgagaatgctccagaaaggagcaattcatgtgagcattgggtgtcacccaatcagctttaaaggtattgcgcttttaggacgaagtgccttggcaaaatgcgcgaaattacatgcacggattgatcagtgtccattcgaccaaacttcaaatggcacgccgttatttggatgcaattggtcgcggaacaacaaacgtttcggtggatgagctcgctattggcctgcaatgggtggatgaacacctccaaaaaaccgatgtgcaagtcaggcgagaagtgaaaccagaagaacgtggcacgaataactcgtcgaagaggacgcggttcatctattttgacgagcagatttccaagtacgctgatggagatgggttccgaaaggcactggctgccattcggcaaaaatcgctgcttgagcgactcactgcgttaagcaaagaggagcgtgaccaacttatattagtcttgtccgaaaaataatttttctttaattcccgcatatataattttccgttccaattttgtacctttgtattagttattactgtttttaaaattttattgtgacttaagaattctaagacattcccttttggtgtaatcctcctaacatatcttgcctttgacttaagcccaatgagtttatattttttgtcccaatggctgctataaatatttctgattgtggtgaataaaagactttgtttatgaacgaattttacttcatttaattcgacaagtgctagaagaaatgtgccgtaattagacgatttgtacaatttaaaaaggaaattgtacttgtgtaaaaccaaagtcagattcgtaattagtgtatttttttacctcggaaaacgcttttgaaattttacggttttttccaccggaccaacaattctgcaacactgggttattttgacatatggtgttttttctccatgggcaaatcccgacaaatatggtactctcgataagataaattgatttgggggtgtgggaactaaatatgtgaatttttcataatgtttgtttgcttaatgggcttaactgcccaaatgtgaggctttccttttttacttctcattatatcataaaattaaaaaatggaaagaaaagcccaaatccatggacattaatcaaatgataggtgaggtttaagctattcttctattttccctgattatttttttggcgtggaaatttatgtttattccggtgttttttttatcaatgataaatgacttaattaaataataactatatggtttttgttaataaattaacttccattcattcattcatttgaccgcttcaacagcgtttgtcggttccaagcgcagtgtctccaatttgacgaactgttccatgtcgtagataacgcgcaacattagcgagcagctcggacacgtcgccacatcttctcctgactcgagttgctctcgcgtaatttcgaatctgaatcattcggggcatttgtttgccatttgatccgtctctcacctgtcgccacacggacatgggaagtgatacagctgaaactcatcatcaaattcaaagtcttcaatttccacttcgtcgtgaaacaccaaagattctgtgacacttttttccatttcctacaatttaaaaggtattatcaaaggaaaattgtgaataaacagaaaacaacgaaagtaatacgatgaaacgaatgacaaaaaaggggaaaaagaaattctgtaggatatttctgtgacaacaaaatacacaacaataattttgtcaggactaaacgaaagttcatcacaacgaaaagccaaatttgaaaaagcgttgccttattaatatgccctcaaattttctttgtccgacaaatgcgaggaatcgctagtaaattcctgtctaaattttccggtgccatcccccgtctcgacgaatttgctgactgtcgcttggccgacataattccaatcaccgaccaacacttcgtgaagagcaccttttttattgaaattttaaaaatctgaaatattgtggcat

SEQ ID NO: 11189 - DNA, 665 bp, Heterodera glycines
cgtgatcagcgcatttttttaccatagaaaaagtgatttggtaagaaattttttaaattttatttttcgtcgggacaccaattccgaagcattacctgaaagcctacaagggattgacctctgcaagtccgggctcaactttgatcggaattttcctctgtgagataagaaaagtcgctgtttgcacagtccgctcaaaaggagacgcaaaaatatgatcgatttggacattcgaaaacctgttttttctattcataaaatgaattagaatatttgttacctttctgccaattctgtggcctgttttatgcctctcgacgataatggactgttatccgatttcaatttttgagggttcgcatttttttgccaattcgagtttatgttgtcttctctttcggcgtgtctgacaatccacaatgtttttaccattttggagaacccgtaattaaaagactagtgggaagctaaaattatgaattaaaagatagaataaaaaatatatagttggagaaatagatttggaagattcttataatgcctattattgtcttatttagacatttagtgcttattttccagattttcagaaaatcccttaataaaatacaataaaatatgtaatatccgaaccccagaccagaatttgaactaattgttctctt

SEQ ID NO: 11190 - DNA, 2908 bp, Heterodera glycines
ctcacttattcggtggaaaacggattcaatgtgcttcgaaaagtccttccgttcgggcttaaccgtctcgaaaggtaccgttcccaacagcaaattgaaaccaatcggggcttttgttatgttgaaagtgcacagttttggttcagtcaatccctttcggtggacgggaattgaaactgttccaaggcactccaacaatttgccgtttacatccgagattttcgggcacgaattgcaaaatcctgcctcccacaaattcagatgcttttcgatgaccaactgataaaaaacgttgcactgattagtgaagtctgcgctccaccatccatcatggcattggtctcaaaatcactgacaaaaaggcgcgttaccataacttttccgatggtatatgccacagcttcctttttactgcactcagtaccgagtttgtcaaagaagtcagtgacttcggggtcaaggtcgacttttccgaggcgcacattcaaatgaggcacttcttcttgtacaatcacacaattttgacggagaaaatttcttgatgggttatggtgcttaacatcttggttttggttgttgccaaatggatggtttaaaggaactcggttagcaccagtcgccgaaaaatttgacacaatttgcctttcgaaattttgcggtggcgaaaatggttgtcggttacgcggacagttacgcgaaatgtgtccaggctgatcacaattatagcacttcaaagaatttgggtactgacgctgaaaagtgttggccgggcgtgacgaaaaatttcgagtttgctggtttggtacgccatggctgtcatagctgtccattcgatcaacatttctcgggttggggttcgtaaaacgctttgctgctttttgggtagactccgcacgcgctgcaagtgagacgaaatgattgagattcatgccttgcgtgcgagcaagttcgaggtttaatgccagctcagggcttgccattgcgcggatcaaaaatttgatcgcgtattcatcacacaaatgttggcccaatcccacataagctctgcgtactaggccagaaatccgattcgccaatgcgtcaatcgtttcatttgccccccgctttactccaatcatcaattcgtcgaacgcatttagttgtgttgcgtcggtttcctctagttggttaagcatatcgcgacgaataagcgcgtactgaaacggctgggtcgcttttgcggcttcaaatgcacgttctgcacgcccatacactttgctctccagcgcactgatgcgctttttctcaggccattccgccgtataaacatcaaaattccttgaaaaatcgtcgaactgcgtcggtgccctcagacccattcaaatctgggtttttttccaacaccaaatgaaattctagactgtcaaaacatccaaattttgactggggttaggtgcattttgtcggggctgatgacgctgctgttcaaaaacaggctgcgcgtagctcggagccggtggaatgcgttcgttcgcataagggaaagacggtggaagcgattcaacatgttgaatgtattggcggtggatgacgctgtgttgaggcgctaacggcggtcggttcaacaatggacgctgctccacaaattcgcggttattcgaagcgcggacatttgtttgacccataatttcgccgctaatatgtctattttgaattcggttttctccaaaatgctggtgtcggtttgggtttgactctctcaactccaaagttttgcagtcccactctttcatgctccaaatttgaaaaatttcgaagtcacgcaaaccttcacgcatttgctgtccaaattccatttgtgcgtcgccgccgtgctccaaattttgtccaatttccaccgattcgtttccgttttgttgcccaaaatttggtgcgtctccgttttgagtgccattgtcgttgcgaatgttgtgtccgatgctcacgttcagaagtcggttgcgcagctcggtctccgtcatttctggctgtaaaatcaatccatgattgctgtggtgtgtcaaatttggagagatcggagagtttctatcaatttgaaacaatggcgggtcaattcggtgatttaagaatcctctgttatggctttcagttgattcttcaagggggttttgctgttggagaatggcgctatcattgttcaacacaattcccgcatttgctgcttgccgtcgcgtcaagtaggggctccgtacaaatgccattcaatttcgtcaataaaaaaaaatttcgccgatttgctgcttaacgttcagcaaaaatttgaagattttgaggcggttggcgttgcgagagtggagttcaacccgaactttccaaaccgcagtcgaatgaaagtccaatcggatccttctagtcaaagtccaaccggatctttcctttcactttccctttcgcttcttttactttggaaattcaaccgaattttccaaattccacgctttttgaaaagaaaagttcagcccgaatcttttcttccaattgaaacaattaccgtccaaccggactgataacgctcctcaaatcagttaatcctcccctttttagtctccgatctcccattaaaatgaaaccgttgagtcaaacctgttctgttggcaggagcgccatgttggaaatgatcggatttggtcgaagaattggggcttttaattgggaccgggacctttagcttttggagcgggaatttggaaaactctttatttttgagttccagtcccgttgcgggatccgcaaatttgaaatttccggtctctagtgagaacagaacatataattaattaagtaatgagaagaaaaataaaaatgcaaaatgagaacataatgccaacaataatttaaaatcacaaacaaaaggacaaatattccaaca

SEQ ID NO: 11191 - DNA, 1041 bp, Heterodera glycines
ggttttcgaattttattttttttacaaattttacttaaacattaaaatttatatgaattttataaatgataccgaattatttaattttttaaaaattggatattcattttttttttattttaaagatatctttatttttataaatttatacatttaaacttaaattaaaataatttttaatatttaatattatatcgagcatttttgttgtttattttttctctcttttaacttattaatctatttttaattctatttccttctatattttttagttatatcattacatttttatctattggtttttgattcttatgtcacaaagccacctgattttttcttaataaaatattacaaatattttttcaggtataaatttttttatctactagaaaagtttttatataaaaattttctttttttattgacttttttacattttttttttattttaagaatcaaataactgtacaaaaataatttttaatgtcttcattcaagtgatatgctgagagcgtaaatgtttcttcgattattgtgccttttattatttcttagattaaaggcatattattgaattattcttctatattcgattaaatccagatttattaagttcttgattaagatttttttggaattgcaccgaaatattatttaactgatttgtaaaaacaattaacgttaaaactttggcgacaattttcaaagtatgcaaaattaactagaaaaaacaatatttagctaatggaatcataaaaataatctaacataaaaatccctaaattgatcgtgaaaattagaaaattattgtataaataataataatttatttcaagaaaaagaataactaagaaatttaattggtttcataaataaaattattaagtcactgaaaaacctttttaaaaaaattttgatatcatatctgcacaagtttaccactatcctataagtaattcatttaagacataataataccaatgaatttaattgttggaaagctttttaacatgataaataaatttattataaataaat

SEQ ID NO: 11192 - DNA, 1201 bp, Heterodera glycines
tggttcaatccctttacagaaactaaaatattttgaattttctttttgtatactcattggtttcctatcgagaaatatgattccttatatttttcttttaacggacacatgtttatcattttttttaaagaaaatcagtataaaatgagcctattaatcccaacaatcagcattttttgttgaaactctgttaacaaattgcacacaaattttcaaaattttcctcggcggcgcctatcggcaccgccagacgcccttcttccttaaaagttttctggaaaaagcgcgccgaaaaaaagtgatgtgaaaactaaatctgaatttctattaatattcgacatttgtccaaaatgattaattgtttgaaataactgaagtaaatttgatttgaaaattttcattaatttaatttagctttaacttttggattttattaaataaaaaacaaaataaaaatttaattttgtattattttctattgaaataaattaaaattaaatttttttttgaatttttgaatttcccggttggtcccggttcccggtcccggtcccgaacaaaaatcgaggtcccggtcccggcttctcaggtcccggcaagtcccggtcccggttttgcccaaaattcccggtcccgctgcactctagtttaatgtgttgatctatgtttttataaatcttcaaaagaacccaaatttcatgaatttcttatgctctaaaacggttataatttttggtgatttaattaattttttttattgagtataagcttatttctattttttgcaaaccttcgaatatttgacttttttattattcaaaaaataatataattattagttacatattaaagaatcgaaaaaatttaaataataaatcaatgaatcaatatttttgcaaaaaaatatgcatacatttttcctaactgtggcatcaatgcaatcaatttctaaataatataatttaggcatattatgaatttttataatttcatgctttatcaaaaatattattatatactttatatctatacaacaaaaaaaaaccgcaaaaatttttttggtcaatttaaaaacttattaaaaataaggggggcggatgacttttaattaaatggtattgtataaacaaattatattaattaacttctttagaaatgattttattaattggcctttttaatttaatattcattccaaaaa

SEQ ID NO: 11193 - DNA, 3193 bp, Heterodera glycines
atttaaatcaacataaaatattgctgtcaatatgctgaactgctgaactattggaaatataatttgttatgagttctacaccattcaaaacatggatttgatcacaaataaatttttaaaagttaaaaaattttgaagaataaattatttcatgaaaaaaaatcatagacaaaagcaatgattttgaaaaaactgatgtcagattcgtaatcagcgcatttttaggctagaaaataggcttctgaaattttaaatttcttcttttttttgcagaaactacactaactttaccattgccgattaatgatattattaagaaatatttgattaatcttaggtaatattgtatgctgatcatattaatccacatggcattatcccattggtcgtaacacgaacccaaggaatttatggcatagctgcatctttaaaattcattttaaatcaacaaatttacaaatttactgtttgcgcacaaaggtttcgtcgatttcgaaaaattatcggacaaaaatcgtacataggaaatgtgcccgctgaggaagtgcgttttgataagtttattcacgaaataggcattaattattgtataataataagttttatttcaaaaaaaaaatattaatcgtccgatgggattcgaacccaaagctcttctgaagcgtggaatgctttaagcgattcgagaaacctaaaagggtcacccgtagactcagtttagagtattccatggcttaaaagtgccgtgggttcaaagtaacacaggaagtgtaacttttaaaataatacgttttgattaatttcaattaacgaaattagcattaattattgcataataataataattataatttttatttaaaaaaaaaataaagattaatcgtccgatgggattcgaacccaaagctcttctgaagcgtggaatgctttaagcgattcgagaaacctaaaagggtcacccgtagactcagtttagagtattccatggcttaaaagtgccgtgggttcaaagtaacacaggaagtgtaacttttaaaataatacgttttgattaatttcaattaacgaaattagcattaattattgcataataataataattataatttttatttaaaaaaaaaataaagattaatcgtccgatgggattcgaacccaaagcccttctgaagcgtggaatgctttaaacgatgggaaaatctataaacgacacccgtagctcagtcggttagagtattccatggctttgaagtgccgtgagttcaaatcccaccggcgggagagtaacttttattttgtataaaattattactaatttttttacgaattagtattcatacccacatgtgctaacagtcggttagagtattccatggcttagaagggccgtgggttcaagtcccattggaagtgtaacttttattttctatcgaattttattatcttttttaattaattagtttttaatcccacaaaactgtgcctatgttgagaccaagcttgatttcgctgtcatgcgttttgtttacggcttttttccaacaaatatttttacaggatatacggtgcgttttttttaataattcaattttaactatatttattatcaaatgtaaaatttttttttaataatacaagacattttttcgaatgaattcattagttttaaaaaatgaaaaattcttaaattgattaattaaaaacaataaattatttttccaataaaattttatggaaaaagaaagatgtcaatttaaataaataaaaattgagcatataacagagataaaatgcacatttttatttgatgaattgaatagaaatatgttcatttcttttaattttatttatttaaaattaaaaaattcgaattttttttaaaagaaaacttttttaggtgcttcaaatgccaaatattccatcacataaaatcagcttcagcatactaattgttgataatgaatttgctaatggaacaaaatattttttccattttcaatgtgctagccgtctaacaaacaatttttatttggaaaaaaaaatgggcgaaaaaaatgggcaaattgaatttatggacgaaatttgtgaggacaatttgtacagaattggcgtgatggtcactcaaaacacatcacttccgttacagtttcaaataaaagtaatttttgattacttaacatttggtaactgaaataaaaaataataaataaaaattgttgttttttttaattaccaaaagcaacagttcaataaatttccaattttgtcataaattttggaaaaataaaattttttaaaatttaccaatgtcattatttcattttaaatgatgctccaaataggaaaaaagcatgcttttcgaatttcgttgtcagggtacaattctggttgaaaaagttaaaaaaatattatttttttgaaaatttataagtaaaaacgaaattataattaaaaaaatgaaaatttatttaagaaaagaaaatatatcgccctacgaaaatgccctaatccgagaaacgaacgaaccgaagcgaatttgaaaataaactatgaattggtcgatttttaacgaatttcttcggtcgaattgccgagatattgacttgtgatggaaaatgcctacacaaaaagcaatgccaaaaagtgtcaaaatatttaaatctaattaatttttattttcattaatgaattaggacgtcgaattaatgagaaatccgatggggcaggaccaagcttgaaaagagaattaccacaaaatgaacaaaacgagataaaagttcccataataacgcaggatttgttagcaaacttcggcgggggtgaacaacaaaatgagcagcaaccgaatggagtaataaaaaaatatcgatttttaaaaaataattaaaattaattatttattaattatttataaaaaatttagccacgaagaaattttgttgaggctttaaatttgttgggcaattttgcgagtggtcatcaccagcaacatacagaagaagtgctgaactaaacttttaaaaaatgaattaaaaaaataaaattcaattggcgtacagtcaattacttataaaaatatttggttaaaattatttaatattagggttataaattatatggactaaaaaacaccaaatatacacataaaacatggactaaaaactgccaaaatatgtgttttaaaccctaaaaa

SEQ ID NO: 11194 - DNA, 1342 bp, Heterodera glycines
aaatttactttatttcataaaaattactcaagatggttaaaaaaattcaaaattgtataaattttttgcctttatcccacgaatatgacattcttaggggtgtattttcacccccgcgcccccccgcgggggtgaaggtcacgggggcgggggttgcgggggtctgagtcgcgggggcgggggcgggggtgaggccaaaaaacctgtcccgcccccggcgggggcgggggtgacgggggcggggctcgaaccctaatttctagtgacgaaaaatgaccgttcaaatgaaaaaattttaacgcagaaatcaggtgatgacaatagttagcgccaagaaaatttttaaaattgagctgatatttgctaacaatttttacacttcagaaaaccataaaatatcctaacggcatcataacacaaatccaaattggtcgttccaacgaaaataaacaacaacaatttttatgatcacgtcaatattccataaatttcgaacaattctcaacaatcattcacttctattgatcacttgggccgggagttattcgaagcctaaaaataaataaataaatttgaattttttgaaaatcgagacccgtccacgatgttacctaccatcataaatataaaggccaatttgattccactgatcacgaattcgccaatcgttcgcttcatcctcccattttgtccatttgctttcatctcgcacaattgggcaacggatcagcagaaaacgatcgcttttcttgatccttttcaatgccaattgttcacgagtcaattcgttggtctgatcaaatggcaaaacggagtcagcagaagacgaccaaatgacagcaatgaaatttgcagaagatgaagccgagacaaaagcctaagaggggaaaactttaaaaatattaattagtaagcacagaatttatgaacgaaaaattaacaaaattttgtcgagtttttgacttttttttcaaaatacgtgtcgataaaatagggaaaagaatattaatttgttaatggtaagcaccgctttaaatgctgcaattctcgatgacaaattcccaccatccttcatcaaccagcatctgaacacttttggcactttgttctgaagcggagtgaaaagccatttggccactgcttgtctatccgatgccgcggcactgtcatcgggcggaaattcggggaacatatcctcagcatagaaagagacaatgccaagagatggacaattgttgaacagtgacgggacgagtggacgcaaacggcgaaaaaaactattgtaaaattcgatggcaccatattttttgcgatcattgggccaatgttgcgcaaaatcaac

SEQ ID NO: 11195 - DNA, 3568 bp, Heterodera glycines
  misc_feature (1730)..(1730): n is a, c, g, or t
ttttactctattgaaatgtctttgaatccgacgattttctttggcagcggattttgcggaattggcaatggtttccaatagtgattgataatttccatttgcttggtgccattctttccaaattttcgatcaatttgaatagatttcaatgtccatttgcgcgttttgaagtgttcatcgatgtaaaggtcaaatcggtgactgatcagcgcaattccaaggccaagttgagaagtcggaagcaaatcgaagacacaaagccaacagtcagcagagatgaagctgaaaaaaaggaaaacaaattttaaaatttaaatttgtgaaatgtagcattttaattttacattgctttttccattttttcctccgcttcttttctgcggtctgacattttgttggcgcaaattacaagacagtttttgacggatttaaattagcttagggaaactaaaaaagacaaattatgtgaaatcaggagattccttttgtaaaccatggtttccaacacagagttcagggagcaaagtcccaatttcttcattttactgttcccgtaaaatctttttttaccggacttttatttaaaacggacacaattattcagttggtcaatttcgtctttttgtgtgaaccaaaaaaactaattttagtctatttaaattaaacaaaaaagtgattggataatttagaaacaaaatggaggagctaaaaaagcaaagaaaataaacatttgcacggcgccgccgcctgctgattaaccaacatttgtacaaaaaaaaagtgacagtcaatgccatttttctccgtcttttatatgaatttttgaagaaaaaatggggcctaaaatattgccttgaccaccaatctgacatccgacgattcccaacccccggattcgaaaatcccaaattttcaaaaatacatttttaggtctgttcagagacatccaacccaaaattataacatttttgcaaaaccaaaatattggccccaaacaaattctgctggaaagtagtgcatttttgtttggtcggaaatgttcaagtttcaggaaatcactgaatttatcataaggggcataacacaaatccaaagtgatcagttttgaagtgttcatcgacgtaaaagtcgaaacggtggctgatcaatgcaattccgaggccaagtgataagccggaagcaaatcgaaaacacaaagccaacaatcggcggagatgaagctgaaaaaaagggaaaacaaaattaaaaattggcattttaattttacattgctttttccatctctttttccgcttcttttccgttgtctgacattttgttgagccaaataattatgacaattctcgacagatttaaaattggcttagcaaaactgagattcctttaaactatagtagagcgggaccgggccgggatatggacttaaatgccaccaaagctatgatatttttttttgtcgaaaaggtactagtcggggacgtacgagttaggttttttggctaacttttttctttggcatcaaaattcgactaatttcgatcttttcgcaattttcatgtacatataacttttttggtaattgtctgatcgcgaagcgataacttagaaatagtttctaaacatgttaagctttcgaatgataacaacaaaatgttggatttggatgccaaagaaataagttattgccaaaacataaacatttttgaaaatctgtacacagataacatatnacataagtaccgaataaagaattagaaaaaaaaattttggaaaaattttcgagaaaacagtaatcctttataaaatttttaaaaaaaccgctggaaaatttttcaaaaactcggtggaacttatttgttagtgcacaaagaaaaaaaaaaaatttttttttaaattctcaacttttaaaaaatcacatgccatttcaattttttaaaaatggagctcttatagcgagcgtgcaaggttgctctcgtctaaccaccaccgtgcccctcccccccccccccgccttggtggttattttggccaaggctcttaaccgccgatgagtcatccatcccatcactgttagcgggtgcttcttcttccctgggcaagtcacttccgttttatttagccccattaatcactccgcttactcgctgaaccaaaatggcagtttcctgatgtcttgtcccaccttgtgttgggatttcaatggatcatggcatgcttttaggcaatgactaatccggctttgtgtttatcccatgaaggagtcgggaggggggtgggatttgtcaattgtcccacgattcgaatcccgacccgagtctcggcatttaaatctccttcaatgtgcatacacattaaaagccttcattattttcgtggttatcatataaaatattatagtattgattttttgcgtcgagagtaagcctcgagagtgacaaaaaacattttcttgacttgagaattatcattgctttctctttcgatgatagtagttatgtcataggcgatatgtgagagattgaaatgaactttaaaaaagattgactaggggagagaaagaaagggacgaaagagagagagagaaggggagagcagagagaaaggactgagagagagaaagagagagagagaagtagaggaaaacccaagaggaagggagaaaaacaatcaatcattaattaggtaattagctaatcagagagaaagagaagagtgagggagataaagagagagagagagagagtaaaggaaaaaaccaagaggaagagagaaaaacaatcagtaattaattaagtaattagcgagagaaagagagaaggaaaagagtgagggagagaaagaaagcgagagattaagtaattatagagagcgcgagagaaaattaggtaattagagagagagagaagagacagaatgttatttcttgtcaattatggtgagtcatttcattgttaattaggggcaattaagcgtttttgtggtatacaattagaggcgcggaaacgattttcaatttatggactgatcgaccgattttttgtgaaaggagaatgtctcttttgacgaaaaaggcgacgacattacacagagagaataaagaaagcgttaatttagatgatgattcattcacccctgggggagaatttttcaatgaaaaattttgaaattccacaaattttaacagcgtctattttttgcaagtaaattgagagcattttttacaaaaataacccgagatttgtcgagatttcgaattatatcaagattttgtccaattgtccgggttttcattcacttgtccggggaaaaacttcattgaaaaattttgaaattctacaaattttaacaatgtttttttgcaagcaaatagagtgatatttttgtaaaaataactcgagacttgtcgagattttgtcccatttcccaattgtccggtttttcccagtcgagaaatttcatgaaattttattttcaatcatgatttttgatttcaatttatgagtcatcatatttttttctaactacagaattttttggtgccatttcttaatgtgtattttgtgggaag

SEQ ID NO: 11196 - DNA, 3935 bp, Heterodera glycines
tagggctgctaattttatgtaaatacacataatttttccctggattctccatggtctaattagtaggaaaaacagtttcttttttgtgtttgcgaacaaaagttgggactttttagtacatagttctcaatttttccgtacatacttatttttttgacatattttgggattttttgagaatttaaaaattttttaagaaaaattttaaagtttttttgaaaatgtacacctaaaaatcggttttttttttcaaaaatcagatatcaaaaattaatttttaaaatactaaaaagtgattctaagcctattttggtcctttttatggcattttgtgattagttcactttttacgaaaaattttttccaaaaaaatgaccatttaaaaatttgtatttacatattttagtacatatttgggggtttttgtacatatgtatttcatacatattttagcattttttatacatattttatttacataattcgcaaattttcttatataaaattagcaaccctaataattttattttattttatttgggaattttaattaaaaacaattaacaatattttttaatatataataaatcgaaaaacgaaaaaacaaatcgtaaaacaccaaattaattgaatatggagatttgatcaaaagtgtgttccaaaaataagcacctcgctgcttttttgtgctgggtcgtttcgtaaaaactgcaattttacagatttttcgagaaaaattcgtcatatatgatagctcttagattgctctattagcaagaaaaatttcattgagttttcagaaaattatgtctgtttttttaacatttttgtgcagaactttctaaaaagtaaatgaaatttttcatgctaatagagcaatctaagagctatagtatgataccaaatattatttaatttgattctgtttaagaaaagttatgacgaatttttatcgaaaaatctgtaaattgacccagcatggtcaaaaacatgaaaatggagtcaaaaataagcccatattctttaaaacataattataaagcgcaatcttattaaagatttttgttaattagagactgggggataaatggagactgtgaggattatttttcgattgatttgtttagtgaaaaatttttgaatttttttgaacatgtcgccaaaaatgttatcgcggcaaaaaaaaatattttttattacatttttgttaaagaatttctgttttacatgaaaaatttgaaactccctatactatttatcaatggaatctttttgctgcgtttgtaaagcaattcatggaggaagccaaagctgttccgtctgcgaattttcgacagattttcccggcagcgcatatcgacaccggctcccggtaaattggacaccgaaaagtggacacaaaattttggtttggctaaatgattttattttattatgcacatatatgttttttataagcgtaataaaactgaaataaataatgtttttattacataaaacttcagcaaaagaaaaaaaccataacatccatttagaaaaaagttttcttttggataggattcccatcttttatgcaattttagcacattgaccaatcattgccctttttcttgcatttttttggcacattgatcaatcacgtgctggcgcgtttcttaaaaactgccacccatgcgcgtttcttaaaactgccaaaaaagatactaacatattatttcctattttttaatttaaatataataaataatttatgttttcatgctaatcgataatataaattacattttttgtttaagttaatacgtaacagacgtgactttcatatgttagctaaaattatggaaaattgtttgccagccttaaattatagccaactacaaaatatttgccaacattaattatatatttataaaattgaaaacgtatatacaaccattataaaaaatatattaacaattttttttaaaaatgaaaataaaaatatatatttttaatattatattatgttcttgcttaaaatttctaaattgtatcggattggaggaattaacatcaaacgaaagcgcaaagcgattggttgatcaataccttaaaaaagaaataaaaacaagaggagagttgttggaaaaactagaagaaattggtgtcgacctaagcctaagggcgttagatagacacctttcaaaaataagaagtagaaaatcggaaggaattcaagaggacatagaaaaagcagaagtgtcacaatgtttttcaaaatttgacaataagtttctcttcataattggtcacggtgatgaatatcgaaagtttaagcagactaatgaaagaaacggcgcaatttgttagctttacatattttaatgattataaattatattaagtatcatcacaagtgcaataataagagaaggtcaattagaccgaactcacaaaatgattcataaccagcattgtaacggtgttcctcttgaacagcttactgctgaacaaattgatagaagccaaagaagagatttagcgcaatgttctacggatcctaaatctatatggcgagaagtattgtaaaattttaataaatcccaaatagaacattttagggatcagaccggtccagagaacatgatattgctgaggatattggggttgaagatacgactggaataccatttaattacccgaattggcagacagtacggagtgcatataaccgtagaagaaaaaatcatttaggggattcgttagacccctttaatgttcccgaaagtattttcaagtgaaagcactgaaaacagcatttctagccaagaaaatcaagggggtttaatttacttaaaaggaaatataaaatataactaataaataaatattaaattttaaaaccaaaataaattttaaaatcaaaatattaaaaattaatgaactcataatagttcaacatgttgctaccatgatgcgttctgttattaaatttgtttttaatcctataaatgaagatcaaagacaagaactatgtgaaacgtggttttacagatttagtaagatttatttctgatcaaaagtaatagcaaatataggtgatgcaccgattgaatatccagtaccgtttgattttgtttcttctgagtacggacccggtgaagttatcagtatattaggagatggtaattgcggttggcgagctgtctctgttgctatgactggaacagaatcaaatcacgccgaaatccgaagagatgtcattgagtatttgcaagagaccattaaccaaaattcttatacagaaaattcttggtggtgtaagtataatataaatcagtactgagtgaatatgctaatttagcgttatttggcagcaatatatatattagagaacatctagaaaaagcaataacacccgaaacaggggcacacgaaactgaaaaatggatgggtaatttagatttagcggcagtcagcaaaatctttcgaataaatataattgtgtgtgaatggctacaggaagaaatttaccgttggcaagtgtattcgccaaatttggaagcatcgattagactttgtttaattgtgcaatttcatattgaaaatttagctttcgaatctgatccaaaaggagtcgactgcatcaatatttttatattatcaccatagccactttgaactcataaaacacccacaaaagataaattaattattttttaaatttttttatattgtattcaaaattcccttttgtaagttgcaaagaaatattgtggaacttattgtggcacttctatatttgattcttgcatgatagcccctgtaatatggttttgcgactttaaaaaagttataaatttaatagatttataaatgtattatttaaatattatagttaatcgttgctgttataaccatgatgtatgctatatagaaaaatggaaaaaacgata

SEQ ID NO: 11197 - DNA, 1125 bp, Heterodera glycines
ctgagataaaattccagaacaattagtatccctcacccggggctgagagtgcggttggaattcccttgactgtagaccagaaaaagagatagccatttttccaaaattttcacgatcaaatgcgctgagaaaaaaattccagaacaattagtatcggcgtcattatgctgagagtgcggttggaattcccttgactgtagaccagaaaaagagatagccatttttccaaaattttcacgatcaaatgcgctgagaaaaaaattccagaacaattagtatcggcgtcattatgctgagagtgcggttggaattcccttgactgtagaccagaaaaagagatagccatttttccaaaattttcacgatcaaatgcgctgagaaaaaaattccagaacaattagtatcggcgtcattatgctgagagtgcggttggaattcccttgactgtagaccagaaaaagagatagccatttttccaaaattttcacgatcaaatgcgctgagaaaaaaattccagaacaattagtatcggcgtcattatgctgagagtgcggttggaattcccttgactgtagaccagaaaaagagatagccatttttccaaaattttcacgatcaaatgcgctgagaaaaaaattccagaacaattagtatcggcgtcattatgctgagagtgcggttggaattcccttgactgtagaccagaaaaagagatagccatttttccaaaattttcacgatcaaatgcgctgagaaaaaaattccagaacaattagtatcggcgtcattatgctgagagtgcggttggaattcccttgactgtagaccagaaaaagagatagccatttttccaaaattttcacgatcaaatgcgctgagaaaaaaattccagaacaattagtatcggcgtcattatgctgagagtgcggttggaattcccttgactgtagaccagaaaaagagatagccatttttccaaaattttcacgatcaaatgcgctgagaaaaaattccagaacaattagtatcggcgtcattatgctgagagtgcgggtggaatcccttgactgtagaccagaaaagagatagccattttccagaatctcacgatcaaatgcgctgaga

SEQ ID NO: 11198 - DNA, 2937 bp, Heterodera glycines
  misc_feature (2830)..(2830): n is a, c, g, or t
  misc_feature (2886)..(2886): n is a, c, g, or t
atcaaatgaaatattttttgatataactttgctcaaacgtactaaatttttaattcttgatatcattagataggcctaagtgttttctattagcctacaaaatttcaaaaagtttcgttaagtttcaagaaagttatggccaaaaatgttcaaaaaaacttggttttttgagcttctcaggtcataactttttttaaacttaaagatttttttagaaattttgcaggataatagaaaacacttagggctatcgaaaaatatctagattataaaatttgatctattttatgcgaaattatgaataattttctgtcaaaaattttccatttgatggtttttgactaacgtcccagcaccgtacagtcagtacaacaattttagtctcaaaataagtctttttcaactattattttcgctaaaattccgtgttttaaccccccgccggggggggggggtcggttgggaatggaatcgttggagcttttccttggatgtcggttgttgaaacaacgtgatcacttcattttggtcgtccgccatgaatttaattataagctcaagcacaacattgccaactaagcaaaaacaaataaaattaaaattaaaacccaaaaaactaactgtatttattcttgtcaaaggtattgtgcaacaaataaaagtgcacggatgtcgcattttggtcgatttggccctgaatcacaacgctttccccgactaacagcggcgtgccgagattcagaaatgacttttcatcccgatactgttcggactaagcaaagaaaaatgtgcgcatttaagtatttcaaaaaggtgtaattaatgcccaaatcggcaaaaatatttagaagccactgcttattagtgtaatttttcattattttttaccgtctcctcaattatttcagcggtcccactctccggaaaaagactgccgttaagctgaaaagggtgattaatggatctacatcaaagcaattttcacaatgatgcaccaaattggcactaatttaacttggcccacccaaaattgtcaattaattgaggccacccctaaattggcaatagtttaatttggcccacccaaaattctcaattaatttggcccacccaaaattggcaattaattgggcccacccctaaattggcaataattcaattaggctcacccctgaattggcaataatttattgggcccagccctaaattggcaataattcaattaggctcacccctgaattggcaataatgtattgggcccagccctaaattggcactattcaatttggcccacccaaaattggcaataatttaattaggccacctccaccgttgcgatgtccgccgtttcgctctcgtgcatccaccaattggcatgccacgggaagaagtggacgtactttcttctgttcacacgaacttcgtagaaataggcatacagcacaaagtcgaattgcatgtacttgttgacgtaattcttcagcatttttttgttgactattttcggaagattgggcatatccttcaaaagttgggcagcattttcaagccataattaatttaattaattctaatttaagttaatttattaattctcatttaagccatgctcgagaccaattatatcttaataaaacattgtccactcctccaattatttttcattaaagctgcatcagtgcggcccaattagtccccaattaagcggtaacggctgtcgatcacctccaattatttctcgattaagacatgccccgcccatgtagtacgacatttgcgggttgaaaggttaaatctgatttgactcggcgcttattggtaccgacagactcaaaaatctcataaatttaaaaattaatatttggaagaatccaaaatttgaaaaagctaagggtaaatgaaaattttattttttcaataattgtaattattaattttttgtgaaaatattttaatttaataattttttttatttaattataagaaaaaatctcatcatattgaacattcaaattttgattttatttttttagaaagtcaatcctcaaatgtcggctaattgtccgtggttcccacctcaattagtctcaattagtccccctttgtctctgcccctgctcgccgactctcaccaaatcatcggggctaaatttggtgccattctccgtcatggaaatttccatgacaaattcgccctttttgttgagcaaccgaaccgaaaattcctttgcttcttcgccaattcggaattgcactcgcaacattttgccaatttcaggtgttccttcaatggtaagctgcgaattgttagctgcaatccgacaatgcttgggaattcgtggcaaaacgtcggcgaaactcgctttggtcgctttatccggattttcagtgggatggaggaactttaaatggacggaaaagtggaaaaattattggaaaaatgccatccccagactcattcttattttggtgactcagaaattattttttaattttttttaaagcatttagttgaaaaattgttgattttaattagagccttatattttaggctctagcaatttccaaaataggtatgttataggctctaaaaaatccataaaagaggcactaaaattggaaaataggcactaataaaaacacaaatttagggagagtaaaatgacaagattttagtcaaaagcaacaaaattaagccaaatcagtattgaaataatttaaaatcataaattcttgtcaagaaaataaataaaaattttagtgataaatttttgagaaaattttttcatagagttgtgtttcaaaaaatacaccactaagaagaatgaanaaatttatttcccaggaaagaatttttgattttaaatgtcgaaaataccctcttanaattcagtcgaaaagtcaggcaccccttttcctacccatgcgtgcatttcg

SEQ ID NO: 11199 - DNA, 3140 bp, Heterodera glycines
ccattttctttgcttttttgtcgtgactttgtttacacacggcatgatgcatttcggcacatttgtggccacgtcattctttttattggtttttaatcatcattaaaaatcaattaattaattaattaattggttaaatgatcaaatttttgtgtgcaatttgtccgaattacccccgctatattttggattcggaattgcttttctgggaccattccaaaggaaaattttgattgttcggcgtccaatgctccggggtagcaaatgagcatactaaattgttaattaggttaaattattaattataattttaattaaaaaccttaaaaaacaaaccctttattgcattttccgattattttgaattttaacaaaaatgaattaattttcttttgttttgattctttcttaaagcattggtccatggcattgtattccgtattgaaataatttttagtcgcatcactcaaataaaccaccctaaatttgcaaaataaaatttcacaaaaatatttttcaaaaattacttttcgggttcaatttgataagaaaaactgcaaaatgcagtcaaaaatacaaagatgatcaagcttttgtggttcattgcgctgaaaattgactctaaaatattttaaaattaatattcaattaagattcaaataaattattattttttttattttttaataatttgttttacgcaaaaataaaataaatgatattaacattttctgttttgcagtggtcaaaagcgaagcaaatgactaaaagcaaattgttttcacatttattttttatttttgctttccctaccgaatgactcattcatttattcattgaatccaccgccaaatacgatttgatgaatatttatttttatctgatcataatccgttttttaatgtacaaaaattgaataaaactatagggaaattaatattaaaaaaaaataaaaaattcaattataataaaattgcttaaagtggacaagaccataaaattactaattacatgctaattattttgcacattgactcgtggcataacattttcaaaaatgtaaaattaagaaaaattaattatacaaaaaacaaaactgttttttaacggtatcttgagcaattaatgagtgagagagggtaaaaggcggcgaaagctagctagtaagtatattattagctggaattttattaaaatttggagctcatggtttcagtcgttttttaattagtttttttaaataattcctttttttatatattggtaaaaatgaaggcttattttattttaaaattaaaaaaatattcacttgaatttgaaatgtttatgcgtattttatgcaaaataatatgtatcaatcaaagatgatcatcagtgaatacaaattacttaggaacgcatttttgaattcaattgaaacaatagcaaacgaataaataaatacccgtcacataggaggaactaattgggctattaattatttacaatagagagaaagtataatggacaattatcacctaattaagagtggaattatgagaagtggcagaagacacaaaaaaataaatacaacaaaaaagatttttcaacttcaatggaatttaaacaaagttcaagccaatgaaaggaattggaggggacatttggcaaatttgtcgtgttcatttctgaccatcactttgccgtctttgcttaatgagtcgggctgggcaaaaacaacctgaaaatgggcaaatgatggaatgtttcgagattctcgcttgaatttaaggcaactcgtacactgttttacagagtcaactcgtacaaaaaccaacttatattttacaaaataaagcctagctcaagcactaagcctaggcctagcctaaagcttaggcttaagcgtaaaccaaaagcataggcctaacctaagcaattgtacgagttaccttttgtacgagttgtcatgacttattcgaaggtttgaacttgacttttattgtcaaagaaatagccgactaatggacaattaattacattaattaaatgttgaaataatcttcaaaaaggcgttttcccacctgatccctgtacaagcgcaatttttgatcggacaaattgcagctttgcaacaatcgcatcggctgttcctcggctttatacgaagcgacacaactgctgggaaaagtgatcagctgctccaaccgatcattgagctgtataaaattgggcatttacaccactgttgccgcccattttggttgtttgaccaccttgaacccgtgcttccagtccgggtccccgttgtacaccaccaccaaacggtcgcccgggcgaagtgcgcattcggacgaagcgtactcgtgggtgacaatgtgcaacagttgcggcctgctgatgagtactaaaacgacaccaaactgttcaatttgcagctttgatttgaaattcacattttgccgtgtgctgaatcggcggctgttcgctgggcgccgtttgcgcgttttcctttttttgcgtggggacgggcggaagacggcgctgccgtctcacagtgccaacaacaacagccgaaccattggcaccggcgccgcaagcggactcagtccgcttttccctcctctcaaattggccggggacaattgttgccatttgtgcgccgccgctgctcacaaacgccgcccgtgcagaacgaatgggcggcttatgcacttaaaaacaaatttgttaatttaaaaatttattcattgggtagaaaattttaaaaaatgccgtggcataaattgaagtcccaaagcatcgttgggagttttttggattaattttgccgatgtgtggtacagtattacatgctaacttactgtaatggttgtgccgtattcctccgtttttcggctgtacgggcggcgatgccggcataaagtcggcacagtccaatgagaaggacttcatttgagatgaaagtttgggagtgcgtgcgcttttgcacaatccgacacgatttgacacttctgcgggggaaaaagtgccgttgagcggttccgaaatgccaagcgaagtgtcacgacgagaagcgggaagatggcacgggatggaaacacctgcggaaatttgggattaaaaattgaaaaaattggggttgtggacgaaaatgaaag

SEQ ID NO: 11200 - DNA, 910 bp, Heterodera glycines
aattaggcgaaccgaaataacatttattttcggtgccataattaccggttttatttacaattaaaacaaagacaatagcaattaataaagagaaaaaaggaatgaatgctcaaagtgttgcaagtgaagttctgctgctttctttgatgataatggaggagtgaacctcgtctacaaaatatgacgttttgcagtgagaaaagagaggagggcaaaaatctgcaaaaaatatatatgaaggattgcaatttgattttctaaaactgacaaaaatgagattgatgaccaaaatggataacacgatcgaacgtaggccaaacttttggcagccccaaccgccgaggacagtcggaccggaaacgcatccgtacgtttgaaatgaatcgtcgtaacccctcttccttaaacgagtttagtttcggaagcacattttaaatgagacaaatgacttgacaacgtccaaacactgctgaaacgaggggatgtaaagggcgccggaggcaatgccaagaatggccaaggaaatgcaaatccattcgagacgcctaaatggaaaatggaaaatgaaaattggagttgaatgaagaggaaatggaaaaacatacttttcaacaactccaaagagaaccagcgaaacaattgtggcggatgagccgaaaaacaccagaaaattgttgcaattccatcggtccaacaaaacgccccacagagtggcggtcaaacagtaagagccgtcacagaggaaaaacattaagccggttttggtgtgtgtgaacccaaactgaaaggaaatgggaaacaaaaatgaggataatgcagaaaggggtaatagtgtagtttatccccccaaaccctttttttgaaaaaaaaaactttcaaaaattttaatgtcataaaaaacaagtttcct

SEQ ID NO: 11201 - DNA, 1424 bp, Heterodera glycines
ccccaactaaagaaattctgctgaattcaagaaacaacgtacccaaatgcaattgcagccaaactggctatctgaaggccagcgatgcacatccatttagagccaatcacatgcatctgaatttgttttcaattagtaaaataacaataaataaaaacaaaaaaatatttacgtatttgccaagaagaggtgcagaaatgaacatcaccaattggaacaaaccaaagaccaatccgatttgagcctctgacattctgaagccgtaattcttagctttttgcatgtgaattctcaagtgaccctcttcgtttagcttcgcccgggtaaattggtcctatgcaactgaccaccacagtgctgcacagatttgaaattgccaacataacaatggcgaccaattgtcgattggtcagttccttgaacattgtcattttcatgcttataaaaagattaattggaaattagtacgcttgtcatttgtgttttactagcggggttagcgccttcggcgcatgggtcggggtcactttggcgcgggccattttggcgccgcgaactttaaagtgttataacttttttcttatccaaccaaataaaataattttgataccattaaataggcctaagtattctttattagcctgcaaaatattagaaaaaataaattctgtttgacaaaagatatagcgtgcggcgccaaaatggccagaaaaagtcagttttttgatgtcggattcgtgatcagcgaccccgaaaacctatattttgacttttttacttagaaattaaaaaaaaattttatggggacaaactgcataagagccacgttttgtcctgaacccagggcggccaagtgtccttatttgtaagatttgtccttatttggaggtgccaactcttagaaattaaaaatgtccttatttgtaagatttgtccttattttggcacgacctccttgctttgtgcttattcatggatttgaaaataaaaatgcaaaaatttaatattttttaattacttattgttttttattgaagcgaatatttgaattaattcctttttgtaaaaaatttcatttttatttttctttagtgtaaattcgttaattttaaatgcccaaaatgcccccaaaacgtaaaaataatctcttttaaaatggtcaaaatttttatttttcctccgacggcgcctatcggcaccgtcgggccccaaaaacttattttttcataaaaatgggctcaaaatctcaaaattggtcattttttttggtgaaattctgttaacaaatttcattttaatttgaaaaaattttcccggtggggccgccgataggcgccaccagaaaccaaaatcccaatttttctaaaaaaattagtttaaatctctagagttggtcttttttatacagatctgttacaaatcac

SEQ ID NO: 11202 - DNA, 1837 bp, Heterodera glycines
ctttctttaggcaataagtatttcaaaactgaatggggttgcgctgttagtcaagaccgtgttagcattaaccaacaaattggggaagctgtcaaggctgaggtggactgtgaagcaatgtttggccaaaaggacgtggatttctcaaatgaaaacttcacaattgatatgttggaagtggaaacgaccactacgaccacgacgacgacgaccagcagacaattggaagttattaccacggcacaaccaaccacaactaccagcagcagcaccaccaccaccaccaccactaccacgaagccaacaattgaggaatcaacaaactcaacgaatgggggtagtgtagacttaacttacattatgcgaaaagtttgcaattaacacatttgagtcaattcgaatgcgaaaaatagttcaaaaattaatttttcatatatggggccaaatggtttttttggatttcgattgtttttcgggtccagtgcatttacagtgtgacacaaaaataatacgtttaccaacaaatttgggcacattgaaggttccactgtaagaattttgtgaaactgtgcaagaccaaaaaagttatgacgagattgatagtattgcctaaaaaatattatataaaacaatttcataaaaaagaataatatgtttgtaataaaatttcaaaaatgcaataaattcatttgttttattcaattttattatattaacaaaagagacttgaatatacatattaagccctgttcctaaattaaatatttttaaaaaatataggaaacatcgtatgtgtgcaccacacgtctatttttttctggatggttattgcgctcggcggtaatttgaattttactctaaattttttttactaattttcagttgttatttccgttttgcatggcgtcattttgtcggctcccatttgaatgccttctgtaatggaggaagaaaaaaaaacaatgaactgagagattgtttgcttaaaaaagatgcactaatgtgataatcttaattttttattcatcataatatataatttaaaaaaccctaaaaaattcacttgccgtatgtacattgtgacagaataggcatgttaaatggaataattcagttataaaaaggtccatgtgcaattttatcggaataaaaaatcgcaatagatgaacatgttagtatgttatttttttctatttttttgattataagttcttttaaattttttcaaaaagttgaagtatatctaaaagctttggtggactctataattttcatgtataattgatattaaaatcaataaatagtacatttgttgtttaatattattgttttttaaagaaaaattttcttatgtttatttgactataatttgaaaatctaaaaaaagaaaaatatattgttttttttttaaattttgaataataattttaattatcccccccacagttgaacagccgacaaaattcgtcagagagtggggctgcacttttaacatttcaaacatcgacaaattctgtaaggagaaaaagtctgagcttgggtacaaagccaaagatgaaacactgtgcaattgcaagagtaaattcatttatccatccgccgttcttcaacgcagcacaacggcggaagtcatcattaaaccgaactaaataaattgaacgggatcaacaataaacaaactatttaagaaaaattacaaaaattaaatctaaaaaatttttgacaattttttattcaaaaagaaataataatttttgaagcaaagaattccatctttgctttctaaaaagcacaaaaatataattatatttgtcagtttttcaaatattaatatttc

SEQ ID NO: 11203 - DNA, 4352 bp, Heterodera glycines
  misc_feature (3926)..(3926): n is a, c, g, or t
ttatttcatggctttgtctataaaaagctctctctgtcttataaataacattatgattattttccactataaggttttaaaccgtttttacataaatagtttaattcagacccaatattgaaaaaattgatttttgatttgaaatttggatatgggaaaaaattgaatttcatacctatttattaaccctccgaacagttaaagtaaattcgctcattagcgatttgatatgacaattttctgaaaatgtcatctaatttcattaaaagaaagtttttttagatgtttggtttattccatcttcttatttttgactttttgctggtcaaaatatttgctggtgaacttcacatacgagtattttttattgcaagcatattaaaaacaattatgataaaattaagcgggattatcctgcgacctagcaaatccaaaagaagtctgagtgctaacaatttcaattttgtctctcttagccacgtccatgggaattgcgcatgactcaagtttgcaaacagcgagcccaagttttttgcaaggatagctgtggctgggcaacatgtgtatgaatttcgaatttttaggtctatggttaagccccgttcctcagggagagaaattacttgacaaaatttttcatgataagctggtgaagttcatttattttggagtgcaacaaacgacatttacaattccccggattgatcgggggatgaattctattttggactattaattgctttatttggaaaaccttaaggaaaagtagtggaaaaaaattatttttcaatttctttcaaaacatgtttgacagacacaatgttaaataggtgtacaaatatttattatttattttgaaaattaaatgaaaagaaaaaggagcataatatataattttgaccattatttgcttacagatttttaacccaactgctcgttttcgggaacgtaatgaactcttatacgcttttgaacaagcaggaagcgaaataaatgctatgtttgaaggcaagcagcgtttttttgacgaagatcattgctgtcctggcagcgactaccttttcaaatgttgtgaaatggtatgcacaaattagcagtaaatgtttttttttaaattaaccaaaatttgaaacattaaatttttgatagaccgtaagaaaattttcaatcattggaaaattcaatttttaaacattgacattcttttttatagttgttttttgtaaaaataaaaattgtcaaaataacagctctatttatacatttgtgcaaacgaaaatcttctgtttatgaccatgaaagtatactactaattttaattttcttttgtattttttttattaagatgccgaaacaaaaaactgtctatgaaggaggttttcatgtaatattataatttatatatttagaattacttaaagattataattaaaatatctaaattacttttttttttgcaactccattatctagttgcctatttataaaattaagtgcctacaaatccggtctctatttataaaaaagttattctataaattgataaaaataggattttttcatttattctatttttcatgactttggtattttttgtgactttttggcgattttttatgaagctctgaacttgctatttttaacagattttctattgatttttttaaaatataaattataaagatttaaaaataaattaaaattacagatcacggattacggaaaataccttgttttcgactcccccgtaattacgattaagaatttgcgtaattgaaaatccattttcatgcagccctgatttataagcataaaaataatttgcaaggtcaatttaggttttgtggaataaatcttgttttataatctatttccattttcttccatttagaatagattgttttatgtgtctggttgtccgaataactgtgtttgcggagagctaaccgaatttataacacttggggcgtgctgcgaccactcaaatgattgtgcttgttgttcaaccgtaataaatgctaatattatttttccacaaattttggcaaaatgttattgtcaacaatttttagatttttttacaaattaactagctgctaccttttatgatttttaatatataaatattttcagaattttagcacaaataaataaaaccatctgttatttaacaaattccggcaaaaagttattcaaaaagttgaaaaactttctgataataatgttacacccctgaacttggaagccttttatcttttttagccatttttattacttttttcttgttgaactaatttttagagattgaataaaaccctctatatgtaacatttacatacataatattcattttagcttcggagcacagagcgtccacctcaaaaacgttctgaaaataatattacacccatgaacttggaatcatttagtcttttttaggcatttttattgtcttttttgtttttgagcctaaacactaatgatttattattttttaggaactgaagaaaaccctctttatctaacatttacatatataactttcattttagtttcggagcaaacagcgtccatctcttccaaacgtacgtaattgatttaattttgctaattaaattacgttttattaaaaaaaagataatcacggagacaaaagaccacggagaagtcaaaggcacttgcagtaccagctacttcggtttagtatttgtggtttgaatatttaaattttttaaaacaattcttagatcttaaactaagtgagcaaatgaccaatttctacaaaaattttaaactcttgtttaggacgtacgcattgttcggatcaaagcaggaagactgcatgctatttacaaatcttgtctgcctaccgttacgaaaaaactgaaatcgaacaagatattctttcgagctactcaaactctggggttgatgagcgcaacaaatattggaataattggctaaacgcttttaaatgccattggatggaagggaagccggaatccgggtgttgtgcagaaaactataacttaattcgtcatactaaggtgctggctgtaatgatctcaaattttaaaatcgattcaagaataaaaaaatgtcttccaaaaagacagccggatacattgttaattgaaaatgaaaattttaaaatagattttataaagacattttttaattctttagttagctcatagtccggtacaacatcctcattgcgcgaagggaaaatgtttttattccggtgtttattgggtagtatatagcatgtttatttttgaatcacttaattggtttagatcatgcatcctatctcagaggctacatcaaaatcggtaagtacattaatatttcagttaatttttattatcttcttttaaaaaatgacgtttcattccttttttatgaactgaaaaactttttgataactatataatttagtatttttcatacgatagcttaacgattttaaaacagttctaagagtattcttttttgtttcttaggtttctttttgagaagaattatgtattttacttttaatttttacaaaaaatcaatcgtttgactccccgttataagaagattaaataaaacattccgttaatagctgagccaattggagaataggcgcatgacttgggaaaaacaatatacggtaggaacggagaattggtgattttaataatcttaattcttgatataattttacaagctctaagtgttttctatcaccctgcaaaatttcaaaaagtttcgttaagtttcagtaaattgtttgcaggataaaagaaagcatatagggctttcaatatttggttcatttggggccaagttatgaataacattatgtaaaaaaatccgtcagcggacaatccgtcagtatggacaatccgtcagttaaggaaaatccgtcagtaatggancaatccgtcagttaagggaaaatccgtccagtaaatggacaatccgtcagtggataatccgtcagtggacaattcgtcagcaaatttttttaaagcaatgatcaaaaaccttgcgaaaattattgttaaattaaataaatataattttttttagttcttaaaatttatagttactttatatttcaaataattgaccatctctagaaattatcatttaattttttaaaaaatgattatttcatatatttttttttaaataacacaaatcattaattcagctttttagcgaatcaaataaattttcacatgattttaaataaatctgggtattttaaaaataaatttgcttatggattagttactgacggatatccactgacggattgtccacttactgagggattgtccagtgacggattgtccact

SEQ ID NO: 11204 - DNA, 4575 bp, Heterodera glycines
tagataatttcgaagagaagctcggctggtaatcgcttgcgcatcatattggtcatgaaatttgaatgaatgaatgaagagtgaattaaaatatttttgtgcccggttctcatgggctcttttcattaattattcaatagttaatattgacttcaaaagacatttgaatttgccgacaatagtgaaggagataacttcaaaggaaatttgaatttgccgacaataaggaaggagagttcgagaaaattaattggtattcggatgggtacaccccgcccctaggcttcataaatactcagtccaaatcacatttcattcatatctgctcatgtctttttactcactttaataataataaaatttgtaaaaataattaaattataataaaatttttattttctgctgttaaccagagcggttgcccaattattaggctccgtttattctggcagcatttgtgtgtcttttagggcttgggattgtacgcgtgacctttactaattacccgagccgtttaggtgccctgtcgtcttgtgcttcatgggtggcagtgcgctgctcttcagggcatagttggtttaaaaaatctttaaattattattattattatccattaatttgcattcacaacgacaatttccatgcctcaaaaatatgtgtcaagattgttcattttatccattcaattcattatttttccctgtaaaattagataatgcaaaatcagcctcccaagcatccctctttgttttccattgaccaaattctatcggccccaagcaaaaagccgcgtcgcggcttcctcatcaatgaattgcttggagaggtgcttcaagagggcggcggcagcagcagctcatcatcatcaaagtctacaaaggaatacgtcaaaaagctggacagcaccattgagcatgtgccccgcttccaatacagcaaaattaagtcgcgattcagcattgaggatgtgccagcagcaaatcctgagggactcctggccggcatcttccagtactgccttgacgcagcgatggaggagagtcgtggacgtggaattgaacccacgcatctcggctgcatgatcagcagtccgttgctcaccggcggggacattcccatccccgttcgacaaatcacagacaacaccgtcaacaccatcctcaaccaattcaccaaagtggcacagagcaagcagcagcaaaacgtcacactgtggggcgagccattcactgtggtggtgaccacagttgaccgtactggactgcccggccgaagggtgctgaagggcggtgctcgacgaagcctagcaccagtgcatcatcgggtgacggaaacttgtttgattaaggtccaacatcacaacgcaagtataattttagtgacaattttgttaagatttgcaatccggacgggcattgcctcttctacgccttgcaggcgacaatggtggccaaaactagtggttggccccgttggaagttccatcgctatgtgcacagcctgcatggtcaacagggatgtctgaggcgggatgctttacaactgatgcagcaaattggtgtacggaccggtcggaacacctatgatgctgagatttgtgtgccgcgtgtggtcgatcactggaacaacacgcaacagcagcatcggtttgcagtgttcatctttggctcatcgggacaatacaagcccttgtacaaatacatcaacgatcattacgacactcccattgtgctctatttgaacaaccagcattttgatggtgtgcagaaattacatggcttgtttggacaaccctactgcctcgactgcgaaaagccttatgagcgtccgtcaaggcacctcaattcctgtaaggcgcgctgtttgctttgctcacgtgtcgggcctgcattcccttgtgttccattgggcggctttttccatcaatgtgcgggttgcaataaaaagtttcgcaataacgggtgcctccaacaccatttggcatccaacttttgcgcccagtcaaagcaatgcaaggactgcggcgttatatgggacacacgagtacataacagagatgggagaaaagtaaacattaaaaataaaataaaattttgtatttcttgctggatttagggtcacaaatgccacgagagctattgtcagctatgcaacacgtttcacaatcccgagcgggggtgcttcattcagcccattgagccaaaagagcaggacccgtaccacattgtggctttcgacttggaaaccatgcagcatcaaccagtggacccccagcagccagagaagagagagcaccagcccaacttcattgctgcccgagtcgcgtgccctgagtgcattgagagcggaaattggcggagggcaacagcgggctgccgattttgtggtccacatcgaactgtcgctttctgccagcgaccctttgaggacactcgtgtggacaaacgagtggtggcggacaacccactgcaggcgtttgtggattggctcatcttccaactaccagccaaatacgacacatacgcttactcacactttggcggacggttcgacatggttggttctggtctttcgcgagctattccggattgggttcaacccggagatgcttcgacgggtacacacaattatgaattgtgtccaaaaatttttcaaaatttcagggcaacaaaatgtatgagatgaaggtgcgcaagcagaagaggcgcaacccgaacattgtcttccgggactctttcaatttgatgccgtgcgcgctggctgcgctcatcccctcctacggcctggacgtcgaggacaagcccttctttccccatttggccaaccgacccgagaactacggccgtgagattcacccgacgcccgaagactacttggctaatggaatgatgcccagcaaaagacagaaatttgacgagtggtacgccgcgcatcgccatgagccctttaaattggatgaggcgttagcgaggtactgtaaaaatattttgctataacaataattttgttctcgattttcagttattgcaccaacgatgtggaaatattgatggcagctctggtcgcctttcgccgggaattcttcgaaatttcacggcgccaagactacgttgatgggattgacgacaaggagaaccacgacgggattgatgtgctgcgtgagtgcatgaccatcgcgggggcatgcatgcggcacttccgcaccaaccacctgcccgacgagcacttggccattgtgcccgagcgcggctatgacaacgcgcagaaccaaagcctgctcgccttgcgcttcttccactggtacgccaaggagcatggagtgcaagtgcagacagcccacgcggctgaaggagagaagcgcattgggccctactccttggatgagtggattgaggcggaacgacgcgcaattgaagtcaatggtaattgagttaattatttttcaccattattataaaatgggcaattttaaggctgcacgtggcacgggtgcaaaaagtgctacccaaacgacaacatgctgctccccagtgggaagactgcggggcaagtgcgcgaacgggattccaagcggatggaatttctgagagagaaggtcaaccgagtggacgtctacttggaatgcgaaatccatcggatgctggagaggagcaaggaaatgcgcaaggcatttgaagactatgtcgatgatggcccgctggtgatccgcgacgcgtttatgggagggcgaactggaccgctgaagctgctgcgcaaggctggaccgggagagaaaatctcctattatgacttcacatcgctctacccgtatataaagtgagcactgttaaatttgtaacaacttttaacattgttttctttacagcttcacaacccgttaccccattggcactcccaaagtgcatgtgttgaaccaggaagtggattggcgcagtgcagcggacaacccctaccctttggcattgctcaaagtgtgggttgtgcctccccgacgcgtcgacgtccccgttctgcctgtgaaagttggaaagcggctttgcttccccctgtgcatcacttgcgccaaagagcacccgacaggaggagtggacaacgactaccactgcgagcacaatgacagacagcgggggtgggtgatcacatgcacctccattgagctcaacgagacgcttgacgagggctacaccgtcacgagggtgttccgtgtcctcgagtatgagcaaagtgacgacaagctcttccgcccgtacatcgctgagtttatggcccagaagatccaggccagtgggtttgacaacagcatcagaggcgatgcggagaaggaacaacagtttgtgcgggagtgcgcagagcagttcgacatcaccatcgacccgaccaaaatggcggtcaacaaagggaagcggtccctggccaagctctgcttgaacaacttatgtgagtactgtcgtccattattattatatttaaaaaaatagggggacgattttcgcttcgcaactttggactcgctcaaacactcatcactgacgacccagaggctttggcggagtacctggacaacaaatccatcga

SEQ ID NO: 11205 - DNA, 1640 bp, Heterodera glycines
cgccagcatgtttttggctataacttttttctttgtaaaccaaatccaacattgttggtgtcgttcgaaagctaatcaatttagaagctttttctaagctattgctttgcgattagacaattatcaaaaaagttatgcatgaaaattgcgaaaagtcaaaatttttgaagttttttcttaataaaattttttccaggcttgaaaaacttttcgtttttgataaggctaataaagcatgttaagagctttcgaatgataccaacaatcttggatttggatgccaaagaaaaaagctatcgtggaaaaacgatttttcaattgtgtcacaaaaggcaaggcaaaactctgttgttatgttaaaagagagagttgggaaaaatgagagagcaaaaagaacgcaaaaacaattttgaaatagaaataaattcatcacattttttggcaaaaaacagacggagatttgtattattgtttagaaaaggattttgcagggcaattattaattcatttgtgacatcaatcaattggaaaacggcaaagttgcagcaaaaatgaacagagggcgaggaatttaaaaaattacaaatttttcatttgcctatttatcttttcgcatgcatttcagtttgatttgtggcgacgtttgatgtattttttgaatttttttccatgtttcagttggatttgtgcggatgtttggatggacattctgccatcttttgaccatgctcaactcggcctcaaaatggcattgctttccgaccgtttcgatgttttggtggacaaacatttcgatggaaaaagcgaattgacaatttggagagcaatcgcaattcgcaaggacaaaggaccaaaagcgaaactgtctgttctgatcgatgacaaatgcgtggcatttccatttcccgaccatccgttgcccaacaaaatccgttttaaggaccttcagatttagtaaatcaaaaaatatacagaaaaccaatcttcatttttccccttttcagttacgttgaccattctgtgctcgcatttcttcgttccaacaagcaaatttgggacagaagtggcatcaaattggatttgtttctgcctttatatatgaccgacgtcaagctcatttgggatgtttttacccgcgaaatttggccactttttgcgaaaagcattcggcatttgagctttcatgccgataatttggaaaatttgcgtcgccgcatttcaccgacacttctcactgatcttgatcaattgtattcaattgattctggtgctctattccccgatggaattgctgatgatgggccaaatgcaactgctggccaagcgttgtccaaatggttgcacactccgagcaaaaatggccaaccgaagcaattgcatcgcaataattattttggtccaccaaagctggaatgggtcaacaacttcaaagaggtgtgtctagccatattttctataaattcagtttaagggtagtatgcaatacgttccatgtaaaaaaacaaattgtttagtttttttccattttttatttagacatttcgccgtgccaccacttctgtcagttacacaattcaactttatattattgtggaaccaatgccaattgaccatttgaattggtgaacgaagtgacaaat

SEQ ID NO: 11206 - DNA, 2694 bp, Heterodera glycines
  misc_feature (235)..(235): n is a, c, g, or t
ttttttttgtttttccaaaaaaaatgcggaaaggcttattggttccagtggatcccctttaataaatagtgtgctcgggttgtgtgacttttgtgcgcttttattggtgaaaaaaaaattaggaaaaaaaactccaaaatttcggtttttttccattttttcatatattacttttctggaattgtctaatcgaggaagcaatagctcaaaaaaaagcttctaacatttatgcttncgaatgctaccaagattcttggatttggttgaccaaggaaaaaattatagtcaaaaaaagtcatggggcccaaacgtgacggaccaatgaccaagtacagtactttcccagaagtttggcagggtcagcaggagtcctgttaagacagaacttcagtccttagttttgtccgttctgttacggttcatttcggaaactctgaaggttttcaataagatattagtgtacatacatacgttttattcgaacgaaagaatcaacaaaagcatttcaaagagaaatgatggcataaaatccgtttcctattggcgagatcgatcatttctcaaaaataattaattcatttccacgcaattagacgacatcttcacaaatacaataaattattcattccgctgatccacttggcccgggagtcgtcgagaacatttcattgttgctttgatccgcttcttcttctttttcttcttccgctggtggcgacaatggcctaaaattaattaattctttttattttcgacaaaatcaaaaattgctgtttttgctgctcacccaatggatttatcgaaactccacagatcaaatcggatatggttcaaattggcattggcacccgaattttcgcagtcttcccacttatagcagttggacatatcaaactgtaaatgtccaaatcactttataaccacttttatcgtgtagaggcatagtcgatttactattttgaattttcggcttcttttggctccgcgccaaaagtgatcagaaaaaaacgatcaaaattccgaaaaatcgatgaaaatggtcaaatttgcaaaaattcctaaaattaatttttacataatatttggacaatttgcgtcgtcgcacttcaccaacaattctcactgatcttgatcaattgaattcaagacattctcccatcatttatagggttaaataaatcagattttaaacaatttttttgcggcgcattttttcagaaaacttggggaacttgggtgggcccggcggtgccgataggcgccgctggggaaaattttgaaaattttagtgtaatttgttaacagatttagtaattaaaatagtaaattaaatgaaaaaacggtaaaataaagtgtgggcatatgggattgaacccatattaaaaaaacaacaaaaatctgaagtgtgcactgggctttaccagtggcgatgctttggacaatttgcgtcgccgcacttcaccgacaattctcactgatcttgatcaattgcattcgatcgatttcgctcttatgtgctctggcacgattgatgatcaaattctgtccaaatggttgcacacgccgagcaaagatggacaaccaaagcgattgcgtttccgtgcttatgtgggcccacgaaatctcgaatggctcaacaatttccgagaggtgatcactgatcagccatattttcattaaacgacgactaattgatttaattgtccttgattttgacgagcagacaacggaaaatccacaaaattgccaccaatcgatacattgccatcgattagtaaagacattttctgttctggtccattatcgtttgcttttggtacttcgtccttgccaattctgatcatcctccaaattaccaaattggatttgtatgtgcctttatatatgaccgaaacttgggatgtttttgcccgtcacatttggccaatttttgcgacaagcattcgccatttgagctttgccgatggcgatgatttggataatttgcgtcgtttggtttcccctacaattctcactgattgcgaccaattcaaaatcaaacttctggccaggcattgtccaaatggttgcacactccgacaactgatggtcaaccgaagagattgtttgcagtggttatttggatccaccaaaaattgattggatcaacaacttcaaagaggtgtctcgccatttttctcaaattttgtttttcccaattttgtttagacatttctccgtgccacctcttcggcagttacactgttcgaattatttttcgtgtgaaaccaatgccaattgcgccatttgaattgatgaacgaagtgacaaatgagaagctgacactgattaagggtggagcttttcgttggctgttgaaacggtgcccaattgttggggagacggcggcggtggttcagaaacagcagaagaaagacgagaaattggaccgtttgaacggagtctacttctgtctttacgatgccattttctcgactcccgggcacattgatcagcggaagaaaaagtgatcatttgagaaatcgccgaccattattgatttttgataattgggttgattgatgctaattgtttgctctttgaactcatatcacttttgtggtggacttttcggggttactacatataaatgaatttctagacaatcgtttcgaaaggtactaaagaaatttcccaaccaaaaaaatcaacaat

SEQ ID NO: 11207 - DNA, 1992 bp, Heterodera glycines
  misc_feature (7)..(7): n is a, c, g, or t
caaaaantcggtgatcagagatcatttaaaagcaattcaccgttcatcccatggcttctcctcctccttatggccggccttacctcctacgacccattaaaatgccctcaaagtcggggcttctcttcccggccctcaacaattgttggcccctttctatgcttggcgttccgccaccaatcggactattggcctcaaagaagctaaatgttggcactgcctgctgttccgtcgttgcgggcggtgaccaaacgctggccaaactgctggtgttgctccagcccagcctatgctgcccgtaaaagccggataaggagaatgcggagagcccggggggcaacggcggagtgttcgggcctgaattggcacaaagaatttgaaaatgaattataataaaataacaaaagtgcaaaaaaaaaaagaagaaaattatgcggaaaatttatctatttaaaagaatcatttttcacaattcaaaagatgtaaaattaaaaaaaaaaacgaaaattaagaaaaatacttaataaaaaatgggtgggtaaattgcaaaaaaaaaaaaagaattaaaaattaatattgaaagaaattcaaagttaaacttttatttaaaaatgatgcaactcaaaagggtaagtaatgtggcaaaacgaatttaaaaccaattataataaaatgcctaaactaattgaagattaaaccaattcaaaaaagcgcaggttctacttcaaatttcaaaatatattcgaaattattattattttttattaattggacacaaaaattgctggctgaaatttaaataaaaatgcaaaaattgaaaatattaatttatggcgcctccttttaaaactgacctgatgactccttttcatcttcttcatcattgttttctgtttctttgttttgagtcgctgttcgttttaagcacacatcggtggaggaaaagctcttttgttgtgacattttgcgctaaaataataattcctaattattttaatttaaattttaaattattttttttagcggaggtaataattagggctgggaattaagtcacaaaaaatctacaaaaactcgactaaaaaagtcataaacaaaaaacgccaaaaaaagcacgaaagaaaatggaaaaaagtcctcaaaaattaggcaaaagtgaaaaaaataacttatttttaacaatttatagaaaaatttctgcaggttttcaattgcattttcaccgatcagagattatttttcgaaatgttcttcgctaaaattcaaaatttgcctttaagtcattttaaggtaaaaaaaagtcatttgacttaattcacagccctactaataattcacaattatttattcaatttaaaataatgaattcttccttgccatcgtcattcgcatttgtgcaagtcgtttgtccaactctctctcggctttttcctgaacatttgttttgaatgcctttaaactgttgctaatttttcgaacttacaattttctggtccgctatataattcaaatttgacactgacgaagaatgaattagcggagccgcagaatcacaagcatcggtttcctatgactacatgctaataaacgactataatgatttgggaaattattaaaaaacttttaaaatatttctgctttaacagaaacattattatgaaaaagcaataaaaaaacaaaacaataaattggcgttactttttttcaaaaaatgcacccctcataatcgatttttcaaaaagcaaagatcctgaacccatgatttggagaacgatcgaacatttttacgcttgaatactacatatcttcaaatttcagtacttcttgaaagggaaaagtgtgctctaaaattgcagcaaacaatgaacagactgtaaggaaaatttttaaaaattacaaattttccatgtttcagtaggataggtgcggatgattggatggacattctcccatcttttgaccatgtccaactcggcctcaaaatggcattgc

SEQ ID NO: 11208 - DNA, 2642 bp, Heterodera glycines
attatcccccaatctccattaatcccccaatctacattcattccccagtctaggaggcgtttgaaaaataatccctctatcataatcccccagtctccaattatcccccagtatacgagggggttgaaaaataatcccccatgggggataattagagcaaatacggtaattagccaaattaattttcttttgactaattagaatcactaaattgccctattttacctcattaagcttcagcaatgcgtccaattccttctccgtttgtggatggataaagaaacaacgattgccaaacggacaaatgccggttgtcgtgtaattttcacaaatgcgcgttttatgctttgggtttgcccgattagagcttaatttgttttatatttttttacaaacacaaaattttcactacaattaaaaaaattattaaaaaaaactttttcgaaattaacagtaaattagggagttttccctatggaaaaaataattttgatttacttatttctggattttattacatttatctatgtatgaaatttttctctatatattaatgatcgcttttcgaaaacatatttacatttttgtaatatattttgagattctgaaatttgtgggtttatttttttgaaaatttgaaaacatttttaacacaaaaaattattatgatgcctaatttggccttttgtggttttatgcatgtttcagactttttcgaagaatctacggtctaaaaaatagctgtaaaataatttatttacaaattttgtatattttttgtatttattccgtaaattttgcatttttttcgttaataaaaacttagaatctcatgcaattatattaaaaaaacaaatctaaatttttgagttccttttacaatattaagcaaaatgtgtaaatttacccaattcaaacccgaactaaggtaattataatttataattgagtatttaacttacggtaatggctgcaattcatcctcgccatgcgcaaaattacattggtctccataaacacacgctctgccctcaagccatgcctttaaataatttaaaaaagcatttttttggattatatttatcaaaaattatcggaattattcgcacaaaaaatttatgaattggattggaagcacaaaaaatttgataatattcactaaaaaaggcaattaattacatgttttttttggagctatagctgatgaacttttttctcgttttcactaaaaatgtgtaattttttggaattttgcaagaattgttggaaactctctaaagttacaactcaaaaaaaacaaatgaaaatataattgaatgcttccaaaccaatattgtggtttctcggctttattaggtcatgagtcataacagacaaaaaaaaagcattttttacatataatatgaccccatggaataataatatttaaatttttgatttattaattattccaaataattaaacaaataaggtaaattaaaataaacgaagccaatgcttctttcctaaagcagtgaaagcccccacttggcacattgccgttttgtacgcctcgcgctgccgcagccgtttcattgccgggtcgacagcggtgcagaacagagaagaacgacgacgactaaatgtggcaaaccgaattaattaattaattaattaagattaattaggttttaacttactttgcgaggacaggattgatgtattgggtgaggtcattggttgacgcgttcttggccaaaagcgaacgtttggccatggaaaatggttgcgcctgaggcgtcgagagcggaaactacaaacaaaagggtaattaattaattaggtagtaattaccatttcgggaaagtttgcctccgggaatgattcgttgtatttttttctgaaaaaacagaaaacaattgttttttggcattttaacaaagtgtgaaaatgaaaatgccattacattaaagcagcagtggccgccgcttccttactctgctcataattttgaatggaattattgtcaatttttctttgcattttttattctttttttgtgtccttttgttgacgcctttttctcacttattgtacatacaataataaatccaagaaggaatatttttgaaattaacaaattagcaaattttattcgtcatataccaaaagcaattaaaatgctaaaaaaggggagagaaaattttcgcgggtcagtggcaactcgtacaaaaatcacctgaaattttacaaaaataaagcctaggctaagcctaaacctaagtccgggcaagcctaagcctagtcctacctaaaaaatttattacaatttgccctcatgatggactcaattttcaacggtggcatcaatgccaccataattttttgaatgtgccaatttcaaattttgccccaattgttttttctctgcatttgcttggcgttgtgatgacacttaaagccatcacaaattcatcaaatttcttaaaccttctcctcccctgctgcggcatttctttgcgcatttgccgtggcaacggatttgaaaaaatgaaaaaaatggcgaaacaatcaatgccaaaatgggggaagccaggaggagtgcaaaattattgatggcattaatatttgcgtgagagaaaagagcgggtggtcattaagta

SEQ ID NO: 11209 - DNA, 427 bp, Heterodera glycines
ccttgcccagaacgctctgatggtcaactgtacgagcagtcaaaacgcactcacgcagaaccatctgcagcagcagcggcaattggaactgatggaattggaggtagaattattttaaatcatatttttattttaattagtctaaaaaagttcattaagactaagcttcgattgatgtcaaatttataaaatttggttgactgtgaagaaaatttatggcttctaagattttttgaatttttcttaaatccttttcctatgcttttccattgaatttttttttgcaaattttagcaaatcctcatgctgaattcgctgccaatgtccctgaagggtatgagggctattattcatatagcaaaatggcacatgcaaatacactccgaagacgccatctctgataaagcaagttatgacaaaatgtctt

SEQ ID NO: 11210 - DNA, 2544 bp, Heterodera glycines
  misc_feature (2371)..(2371): n is a, c, g, or t
  misc_feature (2406)..(2406): n is a, c, g, or t
  misc_feature (2441)..(2441): n is a, c, g, or t
tttatttttattttatcacttgaacttttcgtacttcgtcatagcaaccctattagagcaataaaagccggcaattagcacctccgccttatgacaaaacgaacaaatgccggaccaatgtccttcggtcccttttcgctcttttcgttttggcgacacttttcttttgctattttttggggcacaattcgatgccgacgcttcagagcttttgggtatttcgaaggatgcttttcgctcaaatggttgtacatcgaaaagattaccaaattcattttggttgccctttaaattaaagattttttaaaattatctttttaaattcaaaatttactggaaatttctgcacaattttgtcccacggggagagcataagttgatgttcgggctgacaggccaccaaaaagttggaaaattttgcgtaaatattctcaaattcggactcagattggacggttttcatcaaaacgtcgattttttccttgcttctatttccagccctaatcacaacaatttggatcatttcacctaaatttattattttccgacaaaaatattttcagtgaaaatattttgttggttactaaatgaaattttacaaataattttggacatttttaaacaaaataaatatagagactataaattgtaagaaaaaaatacaaaattgaacttcaattaaaaacacctaaaaccaaaaaataaaaataaaattttgatcatagatgttatggtttaattttctagcccaaagctttattgaatttaattagtatggcttcctttttttatgtaaatacatattttttcctggattctccatgctttgaatagtaggaaaaacactttctttttttgtgtttgcgaacaaaagttgggacttttatttacatatttggtgatttttctacatatattacatatgtacatatttttatacatattttggactttttcgcattttttcttgcatattttttcttatatttttcgtacttattttgagaatttttgaaaattaaaaaaaatattttgtgaaaaaatataattttttttttttgaaaaagtaccctaaaacataggttttttcaaaaaaaaaatggaccaaaaattaattatttaaatactaaaaggtgattctaagtattttagtacatatttgggttttttttatacatatatcatacatatgtcagcatttatacatcttttatttacatatttcgcgatttttcttacataaaaaaggaagccctattaattaatttttaattcgaaattcaccaatgtctctcagcataattaactcattttctgtccagttgctacaatgagaaaacatttttgcgcttaaaattgccatccaaaatttgacaatttgccgcatttcctcggacatttcgtcagatttggatattccatccgccgaccctttgtcctctgcttcaattggcacaatccaatgacaaaatgaatccaaagccaattttggctcactgaagcgcagcattttttctcgcacaatggcccattttttacagaagaaattgttaaaatcctgacactaataagccaaattgaggcaattaattaactaattaaataattatatttaaaaggtatactttaaattggccatccaatgactgtgaggagaagtgaagtttctggcttatttggcacaattccccgattaatgaaacgatttgctcatcgaccaatcgaagtttgactaagtcaaaaagtgggtgattttcaccattaaaatagtgccaaaaagtgtcaagcattgtttcgcaatcgccttcaactttatgcccgttgtttattctctgtttcatttcattgaacaattcttgcaaaattgcgaacagaaagaaattttcctaaattatttttccaattttttaaatttgtttctaatcaaatgaccttttttgacagccaattgacaaaaggattggaccattggtcaaaaatgaagacaattgcgtcttttttgtcggcaaatgtttcaaaataattcaaaatgcatttgctgttgttcccattgtcgacaaaattgcacaaactgtcaagcggtacattttttgccaatgaatacactttttggaccgcaagataagcgaatgggtcggaaatggcttcctgagaaaattttaattacacctcaacaaattaacaaataatggaaatgcatttgaaaaattggctctcagaaaatgctctgttgaaatatttactccccgcccccgttctgaattcgtcaataaagttttttcgaaaggcttaaaaagtttaataaattttgaaaaattacaaaatcctttaaaaatattcatataatattaatttaaaatcgaaaaactanaaaattcttctattacattatgatgtcacacttanatggcaaaatgtacaatatactctttctaaaactncataaaaacaaaaagtttgaatttatagtttcacaagaacatatagattgttagtagaacatctacagttttttttttgataaaaaaatgcacgaaaatcaca

SEQ ID NO: 11211 - DNA, 826 bp, Heterodera glycines
  misc_feature (63)..(63): n is a, c, g, or t
ttttctgtctatcattttataaataatttttggacagtgtaaataaaaattttgaaattttancttaataaaaacaatacctcttcgttcaatgggatgatatgtatggccaaattctgtgccgttttcccattttgaaatgtccgatttttttccatcaaaaattggccattttcatccgttgtaacagtgtaaaaacccccaaaaccattttggcaattgctctaattgccaaataagggtcgtccagcggaaatacaaacttttattgttttcatcgttcccatgcttttccaatcgtcgaacattaaagaaaattgagttttcctcacattcaaatttttgttgtttaaaattggcccaaattataattcggtaattgcccggcggtgaaatctttacgaaatttaacaattaaaaatttaaattttttaattgcaaagttttcgtcgctaacttgtgctaaatgatgcgtcgcttcgttaattgtttctacgttttggtcatatttccgaatgatttggcatacagaagaagaaaattgggcaagaagcaaaatgagaaacggaagcacatttttcatttttctataaaatattaaatattaaaaaagtaaagattttctcaatgtaatatttagaagccaaatgatgacagccgtggaaaatggagcgtttagttgggctaatcgaaggcacttaaatggaagcgcgcaatgacgttaatgaggcgataattttggcataataatgcgcagcaaaggatgaccgaccctgtgcttttttctctcttcattttggcaatctgtgcaaatcgattaaacaaa

SEQ ID NO: 11212 - DNA, 3067 bp, Heterodera glycines
gaattttaaatataaaaagaaatttgcatttttaacaggtgagtagaaaaagataaaattaataataattttttttctttatataataggggaaaatcattttttattattttcaaaatacataaattggaaaatagaaaggaaaacctgcaacaaaagtcatttgatgaaatatttggagaaaaatgggaagaaaaagaagaaaattatggaagaaaaaagagaaataattgaaaaattctataaaataaaagagaaaattaagcaaaaaggaagaaaatattcaaaaaaagaatggacaaaaattgagacaaaattaggaagaaaactggggacaaattgcctatatatttataaatggattaaacaattagattttaatctaagaataattcattctaataaagaaaaaattgaaaaaattaaaatgtattggcaaataaaaagagcacatccgaaaatgagtgacaagcaaattgcaaaaacattgaaaattgaaaaaacaaacctttcaaaatggaagaaaaaaatttgttgttgaggattgaaaacggaaaatcttcgaaaaacgacgattcaaaaggaaaaatcgcgaaaaaattggggacaaaccaaaattatatttataaatgacaaaaaaacaaattgcaaaaacattgaaaattgatcaaagggccattttcaattggaagaaacaatttcaaagaagaattgctgtaataacagaagaagaaaaaagagattgtagcttttcattttgaaaataaaataatttttttttaaaatttttttgctattcatagatttctttactaatttttcacttttgtcctggtgtatgaattatttatttatttttggtcattgtaaattaatttaaaatatttctgattttgaatgaaacatttattgatatttactagagaccggacaactggggtcggagggatcccgactgaatcccgatcccgatcaatcccgaacattttggaaaaacgatcgggacggatcccggttcgggatcccgaccgaatcccgatcccgatcaatcccgaagattttttttcgggatcccgcgggattatcgggatttgctcaaacccattttttttttacattttgtgccaagttttgttcaaatatttatctaatatttataattgatcaattcgattgaagaaaaaaagggatgtgaattatatcagatttttatagaaatttttcaaaattggaatatcatgcccaaaaaatcagattttcaaaaatgagaacatttaacaacatagccttaaataatttttttacaatttaataaattaatatcaatttttgtattttcgcctcagatgatcatttttaataattttgagaaacggaatcaaaaaatcagatttttaaaattttttttgctgcaaattttttcaaaaactttaggggaaccggggggggggaggtcggcaaaatgcctaaaaaatttgccaaaatttctaaaaaaattcatttttttgggggtttacttttaagaaatttccaaaaagtcgatccttaggggtgtattttttcactttttttccattttcatgtgaaaatttgctaaaaatggccgaaatatggacttattcccgaaacccccaaaatatggatttatatggactaaaaaccttcaccaaatcaaaaaattttaacgtaaaaatgatatttttgatcccctttcttcatagcatatgcgcagaaaaaatatgtttattcaatataatttataaccctactacatatttacggaaaaaagcaaaaaaacatatacaaggtgacattttgatggaaaatgcgtcagtgaatcaggatttattcaaaaacgagtactttagtattattacctgaaagcataagcgttgattggtatgtaagcaagcttacaacaatccattagagtataatttcatgttattagtgaacctttaaaaacttaattgaaaaaattagaacgaaatttttctacattctgaccttttgtaatacaatacttaatgaaacagtactttattttagaaatactgtattactgatgcattttctactgacgctttttacacttacgctttttccgggaaccttttaaatcagttccccgataaaagctgaaaaataatttaatgaaataacctataacaatgagagtataaattttttaaaaatttctcaaaggttgagatgaacattggcagtgtggggagctcggcgatgggctctcggacagccgaaatgcaccgtcgaatgctgcaaaggatgcgcatggacgcgtcgaatgtgccggaaaatcgagcatttaatacactggcacggggacttttccaagcctggtaagtgcaaaagagagcacagaaaagtgtcacttttatagaaatttcttagaattttcattaaaatcgatacaattttttcttcgttggtgccaatcagcacttccgacccatcaaatattcagaaacttacttaaaatccaaagattcaaatcaatcatgcatgatggaaaaaagaatcctaattaacacaagctgaacgtaactgcattttatcacagacaatccctgatcacggacaaccaaaaacgttgtgattcgcttgatccgtgatcatgtccactccgccctgaaattaattattttcacttgatttttctaactttaaaaccctatttaattgacccctttttgctaagagaaaagtccaaggcgattttttttctcttataatttattacacagatttaaaaagcatttatttttaaggctccgattcggcaatccgaatgccgtggtcgtttttgccgttctccaagggtcaatgcgccgtttcgatgagcgcgccgtcgaatatgagctgcagcgaatttctgattggcaagtgaaagttgtgcgcttatcgtcgaaagaggcctattcaaagtgagttggtttcgatctacgataaatccggcgcctttgacagttggcatttaacggtgatcccggtaagatccaggggaagtggccggcgccgggtttttacccatattaaaaaattcaca

SEQ ID NO: 11213 - DNA, 2513 bp, Heterodera glycines
ttttgtgaacgtaattgttaaccatgctcatcgattaaaacatttgaaaaagtatttgcgaaaaaaggtcaaaaaccatttgaaaatttcgtagaaaaaaggtcataacatgtgtcaaacagatgaataaaacgaaaaaaatgaaaaaatatacgagaaaaggtggtaggtctaaaaacaatgaaacaaatgaaaaattgtaatatatcgcatttgacagcgaatcaaaaaaattcttagagatgaaaactaaataaatgaaatacgcgaaaaatataaagatagaaagacagaaaaaacaacttaaatatgaccgaatttcccgccctccctccagcatccaatccctccctcctcccctaccgcgcttttcgttgaaaacatgtgaaaaacaaatgaaaaacaggtgaaaaatatgtcaatgtcaaattaggataacagctgaaaaagagtaagaggctataaatgttgaacaatgacgcattataaccttaaaacatggacaaagttttattaaaaatttattacggcctcaaatccccagcaagttatgcaggggtacaaaaaatattagctgaggcaaagaaagtaaatccaaaaattacacccgaagatgttaataaatttctcgaaaaacagagaacatacacgattcacaagcccataaggaaaagattaccaagactgaagacaatacccagttccaattctgatcacgttcatcagtgtcagcttttcttgggtccgttcattcaccaattcatatggcacaattggcgttgtaggagccaatggaaattgaacaatgtaagcggcggccaaagtggtggcacggagaaatgcccaaacaaaaagccaagttgatcaaatcaaacgagcgctggactcaaaggcaagcacggtcttgttcgattcccctcaatggaacggacatctcggctgcttggcaaaacattgtgacttttgaacagttgaacagttcatactcgtaaaattggtatgaacaaaaaaaaagtccaacattttagtataaaaataaaacttttttttttgaatttaaattttttcttttattttgaagttgaaatttttttaaaacaaataaaaaagaaattgggcggcacagctcggtctagtctcggctaacagaaggcaaggggaattgaactcataaggcccaaggctcaaaagccaaccctttaccaactgcgctacgccgcctatgttgattcggcattttctaaaattttgagctgatatattagagaattatttttttataaatttaaagttaccaaatcgctctcccatttttgatagcagtataataccgtataggaatattgaaattaaatccaccatgttggctgataattttaaaattataattaccaaattttaaattaaatttaaagaataaattttaatctatttatattgtgtttaattaatgttttttatttattaaaatattaattttaaaaattaattttggtattttttgaattagagattttgcaatttgatgacaatttttaagaaattaaagagttctagggagtcgttgcctgaaaattttttttaatttttgctcatttgttaataaatttttatcgtgccacccctggtaatgaaaaaatttggtgaaaataatttttttttgagagtgtgtaaattactcttttttttaaatcttcgataattctcagcgagctgagattttgggccctcagcttttcaattcagttaaatgacgtgaccgaccctagtttaaatttaattatatatttcttattattttattgaagtgatttaatttttatatgaaattatatataattccgttaataatttaaaatgatttaatttaatgaataatcaaatgaaagaaaaaagtcgaatattcaacagcattcacggtgattttatcataaaatttgttgaaaattttgtcaaaataacattcgttaatttctgtgtcaatcatttcttattgttgataaattaaaatgaattttcatgtggacgattgaaggcgacttgaccctgttgagaattttcatttctaatcaacgatcgctgaaatcatatggcgcttcaaaataaaaactttgtctgctgcgctttcaatattttttttataatggcaaactttatatgagagaatgcaataatttgataaagaattaagaaagcggctttttaaatcactgtgccaacgccgaagatgcttaagtctgcccactgaaaatcaccatcttgctgaaccacaacacatctgaatagggggataacaacaaaaacttttccaaatctatcgccattttgattgtacgcttttgtggtctattaaaataataataaaaaaattcacatcaaatattattagggattcaaattatatgtaagaaaaaaagaattggacaaaaaacccgtagcaaaccaaaaaataaaatgtttttccaactattcagagcctggaaaaacaggaaaaaatgtgttttactgtattt

SEQ ID NO: 11214 - DNA, 1597 bp, Heterodera glycines
atatttttttttgaaaaattccgacttccgacatttttggggtcggaattccgacttccgaaaatttttggggcatcggaattccgacttccgaaaatttttggggcatcggaattccgacttccgaaatttttgatgaaaagtcggaatttttctgagttttttttttcaaaaaattagcaatttttgtacaatttatgttaataaattgcatagaaattttcaattttttttccgacggcacctatcggcaccgccggactcaaaaaaaaacttaattttcttgaaaatttgctcaaaatcgctaaattttccattttttggacaaaatttgttgacaatttacattaaaaattacaaaatttttcccggcggcgcatatcggcaccgccggacccttccttccccacagtttctcaaattctctttggataaagcgcgccgcaaaaaaaggtgtaactttcccaaaaaaaaaatccaaaataatgtaaaattacttaaaatattttgatctttttaaaaaatatagaaataaactaaaaacagtttgaaattaccttttacatggttaaaaatttaaaaatttagcctattaaatattttttaaaaaatttattatatttttttttgaaaaattccgacttccgacatttttggggtcggaattccgacttccgaaaatttttggggcatcggaattccgacttccgaaaatttttggggcatcggaattccgacttccgaaatttttgatgaaaagtcggaatttttctgagttttttttttcaaaaaattagcaatttttgtacaatttatgttaataaattgcatagaaattttcaattttttttccgacggcacctatcggcaccgccggactcaaaaaaaaacttaattttcttgaaaatttgctcaaaatcgctaaattttccattttttggacaaaatttgttgacaatttacattaaaaattacaaaatttttcccggcggcgcatatcggcaccgccggacccttccttccccacagtttctcaaattctctttggataaagcgcgccgcaaaaaaaggtgtaactttcccaaaaaaaaaatccaaaataatgtaaaattacttaaaatattttgatctttttaaaaaatatagaaataaactaaaaacagtttgaaattaccttttacatggttaaaaatttaaaaatttagcctattaaatattttttaaaaaatttattatatttttttttgaaaaattccgacttccgacatttttggggtcggaattccgacttccgaaaatttttggggcatcggaattccgacttccgaaaatttttggggcatcggaattccgacttccgaaatttttgatgaaaagtcggaatttttctgagttttttttttcaaaaaattagcaatttttgtacaatttatgttaataaattgcatagaaattttcaattttttttccgacggcacctatcggcaccgccggactcaaaaaaaaacttaattttcttgaaaatttgctcaaaatcgctaaattttccattttttggactaaaatttgttgacaatttacattaaaaattacaaaa

SEQ ID NO: 11215 - DNA, 1680 bp, Heterodera glycines
atcttttggtttttcaggaccaaaaccgcagcatctccattatctgcatccaaggggtcaaacaacaagcccaagcagccttgaattcggcctcggcatctgcttcaatgacatctgcgatgacgtttactgagttagcaatcaaataatttgccaaaattatcttgcttcttcctggtccttacagacgacggtgtacgcaccgacacgcttacctaaaattaataaaaataattttccaaagccgtgatcatcaaatcattcgagggtcagtttaaaaaataaaaatgcctacgaaagacgccgaaacttttaagtctgtgggttgactacgccattggacggaacaggagacgaaaaaattgtttgcttcaagccggaaggagcaattggaccgatagggacaaaatttttgcgcgagtttagagaaaatgaaacggtgaaagatggacgaaacgatcacgaagaagccggcttatctgatgattagggatgcgacttttagtgacgaaaaatcccaaaatagttaactaaaatagtgagtaaaaatgccaaaatagtgagaaaatagtgtcaaaaagtccgaaatagtgacgaatagtgacaaattttcagccaaaaattgagcaaaaataatttttattcactatgcagttgcaaatgagtaggactgggatttttgagggcaaaaaatacaaaataggttcctaaaaaataatttttagaattaaaaatttttgcaaagaaagtgaattttgtgaaaaatttttcatttcttaggagtgatttttgaaaatttttatgtcgattcttaggggtgtattttttgaaaaaaaattttaggtcgattcttaggggtgtattttttggttttattgcgtttttgttaaggaattttccaaaaaatgttgaaatagtgaaaaaatagtgacaaaacgccaaaatagtgatttttaactattttagtgacgaagtcgccaaaatagtgatttctagtgacgaaaagtgacgtccaaatgaaaaaattttaacgcagaaatgcgctttttgagctcctttcttcaaatcaattgagcaaaaaatttagttaaaacctaaaaatcgcatccctactgatgatgatggtgatgtagagctggatggagtcggagatgacgatgaatttttcatttgttagcactttcaatgtcgattttgtttgtttttttgaaaaaaattgacggcatataattttcagaaaattttatttatccccatgggggataaatggagactgggggattatttttcaaacccttcctagactgggggataattggagattgagggattaatggagattgggggataattagagcaaatacggtaggtcgaaatggatgccggattcgtaatcagcgaagatcattcatggcgtcgatcagccagaattgctccgatcgagttgcggaaatgccaaaaaaccggtttttgaaccggttcaaaactcgaaaaattgagacatttcgcactctaactttttttttaacaatcgaatcccgacaaatttggtacttctaatttgtaaaccatttcgttaaaaattagcggaatgacgcgactttgcacaacagtgggcaggttgaaacgaatttgtgcctgagaatttgtctggacaaatttgcctcttggaatgagcta

SEQ ID NO: 11216 - DNA, 1778 bp, Heterodera glycines
ctgctgctttccctgattttaggaggttttcagggttgtaaaccatgattctgacatccattttgacccaattcgaacaccaaacccggattcaaactaaaagaaagaaattcattttaaccaaaaccgattcaaaaaactgaatggaatcaacaagatggattcactgcctttccatatatttgaatcaattttggacaataaatgtggactttggtgaatgaatttttgctcgagttcggggttcgaaatttgtcgacatgaaggtattgctgatcagcgaccccgaaaatcaagcgttttcctttttgcgtgtgtgtatttttgtgttgacaccgaggaactgaaatcgaccaatatttgtgaaacataatcaaacaacttttatatatacatacaacaccacattcattatataaacaatgtatgatcaatcatcgttttacaaatcttatatcctcgctcaatttccaatattagcgcgagggttcatgctcccactcggcgtcttctcttgcttctcttgctgcttgggtttcttctttgaccgcacggaagcagatgccgaggctggcgttttgtggctggaaaaaccaaaagataattttgccaaattatttgattgctaactcagtaaacgtcatcgcagatgccatcgtaccagataccggcgctggagatgctgcggttgtggtcctgaaaaaccacaagataattgccaaagtatttgcttgctaactgagtccgcttcatcacagatgtcattgaagcagatgccgagttcttttgctgcttgggcttgttgtttgaccccttggatgcagatgctggagatgctgcggttttggtcctgaaaaaccaaaagataattttgccaaattatttgattgctaactcagtaaacgtcatcgcagatgccatcgtaccagataccggcgctggagatgctgcggttgtggtcctgaaaaaccacaagataattgccaaagtatttgcttgctaactgagtccgcttcatcacagatgtcattgaagcagatgccgagttcttttgctgcttgggcttgttgtttgaccccttggatgcagatgctggagatgctgcggttttggtcctgaaaaaccaaaagataattttgccaaattatttgattgctaactgagtcagcgtcatcacagatgtcattgaagcagatgccgaggccgaattcttttgctgcttgggcttgttgtttgaccccttagatgcagatgctggagatgctgcggttttggtcctgaaaaaccaaaagataattttgccaaattatttgattgctaactgagtcctggcagataccggcgctggagatgctgcggttgtggtcctgaaaaaccacaagataattgccaaagtatttgcttgctaactgagtcctagcagatgccgatggaagatgtgctttgcgaagtgccatcgtaactcctctttcaacgcaagcgcacagaacataccagaaatacttaaaaaaataattgagaaatttcattaaaaaaatgctttataattaatttgacatacaatgccaccgaaaaacgcaataatagcggtcagcaaaagatcccactgcatggcgaaataagattaatgaatgacgaactgagcaacattttgtctatttatacatttgtaagtagtgtatgaataaaaactgcttacctaaactttgtttgctcttacaattcggaaaaaatcactacttacaaatgtataaataggcaaaatgttgctcagttcg

SEQ ID NO: 11217 - DNA, 2554 bp, Heterodera glycines
cattccccgggtgattcgatagccgacgggcgattaaatggacaggcgaaaggccccgggcaaaatgcgattggcgagaaaaaattgggcgcttttgcgcaatgacgacaatgggatgagtaatctcacaagggaaatgttcataaagctatgctcattagggggaggggcaaaagcaaaaaatgcagcaaaagcagcagcaggtggtcgtctttttggattgggtccctttttcgaccggactttgtccctttgctttgtttctcagtgatttcaaatgaaattaaaaattgtcgacgcattcgcagacagagaatgggagaagccaattgggacaatttggtgagtttttcttctctcatccaccgctgatcagaagagaaaggactgatcatcggatggacaatgagtcattcgttcattcgttcgtcggcccatctttcactcctcgtcctcctcctcgtcgccaacctcagctaaaaattagttttttttttggattttcgctggtttccagccccattctcctatgcttcttccctcttcccctccccagtgattctcccgcgccctcctcttcggttatgcctaccagaggtgccgcgcgttacccgaaacgctacacccgaaacccggatttcagcgacccgaaacccattcgtttttttctttctccgcggtaaccctggtccctccctactcgtttcccctgcttctcctctccctctccacttacgctcttcctcttcctccgcctcctccggcgtcggtttcgccaactttggcgtggttggctccgcctcgctggctcctccgccctttgagctcgcttggctcgcccggcgtcccgtggcgtccttttccaccttcttcgtccattccggcttctccgccttgttcttctgctgaaatgccaaacggcgtccagcaaaagtccacgcgggacaaacgacgtctccgcgtgactcttgctggacacaggccgaattctctcatttgtccgcccgtcggacaaaggacggacagacaaattgttaaccggggaataaatgcacagcaaaatccatcccagagttgccagtccactcccgccagtatatgatcatagtggtaaaatgcaaatgccatccctcttcttcactgtcaccctatggctacacgacattttgccacccggacatttgaccaccaaagacaaaatcggacgtttcgccaccaaattaaaaaaaacagaataaggccgatgttaccaaaataaacttgttttgctactcgggcatttctccaaactcctcacattttttgcaaaattcattcattcttcaatcattgattgatgaaaagtccgactttagctttgatgctgaactgtccgtttttgctgtcgcctctcccccaccctttttccctttcctcctcaatttgtcccaccttgctctccaactcttccatcacgttcttcttctccaccgtcttcagtttcgatcggaagtcctccttcggcgcggtactttcgccctccgttaatgccgctttgcggaatttgttgtcatatttggacactttcttcagcgttggtttcacactttaatatcaaatattgtataaaaataaataaataaataaattattattttttttaaatctcacaattttccacgcaaatcattcacagaaatggttatttcgctgatctgaaacggtgaaattagcgtttcttctttcgtccccaattcgtaaatgcttttgctttacctccgcgtccttttgcgagaccacgaagttgatgtcgtacttctcctcctccaacttgagcatttgctggaacaggtcgttgtacatcttctccagctgtcctaaatccgagcactgatctgtgtctcccccctccctctctttctctgcctttgtcctcaattgcgtcgatattcggacattgcggaattcgcttgctcagcacattttggcgttccgagtcaagctgtttctgctggttcttcaggttctccgctgctttgatcatcaacagtttcttaaatcggttcattagccccttaattagtataattagctctccaatttcacagtaccctcagcttcttcttgcgctccggcgtcaggaaacccttcttcttcttgccctttttccctgcttcttccaaccgtttgcgcacttccgcctttttggcggccaatgcctgccgtttggcttcctgaaaatccgcttttttcttcaactttccgttttggcattgtcttttccaattcgtacctcatccgattttggtgccggtgccgcttcaatgtccgccatttttccgctttccgacttttctccgattatttgtggaattagcactaacgaaatggatccgatctgttgtgggaggttggccaaatcactactcaaaagcaaacgacggctgtcctcgcccggggggttttggctatgttcctcaagtgaagaagaggagacgaggaaataatccctccccccacgcaatgtgggtgggaaggagggaaagcagcagcagatgtgatcgggggggatcaa

SEQ ID NO: 11218 - DNA, 2135 bp, Heterodera glycines
gggggatcaaggaaggggaatagagagacagagagagcgagaggggggagagagtgaggggagagagagaggggagagagaagtctctgggcgggaggaatgcgaagagatctctcctcctcccccgtttggcccaatgacttagccggaggcaaaagacgaggcaaaagacagaggacgttctgttcttcccagcacttcgccttctttctctctggtgctgtgagagtgaaaagaacagcagcaatagacttgattagtgttatgtaagcgctaatatagggagtgaaaaagccgatcggatcagattgattaaagaaaaaagcggggaaaaggggggggggaaggacgattacggtgaccaacagaacgaccaactgtgctgctcacaagtcagctcacaatcagtgctggtgagtcgctattgttttgtccatgcgatgatggattagtgcgagggggggggacgaagggcacagaattagccaaccacacaaacggccaatgcatcagttttttagaaatttttttttctgccatagtatcaatttattattgttgacgtcatctttagcccaatgttggccatggcatcaaagggatggatggcccaccggtccgatcactttccgctgccctctctcttccgctttttctctcatctcccctctgccgaacaactgttgccgtcgccggaggggcaatgagtgggcgttgaagaaaggcaaatggaatgaatgaacggaagaatgaatgatcaaaaagtgaatgcgttttttcagtattcggggggggggggggatattaaaaatcaaatgaacatatcaataaaattttatttccaataaaacaaatttacaaaatggaaattgatcagaatgcttttcattctctgttcggagacggcggcggacatggcattcggcactgccgttgttcgagttcttgggcatggcaattcggatcatcggggtcgatctgaatggacgtttgcttgtcagatcgaaattgaccagcaggtctcttctcccttttgatcagtttgtcggtctgatcactccccccctcccctctcaccagtccgtatcgatgcactcgtcgcctccgcgtttggtacccaatgccgcaactgaccgaacatggcgaccaaatcgaccaacgactcactcggcatgtgctcggcgctaaaaggcaaaggaataccaaagaaattatcgagcaaagaatccacttaccgcacgggcgcatttcgcagtgcctttcctgcactcggtgttcccgcgggggacatttgttgccaccgttttgaggcaacgacttaaatgaggtccaatctttttcttttttccttctctctctcctaatccacataattcccctcttcctattctctattatccatatacactcttatttccctgctcctcatcctattctctctgactccctattccctctctctctctctctctctgtctctcgtcatctctctccgctctttctctgccgctttacctttacactccgatgccgactccgtttgcctctgccgcatgaaactgagcattcgctccacggcgaccattcgctcatttcgcagtccgtcgctgtgccgccgtctccgtccgtcccttcctccccctcttcgccgtcgttttgccaccgttcgtcgccgccaatgtcttccgcaaaaggactgatcaaatcagcaccggacgctgtgaaaacaatttggccaatttaaaaaaagaatgccaaaacggactgatgacgggccgataattggggatgcagaactgcttgcactcctcctccgattcgaattggtttcgattccctttgcagcccgagtaaacgaaccgctcgcacttctgctgcttggtgttgaaccaatagcgcgggaattggccttggcactggcccgtctctttctcctcctcgcaaatctctcaaaaaggaacaaacgatgaaaattaaaacggaatcattaatttgctaattaccctccgaatgggcactcagcaaacgccgacacgagtgaacgttgcaccgttccttctccatgagatttttggttctgccacattccttcagccaaaatgacattaattaataatatttttttttgtcatttt

SEQ ID NO: 11219 - DNA, 1583 bp, Heterodera glycines
ttagtatagtatatatgaaaaaatcttcctggcatttcctccaccgtgatcagctagtttaccaaggccaaacgatcggtccgtcattccctctccccctccccactcattcattcgtgcgcccccccccctatccaaatgtcccccttttctgccgcaccattccgtccagtcgtcccatccgctgaccaaacaacgcgaattaaatgcgtccgagtcggcgccgcattcgctttgtttcgcattgcaaaattgacgttcggtggtctgtcgatggcaatggaacatttgcgccttcaccgggaaaacgaacactctgaattcgagattctccaccattgggtcattatcgcactctctctctctcctctctctctctctctcattcatttgctaattgtctctctctctaagtgcccaattaattgctaatttgtgcctggatcgcattcgaatgcctttgccgcaagtcgcagaacacagtgaccatgagccccattggctgaccgcgcactcccctcaaatggaaaagcatcgatcgcttaaaaaccgtcgaatcctccgctggccaaccaacttctgtcccggtattcctcgtcctccgaagtgttcgtcgaattgaacgcctcgcgccgataggcttcttccgattggcattgtgccgtgagaacattcttccgtctcagcaccaatcgggcgagcggcgcaatctcttcgctgtgctcgtcaaagaacggcgagcgcgggtcgtcacgagtggtaatcgcagcgattggcactcgcggctctgccggctcatttggcgactgaaacccttcgattgacttgctgttccgtgcttcatcccctgcccacatgctgggggcagttcacccccccccccaccgcatcgtcccctgggaaattaaaaaaaacggggggggggggggagacgtagtgcacccctcccaccgtatccccaccccattcttctaccgtaccatgtacgtgtatccgttgtcagtgcccgcgtcgaacggacgcaagtcaaacgcgcgttcctgcacccaactgcagtcaggcaagcacaagttgacctcggagatgccgacacaccaatcggggcttggaccaaacatcgcggccaacgaggccaagtggtggtatttgttgacgcgaaagtgtccattggtacggccctgtacttcttagacggcaaaagaaagtgcaacaaaatgccaaagcaatgaaaaggctggcggcggggccctcccctccccccgggcgccgctcctccggggggggggggcttttccccctcccccgggtgcccctcccccactcaccggggtaccaaaggcccttcattttgacgattgtccgcacttcgcttgcattcgctttcatctccgcctcgcctttgtaagtgtttccccattcggcaatttcttttaaaccgtcgctaaaagcaaagaaaattcatccattttaataatggtaattaattgcctcttcctacagtatcacctcgcaatgtctccaaaacgccacaaacggtagtgtttggaatgagaagcgccaagaacatcggtgaaatgggttaa

SEQ ID NO: 11220 - DNA, 2963 bp, Heterodera glycines
attttcgaaaaaacaaaattctgactaattaaactatgaaattttgaaagattacatttattttgaaataaattaataaaaatgttcccttttttattctgaatataatttaaattttggaaaacaaaaattctgactaattaaactatgaatttttggaaaatattgcatttattttgaaataaattaatataaatagttttacttgtttttattgtgaaatataatttaagtttggataacaaaaatgatgactaattaatttgtgctttttttggggaggcccaacctaaaattattttaattttgtacttcttttctcatgcactttattgtataatactcaatttttttttgtcataaaaccgaacggtacgccaaattcacattgactaattttggagaaattataaatttctcaccgaaagtaccaaataattatactcattaatctagctcataaaaattttagaaaattattaattgcctatttctaattatttttttttgtaaatttttaaaattaatctaaaaatggaatttaattaaaaaataattttttaattttagcgtttttttttggaaatttttgctcagcaaatgcaattaattcaaagccccacacacaatcaccaccagaatcatcataatcaccataatcccaacaaccaccgttcatcctccgtcataccgtatcgtccgcgccgaatgacgtcaccgtcgacattcagtgcggcacggctttttgccaaactgtccggcaacagcaaccaacaacagcagtccattgagcacaaaatggcggaacttcgagcagcatacgcaatacaaccagcacagacgccgacggtggcaaaaaggtggagtcaaaatgggagggaaattttcattaaattttaattagtttaattatagaatattaaaaaaattatttatttaaaaatttttgttatttgtaatatatgaaaatttgaattttcaactttcgaatttattaaaatatgaatttttaagttttaaattttttcattcatatggtcaaccatttttcatagatagattatttttaattattaaaaaaaaatttttgtcgatttatatggaaatttgaattttgaaaattttcgtattcctcaaaatgattgggaattttcattatcagcataccttattatatgaattttaatttcaattttttgttctaaatgcggcaaccatttttataaaagattaaagtttaattttttgaataaaaaattaatgatctgtttcctaaatatgccattgatgccattttaaaattccacaatattaacggatttaaattttaagtgctctcaaaaagaaatgttgggatgtagcgaatcggcggaatagaaaatggttgcttaatgaggagcaaatggattttgaaaaaaattgtgatccataaatgtaaagatagttaactgagaaaaaccagagtttatatactaattgcgtatcttaaaacagattttattccattccaattttcaaatcctttaaaattcttttaatttaaattgtttaagactcaataatttttaaacctttaaaactcaacaatttcaaatcttttaaaactcaattaatttcaaattcttttaaccctcaaattatttaaaatttgtttaattttcaaattctttaaaattttcatccttttataccattttcaagtgcatttaaagatattgaaaacaaagcatttcatcccatttactataagctttttgggaaactaaagtgtgcttaagcaaattgtttaaaatttttgtaattttatttgaattaaatatttttacaatgtaatttttatataattttttggaaaataaaaaattttaatggttacattgtcagattaaatgaaataaaaccaattaattcatttttagaaaactttccataataattttaataataaaaataaaattgtctctaattgaattgataccttattttagttctatgctcatatacaatttattttctatcaatcctaaattaaattaagaatatttatacatacaaaaatttaattaaagaaacattttttcagtggtgccaattccacccaaaataaatcgtcggcaccaccacctcgtcgacctggacgaacctcattgccaactccgtcactaggcgacatgcttgaactaccacaattgagtcagtttaaataaataattttcatttatttttattttttatattaaataggcacaagaaattgtaatatttagaaatttaatgaaaaataattaaattgtttaaatcaaaaaaattttaagtttaatttagtggggggagggcgtctgtattttaggaaatacggtaatattttattacctaaattatttaaattatagttttttaataaataaattttatttaaaggctctcgcagttgtgtaccgtcgagaagagcaagcacagtgactgcctgtttttcaccagccccatccctaatggatttggcatcgtctgccggacttttgtcgctgtcgccaagcggtactatttttaattttggaattcgtcattttaataaattctagatcctggatcctgagttttctggaaaaccccagaaaaaaattataccctaaaaaaacaaataaatccacctaaaacagcatttggctcctgaaaattcaggtctgacctagaaaggttgaaattttattttcttaaagcggcctggttttggtcactaaaatccaggtctggtaggatgaactccaattttcctaaaatggcgggatttggaatcctgaaaatccaggtctctgtgtctagaatcttgttgactctaaattgatcaaaatggttgggtttgtatcgtgaaagccaaaatcatgtttactaattttaattaattaacagtgattaattaaggagtttaaattacctaataaaactggttgattaatttttat

SEQ ID NO: 11221 - DNA, 1594 bp, Heterodera glycines
gtacagtgatgacatagtcagagcatcggttcgcccagcagcatcagcaaccgctgcagccagaaacaaaagtggagcagagtcgtccgtgacaacatgtcactgcaacatcgcttgaacctccgccgccacatcacacgcctgctgttggtggccgcgctcgcgtgttgtcgccggcgaccaagcgtcgcgtgcatggcacaggcagcgacccaacaacgcagctgacgccttcgactgctgttgctgctggtggtggtggcggtgttgcagcggcgccacaactgaaccagcagcgcaagagtggcgtgtttgccaagttggccgagagtgggaagaagcagcgagcacaacagcagcagcatgcggcgactgatgcgacgggcgagcgaagtaagcacatcaattttgtatcatctaaatatttgtatgtttatattaatattaatttatttaattattttcaaaatattctaaaccaaaaaacatatttttaattatcactatttttaaaataaagtttattcatgtgaatatttgtatattttgtatgaattcttaaaacaatttgaatttcaaaaaattacaaaccaaaaaaaatttaatttaattctcattattcttaatttaaaaaaatatttgttttattcgtgtaaataatttagttctttgtatgaattttttgaaataattttatttcaaaaattttaaaatgatttttaaatcaattttatttcgatatattttaataattattcatttctcagtatttttaataaaaaaatatttaattacatatttaattgattgcaatatttataattatttttgattgaaaaatattattttttttaaagttttaaaagatttaaaaattttttcatatatttttagaggcttcattggttgaaaatatcgctcagttggctgaaatttgtgaggccgtcactgacactcgtttggatggttcggaccatagtttggctgtctaccgactacttttggccaaattggaccaaaaaacgaatgtggaatggttcgagagtgttctggtgccagcggtgagcaaaaaataaaaataatttaattttgtaaaaataaatttaattattttttgcgaaataatttaatttaaaataaatgaattattttttttgggaataattgtttaattaatttaatttttttagatacataaatttaatttttttgagaaataatttaatttaacttatttcttagaattaacggctttaaataaaattgttatttatttgaatttttttatttaaaaattacaaatttaaggcattgcttgagcgcaatggcatcccagtcagcgagttgtccctgctgaccatgggcattttggtgtggcgctgcacgctgaacaacgcgcgcctgctatgcctcgttaacagcatgccacagcaacaaatgcatgaggatgggaacgcaactgccgcctcgtttgaggcgctaaagcgcgcagcaaacaaatataagtgtatgcaccatgtgttgaccattggccaacgacgaccgtccgctggcagcacgcacagctcatgctcaagctcaagtcgcaggtgcg

SEQ ID NO: 11222 - DNA, 1154 bp, Heterodera glycines
  misc_feature (26)..(26): n is a, c, g, or t
  misc_feature (163)..(163): n is a, c, g, or t
  misc_feature (188)..(189): n is a, c, g, or t
tttttcatgacttttttgcatttttntgtgacttttgggcattttttatgactttttcgtgacttttgggcgatttttcatgactttttaagtcgactttttgagatttttcgtgacttaaattcccatccctagtaattaatatttaaattaaaataatatntaattatatttttttcaattttttnnagatgtgccaatcgcgcaatgaattgccagaatttccttcccatgctctgagagatgcaaaatttttgttagcatcaaacacaaacccgttgttctgtctctgctttccgttaacatgattttattgattttttcaatcgattttttcctgtactaattgcttttacctaaatggggactcatttcaaaaaattaaatttagaataaaaatagattttctaaataaagttttaaaaaaccgagtcttaaaaattccaaaaaaataattattttttaattgatcatagctgtatcattttgaaaatataatagattttgcctggaagtcctcataaaaaatatttctatttagccattaaatttgtcttattgtaattagagtaccgttattttgtacgaattctcgggttgaattgaataaaggttgtttcatttgtatgaacatttttaataattgaaatcaacaggataggtttaatgaaaattgtttaaaaaattttttaatttgtaaattttataaggttttaaagcatttttaaatggattttttccgcgcgggagagtggaaatgtccggaattccaggtggaatgcgaaaccgccgatcccggtacaaaaaattgctatggtcgcattttggaccttatcttattttagaaattaatgactcatcagcatttttggttccaatcgataaccggaacactgagccgagagccgaaagaaagagtggggaagccctttacgcaattagggacaattgcataaataggcggtgaaggagggataatgaaatctgatatcccgggaattttggctccggaaatcaataaaatggagaaacataaaaattgcttcttttcagtgatggaagtcgatgaggaagacgacgataaaacgtttgactgggacgtcctgtgtgctgaggacctggatgaccacgaattttgtgccgtgttccgcgtg

SEQ ID NO: 11223 - DNA, 1589 bp, Heterodera glycines
  misc_feature (1560)..(1560): n is a, c, g, or t
  misc_feature (1569)..(1569): n is a, c, g, or t
  misc_feature (1580)..(1581): n is a, c, g, or t
aaatatcgacgaattatatgcagatatgacattaactttcccataagtgcgtaaattttttatcatttgccaacgacaaaactctacctgacaaaatgaagatttaaaaagatttttatttaacacttttaattaaaatctgttttgttttgcatatgacaactttcatttggcgaattatgtgcagggcctatgcacgaatttttcaggcccgaaagcaatataaaaatgtattttttcataatgttccatcgcaattctcgcgccctgaaggaatgcgcatttaataacgaatattgacaagcgattaaatagaagcgaaaagtgctggtaaaaataaccagttagcaagtttactcaagcttttttttatattaacactgtaattttcacgaagaaattagtctaatagcaggaaattatattgcgatttttgaaagaaacttctttcatggcctttggtgtgccaaaaaacgaataataaaatttaaatgaatcaagattttaactttttaatgaaagacactttttgatattgcatatgacaacactcttccgacgaattatgagcataacgttcagccgaaattttcagttaagcaagttaattcaaaaatttttttttcattattttccaactccattctcatatttgaattaatgattatttaatagcgaaaaatatcgacgaattatatgcagatatgacattaactttcccataagcgcgtaaattttttatcatttgccaacgacaaaactctacctgacaaaatgaagatttaaaaagatttttatttaacacttttaattaaaatctgttttgttttgcatatgacaactttcatttggcgaattatgtgcagggcctatgcacgaatttttcaggtccgaaagcaatataaaaatgtattttttcataatgttccatcgcaattctcgcgccctgaaggaatgcgcatttaataacgaatattgacaagcgattaaatagaagcgaaaagtgctggtaaaaataaccagttagcaagtttactcaagcttttttttatattaacactgtaattttcacgaagaaattagtctaatagcaggaaattatattgcgatttttgaaagaaacttctttcatggcctttggtgtgccaaaaaacgaataataaaatttaaatgaatcaagattttaactttttaatgaaagacactttttgatattgcatatgacaacactcttccgacgaattatgagcataacgttcagccgaaattttcagttaagcaagttaattcaaaaaattttttttcattattttccaactccattctcatatttgaattaatgattatttaatagcgaaaaatatcgacgaattatatgcagatatgacattaactttcccataagcgcgtaaattttttatcatttgccaacgacaaaactctacctgacaaaatgaagatttaaaaagatttttatttaacacttttaattaaaatctgttttgttttgcatatgacaactttcatttggcgaattatgtgaagggacctatgcacganatttttcanggtccgaaagnncaatataa

SEQ ID NO: 11224 - DNA, 2592 bp, Heterodera glycines
gtgatcattttggcagctgatgcagaaccattgggaaatcattttgcatttgccattgttgtgcgaagacaaaaacgtcccatatgtattcgtgaaaagcaaggtgattgactattttgaagttctaaaataagttaaatatttaggctgcacttgggcgtgcatgcggtgtgactcggccggtgggtttgctttgctttaatttaccgaacaaaaataaatgtcaatccatttttatttatgtatagagcaattaagaaaaacaccaaaaagataaccttttattttattaaatacctatgtatctagggttttataagactcgctgcgaatcctaaactttgaagaactcccttgtaaacagggaatttacttgttcgcttattcctttaggtgatcgcaacttcgatcattcaaaatgaaggatctcagttgaagtctcagattcagaagattaaagaagatgtggaaaagttacttatttgattaaaaatttgcaagcttatcactgttttgttattccatcttgttttgttgtttcatgatttgttcgacgacaattaaaatgactctgaaagcaaaaaaaatcttattcagtattaattgtttactacttacctttatatttaattaattggaaagtttgtttaaacatgaaatatttgctcatttgtacctttaagtgcttttttaggcttatcaaaacattttaaacagaatggctgacattaatgctattttggatggtactgacggtgatgaagcgctgaatttgaatgatttggatgaaaaagaggttcttggtgatgacgaggaggaccaacaccaaaatcaacacacaacgtatgtgaatgcgtccattgaccacttatttaatggcccgacggataaaacaaatgggatgccttttaaaaaagcactagatattatttacttatcaatgaaaaacactggcttctagttccattcagcagcatttgtatatactgtttagaaaagaagaagtggaagacctttacgacgaagccatggctccgtccggtgcactctctgaaaagcgcgagtcggctgaagttatttcgtcgttgccaagttcgattcagcacaaatcgtcgtttgccatgcctatgatgatcaaatctgagcccggcattgctggcgggtcgcaaagtggcaaacgctactgctgctacattggcaatatgacttggtggaccacagacgatcaactccaggtttaattaacatttgtttcggctttgttctgcttccattcgcactgtgttagttatttcactattcattttttaagaaactgattcaaaccctcggcgtcgacgatatgattgacgtgaaattctacgagaatcgcaacaacggacagagcaaaggttttgcgctggcagtgttcgccagtgaaccgtcggtgaaagcggtgatggagaaattgccaagcaaaaagctgcacgaacaatcgctggcggtgttgccgtacactaagcagtcgttggccaagttggaggaggccaccaaacgctacgaccaggtcccctcttgtttctgcaaaatgttatcctatggctcttctgcattctttgcatttctttgaactccgatcattgcttgtcgggacgtagccagtccaatcaatccttggcattttgtcaccccttacactttgcaaacaaaagaaacgtaaacaaaaaagggagacttgtgcccggcgtagtgcaataacctcttcttcctggctacgtcatttattgtcttatcctactcatttggaccaactttcgataacaatcctatgagttgcattttaatgtcatggaaaatggttggataaactcatttcgcttagccatagcctctaaaccatcaatacttactataatcagtcttaaaagatcgtctcataaaatttacgacattcaatttatttaacgctaactaagaaaggaaagcatttttatgagatgattgaaaatcctttctgacaatgagttaaatccacgagatttttattttcagttcagaatttacaaaagtttttcttccccaatattaatgtattacatttataaagcaaaaacaaattgtctaacttctatagtgcttataaaattgcaacttcctgtcacattttataaaaccatagaaaattaatgttttagatttgtcattttggttttccattccattttcgaaaaaattgtttattcatgagaaattgtatttaaatttcacacctgaatgaattttcaacaaaatttttgtgttttctcagtcatgatggataggaatctcataatttaaaataatgattgcattaaaattttaacattaatggaccaatcaaaaggtgttgggcttaaacacattcataagagcgggaattaattgatggacaacatttaatggaaaactgaaggaaaatccggtgaaagtattcgtcccgttttaagtccgttcacttctcaaaataacaataaagtttggctacgtccccgacaatgagttgaaataaattggaagttttgaaaaattgatttaaaaaaaaatcagagcgcaatgaagtaaactatagatttg

SEQ ID NO: 11225 - DNA, 2813 bp, Heterodera glycines
tttacttttctaatctacaaattatgttggtttctacattgtctcattttttgctaatgttttcattaaccaaaggagcaattaaattcattttttaattgtttttgttgcattcggatatcaaccgaactaccaattaatcagtcttgcttttcccgacgtctctgtcgactgttttttgatgcctttctccgttcgcttgttattcaaaaagtgtggatgaatctcaactgatttcctgcgaactaccattaactattattattttttgtatattggccaatctctttggtcattttccttaagcagcggctgtccactttaggggctacaaattcaaattgtttaatttgaaagtatttttgatattttataataatttatcattaaattataatttcaaacttaaaaataatttgatctatggtcatgtggatttaaactctcccgttgcctgaaaaagtgaagcaacactataactttttattaattacattgtatatttgttaaaagagtaattaaaaactgttctttcgcttgtgtcctgctactgttttcccttcccgtggatgttcacttttgaaatgtcccaggcttggtactgaattacctttcatcctccaaactgctcttttcctttccctcccattttttatgttgccatacattttccgtcctcgcatcaacaaccactctccaagccgtttgtttgtttgttcggctaaggatggctcccctccctccgtcccctctcatcctaaattccatccatcccactcaattacgcattattctgcaaatgtccatttgtatcatcgcttcatcatcatcattatcatctccaatccttccccctccatttttctgcctttgctccttcgtttttcgtcatttccttaatggaccctccgccccctcaaatagcacaaaatgtgtctttcgccttcgctccgtttgctctgactttcgtccgccattaagcatcgatgaggcgtctcggcgatatcgacgacagtgagagtgttctacttctacttaattccccgcgcaaacggagtcgatttccggtccgtgcattttttgtttctaaaatgtgccattttgaacttttttgaatggtttccttttatgtttattcaaaagaggcgaaagatagtggctaaaaatagtagaagatcggctttactaatccgccacaaaaatggaaagcactgaatttggaaagtcacgtcaatccaaagtgttggtatgtataaatatgctattcgttctcttccgaagttgctttctcattattcctaacaaatggacaaatgctttaaggaaatgcttgcaatttccccagtgagttttattaaaatgtcttttgagccctcgttttatttccaatttccctctgttttgaaactgattattatctgtccattaggccattgccagtggtgcaacaaatgtgaccttccaacagcacaaagtgacgcgggaggagcgtgccaatgcgttgggccgtttcccgggctttcgcggctgcactttgtggttcaccggcctttcgggggcaggcaaaacgacaattgcattcgcacttgagaaggcccttgtgcaggttcgcattttcaaatagaaatgattgagttcagtttaagttgggcgttcccgcttacgcattggacggggacaatattcggcacggattgtgtaagaacttgggattctcggcagaagaacgagcggagaacattcggagggtggccgaagtggccaaactgttcagcgacttgggaatggtggtgctcgcctctttcatttcgcctttccgcgcgggtcgcgaagaggcgcgccgaattcacagcaaagtgggaatttgtaaaaggctgaaaacagagattgttcaggaaaatattccctttttcgaaatatttgttgacacgccaatcgaagtgtgcgaagcacgcgaccccaaaagtgcggaattcatcgctcactgtctgtctgtattcatttctcattgacttcagagctctacaaaaaagcacgcgccggcaaaattcgcggctttaccggcgtggacagcgactacgaagtgccgctgcaagccgacctcgtgctgagctcgggcgtcgactcggagacgaaatgcctccagcaaatgctacagtttctcttcgagcgaaacgttttgccagaaaatgtaaatccgctgtcaaattctaaccaccgacaattcccatttccacaggcgatgttccaattttgcggtcagtccgtccgccagcttttcgttcccgacgacatttctcggcgtcgtttactcaatgggatcggtctttgtccagcagttcatctttctttggttgatctccaatggctccaggtcaattcgtttgggttggctttgctccgtttttccattttcttttcgcttttccttaggttcttgccgagggttgggcttctccgttgcccggctttatgcgcgagcgccaatacctgcagtgtttgcattttggccagcttatggacttacaatcgttttgcggtgctgccgaatttgccgggtatgaggaggaagcgattttattgttcatgcgttagttaatgtttgcctttttttgctccagtgatcctttttcgttgaccaatggccacgaaaagccttatccgttggccaatccgatcagtcaatccgtccccattgtgttacccattgacactgcgaccaaattgtccattgaatgcgtcatccgaaagcaacgcaattcgccgaccacgggcgaaatggcaaaagttcgcttattatacgaggtgaacaa

SEQ ID NO: 11226 - DNA, 846 bp, Heterodera glycines
tgacagtagcaactccaagaaaaccagtgtagtggaaccttaggtggaacatttgtattggccagagaagttaagcgcaattaaggacaatatttgcaattgaacgaaatgggggaaaagcggagtgaaagggtgggggagggaaaagccgtcgaaaggaatgtgggggagaaacaccgatgtcggaagggactaatgggacaaaacgttcaatgagtgcacagattgtccgcttttaggccgtccctctctctcttcgttttccttttcattccgccagattttctcctatggccaatttatttttgacccattgagtaattattttcttacgaccattgtccatcgctttggccatctttccgattgacccaaccgatcaatcaaaagaaaggagaagcaacagaggaagagcacagctggagaagcaaatttgtgggattagggggggggggggaaaggagcaaaagacgaattaatatgggggggggggaggagtagcagagcaataattggccaaatgaagccgagcaatgagcagtcaaaacggaattagagacagagataaagtgagaggtcaaatgggtgggcgagggatgggccaaacggagagtgccattgcctggcaaaaggcgccgtgcccccaccgacctgcgcttgtccttctcgacgcttggcaattcttttttctgccatttttggtgttttgtctccttaaattcgtcatcgcctcttcttcttcgaccctcagctgacgcgctctgattagccgaggagaaagtgaaggggaagggaagaagacggaagacgaaaaagggagggaagggaaaatggagggaagcgaac

SEQ ID NO: 11227 - DNA, 1814 bp, Heterodera glycines
aagtgaagggaagggaagagacggaagacgaaaaagggagggaagggaaaatggagggaagcgaacgggggcaatcagctgaggaagaagcgaagggttaagcctaaagcggaacaggcgattggagagcacaaatgaacagtgagtgacttctgcgacgggcccatgccgtccaattttgccaatcgcttcttctctttttgtttctccatttcgtcccattttttcgtttttctctccttttgtatgtttttttctccattttgtctttctcttctctcttttgtcggaaatatctccaatctgagcactgaactttcactgcgcaacagcttatacgcctcggccattccgctgatcatttccttaaaatgaactcaatgccattggacggtccttcctttgcatgccaaagtaatgccatcaattgcgagcaattcatctccaatttgaatggcaccacagctgaaaataaaagaaaaaaatattggaaaaattcaaccatcggcacactttctttgcccatgcataagtgaaaaacaaaatttggtggggaataggggggggggcgggaataagggtgccaatactgcggaggcaatgatcggagaggggggggcatcgtaagctgaacactccttcttgggtggtcgcgtgggtaaaaatcggaggaaataaaaacaaaaatgcgaatggttttgaccattcgtcgtcattctctcccctttttgaaacttttcctaccgatccgcaactgatgccggcacaatgcctttgacggtcactgtgctccgtttggtgtgtccattgctgagagagtgccgaatgtccaattcggcaccaaagtcaatgcccggcactttctcaatttccaaattcaaagtgtcgcccgtccgacgcaaagaatctgagaggcaattaaagcacaataaacagaaaggaactcactcagctgactaacgtcgtattcaacggtcagcagaattcgtccggcacggcttgccgaccgcaaagcaccgaacgcagccgcgagagtgcactcgcggacggacactccgtcgatggccgtcagtcggtcgcccaccctcagccgcccctccctcaaccgtccgtctcattgtgccccaatttcctcctttccctcaccgatgggccgcccctcccgcgcggatggaagtcacagtcaaaggtcgactttttgttgggtcgggtccaaaagcaccgccgcggacggtcagcccaaaagttccccatccatccgctgacttttcgtcgaccaactccaattcgacagttttcctttgaagtgccgcttcgtttctcgacgactccgtcccgtccttgtccaattcgtattccaattccaaatccaccaaatcgctgccgccgtttctcaaaagggccaaaatttggcaatgcgttaaagtgccaacattcactccatttattgagacaattcggtccccgatctgcgaaaatgtgaaacaaaaagttaatttgaacgcttcattttttagaagttcagcagagcttcaaaatgtaaatcgaaaggatgttctaaaataagtggtcgatgcctgaatttggtcgcttcgatgggcgataaagccgggccgaagaaaagaaacaactgggccaatgggccgatctacgccgcctgaaagagcattggattgaatgggccaatgttcaatggcacgtgccagcaatgcccaaaccaagcggttgcccggggctttttcgaatttggataaacactttgccaaaaagcggcgccctttggcacttgaaaggggcggaggaagactgtagag

SEQ ID NO: 11228 - DNA, 1481 bp, Heterodera glycines
  misc_feature (56)..(56): n is a, c, g, or t
taaccatccttcccagcattttgcccatgctttttgtaccctttccccccctctcncctctcctttttgtcattcttttacattggttcattctcagttttcgctgctccttttcttgccaaatccgcgcacttttccttcgctcccttccaaaactgagttcgctttgtttctgttgcttctcctccccgtctttgagattcatttcgctttttgcggcctttgtcatttccaaaaaatggtaatattcgctgggggtgcgcagcgaaatgccaaaaaagtgaaaggagtcgcgcagaacgagcggagaaggccaaagggacggacccccgcccacactttgtgccaatgtttggccaaattgtgccgcggttgagtcggcccattccttcacactttctttctccatatttccttcagctgctttacgccgcccccaacaacaaattcccctccggcgctttttccaactttggcatttttgcacatccatccgaagttcgaacaatggtcacgccagatttgaacactataaaaagccaaacagatcacattatctaaaaagaaggaagaacggccaacaaaacaaaaaggaaggatgtgttaaataaaatgaacttggggaaagttcggcttcgaactttaggattattaaggtttcgaaaaacgaacgaaatgttgggaaaatataccccataaaaagatgaacaatcggggaaaatttattcctagcctaaagacagttaggctttgttttttagattttcccaggttggtttaaatttaccaaaaattaattaaccttatagaaattacatttatgatcagtttagctcaccctcaccacgaagtgcgaaacctgacaagttggagtaatacgagagagataaagaagaaggaaaagaagaaaaaagaaagaaaagaagcgaagagaaaagaagagaatggagtcagtggaggatgggacgaactttcacttcagttgacccctcccaaactcacaaatcagccgattaattaatcgttttcactcgaggggaaacaattgccattgttgagaatagtgcaattgcttctgcttgccattgatcaaagctttggaatgaatcagttcaaaaagattaatgaaaacgaagagaaataaaaaatagcaaaaggaaattgaaaaataaagtgaaaaattggaatgaaattgttgaagtggttaagcgatgtttgcaaaagtgatcataaagggatttgaaggcgaagaacaaggcttagtgagtgtaagggaggggacgcaaaggaatcggaaagagagtggaaggaaaaggaggagagagaggagaagaggagtgaattgagaggaagaggaagaagagaggaacagaaagggatgaaaagaggaagagaagaagagaggaacagaaatagaaagaggaagagaagaagagaggaacaggaaatagaaagaggaaggagagactctagaggtcccc

SEQ ID NO: 11229 - DNA, 1657 bp, Heterodera glycines
  misc_feature (12)..(12): n is a, c, g, or t
ttgatataaatntcggggtgctaattttcccacaaaatttgccgcaatttgttggaccgccaaatctatttaatgtcgttgttttgttttgtagttgctatggccacccaaatatgtttctcgtctctacttcatcatattccatttttgggtcaccacaatttgcacttattcactaagacaaaaaggcaaattcaaattcatcaattcttaatcattttgtcactgaaattcatttgaatttaaatttcactattttgtttaaataattttaaattatttagtagtacaaaatatattatttaaattattttaattcaccataattccctaaaaatcactgaaactcattaaaatttaaatttctcaatttttgtttaaatgcttttaaatcatttaatggtctaaaataaatttttaaaattatttaatcaactataatattttcataaaattccttttgaaattcaaattgtttgaattccaggaattttttgacttaattattggtcctttttttcattcttattttggcattttagctacacacgggcactggcacttaaccataaattaaaaacctatgaattttcaaatgttttaaattcctgaaaatttaaaacgcattgacggtttttccatttaaccctccctaccatttatttcctttctatgctccaaaattataggcccgcccaaaaatttggcggttaacccatgccagaagttgatttatatccgttgggttggattgggttgtgtgtttgcttactgctggtggtccttccctctcaatttggtgatggtttgggtgctcgttaatcctcaaaaatccccagcagcagggggctaatttgcataaatttgacaagccccgcggggccgccgccacttcgtctgtttgacgacggcacagcccccgcgggggcacaacgaccatcaggccacccacttcagcgaacagagggcttgtgtccctcttgcataatctgcgcatcatttcttaaaaatcggcacaatttgtgccttgagggggctctgggggggggcaccatcgccataggaggcaatcaaatgtggaaaaatttgccaaaattttcgcattttctaaccttcaacttatatagaccttttctaactccccgatttttagtagtattttttttagacttttttctttagtcctaatcacgataaatgcttgattaattttgtttttaaatgttttcagtccatttattaaaatattagatttattatattttgaatttttcatcaaatattttatttgtaacaaaaatatcttgtttagtaattgccaaaaaaaaataaacaaaaattttttttttgtacatttttgttttacaatatccaaaatctaattactttttattgaaaaaatatataaattattttatttagtaaaaaagtttttttcaattttttaacaataaaactagggttgctccccgaccccgagccccccgacccgacccaagacgtttttgggacctattccccgacccgaccctcgacatgtcgccccccgaggtccccggcccccgactttttgcccccgacactaattagggggattggggactcttgaaaatttttaaattttgaacaattttcttcataaaatcaattaaaaatt

SEQ ID NO: 11230 - DNA, 2562 bp, Heterodera glycines
gccggaggggggaaaattgagaattttgaccatatttttagcagattttcattttaaaaaattcataattttgtggattttcgaaaaaaattgtaattttctggctaaatttgggtgagatttccgtttgatactctattaaaaaccaaaattcaaattaaataattgccaaacattatgccaatttatcaaaatttaaaagattctgaggattttccccaaaagcctcaaaaatcctcaaaatttctcagaaagccacaaaaatcctcaaatcctcaccgccgggggaaattttgaaaatttgagtgagatttgtaatagattttcaacaaaaaaggctggtttttgagattactaggccgtcccggtcccgtggcactctagttataaccttttgataagtgtctaattgagaattatagcttagaaatagcttctaaacatattaagctttcgaatgataccaatattgttggatttggttaacaaaaaaaagttatagtccaaaaacttgggctggcgccgaaatgtgggcgccgaaacgaccccgaccctgagatgccttgtaaaaatgcctaattggacgcacttttactggcgccaacgaatgcatttgaatcagatgattaaagtgaaaaaaggaagatttcgagcatttaaaaagaaaaattggtttttttgttaaaaatttagttgatcactacccgatcggggtccccgacaccccgacatttgagctccgccccgacccgacccccgacatgtcgccccccgaggtccccggcccccgacattttgccccccgaggggtcggggagcaaccctaaataaaaccctcacaaaattttcactatttctgagtagtaattttacaaaaattaataaactaaaaaaaaacttgcttcaatacctttttgttttaccatgtccaaaatttaattacctaccttttattgctttattaaatttgcgcactttttttttgcattgtccgtaaattttattttctttttgcgccgcccgccgccccccacaaattaccgattttttcgctgtgctttttttcctaacttaaaacgacgatttccttcataaaatgcacacttaaacaacaaccacacacactcacacaaaattgtcctaacgacgacagcaaaaattccccaggaaaataatgggagtgataaaatgccaaaaaatggcatatttagtgccaaattcaaaaaatggggcaaagcccattgaataaatccctcgggggtaaattgctgtcaatcattgtgcaaagcttcgcggaaaaaaacctaactttaaaaacagcaataaaagttgtctttgatatatgcttttgaataattttttcatggaatttttatttatttaaatttttttaatttattatttaaacaaacaaaaaaaaatggtaatggtaaaaaatattttttgctatcaattcttcatcaattaattaaaattttacattttgaacccacccatccattgaatttccattccggttcaggaaactcccacaaaaatgccatcgaaaacagttcgcccccgagggcatttcgcattgattctccccccgcccgggcgatgaattttttccaaattaattaaaatttttacattttgaacccatacaatgaaattccattccggttcaggaaacccctcacaaaaaatggcattgaaatcagttcgcctccgagggcatttcgcattgattctgccccaccccctcctcgcccctcccggcgtttgtactgcactttcaattgctatgccattgcagtgccatacttacatatatgatgatgatgttttatattctgccagggcttggccgcggtgcggtgttgggatgggatgaaacttttatcccctcccgcgcgtctgtggccacgacggcacaaaaaatgccggcccagtcctcgccgccccccccccgccggggctatttgccggttgatgaagagtctctcgcggtttgcgttagctttctcacctcccccccccccgttgcttctgccgccgcccccgctggggccttcgcattttttcttgactttttgctgatggcacactttgtgccaatgccaggggtggggaagtgtgccattttgaacaaccccttgggggagtcaagggccaacacatccccccgaggggagatttcaaagggatgtgcccaacccccccctccccgttgttgtaaaatagtggggaagaaggcgcagttacaccctcgccatcccccgggggcaccacctcctcggactcggacattttgtgttgcctctttactttaaaagcatcggacaaaccaccaacccgacggattaaatgggctcctccaatttaccccgtgggggagggggggcatcctttggcattttaaaaatgttttttttccgctcaatcccttaatcaaaagcatagggctaaagttttaacaaaaaatgttttattacaatttaattttaaaaaataatcacgattttaaatacaattttatctataatttttttaaatgaatttaggataattatttttaca

SEQ ID NO: 11231 - DNA, 1412 bp, Heterodera glycines
ctctagagtcgcagagggtcacgaaaaaattaaaacatttcaattattctgtcccaaaagttccggaactaaaatccagaattttttttaaaatgccaggagtttttttgggattttaattatgcctaatcttaattacactgtatcctacttaaacattttatgtctgtagaaaatttcatttttcaaagttcgaccaggtggcggctgtagcattgaacgcggcaccatttgtgccaacggtgttgtcgcagctgaccacctccaccagcaccaccagcaccattcggcaccgcacaaccacgtgttgagacaagcaccgttggcaccgttgaacaactcgctgctgttacgggcgcgtaacggtcgctttggtggttcgctacggtgtccacctccggcggctacggtagggacgttggtacgatcatttgctgaaccaacgcaacaattgatcaaccaccataacaacaacaacactattgttgtggaacagcagcaacatcagttgccggcatgctgtaaagtgatgcaaaaggacgatgatgtctttggcattgcggaagagcaaagaggtgagagacggtacaactcgcatacagtaagggcaattcgtatggtgatcaggaaaaaaattctatccagtgtcaacaaattttcgtggtttaaaactcggacttcgtgccatgccaaatattgttaacagtctgagttaaaaatgccagaattttctcggaattttgattaaaaagcgaaatttcatgcaaaaaaaaatcccggaattttcattctaagtaatcataaaactttctccctatataaaataataactttcaagtttttaaaggattagtgaagttatttttattcagaaaaatgatttccttaatttctattaagaaaaccatactgtgctacagtacgccacagttcaaacaccaaaaattgtccatcgccactcagaactgcccacaaaaatgcctcctacaacaataatggtaccagcgcaacagcaacagtttgttgtcagcaggccacctccgccaccgtatccgggcattcaaaacagtacagccaaaatggctgtcagcagtggtacggtagcgaagagaggttcgccaccgtcttcaattggcagcaacagtagttgccgatcattgcctccttcaccgtatttgggagcacggacaaatgtgaatgattaaaaaaatgataaataaaacttattgccattcaaatatacacattctgatcagatatatttgatcacactgactcactgactgacaaggaacttgaccaattttgagattaggattcggaaatatttgctttcgtccgtaatgttatgtaaatgatttgatcagagcaaacaaattgatcaacgtaattttgtttacgtttaattaata

SEQ ID NO: 11232 - DNA, 1041 bp, Heterodera glycines
aaaatttatgagtcaacggcaaaaaaaaaaaaaaaactggataatatcagcccatgcttttatatttatttaggcaaattttgccaacaacagcaacaccactttccaaatccacgcgattcgtcaacaccaaaatcaaacagcaacggatcatcaccatcatcaatcacatccaataaaccattttcatcatcaaattgtcttggaaataaaagtattgaaaatatgaatgacatttgattattttaattgagtttaaaattaattataaaaaacaaaaccatgagaaagcattaaatttttaaaaattcaactcacaaaatattttattaaaaagcaattttgttccaaatgaattaaaagaattttgagaaaaaattaataatttaattataatttaaataacaataacactccttggatgtgaggccaatttttcaattttgaaaatctcattgatgccttaaaaagcttaataaaaaagcctcattataggtcataaaaaattttattttcggcacataaatttgggattacatataagaaatatgttattttttaagcagatcgccatcataaaacttaaaataacttattttaataaacacacatttattacagtatacagcacacagtcgtccagtaatactgtggtggccaacggtagtggtgccaacagttcaacagcgactacagcggcatttgttgccgaagatagttgttgcaaccaaatgcgcggcgagttggtcgcgcgcaactcggtcgccgagcgagcggagaaggcgtccagcgtttatgagaatgtggcgaccggcgagcgtcgtgaagctgctgaaccagcagctccacgagaagctaattatgatgctaatgatggtgctaatgaccataattatgagcagcagcagcagcaacatggcccgccacaaaatggccagggcggtgaacggagggaaggcccaaagggggagatttggtacgaatttggatgcgtctgatcagtgatcgatgtgggggggggggcatttttttacaggacct

SEQ ID NO: 11233 - DNA, 1456 bp, Heterodera glycines
  misc_feature (47)..(50): n is a, c, g, or t
aagaatcgtgaagcgaaattaaaaatcttcagagaccttctaggtgnnnngaatttttgggaatttaatttaaaaaagctaagaaaatccggaaccaattttataacggtgggacttaaaagcattgttaagcaaaatttaaatcgagaataattttcgtgtatattttcatttcaatttcaaaaacaaacaattgatacaattttggtaagaaatagtgcataaagaaggggggggtagacgaaaagagaaatttttaaaataacgcaccccatctgatattcccctttttctgttccacaactcgccaaacgcgactgttctcgttgacaagaatttgtccaattaaggtacttggactttccacagaaatgtggtacaaaattttggaactgtccggcctcacggttggacttaaaagaatcgtgaagcgaaattaaaaatcttcagagaagatttctttgttttgaatttttggcaatttaatttaaaaaagctaagaaaatccggaaccaattttataacggtgggacttaaaagcattgttaagcaaaatttaaatcgagaataattttcgtgtatattttcatttcaatttcaaaaacaaacaattgatacaattttggtaagaaatagtgcataaagaaggggggggggggtagacgaaaagagaaatttttaaaataacgcaccccatctgatattcccctttttctgttccacaactcgccaaacgcgactgttctcgttgacaagaatttgtccaattaaggtacttggactttccacagaaatgtggtacaaaattttggaactgtccgacctcacggttggacttaaaagaatcgtgaagcgaaattaaaaatcttcagagaagatttctttgttttgaatttttgacaatttaatttaaaaaagctaagaaaatccggaaccaattttataacggtgggacttaaaagcattgttaagcaaaatttaaatcgagaataattttcgtgtatattttcatttcaatttcaaaaacaaacaattgatacaattttggtaagaaatagtgcataaagaagggggggggggtagacgaaaagagaaatttttaaaataacgcaccccatctgatattcccctttttctgttccacaactcgccaaacgcgactgttctcgttgacaagaatttgtccaattaaggtacttggactttccacagaaatgtggtacaaaattttggaactgtccgacctcacggttggacttaaaagaatcgtgaagcgaaataaaaatcttcagagaagatttctttgttttgaattttttgacatttaattaaaaaagctaaaaaaatccgaaaccattttataacggtgggacttaaaagcatggataagcaaaatttaaatcgagaataattttcgggtatattttcatttcaattcaaaaaacaacaattgata

SEQ ID NO: 11234 - DNA, 1637 bp, Heterodera glycines
  misc_feature (327)..(327): n is a, c, g, or t
  misc_feature (339)..(339): n is a, c, g, or t
  misc_feature (347)..(347): n is a, c, g, or t
  misc_feature (353)..(353): n is a, c, g, or t
  misc_feature (363)..(363): n is a, c, g, or t
  misc_feature (367)..(367): n is a, c, g, or t
  misc_feature (370)..(370): n is a, c, g, or t
  misc_feature (374)..(374): n is a, c, g, or t
  misc_feature (380)..(380): n is a, c, g, or t
  misc_feature (388)..(389): n is a, c, g, or t
  misc_feature (391)..(391): n is a, c, g, or t
  misc_feature (393)..(393): n is a, c, g, or t
  misc_feature (414)..(414): n is a, c, g, or t
  misc_feature (425)..(425): n is a, c, g, or t
  misc_feature (433)..(434): n is a, c, g, or t
  misc_feature (1607)..(1607): n is a, c, g, or t
aaataaaatcattcaactcaattcctttctcatttccgccgaaaaaatgtttaaatttaataaaaataaaaattatttttggcactttctattataaaattagaaattaattgacactttttgtgtccaaataattcattccacaaaataaattagaacacaatcattattaactttgtttaactttgtgtgattttataaatgtgttatttgaaccgtaatctgtgctctcaattataaataaatgaccgacattttcagcacaaaatccgtcgaatgaaattaaattgatcacttaaaaagtgaataaaatttaaattaattttnacaacatttttnttttcaanattatnaaacaaatcnaatnttnccanttatancttaattnncntnacatatttttttaaatatatnacaaaaaactncaaattcnncaaaaaaatttttaaacaatgggcgccacaaaagtttattttaccatataagtaaatgaagcaatgtacaaaaaaaatttaagaaagatatgggttagtaactaaaaaggtcacccaagaaaattggcatacttgattttgaaacaaaattataaaaacatttaaatataaaaaagtgacttaatgactttcggtttatcgtattggacattcggtacttttccgttatatggccaaaatttgaatttattaatagatcgcgcgtagtaattgcaaaaatccattcttattgcatcaataaagaaagggcgtttctttctgccttcccacaatttttatgaataaattagcacaaatggaaaatacttatgctttcccctcctcattcttcctccccacccgataataaaatgagccttaattttataaccctcttcaaaaaaacaacaaatgaatttactgcagcaaatttcctacaagaaaaggggattattatgcacagagaacgtgtctgtgattgtggtgacgaaatgaaaagggacaaaagaaaaaagtcaagataaggaaatcccagtttggcgttgcaaaacatgccacgccagaaaaggataagactcaacacatggcttgacccgtcctaccgctcgacacaatcgtccatttcatatattggtggacgcgagaaactacttccgtagttttctgcgaaagagaacttgggatgaaccataattcgaccgtggattaatcgaattatatgcgcgaagtctgcgcggactttctgcttaaacagcatacgggggggcgggaaagataggcggactaaacttaacagtggaaatagatgagtcgctgttttctaaaaggttgcccaattgtccttaacctgtttaagtcttaaactaaatagaaaaaacaatgtcggccggatactcactcctcaatgggtgtttgggggaatatgccgccagaccagagaaatcttcatggtagcagtgccagatcgcagtgcagcaacccttttggcagtcgtccgcgagcgaattgcggaggggtcgacagtaatgagtgattgttggttctcatataatatggtgtgcatcgcgtggctcttttgtgtgtagtttgggtcattttagcttggcgcagacggcacctacaaccacctgcgangtaatcttaactgcaacttcattgatccag

SEQ ID NO: 11235 - DNA, 1805 bp, Heterodera glycines
aaaaaacaacacggcacacatcgccagatgcttgactcgtatttgtgcgaatttctctggcgcgaaaatgtcaaaacccgtggcgcagacccattcgaagagatcttagctcaaattgtggcatttatacctccgaaataattttggcgcgtagtcttagcaattctatgcgcccgttgttgatttttttaaaaaattcaaattttggccatataacggaaaagtaccggacattcttttggctttaatgttcttattgtttgggctggcattggcacgcgtttttttgaatgggttaaagagctaaaaaaatagttgaaaattgctcttttttcatcaaaatcaccaaatggtaataggtgggaaatttaaaattaattagatgaaatgttaccattattttttgtaaataggtcattcagtggtgcgcgaaatagtcgtttttgaaaacccaacatctgaaacatcaaataattattaataaaaaaattagagattattaaattttattttaagcttaccaaattgggtttttaaaatatgaaaaaagtgagaattcgcttaaaaggtgcggagtcgttcttttaaaccatcaaatgaaaattttaaccaaaaataatttttaactttgctcaaaagcaacgaaatttataactattgatatcattcgatagctttaaatcttctctatcagtctacaaaattacaaaaaatttcattaagtttcaacaaagttatggctagaagaactcaaaaaatcaagtttttcgaactttttggccatattgctttagagcaaagcataagcaaaattttttattttatggtttttaacgacatagcaacgcttaaaatgccataaaaacccaaagttacactcagaatatttataaattttataatttttcaaatttttaaattcccaaaatcaatattggaaaagtatttgatttttaaagtgtttttttaaaatattctctgggttttcattatttttaaaattatatttaccccaaaatagagacaaatgcatatagctgctacctctatacatggccaaattgattagatatccgccaatgttaataaaaaaaataatgaccaatgaccgtaaaactcgtgtgttcgttcgtctgttgggttactgtaaaaagtattttgaattgttttggcgcaaaataaatgccaaagaaatgaatggcaaagttaccaccatttttcgctgacccacaaaatgtccagcccacgaaatgtccaagtctcgaatttgagttttttattattcagatgggcctaaggttaggcaaggggtaatataaagggtatattcgtattcagcgaccccgaaaaccttaaaaatcctaaattagactcattttgtttttataaattttgaaaaattttggacatttcgtgggtttttactcttttggacatttcgtggcttggacactttgtgggggtgccccatttttgcatcggatgatcacagaaatggataactaacagcaagtgctacaaaatgaaataataaatgtgccgttaaagaatttcaatccgatgtgactaagaaaagttgcagcaacagagccagtgactgcactaaaataataaatatgggaatttgtatttagtaaaatagatgagtgactgtaaaatacttaattaagaaattaaaaaatcaattaaaatattgagaccaaactaattattcccagacttaaattttgaaatgacagcaaatagtcgatcaattgctgcacaaaacattgccattaagccacaatttaaagcaaaaatcattg

SEQ ID NO: 11236 - DNA, 2090 bp, Heterodera glycines
aaaaattaatttattgaaataatatattaaagaaatttttgcccctcgccccgccccccccccccattttgtatcgtatttaagtctcttctcgtcaccactttttcacgtacactgtaccccgttgtattccactgttctacatttaatcaacacaaatccatttacccttcatttaatcaccgaaaaatctacaccgacgaacagctgttaaatataaattatttactaaattctatacttgttaataaggggaattaacattcatttaaaattgtcatttaatgaattttttggttaaatttatttccttattaaattaaatgtggttttgatatatgttctttatgttgggatgctattattaaatttattgaccaatttctactgggtaatttggaagctgaaaaaaattctggcgtaccgaaaaatatgaaatgtataataaaaatgtaagttcagtaaatacggtaataattggggttgttcacggtcgtttaaccgaactgaaaccaaagaccggcggcttttttggaccaaaaaccgaaaccgggggtatcggttaataaacggtcgtgaaaactctagtaataatgtaactgaatacttaatacttcaatacattcagcggttgccgagttgttcctgcggcagcaaaatttttttttaaatggggattaagtcgtccgacggtgcctaggggaaaatttttgcaaattttaggtgcaacttgttaagaatatttacacaaatagaataaagaatatataccgaataaaaaaagaagttagattattaaaaaacggtgctgggacgttagtcaaaaaccatcaaaatgggcgttagtcaaaaaaccatcaaatgaataattgttgacagaaaattattcataatttcgcctaaaatggatcaaattttataatattgatatttttcgatagccctaagtgttttctattatcctgcaaaatttttaaaaaattctttaagtttataaaaagttatgacctgagaagctcaaaaaaccaagtttttttgaacatttttagttataactttcttgatacttaacgaaactttttggaattatttttaaaatccttaatttggtgcccaaatttccggtgcccaaacatccggtgcccaaacttccccccgcgattgagtttgctacttatctcaggtcttcacttttattttattattcgatttagagttttttttcttaactatttttttaataactttaaaatccttttgttaaattttttttctaatttatttttttatatttttagctttcttttttgaatgatttaaaaaaaattcatacgtctttatttataagaaattttctgattttggggtagtgattaaattttgtctaattttttttaacttactcatacctttttaaaatttcaaaaaatttcattgaatttcaaaaaggttattgccaaaaaacacttaagatttttagaaattttataaccataattttttattctatttaaaaatttttgatattctgataaagaaccctagagctactgaataatttggttgaatttgagccaagctatgaatttttatgtcctagatttatgttttcctatcccttggcggatttaagaaagttattgagatttatttcgtaccattttggccaaattaattgaacaaaagaagaattttggcttgataaataaactgttaaaaatggtcaaaccggacttagaaaaaatcgccggacccgtgactggacatttggacagtggacatttggacagaaccggacaattgtacagtggacattacgacattgagtgaattttgttactattataaattgctttagcaatgacaaaaatattttcttaaaccatttggaaattcttccaatccgattagtcaatttgtaagcgcacggttcattaataaagagcaataaatttcatcttgtttattttttaaaaacataatttatcttgactttagaaggaatcaattacctattttagtgcctgatcagacttaagaaaattcaatttacctaaacaatcttaaaaaactttttttttgttgctgcg

SEQ ID NO: 11237 - DNA, 1119 bp, Heterodera glycines
ccctttggattttggctacaaaatcacttttattttcataacttttttcaaaaaagtgataaaaatattaaataaatataaacatgtagagaaaaaaattgcgcattttatcaatgtttgcttataccttaacgccttttatggaatgagtcatgaattttttagtgaaaaattgaatttttaaactttttatggaataacttttttcattttaaatatagaataaccaaatcaaaaagataaatttttcccgatttttctgcattttttcatcattcaatcattcaaatagacacattttaaagggagttatgatttttcgaaaatccccccaaatttcccttgaccgaaaaatgaaaatttcaaacccagccaattttggtcaaataaaaaatttaaaaaattgaaaaaaatatagaaaattttttgaaaatatttccaaccgcttagaacatcgttacacgtcataaaaaatcatccgcacatcatgggattcgaaccctggcccccctctatgggtcccccagcagataccactggaccaaccgggtttcaagcgaaaaactcactttggcttttcaaaattttttttatatcaattgatagctcttgaaatgctgtgacccaaaagtgtcatgcgtttttcgatgacacaactgtaaaaaaagttatagtcaaaaaactgaaaaactttgagggggcctagctcttaaatttttgaaaatttcaaaaattcaaaaaatccattcgatgcagctaatcaagctgtacaaaaagttcaacggcgccaagacactcagcgcaatccccagcgagttattctccaaaaaccaaaaagcggaaatttggaaaaaattttttgccaaaagctacaggccaggcctttgatgctagggcctcggtgaagaagaaaaaaattttccaaacatttcaatgtaatcgcctcccagcagaagttttgtgatccgggttcccagaaaaaagttttgatccaaagactgaatgcatttttcccgaaaaagccatttcagcgccgctggcgctcacctggccaccggaccggaatgccattatttttcctggatgcgcctcaaaaagttgctcaagcaatgccacact

SEQ ID NO: 11238 - DNA, 2536 bp, Heterodera glycines
  misc_feature (60)..(61): n is a, c, g, or t
atcatcactcaaaatgaatgtatattaaatggttgcctatgtaattgtattgtgtgtgcnnttaataaatgctcatatgtgcttcaattcaaatgcttttgtaggaagggggcggggggtggtaaaatttggcgtctgtctggtcggagggttagctcgcgcagaactcggtctgctcactccttgtaaattcaggtcaaaatgagttttagacaaaagtggtccttcctataagtctaccagtcacacatttcgtttggaattcgaatgttagccgcccaaatttggagataaactgaaattcagagtgtgcccttccttctgtttcaattcctgagataggtaacactggtacaaaaatgacgaaattcacaaataaggacagaactcgttcaaaaaatcacaaataacaagccggacaatcaaatctttcctttgaaaaagtcattgcttgccttttattggaaaaattggccttttttggtctgttaacaaatcagttttccgccggaccccctcccctcgcccgttcaccagaagttttatggaaaaactgcacccgcaaaaaattgttaaaaatcttattgtttgatcccgaatgcactgaaatttacgatttgcttatttcctccccaaaaatcgttaaattcgacaatcggaggcgaaaaaataatacattattgatcgaataattttaaaaataactaatttggaggcagtttcgcaaaacaaaatctgttctgattttgaaaaattgtcgatccgagccctgggtttaacgactttttaaaattttcatttttttcgaaaatggggggaacaaggtaaaaaaaattcagggggatgacaaaaaggataagtaccgtatgtcgaacggtttctgtgatgacccgctaataggggacgaatgtttaaacgccaaaaaacttaatgccatccaaatgtctacgtcaaacagagagagggagggagggagaggaccaaatttcagttaataaattgacacacgcttaatgaccatcaattcaatttatttcggaacacagatggaaataaagtgataatacacagcaaatgatatatgcatacaaatgtacaatacatcaataaatacagatcacgattatgagacatcttctttatctttgcatcttctgacaggtcgctcgctcttcaggtttcgtccatccatccgccggtcgttgttgcatcttctcacatgtaggcgctctgatccggggacttctcctgctgcaaaaacaaaagattagtgatgcgtttgctcccgtgtcccccttaaaccaaccgctggtggctcgtacgcgggcgaggctcccatgtaggcgctcgcgactcctgacgatggagaggcttccgcggcgccggacgacggtgcaggctcggcggggccggatcccatgtaggcgctcgcgactcctgacgatggagaggcttccgcggcgccggacgacggtgcaggctcggcggggccggatcccatgtaggcgctcatgtcgctcatgatgaagtgatgagttgtcgcgacgaaatgtgtagacgagcttggcgcgcactggtgttgatgttgcgttgagttgaaggctggctggcactggtgaaaagtgaagaaaaccgtcgccttttatacacttttttttgatgcatgaatttttgcacccgaattttgtatataaggaggtggattttgcacattctcctcactcagcagcagcaacacttcaagcaacgctctcaacgatcacacatcaagcacccacaaagccagcccgacaacagcgacaacaacagcaatggcgcaacttccaccagaggacgtcgcaacaatgcccacgcagaaggtcgtcttcaacgccccgttcgacaacaaggccacctactacatgcgggtgcgtttggcgtggtgcacgtggcatgcggaataaccccccccccccctttttcaggtgatcaaccctgggacgaagcgcatcggctacgccttcaagaccaccaaaccgaagcgcatcaacatgaacccgccgaacggagtgctcggcccaaaggagtccgtcaacgtggccgtctcctgcgacgccttcgaccccggcagcgaggacaccaagggcgaccgtgtgaccgtggagtggaccaacacgccggacccagccgccaccgcgttcaagctcgagtggttccagggagacgggatggtgcgccgcaagaacttgccgatcgagtacaacgtctgatggaaggatgcttcgtcacctcaacatggacatgataggatcccaccgtcccaaaattgtcattttgtcccccatcatgtaaattgttgtatctgtatgtaaatttctgtgatcatcacttcaaatgaatgtatatttaattgttgcctatgtaattgtattgttgttgtgcttaataaatgctcatatgtgcttcaattcaactgcttttgtaggaaggggggcggggtggtaaaatttggcgtatgtgtggtcggagggttagctcgcgtagaactcggtctgct

SEQ ID NO: 11239 - DNA, 5354 bp, Heterodera glycines
  misc_feature (60)..(60): n is a, c, g, or t
  misc_feature (65)..(65): n is a, c, g, or t
agaaaagagtaggaaatggtgaaagaaggagaaatttttgataaaaaattaaattttatntcatntagtcatgggattacacacatgcacatgtggtgtagtggttaaactttctacctttcataatttttcgcctgggttcaattccccacttggatagaatattcctcacattttctttaccattattttaattaaaattttaattttaaaaaatattccaacttttttctttcatgttaagcatcctaaaaacccaaaaattaatcaattggtcattttttttacaaattctgtttgaaagcaaaaaagatcattgatttacattaatttacatggccggagacccttcgcaaaattggaaaattggccgctgatcccttgttttgcaataatctgaattttgaggtctacatctgaattttagtgttctttatcctgaatttgaaaaaaaaaacttggtcaacctgaatatacatatacttctgaacaattctaatgctaaaaaacaggcactcgcgcgaaaactgaataaaaattttgtatttggaaaattttgtccaaaaatttttatgttctaaaattaccggtttttaccggtaccggttgaaaaagttggtaccggtaccggtaccggtttttgcagtaccggtcagtaccggtaccggtttttttgcaattaccgattaccgctcaactctagctctaaccaactgagctacacggacacattctacactcctctcaattccatagataaggaagagagagactcattcccaacatgagggaattgagccgcatcacatggaaacaagctgatcagaatttcttacaagagagaggcattgatcagcagttctttctaaaaatgaagatcagggaaagcggtctaagagatgtctgcttttattaccggagacttattttattccggatatcatttttgcgaattggtgaccaattttagtttgacggcggctatttattgtccattagaggagctaatgtcggaccaccaaaatttaataaaagttttgcctcatttcagagaatgcccttccaactggccggaacaacggcacggactgttcggtgtggcacagcgaatttgaggcggacgatgcgaacattgcgctgccgctgagttcgttggacggtggtgccaaacagaaaacgcagcccaaccatttggcacgccgaaggcggacgaagaaagcgacggcaccgtcgtcaacgaaaggacttttggcactcggaagggaacgaatggccgcaatcagtccggtggcagaagaggatgaggaggaagaagaagaaactgatcgggaagacgaggacgaagacaccgatcagcgggaggaggacgaccggcgggagaaggggcgacggaaggagacgaagcggaggagagagtcgagccggggcgtgacggagctttgactggagcggggactccgatggcaccgaacaaagggtgccatgcttttcgacattaagctaattcgcttttctctcactcacttcgttggcattccaattcttttttgttttacattttcattttcacatttaaatttgtctttttgtcgctctttatgtttttgtttggttgggtcacagttgagaagcaaaggctcaaaaattgtgatttttttttttttgaaaaaattgctttgctcacttcccaattaaatattttgatcataaattacagaatgttgttccaaataaagtacaaatctttaaaaaaggaatgtctgcattaaaattggaaaatgtattcgtaattaactttaattaaaaaataattgtaagaaaatatgaataaatttctattctaatgacgaatttaacccaagcgaaaaataacagaagatgaaaagcttatccaaaagacaaatacacagaattaattttgaaaacaaacagaatagtagttatgttttgttcagttcctcaaatacgaacaatgatttcccccgcgtcaagatgctcaattggagttgttttgtcacctgaaaaatgataattgtttaatttaaaatacatttttaataattaatattaaaatgtatttaattgtttaatttaaaaatatatcttaaatattatttatttaattcaaattcatttttaatattaatttttttgcccatttatttgcctttttcgcttttgcgcctccgtccgtctcgccacgctccacgtaaatgaacacggcattccaacactgctgcagttcgtccaagttgcccagctcgacaacggccgtcgtctttttccgctgttcagcaaaagccccgccattttctccccccagcaaattcgaattgccgaaaatcaccaaatgcttgggctcggagatgtgcatcattttggagcagtacagcagcacattcaaaaggccaccgcctgcaaaaattggaatgggccactaccaaacggaaaagcttagaaaaaaatacaacttggtccatttgtgtgaaaagttcttatgttagggggaggggcttctaatacagaggggcgggggcttataattcagcgaatacagtatgactaagactgtagacatgttaaaacgatcgaatttaggtcgattagatgcacaaaattcatctcgaacagcttcaaaacagttgcggttgctgtttctcgtcccttttggcattgctcgtctcccctttctcaaacagtcattttctctcttttttggtgaccattaatcccattttgatgacaattcgtcccaatttggtgaccattagtcccattttgatgaccattcgtccctttttggtgaccatttgtcccactttgatgacaattcgtcccaatttggtgaccattagtcccattttgatgaccattcgtccctttttggtgaccatttgtcccactttgatgacaattcgacccaatttggtggccatttgtcccactttgatgacaattcgtccctttttggtgaccattcgtcccaattttctaatcatttgtcctcatttttgagctgcggtggctcatcaatccgaacttcttgtgaaatcattttgtccagttgcatttccacctcatctttaatttccgccaaccattcttcttctttttatggcacaatttttccgaactttcgttcatccgaaagaactggaaaatttcaggttggtttttgtccgcatttaatagagtttttagtccctaatattaatacgaatgcagcagtgctaatactcgggactaatatgaagacccgagactaaaatttccccagaatcggggccgagtctctcaagagcagcaggggcggcgaattgaatttttatattttataattaatacatatgtgtaattgtaactattaaattagaaaatattctataagtgtcttatacatttatagaattaatttaaaaataatctactggtgctttgtataattaaaaataaaacaattaataagtcactaaataaggatgataattgacacataatataataaaaatgaaaaaaaatttttcttggaatgaaaacaaataaaaattcaagaatttaagaaagcgcagatgactcagccggggaccccaggaaaaacgggggtaaaaaactgagattcacaagaaaattaatatttttctcttgagtaggtgggtgatccaacttaattttccgcatcctattaatcatattcttttatttttctctgatttgaattccgctgtttttcctctcatgagtggcgaaacaaattccaaagttcaattaaaatatatcaatatttcaatttaaaatcacaatttaacaaatcatcgtgttttttcgtcacttttcattttgttggccttttcttctcacaatttctttttcattcggaataataaataatattaaataataatttcataaacagtaaataaaatggaaatatttggcataaatattccgtggatcattttgtttttgttgttatttgttccacatttatttaagcaatcaaaaatctgttgtcaaatacctaaataaaaatgagcctataaataaatgagaaattcaccaattaaaataaccattcccccgttaattttgcatttatttttcattttttaagaagcatttcaattttcaaacgattaaaatgtcggacgaaccaaagcctccgcaaacttcgttcttcctttggtagtcaaaaattagtgcaagcgggaattgtaactaatcggaagcaatttaggatgaacgaaaaccgggaccaattctatgagccgggaatgactcaggcggacgttgcgattgtcgcaggtcggcacaaagcccaaaacggagttcggtcttgaaatccgtagtgtttttcatattgttccatgtcacaaagtcggacgaaggattgtttttggggaaatagggctaagtaaagagaaacggggagccgattatcaatacgatgaaaagcatcatccccaaattaaggcgctgagtggcgccgattgccggaatctgagaaagccaaatgggcacagaagtcggaggaggacaaagaacgcttcgcacacggcaaaaaaagggggggggaagaaaatgaaagaatggcatttttgacatttgcagagaaagccgagaaaagccaatcgcagcagaaggaagaggaggaatgagaagaataaaggaaaagtggggaaaaggatgaagcagcataaaagtgaaaagaaaaagctaatgaaggacggatggattgatcacatttgatcatttttaagtttatcacaaaacacagagtgccattattgcttttgttgaagcaaaacataattagctcgtaaagttggattaataaatcgttatttattagttttaattaattttgattatattttcatatacagcgctgatcattatggacgagatcattatcaaactcctaataatgaaaaatggtaaaaatgccgaaacaatggcaaaaagaatggcgaaaaattgaaatttgtgaaatcagttaaacgaattatgaatatttcttccttcccttaaaatttgattgaaatggaaaaaacaaacgtcactcgacggaattaaagaacaaaagttgaatgcatatttagaaagatacaatagttttcaaagccaattagacaaatcaaatcaaaaaaggagagataaaccaaaaatagagagtgcagagaaaaaaagcatatcttttgttacatgcttaatggattttaattaaattgaccattttatttatctaaaaacaattctaacggccgcgaagggccgccaaaagggatgcgatgacggagcaatcatatcatatgtcaattagaaggcgtaggcagggggggggggggctgaggggg

SEQ ID NO: 11240 - DNA, 1898 bp, Heterodera glycines
agtaccattcttgtgtatttgtagtaggaatcagcgccctagagcagttttttccgcaagtccaccagtccaatcaatgcttgccatttcgtttttacttcggtgttaagattctcagctttgacccgcgtttcggcatgtaattcgagtgtaagtgtaggcaaatttgaaaatttctccttctcttcgtaaaatcggctcacattctcttcggtcgcctgaaaatgtattagagaaaacgaagagatttgaaatgggacggacctcaattccgacacgaaattcatcgtaattcctgttttccatcgccacctcctgctgatttccggggatgaaaaacatttgccgaagcgccatttggtgttggtcaatcgcactgatcacccctttggcacaatgtcgcaatgcgcctaattgaatgccgagctcaatccgttccgacacatccatcgcaatctgagggaagaaagtgcagaaggatggtatcagcaagcttttgctttacttgcatcccttcttgctgcaaattgtgcagtttatttgctgctgcgttgactatgtcgttcaacggcgtttttggcgcagatttaaagacaagttgcaaattctttccgcgaatggactgcaaaacaaattatttaaaaatatttatcacctgttataattccacgttttttgtgttggttttgtgcgtttacctgtaacagttctctttgttttttcattgcatcggacacggtctgttgcaccctgacagtgttgtcggtgtgaaactgcttgaacacttcgacatccctggccacggagtgtcgcaatccttcgaggtcctgccgccagttctgaatttaaatatttctcattccatttaaattatctcaaagaatgtataacctccaattgaatgctaataacttcacagtcgcgcagaaacactgaaatgttcagtgctgcgttaaggtaaaatcgttgcttgtgccatcgttccttctcttgctgatggcgcatttctttaggaaagggtgcaaaggcattaattattgggaaatggtcacattaaagattgaaaagcaattcaaattgtgtgccgtccaactcaccgatgtctctggtcagcctatgaacatggcaagctgcctctgagttatcaacttcgagcagttccctctgctgtttgagtgactgtagcagttgctgcgactcgaccatcacgcgttcgtatgcttgcactgtcccgtcattttccgactgaaatttctctttgttctgctcgcaaagctccactgattcgggcaccttttggatgaaatcaattctgaaaaaagtgtttttctatccgattttgtttccaaattacctattttccatgcgaaaataccaattcataatctcctcgtagtgcaagaaaaagttggacgacaaacaaagtctgtttcatttcgaaattttttgttttaattgctcttttcctattttagccttacaaatttgttcgctggtcaatgcatcggcggaatttttcaatgcgctgtctcagttcttcgactcgtttcagtgtttctgtcctcctcggctcctctaaaattttcttttggatagaaagaaatattaattagcattctgatgacctaaatcgcggacaaggtggaagatttgttcggcatttctgtttgtgttgtgtgccactgctcgaaatttgtcgtgggtttcacagaattgtgccgccgttgtccgatcaatgccaatgccaaattttctacgcatgaaaggctcgccgtgttccgtcagccaactgaggacctgaaaacagacaatgttacccaataattaaagtatcagcaaataaaaaaccgatttcaaatcatgattaagcgcattgctggacactttagttttgatct

SEQ ID NO: 11241 - DNA, 3227 bp, Heterodera glycines
cgttatgcctgtgcatagcattaggcaattcgtcctcagagcggatggagttcgggtcgaccccagcgttgggcagccaacgtttggcatttttaagaagctgacccgaataaaatagaaagtaagccaaaaaaattgtaattaacttcaaaactcctaaaatacttacaagaatcgataaaatgataagaaaataattcaaatgcaaaattagcgaattcaaaacggaccgtgtcgcattttctgtgcatatttagcgtaatttgcaaaagagcggttcgttgcacaatcattcccacaaattggtcccaatcggcctgcaattgttgcgaaatgctctcaattcgattgacaccgataaattggaattgttggagaaggcgaagactgacggtgatcacttgctcgtaactgacttgggatgtctgcaaagaaatggaaaacattcaaatcatttgggctgctcacattcactgagtccgcaaagtctttgtgctccttcagcagtcggttcgtttccgtttcactttcgccaatgagcacaaatcggtgactcagaacattcaaatgggagcaaatccattttgacaactgaacgaaagtcaaaaaatgacgagttaattaaaagcgaattggctcgcctcctccgcatctttctcaaacagtttcaactgaaagtaccggtcgaggtccttcttccgatagtcccatttcgcataaacaatgcctctgaaaaactactttattggaggacaattccgcttttggcacctttgcttgtctaaattttgcttgagcatttctatttgtggaaacactgacaaaaggtcggggtttggactggaaaggacggagccattccgactgcccacactttgtttatggccggaaattatcactctgtccctcagcgattggatttccgaagtgaactcatccatcggaacagcagtgataattgggtacaaatcttggtgctttgcaattgatgtttgggaggattgaacatcgatgggcatttccgcgttgtccatttcggtggaaattcggtccaaatttttgagaatttcgcacattctttgcaaaatcctttcaatgtcctgaagggtagtttattttaaatagtaataaaatagtcagaattataagcgccttgcgaagttcgatccattcgtcgtgatcataaggcaaagagccgccaaactcgcggataatttggcaaaagtcaatgtattttggcattgcttccagagagatcatttggacgtcgaatttgtattttgtcgttgaaattttatatttttcgagaattttgtccggcttcactatgtacacacaattaataagagcggggaaatattcctgaaactcaggaatatataatatgtagaaataaagtcaggatattcacctgtaatatttttaatatcggtttgacaatttcccaagtggtccctcgacgcatgtcaatgacaaaagtaaagccacgagtctttgcatcgtctctaaaaagacccaagtaattaaataaaccaattaaattgtaaaacaattaaatgatgaagccgactcactgtgtaacttcgtagagatacgtgagaaggttgcgtaagtgatcggggtgagaattgacctctcgggcgggcacaaaaataattggacgaccttcacgatccctgaaaaagcgtttttttttgggaaaaattctaaatttgcattttaaattatgtttacctaacgccaggcaacaaggccactctctcccttagcacatgttcaatatcctcggcacgattgggaacatggcactggggaaaaacgttgtttaacattgcaattctaagtgaagagaaacggcaaaaacataaaagaatttaattgtattaattagtaatttgaaaaagaagaaatagaaaaccaaaggtaaagcattgctaattgtaagtcagaagaggaaaaggaaaggaaaagatgaaaatcccaagggcacaaactcatttttttaaaaaaaagataatcagaatgccaaaaaaaattaattaagcaaaggaaaagaaagaaaatttcaaatcatctaattgtttgtaagttcctgctaatactctttttttcattttattatgcttacgaattggtcttaatttaatcctttgaattagcatttctctgcataatttattccaatgctaataaaagtgaaaacgctgaccggaaaagaaattgagttggacattgagccgacagacaaagttgatcggatcaaagaaaaggtgctaatttgaaattaaaattcaaaataattctttatttgaccatttcttaggtggaagaaaaggagggcattccgccgccgcagcaacggctgatttttgcgggcaaacaaatgttggacgagaagacggcgcaagactacaaagttagtattcgtaattaattacctattgtgaaaaacaaaaggcgatcttttaaatttggccaaaaatgtactctaccttttgttcggattcgagttaagcattgattcaaaatggaaatcaactgattcgagatcagctaccccgtaacccagagaacgaattttcaagattttgacaataacaaaaatttggaaacccacgggtctcccctttggttttggtactttcctgttttatttatttatttattcagaagaaataaaaatatccaacgaaggggtgaccacttacacgttagattttagtaaagtaatataaagtccaaggagctcttttacagactttcttcggaaaacaatttctttttttgtatgtcctcccttttagatccagggtggctccgtgcttcatcttgttcttgcccttcgcggcggatgaatgttcgccatttggacgcttttgttggataaatgatttgattgtctaatgtctcactgactttttaaaaatatttaaatacaaacataaattgagttccacttaaacatcgtcagattggtctttctttttttctttggattttcgtccctccgttcgcttttccctttcaaacattcgccattagtttatgttgtccggtgggtcgaacaaccgttttttctgcaattctaattttgatttagtaaaatcagattctgtgctgacttaaaacaaattaccgtcacaggagggcgttcgggcttatgccattttaagtgggctttcaaatgcgaacttttttctaaatacgagacaatctttttttctgtt

SEQ ID NO: 11242 - DNA, 656 bp, Heterodera glycines
  misc_feature (8)..(8): n is a, c, g, or t
ctaagcancacttattgatgtcaacagaaattcaactaatataagaaaaaaaaaatttacaaaagcctaaacttaggcctagtctaacaataagccattgttcgagttgcctgtgtatgagttgtcatgataaccttaggtttaacaacgaaatttatagttaaaaactttattgaatacctaacaaaaaaaaagtttttctcttagttattaggacaactataataccatgggaccagggatggcacggaatttcgatttccgaaaatttttggggcctcggaatgccatccctgccatggacacaaaatgccatgggacgcgtaaagtgttgttgggacgcgtaaaatgtcatgggacgcgtaaaatgtcatgggacgcgtaaaaccgactagaaccaattttaattattttttccgtttgacgcatatccgaccaaactgacaaattattgtagaagatactagccgcaagaaataaaaaagttaagaaatttgtccgaattcgggttcgggattcgaaacatggatgttttgcacaaatccgaccaatttcagtcctaaacaggtactcacgcgaaaacgtaccccacgcgaaaacggccacgcgaaaacgtaccccaaccacgcgaaaacgtccacacgcgaaaacggcca

SEQ ID NO: 11243 - DNA, 3467 bp, Heterodera glycines
  misc_feature (85)..(85): n is a, c, g, or t
gggaacggatttatatgttgcgttttttatgcgcatatgctatcgcatgaaaagctcataaatagcatttttacctgttttcctntcaattagagcgagtttttagcacatataaaaacatattttgggcttttggcgaataaaaacatattttgatggtttgaccgattttagcacatattttagcgatttttaaaaaaaattttgaatttttttagaaaattctttttttggcacccaattcttggcaaaatgacaaaaaatttttcaaaatttttaaattatttttcattttttgacctttttcatgatttctcatttttatggcaaaatctaaattttagcgaaaaaataccaaaaataagcattttgctagagaaatgggtaaaaaatgagacttttatgcaaaattcacgtatttattaagcagtttttttcagtttttggcacatattttggccttttttcgggtttttagcacatattttggcgtttttttggcacatatatatgtacatatttggcgttttttagcacatataaatccgttccctgcttatattacatctataattatgcataaatatcgccgccatgttttgacatattaaagaatttagttaaaataagtaatttaaaatttcagattccggaattttttaaacctaattataaggagttttcagtctatttaaaacgaagaagtgatgggtgaacggcgccgggaaaattcgccccattttttataagagttttcaattttcataaaacgtaatatttttttatctgtcataatataataataatttggctattttttgtaatttattttaggaaaattgattttattgattacttctcttttttcttttagcattataaaattatatttgtgaaagtgctttctttttaacaatagaattagttagaaatttccctactcattctattggtaaattaataattttttttcattttctcatttaatacaaattgaaatattttataattcataaataggaaatttatttactattgaatctataaatatttaaattataataattcgtgaaatattattttttgaaaaattataactaattctttaacgacccggtaatcggacccgggccccgcttttctgggcccagggactcggttcttgcccaaattcccggactcgaatatacgaacttaaaaacaagcatctaaaccaccaaataagcacggaataagcacagaatgataaccaagcacgaagaatttaaaaaaaaactaaaaatgccgcagttatttcgaattattattttttaaaatctgtaataggaaaatagatttaaattccaaaaatttgttagaaaatgtaaaaattgtaatcggaaattcctacaataaaaaaaagaaattttaggtttttttttttgtaaaaagtcttcattcataggggatggttttagagatgctttttgctctttcaaaaacccaattaagaataaaactaagcatctaattacaaataatatgaaatttaaatgcctctattaagcaagaaaatcctaaatcactctctattcataaatttgaagaactaccctttaaaatattccctttcaaagaaatgatgctgcacaaattatcctttccatttttgcctataattatgatggattttgcgatcggacgcattgctttaaacgacgagtgccaaaaaggtgtgaacacagtttgttttaaaaatgttaataaactctcaaaacattttaaagacttttttggaacggctgatcaattggaagaaatggcattggaaatttttgcagcggcggacaaacaaacggaaaatggaaaattttttgaaaagggatttgacattttctgttgtattgcatttgaaattgaaaaagatgctttaaacaaagatgagttggcattaattgatgaatttgaagcaaatcagcgcaatttttgccaccaattgaaaaagggccaaaatatttgggaagcggtggaaagtccggcagggaatgccattgtaacagcggcgagaaatgcgaaagttaactctctaatacatgaagaaggacttcgaaaattggagaaaatgcaaaattcgagccctgaaaatcaagcagaaattggaatgtttgccaaacattgcattgccgcgttgaaattgtttcaacaattcatcaccggtatttctttaatgcaaaataattaagtttcagtcagaagcaaaaatattcatcaaaattgctaaaaacgcttattctgggctctattgcactttatgaatataaagttacaaaagaaattactcaacaattacttaattaatctaatcttttttggcaattgcctaacactgagattttatatatatttgcttcttaaggcttttactttgaatgataccaaaaagataggggtttgttcgaataggacattacggtggataatcgatcaaatgatgttagaccgcggcaaaagtatgcattcaaaactgctaaaaagtagaatcagaatcccgcggcattaaatttcccgccccggggtccctctcgaccgtttttccaaaacctagggattgacctggatcggtaatccggctgggatccaatttgtttgcttattaattgctacagtagcgactgttttatacaacaacaaattaagatgagcgattggctcagactttgctcgctggtggaggacagaccgtgtctgatcaaagttcagccttatagctcaacaggcgcccactcgatctgatcagctgccgaaggggaaatcgtcacggcgaaggaaaaggtcgagtaaatggccaaaatgccttggtgcttttgcattggccggcttttccggctatgtgtgcagtatatttatgaggctcttgaaaatgaatcatgttccgatattgacttactttactgctgactattcttctactcttcctttactcattcgtcgtttgcaacggagctgatagttgtgttgtacattttctttgctgtttctttgggcagcatatttttaggcatttatcattgctttgtcaagcgttcttattaatggaaggatttgctttatcggacaattagccggggccataaaattggacaaggtcatattttacatgactttatttttattccataaaatgaagagagtcattttttgacactttttcagaaaattttcgttttttacaaaaatttcataacaaaaaggcaatacaacaaaatatctaacctttttttcttcaaataatgggcagcaaaatatgaaccaatcggttcctttcggcatttaaattataaatccgaatgccacaggcggtggactgcgggggcttaaggacccccgccaataagtcaaccccctacggatcacgcgcgggtacttttttgttttgagaacccccccccccccttttttgaagttttcagataaaagtcatttctgag

SEQ ID NO: 11244 - DNA, 1918 bp, Heterodera glycines
ctctattcataaatttgaagaactaccctttaaaatattccctttcaaagaaatgatgctgcacaaattatcctttccatttttgcctataattatgatggattttgcgatcggacgcatagctttaaacgacgagtgccaaaaaggtgggaacacagttttaaaaatctttaaactctcaaaaatttttcaggcttttttggaacggctgatcaattgcaagaaatggcatcggaaatttttgctgtggcggacaaacaaacggaaaatggaaaatttatggaaaaagcatttgttggcattttgtgttgtattacaattaaagctgaaaatgattccatgaaaaaggaagagttggcaatgattgaagattttgaagcaaatcagcgcaatttttgccaccaaatgaaaaagggccaaaacatttgggaagcggtggaaagtccggcagggaatgccattgtaacagcggcgagaaatgcgaaagttaacctccaaacatacgaagaaggacttcgaaaattggagaaaatgcaaaatttgagccctgaaaatcaaacagaaattgaaacatttgccaaacattgctttgccgcgttgaaattgtttcaacaattcatcaccggtatttctttaatgcaaaataattaagtttcagtcagaagcaaaaatattcatcaaaattgcaaaaaacgcttattctgggctctattgcactttatgaatataaagttacaaaagaaattactcaacaattacttaattaatctaatcttttttggcaattgcctaacactgagattttatatatatttgcttcttaaggcttttactttgaatgataccaaaaagataggggtttgttcgaataggacattacggtggataatcgatcaaatgatgttagaccgcggcaaaaatatgcattcaaaactgctaaaaagtagaatcagaatcccgcggcattaaatttcccgccccggggtccctctcgaccgttttcccaaaacctagggattgaccgggatcggtaatccggctgggatccaatttgtttgcttattaattgctacagtagctgagtgttttatacaacgacaaattaagatgagcgattggctcagactttgctcgctggtggaggacagactgtgtctgatcaaagttcagccttatcagctcaaccggcgcccactcgatctgatcagctgcagaaggagaagtcgtcacggcgaaggaaaagatcgagtaaatggccaaaatgccttggtgcttttgcattggccggcttttccggctatgtgtgcagtatatttgctaggctcttgaaaatcaatcatgttaacattttcacatctcatcatcctgttgttcagccccatcctcgtatatcgttagtaatggaggtgttagtttcaatgtacatgttctttgttctttctttggtcagcatctttttaggcatttatcattgctttgtcaagcgtgattactattgatacgatttttagggttttcaattttttcctgagcttcctatggtctaaaagaaaacatatattttttggtgtttgttatgctatttttcgagttattagcacctttctaggtttttatttttagaacctaaaaacctaaaagaaatctgataaaatcaagaattttaattttaaaaattacgtatctcaatactaattgtagggctgggaatcaaaatatgtaaacaaatttataaaatggttttttttttgagaaaattgttaaatggtgaataggcacaaaatgccacaaaaatgagctaaataggcatagaatcatcttttagtattttaagaattaatcagattctaatataaaagcaaattttcaaaaattcgattttcgactttttggacgaatttgggtttcggagttcgga

SEQ ID NO: 11245 - DNA, 4362 bp, Heterodera glycines
attcctccaccagccgcggcctctccccccatcttttcccttcccttttccgcctccctttccggcaccgccttcgctttccatgcgcccgcccgtggaggcaattccgcctccctttttgatgagggccgcgatgatggcagcggcgccgcgggcatttcacgcgggcagcttttggcacaacgccaacacgtaatgatgagcaatcaagtgctaattatactaattgactatgtgtcaaaatgatagtaattgtgattccttttttagtaattccgcaacaattgtcggccttcgatgggtcaaatcgttcgttttttcctccgttgtccatcggaattcaaacgccaaatcaatgccaaaaaggggaggagggcccattggcaaagccaacggcgaattgccaaaatggtgaagaaagcgaatggtcgacaaaatcagcgccaacaccaaacgaaatgagcggaaacaaaagagcaaaaaagcggaagagagagaaagttgccaaaaatggacaaaatggggagggagagggggagcaacggaacgccaagaaatgcaacaccaacgccaaagacaacaacaacccaattgtgcaaatggtgatgagtgccgtcgccgaaggcaccgccgcaacgacagccatcaatttgaacacgtgcggtcagttcagaggagagggagggagggatacggtgctgtggggatgaccaatgaaaagcccactttctttgtttgtccgttggacccatcccccgagggaattccgtcatgaaattgcccttttagccatttgcggggaccaattccgcctcatcagtgaccttgtccaacatgcgcgaacgaatcaccgccaaacgagcagatacgatcggaatgggccgagggcatcgattgcggaagaagtgcagagactaagcaaagagtgaagcggagagaaagagagacaaagagagattggaggggttagagaaggagagactgtcagactcacaacaagacaaaattaaaagtgatcagagtgatcaatcagccaatgatgaaccgagcaaagtgacgcgaaagtgagaaaagacttatcaactgtgaaagtgttttgtagataccttatgtttttgtataaattaattaattgttagtcaacaagtgttagttcgttgtaagttttctctgattgtctgctgaattaagcggtgcactctatctgttccctttcgctccctcgtccctctcatttttgccgtattctttctccccctctccgtcattcatccctctcgtctctccgcagtctcttccgtactgtcctctctctgctctttgtctattttttctctgactcccccctcggggcatagtttttccatctcttccaaaacatccaccggatgttctatcaacagaggttgcgaacatgtcatcctaaattaggtcagttttggccatttttatccacaaaatgcaaagtctccgagcaatggcatgttggatgaaagcagccgaaaggaggaaacagaagcagaacttaatggcacagctaattattattaattagtcaggcaattagcaacaattagcgaatgccgagaggcaattattaatcataataagagcaaatacccaccttgaaaatggtgtccaagtggaaattgttccaaaggatgccaatgacaagcaaattcaatggcacacggaagaaattcattgtcgttgaacgagtctgaggaggacaattttcaattgaaaatgattttcgtttgtcgcaatttgccaatgtccgaccttttcgggaatgtactgggagcgcaggaaacccatggcaggccaaaaaatgccaacgcaaacttcgaagagagcaaatgagatgaaaataatggtggaagatgaagggaaaagcaccggggcacacatcaaaagggaggcgacgaggaagacgaagcttaattagcactaattagtgttgaaatgaaaagaccaagagagagagaaaaagagagagagagagacaaagagagagagggagagagaaaaagagaggggagagagagaaagatagagagacgcggggaggtgcaattaacaaataatcagagaaaggtaagaacgatcagccgattgatctggtctcagtttaactagcctaattagttttgatttgcaattatgattagctttggtttgccgttgttttggctttgttttcttaccgcataaatgactcgggtcggttgtactgactgagcaaattgaacacggccgagcccatcatcactgacaacatgaaggaggcctatggaaaaaaagaagggcaacgtttactgcgttttccattttcttttgaatgtttattacgcacaaaaataaagccgtgagggattgtgccggtctccgaggcgcggctcaacgcgggtgtccattccaagacgaaaacgtacatggaactgacaaaagagcaaatgagggggaaggggaggataattggacggagggaatatttatccgaatttaaatatttatccgaatttaaatatttatccgaatttacccttcgaaaagactttgggccaatccgaggcacaaaatgcgttggtctgcaaagtgtttcatacacatttcatttttcgtcgccttttctgaccatttcgaattgtgttaaaagcttcgccaaacgtttgtgccaaattcgccctttcgtcgccgtaattttcagtccaagtgaatgccattagcagtgccatcacaatgagtaccacaaaggcgcaatcgaatggggcactgacatcgaaacagtgatccaattgagttttgaaaatgccgcggttttaacccacacaaatccgaatgcgttggccgccgcctgtgccgtgatgccggccaaaatggcgatcagagagttggccaaagtggcatttgcaaagatttgcttcagcgactgatcgctgaagccgcgctggaaaaagggcactttgatgacatcccaaaaagtgagtgagtgaccttccgatgctcaaacacaagccaagactcaaaggcactgaacaaaatgctggtggcgatgccgcccatcaatcggccgatcagtaaaatgttaaagtccgcaaaatgtttggtcacacagctgacaccgtacaacagggcgtacagtagacaattggccttgcggccacttaacagaattaccgtaacccatcggggaaagggacgagcgaagcgggggaaaggaggaagagacattttacccgctccaatttgttcaaattgcctatttaccgcgcctaaggggctttagggactctgaaaaagcgactcacaatttgtcggcgatggacccaatgaaagtgccaaaaaagagactggagccgaagccggcgatgaacagaagttctgcgaattgtggaaaacgaacgaataaacgccccggggaacgccacccaaagaccgaccgatctgatgtttggtcatccaataggactcgtaaagtgcgtacacatgggggccctggggaaaagccgagattagcagtggcaaaaatgtgcttaattaggcaaagagggggagggggggatgaaggacctgaagccaatcgcccgccacggctaaacagtaaacagccaagtaaatgcgttggaagctgagaaagtggccatctaagacggagggggtcagacatttcgggatattaaattgaaatgagtcatggccaattggacacgggcaaattcagtccctttccgtcgacggacgcccttttcggcaaaatgtcctctcctccctctccttccgttttctgtttccttaccttcgtccgttggttttccgccgctcttttccgtgggcctccgcttaattttatgggccccccgctttttcatttgaatgctttgctttttacggttggaaagggatcgattgaataaacaaatatttcatggggcgggggaaaggcaaccgaagggaccgtcccattttaagtgttgttaattaggtgtcaattaacgataattaattaatcggtcattaatttgtatttgtttgtccgaccatcgctcattcattgctttgctcaccgttctgatgttcgtgctgaacctttcgtttaacagccgcacaaataatcgcacagcaaacgcacaaagcgaaaagtgcaaacacaaaaaacatttgcgaaaatccgaagaattttattatttatttctgtgttatttgaaacagtgaatcccccgagggttcaaaaatgccaaaaaaggcgcttaaaactctcacaaaatcccaattcaattgaaataggaaaagcatttcttaggggggaaagacagtgaatgaatgaataataaataagcaagcaaacactaacactcagca

SEQ ID NO: 11246 - DNA, 3864 bp, Heterodera glycines
ctgaaggaaaatcaattaatgctatggtaaagtctaggttgaggagccccaccttgatctgacggaagagacgctgaaggcaccacatttagttgatgcgcatgttcaatcaaatggtcaggacgagacacagtccatgggctttgcggtggtccggttgatgagcgtcgcggcacatgaacattccttgggctttgcggtggtccgtttgaagggaattgcggcacatgaacattccatgggctttgcggtggtccgtttgaagggagttgtggcacatgaacattccatgggctttgcggtggtccgtttgaagggagttgtggcacatgaacattccttgggctttgcggtggtccgtttgaagggaattgcggcacatgaacattccatgggctttgcggtggtccgtttgaagggagttgtggcacatgaacattccttgggctttgcggtggtccggttgaagggaattgcggcacatgaacattccatgggttttgcggtggtccgtttgaagggagttgtggcacatgaacattccttgggctttgcggtggtccggttgaagggaattgcggcacatgaacattccatgggttttgcggtggtccgtttgaagggagttgtggcacatgaacattccttgggctttgcggtggtccggttgaagggaattgcggcacatgaacattccatgggctttgcggtggtccgtttgaagggagttgtggcacatgaacattccatgggctttgcggtggtccgtttgaagggaattgcggcacatgaacattccatgggctttgcggtggtccgtttgaagggaattgcggcacatgaacattccatgggttttgcggtggtccgtttgaagggagttgtggcacatgaacattccttgggctttgcggtggttcggtcgatgtgcatcgcggtggttcggtcgatgtcggcactcgcaaaaaggaaggataatccgatggacgacgcgattgagaccacgtacgacgctgagcccgatgtttcactgaaggaaaagggaatgagtgttttggtaaagtcagcatttgaaaagtaccacaccattcgctgaagtcgcccgacgacgggttgaagccggcggacgatgcgtttgagacggcgtatgacgggttgaagccccaacaatatgatgatcattcgactccacatccgagcgaactgaaggcgaaactgtcagacgacgctgaaattaataaggtaagaaacaaataatgaaatggagagttagttgaacgcgcctcattttggcgttggcgttgtcgcgcgttgtcgggcgctctgtcggcggacataataacaaataatgtgaatgaatgactgtaaacgaaaattcccctctttatatacacattttctcttccaaatcgacacaataacttcactatgggtcaactccactgtgcagagaaaagcctagtactatctcgtcgtttctctttttctttgtaatttctcttactttggcatactatctcttcattttaattatgtaaaaaagagaaattaatctgatgctaatatcttttttttaatgctaccaatccttttcaaacttttggggccgttttattagaggttttttggaaaaatgccaaaatatgcacataaaatatgcacgaaattccaaaatatgcacataaatcgcgaaatatgcacaaatatgcaaaatatgcatatggaaatacagtctagaagcttcaaaagaagctaaaaacatgtttttcgtgcgtttcaggcctcccacagtctaggaaaaaaatatgcatgtgctggtgctatgtgatttcgacagtgagtgatttcgacagtaccggtaaatttaaaaaaaaacgagtatatgaaaaattggaacctaaaataaagtggtatgagcacgttcaaagaaaatttaggattacgattttcaaaatcttcgaaggggcttgtggatcgtgattttgctctccatgtcaccattcatttataatttttcacaattatttcaataccaagtataactttttatatacaagtcgtagctctaccattcaaaagaaaattcggtagtaaattttgtgttctttaaaaggagcttattaaaaatttacctggaaattttcccaactccctatgattttttttttaaatttcagcgattttcaacgtattttgtggtgtcccgatcaccatgaaggaatgatctgatcaagttggggtaaaagaattttttgatgaagaccaaaagataagcaagcatgaattatctcagatttttatatgaactatgagatggtttttcatcttaagtcaacttttttccaccactatatcacttcattttaggttccaatttttcatatactcgtatttttttaaaatttaccggtactgtcgaaatcaatctctgtcgaattcacaatttttctgatactgtcgaaatcaatcatcgtcgaattcactcactgtcgaaatcaaccactgtcgaaatcacctggcacgcatataattaccagccttagatattagattcaactaaaacgtgaaaatatttgtgtgacatcgttttgtcatcatttcttgcacacagcggcccaattttgggctccaagtacaattaagttggatttttcgtcttagtggtctgtgagttagtcaccaaaagggggggtctcaggttcgaatcccatgcatgctgtaactgtattttgaggtttttaaagcaaataatacaagtgaaatgataacacagtttttaatgaagctcaaaaatttaaaaaaattttatttcctgtaaaaacgaagaagaaccttttatcgaactgtgtctattcaaaatcgaattgctcttctccattgttttcttcgtccgtctcccgtcgatcaccaatttctttttctaaatcaccatcaataaatgacattgataagcgaaatttcgtcagtttcctcttcagattgatcgaactcatcatgctcttccctccgatcactttgtctctgaattattatatataaattttaaaataaaacaagtttaacgcaatcaccccctccaaacatacagacctgcttcatttcatcaattttgcccgtgtcgaggagccaattgttgacaaaatggtgctccaattgctgcaaaatttggtctgcgtccggcatacacttccacagttgctcaagtcggcgccaaactgaatggagcgcctcgtcacctttaaattcagattaatgggatagaaaacatttttcaccacaaccctgttcatctaaaaggccaagaaatttgtgctcgcgagcgaagggaacaaaatggctcaacaaaagatgtgccttgggcttctttgagagaaacacgcgcattcgctcctgggcagacaaaaaagatttaaaatcgttgacacgctcctctagctcatccaggtcattcggtgacaatgggctctggcctaaatttcataatttagtttgagaaagaagaaaaaagggacttttgaaaatttttggattttcccgaggtgcacaagggttctctgcaaattgaaaaattttcgaaaatttgttcccccaaccagaaaaatgaatctgtgcgatatcgtttgccatcatttcttgcataataccaaacatttcacactgtttttttcagtactggaaaacctcccgtgccggtgacaatgaggcggtcaacgaagtgcggacggcacttgatgcgggaatggaatgtcatgcagtggttgggcacccgtacctcaacgcggtgagaacagaggagacaatggcaaattggcagaaagcaaatgcgtcccgcttcaaattttttgtattttttaaaatgaaaat

SEQ ID NO: 11247 - DNA, 461 bp, Heterodera glycines
actccctctccccttttctcttctctccccctccccttatctcactccctctccccttttctcttctctccccctccccttatcactccctctccccttttctcttctctcccctccccttatctcactccctctccccttttctcttctctccccctccccttatctcactccctctccccttttctcttctctccccctccccttatctcactccctctccccttttctcttctctcccctccccttatctcactccctctccccttttctcttctctccccctccccttatctcactccctctccccttttctcttctctccccctccccttatctcactccctctccccttttctcttctctccccctccccttatctcactccctctccccttctctcttctctccccctccccctccccttatcgcactccctctcccgttttctcttctctccc

SEQ ID NO: 11248 - DNA, 393 bp, Heterodera glycines
tcccgtaatcactccctctccccttctctcttctctccccctccccctccccttatctcactccctctccccttttctcttctctccccctccccttatctcactccctctccccttttctcttctctccccctccccttatctcactccctctccccttttctcttctctccccctccccttatcactccctctccccttctctcttctctccccctccccctccccttatctcactccctctccccttttctcttctctccccctccccttatctcactccctctccccttttctcttctctccccctcctcttatcactccctctccccttttctcttctctccccctccccttatcactccctctccccttctctcttctctccccctc

SEQ ID NO: 11249 - DNA, 2747 bp, Heterodera glycines
atcgagaacacgataatcatgtgagcaaacaattcccttaccaacgtaaggtttataaattttttggaggggagcggaggtgacattgccttgaattacggtgggacggaggaaatttgggtacaacactttaattgggtctgtctttccggagcgggcaaattccaggacacgctgtttgaatgtgtcataacgaagtccttgattttctgtcacgtcataattgagcgtaatccctcggagtttgaggacgtactcaaagtcgtctgcggctcccttctttcgcagcttcagcccgtactgctttgcgccgccgcttacgaattccaaaatatcgtgctaaatttaaaaaaatgcagcgcgatttatattggtcttttacctttgggaactcgtcagtgagttgtcccaagtgcacccccgtctgaaggaggtttgagtcttccgggtgtacaagaaacaatgaatcggtgtctaaaatttagaataataaagaaaattattgtatgtttacccgtgtataaaagagtgcagccgggacttctgaccactttctgcattgatttcagtaaatgtagtcgggctgctgatgttgtgaacagtgaaatcacaacatttgaacaaggatgctctttgatccagtcttttttcaattgataactgatcagaattctttccggcgtcagcatgtcaaggctgctgatttcaatctttttgttgtccaggtaatttccaagctcagatgggtcatctgtgatgagcgtctgcgaaagaccataatttcgaagtgaaaatcggcccccctaaattttttgtttataatattttcataggacaacgaaaaaacatacataaattattcacagccaattttgccaatgatctctttcccttgttcgggaccatttttgttcgatcaatttttattccaaattggtcccagcattccgcaataaattgctcttcggcctcaaaattgcctttgatttgctcatcaaacccagaagcatggagttttttcaacaacgaactcgctcatgtatggcctgaagagtttgttgtcacttttgtggtattcgagaacgccaagcagctctgtcactcgatatccctcctctagtgccgcatttaactaaaaataatttgaataaaatattaaaaaataaaactttacttccaacgaggtgcatgtactaatccagcctcttcgtcggtcatcgtgagtacaactgtatgatgatttgacggcaccatttggaaattttttgcaacatttgatgcaaagtggaaaacaaagccgatcgtcaactttgaccggcaaaacggggatgtcgagagttggatgtccaattggataatcggtcacacaactatttttttttaaatattaaaaatgttacgacaaattttcacttgataaaaggatagaggctggtaaagtcatagtagctaattttctcgccccttgtcgctttgtgataaagcttcaaaggaccagttctcccgcccatgaagcaactgcgaatagcttttggttgagttctcgtatgcggcccgcagattttccacatggtaaaacttcattgtcatccgggtagcactttgcacatgcgtgccagggatgtgccgagccagacaaaatccgattccgattaaatcgccgattccgattatggccaaaaatccgatacggttttaaaaccgattacgattatggcccaaaatccgattaattgcgattccgattacgattccgatttttttaaaataattttttcccaaaaattttattcataatcaaaatcataaattttaagattgtgatgcaaaaataaaagtttgtccacattctgaggcaataaacgttttctcagatctgtcacaatcaacccagcggtggagaaaagccgttcgctttcagtcgatgtagctggggctgagaaatatttttttgatagcttagattcggaaacgaaatgtcttctgcatacagaagcccaacaactgttttgttttgcaaaaacgatcaagcatttggaaggtggatgaccaacgcacctgataggaaaattgcaacttagtaataattcattcatggttcttttctgctttaatgtcccaacaaattttttcttcaaaatttcgacttttggttcgaattcgggtccgggattcaaaaataggtgaattggctgccatgttcttaaactgacaccattaacaacccttcaaagactttgacatttttgctaaataacaaaaaacttgattatatcggggagaattaatccggcactgctttgtgagaaaaatttaatttcagtcattatcagggcggccaagtttttattttcaaaataaggacagatgaggctaaaactaagattcggaccccaaaaataagattttttctaaaactgatagtagcgcgaaggaaacgcaataaaaacatgaaaaaacgacttaaaacaacattttattagcataaaaacgaaggcctgtcaactgaaaattttgtaaatcagcattttgaaaaattttattcaaaatttaaaaattaattagtttttgcggcgtgctttttccaaaaaacttttgggaattggggggccggcagtgccgataggcgccgccgggaaaatttttgaaattttgtatgtgatttgttaacagattttgtataaaaaagaccaaatttagagattttaaactaattttttaagaaaaattgggatttggtgtccggt

SEQ ID NO: 11250 - DNA, 1315 bp, Heterodera glycines
  misc_feature (1310)..(1310): n is a, c, g, or t
gctgtaaaaaaaatttggggcgatttgaaagagaatagaaagaaccaggttcgatgaagttttggtaagccaaaaaaaatccaaacatttaaaaatctataaaaaatttaaaaatgagaattcatgcgagattttctggaaataagcttaattgggcctagttaagctgtaaaaaaaatttggggcgatttgaaagagaatagaaagaaccaggttcgatgaagttttgttaagccaaaaaaaatccaaacatttaaaaatctataaaaaatttaaaaatgagaattcatgcgagattttctggaaataagcttaattgggcctagttaagctgtaaaaaaaatttggggcgatttgaaagagaatagaaagaaccaggttcgatgaagttttgttaagccaaaaaaaaatccaaacatttaaaaatctataaaaaatttaaaaatgagaattcatgcgagattttctggaaataagcttaattgggcctagttaagctgtaaaaaaaatttggagcgatttgaatgagaatagaaagagccaggttcgatgaagttttggtaagccaaaaaaatatccaaatatttaaaaatctgtaaaaaatttaaaaatgagaattcatgcgagattttctggaaataatcttaattgggccttgttaagctgtaagacacccaccacttttgcacttaaaaaaatttcaaaaaatttgatcgtccataaataatttgtaattgatcagcggctcaccaaattttgcagagatacgtatcggaacactacaaaagcttactaattttcctagatttattaaacccggtgaaaattttttgcagacacccaccacttttgcacttaaaaaatttcaaaaaatttgatcgtccataaataatttgtaattgatcaggggctcaccaaattttgcagagatacgtatcggaacactacaaaagcttactaattttcctagatttattaaacccggtgaaaattttttgcagacacccaccacttttgcacttaaaaaatttcaaaaaatttgatcgtccataaataatttgtaattgatcaggggctcaccaaattttgcagagatacgtatcggaacactacaaaagcttactaattttcctagatttattaaacccggtgaaaattttttgcagacacccaccactttttcacttaaaaaaatttcaaaaaatttgatcgtccataaataatttgtaattgatcagcggctcaccaaattttgcagagatacgtatcggagcactacaaaagcttactaattttcctagatttattanacccg

SEQ ID NO: 11251 - DNA, 1702 bp, Heterodera glycines
agttaagcttgtaaaaaaaatttgggggcgatttgaaagagaatagaaagaaccaggttcgatgaagttttgttaagccaaaaaaaaatccaaacatttaaaaatctataaaaaatttaaaaatgagaattcatgcgagattttctggaaataagcttaattgggcctagttaagctgtaaaaaaaatttggagcgatttgaatgagaatagaaagagccaggttcgatgaagttttggtaagccaaaaaaatatccaaatatttaaaaatctataaaaaatttaaaaatgacaattcatgcgagattttctggaaataagcttaattgggcctagttaagctgtaagacacccaccacttttgcacttaaaaaaatttcaaaaaatttgatcgtccataaataatttgtaattgatcagcggctcaccaaattttgcagagatacgtatcggagcactacaaaagcttactaattttcctagatttattaaacccggtgaaaattttttgcagacacccaccacttttgcacttaaaaaaatttcaaaaaatttgatcgtccataaataatttgtaattgatcaggggctcaccaaattttgcagagatacgtatcggagcactacaaaagcttactaattttcctagatttattaaacccggtgaaaattttttgcagacacccaccacttttgcacttaaaaaaatttcaaaaaatttgatcgtccataaataatttgtaattgatcaggggctcaccaaattttgcagagatacgtatcggagcactacaaatgcttactaatttttctagattttttaaacccgctgaaaaagttaagcctaaactttttcggcctgtttaaaaaggaattagaaatttttaaaatatttattcatctccctttttgataatataagagtcagagtgccttattcaacttgtaaataaattttggtgcgtttcagagcagtttctgaaaaaaatttatgaattaattttgcaaaaataaataaataatgaaccctcctccttaataattttcctgcgcccaaggtactcactcggccgcttcgcggcctcgtggctgtaaaaaaaatttggggcgatttgaaagagaatagaaagaaccaggttcgatgaagttttggtaagccaaaaaaaatgcaaacatttaaaaatctataaaaaatttaaaaatgagaattcatgcgagattttctggaaataagcttaatagggcctagttaagctgtaaaaaaaatttggggcgatttgaaagagaatagaaagaaccaggttcgatgaagttttggtaagccaaaaaaaatccaaatatttaaaaatctataaaaaatttaaaaatgagaattcatgcgagattttctggaaataagcttaatagggcctagttaagctgtaaaaaaaatttggggcgatttgaaagagaatagaaagaaccaggttcgatgaagttttgttaagccaaaaaaaaatccaaacatttaaaaatctataaaaaatttaaaaatgagaattcatgagagattttctggaaataagcttaattgggcctagttaagctgtaaaaaaaatttggggcgatttgaaagagaaaaggaagaaccaggttcgatgaagttttggtaagcccccttaaaaggcaaacatttaaaaatctataaaaaatttaaaaatga

SEQ ID NO: 11252 - DNA, 1070 bp, Heterodera glycines
  misc_feature (27)..(27): n is a, c, g, or t
tatcaaaacgaatgattaagaaaatantttgtgatttctctttcgtcagatagcaaagcaaattgctacttgggcctttgctacagcgaacagaggcgggaattggcgaagaaaggcgcagaggagcagcaacagccgaacgcggcgaatgggcagcagcagccgcgatacaacgccgtaagggggcggggcaggggaagcggaggacggcatcatttggtgatttatatttgacaggaccaagcggcacaaaacgccttcgtctcttatcgaacggcgatagacagcgacgagtcggacgcgaacatttggcgcagcatcggcgttctctaccagcagcagaaccaaccaatcgacgcgttgcaggtggtgaagagacgagcaatgaataaataaaacaggggccaaattcacggaggaggtcaaaaaatttctagaatttttgcattgtttaaaactatagaaatttagattttaattatcattatttttttattaaaatttttgatggttttttttattcataaaatttgtttttctttaaattgcctttttggtttcttaatacaaaaatagtttttatttaaatttattttttattatatcgcagaacctgaaaaaatacatatttaaggggaaaagagggggaccctttgattaaataatagtgcgattaatttgtcttaatgttgattagatgagaggacataattactcgccccataaaaaacataaatcgctgttataattaggcgttttctttaacataaaaacgtctgtccgccaatgaccaatcaccactgattaattaattacctaatttgttgtctcccatttgtgcgtttgtttcatttccgcttttccccgttaggcatttgcttgcgccgttcagctgaacgaccgtcacttcggcgcttggcttgaccttggccacctctacgaaagccaccgacagtacgcggaggctctcgccgcttacacaaaggcgctaaaggcgacatccggtaaatgtttactatgcaaaatggctttatgttttttgttgttgctttctttggtggggggggggg

SEQ ID NO: 11253 - DNA, 3671 bp, Heterodera glycines
  misc_feature (3638)..(3638): n is a, c, g, or t
acccccccccccccttccccaccgccctcttttgctgctgacgttggcgcttggtttcccgacgattgagtgtgtgttgtttcatcgacggatgcgtcagacactcgcttaatgaatggttctgtttctttctgtcttttgttcgtcgtcgtcgttttcctcctcctctcccttccgacccgttcgtctcgttcatttgttggcatttctcttctgaaccatttgtttggtcttcggtgttttcacacctttccctccctcccccctttctctctctctccctcctttttttttgcttctttccctcatcatccatcgttcaaattccttctgctgttgctggtctctccagtcggagttattaatccctcctccctctttcacctgtcacttattcactctctttcagattgccttccatcgaaaacgcgtggcaattgggcatcccggcgcaggtgtaagtgaagaagttaaagactgaaaatgtttcacaatttaactcaatgattattcgttcaaagaacgtgccttccttcccccattattaaattgtttcgcacttttcagacgtcagcgactggccgatctgaagaacgtaggtgaatttataaatactttgggcttgtatttatagaaagtttctcccattggctaattcgcttccgttttatcaataagagtggacccgttttattgaagcattttcttttatggccagaaaaattttaaatggtcaaatttccatctccaatttatttttcattcattatcaactgttttattcgcttttgcctcttttttcactttcccatatctgaaaatgctttttctaatcaccgccgaccttttctcaattatttcttattttttttgcaattaaaaatgaatttttggattgtggaagtcaaacgctttctttctaaatctaattaattatctcttgcccattcacccccatgtaattgtgcaaatccgctcggcttatttcgttgggtgttggattgcccaggggcgggggtgtgagagaatgaatggttgtttggtgcgcgtgtgaacaaaaagcattcgcacctgggcaattagttagtgttcttttttaaagatttttgtcgaggagggtggcacactttgcctcattggcttttgaccccccataacctggcgatggcattcgttcatctttggcactttgttgcatgcttaaacatttgccatattttagcacaccattctcaactaccgtgaaggctcttctctgtggagctcgcaagaattggtcgcggattccatgcaaatggacagtccgacaaccctcaacagattaacgcccacccaaagacaaattctgcagattttgaaggtcaacaaagaccaacttgagggcggcagtttggaggtgagggaaaacgcatggccgaacacccccaattcctttctatctgttcagacgacacttttgtatgagttggagcaaagggtgcctacgaccgctgatgctcgggagggggcgaagaacgacgcgagaaatgggacgaccacgtcaccagggcacagaacgaccgctgaccagacggatgtcccgcggccgctgaatgtgaggaaaggggcggcttaatcttcttacaattagtgagagtaggggagggggtaagtacacagtttaatggttgacgatgaatcatcttcgaatgatattacagtggattaaataattcggaatggtcatgttgatcaccaacaattaccttccctaaatgtattgattgatcattgcttcgcctttttcagcaaattgagtgccgtccttcgtcggcatttccctccgagcggccccattcgccgtccactttcgcctccccccctctccagcagccgcatgaactgacgctgccctcctcgatgatgtctccgaaggaagagacgccgatggacggggaggaggacgaagaaagcccctcgtcctcccacaaattccaccggcaccacaaacaacatatccaagaagagaagatctcctcctccacctcgtcctcctccgatttgccgccgaacttctcactgcttgcccctgtcaatgtccctgtcaccgtttcttcggaggaaattttcgatttgtgtatgctttttatcatcggtttaaattaataattttttggtttcctcattttctgaacatttaggcaagaagcgtgcttccaaacccgacgaatactttttggcacccatttttgacgaggacgtgcccccgccaaggcgacccgtgccgtcccaagcacccgtctccaaagacaaactcttactgaaaacaccgcttctgctggtcgagaatcagaaggacgcgagcgcaattgagctgcagcagtactgctacgcgcagcccattgtgctcatccacgggctgacaatggcactgaaaatcgacctcagccaattctccaccaaaacactcattcagacggcacctgagcacgaggtgaaattgcacacaacgacaaagttcatgtcgtaacactgtgccattgccatgttcaggttgaagtgcggactcagttcaaaatgccctcttacgatgtcaatttggaccaaatgggcgagtcgacctgggccatcgtaatattttttcgcaaaattggaaaactttataccatctttttgtcatttatagaggagttccaagtcgtggtcgaccatttcgcggtacggccaataccaagcggagtcctttcggtgtgtttggttggatttgttaccgaacagcttttgtaatgcctttttcagccattctctgaaagaggaaacggaaaaactgcgccaggccaaccccaaattgttccaacagcaaacgcccagcacttctgacacgccacccgtcgactgtgcttcgccagcaccgtcgaagaagcgcaaaacggccgcttcaatggccgcggggagcggaacgccgacgagcagaggccgcgtggaggagagcagcccgtacaaaatcatcaaattcggcaccaacattgacctgagtgacgagcgaaaatgtaatttaaaggggggggggggaattaaaaatatatatgtgaaattttcaatttttcttcgaggggagaggaaaaagtgatacgaatgagtcaatacattaaaaactaattggaatatccaagttccacaaccctaaaatttcagtctatgtccaactgaaggaattgaacaaattgcccgccttttgtcgcctccattccaccagtaatatgctcagttatctcggccacaccgtttttgggatgaacactgtccaattgtatttgaaagtgcccggctgcagaacgccaggtccatcccaaccaaaagcgaattttattaaaccattaattatgttaattaggccacctcgaaaacaacagttttgccagtgtcaatgtgaacattgggcccggcgaatgcgaatggttcggcgttccttacgaatattggccgggtactttactttcccatttccttttttcattgtcaaactaattttccccactttttagtgttggaaaatctgtgcaaagagtgagtgtccctcttccatttccccaatgtttccctttttaattttttccattttaggcggaatatcgattttcttcgtggcgcgtggtggncgagtgtttcggacttggtaaagtctgacgtgc

SEQ ID NO: 11254 - DNA, 575 bp, Heterodera glycines
ccccccccccaccctcttacgatcgactaagagaccccccccctgacccccctgtgaaagtattataaaaagggccccattttttcctaactgaaaaaactaggtaaataattaaaattatgctaagaaccaatcttccatccttttacttcccccataccgtatcccttccctccccccgtttagtcctaccagtcgttggtgcccatgcaacatttgtgctgggccttggcccgcgatgtccgtttcaccaaccaagtcagtgtagtctctccgtcggcttgcacttcgttatttcatttcagaagctgttcaaccaggtcaagcacatgctcatccgctcgttggcctattgccaaatgctcgtcgattatgtggcggtagcgctcaaaagtcccatcaaaaagcagcagcgacagaagggcgagtgcgcccactattgccacctgtgcgaggtcgaagtgttcaacattctttttgtcaaggaaattggcggcaaatggaaagtgagaagagcacttaatctgacgaatggtcggaagaaacgcctttatttttttatcattttttagatt

SEQ ID NO: 11255 - DNA, 4769 bp, Heterodera glycines
cttccgaaaaatgatctcttccaactgttattttattctttttttttgcattaatcatttttaaatgtgttgcgtaaaatttacaatgtgtgaccaaaattcatcaattgaaaaccctgaccaacaattcccttaccaacaaagggacggtagcatttctgcattggcattgaagtcagacgtcccccctccctaatgttttgccttagaaaattgggataaatgacatttatcggctcatagtccccggtcgttgcgtaattgatcacttcgttcttgaacgtctcgtatcggagaccctgattgtttaacacatcgtggttcagcgtcattcccctcactttgagcacatgctccatttgggcaccgggctcagcccctttgcgttgcagacacaaaccatactttaaatgcaacattgaaaaaaaacaaaacaaatgatttttacttgttttgctcctccactgcaaaattcgatgattttgtggtccgggtactcgtccgtaaactgtcccaggtgcgggccagttttaagatgacaccgaccatcgggatggacaaggatcaggctatcggtgtctaaaaattgaaattttatacacatctcatggtttcgattgatctcttgccgatgtttgagcacgcgtgctcgtccacccaaatataattaagccaacattagccctttagatgtggaaaataaattttgtattgatttgtttaattttgttttatgttatcggtaatagttttgggacttgtttattcaaatttattcgctacaatatatttataacttttctctattttttattttaattattactatatttaacatcaattacgaacaatttattaatttttttctttaatttttaatcatatataaagacataatatgacaataaaattttttgattgttaattcaaacttttttctttggtagtttctttcgaattaatagatttatttactaaatttttgaatgtccataattcagtaatttcgaaattttaattttattatttctttcatatcagctattctgatttgttatgaaattttatattatattttcataatttatataaagataatgattatatccattaattattatattaaacatagaagatttgtcctgatatggagggaacgatcaaaatttgtcctgatttcttaaaattcttcagaaaatttgtaattttatggcgtaagtcactcagagttcaaaatttttcaacggcggtgcttaacggcaacgcctgaccctaagaatcctttgttttattaaaaattggctcaaaatcacaaaatttggacaatttttggacaaaatctgttaacaattatacccaaattttcaaaaattttcccggcggttccgccccgcttgttcctcaaaagtcattgaaaaatgcgccgcaaaaatattcttaaaaatctgtttttttgagaacgataacaatttaatgtaatatttgcttatttcctccctaaaaaagttaaaaatagtcattggagggaatacgaaatatgattctatatttaatctattaaattgataaacaaacaatttttagctattttccaaaatgtcctgattttcgaccccaaaatctgaatttttgggcccgatgtcctgaatttgaataatttttgatacgcaccttgggtaaaacacattattaattgctttaaattaaatacaatattttttatttgctctgattttttttcttttaaattttatattgcatatacctgcatctatttgcattgcatttaatgaacttattggaatttttttttatttttgctatgggtttatatatagttaaacagcattaataaattttttattccttgttatttttatcgggttttaatataaacaagttgtttaaaaaagaagtgcagcagcaagaagttgagtgcagaacgttgaccaactgctttgcttttcttaaatatttattaaaatttactccattttgaaatgtattattttttttaattatagccttcataataattttcaagcgaagtctacatcggtttgctcttcgtgtaaatggcaacatttaaacactataattttggattataattttaaattttgttttcactttgtaagaaataattattatttttgaatttgagataataaatgcatcaaatttaattttagaatgaaaagaaataaaaattgatttattttgggttaataagtgttcttttaaatttcatatatttgattgtttaaataacaatttttaaatgcgcctacaacaaaaaatcaaattatcaattttcataattggatgatgtgtagtttttgctcgctattaacggggtttttacttattttttctgcggctttaactcgacgagaaatgcacaaaaaagatatttttgttcgaaattttgcgttttatcgcccttatagaattcaatcggaaaatttaaaataagttttgaaagtatttataataattaaattgcatgaaaaaaattgaaaaaatttttcaaaaactgccactttttcacaagcgccaaaaatattatgtcctattttttgctaacaactgaaaaactttttgaaatttacaggcgattggagaaattttgagtcatagaatttaatcaaaaagtgaagcgttgaattttgtcgtgtcattttattgtcgtataaaattaacaaaaatatcaaatggagaaaaaaataatagtagaaaattaagtggaatgagggaagggaggaggaacgatcaattggattgggggcaatgccaagccaaatgatgtgctgagagcagtgccaaaggtgtgacggaacagcgtcaatttgtattggttttataacaaggcatacagagaaaaaaaagatgaatgagagagacagagagataacaaaggttatgactttttatttaaataattttctttgtattttacatagaatgtgcttttaagaatttatcgaaatttagtatattttaaatgaaatttatttgaaaaatgaactctaaaagacgattccttcggaaaagggaaacaaagaattaatttttaaaatttataaattatattctaagcctaatgaagtaactttgtggtagttttgtttttcaaccccggcctgaaaagccgagtctacactttctaatttgttgtttctttctttaaattactaaaccatttattcgtaaacttaaaaatattttttagttaatttttaaaagtaaaatttttatctttattttacttgtgatatgactttatgtgaagtgtttgttgagtgagttacaaagtgacaaaacattagtattcttaattctttctcattaaaacattgctttgaggagtttttcggttttgaggcagaaattcctcatgaaatattgcatgattgtctttaatattaagatgttagttttttttttatagcattaagcgaaacattaattttttgtttaatttgcttatcatgaagaaattcggtaaaaaaactatttcgttttgtgttttctgtacatgatatttataccttttcataaacaagaccgagtattaaaatacttaatgaataattatcatttgaaaatattttaattcattatcaggtttgattggtttataacttttttaaattaattttatttattttttattttcaagagatattaggttttctttttcttttaaattttgatttttattttacttgaaaattttttattttttatttatctcattaaaaaattctattatgaagtttcattattgcatgcattatttttggtagaaccatataaatgacagaatagtaataattatttttgattcattaattgaccaagtcaatggtggttatataccttcaaagcaaaaaattatttatgcaatttaaattttttaaatttgatttgctataattttgagaaagaattaagaatactaatgttttgtcactttgtaactcactcaacaaacacttcacataaagtcatatcacaagtaaaataaagataaaaattttactaaaaaaaattaactaaaaaattcaaacaaacatctaaaatattttcagagatttctcttacgaaatttatttaattaaagtaaaaaaagtgttaaaaaggtgcagatggtaaatacaaactataatataaaaaacataaaaaccaaaatatacaaaattttaattatatgcagaaaaagcattattaataaatacattgaattacaatagttcttcatcgactctttctttaataacaaaagcaacttttacaaagcagattaaatttttaaatttaaatattgcttaaataatcataaatattaattttaccttttaatgctatttttcgccattgtaatttttttcatattttaatagaattataattaaataagggttttaaatatctaaaacgaaatgaaagctttgtacaaaataaaaattctaattttaaatgaatgatttttttgttaacttaatttcaattaattaaaaatttgtcaaagaattccttcaacaagtgaatgagtgcctgttaacaaaagaataaaaattaattctataattataataaaaatatttaatttttttttcaaattaattcgaaaaaatagtgcataattgttgctgctttgatgagtacggaagatcagttgaacaatgcaagttctgcaaattcaagcagcttctgctcttaaaaacataattgagaagtggttacaaaaaataaatttaaaccaa

SEQ ID NO: 11256 - DNA, 1114 bp, Heterodera glycines
  misc_feature (28)..(28): n is a, c, g, or t
cattactatgtgcggttgagccctacanatggtcggttggaaaatggctccattactaagaatagatagtctcagaaaaatggctaactcttttttctacagcctccaacgagagggttttccccgaaaacgcattactatatgcggttgagcaatacaaatggtcggttggaaaatggctccattactaagaatagatagtctcagaaaaatggctaactcttttttctacagcctccaacgagagggttttccccgaaaacgcattactatatgcggttgagccctacaaatggtcggttggaaaatggctccattactaagaatagatagtctcagaaaaatggctaactcttttttctacagcctccaacgagagggttttccccgaaaacgcattactatatgcggttgagccctacaaatggtcggttggaaaatggctccattactaagaatagatagtctcagaaaaatggctaactcttttttctacagcctccaacgagagggttttccccgaaaacgcattactatgtgcggttgagccctacaaatggtcggttggaaaatggctccattactaagaatagatagtctcagaaaaatggctaactcttttttctacagcctccaacgagagggttttccccgaaaacgcattactatgtgcggttgagccctacaaatggtcggttggaaaatggctccattactaagaatagatattctcagaaaaatggctaactcttttttctacagcctccaacgagagggttttccccgaaaacgcattactatgtgcggttgagccctacaaatggtcggttggaaaatggctccattactaagaatagatagtctcagaaaaatggctaactcttttttctacagcctccaacgagagggttttccccgaaaacgcattactatgtgcggttgagccctacaaatggtcggttggaaaatggctccattactaagaatagatagtctcagaaaaatggctaactcttttttctacagcctccaacgagagggttttccccgaaaacgcattactatatgcggttgagcactacaaatggtcggtggaaaatggctcccttactaa

SEQ ID NO: 11257 - DNA, 997 bp, Heterodera glycines
agaaaaatggctaactcttttttctacagcctcaaacgagagggttttccccgaaaacgcattactatatgcggttgagcactacaaatggtcggttggaaaatggctccattactaagaatagatattctcagaaaaatggctaactcttttttctacagcctccaacgagagggttttccccgaaaacgcattactatatgcggttgagccctacaaatggtcggttgaaaaacggctccattactaagaatagatattctcagcaaaaatggctaactcttttttctacagcctccaacgagagggttttccccgaaaacgcattactatatgcggttgagccctacaaatggtcggttggaaaatggctccattactaagaatagatattctcagaaaaatggctaactcttttttctacaacctccaacgagagggttttccccgaaaacgcattactatatgcggttgagccctacaaatggtcggttggaaaatggctccattactaagaatagatattctcagaaaaatggctaactcttttttctacagcctccaacgagagggttttccccgaaaacgcattactatatgcggttgagccctacaaatggtcggttggaaaatggctccattactaagaatagatattctcagaaaaatggctaactcttttttctacagcctccaacgagagggttttccccgaaaacgcattactatatgcggttgagccctacaaatggtcggttggaaaatggctccattactaagaatagatagtctcagaaaaatggctaactcttttttctacagcctccaacgagagggttttccccgaaaacgcattactatatgcggttgagccctacaaatggtcggttggaaaatggctccattactaagaatagatattctcagaaaaatggctaactcttttttctacagcctccaacgagagggttttccccgaaaacgcattactatatgc

SEQ ID NO: 11258 - DNA, 5819 bp, Heterodera glycines
  misc_feature (4270)..(4270): n is a, c, g, or t
ataaaattttccagtggtttttttcatgtcttacacggtaacattcgaactgacaatggtactgaccaaatcactttaaatccacttttatcgtatagaacatagtcgatttgcaattaaattttaggcttttggcaccgggccaaaagtgattagaaaagatcgataaaatgaaaatattagcaaaaatattttaaatttaatgcgattttcccatgggttcggatccgctcgactattgatgaattattttgttttttctttgggggttcgattccctttcacgccgtaaatattttttgtaatttttttatcaattaaacaaaaaaaaaaatctaatttattataagcaagaccgacataccaaatttccataattagatgccaacactgaatttatcccggtaaaaataaatttgatcaatgtctcttaaatttggccctgaggcgccattttaacaaaaaaaatttcgagaaaatggcccttccaaatgccgctccttttttaccttaatgacatgttgcacatgtaacaaataggacggtgggccaagcgccgcgtcacgaaacccaacaaattggggcggctcagcacattggaggcgaagataggcctgttcagcgggcaaatggtgataaattatctggaaaatggacaaacggtttggtcttagattttttgaaatttttttttattggttttcctccattttatgtatctcttaatgagattaactatttgtttttcaaatcaaattcttcccatgtgtgtttaaaaagagattttccggtttttgctgaccgttttcttaattttttttttttaaattattatattttttaaatataatttagatttaaaatttaccaaaattttatataaaaaatagagtagagcgggaccgggaccaaaacacggacaactgagtacaactgagtaccgaggtcccggttttgaccgggaccgggaccagtcccgggttttttcccggttttcccagccaaaaattcccggtttttcaacccgaaaaggtcccggtcccggttaagcccaaaattcccggtcccgctcaactctattaaaaaataaaaatattttgctaggcaacaccaaatttattggctttttaacttattttcactcaaaaaatgtaagtaacaccacattttatatcaaaattggagaataaccatataagaagcaatcaggaaaacggcgttcacacgacattgtgggctaaaatggcgagaaattattgcgggaaaaattagaattttttgtttcagggggacccctcaaatgtttttaagaaattttgggcatttgatctggttgaaagattgaacatcatattcatgatcaacattcttggaaaatgccccacaagataagccaaaaagctaataatgggcttatatacatatttgagctcgacattttgaaaaaattctggatcctggattcctatttgacctggccctggattttcggtacaaaaactcagaaaaatccaggtccaagaaaaacccatgcttgtcatggcctggcctggattgctttgtttttaaaaaacaaacaaatgtttgagaaaaaaaacaattaattgtttaggaaaaacttaaattatctaattgacaataataaaatatttaatcattttttgacaagtatcttgaaataaaaaatggtcacttgagaaataacaagtcaagttctaaaatattatcctgaaatccatattttgactggaactggatttaggaaaatccaggcccttagtattatccaggacatccatgagtttggcctgggcctggacccaggaaggatccaggcctttacccaggttcggatcaagctctaaggcacatgcctttaacagatactttaatgccgaattaaaaatattatgttaatgacgagaatttttaaatttgaaaaaccaatttttggggtgccatttttactcggcacttgtgtagagaaaaatccgcttcttctgctgctgttgctgagcattgttctgttgcagcaccaatgtgtgaaggaactgacagaaccggtaaagcacagccaaattcaatgggccaaaatcatcatagaaggcatctatggatttgtttaaaaatggattttgaaatttaacttcggatcattaatttgtaaagtttaattttctgaatttttttttcttgtaaatcctttaattagccaaatttcacctaatttttaaaaatattcggccgaaactcagcatgatgcaatattcccgagcaaatcacccttttttatgttttctaatttgtaaaaagcgtaattttctggatttttttttgtaagtccattaattagcttaattttgcctaattagttcgtccatccgctggaatttttttgtaagtccattaattagcctaatttcgtctaattagtccgtccatcccctgtttttcccgagaccatagtgcacgtggctgtcaatgtcaatgtaaatggtttttgcgtcgtttttcggaggcacaacaaaatttttatcgctgctgtaggtggtggtggaggcctcattagttcgaatgttgtaagaagtgaaataaaggcatcccgggattatttgcgcgattggaaatgccgccgccggcgccgctgtggtggcggtgccaacaacagcggaagacgaggacggatttttggtggcatttttgttggacgacggcggatgactgagcaaagtcattattctccggcacggctcctgctgctgctggtggccaacacaacgcgtatccgacgggggacggacggcgttgggacccgaaaatttttaaaatattacaaacaatttaaaatgcacaattttcttagagtttttgcattggtatggcatcgcaaaaaaataaaaataaaaaaatatgtggatggatgtggaggtaaagcgttggcatagtgttggtgtgttgggtgagtgagtggtgggatgatgatgatgggggattgccatcaaaaatgcgcctttttggcaaattttgtaaaacaaaataaatgaaatttgaaatatgtaaaatcatttttgggattttaaattaaaataaaatcattctagcgctatttttccattttttgaaaaaaattattattaaaaatgcaaaaagtaaataaataaaataaaatgcagcaatgagggatcatcagagagctctcctctctctatccaccgatataaaaatgctcatttattaatctagttttcttttttgggttctattgcactttacgagtttatgagtccaatcggaatttatgagtccgatcaaatattataattgcattttttgaatccaatcaggtttatgagttatttaattaattaaatcaaattttgagtccaattattttttattgtcgtaaaccatttttaagcgtaaaaatgaaaatgaaaaattcttcaaaaagtgtcagttaatcgtaaaaatttattgactcataaatatttgatcggtggattcaaaatatttgattggactcataaaattaataggactcgtaaagtgcaataaaattttttttaccactaaatttacacccccaatagaatttataatgaaaaaatagcctaattttaaatttttgtggtcatagtctacatattgatcggaatgaacgcgcgcacatttaagctcatttgttttaatgagatctgctgatgatgatgaactcgctgctatgaaatgaatagagtcagtcagtgggctgctgtggcgtcaatccgtgccgtcagaaaaaaaaagattgatcgatcggggggggggggttagtgcaaggtgtttaggccaattatcatagcaaagaaattcatatttgttattagttttttgacaattatgtaattctttatatgcattttttcttgttttaattatgtctgctttttggtattctttcttaaattcctttttaatcgagtatccctgaagataataaccaacatagtcgcttgatagctttaaaaagatgcaattaactgagtagtgtgaagttccttatttttaatatataattggtagaatctttatgtaatatactggattaaaaaaataagtcttaatatgtattttctgcttatagttgggatttttgtttagaattttattttcccactttagtctttaaaataatctgactaatagttttataaactcataatataattttattgccccttattatattgctaattttatttaaataactccattaaataattctttttanaaattcttccctttttgccccgtgtcgagacacctatgattttaccggatggcatttggcattcgtagctcagtccatcccaagtaattacataaattgaatgagattatagccattactccgaaggtggaccgcaccaaaataatagtaattgtgaaaggggaaccgaatttccaactcataataaataatatttaatatttcttcaagtattcaatgaaattggtattaagctgataatttttttttttcaaaaattattaaaagaatatttaacctttaaaattgaatatcctatttttttaatgttatttcctacaatttatgcatttatgcttaagatggaaagcccggttgctgattaggtattatttttttattcataagttgcttaattcctcaaccatttttctttgtttacataagaatcatagtaaagaaaatttcgatacataaatttgtattttattttttttaattcaaaaactttattttatttccatataatagagcagcctttcatttgctttaagaaaccagtagagtaatgcaggtcatttcttgtttatgtgattttcatctcaataatgtcatcatatgagattttttcaacttcccatccataatcagttttttaatttgttttttttgttaaatattttattatttttaaaaattttatttgttgttttcttctgtatttttgcatacgaatcgagttacatattctttaataccaaatttcgtttttttaatgtacttgaaatttcgctatcgttactcccgtcatgaattttttttattatgggaagaataattttttatgcgtccttgttttccaaattgaattatgccccaactcatggcggcgtcgcggttgtgggggctctcggtcccaattttgatgccgcattggcggctcattttcttcggagatgatctcaaataattcgacgattgcgagttctccggcgtgtttccttagtgccacggtttatttttatttctctcttgatatttttcagcggtatttatacaattgaaattatttaatgtaaatattttatgctttgcgcgattggattaaattattttaaattatcttgtacttttttctaatcctccaaatcttgttgactcgcggatttattccgtaaattataatatttcattaattaaagggttttatgtgttaattttattacataataaccacttaccttcacataatccagatgtttagaattttcgttatttattaaaagattaaaaaggtaataaataaacaattatagtcaccaacattttataatttaattttcatgagatgagaaagcgcccaatggcaatcttttcttttgccatgagggcgtttgttcttttcaggcattttaatattttgctagtgcatcattatttatttttgtttgataataaatgttttattataaaagtttcatttttttataagtctaaaaattaattaatcgtataatagtttgtaattaaaggttttaaaataaattttattagagtttttgatttactg

SEQ ID NO: 11259 - DNA, 1274 bp, Heterodera glycines
aattatatatcagggaacccaatactttcttgggattttccagtacgggtttgtccgtgaaatttgaaaaatatttccaaaattcctatttctttttctatccttgtggactgagtcggcccttgaaattatatatcagggaacccaatacttccttggaattttccagtacgggtttgtccgtgaaaatttgaaaaataatagtattatatgcagtgaacccaatacttcttggaattttccagtacgggtttgtccgtgaaaatttgaaaaatattccaaaaatccctatttcttttttctatccttgtggactgagtcggcccttgaaattatatatcagggaacccaatacttccttggaattttccagtacgggtttgtccgtgaaaatttgaaaaatatttccaaaatccctatttcttttttctatccttgtggactgagtcggcccttgaaattatatatcagggaacccaatacttccttggaattttccagtacgggtttgtccgtgaaaatttgaaaaatatttccaaaatccctatttcttttttctatccttgtggactgagtcggcccttgaaattatatatcagggaacccaatacttccttggaattttccagtacgggtttgtccgtgaaaatttgaaaaatatttccaaaaatccctatttcttttttctatccttgtggactgagtcggcccttgaaattatatatcagggaacccaatacttccttggaattttccagtacgggtttgtccgtgaaaatttgaaaaatatttccaaaatccctatttcttttttctatccttgtggactgagtcggcccttgaaattatatatcagggaacccaatacttccttggaattttccagtacgggtttgtccgtgaaaatttgaaaaatatttccaaaaatccctatttcttttttctatccttgtggactgagtcggcccttgaaattatatagcagtgaacccaatactttcttggaattttccagtacgggtttgtccgtgaaaatttgaaaaatatttccaaaaatccctatttcttttttctatccttgtggactgagtcggcccttgaaattatatatcagggaacccaatactttcttggaattttccagtacggtttgtccgtgaaaatttgaaaaatatttccaaaatccctatttcttttttctatccttgtggactgagtcggcccttggaattatatagcaaggaacccaatacttccttggaattttccagtac

SEQ ID NO: 11260 - DNA, 5350 bp, Heterodera glycines
  misc_feature (5339)..(5339): n is a, c, g, or t
ccccccttaggtagtacgattgtattataggattatgaatgataaaatcgactggctcgtccgcttcgcggcctcgcatccttttcttggctttttctccaatcaccagaactcagtccaccagcatttcaatcactggtactcaaccctccagcatttcaatcactggtactcaaccctccagcatttcaatcactgggactcaaccctccagcatttcaatcactgggactcaaccctccagcatttcaatcactggtactcaaccctccagcacgtctgttctctgcgttgtatctgtggcacgggcgaaatgtgaagccggaagagacgtcgtacatcatcagaaagcggaggagctaaacaaagcgaaattgggagaggaatggacacggaaaaacagcggacgaagcggaagagtgcacaaatcccaaccacctcccgccgccgaaaaaaactttttaaaacttaaaatttaattcgccgaaattaagtgccgcgggagaagaacagccagccaaaaaacgagttttgagtatttttgtgtgaaattctccaaaaaaaattgcgaatttggtcgaccgatagctcaggatttctccttgctaattataatcaaacaaaatttataaaatgacatttaattttcattaaaaagtcccgttctcacgtggtctttgaagttttgcacttcttgttcggatttgcttgccaaaaaatctgtgaccgttctcaacgacaaaagtgattgggtcagtacaattgcgttgccattgtccacaaaattggagagtatttcaatgatttgcctccgttcttcttctgccaatggcttatgactaaacaatcggaacaatcaatgaaaacaaacggaaacgaaaacgaactcaaagctcattttatgcgtctgaaagcccaaaattgtatccacgagaatagctgtacagagatctaaaaacggtccaagtggagtttcaaaattcaaaaaacaaattcatccgaaccatcattttcacataattccttgggagtcatttggtggctgcgacttggacgcaatttcagtaaggaagaggcagcagcacaatgggtacgccccactgtgcagagaaaagcctagtactatctcgtcgtttctctttttctttgtaatttctctcactttggcgtactatctctttatttatttatgtaaaaaacaacttttacttttctatgtgtacctttttttccttatgttaaatctgaactaaattttgcatatcgatagagaaaaaaaatctgcatccaaatggacatatactaaaattggaacaatacagagaagattagcatggcccctgcgcaaggatgacatgcaaattcgtgaagcgttccaaatttttttgttcattccaaatggacatatactaaaattggaacaatacagagaagattagcatggccattgcgcaaggatgacacgcaaattcgtgaagcgttccaaattttttttgttcattccaaatggacatatactaaaattggaacaatacagagaagattagcatggcccctgcgcaaggatgacacgcaaattcgtgaagcgttccaaatttttggtttaattacccaagtttgagctcaatatcgcagtcctttctgaaacgccccttaatttctaattccccgaatcaaattccgcaaaaacgtcatttcctcaacgaagtgacttcaacaaatttggccattgacacacttaacgacgacccgtccatttctcaagctgcccgtgtcatcatttcacaactaagcaatctcctcaaaatcgccgtctccctcgtcgacaattctgtctcagacattgactatgctgcggagatggaaagacgccgctctgtggtcatcaccggacttccagaaaaccaatcggagaccccatcagttcgtgccatttctgacaacaatgccgtcacaggttttcttgaccagctcggggttgagactcattctatagtcagctacagaatgggatggtacaacaaagaccgagcaagaaatggtgcctgccgtcccataaaagtcgtgctccccgcctcttcttttcagcgcacatgccttcaccaatggaacaaaaaatcattggaaattcgccgacagttggacaacaaaaggctgaacatcagggaatctctcactcaagaacaactgaaagcgagacgtgaacttcaagcgcagtgtgccgaaaagcgaaaagaaacatccgctgactggatcatctataacggcatgcttgtgctccgaagtgaaatcaaaggaaggaggatgaacggagagaacttgaacgggccttttcctcacattgactctctgctgacacgcaatcaaaaaaactaattcatgccagcaatgttctgaggtttgggggtagacaaaatttccaaaaaatatattctcaaaacagaaaatcccctaaacctcatcctaaattttctcatgctaatgtaaatacaaatatgaatttgtccatctctggttgtttagttaatgcacgttccataaaaaataaactaaatgaattaagtgcattactgacagtaaataaaattgacataatggggattacggaaacttggctttctgaatctgatgaaataacttttcttgaacaatcactcaatgacaaatatgttgtttttaatgcgaaaagattaaaaggcaaagggggcggaacctctcttattataaataaaactattcagccttattttagtaacacggttacaaaatttggttgtgaaatctgtttttgtaaattaaaaaatgctaaaaatttatctattttatctttatatcgcccccctaataccaaacttaaagcaacaaaatcactttttaattaccttgaaaaatttattacagcttccaccttaattataggagaccttaacataggcaacagagacataacttggtctaataattgtcccatacctcatacctgtcttggcataacttttgttgattttttcaataaattttctttaaatacaaaaattataggtcctacaagaggaaattctgttctagacctttgcttatgtacaaacccgaacctaattcattttgttgaaattaaggacagccttatacattctgatcattcagccttattttttcaaattaatttgtcattacagaaatctcctccaccaagaataactattagaaactttaaccctaacaatattaaaaccttaaattcgtatttactttctaatgttacatcaaatttaaccaatgtttttacattagaaaataaatacaaagttttttctgaaacaatttcgagtgctttagagcattttgttcctcaaacttcctttcttaaaaaaccaccaccaaaataccctcttcatataagagaatcgatcagacataaggctctcctttggcagaaaatgaaaatagacccaataaaatataagaaattctatgattctataacattacatatcagaatacaaacaaaaaaattctatgaaaacagacagaaaaaatttctctctgttaatccaatgaatctttataaacttatcagaaaaagttttgtaacaaacaatagtattccacctttagaaactgaaaatgggtttatttttgatgacaaggataaggcacaatattttgccaagtatttctcagaaaccttttcaaataatttggattcaacaccttgtttgtctcagacagacagcctcggctattctatctcggatttaaattttgatgtctctgatgtttttgataaacttaatcgtttaacaaatagaaataatacttctcctgattttataaacaataagattcttaaaaattgtttaattcctcttgagacctgtaactgatcttcttaaactttcttttcactctggaaaattgccaaaaatatggaaacattctattattctcccattacataagaaagatagtaaaagccaaattaagaattatagacctatttcacttacatgctctttatgcaagatatttgaaaaaattcttgctgaacatattttaaagttcttgttagataaaaaattaatttctaattttcaatttggctttgttagtagaagatctactattactaacttaattacaacacttgaggactggtatgacggtattagggataagaaaaatattgatgctctttatcttgattttcataaagcctttgataaggttccccataatttacttatatataaattacataaaattggtattaggggcaagatattagcttggatttctaattttctacttaacaggacttttcaagtcaaagtaaacgaacattattccgaaatttttaaaattaactctggagtcccgcagggatcggttcttggaccacttttgtttctgatttatataaatgacttacctttatgtattcctgctgaaattggcatcaaactttttgctgatgatactaaattatatgttatttataaatctgaagctgaaagaaaacacatggaccttgcactttctaatgtactaaattggtcacaaaaatggggaataaatttctccttggataaaagttttgtactttattttgggctaaataattctaaaacactttacaaaattggtaatcatatagtcagagaagccaagtatgtccgtgatttaggtgtgttggttgacaataatttacagtttactgaacatataacccatttaattaaaaatgctttttatcgatctaaacttttatttaagctaattaaatctaaatcagttagaatttggtccttagtttataaaacatatataagatccttattagaatatgcaacagaaatatggaatccaaagtcagttaatgcacttaacagaatcgaaaattgtcaaaaatactttaccagaatagccctaaaaaaatgtaatctcccttacatttcatataacaaacgtcttgaacttttcaaacttgatagacttgatgttcgtagacaagttattgatttaactacggcttttaaaataattaatagtttttcacatttagaccctaaaaacctttataccttttctaaaagaataaatagattcaactgcaaacaacttgtttctaaacacaaaacaaacaagacagaacattctttcattaacagaacaaccaaattatggaacaaacttaactcagaaattacaacatctccctctataaatatttttaaaaacagagtccttaattgggttaagacccctaaataccataaaaatatttacattgcatgaaaaaaatgaaagaattgttttataattatatattttacaantgttgatgtga

SEQ ID NO: 11261 - DNA, 1318 bp, Heterodera glycines
tttgctttgatccaaaaattaaataattattgaaaacattaattactttaattttaataaacgcaatgaaaaaataagaaatacaaataaaatatattcatttttcttaacattttttaaaataaaagatatatgtaattaatataagaattaataattgagtaatttcaaattttattcaattgagggataaaatttaattcaaattttaataaataaaaattcattttaattggactaattttaatttaattatttgaataaacaaaagaattaattttaattggctaattcagagtgatatgccttttttgctcgaagccgaatatttcacatgtggccattcggatgccgaattggccattgatttggacatttttcaaacacttattagcattgcattggcaatggaactgcgggacaaattagtgcgctatttggccgatgaattgcccaattttcaaaatgacatgcaaaaaccaaattttgcaccatcacccaatgacatcatccaacaataccatgccaaactttgcgcattggcaacaccattttttgggaacaaatttggccagaaagaagaacagcttgtttggccaagcttgacacggtaaaaattgaaatttcaatgaaattttggaattttaaattttctaaaatagatgggctcatttggctgaccaaagtgacattgaaagtgccatgctttttcttcatacaattcagcaacaaaatgtgccaactcgaaggtattaaatggctaattaattttatttttttattttttaaagcggttaaattaataaattaaatattttattttttgcagatttttacctccacttagtgcccaaaatcgaccaaaatggtgctcacttttgttaatggatgcttcatcggaccatgcaataattggtgcttcattaaattgggttggccatttggaagtgtttgttgatgaggagcaaaagttcaaggtgatttaagcaaaaaagattattttacagtactctcaataatcttttacagtactatcaacccacaaaaatattattttacagtactctcaacacattaatactgtgtattcagcttgtaagcactgattttgcgcgtcttcgctttttggcccaccgtatccaaatggtgccgctccgatcacagccaattcaaattttgctccattttgacccaaacgaaatttgtacagtagtcgatgaacaaccaaaccagcaaataccgtatttgaccaccccatcgattaacaacgactttcacactcgagcaatgatcagcagcaaacacagcaacactgatc

SEQ ID NO: 11262 - DNA, 3710 bp, Heterodera glycines
ctctagagtcttaatttcaaaattaaagtgttcgaaataattatggaattttttttcacgtccaaaatttttaaacaaataaataccaaattcaaatttgaaaatttagccaagtgatgaacaattaattaatgaaatggacacaattggacaaagacttgaatggattcggcaacaatttgaacagcggactgttgtgggacaaattgatgaagccgaaatgtcaagctcattggaggaggaaggcaaattaagcaatgaaaatgggaaggatgccgtcatcaaaattccacaaaatgaagacagaaagccgaaattcggagatgaacttgaaaagataagggaattaggaaccatcactgagaagacatgccaagaaaattccaaagtcgaaaagcctgcttctgtaaatgccaaagtcgaaaagcctgcctttgaaaatggcgaagtcgtcgaaaaactaccattcgaaaatgccgaacaacaaaagccacatcgacaaaatgccgagaccataaaaacgactcttgaaacagcgagaatggcaattccggctcttaaaaacggtgaagaaaagccatatttggacagtgccaaagaagtcaacaccaagacaacttccgaacaagctgaatttgaagaaaaaattattgccgagattgaaagtcctcaacaaaatgccgaaattggactaagattattggaccacgaatccgacagatcttttgtacgtcagagcccaccttcatctgctggctatcactcctcacgtccttcgacttcacaaaacaatagtcacgaagaagaagctaatgtcaatgctaaattaaatgccaatcgaagaaatcaaaatgccaaaactggaaatgtgccaacgcctccgattgttgaaccaatggatttccgcggtttgagaagcagcgatgaaggagaagaaatggagcagcaacagcaattgaatgtacagcagaaaaggccaaaagtccgttcatggaaagagatagaggtgaggaaggaggtcttggagggggtacgaacagggaaaaatcaaaaatttcagcaaaaaatgcaaatttcccccaaaaaaaaaatttttttttttacacaaacccatctctgggctaaaaagtacgggaacggaactggtactcgcgacaaaccttaaagtgtaattaataaaaaaaattttaatgttcaattttaaaaaattaacaaataatgatttaaaaataaattgactgtattcagttgaaaagtcgataaatcatttgttaattgctgagctgtttgttttaattttaaagaatatttaaatcataattctaaattatatttaaaattaatttcaaattcaaaattaaggtgttccctcggaacagtccatcaaatgtggaaaagccatcaattttcgttaataaatgcgccaaatcgataccaaaatccaaaaacaatgctaattaccccagcaaaaacatcaaagaagaagccgtccaacaaatgccgaaacggtcaccctggcggcggccccaatggctgcgtttgttgccacctttcgatggcacaattcgtacagaacgccaaacaaccacggcacagattaagcacgggcatccgttgctcgagcttaaactcgacggttcgccaatgttttttaattttctatttttatttttagagcatttttcaacgcctcggtctacggataaagtggcaaatgccggaggtgatgttggcacttttttaacaaatccgggacgatgccgaagaacatttttggagttggctgccaaaaaggagcgtcgtcatcggagccaaaattcgagcctcaacaggccaaaaacgacgatggtcagtttaaaaaaatgcaaataaataaataatctcaaacaaaatgtaaataaaaattgaaatttttgaatcttaatttttctccaaaattctttcgctttgtttgattaaatctaatggacaagatctaattgtaatttatgaattaactcattattgtataatacagggggtttagccccgaccaatcggggaagaaattctcggtgatcggggtaggggagcgcaaaattgtcaggatcggggaccacgatcggggaatgatcatatttttatttgaacaaaaaattcatttttttgccacttactagaaatgggctaaggccgagcccagtacatttgaagaaagggtcataaaggcatgccgtgggaaaaatgaaaaattttgcgcgatttggcgaaaaatttttttttttactccaaatttcaatttaatagatttttgagagccggtgaattctagcttttttcattcaactttccttttttttgacctaattggaccggataattgtcattcctaatggtctatttataattgatcagtttgatgatgaaaaaataataatataaaaaatatcctcaaactactaaattagcaattttgtaattaaaaatatttaaattaggaccaccagcagcagcaaacgcacaacaacggcatttacgacagtggcatcggacttgagcagcagcagcagcagcaacaacagagcaacaatggcacatcaagaaatggcattgtgctgtacacagttgagcttgaagaagcggatgttgcggcaatgcgaaggcgtgccgaaggccgtcagaattgatagttaatgggcaactaaccattttttgaataatttaatttagattttatgttggaaaatatttttattttctcgaaataataataaaaaaaaaattacagtaaaaaaaatagatttgggtaatctactgatgatcattttaaataattcataattataattttataaaaaataaagttaaaaaaatagatttggataatcctactgattatcattcactaatggtttataagacatagcgatttaagaataaataatttttatttaattagtaatcaaatttattttttaaattgatatttcaattttttattatttttaattaattattaatcaaatttattttttaattgctttgtaattttttttattaaaatataagctttaggtaaagatgtaaattccttatttttcagggattctacctattaaaaaaagtagaaaaaattttagcgttttcgaacaatagttgggattttatttacattttttggctttttcaaaaaaataaatataaaaattaatttaatattcaaaaatattacaaaactgaaattgctgatcattttgagaatcatttccttttattttgtcttccaaacttgcatttttatgctttttgataaatataaagtaaaaacgacaacaaaaatgatgtttattttctttattcctttttttattattgtttgtgatcaattttttattccattttcaattgcaaatccattggtgagttgattaatattttaattaatccattgttaattaggacgaggaccaaaggctaattgcagttatgaaaggcgacccgaaaatgcgactaagtgaatattcaacgcaaaaatatgaagcccaccttggcattgtgtatttaatgagaaaaaattggaattgtgacaaaattgcggatgaatttgaagaatatgaacgaacagaatgccaaaaatatcgaaaatatttggacatttcgcttaaatatttgcgaatgggatatgccggaattccaacagtcaagccaaaatttgtttttaaacataaatt

SEQ ID NO: 11263 - DNA, 2632 bp, Heterodera glycines
agctccacaaatggcacacgctgctggccaacaggtcggccaacaggaaaccatgggtgacacgctgagaggaaaaaatagaaaactttgttattgaatgtttggcatagtgctgatgcattttcccctagagtgtgaccaatgagcattgaccaataagaaaaggggcgtggccaatgtgcattggccaacatcaaatagggcgtggctaagaacatttgccaaaggcgtgaccaattagcattggccaattgcaaaaggggcgtggccaatgaacatttgtcaaaggcgtgcccaattagcattggccaattgcaaaaggggcgtgcccaatgaacacttgtcaaaagcgtgatcaattagcattggccagttgcaaaaggggcgtggccaaggttaacaatgagcgagaaaatatgaaattaactgcggcaaaagtggatgattagtgattaacttgcttacataaaaatccacaccgcgaaattgcagccacacctccagcttcaatgcagcgggcgaaatcactggcacattactgtaatgaaacagaagattactgtgcccactgtaaaagtgccaattcccaaatgttaggcacaaatgttaattatatagcaaaaattcattaaatctgaaattcttgaaatttttatgagtgtttacggttagtttttcaaactaaaaaaaagttctaatggctcagtggtaaaatagaaaattgattgggttcgagtcccattacgtgctatattcctacctgttctcatcaaatgcgccgattcgcggataagtgattaaataaaccacattttttctccagttctgtacaacattcactgaaaattttaatgtgccaaatcgttttagaaaattaaatttaagaatactatttaatccaacccattagagcaattaaatatatttatatttataaaataaacatacataactatttaaatgcatatgaattttaaataaattaaaagcaattgaaaatgtttttaattaattaaaataaaaaagcatttattttttgatacaaaaaaaaaaaattattttaccttctgccaacagtggcaaaaatctattcttcatatctgctataattttccgtacagcatcaatcatagagccgacaaaagggattttggcaaatacggaaacgcgttttgcaatgccacgagcacagaacattgcaaaactttttgctgacgataaaccactttgtaatggaagcattaagttaacaatggctttgctaaatttgttcataaaacgtgcaccgatgttggagtagtacacttcgaacacctacgtgtgcatacatacacaaataattgttaagaaatgatgtttgaaacataaaaggttgcattgcacgcgcccccggtgggaattgaacccacggcctttccataccgtatggtgaaaatcctctaaccgactgagctaggcgcggtaggggtcaacttgcttctggccaactgcgtctgagacaagtttaagaagccataacttttttcgttgttggccaaatcaaacaaacttggtttcattcgaaagctctatatgtttagaagatatttataagcattttctaagcgattaagctacgcataaacagttaaagcttgaaaattgcaaaaaactccgaatttttgtatatttttattttaaactgttttagttctttacgaatcattacgaatttttgttagctgatagagcttattaagagcttccgaatgataccaatatttttgatttggtcaacatagaaaaaagttatggcttttagtctcatgctggtatgcacaatgctaactatctgcagataaatcgttatccgcagataaatccgtatgcacaatgctaaggattaaaatccgcatgcacaatgagagtttcttttacaaataatccttagcgtcagctgcagctaggctacatatgcacaatgctaaagatagggtagcagctacctatctgcagattaaaatcactatcctcatcgagatgaggataatttcgatagaaatgtcgattaaaatcccaaaaataagtttaaaaatgggaaaaattgtactaaatgacttttaatacctctaaaattttttgatttacatttcatgatgattgaacaaaacccgaaaattcgacctttcgagttcgggttaggaattggttgaaataaatgtcagattcatgatcagcgacctagaaaagccccaggaataagtttttacgcctttttatgcaataaaattttgctaaccaaatttgagttagaaaatttctcttgagggatagaaaagataaaaagatgtgtgacgagagagttgctgcggatgggtatctgcagataaaaaaatcttcagctgcagatagttagcgctagcattgtgcatagagattttatctgcagatttttttatctgcagctaccctatccacatatcgctagctacagataaatatccttagcattgtgcataccagcatgagagagagaaacagagagagagataaaggaagagcgggtcggtggcagttcgtacaatttcaaatgggaatggccataacttttttgttcatcagttaatttcttcaaaattggtatcatttgaaa

SEQ ID NO: 11264 - DNA, 1956 bp, Heterodera glycines
aatatttttctatgtagaaaagaaattatgagaaaatttctgctaagttaatttttgttgctgttcaaaaaagttttttggacgaacttttcgtaccattccttcatggtgatatgaaaacccgaaaatgccttaaaaaattttcgaaaaaattctagggggttgggaaatttttcaaagataatgagtgggcctatcagaaagaacgcaaaattctaataccgaatttccctttgaatgatgagtctatttttgcaaaagaattatttgtaagataagcaattttaggagaagctcactcatgctggtatgcacaatgctaactatctgcagataaatcgttatccgcagataaatccgtatgcacaatgctaaggattaaaatccgcatgcacaatgccagtttcttttacaaataatccttagcgttagctgcagctaggctacatatgcacaatgctaaagatagggtagcagctacatatctgcagattaaaatcactatcctcatcgagatgagaataatttcgatagaaatgtcgattaaaatcccaaaaataagtttaaaaattggaaaaattgtactaaatgacttttaatacctctaaaattttttgatttacatttcatgatgattgaacaaaactcgaaaattcgacctttcgagttcgggttaggaattggttgaaataaatgtcagattcatgatcagcgacctcaaaaacccccaggaataagtttttacggctttttatgcaaaaaaattttgctaaccaaatttgagttagaaaatttctcttgagggatagaaaagatacaaagatgtgtgacgagagagttgctgcggatggggtatctgcagataaaaaaatcttcagctgcagatagttagcgttagcattgtgcatagggattttatctgcagatttttttatctgcagctacccctatccacatatcgctagctacagataaatatccttagcattgtgcataccagcatcagacgcagttggcccgttccggctaggggcgctcccttttgaggtgttctcctcctatgtcatttataccgactttcttctacacttcgaagttcgaacacctacaccaccagcaggggtgtgacttgtctcagaaaagacgagagcgagggttcggcgagaggcgagggtttttcaattttttttgtggccctattttttacttcaaaaagttcattcataaataaaatcgtttaatgtttcgttggggtttttagcggaaaaatggttttgtagtaaaatttttgcaaaaaacgatcccggtttcctttttgaaataattccattttttcgacatggtcacaccttcgaattattacaacgtgcaaaaacagagttcccaattttttttttcaaattcaggacaaaaaacattaacattcagattagaacaaaattcagattttttgcaaattaaatagtggcgctattaaaaacatgtaaaaattatcttgaaacgattttttattagcgtaaaacacagggcttcccaactgaaaattttcaaatttaggattttctcggcgcgctttttccaaaaaacgttgagaaacagggggtcccgcggtgccgataggcaccgccttgaaaaattttcaaaatttaaatgtaattttgttacaacatgccgccctttttatacttttaacggaggcctcaaaattcaggacaatctgaaaattcaggacatttttgatttgtcagataggtactgaaaaatcaggacacttgggaactctgtgtaaaagcaataattattattgaccatttatcctaaaataattgtgctatgattttaaaacatagaggaagcagagaacgagaattattatggtgttttttttgcgtaaatttgaatatttttctgactgctcaaaagttcaatctttacgggtgtattttcacctctcgc

SEQ ID NO: 11265 - DNA, 2617 bp, Heterodera glycines
gcatatatttaaacatttatcttgattttctaacccaatttcagcccaattgaatctgaacgaaacaaaaatgggcaccactgacaacgaagagaagaaaactgagccgatgaagaagttctgcaaaatgttttcatgggttcagcaaatgttttcatgggttcaggtatgtgttctctaaatacctaaaaacggatcacaaattttcatgatttccttattttgaaatccattaaatttagaaggaaaatgtcgaaacaaaaattgacgacgacgaaacattgttgaaacggttggacaatgtgttcatggtaaaacatccgccggaattgctcaatttttggcgacacgcggtcaaactgaaccccaaaaagccattgggtaaatatttttttacaaaaatttaaaaaatgtaaattttcaaccctttttgtagcgggggttgaaaaaaaaatttttttttttttttttttttgcgttttttgtttcatttctccattcttgggataccattgatctacacatatttccccctacacagatgccttttctgaattggactcgttggaattggtcggtccttttttgcttcttgccgccgcccacagcgaacggcacgccaaaaataccaaaaatggcgccacagcaacagcggacgaagacgcacagcagcagaatcaccttttgttgggctcacgttttgccaccgatttgcccgagctggaaactctgctggtgcaccggggcggccgcttttgctattggcgcgatgtgccggaggaaatgccgaacattttggtgcatgtcgagggacatgacctccagcagcagcactttccgacgactgccatttgcggagagcacgacctttttgcggcactccaatttatgctaaacaaattggtggacacgggtacaacgacgacggcaaaggcgaagagacaacagtccaacaacaccggcaccaccaccaccagcaacagtgggtaatgcaatgaagcaactaattgcccaattagaaagggtccgaaattcaatgaaaatttcaagtaaagatttttagtgattttttcaaagaatatttactggtatctctcaaaagaaaaattttccaattttgtttggataaaaattttgtgtactttcactaatgacagttttatttacttattttttcatccctttccctttcaatgcgcagcgtaaaacctgatcaaaaattggcacatttgttccccgacaatttcggcatgtccaacaatgggccggactatttgaaaatgctgaaaaagcggcgtgacagagaatctctcgaaatgctattccatggcattgtcaacaaattcccactggacgacaaaggcattggctaccaacagctgctgttggacgacgccaaggaaaatggtaatacatttttgttttttcttggtacacccattttcgtaaatttacgggtttttttttaattatctcagttttttaaccaaaatttcagcccaactaaagcggaacatcaaaacaatgggcaccacggacaacgaagagaagaaagctgagccgagtaaaaagttcttccaaatgtctccatgggttcaggtatgtgccctctaaattattcatcattttagctgttgttgttttttttgctcactcaaattaaacaacttttacttgtacgcaacggcattttaagcaaaaagaaacgatttttgtgtcattttacaaataaaaacaaagacactttcaattagcctttcacaaatgattggccggacatattattattccattatcatttccgtaactaaaaggaggtaaattcttttttttaagctgtccttttgcttggttttcttgctcctttcatttttggtgttgtgctgctgtgcctccaaccaaactcaaaccagcacaacaacagacactgttcgtttggttttttggggcggtttttttgggtttatttatttttcaacagatttcttccaacaattcttttgctgtcactaagccacccttttggctgcccactgatcccttttggcgtcccgtattcgatgcaatgatttatgcagccattgctataagtgccatcaccgtcatttttggagttccgtttatgattttcattgcttgtattgcttctagtgcggctagagactcggaaagatgggctgaaatgatcgagcgaagggagcagcagagacgcgaggcggaaagaagagatgaactgctgttttaagagattatatgaaatacgagcatattcacaaaaatattaaaatgaaatacatcaggaggcaaaaaaaaaagttccgaaaattttactttttaccaaagagttcggaatgccgacccatttcgactacggacggtggccagtaggtggggcaagacacgggctacagaaaaagtccgcgccatggacggtaaaaaacgaaaaaaattgccaaaaaataattggcgtaaaacaaaacgccaacacactcaaattgaaaaacaaattatattttcatctgatcaaatgttttaaaatcatataattcataaactaacagatagaatcaaaaaggaacagatgaatcgatgcagaatttttttctctatcgctatg

SEQ ID NO: 11266 - DNA, 1206 bp, Heterodera glycines
cattggctaccaacagctgcttttggacgacgccaaggaaaatggtaatacatttttgttttttcttggtacacccatttttaaccgcgtaaatttacgggtttttttttaattatctcagttttttaaccaaaatttcagcccaactaaagcggaacatcaaaacaatgggcaccacggacagcgaagagaagaaagctgagccgagtaagaagttctgcaaaatgttttcattgcctcaggtctgtcgttaatgttttaaaaaaaaatttttttttgtttcaaaataccaaaatactacagagaataagaatgacaagaacgcatactgctccgactcgtactgttttttgtatgatcaaaggaggccggccaaaaaaaatttagttggacggcaaaaaaaaatttttcgaaaaacaatatagatttaggctttgaactttttcccgcaaacaattacctttttaaaaaatcaaatgatcatttaaattttctttcagctttcattttgcttcgttttcctgctcctttcattcttcgtgatatggtacacatccgatcaaactcaaataaacacggtccgtttgcttggcaatcctggagaatgggtgtgcccaatttaacttttttttaattttgtgctcataatcagtttttgagcccaaattaaaataatatattaaaaattagggacacccattcgcgtgtcccggcatttgcggtccgacatttgcgcctttgtccaaaatcgagttagtttaagctatcagggattgaaaaaaaaaaaaatcaactttgagtccgattttggacataggcgcaaatgtcggggctcccccattctccagcaggattgccgtttgctttttttgtttttcgttttatatttatttattttccagaaaatgccgttgaatgattccacgtccgtcacacctaataagcctccgttttggccgtacactgatcccttttggcgctctgttgctcatggagtgttctacgcttgccttgccatttctgctttttctctcatttttggctttgcgtcattcattttcatttttgttctgctttcgcgcactttgacaaacatggagcatattaccatgacctgttatgaaatcgacgagatatttgcgtggatgcgtttgaaaagtgaggtatacagaagcgcgatggacaagctggaggaaaaaggaaaga

SEQ ID NO: 11267 - DNA, 4806 bp, Heterodera glycines
  misc_feature (722)..(722): n is a, c, g, or t
  misc_feature (779)..(779): n is a, c, g, or t
tttttttttttttttttttttttttttttttttttgggaggagaagaaaaaaaaagaaaaatattattttttttttttttttttttttttaataaaaaaaaaaaaaacccccccgcccgaaaaaaaaaaaaaaaaaaaaaaattatttttttttttttttttttttttttttttttttttctttttttttttttaaaaaaaaaaaaaatttttttttttttttatttcccccccaaaattttttttttttttttcccccggggggggcccaaatttaaaaaaaaaaaatttttttttttttcccccccaaaatttttttggggggggggggccttttttccccccgagggggcaaaacccccccttttttgtgggtggcccgcgggcccctcttagagaacaagggggggaaaaaagtttggggggcccaaattttttctcaaaagggggaaaattttttttcaggggggttttaaaaaggggcccaaactcccccctttcggttttttgggataaaaccacccccccaaaagggccagaaaaggggccgttttgtctcccaaaatttttcccgagaagcaaacccaaattttcccttcccaataataaattttcaagagtaggggtttttaaaaaaaggggtaatttgcccaaaatttggcaaaaggggtaccaattcaccccatccataagtgaaaattccgagttttttaaacgttggncctccacaaagtcagatcagcgtaagaccaagctgctcagagaggcgagtgcagacnagatactcggattagtagaaatttgcgcgaacatttttaaatttaattttcgccttaatacgcgtcaacggccacgctaattcaatacgcggactactacagggcaattgctcgttcacgaagtgagagcacggcaaaaaagagacttcaagagggaaccggtgttgctcttggcgcaattattgcaccaataatcagtgtgcttgctcaacatttgctggagaaggcagcaacaacaacaactgctgtagcgtcatgaagtacacaaaaaagatgataatggttcccgagagtgaatatctcactttgataaatctgctgaagaggggaacaacaacttctggcccctatgaaagtgagagagctgaactggacacagacatccaaaaaaatttggctgatcataaacgcggagcagatgtgcaaatgaagcgccattcctggctgtataagcaaagacggcagctaaaagatttagcagtaaatagaccccaaaaggtggtcattgaaaacctggcagccataccgcccaatattgctccttatatggcaattcagtctccttccactaaagctaagttagagacaaaagttaaaaacacatcggatggtgagcagaaaacgaattctttttataataggcttactgcagcaggtgatgaacgaaaaagaaggagtcgtaaaaggaagttaggcaaaaaaatggtaatgaacactggcgatgagtctgatgccgacaacaatagtggagataatgccgatggctccttttattcttcagcgaaggatgatgagctcgagcagacatcttatcataaaagaaaacgagcaccttctttgttgacacaaatagaccaaacagaccctgaacactatgaagaattgaagaagattgtggaagcaaggctcataaaatatggaattgatgccaaaacgggcgcaattttgaccaatttcaataaaccggtcgccggatcacattacctgaacgcaattaagtacatgacaggccagctgaacaacaagccgaaaggacatagatttttaatccaacgcttgaacagggaaaaagaaattttaaaattcttcccacatctaaaccaatcgctgcagtccggagagggaatcaagagatttagagccaagaagaaaaaattcttagcccttgttcgcatgcaaccccctataaaaacaccgggactacaccgaactgcctatgccgaaaaactacatgcaaaatttcctccaaaacatcaacaacaaaaatttacgtttaagccagcaatatgggcaaaactgtagagaagctactagagcaaatctattatgaccttcgctcgccggcaagctacgcaggggttcttaaggtctggcaagaagcaaaaaaacataacaaatcaattggtattagcgatgttcaaaaatttttgcatgatcagcgaacctacactctgtttaaaccgcgtcggaataaatttccgcgcctaaagactattccaagcggtcttcacactgactggcaatgcgatttgtgcataatggatacactgaaagatgaaaacgatggataccgttacttattggtttgtattgatgtgcttagtcgacgcatttttaccgccgaatctgagtctaaaaagagtgaaaatatgatagaagcgtttgaaaaggtgtttaaaaaggcaaatgttctgcccaataaactgtatagtgatgctgggctagaatttcaagcaaagcgtatgttagactattggaaaaagaaggacattataaagcatgtgatgtattccccacatctgcatgccggtgtggttgaaagggctaaccgtacaatcaaggagcgtctttatcgctactttagtgaaaataatacaactaggtgggtggatatgattgataaaattgtggaaaatttgaataattctgtaaatcggaccacgggggtgaaaccaagtgcagtgacattcaaaaatgcacctccactatggcacaggttatataaggaagcggatatgcccaattcatcaactacctcttcaattaaacgagcaaaaaataataacaacaacaaatataaactgggcgacactgtgcgcataagcaaggagaaaggagagtttacaaaaggctattatcccaactttactgacgagctattcaaaatagcacaggttaaaccaaccaatcctccctcatatagaattcgcgatttacaaggtgaagagattaagggtgtcttttacgagcaggagttggtgaaaaccagtgagaaggacacaacccacagggttgaagtgttaaaatctcggacccgaaaaggagtcaaagaacaccttgtccgttggattgggcattccgatcagtataacaagtggattcgggacgctgatcttgtaaaagagcgcgaagctaaataaaaaaaaaatggacgaattttatgtggtactaccatccaattcacctggaccagggaacacgacctcaaaattcactgtcaggcttccacatacgcttgagctggacgcaaactggatggttgcactttcatcaattatctacccctattcattcccatctgtcggaattgatgatgacgacttcatcagcattaaacttgtaaatccaaattttaaatttgcggatgacaaacgttttgtggatattgagctaaaaataccgagtatgcaattctctagtgttgggcatttaaggcaaacattaaatgacataattaatgatgcgtataaacagcggtttgggctctcatcacagaaagccgccaaagttaaacgccaaattgacgttacggagcttttttttcacgatcaccctgtcgattattgggaaaaaattgaagagttggaaaaaaggttggttgaattgagagaggagattgatacgaaggagagggagcatggtgccgaaggtacagagcagaaaagaaaaaatgaacttgaaggtgaattgaaaattttaaggcttcgcctcaagagaaaagatgatgagctggaggagcttaagcgggcagcgaagcgtcgcgatgacgacacccctgagaatcagcagaaaaaaatacgggaattcttccatcaccatccggatgatcatgaaaaaaagctgaacgagtctcgactgatcttcacaaaatatttgtccggtttgcaagaaaaaatgagtgaatatatcggtgaaagagatggagcaaaaattgtgcaacttaatgaacagacagggaagctgagagaaaaaatcaaatacttgctgcgcaatcttaatttgtttgagagcgctgtgctacagcgcgccaacagtgatgacccctcgcgaaaaacgagagaggaatatgaaaagagcagccatgaacagaatagcgtatatgttcaggaattttttcaaagacacccgaccaattattggcaaataattcataacaactacgacggtctccgggaacagttcgacaagatagaagaactccaacaaaaaacggcacagaagcagctaaaggacgacgagcactcatcgttccagcagcaaattgaccgagcaaaacaactgctggaatacagacgcaagagatttgccgcattggaatttgaggcaaagaaacgtgacggacaacagcaacaatcctctccattctcttcaccaatttcatctgcattgaccgccggagaggcgttaaaggagcgattaggtgccgttcaagtgaagcagacagaaaagtcggatcaggataataataattcgatggaaaaaccaaaaacccacgctgaggttctcaaagagaaaatacaacaacaacaacaacaacaagatatagccacgtcgacaccaaatgagttgcaaaatgacggcaaagcagtagcagagccaaaaacccatgccgaggttctaaaagagaagctagaacaaaagaaaggcaccagcgcatcagctgagagggatggtgatcatgacagcgatgccgtcgatttactatcgcgaggtcataaattggtgagcatgcttccaaaaaaaggga

SEQ ID NO: 11268 - DNA, 3941 bp, Heterodera glycines
tactcaatagcagtttcatattattctatacgggcccaccctgatagtatatcccaaaagtttctaaatatcgaagcacgggtttgaaaaatacattttttggtctaatttttaaggacaaaaaacacaaaaatatttctatatttattttatccttatactcatattttagtattgaaatataaaaatttaatataactacgaatatataacagaaaatgtaaatttgttgtgacatttcatcacattttccccgtttgttccgtttttgcaatctgtccacaacaatatactagacatttcctattccatcggttcctcatcagcatcaatggcatcaacttcaccatcaccattggcatcatcttcaagcagttcgccctctgccaaatcgtaagattcggcactattcgcctctcctaattcttcatcagcctccatgacgtcctgttcttcctgttcaacttcagttgctggtgcgctggatggttcgttgttcagtgccggctcagcctttggtgaagcggccttcacagctttgctaggcttggcttaatttattctttattttaatgatttttctatcaaaaatatccattttaagttttgtaaaaactatttaaatagctgtgccaattcgtactgtcagaaaaattcttaaaattacgaaaaatctcattagaaaagttgaaacaatcgtggtcaatacatggtcaggatttacttggtgtctttttgtccttggatttcgatgatttggcggtttttgattttttgtctaaaataattaatttatgtttggaatttgcttcaataatttacaccttttgatttgcctttctttgctggcttatcttttttgtctaaaatttgaagaacattttgcagaaaaatttccaatacttaaaaacctttttttcctttggcatcctttttacccggcgattttgctgcttttttattacctaaaatatggagagttaaaaataaaatgtaaattataataattaacgaattattcttatttattcctatttccttcgattttaatttaaaataacataaatattaagtgttgtcttaagtccaatacttaattttactatagcaatactgtttctgtatactgtaattcagtagtttaccttttgctggacttgctcctcccttatgggcatctttgccttttccgtgcgctgccactgctccttataaattaaaaacgtttaaataaaataataagtaattaaattatttgctttttaccccttttattatcctttttcacagcctttgaatttgctaaattaaaaaaataaataatatttaaatatataatgattttatttttaatgggagagctacattttgaaaaaaaaaaatcttaattgtgattttattttatatttgatatagaagaaagccctttttcacagcttttgaattgctaaattaaaataaataatatttaaatatatatatataattttcatgggagagctatattgtgaaagaaatcttaatcttaattttggttatgttttatatttgctatggatttataatttgggacaaaatttaaggaaaatccgccctcgtaaactataatggcaaaaaatgccttatggggcccactttgtaaataattttcttatttttttgaccaacctgtttctagaagaacagccaacacaaggctaaccatggtcaagaagagaagggcacgcatttttattggataaataatttaaattagataaaaatatattttaaattattttacttttattattaattgtttgctgcttaaatatgccataaatcggtagcggaaatggtgccaaccaaatttcgttgcaatgtcattgcaaatttataatatttcgtctatcgatgttaatgaatttcatcatctttatgtttgccaacataattgttttgaatgatatccgacaaaaaagagaatggcacctagtaatttaatgttatttattttttaattatatttttttaataaaaaatttaacattatagaggcataataaaataaataattggcaaaaaatgatgatgatgtaattaaaggaagtcgaaatgaagcaaataaattatgttggcatcttttcaggccatcaaattaaaggtgtataaaaggaattaaataaacacatacaaacatagattcggattttacaataatattaattcttaataattaattaaaaatctaaaaaaatgcgtgccgttctcttcctggctatggtttgtctggtgatggctgttattttggagactggtaataaacattatttaaaaataaacaataataaaatatatctattttagcgaactcaaaagcagtgaaaaacgacggtaaaaaaggtgaatataattgttgaaaataacaatatattaaaatttaaggagctgttgcatcgcctgccaaaggaaaagcttcgccaaaaggtgccagcccagcaaaaggaaaaactgcaaagggtaacgaatttaatatgtttttaattatattaaataataatttaaattaataaggtggcaaaaaagatgcaaaaaaagcgggcaaaaaggacggaaaagtgaaaaagggttagttggtatttgaaaaagattttttgaaaatgtttttgaaatttagaaaagaaagaaaagccggcaaagaaggcaggcaaagggaaagatgcagctaagaaaggtaatattttaagaataatttaatttaaaaaatgaaatttagacaaaacaaaggacaaaaaggcaccagcagcaggtaaactcattaaattctaacttaatgaatggcattgtgccaatttggcgatttaagccaagccaaaggctgagcctgtcgagactgaagagccgtccagtgcacaagttgtagctgaacaggacggaggcgaagagtcggccaacaaccaagaaatggatgccggtgaagagatgacggaggaggaacagacggatttggcacaggatgaacagcttgaagatgatgccatcgacggtgaagaaggcgatggaatggcggaggaagaacaaccggagatgaactaataaacttattttttgaaaatatataggaaaatatttacacgggtcaaacggggccaaacctattgtaaacattattttgtataatatttaatttatcaataagaatcagaagataaatttgtaaacctatttatttgagattttgatttactaaaaaaaaaaaataaattactgtatttattattataaaatagaaattttattaaatttataatttacaatataatatttttaaatattaaaaagttcaaatgtgaaaaatactgatttttgtattccaaagtattatgccgacaaaagaagaaaaagtgcgaaataataaaaacaaaaaaataattttattaaataatttttctaatttatatgttcattgacataattcaatgaaaaaatagtttttattaattatatttatagcgccttttgtaaaagtaaacacaattgcttggtaaaatttttcattacttagtggcatattttctgaaattttctcaattgttaggagtatattttctcagaaatttttgggaccgattcttaggagagtattttcgtttttattgcatttttggtatgaaatttttggaaatgccaaaaataggtgctaaaattcgaaaatgccaaaataggtgctaaccctaccgttttaggttttttaggtaagtcgctctaaataaaaaaatgttcggagaaaatgtgtttttcgtgcttctctcatcaagtatttccgcaaaaaatatgttaaaacataaaaatccggtctctacttatcaacaaaaggatttgatagaagaattattaataacataatttaaataaaatgtgaaagattaaacccgttttctattgatgatacatggtataca

SEQ ID NO: 11269 - DNA, 979 bp, Heterodera glycines
tctaaaaagttccatttgccctggaaaggtgttttccgtgttctggaaattgatggagtccgggtaaccatcacgagctgtaattcgcctcaatccaataccagagtcgttcacataaatcagcttaaaaaatgcattgagaccttaggctccgctgtaacagttccaaatttggaaaaggaagaagaagaagcattggcgaaatccaaagcggaagagttagttgatgaacctgggttttcacataatttgagtcaaaacgttgaccatgaagtcgaaaaacaaggggaagaaattaatgaaaacgaagagcagaataaaacaaaacctaggtataatttgagaaaaaatcctaaggcaaggagactaagtttaaatgaataattgtctgcttcggcgagtataaatggaaaaaaaaaaaaatttttaacaacaaaatggaaaagacattttttttttactaaaaaagaaattttagccaagcatgtcaatccaaatcgtcacgactattgatagctccatgcggctggctcccttcttcacgaaggccttttgcttctccaatcattttggctgccaatttgttgttgagggcatctccttttgttgtagcgagcaatgctacatgtatcttaaatgtttggcatttggcgacaacagcagcgcttcggcgatccttcagtcaagcaatccggcagagatcaaacgacttggttcgggatcgcggattcggggtttcgacacccaaaaatggagacaactctccattttcgcgatggtggtggcgaattggaataagtatcgtcagaacgactatttgatgcagcgtcttttgagtatcgacacagacgtgcttctcgtagaatgttcgccgacagactgttattggggcataggtctacaattacgtgatccggatatccgcaacatggcaaaatggagaggaaaaacatcctcgggagagtattgacaggactca

SEQ ID NO: 11270 - DNA, 1780 bp, Heterodera glycines
atgtggtttgttcagaaaattaattggcaggcttcggtcgttgaaataagttatattaattacgcggtatggagagagaatttgggtattgttctgagagttaaagaaagtgtttcgagtgtatcaagtcggaaattgtatgcattagttatttctgcagaactgcaggtgtcttcgcgttgttaccgtcgacagttagttgacttggacttggacactttagttgagggtcaattagttaaagtttggtccgctgtgttgcctgagcagtacttaattgagagttcatacatccttcctccgcagagtgaatttaaagctggtactgagaaaatggttgaggatggaaagggagttcttgcctgcgttggtccacacgagccttggccgtatcagcacttctatcctttggctaaagaaatgagtatgagtgaaattgagttggctgagaaaatttttagtgcggttattgcttatagttatgaggatgaggagaggaaaattgtcgatggcagatttgagggctcagcgacataccatgagggcttattttggttgaagttttctgagatcgataatgtgaaaatgaagcgacttaatttgggaaattgatgcgcaggtaatgcttaagccttcaatggatcagaaacattttgcttcgggggttgtcaaagaaacgaatgtagagtcaatgagatccttagggagaccaaaatttattttgtggattgcggtgaaagtgacacaagtgcaagaaagaaaaaatagggatgttcatgaagagttggagagagctgaggaaggaggtagctttgtagcacatccgatgattccgcagggtttggagttgagaagggcatgttttgcgtcaaatcttccatctcgagttgccaagctggacacaaatcaaggaaagctgatgagggcagtaatgggtcgtccacgagaacagctggttggtgaacagggagagattttgggtcatgcgtcggcagttcaagagtttcacccgttgatgagaaagttaaatgagaggcaaaaagtgtcggccaaactgttgttagggaatgagtgttgtttgatctatcaaaatgcgccaccaggagttggtaagacttatgttgcatcaattgtggcggcgattctcttgtcgataaatgaaaatgtcaaaattgccattgtcacatcagcgaatcttcctcttgcaaaattagcccaagaattagacgaagtgttaggtagtgacgaaatggaagagtcgggatcgattgcgttcttctcgggttacgcgaaagaaaaatatagagagatggttgagaagttgaagcgtcacattttggtgtcaaagctaaaaagtgaggaaattcagagcaagtttgaagagagaagtgaagagaatcaagataagagagatgtgagagagtattgccaaaattatgagttcaggcctaggctgacaaaagagagaaaaatggcatcgttgtatgcggaagtggcgaacttgagaattgttttcgcaacggcaacgatggcagagaatgtattgtggacggcgttgactggcacttcggtgcttatatttgatgaagcaacacagggttcctgggtcattctggcacatctggttgctcggttgccgaaattggagaaggtatttgtgaccggcgatcgttaccaacttggtgtccatctgcaggaattgccaaaaattttgagaaagggatttggcttagattcgatggtcgatcagctggttgattctccgaatgttgtgcaataa

SEQ ID NO: 11271 - DNA, 991 bp, Heterodera glycines
  misc_feature (950)..(950): n is a, c, g, or t
accagcgagaggtgggaaggcaaccccggggcttgatcaccccgtggacccatccttcgggaatatgtggcacctttccctttccctccccattccgaattccaattcccaacgccagcacgtccaccgcgctcggccgcgctactttacgctcaaaaagcttctcaaacaattttagcgcttccaattccttctacaatcgcctttatacatcccattatgagcgctaaaattatcagagtgccgaaaatcgcatgtgatctaagcctagaaaaaatggtctaagtaaaaatcgtaattacgctcaaaaagcttctcaaacaattttagcgcttccaattccttctataatcgcctttatacatcccattatgagcgctaaaattatcagagtgccgaaaatcgcatgtgatctaagcctagaaaaaaatggtctaagtaaaaatcgtaattacgctcaaaaagcttctcaaacaattttagcgcttccaattccttctacaatcgcctttatacatcccattatgagcgctaaaattatcagagtgccgaaaatcgcatgtgatctaagcctagaaaaaatggtctaagtaaaaatcttaattacgctcaaaaagcttctcaaacaattttagcgcttccaattccttctacaatcgcctttatacatcccattatgaggctaaaattatcagagtgccgaaaatcgcatgtgatctaagcctagaaaaaatggtctaagtaaaaatcgtaattacgctcaaaaagcttctcaaacaattttagcgcttccaattccttctacaatcgcctttatacatccattatgagcgctaaaattatcagagtgccgaaaatcgcatgtgatctaagcctagaaaaaatggtctaagtaaaaatcgtaattacgctcaaaaaagcttttcaacaattttagcgcttccaatccnttctacatcgcccttatacatcccattatgagcgctaaaat

SEQ ID NO: 11272 - DNA, 3507 bp, Heterodera glycines
tgcatttttgaattttttgtgtttttcttagatatttttttcaaaaatgcctaaatatgtgcaaaatgtgtgccaaaccccgaaatatgtgcgatatgtttttatgtgcgaaaacgccaaaatatgtgtttttatgtttttataagtcgctctaaatcaaaaattgttcggagaaaatgctagttttgggcttctctcgccataactaagccgcaaaaaaaatatgttaaaacataaaaatcccagccctagtgatgagctgtgtctaaaaatcagagaaagaaatcgaaccgaggcaatctgagtgtgagacaactgagtcccagtaaaaagggacacttcagtaccaaaaataatggatgaagaaagataatttaacaagcaaactttgattttagacttacgtttctcgttcaagagctttatgggttttgggctaatttttgagatttttccatataattttttaaaattttattcttgtatttaaaaacccctacctaaaactttatacctttgtttgttaccaagaatcttggcattgaccgagaaataaaaagctgtggcttaataaactgaggatttattcaactagcaatacgccatttggcagaaatataatacagtatacatggaaatggtgccatttcacactttggcttaatcaaggcgacttatcaaatcggtggtccatgcccagctggtcgtgtaatcgtccttctcttcaccgctcatctctttgaattcgcgctccaccgcctcaatggtggtcgttggcctcggcttctgctccaccgttcttgtgacattttccgccgtgtaccgtccccatggactgtacgttttgttgcgacagtaacgataccaacggtggcgccttctgttgtccacgtagttcacatagacaaagtaaacttaaagtgtaggtgataaagcagaaaattggagtaacaaaattcagtgccgtactgaagcattcgtaagttctgtgcacttcgtggccacatgaatcacagttgaacaacacttcaagtgcggtgtgtttgcattctgtaaataaaatgcgatgggaaatggatttgctaaatgccaaaatttgtaaattttattaccaaaatacgttttgttgcagcaaaggaatactaatgctatatttatagcggtgaataaaaccatcgcaagagtcactaaaggggaaggcagagtttcatttgtctcaatgaagtaatgtataatcatccacacagacaacgcaacgaacgcctggggggagacggagaattttaattttttgaaattgaaaacggaagcttacaacgatggaaatggctaacacaaaccagcaacacactcctctgcatttgtctgtgtatgtggttttcacctgaaacaatggggaatgacaattttgaaaaaagaaagtttttttttaaatgttttaccttggtaaaattggtggccatgagttttttggcggggcattgacatcgcatctcccgcataaatatgccgtgttttcgcgcatttttcaaatttgcttcgaccattttattagaagggattcggaatcgatgaaccttacgaatagggttgggatttataagtttttgcttattttttctgcgcctttaactcgacgagaaatgcacgaaaaacacatttttttgttcgaaaattttgcgttttaacgcacttattcgagcttagaaatgcttattttggcgtttcgtgcttaaaaatgcatattttagaggttcgcccttaaaataagtttttgtacttattttagcgttttatgcttgttttcgttcttatttcgcgatttttggaaaatttattaacaaaaatgcaataaaaacgaaaaatacacccctaagaattgacctaaaaattttcaaaaaatacactcctgagaatcgacccaaaaaatttcggaaaaatacgcccctgagaatcgacccttaaatcctgaaaatttctaaatgtacttcatttctaactgcaatcagaaaataaaattgtttgacttaattttaactaatttacatagagaaaacagcaattttaacaaatttcacctctacatttggaattttgtcatgcttattttcgcacttatttcgcgctttttcgcccttatttaagcacttattttggactttttcgcgcttaaaaatccgagccctacttatgaaagctaaaaaatgcgtgcgcttcaaatgtcgaatattttgaaagtaagaaaaagggtcggttttttggtgaaatttatgctttccttgaaacagagtccaaaaatgtgaaacaaacaaataatcccgcagcgggattcgcaaattttgtttttgtatgggatcccgcggtccgtaattcattttcttgggaataattacaaaggacatataatgccaaatcttaaaggtcatacgagctaattggaacagatcttggttgatttttatcggaccaacattaattatgctttgttaaaggaaaaaatgtggtcaactaaccgtaaaagaaataaaaattcgggtggtggccggacaacatttacgtaagctgataaaaaagggttaactccttaatctcaaaatatatccctcccatatccttaatccttttacttataagttataacaaagtgccaattcattttccactgtttgtcacgaaagagcctttatcgtttattatggtagagcaaacataattgagagacaacacatagcgattaaatcgacaatacaacatcagaatgactgacattagggggaattcatacaacggaggtgtggcaagcatctcacgggcttataggaaatgaatattgtacaacacttggagaaagagggccactctcaacatataattatgatggagacaaaaaatagttaatttctgctggaaaatcgcttctcatccgattcgtcatcacccatttatccattgttggtgttcttccattgcttctactccgtggcacgacctccatccgccgctgtcccaccggtgttggtcgcctccgcctcagaaccacgcgatgacccatccgttgcactcccttcagaacctaagaattttgaaagtgtcagattcgaaatcagcacccgtactcctcccaattcttgaatttcgccagaaacgaacgttcactttgctgggaagcgttggtgttgtccgtcgccgtcgtcgaagtcgtcccggcatcagcaccagtggcggtggtagtggctccatccttcttcgacgatttcgccgtcttcttcttgctggcactgcgtcgacgcttgctggtggcacggcgccgcgacacggtccgcggacgacgacgagacggcttccgcgcggatgagccaggcgcagccttcttcttcctcggcgacttgctcacagaacgcggctttcttgaacgactgcgacgctgcgatgaccctgctccacaagtcctccggtgagttcgctgaacgatgtgggagagggggtggtaagtcgattacgaaaatg

SEQ ID NO: 11273 - DNA, 1471 bp, Heterodera glycines
  misc_feature (1296)..(1296): n is a, c, g, or t
  misc_feature (1368)..(1368): n is a, c, g, or t
attcggacgtttcgccaactacccataaatcggacattttgccaaatgacatttcgccaactagacataaaatgtttaaaatcatttttcattggcctcagtttcttcgccactttcttcgtttccatgaacatcattaagcccctacaaagccttgtatgtatcacaagtccgaacaactgcaaagaatttgtcaatccttcttccgatccaaatttgacctcgtcaaagatcgcaccaattttttacttgatgatataccgttggggacttaatgctttactggaggtgttctgctcgtccgatttccagcttgcggtgccttttggcttttgtatttcgcgaacagttggcaattcttattataattttatgtttacaggacattttgaaaaatttatgttatcattttcgggtttttaatgaaaatttctgatccaacaactgtctggggtaatccgttgacaaataaaacccaaggtattataaaaggcttgttttctacaagtcacaaaaattatggattccataaaataaaaagttttggccaaattcttgaagccagaaccgagtttggcatttttggcacctgaaattcggattttggtaccaaaaaactgacccggcaattcaacgctggcaatttctgccagcattttccaaccataatctcagctcacagaggacaacactttggttaattccggcaaaaacagaaaatggcaaaatatgactgaaaaatgccaacatgaatttaaacttactcaattttcatttcatttccttacggaaatgaaatgaaattgataaaaaaattcacgtgaatttattttgtttttatgtttttcatattataataaagaacggaagttgaattagtctgatgtaatttcaacaaatttctgtatgaattttgcatataaatttggcaaattttctcaaataaattcattaaatattttaatttatatatttttttaatttttagtgtttgaaaaaaatgaatttttttctattcattactattatttttacattcgtaaaaagtgggtaaaatccattaaatatgcatttaaattaaataaataattattgatcacaattatttttattaaattattttatttttcatattttaatttgtaaatattaaaataataatatttaggcaacgcggtactaaattatgtggaagaagcatttagtagcagagacgaagttcaaaagttggccaattatgcaattgattgggcttttaacaacggaatgattcttcgttatgacatcagacagtanaataaataaataattataaaaattaaatggttatttttgccttatttagcaatttcatagcccaattctcanccgtttcgcttcttcccgtcccatttccgagagaagcatttgagaaaagcatcgctggtcaggaggttaaaataaacagacaaaacattcgttttataataaa

SEQ ID NO: 11274 - DNA, 3990 bp, Heterodera glycines
aacggtaacatgtagcacagttgtaacccttcctataggcgtcccggttcctgtgtcgtaaaaaaatcttaaatttctctcaatcatgcagaaacagaagagtggggtgcggtgataggtggcaatataatcagaatagcggctttcgtagtccctgtgtattataattttataatttgaagcctcaattaacaatgcctccacttctgctctgtttttctgccagaaaaaaatcttctttttcgagagcctcctcaaaatatttttgaaacgagtacattttaactaaaaattaataaagaaaaaaatcgaataaataataatggaatgaacaaaaaataatgaaatggaaaaatgaaaaaaattttatttaacagggaaagaataagtggcaataattattgaaattctctggtctaacaaattcacttccccaaatgattgctgcctgtgcatgaactcgttgaaaacaatgtctggattcgattgttggaaggggcgggcagggatgatcactgggtctgacagggcactgcaataaaggtccactgaaattttctcaattttccagcccggctcagcttctcggctcattgcatcccccattaattttttcaggatttttttaaacattttttcgggatcttcattttcggggcatttaaaatagaaagttgtcacgtgctcttttatcccaaattttttattttcctttatgtgactctccacttcttcgaaacatttttccaaattaggactgtttttgaaataattttttgtatttttcgagcggcggatttcttttgaagtttcttggaaatttttctttgacattctaaaaaatgaaacaaatttgattaatttaaaatattaaatgttataaacatgagacaaaattatcaaaacaaaaattattaataatatccaaagggcaaaacattaaagtgatcgtcaataattccttttttctgcaccggtgtatattctttttgtacgtcttttgagagaacccggaagtcgtttgtcggcccgatcttctccgggtagtgaaaaacttttttgacccctttcttgtaatccagcaccatctctttgaacaattcatatttaaattcgtttcgtctatccagtgtcatccctctgattttggttttgtgccaaatcacaccacccttcttccttctgagcttcaaggcgtactgcttcggacccgcggacacaaactccaaaatttcgctgtccgcatactctcgagtcatctcccttaaaaccacaatttaaatgcgtttcaaaatttatgttttaccccaaaaatttcccctccaccaacggacagcgccccttccgatgagcaaaagctagagaatctaaatttttgtgtttattttctttttattccttttcacctgtgtcacaatagagcagtttacacccctccttcttgtagacctgctccatgtactcgtacagctttagcctcgcagcactcgtggtccacaatgacaaaacaatattcgacactttatgctccctgatgaactcctcctttttccggtacacgactcttgatatctcttcgcttatttttactgggcgcccaaactcaattgtattgtctctccccaattccatccaacgttccatgctgcccacaatttccgtacttgaaagggtgttgcgcatcgaaaattttccccacaaactgtttaatcccttaaattcgaacattttttagagattttttataatttctcaccaattttgcaatcattcttagtccgggattaaacccaatcttatcataatccaaaccgatgtcatactttgccttgtacatttcgatgaatgctcttttttcatcttcacttttcacctccgccggccaccccgacgcttccacctttatcttcaaaaacatccgcacatatcctttgaacagttgactgtcaaactgttcaaaatgatacgctcgatagaatcccataattctatatcctagctctaaagccttccgcaactcaattgatgtgaatgtccccaaaaatgctctctgcgtgggacgatggttacattttttcacatcttttgtcatcacaaattcattcttggcccttctcgcacaagaccaacaattagggaagaggagcatttcatcgatgtgcacgtggaggagggggtacaaaagatttttcggtgggatcacttttactttcaaaagtccatcatagggtacgtcgtcgggtgctgtccaattcacattaaaattcctgctcactacaattttcgggactccaacggggtatggggtgtcttaagcgaaaggaaactaacaaaaattaagcagatttttaccataattaacaaacgggtacaaactaatgatgtcgaacattgatatctcaatttcttcggtagcctttgcgtacaaacaaaatggcatcgttcttcccccggcataagcatccctcggattgatcggtcccttgtccggcacactttcaaagaactttttcatctccttatttttcttcaattcctctctgacatcacactcctaaaactaacaattaataaatatttctaaatgttttattctacccaaacttctccgattgaaaaatttttgcacttttccctcaaaatttccatgcgaatttcggttctactttgattctcttccatagtccgtccgtttggcgctatagtacaaggtaaaaaacatctcggacacccgtgaaatgcacaccccttaagtattgtttaaaaagaaaatatttttccttttacctgaaactcaattatttttttctctgcccctatcacacagtccactttcagcccaccaaattccacttctcctccgttacacgcatgccgcacttttactccttttctttgggcaagccactcaaaatatttcaccgctattttactctgattttcagctctctcataccctccctcaggcatgatcggaatgtgcctctccttcaaaaattttgccctgaagatcttcatcacaactcctgcgattgtcacactgtctttcatcacatcaaaatcccctgttatttccaaaaacaattgtcgaaacttcaaaactgattgcaacagaatttccacgtcgttttcgcaatatatcttcagctgttcccctaaatccaatataatttaaaaacccatatttttctgtctacctagttcaaattccgtttgataattctcgttataccatttttccaattttacggcttcttcctctttcatattgtccgggcaatagtcttccaaaggtggcaggttgggcaatctcctcccaaagttctcattcttattgtatttgtggggaaaatacaatttttccgtaatgtttaatcccaacgtttttggaaggtccgccaatttattctgactgagcatccaaaagtcacgaaaaatcactcgtcccgcctttatctgataaattttcaaatctgccatcatcagttccgtcgcgatttccttcttcgttagttcagacaagacaaagtgggaatcgaatctcccagcataatgcgcgaaagcaatcgtttcaaatcgttgaaaactcattatccaaacgacaaactcgctcattgggtcaaaaccatccgctacagaccatgtgattttactggggccttcacaaatctcacattcccgctcttctcccgcacaaatgttacaagtacgtgcagcacaaacaagattaggccggtgttctcccccatctactgtcgtctccagatcgtaggccagaattctgtaggctttctgcggtcgcacttgaatttttttgatgaaacattgcctccctgggtggcaaactttgcaaagtttgcaaaacttttccccgcaaacgtgtttcgaacgtgtttggtagacttctgcgcatttttcacatttcttgtactcattacaagccaccttcatgggcgcttcaaaacattcgttgttatagaagttgcggtt

SEQ ID NO: 11275 - DNA, 3838 bp, Heterodera glycines
tacaattgtccatgagcaaacggctcttctgtaaaatcaattcccaatcgaactgccgtttggccttgagctttcacaaccgtcatagcgaaagcaagtcgaatagggaattgaaatctttcaaaacttacaccgtcaggacgcttgtctttatatgtatgtcggtttcgaggaatcccaataattatgccatttccagaggatccgctaccaatggtttcacattcaattaaattgtcagttagttttttaataagaagtctggtgccattacaaagcccttttgaagtgtttaaatttacaagtaagacgacaattgatccaattttaaggcgtaacaaatgggtaggcattcccattggattcagctggtttagctgggctacatcaaagtcagctgcatttaccgaaaacgggttttcatctgttgccttgtcgaccgagaaatattcaataaaatttccaagcatggaatgagaaatttgggaattatttatgtcaacaattctatttgtagtagacaaaagaagtcgtttcagcatttcgctacttggcatattaagcccttgatcaaatacccatgcaatcagatcttcacgtgaatcgacgagcatgtcttttgggattgcgaccgtgtctccatttactcctcttccaatatcatcaaaccatttaagaaactctatttcgtttggattaactcgcatgctttgggtcaatttgtattttgaaaatatagggtaaagcggggaggactggatgcatgccgcaacttgtgctgcacttccataagaattgatcacaactggaagtgactgtttccagtcaccggaaattataacacattttccaccaaaaggtaagtgagctttttgtgagcacaattgacgacagagtaaatcaatattttcaaaaactgtcctctccaacattgtcatttcatcaattattataatgtcactttctattattcgcctaccaaagaaactatcaaagggaatcgcaggtaatttcccaggttcaacattaattccaaatttaaacgccgaatggacagtggtaccacctacataataacgggtggaagccattcctgtagatgcagtgggaataattttggcacctatttttcgcaactgatataaaatgtaattaagcaaaaatgtctttcctgttccgccatcaccacataaataaaatagtcgagaattcgttgtatttaaaaaagcagtttttaccatatcaaaaaatttttgttgttccgcattcaaattcccatgttcaaatgctgttgtgtcaactgtgtcgtcagcatcatcatcctttacgagctgggggaagaaaaactcgttaatcccacgttgttgatcattcataattgaaatcgctggggttggtagtccataatctttacattgtttgttttgtgcaactaataatttttctaaaagagcaagagcatggtcaatacgagcaggacgctcagcttctgtgcagcgtgtgtcaaacatgtgtttaataaattttttccagagcagggctccatcaatgagacaattttcagttgacccaaaaattaatatgttagcaagcaattgtcgcatttgtgctggggtgagcgaggcagcaccctcctccatggtccgaacccacacgtcgttgtcatcaataagccccctgagtcgggctgtctccagaaatgtttcacagatatgcgttgggtttaccatttttaattgctgcgggtttcctggaaaatgttttgtcaacaaatataaggcaaataactccggatttcgtggtgagaccgggaaaattcgtccaataattggttttctgttgtgtatattatgtggacgtgtagaaaaaatacgttttttccaaaattttccagatttgttgaatgaatactggtcgggcatatgctcaaaaagaattttcctaacatcaggatccgtttcacacattttccaataagctgttaaaggagtttcaggcaaaatgcctgcctgtacttgttgtgcgacagactccttttcacttgatttataataaatcttttgctggcctggcaaatgaagcgacaaagcaataaccgtatgagataatttagcatattttagcgacatgatcctacaatatgcctcaggagatgagcgatataacattctggcataataagcaggctcgtcaatacttgtttttccattttcttcaatagtctttatgtacgaaaaactggggcctttgaacggatacttatacaaatatttcaagttggtgctttgcccataggcatattccaaattatggtgagtctcaaagtgaactaaaatatatgggttgtatgccgatactcgtgaattgtcatatgtaatttgtgttttgcctctttttacagttaacgtttgtccgccatcttcttggcacggacggaaatagattgctggccggtcatcatgcaagatcgtaaatttactaaatggcttcggaaaaccttttttacatttccctttatgattaaagcaatggcgtccgcagtcatgaaattgatactttggcaataactcgcgcactttgcgaataaaaatagcccaatcagatttttcattttggttcggttcaggtggaatatgtgcccaaatcaatccgtcaacattttcagggattgcgagcagatcggtatgatagacacgatgggcatgtggcccgccatattttttttgaaattctctacattcttggccaatcattttacccaaaatattttttttatccaataaataatgaaggtggcgtagtttgtcctcataaatgcgacaaattaaatcgggtctatcaacagtcctctgaccttggtgaagaaaatttcgagaaatttctggccatctgggatttgtcgtaaaagttaaaaagaatgatgcaaaacctggtctcttaaaccttgacataatggtggttgcatcgtaaaatttatgttgaaagtacgcccgtgttccaggctcagatctccggaacataacaacgctacctaattcttcggttgagttaagccccgcattacgagaaagccagcgaagcgcattttctggtaaagtactgcgtaaatttaattcaggctttcgcaaataattagcaacatttgtatcgatacgagctgaataatccaacataaatttctgactgaggcctccaccagcactccaaatatggtgaagcttcttgtcatttcgcagcgcaatacgatatcggatatatgacctaactgataagaattgacgtgttccgcacttttcacccgaatcaactgaacttgtgacagataaattatcatcggattctttttcgtcagaatctaaagtattttcatcagattcaacatccacttccatagcttcatcatcgcattttttattttttgagttgtaaggaatttttggatggaaaccatcatcgccatttggaaatattaaggggtagcaaagagaatcggtttgtgggtgatgtggacagaatttttgaagctttccttcatctgtagtgatccaaataccttttagtaatggtggctggtcgctttcggcccagatggaaaataaagaatttccctcgtcgggtaaattggcttgccttggatggagggaagggtcctgtatatttaaaggtgcttcacgagcttcaaccaatgtaaaacggaaattaagaacagattctggaccctgttccctctaagtcttttggtattgtgcatggaaattcattagctgtttggcaagcggatggtatttgcgaataataaaatcaagttttccgattgttttttcattaactctatccc

SEQ ID NO: 11276 - DNA, 1812 bp, Heterodera glycines
  misc_feature (24)..(24): n is a, c, g, or t
cataatgtaatccagaatgaccanttttctcaaattgggagttgcaattctcttcggcttggctttggcaatgtcttttccggagactgttcccattggtcgagccaatatttggcatctttgaagccacggacaaacagctggaaactgccccgctaaatgaatttctgcttgagtaatggaagatgataaactgaaagtcatccccacctttggtggcaatccgatgcgcttgaaatgccggcccaagtcgggataattcctggcaatttgttcttttgtgttcgtcaccgtcctatcaattcgtccatagtaaaaggtgggtgctgccaatgccacaatcgcagtccttggcacaatgtccaggcccaatttttggtccaccagcgaagcacccgcctctgagagataaccctgaattgctaaaaggtcaaaagactgttgtaaattgtttgcctgattcgggacaaggcacgaacgaccaaaacagcagggacagagcaatttgtgcgcccatttaacccattttggatttaatgacccgtaaggctcctcattttttggcttgaacacaccgatcacttcctgaaaaacaaaaatatttatcactgaatgtttctttgttgaagcattaccccttgtaagtttttgacaaaatatgagcccgaagagccctgaggaattcgttcggggttagtccctcgattgatggctcggattgcctcgacgagacaggcggcgaagtcttctccgcttgtgcttccgtactgttcgttgactatgatgggaagttaacgccaatctctttaaaaaataatgtataatacaaatgcgatgcatttcttcgtctgatggctgaaaatccgttgtcacacgaacggaagtcgaactttcgcggtccgaatgagcattgacagaattgccaagaagaggaatgcgttcggttttcttaaatgattaatttactttacagaagcaaagccaaatcgaataaacaaaacggtcttggaatgtctgtacctttgaggtttgtggctcctttataagtgcagtcgtttcgtcattgtccgaacctttacaagacactgaaaaacaaatgtaaagttatgcatttgctattttctatcaccgttttccgtctcctcctccgtcgctgtcacttttgtcggaattcgatgctgctcagtgatcacagcagccttcgccttttgcttatcgcgcatgtgactgaaggactttcaaccaagaagttttataactaaattgaaacgtagaaacggctctatatagaaaattaagctttggttggaatcagcgataggaatataaataaattcgcgtaatatggacagaaaatatggaccaaaaatcgcgaaatatgcatgaaaattgcaaaaatacggacaaacataaatctttacaaataaatggtaaatttctcaaaatatcttcagatttgctaaatgtaattaaaactttaaataatgggctaaatatggtattaacacaaatttagctgatggggaccgttctaacagaggctttttggaaaaaatgcaaaatatggacttaaatatatataatgccaaaatatagaaatatgtgggaaaatagaatatgtaggtatgaactccgttctagaagcatgaaactaattgtaaaataaaaacttttatttaaacatatttaacaaagatcattcacattttacttcatatttaagggtggcgttaaacatatcaccaggactgtagttggtaaaatttggtaaaatgaaaaaaaaaatggaatagactgaaacgagcgcttggc

SEQ ID NO: 11277 - DNA, 3728 bp, Heterodera glycines
  misc_feature (3705)..(3705): n is a, c, g, or t
  misc_feature (3717)..(3718): n is a, c, g, or t
ggtgacaaataatcaattcattggctttgattataaatggacaaacacattcctagtttgaaagtattttggttcactgattaaattcgctttcttatgtcaagttcaatctacagttacacaggtccgggtatttgggcaaaaaccgggtacgggtgttgcccggtccagaattacgggtccaattttttaaccggatacgggtataagatcaggtccaactgggtctaaaaaataattaaaattatattacattattacaataaataaaaatattttagatagagtcgatagcaaatcaaataatatttctgaaaaaattccagaaggcacaaaaaaaattaataatatttttccaaatcaattatctctaattatccactcgtctccattaatccccccgtctccaattatcccccccccctttctgaggaggttgaacaataatccccccggggggttaattagagatatatgcacacgcaaggggtgtctcaggacaagggccatacgacggacgattgagacaggggggggggggggtgtcttcggtgattttttttgtttttcacggaattttttgcggcgcgctttttcattttggaaatttagtgctatttgtgacagattttttcaaaaaaaatggattttttccaattttgagaaaaattggatttattaattagaatattcattccggttccaagtccggtagggaaggtttgaggacagaaatttttcacaaaagaaaaagtaaaattttcttacatatttaaatttttacagtagcctaaaaaactaaaataacattttctgttatttttttaaataagtaaaaaaaaaatctaaaatggttattttagagtaaaatctcagccaagtcattagtgcccagaatctgaaaggaaggggacagagatttgaagattgaccggggcgggggtcccgggaccttttttccggcactccttgtccacaatttttaaccgaagctcaaaaattatgttaaaaatttatttttcaaaattttgatctttgataagtatttaaaataaagatttacgaaaaagccaaaattttatggaatattgtataaattaaaaaaaattcccaatgaaaaaaaacagtgaataacaaaaccaaaaatttattcactgctgctggttgcagttgccaataaggcacatttttaggatttttctactataaatctttattctcaaacccgagaaagtctttcgaattttttatcgtaccacaactcactaaaatgtttcaagttaattcattaaatttaaaaaattaattgaaaaaattcgcttcgttccgacatttttttctagttttttgcttttttaaattattgataaaagatttttttatcgtccacagaattaccaaattttacagtatatttgtcgtttatggtgaattttctttcgaattaaccgaaaatttcatgatatgtacacagacattcttcaatcatttttgatggcgcctgaaaatgccgaatgcaaattcttttttttcatttttaatttttcttatgtttttgtttactcactgctggtctcttttttaatggatcataaaagaaaaagggcaacaaacaacaaacgccaatttcattctcacattttcttcccttaactttacaaatactctcaaagaaatgttttttaattttaattattcaattctcagttttgtaaaacataaaaattattattattttataattaattcaaaatggaccgaagtgatccgaaacaatagaagcagcagcaaatgatgttgagggaattgtacagcccgaaacattcccatggaccgcgggaaagggactttcgatactgaagaacaagcagacgaacaaggcaatcctcgatgagtcatagaaaaagtcgagaatctttctaataccgaaatccgaatcaaatgaacagcgaaagagaaattaacaaattgtaaatatcaaatttgaagggacttgcccattcgatggcggaaccttcgggtgaccgaccattagcaaattaattaacgaaactaattatttaattgcccaaattgatttggaaaggagcggaatgagaagctgttcttccgcgtgatgaggcagtttcttggcgaactgttgcccattgtgtatacggtagaaatcataccgtaacactggttgtgaactgtttgtttgtttccatttcagcccactgttggcgatgcgtgcattcattttgagtaccgacacccaaagtaagcagcagtcccccaaattaattgtcccccatttgcgactcatttgcccaattaatcccaattaaagggcccttttcctcaacatcaattggcataattctgtcagtgaaatctgaagtgacatttgtttgaattttcttttcaatcataattaattattatccaattaaggatggattggcccggctttaccccgagccggcggacaaagaactgtttgtccgttcccaagtttacagcacagactatgaggagctgatacaaaatgctctttccgtgtcattctccgccgatcgctctcagaaaagtcaaaagagttttagtgttgaaatttgatcccaacgataataataagcgaaggaaggagtaaaatcatctgccgatggatggggtggttttgtggttgttcggcattcatttggtgtggcgattggtgtgctttgacccctcccccgtgtcccccgctttttgtttggccatcggtgctcggtcggaccagggacgaaggaaaagacgaaaagcataaaaagttaaaccacttgagcaatttgtccaaacgttgtcagttaaactaattgctaatttctcaacaattaacagaattcattgttttgtttttaagtaaaacttttttaaattgcgcttattagttaattattaattaaattagcatattaaatattcattttaatttttgaagaaaaaaagcgcggctgttttttaggtaggaattgttttcaacctgcttaaattagctttaaaatggtttaattagggatttaaatgcttaataaaatttcaggcgccgtcccaattcattttattccgttggattttctttaatctttgattttttcacattaatcactctcatattaataatttttcattctgcgttgtttcaaatgcttctcctctttctgtgaatgattctttgattgggcagggacagctgtgcccaatggaatttggcccattaaattgacggtgatcgcttggccaacccaaccacacacttaaaatagccatttctcggcaattcctttccattcattcaaatggtcgtccaacagagtaatttttagtcttttcttttttggcttcaaaaggtagaagataggaaagataaaagaaaaaaaaagataatggaatgagaatgagtgagagcaattaattagcaattcaattgaaaggcgtgggaagcagcagaaggcacggaattccgacttccgatttccgacatttttgggggctgaattccgattttcgtgtttttggggcctaaaatgccatccctgctggtaggaagggaaagtcaatccgaagtttggatggtgaaaatgttttatttatttaaaaaaatacacaagagagaagcggcgactttttcttaaaatagaataaacaaagtttaaagatgaaaatatttacccaatttgccanatcagtaatcannatgacctgca

SEQ ID NO: 11278 - DNA, 1196 bp, Heterodera glycines
aggttagcagaaagaataaaaattttctacaggatttcccttgggatggaaggtcgatgactcaacaatatcacaaattgcttccatggcattattacctcattttccatttcatgcagtgtcttcgtactcagtgtgtccatttgagcaaaatggtccatcttttcgtcaagacagagactgatactgctgaggcgctgtcttttaactgtaacgagaaaagtttttagaattaaaaggaatttctattttgttttccgttagtattttttcaatttggttccctttgcccgcccttttaggaagtccaccaacggtttctgtccgccaccttccgctgccttttccgaacttccggccgtgtcctccatttcgtcttcttccattattcgtctcttcagtccttcccctcccctcaattcgttggttttcccccgctctgacgtcgttagcttttgctgttcatcgtcctcccgaaaaaggaagtctcttttgtcgactctttgccatctctcaaaacaggcatccaaccaatgtgtgtttactatgggaatacgaagacgttgagcgagacggaatttccttaaaaacaaacttgtgattgtttataaaatgaactaaatcgaatcaggacacgcggaatgaggaagagatacagagacaaattaaaagggtacacggtgacgtatctcacccaacccgccccaactcataatttaggaaaaaatattggaagtttttctttaccattcttgctcaattttttttgaaatttctcgaaaggggtggggggggctgacggtggaaaagaaaaccatctgctaattgtgagtgttaactctcccttcaagcaatgacacattaaaagtgaaaatcgcattcaaaatgcgttactgaaatcaggggcgtatctagaaccatttttcggggggggggacccgacctgaagaccttttttttgttgctatttaaccaataacttttgtttccactgctggttaaaaactgtacttttgcactaaaaatgacccaattttagccgttttaaggcaaaaaacgtgcaaaaatagtggaaagtggaggtccggcggtgccgataggcgccgccgggaaaatttttttggaactttgagtcctatttgttacgaaaattgcctattaaattttttaattttcgtttgggggggggggggggg

SEQ ID NO: 11279 - DNA, 2807 bp, Heterodera glycines
tcggccgtcaactttagcgccaaaacgcgtacacttcccgtatatttcacaagctttgaagtcgacccccagaggaatgatcccagagaagacaatgcgctcgccacggagcactttggaacgaaggcagcccaaaatgcgttttacatcagggatcttgggacaaaaaaagaaatgaagagagacttgtaaccaggaaacactctccaagaaattattttttaaggaaaaacgaaagcgtttttaaaaattcgtatcaattttcttatttaattcgttaatttttacggaaaatgagttttagaaatagtgggaaaaaactttttggaccaaaatagcaacaaaaaaaaaattctgattttccgattttatttttttgacaatgagacagttttaatacagagagtaaaacccgaaaatcagcacctttttgtccttgtcatattgttggtagaatagcgaatgtaccttaaccattgtttttccgttttttgttcttcataacctaacctcagccagcacacgttcgacgtgttccaatgcgttgtcatcgtccacaatggccgcaattggctcggctaaggcattttcagtccgttcttccccgttcccccctccgtctcctctctctttttcctccgtttcgcctttcttttgggcattttcttctccgtttttcgtcgttaaaagactcttttccccctcctttttgtcctcttctgttttcgatttcactttttgctttaaagtcttaacaaaattaaattaacgtgcaaaaaactaaaggtgaacaatattttacccatttatcagcttgcgtattttccatttcttccgacgcttgcactgagtcgagcagttcctgtggtggagcattgatatcgccaatttccacaaaaaaacgatatgggttgacctggaaaacgctaaatgaaaaaaaaattgagataaatacggacgcggatgagagcgtcggaatgcatccaaacgtcgggtctgtcgtccagcatcaaaatcagttgttcactgcatggaaaaagggccttcaaattgccggttttatgcatactaaaaaagaggaaacttttgaaaactttgtgactattagtggttttgcctgctcaacaattcatctctcgaaagaatgcgataatcgaaatatttctttttgggatccaacaattcagctattttatgggcatacattcgctgaccttttaaagataatattttttataggttttggaataaaaccgaatgtaacgatgtgcatttcgaacaaattgttcaaatggtcgaggaatcttcttgtatttggacgaattttggtgcaaaatgtgtaaccattcagccgataaacgaataaatcctaaaatgaatagttttttttagtatttactataataaatgcgaccgaagctcccatttcctcggcccttaaaggtcggttcgcagtgtgaacgagtgtttggtcaaggtcgagcagaaggatgagtttcctttgacggacaatgttctgatggtcacgtgcacccaattcgtccgctatctaattgccaaaattagtcataataggaaaatgcaatgctatgaatttttttgttggattggtcacctccttagagacaaccaattcgggaacatggtgaatcattgaaacattggccgtcgtcggttcaatacgttcaccggagaagccgccttccctaaattcgtaaattcaactttactattttaattattttcatcctcccatacggtcgaagatttttgccacaaatgcagcacatatccttcatgatcactttatgagcacattttccatgttcactggttatgtcccctgaatggtaacaaaccccaaatttatttttaaaacaataattaagctcttgtagtaaaaaaaaatgccgaaaataagtacatccacaacagcaaccagatttttacctgttgtagtttttccaaattgcttatcgttagaatgatgttgcacaatatttttgtccattttgatttttttttcataaaattgtaaaagtaaaataaattctgaatggatggcagaattaaattaaaacatgttggctagatcaatacttcggtatttttaagtttgatggcgtatcccatttaaaaagaaaaggaacaacaaagccgttcagtgtgcatggacttattttggcggcataaaaacaattttccgccagaatttcctcaaatgcatcgacgttacgtcgcttctcgcctcagagaagctcgcataaatatgtgcccaacatttgacgatttgtgccgtattgttttttgttgcgcgccttcgttgaacgccatatgcgttcgattgtcagcgtatgggcacccgaaaattagggttcaaatgggaaaattatctcacttcctttatattttgaatttaatatatgctttcggacggctttgttactctaaaaaaaagtcgggtgtggcatcaactcggaaaagtacccagtgcttaattgtggttggatagagagaggacactacataacactttaaaaaccgataaaatttttattaaaaatccggaaaaaatgattaaaaaaacaacacaaaagttatgtatggaactaaatttctgtatttacggtaggtaggtaccgtacttcttcgattatagcccccgggggctttattgttcacccccctcaaaaggggggctttattcgagaggggggatctaatcaagtggggggctctattgttcaaccctttttttcaaaaatttgataaaaaatggcgtttttttttgtaaaattttacaaaaa

SEQ ID NO: 11280 - DNA, 3622 bp, Heterodera glycines
  misc_feature (39)..(39): n is a, c, g, or t
gcggggcggaaggcctgcggtgccgacaggcgccgccgnggaaaaattttgaaaacttgagtatattttgttaacagattttgtccaaattttgtgatttttagccaatttaaaaaaacaaaggatttttaggtccggcggtgattaggcaacgtcgtgatttttttttggaaatctgagtaacattacgccataaaattaaaattttggaaattttaagaaatcagaacaaaatttgggggctactccgaaatcagaacatttctgataaatcaaaacagatccgagcctggccaaaacgccaaaatatgtaagggttctgttcggcattttggttactcaactcgagttatgggaaagaagatgttcaggtgttggatcggcgacagaaatgttttatttattcaattttactttgtattagtcggataaaattatttgatgaactatgcttaattaaatcagttgttagaacgttttattaggtgaaaactcgagaaacaaatacttggaaatgcttgattttactaaaatgttgaatttttgagcttttctggcgtaatttttttttagtttcctacaatctgatgtaggaaactatagttcatttttcaatttattccctacaatttacctatttcttatttcgcttctctattttaggttttttccatcttatctacctccaacattaatggcaacaatgcaaaaaagtgcgcgaaatgtgcggcgattgatcgaatcaacggacggtaagcctaaagatgaattcagttgttatagccttctcgggattatcggattattgtacaataattatctgcgaagtcgagaaatttctctattttgactaaaaaattcatatacaaaccaggaccgatttagctaacaagggaacattccgagctttaagtcggaaaatgcatatgtattatataccattggatagagattttagcttggtttgaagcttctaggccgtattcccatatgcttatttgtgcatatttcgcaatttatgtgcatattttggcatttcgtgcatactgtaccttactgtattttgtcttacgtacgtaataaaagggttggcattataattgtaatgtcgcgccaattaattaatgggggtacgtgaaaagtacaaatgttaagtgatcacatgcttattcattttgtagcaaattcaaattttgaatatgactacgatttaaaatttgcttaaagaatgttaacttaatattaagaaaattatttttacctatttttgtgcctattttgcgatattttgtgcctaaaaatggaagccctaatcattataattttttgcacaaacattttttgtgattcatttattcccattacaaatccaatgtaaatgtaaatcaatgaaataattccaaatcgtaatcgtttacgtaaattaattaatgcttaaggtgttaaattaatgaagaattaatcggaaatgccatcgtaattatcaaatttcatttttaattgtcttaaaatcattagttcttcacttcgcatcaaattccccattctcttccatttatttcttctcattagctggtggaccagcagcagcagtgctctgcctctttaaaattattattaataaaacaattgaaaatattttgatttctaatcaaaatttgtaggaatgggtcgttttattaggcttacaaaaaacccaaaaatttctaacacttaaagacatccttacaaaaaaacttcagaaatttcgagtttttttgcaaattaatcgccaagcaataagaaacaatttctaaacatgtcagcttttgattggtgaaattaatgaaaattttcaaatcaaattttcttcaattatttcaagcaattaatcatttttggactaaatgatcgaatattgttagaaattcagatttgcttttcattagagatcggaccgggccgggcccggcaccgggttttcccgggcccggcaacccggcccggtgatttttgggaaaatccgggttgaccgggttatgagaggccgggcccggaacccggtcgtttttgaaaatccaacccgacccggaacccggcatttttgaccgggttatgatttagccaaaatttgttctttttcattcgaaaatctctttggcataatgtttataaatgttttttttcgattttctggttaaatttttctattcgaagaattcaactttatagaaatgataattttggtatttttctttttaattttaagaaaatagtcttatttgggaaattggactatttaaaaaaaggtcaaagttttgtgtacgtaaaaaataatattcaaaaattttttcattatcaaagtttttgatatttcttaaaaaaagtaagaaataattaaaccggactttaaaaattcttaattttcttgaaaaatttgctaaaatcgctaaatttagtcatttttggataaaatttgttgacaaatcgttaaaaattacaaaatttcccctggcggcgcatatcggcactgccggacccccatattcccgaaatttttttgataaaaagcgccgcaaaaaaaaaatatttattataaaaatttagaaaaatcgctatgaaaattttctaaaatttaattcttgaattttctcttatagaaaatctaagatctttttttgaaaaacttaaagtttataattgaagacgtcatttattattgacgcctgaagtgaaatagagcagaaatttaacacgtgacccactttttggtcaattttggtgttgaaaaatatgtgaaaattaaaatttttaccaacccgaacccagcaatttgaaaacccgggttgaccgggttttgagaggccgggcccggaacccggttgcttctgaaaaaatcagcccggcccggcccgacacttttgagaattccgatctctacttttcatcactttttcgccgtgcttttccaaaagtttgagatttataggctcaatttgtacggatttttaatttaaaatgataaaatatgtatcaattaaaaaatttcgactaaattcgaaccccggatccgtattctaacaaaaattcgaaaattcaaattttcaaaaaattattttatggtgcgaaaagtcccggtactttcaaaattccgggctctaataattaatcattaaaaaaaaaattcaaattatgaattacaatcactatttaatgctgattatgacctctaggattataaaaaactaattttatacctgtttttttttacatagacgaaaattttggatacgctaattgaatattttataaattctgaccaaattgttgttggccgtcgaatgagcagctttttgacgtgaatcgctggagactttgacgtaaaattaatgcaagaaatgaagtaaaaaatattaaaaattaatttaaaatgataaaatttgaaattttttaaattctctaaacgacactcagacaaaaagaaagaccaaaataaaaaaataaattaaaaaaggaaaacaatttttatgttttccttttttattaattcaattgacaaacttaattaataattaaaatagtatgaccttaaaaataataaaagtaaaataaaagtgagaataatccataggatcaatcttaa

SEQ ID NO: 11281 - DNA, 1951 bp, Heterodera glycines
  misc_feature (1811)..(1812): n is a, c, g, or t
agatcgcaaaaaacaaatattctttcccaattaatcgtcatgaagcgaaccaacgcaacaaacatcactccgcctcgcgccaaacgtttaatggtagctacactggacctggacccaaacactgttgcactcgcagatcaagaacgccaacgcactttggtgttcattggcctcccggaaagcaatgcgctcgcccatcggagcgtgttcaggaagacagggaagcgaccaccaaaatcttggaccatcttgaagttgaggccgaaccaacggccgtctttcgactcggccagtacgacccgcagcgaactactccacgcccgctcaaggtggtcttgccaacacccacacaccaacacgtggcactcggaggatggaagcgcgagcgtgctcgactccgttctcaacagaacctgacccgtctgttcgtccgtccggcgctgtccaaagaacaactcaaagaggaatacgaagcgcgtctccgaaaacgccaacaaaacccagctccattggcacctccaacacagctctcacaaacgaaaaatgaccaaactcccgttgttgcaaagggtccaaaccagaacgaggacagtgaagacatttccaaacatccggaagtttttgacgaaacaatcctcgtatgttatgaagcattaaagccattgccaccaaccgacaaaattgttcaccaaattcaatcgctcgaaaaacaataccctcatcttttcaataaatagttctaccagacctcgaacaatttcttcaaataaaattaaaaaacaaaacatcctattcaaactttctttaaaaattttcctcaaaaaaatttttctccaacccctataaaaaaccaaatttcccttttttggaggtctgacatttctactttctgcttctccagtcaaaatttcaattgtcttttatcagtacttcccatttcaccttatttccaccaaaagtgtaagtggcacatgtccttcttttggttatttttatttttgaataataaataaaattacaaatttaatttaaaaaataaaatatgcgcaattgtaatttgtttattcataaaaaataaaaaagtcatcagaagggcgagaaccacttatctgacgactatcagataaatgtcgtagagtaagtgacaaaatatatggatgatcacaggaattaaaaaaagacaaaatatgtgaaaataaataataaataaattgaggtcaaagtcaaatgaggtcgaaataccaaatcacttagaaatttgttacattctaaatttcccggtcttacagattaccttagtgaacttctaagtttggttttaaattgatttaaagaatttgtttttattagttctttatcgagttgattccacaattttgttaccctcccagcaaagggaatgaattttttgcccagtttgtattttgtgttaaatctgtaaaaggggatgttaaagcgtgttgatggattaaaaatagaaaatagtttcagatctgttcggccataaacaattttatgcgccatgaacagatcaaacagctttcgcctattctcaagtgttggcagttgtaggtattctaatcgattttggtatggaattggcggaaggctgcatttaaaaatacccttttggtgaaatatttttgacacttcgatttttttaatatttttttgaagagacggattccaaacctccggagcgtattccaataaaggcctaatataagttttatataacgtaatccaaatcttagacgatttggatttaattattcgaaacaaggaacgcatacgtaatacgcattctttgnntattggtttcggaaattgtaatttgttatcaatgtttactccctaatcctaattgtatcacagcatttattgtatttcatcaaatttataggttttttttaagggttttttgaaccaaatataataacaaaaggttttt

SEQ ID NO: 11282 - DNA, 2348 bp, Heterodera glycines
ctagacacattgattttttattagaaaacttataaaatcaaattttgcttaagaaaaatggggtttgtgtgattttaagaaaatcatccaccattcttagtggtaaagtcattattttgaggtgccaatttcacatttattcgttaagaaaatcttaaaaatatttcggcaaatttcaataaaagaaaaatgtatttgttcgattagtatttttttatataattcagttttaaatgtttttccttttgtggataagtgcaaatgttgatttttcttatgaatgcaaaacgtaataatatcgctaatagactaaatatttttcgctgcttttatgatacatttattcccttctaacaaaataggataattatgaatatatttttctcaattaaaagttgatcggaagcgcgaatgatgaagcggaatgcgcttccgacggacggatcaaaacagaggcagctagctcattagcatgactcactttaaattccccgctttttggtccctaaatttctatgcaaatatttgaaagtgaaaacagaagagcatcttaaattcatttcatcattactttgtgatgatctagttcatttttgcttctttttttttgtagttaaatgtatcgtttcgaattaaataggtaattaaaactgtctgcatcactgaaatgcccctgctgaccttacgccgacaaataataatttgttaaactggcttcaaatatcgaaaatatgaaatttaatctctacccaattttgtttaattaccctttcatccttaattaattatctgtaatttaacgctaataatttcgtagaaaaaaccttaaccattcttggtatagcggcgctgccgtgcgctgtgggcgtgctggcattgggaattggatttcgaataaggggagggaatggggaaagtgccacatattcccgaaggaggggtccatggggtgataaagcccaggatttccttcccacactcgctggtcacacagttagatggctttattacggaaaaacttaaatgcgaaataaaattaagaaattaaatgtgaaatgaaattcctaaggcttcggcaagacaaacagcaaacttggaccctcctatctcacagttcatatcattcggtagcccgaaattttatattcatctgaaatttccaaaaaactttaaaaaaaaatttagactaataaagaataattataggagacaattttttttccatttgtggtcggacattgaaattggcctctttaattaacagatgcactatattatattctgttaaacttaattaatttttatcatttttttaaataattgcaaaactcccaaaaaattcccttttcgtcccccccaacacaaaatgcgaagaaaacgtgttcttccttcttcttcatcttctctttcttttttatatgtacacaacagctattttttcgtagcgcaccacacacaaatcaaatgtccagcagaatctctcaaaaacaactcacattaattgccttgcttttcttcctttcaaatgttcttttttattatttggtttctttgctttttattatttttaattttttttatttttatacattgattttgcataataattacgatgtttttttgtgtcgtcgtctcagccaaggcataaatttttttacaccaccgaccaaaaatggtcatttgaccaacataaaaatcccctttttaattttttcttttattacataggtaaatcattctttttttctctacccattttctctttttctgtgtgtcttctgtctgttttcttatgggctcaaccactctttcccaattgttccgtgctctgtttgttgctcttctgttcctgttgctggtgctgggccattggttgggacggcgaaagcgggcgaatgcgtagcgtacggacacgaaaaattcagtatcggacaattcagtattttgagcagactaaaaagttcttggtttcatctctttaaattaattctgcgacgtataactaaaaattgcgatttattattattttcgagacaaataatttaatttgtgcattatgaccaagtctaattaattggcctatgtattttgctgacataaaaaataaagaaaatgaataggtatgttgtccaagaataaacaaaatactcaattggaacgccccccacatttttctccgctgcgtacgcctcccccccccccccccctctccgccttttgttgctcgcatctccgccaccaacaaacaaaaattgcgtccgtcgtcgcgccgcatcgttttgttggcgaccagcggcgccccccgtgggccgtggcggggatacccgggggcagtggggcaacggcag

SEQ ID NO: 11283 - DNA, 1279 bp, Heterodera glycines
catatttaggaccatattcggccatttttgaccttcttagtccatatttcgagtctttagtagtccatatttaatgtccatatttcgcgttcattagtccatataatcaacacccctaccaatctctaatactcaattttacgacattccaattagtgagactcaattctgtggcattccagtcgctgtgcctgaatccaccagcattcaaaaacctcacatttcgtgtgcattcttcactccatcctacgaaattatttcttttcttatatttatccacaaaaaatccttccataaaattcgtaaggcaatctggtctctgatctcgtgcgcaagtatttgtctcttcatcaacatgttcggtactgccggatgtcaattcgaacgaagagttgcattttgatattctcgaatattgcattaatagtaaagaatcgtcctacattcaggaaacccattcgcactcattccctctaattcattctgtacctaacaagcaatcgatctatcttatctcttccccccccccccatcgttcaccttttgcttttttcaatttcaattttactcctcgcgcaccgtcgcacacaacaaaaaggcacaatttttaatcttcgtaattccccccccccctcccccgtccattcgttctcataaacatttcctccccttttttgccgatgatatttatgtggagattttgttccatgcattttctcaccagtccatgtacaatttattaaaatagttatttgtgttggcaattaacagcagagatgtcaccgtcgtgacagaacaaaatgccattgtcattaaagcgactgcgcgaaaataatgtgccataaactgcacaattcaaaaattatttccattattaaaaagctatttcttgtgaaagttatttgtatatacatataggattctgttaaaattaaaagcgaatttcgctacgaaatccattttcattttattaattttgtttgactttcgttaaaatgctattaattaaaattttattttatttagttatcaacatattttttgattcttaacgcattttatttgttaacgcaccaattgatactaaaagcgccaggacagcagcagcaaaatggacaaaaacaacggaaaaaacaacagaaaaagtgatgccatcgacgagcaacaacatcaaaggcaccgcctcgactattgcaattctttgcccggcacttccgccgcagcagaagcaacaacagaagaagcaacggtcgttcttctggagactctagaggtcccc

SEQ ID NO: 11284 - DNA, 1557 bp, Heterodera glycines
  misc_feature (52)..(52): n is a, c, g, or t
  misc_feature (65)..(65): n is a, c, g, or t
taaaacagattataaatatttaagaaattacaactttatttaaataaaactntatttaaatatanataattaagagagtgaaaaattcagttgaaaaattaattgctcaaattgaggctggcaatgaagctggagcccaactcaatcaaaggggtgacggacaaggccagctccacgttccagcagatgagcaacttggagctgtttatcgaattctgccgcaagcagggagtcatcacgcaggagttgttccgcgccgtggacctggtcgaggcgcgggacctctactcggtgtgcatgacgctcaactcgttgggccgaattgtgagcataaattaataattaaaatattattcttttatatgtaaaaatttaaagacgggaaatttttgaattttaattgctagatttcttggcattttttaattatggggaggggattcaaataaccaatgattgcttgtagtgttaagcgtgaattattttatttatttatttatttttgtctcatcatttccaaacagtctaagtataatttatcataaattatttaataaattaatagatggaaaagcacggcaaaacaggtcctcggcgtgtttctgtacatgaaattgtcaatattccgctggccgatcagctgcgtatccatgatataaaaacgttttgatcattttcactgctgatttttcttttattaaattaactaaataaaaacataagctcttcgatttttgtatgaaaatagacaaatttagcttacaattttaaaatgatataaaattattaaaatgatttcgttataaataaattcattttttaattgattgaaaattatccattttcctttttattactgaatttaaattttcggtaaaaaattttgtttccatttgtaatagattttaaagaaaaaaattgccaatttgaaagagttcaagaaaatttttggagagctgactatcaatttgtaatattctgtatttttcttctacctgtatttttctgtacatttatactgggagtatgggtacaggccattcttggaatacaggtacaggtacaagataaactcgaaaaacctcgatttcctggacaaagttttcgaatttattatttaagtgaccgatttttcttcaaaaaatttaaatagaattaaaacacattattattgtaaaattgttatttttagatatcataagcaattaattcaaacgtttttttgctttttaaaacaaatttcaaaaaatccaggcatggatccaggtctcgaagagccttatttttcctttatgtgaatttttctgtacttttagacagaaagtacaggaacaggcctttcttggaatacagatacagctacaggttttacctaaatgtcgatctctagtttggaccccaaataataaaagtttagcactttaattttcatttctttattttttgttcattttaaaaaaagtttcatagaaataaattttgatttatttattatattttttacaatttttaaattttataatacaaaaaattaattttttggttcatttacaaaaa

SEQ ID NO: 11285 - DNA, 2545 bp, Heterodera glycines
cgactgagaatggtccaccgcagcagctccagcggactcagtgtggcggtgatgggcaaagtgaggcgaataatttaaaattaatataaaaattcttttttagcaagccaacaaatacaatacacaggagggcactctgttgttggaatggatcaaaaaggtcaccggagcgaattgtatcaacacagacggaagtgctgacaattttgtggcacaattgaaggacggcatattgttgtgcaagtaatgataaaacagattataaatatttaagaattacaacttttatttaaataaaactttatttaaatataaataattaagagagtgaaaaattcagttgaaaaattaattgctcaaattgaggctggcaatgaagctggagcccaactcaatcaaaggggtgacggacaaggccagctccacgttccagcagatgagcaacttggagctgttcatccacttttgccgcaagcagggagtcatcacgcaggagttgttccgcgccgtggacctggtcgaggcgcgggacctctactcggtgtgcatgacgctcaactcgttgggccgaattgtgagcataaattaataattaaaatattattcttttatatgtaaaaatttaaagacgggaaatttttgaattttaattgctagatttcttggcattttttaattatggggaggggattcaaataaccaatgattgcttgtagtgttaagcgtgaattattttatttatttatttatttttgtctcatcatttccaaacagtctaagtataatttatcataaattatttaataaattaatagatggaaaagcacggcaaaacaggtcctcggcgtgtttctgtacatgaaattgtcaatattccgctggccgatcagctgcgtatccatgacataaaaacgttttgatcattttcactgctgattttcttttattaaattaactaaataaaaacataagctcttcgatttttgtatgaaaatagacaaatttagcttttacaattttaaaatgatataaaattattaaaatgatttcgttataaataaattcattttttaattgattgaaaattatccattttcctttttattactgaatttaaatttttggtaaaaaattttgtttccatttgtaatagattttaaagaaaaaaaattgccaatttgaaagatttcaagaaaatttttggagagctgactatcaatttgtaatattctgtatttttcttctacctgtatttttctgtacatttatactgggagtatggtacaggccattcttggaatacaggtacaggtacaagataaactcgaaaaacctcgatttcctggacaaagttttcgaatttattatttaagtgaccgatttttcttcaaaaaatttaaatagaattaaaacacattattattgtaaaattgttatttttagatatcataagcaattaattcaaacgttttttttttgctttttaaaacaaatttcaaaaaatccaggcatggatccaggtctcgaagagccttatttttcctgtatgtgaatttttctgtacttttagacagaaagtacaggaacaggcctttcttggaatacagatacagctacaggttttacctaaatgtcgatctctagtttggaccccaaataataaaagtttagcacttaaattttcattcttttattttttgttcattttaaaaaaagtttcatagaattaaattttgatttattatttatatttttacaatttttaaattttataatacaaaaattaattttggttcatttacaaaaaatcgtttgtagaaatgtgtgtccaagtgccaaatttattcacagaactgccaataaacggaacacacatctttatgagccaataactccgatcactgcaaaaatttggtgccgcatacccaccccattttcaatgtttgatcactgatcaaagacgaagcgcatccgtggaggggatgttcacaatttcggatgccgacacgtgcttcgggtgggatttgcccttcttttgcatctaaattttgaaaaaaaatcatctggttgtatttataaggaaattaatgttttaattgaaaaaaaatatatattataatattttggttttttattgccaaaatatttaactatataacgaaattcttttgttaaaaaattgaaatttggttatttttatgagccattcaagaaacacataattattagcttaaaattcgttttctcatccttataaacctgtaaatatttcattgcataaataaaataattttcaaaattaattaatattttctgttgctcacaattcggcccaacgagttgagcgtcatgcacaccgagtagaggtcccgcgcctcgaccaggtccacggcgcggaacaactcctgcgtgatgactccctgcttgcgacagaattcgataaacagctccaagttgctcatctgctggaacgtggagctggccttgtccgtcacccctttgatcgagtttggttccagcttcagtgccagcctcaaattgagca

SEQ ID NO: 11286 - DNA, 2119 bp, Heterodera glycines
caatcgtttatttatttacataatgattttgatatcatctacattaaaaatgaattatttaaaatagattcatcaagcgctatgtaaaaacgaagacataaatttattaaattttggggcttttttggctttttacgactttgtcagattcattcaatgcctagcatttagaattaatatgtaattataacttttttcttttaatgctttattttctttacttgcacaacaatgtgccgtccttcagttgtgcttggaagttttcgcgcgttccgttcaccgtcattgtggcaccggtgacctgcttgatccagttgagcaacagctcaccctcactctcgttgtatttgctggcttgctaaaattttaattttatttttttttttaaattttccccctttttcttagttcactttgttcataatcgaagcaccaacaccaccagcgacacttaaaattaaaattcataatttttgttaaatccattttaataattacctgcgagatcccatgttgttggctctgtgtttacgcacaaattttacctaaaatttattttatttttattaattaattttaaaagaaaacaaaaaaattagggttgaaatttttaagttcccccgattgtaaaatggcaaattttgaaacatttttatctaatccatttgacaaagcattcgcttccgacgaggagctctaagcgtgaataaatagcctccttcccacgaattttcgagataaatcccatacattttgtgcccttccgtaacagctgttgcccggagagaatgaacaaaaatcacatgcttattcagtatgctgtgttgagctgagattgatcggaagaatggaaagtgatcagaaaaggtaaaaaaagaatgggtcgaaagtgatcagtgtaaaaggagagacgaagatacacagagagaaagagaaaggaaaagagagagagagaggagagattgagaaagaaaaaaaaatgaaaaaagagacagagaaaaagagaatgagagatagtgagtgaagaaaagagaatcatcgccgcttcgaaggtgatcatctgaagtgtaaggagagagaaggcgagaagagagaagaatgtaaaagagagacaaacgaaacagagagagagagagagaatcacaaatgatttggcctggccaggaaattcttcgcccggagagtcatgagctttttgaggccacaactgacgcaaaaattgttatttcctcttcacacacatatccgaaaaacgaatgtgtgatttaaagatttgaacaaaaataactttgagaggggaggaaggggagaggataaaaaaggaccactaaatatggacaggtaaaaaaattaaattaagattaaaatgggagttcaggaaaacgattttgaagaaaggtaatacaattagtatacattttactataatagcctttgttcaggacttgctgattaaaattttcaaaagactcatttagctcaaaaaggataatttaagcaaaaaaaaaaaaatcattttagaaaatttattcaaagagcaaaaaactgcgataatgatcaaatattattggcatttttcattaccaaatgatcattggtctggtcaaagaccactgtcatcaatagggatgcgatttttaggttttaaatatttttttttttgctcaattgttttgaagataggagctcaaaaaacgcatttctgcgttgaaatttttcgattctggtgtcactcactatcgatcggtcactagaaatcactattttggcgttttgtcactaaaatagttaaaattcactattttggcgttttatcactagtttttcactatttcgacattttttgtaaaatttattagtaaaaatggaaaatacaccccctaagaatcgaccccaaaaatttcagaaaaatacacccctaagaatcgaccaaaaaatgtttttaagaaatacaccactaagaattgtaaaattttctcaaaattcttcccccccaatttttttttcttgacaaaatttttgatttaaaaaacctcaatatttgctaagagaattttataaagaaaagtgtacctccatttgcaactgcaaccagtgaataaaaattatttttgctcaa

SEQ ID NO: 11287 - DNA, 2113 bp, Heterodera glycines
tatttctgaaaagaaaatttagctaaaatactaataaaaataaaatttagcgcataaaatcgccaattggaattttataaaattttacggtgctcggtgcttactgtcagcatcgtcgtggccccaaatttgacagggttttttttttgttttttttttaacttaaaattggttatttttctaaaaaaaaagaaatatttcaactataaaaaatttcatgaaaaatttttgcttaaatttttaaggagaaggagaaggaaaatacacaattattcgccctaacggaagtacgcttatggttcacggtaataacagttaggggacggacttttggcatcaaaaatcgaaaaaagcagaaaaatttaaatcgaaattttttttttgaaaatctctaaaaacaattttaagtggttcttttcataatttttttgttaaaataattgcaaaaaaaaaatgccaaattagcactaaaaatccagaattcaacaaaatcaatatgaaaaagttggggttgggtgcttaaaacacagatgaagcttgtcctgaatttgaaaaaaatatgagaatgcttgaaaattttgtccccgacaattacatttttcccatgaaattttttttaatttaacgaatttttattgttcagataatcattttggaaacaattgtgagttttgtttttattcaattttttaatgctagaacgatttcgttaagttacggtcgaaaaaattgaaaatggcaccattcgactcagcaaaaacgatcgaaaatagttgtttaaagattattaaaaatgtcaggaagggtgcggaagccgaaaaaaaaattacggaataaaaaattcaaaaaaccggaggccaggctcaacacacctaaaactgagatggaattttggcataaccaataaatatttaatagaaaaaaattcattaaaatccgtttatttcgcatatatttttttcctcaaaattttaaacataaatattataaagtaaagaaaattgtaattctttcttttctattttttcaggaattttgtaggcgaacacataaaacttagagctatcaaataattttaaaatatttgaactgagtttaacgagttttcatctaatttttttttaaaataaatctctattaattcaaaagtttcgaagaaaagattagatttgccaaaatttttcagggctaaataaaaaataattttttagacttttttttcattttctaccactttgctgtgaaattttttgataactatgtacattttcttatcatatgccattaaaatttccaataaatttttcctgttgttaccgctgcgaaccccattgaaaccattcttttttgaaaagttgatcccaaaacggcaaaaatttcagaaaatgcctgtttttaacaatttttaaaaaaaatttgttttcggcatgtttataactagagttgagcggtaatcggtaattgtaaaaaaaccggtaccggtactgaccggtaatgcaaaaaccggtaccggtaccggtaccaactttttccaccggtaccggtaccggtaaaaaccggtaattttccaacgtaaaaatttttggacaaaatttttcaaatacaaaatttttattcagttttcgcgcgagtgcctgttttttagcattagaattgttcagaagtaatgtatattgagggtgaccaagttttttttcaaattcaggataaagaacactaaaattcagatgtagacctcaaaattcagattattgcaaaacaaggggtcagcagccaattttccaattttgcgaaggggtctccggccatgtaaattaatgtaaatcaatgaccttttttgctttcaacaccgcttttttcgcggcacgtttttctcaagactttttgggaacaaggagggctggcggtgtcgataggcgccgccgggaaaaattttgtattttttaatgcgatttgttaacagaatttgcaaaaaaaagaccaattgattaatttttgggtttttaggatgcttaaaatgaaagaaaaaaagttggaatattttttttaattaaaatttcaattaaaataatggtaaagaaaatatgaagaatattctatccccagtggggaa

SEQ ID NO: 11288 - DNA, 1672 bp, Heterodera glycines
accaaaaaaaaaattaaacctctaaagtagttattaagaaaaaatcacaaaaatttagacttttttgcaattttcagttacaacttttttactaaccgactaatcgataagcaattccttagaaatagcttctaaacatgttcagctttcgaatgataccaagattgttagatttgatcgacaacaaaaaaagttatagtccaaaaacaagggctggcgccgaaacggcggcgccgaaacgatacagaccctcttaccagtgcaaatttttaccggcggtaccggtactagacaaaccggtaccgatactttgatttttgaaaaaaccggtaccggtaccaaaaaaccggtaattaccggtcggtaccggtaccggtaccgctcaaccctatttataacaaatttttggcttttttaacttttaaaaacatttttattatatatttatatataaatataatatatatatattgacattttcgggatttacattgttgtcgaagcaggcgatgaagaaaatgtcactgaatggactattttcatttcgcttcggtaaaaaaaaattttgagacgtaagggctcgggagccgacaggcttttaccggaccgcctgagcccgggcccggtaaatttttaaaaataccgacacaggtcaatcggatttttaccgggcggcccgaggcctggacaattgtctaagtccgaccctggctcggcaatcccaaaattaatgtcttggtcttgagaaatcactttcaaaaaatgaggaccaaataacggaggcgttcaatcatctgacatttgcttttgtccaacttccagctcaaggagttgtaagcaattaaacttaatttacaattttattttaaataattttaatgcttaattcaaataattattttagaaatatcattttcttatattaaatgttagtttaaataaaaggttataggacggacttcgcttggttacctttatgacaacataatgtcatcattttgtatatatgaattaagtggattagatgattgtttgtggatttccaatttatagttttgtttcaaaattgaagatcgagtccggcatcccgagtgcccttcccgattggcgctggaaatgtgccaaatgcccttcggttcgccaaattctggctttatttgatcagcatcgagcgaataaattttctaatgtctaaaaacacaaaatttggttgacttttgtttataaaaattaaaaaattgatcttgcaaataaatttcacaatttatttagaataaaactattttataattaaatgggggaaaaaattaagttgctcatcaatcactctttcatcccgatgtagtcttaaaatttttgaattttttaataaaaaattctgctgtatatgttggactatcttacattctacaaatttttcaagaatttttatggtgttaagacttaaactctttattgtattttttttgcataaaattttaaattagaaaaataatttttttttccataacggaatcccattttattaaggcaattgtacaaaagcatttttggaagggtcgtgggtgcgagtcccaccgcggatcaacgtttacacttcgccatccaccaaaatctccacaattattccctgatatctctaatctatgcatatatacaaattactatcact

SEQ ID NO: 11289 - DNA, 1467 bp, Heterodera glycines
tagagagagaaagggaatgagaaagagagatgctgcacgcattaaatgccacgtttgatttgtgccaaaaaatggcaatttaagcgcggcgaaaagaaaaaaatcagaatttaaaaatcataaaaattcaaactcatcaaattcactcaacatcatcaccaaccgtgaacattatgctgaggattgctctactgatctccattttggcactgtttggtgattgcatggacaagggaaaaagaaaattaggaggaataagtaaaaataaaaatacaaatttatttatttatttatttcgtaaaatttaggtattaatgagccaagtgaatatagaaccaaagaaaaagaagccatcgcaacaagtaaatatttgtaaatcaaaagtgaaattttaattaaattaacatgaatttaggcagaaaaggcaaagaaaaagtcggcgaaaaaataagtaaacatttaaataaataaattatttttattatttatcatgtataaatttaggcgttatgaacacagctgaacgcattgaaaaaatgggtaaaataaaaaagataaaaatttaaaattaagaaataccaagaaataaaaatgaaattaaatatattaacattatttacacatatttagacattgcccaaggcaaagctaaaatgggtaaaattatttttttaattttaaataaatttttgaaaattaaattattattttaatttacacagatatagacaccaatgtcaaacccaaacaaaatgaggaaaatggtaaaattattaacggattttttaataaattaagaatttttgtttaattaattgtataacaccttttatgaaaattcaaaaattagttagaattttcactaaaataagggtcgcgtttttgcaattttttgaattgacattggccgtcggcgccgaaaatgtttttgagtaatagattttgtcaaaaaggggctattttttatggatttcttgaaatttatatcaaaaactctccaaatttgtcaaaatttcaggattaataagtataataaagttgctacattccgcaaatcacaggttttaattatccccgctctccctgttccctggatttgacaagggaccccccccccccgccccggctacaatcctagctaaaatcttaaaaaaatcttttgtctcaattctgtcactattatttaaattagggttgctccccgacccctcggggggcaaaatgtcgggggccggggaccccggggggcgacatgtcgggtgtcagggcggggaggagctcaattgtcgggggtcggggaccccgatcgtggaatgaccaaattttattttaacccaaaaaaaacattttttctttttaaatgctcgtaaatcttctttttttcactttaatcatctaattttgttagcgccagtaagagtgagaccaagctgctggcctttaaacctggggcttcccaattgttct

SEQ ID NO: 11290 - DNA, 2650 bp, Heterodera glycines
atctaattttaaaattaatcttagtatttaaaaaaatacttttcaataatttcaaattctttatgatggttatttttcaaatatttttcagtaggaaataatctcggtttcgattaaaaaaataattttttttttataatttttgaattctacgaaattaattgagttttaaattctcattctgttggatagtgaataatttgaatttatggcgatctgacttattgactttatttgttatttctatgtccatccgccccctccctcgtccataaaagtggacacctcctcccactttttgttcttccctttcatcattcatttatttatatttccaatttgccctccgaccgaatcaataaaattatttatttatttctttttctttgtgtgttctaagtggaagaacacaacaaattggcgcagtcagcagccattcttcatcactgaggacaaggacagctgcaaattcaacaaaaaccaatagcacccaggtggtgtgaggtctgctaagaagcagtttaactcaacaaaaaaaccaatagacctaagaagggtgaggttccgcaagaagcggtttttcaacaaattcgtcagcttagcaccaagacggtgtaagcatccaccaggtgtggattttgtggaatttttcaacaatttcaattgacggacaatgaacgccgaacaaattcagcaacttttgaccgctttgctccaaggaaatgccgcttcaagcataagccaagcgaatttggccagctcaatcgacagtagaatttcaaagtttgtttatgaccccgagaatggtcaaacatttgaacagtggcacaaacgcttcggcatattgattgaagaggatggcaaagacttaaccgagcaagccaaagtccgactattgttgggaaagctcggagacgaagagtacacgaagtacagggacacaatcagcccggagttgcccgacaaaccttcgtgggctgaatcaatcaacagattaaaggagttgttcgctgaaacgcgctctcttttcgtccgccgatatgaatgctttcgaatcagacagcatccaaaccaagacatcagttctttggttgctcaaatcaacgcagcgtgtgagcatgccaatttgagccttaccaaggaacagctcaaatgcatgattttggtgatttcactgagggatgaacatcacgatttgaggcagaaatgtcttaaaatgatggaagaagccgagaaaagtggcaccacagtcacactcaaaaagttggaagaggagttaaaagcgatccaaattgtcaaagatagtgctttgtcactcctttccacgccagcttcgacaaatgccatccgaactcgccctcaacagtggagagaatcaaaaaccaaggccaaatcagcaaatgccgtgcaacaaaaccacccggcacagcaaaaaccggccacaggaggaaaagcaattcgtggacaaccgacccagccgtgcggctcatgtggtggtactgatcactggagatcagattgtcgcttccgagaagcgacatgccacaagtgccaaaaacaaggccacattgctaatgtttgccgaaagggagcattcacgacaaagaaccaacgccgttcatttcacacggtccaagtcaaagcaacatgcctacaaattggcacgactcaaggacggtggtggacaattttggtcgaaattaacggcacaaaaatcgaaatgaatgtcgacacaggagctcaggcgacagtccttaccattgaaacatggaccaaattaggacaacctaaattgttgccaaccgacattgagactcgcaactgcaacgacgtcacatttaaaacaattggcaaatttatatgtcttgtcagcattgtgggacaaccagccaaaaagctaacagcttatgtgactgaagagctcaattacgatttgtttggtttgccatggattgaggcaacggaactgattcccaaagaaatcatgtttccggagacgcacacatcggttggaatccgcgcatcatctgccgcacctttccaagaaatcgccgatgttaagtcactcacgacggctcttaaagaaaattttccggatgtttttggtaaagagctaggacagtgcaccaagattaaggcacacttgattcttaaatccgacgctcgaccggttttctgtaaagcccgacccgttcctcatggctcactggaagcagtcaacacggagctggaccgcctcttacagatcggtgccattaatccgatagaatttagccattgggcagcacccattttggccgtcaaaaagaaaaatggcaaaatcagagtgtgcattgatttctcaactggcttaaacaatgcacttgaactcaaccgccacccactccctcggcctgatgacatttatgcagccataagcggcgctgcatttttcacaaatttggacttaaaagacgcatacctacaaatggaattggatgacgaatccaaacagctctgcgttttgaacacgcatcgtggcctttttcagtgacaacgtcttccatttggcgtcaaatctgcaccgacgatttttcaacatttgatggatcaaatatgagctgcaatccccggagcatttgcttatttggatgatggactaatcgcgtcc

SEQ ID NO: 11291 - DNA, 1796 bp, Heterodera glycines
aaaattttgcctattttttaaatatttttcaaaattctttttagaacattttcttgagttagagcgaaattcccggctcttaataagtaccgaagtcccggttctccgtgccctactgtatgtacaaagcaaaaaagctttagaattaatgaaagaacgcatttgtcgtctgtggtggtgatgatttgttaaataaagtgaagatgagaatgaaaaggcggggaaaaggaggcgacaacaacgaccttcgccacacattcttggccatctgtgctgtttgctgttggctgtgtcctcctttaactctcttctctccgttgttgggaattaaaacggaaacgatggacgtcgtcagtcaatgagagagagagagagagagagagcagagaaaaaagagggcgaaaaagagcaagggagaagggaaagagagagaaagtgggtggaaagagagtgacaagaaagagagataaagcaagagagagtgaggggaggagagagtgagaaggggagagagagagagaaaggccggaaagagaaggatgatgaatgaaaagtgagtatgatctaatcaatggcttttcttcttggagcacaaagggccttgaaatccgatcgattaaccataaatcagccctcctccgcaaaatgaaatgatcgaatataacattttgcctagcgtgggggcagcgcggctgctaattatttttttaatcctggatttggaccatttccttatggcactttccgccgcgcggggcgtaacccaagtgatgaatcggtgtgaggaagccaaggccagcggatttctgggtaaatatggataaaaagcaaaaagcgctatataaatttccgacaaacaagagccctcccttttgggaggatacgcaaaactcacctatcccctgataaagcgatcaaaaaagttttatcccctgataaagcgataaaaaaatgccaaatgggggagggtgtcaaatatttgttcaacaaaatttcccatactgtagatctgtctgactgttcactgatgtacattgcggacgcaatttacatggttctgcgcggttgtcagatcaaccggtgcagcctcaaggacaacaaattgaagaagttcccagtcaaactggtcacaaaattcccggacatggatggcatgcaaaaactggacaattgggatccaatttaaacagggttttgttttagtgatcaatttggaaggcaatcagctggctgagttgccgccagagattggccaatggggccaactgcgcggcatcaatgtggcacacaatcggctggcacaattcccggtgccattgtttagctgcaacgcattgtcgttgctggacctaagcggcaatccgattgagggtgggtggtccaagtccaatttatttttcaggcaaggggacaaggtttagtggcagggctggacacgtaaataaatttcaattacggaaattcgtaacccgtaattacggggggagggggtctaaaaatgccataattaaccataagccgtaattgagttcagcgctggagaaaatcaaagaaatttgatttgaaaattcggatgcggtaaaattgcatttaaattcacgctttttccagacattgacgccgatgccatccaccgattgtttcccgccttgaaacaactgcatttacgcgagtgtccaattagtgaagcgaaaattgaggcgctccgcatcaaaatgggcacaaagtgccaaattatcgaccaataaatgaaaaatggcaattttagaaaatatcggaaaaattttttttaaaaa

SEQ ID NO: 11292 - DNA, 1822 bp, Heterodera glycines
atcattagtggtggtgaagacggtgttcatgttgattttctttgtccagtgagtgttcgggttgctggaatagcatcattaaaaacaatttccaaaattatataaaattttttaaatgccagccaacccattttgtttgaaaatttaagaaaattttcggtggaaaacgaaaggctcccaacccgctcacccatatttggcaaaatttgtgaagaagccgccgatgatgcgcatcatttgcttgtcatcccaattcggtcgaaatttggcgtacaaacccttgcccagcaaatagcgcgcgtcatgacaatgggtggcagctgaggggggggggggaaatgctaaatttaacacaaaatttttggatttttaccgaaaatcgattttaagaatttttttttatttaaacaatgtcgagtgaatcacttgtccggtctctaatactaattcatacccgaaatatgaaaaattcataattcaaaatttaaaaaaaaatcataacaaaattttaacaatttccaaggtttcgtatggacgtacattctttccgaaattccccccccccccaaaatgccaaagcatggactaaaaacggaccaaaaaatggcattcgaagtccgacaatgccaaagccgtcccggttgtagtgcatcatattgtacaggtaaatgcgatggttgagcgacgttttgccggcaaacattccgcgacaataccgctgcaccgcattgttcatcatcaggtcactgtgcatctgttaatgtatttttacaattaccgtatttgctaaaatacagtacccacacgcctaaattaagtgatacacccccttgaaataaaggaattcgagttaaataaattaattattccctattcgtcgcccaagaaaaaatatgaaaaatctgggcgctgatcggtgatcacaaatagaaatttttcaaataaatttttgtttcaaaactttgatgaaactactaaatttaaaaaaaaatcgctgaaaaattttcaaaaatttctttcttgaaatttcttataaaaaaattttctagatttttttttgaaaaatttctaggtttgaaaaaaaaatttttttttggggagggggggggggggggtgaagtgcacgctctcctctgctaccttcaaaaaggcacgggccatttgctgttgttgtggttggaggtggtggtggtcctccgcctcctcctcgcctggccccatgccattgctgttgtgtgtgtgcacatacagtgcgatgcactgctcgcgaagctgttccgcccccgcaattgttggcggaatgtaaatttgcaaatatttacgcatcgacacgacattggcctgacgacggccaagcgcagctgttgagacagagagagagagaggagattgcattgatggaattattgggcaaagtaattatgtaattaattggatcggaggctacctacctaccccagggacgggagggaaaattaggactttttcgagttcagcatgttatgggcctggattgacaggataccatcctgctggttggtacacggctgccatgttacagagtgcaagactacgatgcagagggttgtagatgcaaaaaataaacagaaaatgttttctacctgttagaaattttgtctattattgtgtttataattgcgcggccataaatgtttctagaaaagtcgtaaaaagaaaatgttaaagaagctctgcggtgtctgcagtgcggtcttttatttatttttgtttttggcattttgacattgacccagtttccagcaattgtcatcgtaaacattgtatccatccatgtctcaat

SEQ ID NO: 11293 - DNA, 1492 bp, Heterodera glycines
ttatttcgtttggtccgccattgactcggccattgccagcgtcgcccattcgctgaagcatttggaggacggacgccaactgctggaccgttttgagcactttgtgtgctcagtggtggaacccgtggcgaccaaattgggctgggagcccacggatggcgaaggtccgttcgggtcacgtcacttcatacttcatccccccttcccccgctaaaattttctaaaaaaaaaagattaaattttttagcaattttttggaaaaagtcagtatgtaagtcatcataaaattaattggaaaaattatgaatatttcttttttttcattgcaaaatattcagcgccggtagcaaaaagaaggaatttgtaaaaaaaattcttgaaattttcattgcattttttaatttttcaggggtatgggaaacgacggagggatataatggaggggaaacgacctgctccgggaatttgtagctattttttgtcaaatttgtccatgttttcttaaaaaatattggcattttcatccccccccccctgggccacgggcctgctgccccacattctgtcccccttttttagacattcatgtcggccgtcttcgtgccctgctgctcaaccgtttgtctcagtttcgccatccgccaaccgtccaaatggcactgtccaaattcaatgccctcgtcgaaaagggcgtcgaagttgtgccggacttgcgcggactaattttccgtgccgttggggcgacaaatgagccgaaaaacattgcggcactcaagcatttgttggagacatccaactactctcaagtggagctgtcctgcatcattggcaagaacaaaatttggggctgacacaagggtgcaccccaaaatctcgccgtcgaattttataaaaagcctaggcctaacctaattgtaagcctatgtgcgagttggccattacgccgatttttttttcttgaaattttcttataaagaaattttggaactttcttaatttacaatttagaaaaaaaatcggcggcgacattttgtcccgtccccctcacacaatgccatggatttgcatgggcacaattcatgagtatcatggtactataacgtattcccctcttttttcagcgcttggccaatgctcggacttgaaaatgctcgaggaaattttcgactacggcgccgtgcagggcaaaatccgggaccaagacctggacggactgttctcgggcgcgcaaatggcgccgatggtttgctgccagcactttgcctgggacttcttcaagaacaatgtcccgctgctgctcaaaaagtatggctccgtcaacaacaccatgttcctgcactgcatacaaagcacggcttccggcttctgttccagtgccatggccgacgaagtgacggtgggttggggcgagtttggcaggtgcgcttcattcccccccccccccccccgagaaataaaaaaaattctactaacttagaagtgtcaaggaaaa

SEQ ID NO: 11294 - DNA, 1683 bp, Heterodera glycines
actttcttaatttacaatttagaaaaaaaatcggcggcgacattttgtcccgtccccctcacacaatgccatggattggcatgggcacaattcatgagtatcatggtactataacgtattcccctcttttttcagcgcttggccaatgctcggacttgaaaatgctcgaggaaattttcgactacggcgccgtgcagggcaaaatccgggaccaagacctggacggactgttctcgggcacgcaaatggcgccgatggtttgctgccagcactttgcctgggacttcttcaagaacaatgtcccgctgctgctcaaaaagtacggctccgtcaacaacaccatgttcctgcactgcatgcaaagcacggcttccggcttctgttccagtgccatggccgacgaagtgacggtgggttggggcgagtttggcctgtgcgcttcattccccccccccgagaaataaaaaaaattctactaacttagaagttgtcaaggaaaagcctagagtttttttataaaaaaatctaagaaaaaatagaaaaatttttcagcgattttttagaattttttgaaaaatcttagtaattccccacaagtttttcgaaatttttttcttctacttttttataaaaaaaactttctaatattttttcttgaaaaatttttaagttagtaattataaagaaaatttctcgggcggggggaaacgacggaggggaaatgagttgctcccgacactgagataattagcaaaatttacgaaggtttcttgatggtcttctccaaaaaaaaaaaaaaattttaatatcaaattaaatttgaaatgcaatttaggcgtttttcgagaagaatttcgacgaacattcgctcaaaattttggatcggcccctccgtcagatcgtcgagtcaatcaagatcaaagagagtctgctgaagaacaatgcgccggatttggagaaatatttaaccgaaaataggacggcaattaattaattaattgttaatgaatggccagcggcggatattattttattattattatgtgtattgatcactcatcatttcattttgattgttttctttttttgttgatgaaaaaattaacatttatttcactgctttcggctgttcgacggttggcgatataaaatgcagatttcttaacctaaatttgaacaaaaatcataaaaaggcgctggtctccccctttttcgaaatttttttatattttcaaaagtaatgaaaagatgcttccaaggcttttcgggatcgctgataacggatccggcatctattttggccaattccgaatcccagacccgaattcggtacttgtacagtttggaccacattaaaattttttgttttaatgataaaatgagttttcaagggttttcggggttgctgatcacgaatatgacatccatctgaccaatttcgaatcctggacccgaattcgaacaaaagtcgaaaaaaatgttcaccaaaatccacctttgtccaaaatcgattcaaatgcatgaaatggccgtgaatgcctattttctattcaatttagtgtgcatttgaatcgattttggacaataaaggtgcattttggtgaaaatttttttccgacttttgttcgaattttggtccggggatcgaaaattgatcggaattaatgtcatattcgtgatcag

SEQ ID NO: 11295 - DNA, 1078 bp, Heterodera glycines
gagcagcgacacccgaatacgcctggaaaacacgttttttaccagtaaaagcaaaaaaaatctttctatgtggtccaaactgaactccgaatcccagacccgaattcgaacaaaaaatctaaaatacaaaatgttaaaaatgctcgcttttgttccttctatcgaatttataggtagtttagtttgaacatttgtaggaaaatgccggcgttcaacggcatcccaaaaacaatcgttttctctgcgattttcgatacgaatttaagatttttgcaacaagctgtaatggggtaaaaaaaactcaaaaaaaaaccatgttgatcattccaacaataaaacaatttttacgaaatttcatgattcaaattgatcgatcacttctcaacaaatttatcctaaagacataaatattgtataacacaaaacaaataaaagttgatcattacaataatatgggctcaaattcgttctccaactccgcaattcaattagatcgatcagttctcaacaattgattcattcattcacttctgctgttgatcacttgggccgggaatttcgtcgagaagcctaaaaaagtgaaacataaataaatttggatttattgaaaaaatattcgctgacccatcgccgatgtcatccacaaaaataggacaaatgctaattcgattccattgaccataactttgccataatgtgttaatttgtttgcgataatcttctttgataataaaaggagggttcgaactccggcgaagaatcaaattaattagtaattgtccgctgcggccatttccgtccccaaaagggtgcaggcggatctattggtataaatgagttagttacttgaaattctctcaccccctaggccccattttaactaacaaaacttaggaaggcttgtgcagcaaatttttgtgtaggcagattagtggcatcgcataaattcatccatttgaccaactcttccactccgtccttcactttctctcttttcactccactgaaattcattccctccggctcatatgccccatactcggcgacggaatcttccaacccaaacatcgttctcaaa

SEQ ID NO: 11296 - DNA, 4171 bp, Heterodera glycines
tgtctttttgctgtacgcttgtatcattatatcgaccataaatgtgataagatgtgtaaatgcgatgcatgtttcgactttgttgtccatttcaagtcgtgcaataattgctacaaaataaaatgttacagtaacagacaaaataatttcgtgattcatgtaaatacatattaatttgaaaaaaaaacattaaatatttggcgctaattaagaaaattgtggcttttgattagaagaacaaaatattttattggattattctgcaaattcactttttaagtcaaattttaaaaaggcgtaaattaaattttacaataattaatacttgcataaaattacatcaagttaaattttctaattcattttaaacccatattttatatttaaaattctcccacctaataattgttgttgaaaaaggtccataaaatgttgcttaagcccatactgggcataatttgcatgcatttcgccaagatgtacacatgcatcgtacattttatcctcatccattttgtattcattgatcagtttatcgaaaaacttgaaaattgcctgactaaaaattaaataaatagataatttataataaacttttatatttttaaattattatcatttaaaatattttagaatttttggcattttcaatttgattttcataataaataaatttaactcattaagaaaatatggtatgaactttgggtataacttattaaattttatatgtttagaacgcaacaattttgtataaggtcatatatatcgaaaaaggcaagaaaaactatataaaataaagtttactcgctccgatgggactcgaacccacggcgcccttccataccgtggaatgctctacccgactgagctaagggcaactcctctaaggggtcctcccatgccctttatccgactttctcccacactccaattccttctttcaccacatcaaaagaaacatttttttaaattgatttttattaaccaaattctgttaagttttggccattttgtcaggtctctatagcaatagtggccgcacgcgataatttcgttcatctttgggctcgcatgaatgcaataatgcattgccttgtggaacagatcgcttcgacttgtcacaatgttattgtgccaacacaaataaattctggtaaaaaaaaaaattaaaaaaacaatattatattgatgtaaatatttttttctaaaaattaatgagccaaaaattcttcaatgccatgattaattaataataaataatcaaatatatttttcttattatttgttaaactaataaattgacgtacaattctcggtcttttggcgacaaaaaattagtgtccatcctccgttcaggcaaaacaattgcagtttctgtccttggtttgctgagcatttttgtcagcgttcgtttgttaattaattgtcgtttgacgaggatcgttgtattaactaaaaaataattaattaattttaattaattctttattttatttttattactcggccgacgcaaaattgcgacaaaatcattggacggcggcgaaattgtttgttctcttgttgaatcagaaattaagcatgaattgcccattttattttaaagatttgtttaaagctaaattataagaaaaaaatttatgccgattaatcaattcaattagtaacaatgtgattaaaactcacaaaaattttaactgtttaaatcaaggttgtgcaaaattattgtcatcttttcgagactcgacctataagagtcgaaaccgagactacaaaaaatgccaacaaatttctgtagtttcgagtgtagttgggaacaaaaataagtttttaaaagtgtccaaaaaaaattttggttcgcattcaaagaaataaaaaattttgtcatcacggtagtgacgagtaatcccaataaattctgagcaaattgttaccaaaattaacactaacttttaacaaatacaaattttccaaaaaaacttctccccccacccgctcactgcttataatgggcctaggggttaagcctgaattatgagactattgcatttcaattaatgcttcaattctcatgtgttttaaataatctgaaattataaaatagagggttggcaattataatttattcccaaaaaatgaaaaaaaaatttgtcctttcattttaatggctaaactcagaagatgggaaaactgaattcaatattttgtacttaatgggaaaagcaattaacagtaaattatttcattcatttatgtatgggaaataattgttagcgaaaaattaaaattatgaaaagtcacatttgtttaaagaatagcgcctttaaatgtgggaaatcagtgtgaaatttgataaatggggaaagtgaccgaaattaaaaaataaaattaattttaataatgacaattcaatttgataaatgcaggttaacatcggaaccaaaggtagatgaccaaatcaaattattaattattcttgaaagattgtgtaaataacctaaatttgcatcaattatgtatagatgagtgaattattgtttaaaaaaaataaataaaattgttaaacggaatttttaactcaaatcgaaaattgttcggagaaaatgctatttttgggcttctctcgtcataactaagcgcaaaaaaaatatgtaaaacataaaaatccgttctcgacttataatggctgatatcataatttaaattatgtaagaaatttaatttttttcatttgaaataaaatgttttataaaaataatagtaaaaataaaataaaaaatttttaaattgatcaaaaagcccataaatgagagctttttctattttgtctttaatctattttaaatccaaaattacatggaataattgccaattcaattaatgcttccatttttgttgtgaatttacatataaatatatcaataatttaattacgcacatgaatcgagaatagaatcatttttaaacaattgaataaaatagctgaccatttattctttcaattcaattattgaaaaagtcccaaaagggggaaccctttggtttgaacatttgaaatttgaaaaatgaataacttggcttaaactagttcaaccggtataaactttttttcttaggctcgtaatgatataataaattatttaaaaataaattcaaccattggtgcacgttttgaaattgtggcatttatgcccccgaaataattttggcgcctagttttagcaaatctatgcgcccgctgttgattttttaaaaaattctaatattggccatataacggaaaagtaccaaaattttaaaatatcccggctcatagtactcaatgaatgtgtaaacgtttcgggtgagtcagaatggcataaatgatcatccataagcaaatcagcatttaattgaataagattgtttattattttaatttaaaatttataaatttaattcaaaacaataccgttttatttagcatttgtttacaaaatgaaaaagattcgtcattgtcaaaacttttttgtttgaaattcttttaaaacattttcgaattagacattgaaaatttggttgtaaaattgaaagttcgatttagtggcggtgaaatggtcggcggcgaattggactctaacccgctaaatgagcgccatttctttcagttctctttcaaccccttctcaaaagccagcacttggccacaaaatgaagtgccaatgattgacaacaatgctaaaaataaatgtttattttatacgaaaagcatcaaaaaaatcacaccgattccaagcacaacaataaatgacgagtgcacaatgtcggcacaatcacttccaatgtccgaaatattaataggcacaaatatctcttaaatgaagaattctgatttaaattggataaattttctattcccatatattaatcatgattgcgttggaatttataagtgagatacaaaaactataaataaaaaacttttttacatatttttcaacaaaaaaattactaaacttttagattatcgaattatatttttttgcacaattatgaacacgtttggcacctaaaaattttataccgaatttggcagcacttaaaaaatgaatcccaaatttggcacttttggaactaaaaaatcgcattctccattaatcaccaagcttctgctctacaccatttttgc

SEQ ID NO: 11297 - DNA, 2738 bp, Heterodera glycines
  misc_feature (51)..(51): n is a, c, g, or t
  misc_feature (165)..(165): n is a, c, g, or t
ctctccttcgttgtggctttggttgttgtcgttggcaaatccacaaggganatccttgtttcccgcatatttttcccgaaatagtgcaaccattgcatttgtaaccgccattcccatcgttcaaataactttggatctttggtttgagaatctctacatccatcntgggtctcccagttttttcctgacaaaaatctattgacagccaaagtgccacagttcggcacacgatttagggttgtcataagaattgcatgaataataggtcaaataacgatcaccaccatcatctgaaccagagaagaatgatgtcacccgattttggaaattaaaaaatcaatcaattaaatggaaattaaataaataactttttctctgtaaatgtttccattgggacaaaatttctaaatggaacaccaagcagaagaaagaaatcttaaacctcaatttgttttgttttttgatgtacaggctttatttttgggttcatagaattgccatttaactacaactccgtcactaaatacgaaaaattttaaaacacgtatataagtaaatttttctattcaaacggccataaacattcacaaaaggacctttaaagcagtatgttgtaatgcaatgctgatggttattaatacagttcatcaatttgtcatgatatttgtgttccaacagtgtgccaactttatatacgcggcaacattgggcttcttaaagaaaacgtattttttcatttcttaaggtgttgagagcaaattcaaaaaatattaaattttgttaaatttttcaaaaaaatttttgtaatgaaaaaataataatttattttatacaaaattaatttgaaaacgctattttttaattcttctaagttgacattttttaaaatttatctaaaaaatagttgttagcatgagttctcaagaaaaatgaagcataacagctcaagagaaaaaaaaatcgtcttaaaccgggttttcttaaactcaaatcattatttttttttaaattataataatgaattttctaactctaattgtaattaataattctataggtttcacttttttcgcttttcgctttttatttttctctttgcaacatccctgtaatatacccacttccgtaacattcgttttcaatgctttcaataccaatggtgcagagcagcagaaacagaagaaaatagttcattaagaataaatttttattcttaataaaaagaaataaaataaataaaatatttaataaaaatttgtgtttaactaatgaaaatctgtctctgttttttgatgttagcacagttttgtgttaatgaattcataaaaatgaatggtatgaataatttacttacagtgaatttattttttttattttttcgcagaataattatctgtcataattaacaaattgctggaattttagcttacttaatgctaaaaaaagaatgtgaattataaaagtcaaatcttttatgaatattaattacaaaaaataaatgaacttattattttaattgatgtctaaataaattgagttcgaattaattatgttctaaattaatgatttatttcttattttttcacattctaaaaatattttttgaacatacattttttttattaattttcatttaaatattttaattattaatccttttaattcaataatattttgtgttttaaccagttaaagtttttttttttttgcattttttaaatttattgctctgtttttgttatggtatgatgttaaagttgattatggtatttgatcaaaatatttcttaatgttttttctttcgtcatttcgtcgccgtacttttcttttcacttcctccaattatttctgccatttgacggatttgcacacaaacaccaaaagggcaatgatgccttggacaaacagaacgccaagaacagaaaggacaacctgaaaaatatttgattgttatatcttgcacaaggaaaagcaatgaactgaatggtgtttaaagaaatttcataaaaaaacagaaggccctaaaatttgtttatctagaaatttgtctaaattcgggaattcgaaatagcattttgtttttgaaataatttgaaatagggttaagccccgagccctctggggcaaaaagtcggggcgtggacctcgggggacgacatgtcgggtgtcggggcggggaataggcccaaaaatgtcggggatcggggtcggggaccggggagctcggggtcggggcttaaccctaatttataccattatttatcgaaaggctgcaaaattatttctttttttttataaattatctgattgggtaaaaattataatatttaataggtgaattaaaaatgtaatattttaataataattttattctcctgtctattttctaaatcgttctgggtcgttcataaaatgcgccaatttatcaaaattttcgacaaaacatggcgcatatgctatctagaaaggaaaacacaacggtttgattgtgataaacctttttgtaattgtttgtatgaagcttttgaatgcctattgacaaaagtttttgtctttactgttattttaaagactttttcatgtttagaatctgttatgctggttagtttatatttttggaaaaaattttaaagaaaagtgaaagaaggatttttgttggatatttctatattgaaatgaaatcaatattttaaatttgataaataaaaataatgtttgtgttaatttattttctatta

SEQ ID NO: 11298 - DNA, 2304 bp, Heterodera glycines
  misc_feature (2266)..(2266): n is a, c, g, or t
  misc_feature (2297)..(2298): n is a, c, g, or t
aaatgactggaagagtaaataatacaaatattagcaaatgctttaattataacaccgtcatggcccaacgaagaacccatcgtacacattgttttactaaaaatgaaagaaatgaaataaaataatcaatgatttttaatattgcattaaaaagttgaaaataaatttaatattgtcaattaattaagaaattaattaattagctaattactcgtttggttgcgccagtagatttgtgtacaacaaatagattgtgtataacggataaagcacagaaagaatgaagagaacggcagaataaaatttggcatttctttttctatacctaaaacaaattatgtaaataagataattaatatttctttattatgacaattaaaacaattattattatcagtttaaaaactgaccaaatgggaaagaaaacgcaaagcaaacgatcaaagccaatggcaaacatcaaagtgaagatgtttacgagaaaggcaaacagaacggattggaagcaaaaacatgtggaattggagaagaagcttcgctggtcggaggagggccacaaaagcacagagagagggaggaaaagctcaaaaaagccgaaaatgctggacaagcgttgcaaagcgatcagaatgtgacaagcgttgtgcaatgagctaaaaatggaaaataaataaatacattaataataaattaattaaaattgataaccgattttttatggtcgtaattattaaaaaagtttcaaaaacaatgccacaaatgttaacaaaggcgttaatggagaacatcaaaagaagcgggacagaatgttttgattcctttaggaattgctaaaaaaatatttatttttttaaaataaattaaatgcttaccaaatccaatccataagattcagcagttgttttttccattatttttttttaaagattcgatcgcttgcttgaaaattttttttaaaattaagcgttcatcataaagcaaggaaactcagcattatttatataaacgtttttcatgaaattgttaattgcatttctttttgcgtgcccacgcaatggttagcaaatctaaaaagtgtaaatgacgtaatatttatttaattctatttaaatttaagagtagaataaaaccataacttagctcaaagttaataaaattaaacaattttggtattgagccatagaaacgtcattaaatttttatatgaccataaaataaaacgcatttaataaaattaaataattataataaaaatttaaatgttactatcattgatattttgtaggttcgataaatttgtctgaagaatgtccatttttagtttgaacccaagcattacgaaacggcactttaaaaaaggcaacatactaataaattttaagaatgaaggcattttccgttttgtggtcaaaaatgaatatcgttagcattttaccctttttaactgagtgaaatttaaattccgcggttcaaataagcctatcttaaatagtcaagtaattatgttctcattaatactcttttaaaaatgctaagtcatttgaattaaaccttcatttggcaattccatttatataccacaaatatgatacctttttaacaaattctcattaaaagataagctcaacagtcattattttatacaattttacaagacaaatttaaacatggcaattaaaaattatttaatatttcctgtaattaaaaggaaattcttgacaaaaaaaaatcaggaacgttctatttaaaattggttcaagttgaggtgcaatattttagaattgcatatcagcaatttgcacttttcttttaatccatttttactttgttttgatcaaatttccctataatttcactttttcattgatcacccaaccaattttatcaaaataaattggaagtattttcaattgatcacatatttgggtgccaatttgtcctcgtcgctttttgatcaatttgttttttattaatgtttagcccaatgactccaattttgcgtgcatttccttttattgttttgctttccttcttttccttccttttttgatatttttttacatatttttgaaaattttggctattttctgtttttttttaattttctgtcagtgaattaacagaaaataataaatttagttttctttaaaaaacaataaaaatgacagggaccttttaatgtttttttaaaattgagcaataaaaataagccatgaattgtacaaatgcatttaaaatgagttttcatcaccgctttttctccggnagatttaatttttgccaatgaaagatgcctnntggcat

SEQ ID NO: 11299 - DNA, 2262 bp, Heterodera glycines
  misc_feature (155)..(155): n is a, c, g, or t
  misc_feature (169)..(169): n is a, c, g, or t
cattaaaagataagctcaacagtcattattttatacaattttacaagacaaatttaaacatggcaattaaaaattatttaatatttctgtaaattaaaagaaaattcttgacaaaaaaaaatcaggaacgttctattaaaatggttcaaaagtgnaggtgcaatatttnagaattgcatatcagcaatttgcacttttctttttaatccatttttactttgttttgatcaaatttccctataatttcactttttcattgatcagcccaaaccaattttatcaaaataaattggaagtattttcaattgatcacatatttgggtgccaatttgtcctcgtcgctttttgatcaatttgttttttattaatgtttcgcccaatgactccaattttgcgtgcatttccttttattggtttgctttccttcttttccttccttttttgatattgttttacatatttttgaaaattttggctattttctgtttttttaaattttctgtcagtgaattaacagaaaataataaatttagttttctttaaaaacaataaaaatgacagggaccttttaatgtttttttaaaattgagcaataaaaaataagccatgaattgtacaaatgcatttaaaatgagttttcatcaccgctttttctcccgagatttaatttttgccaatgaaaatgccttggcattccgtctgctctgctttccttccgctcaaagaacacgcgaaaagtcggggccggccaggacggccgcggttggactttccgcctcctgcctcagcagtttcggcctgtccgactccatgcgacccattcgctccaaatgttgtgccaccacttgccacacgcggttggcacggaccaagccaatcactttttggatctcgggctgcaagaagcggtcctgctcaagggcactggcaaaagggcagagatttgagaaaattagcctcaattttaaagaaatatatccgtattttcaatatttcgggggattttaatgatcgcaaaaaatggaattcctccccaaaattattacggagaaacgctgcggacgaggtcgtacactttttgcaatgcgtcggtgcttttcaatggcttcagaaattccattccctaaatttcgcgtaaatactcaaatatcattcaaattcattgtggggttttcattattattagacacctgacaagctgccatcagttccatcgcaagcactaaaaatggggtgattaggttttatttctgattcttcaaaatgcaaatgcaaaaatttcggtcttttggattttcgaaaaccgatgtcagatcagatcaccatagttttgggttagcacctgcttcggtgtgttcaacaattttcagtgcctttcgtgccgaaaaaccgcccattgacacgtggtcctcctggttgcaacttgtcggaatactgtccgccttaattttagcagtttcacattataacaattgttttttaattgctatagggccaacttcatgaagcataagacggtgttaggtcatttattattatttatttaacttatgtataaaaagttttttttaatgaaattagacaaattccttaatagcatttttgtatttttggcagtttttaggaaaactattaagcattaattatgactattgttcctggccttcttttttttggattttttaaaaatttactgatgatggatggcataacactttgttctcggacaccaaacttgcggcacacaattggaccgtcatgaagcccgagttgagtccgccgttgcgggtcagaaaagttggaagcccactgagttggtggttcagcagacgctccagccgacgctcactcatctgggccaactcgtgcacggcaattgccaaataatccaacacctaaggcaaaaatggcattttaattaattagggacaattaaaattgtaatttcaatgctaatttaacccttacttttgccggatattcaccgtggaaattgccgcccgaaatcacttcttcaatctcagaaaacaccagtggattgtcggtggccgagttgatctccgtctccaaaatacccttcacaaatgcaattgtgtcgtgcacaactccgtggacctgaaacacaagtgactgctcaaaagcaatcattttaattagtaaaagctaattaattaaattaaatattgtagatgaggcaaaagaacatatcaatattatttcctaaaagcattggtttctgaatcaacaatattcaaaattaag

SEQ ID NO: 11300 - DNA, 5069 bp, Heterodera glycines
aattttgcctaaaaacaattttttacagtgaattgccaccctatgttgctgcacaatttggtgttgacattcaacctcttccaaatattggaggactacatgtttttgactcgtcccaattgttcgccattgtcaaaaagttggtcgacacgcttacgtcgttgacgccaccacaacaactgatggacccaccagcatttacacagcttcaatgcaattattggcgcgaacggcttaaacaagtggcggtctatgtgaacgcgctgcaaatgttcctccagttgacggtcagtttttgtgttacctattttttgaagccgcaaacttggcatccgaaatcactgtgaagttttcccccgtttcgttttcccccgcgtaatttttttgaaatttttaaatagaatttttcaaaaaaaaatttaaaaattttttcatatgaaaaatacggaaaaaaaatttttagcggttttttgggaaaattttcaaaggtttttcttatcaaattacagaatgccaagtcgtatgacactgatcaacttgtcgctgttatttgttgtgcatcctttccgttgtcgccatgttcatcaacatcaattctgcgccaaatctgtgccgttcaccgtgacatttccaattctttgcttcaattggagcccgaaaagactgcagcgagcaatgatgatgatgaacttcccaaatcgactgtgttccggtgttggctgcctaatcttgacgtaagagacctgccaaacctagtcggttccaggccaaacccctcatatccataaaaaaaaaatttcgtgtattgcaccaaccggcaaaaccaacttttttttttggcctcaaaatatttttccggtacaatttccaaaatttcagtgacgcgggagaatagaatacattttagcaggccttttttatttcgaaatttttaaattttgagaaatgcctgtcggtgtcgatagccactaaaatttgcaaaatgtttcaaaaagattatatattttttttgggggggggggaggagttatgccaccatgccccttccccacatggattaagctaatttagcatagaattttgagtaactttttgctttcctttttgctgcagcaatttcaacacaattttgttgaccggttgcgtgaagccagcgctcatttgtcccaagcaattggaaatgttgccgaggatgctttgtgtttgttgcggtggacgaacaccaccaccacatcacgcgcatatcgtttagatgttgtccaaggaaacattcacaacattttgaccaccatttcaaccctcaaaacattgcttattacaacaaatgagcgagaaaattcttgtaagaaaatgcaattgctcagcaatttttgagacaaaatttgccaaaatttttcataaaactaagagattttttcctcccttttcagcatttgattccacgctgtcagaagtgccatttctgtttgtttaccccgacctggtggccccatatttgcatgtgctcaatttgctttcaattgcactgtccgaacttggtcgacaaattgccagtgcacagaacattgagcgtgttggtctcaattatggcttttcacatgtaatgttttttaaattttctgtttatccccctaggggttggcacccttaaaaaaatttttgattactttttttttttaaaaattactatcaaattgagtacatttgccgccaagaggtgtccacccaaatttttcgggaagctttcctttttggattttgaaaaactgctatttttcgggatttttttgagtcttaattttttttatttcagtctgaattttacggcttgaatcaattgcttcattgctcatctcaatctgctggcgtcaatgccgccaacaatgactttgccattgacgtccaaccattcatccgttggctgatcactgatcaacaaactccgctgaccgcttccgatcgcctgccaatttgtctatggtcaattgctgcgccgttccgtcgtccattttcccagtgccgtgccgatgtgttgggatggattttgcatttgtgggagcgatggcatgagcaaaatgcaaaaatcaaagccaaggagaaattggtggtgaaacggaagaggaaaaggaggaagcaaaatgatgaagaggagccgggaatgatggacgagggaggagatgagtgtgttcacatggaatcagatgaccaaaaggtagattctaattgctttttttgagtgtgattaatggtgcagaactgtaatgggtgcgttaagttctttcctccataaattaagaaaagttttctaacttgaaaatttttactaaatttttttttgtgtcaaaattggatgtgagagaggtgtacgtacgttcccaagaaaattcctgcgatgtattctccccatcttggtttggttttgttgtaactcgaaaaaattcattcctaattaaatatggattcgtgatttttaagtctcatttgtcagcacacatttcgccgttattttgcctaaaaaaattctttaaccatttcagctgcgcgatgcgtaccttcccgatttctcaaattccgcctctgataataatcacccgacgtcgtcccatttggatgccgccgccgatgttgttgttgaccaattttcggtgtccaaagatgaagtccatgatgcgttgtgcaacctcttcaaaacgctgtcgtcaaatgaagatgatgaagcatttgccaattcttcttttcatcctccgccttttatgcctcttttgtgtgtcatcggcaaattggagctgttcagctcggcaacaaaccaaacggagcatgatgaggatttggcatgtaagttatcaaggaaaattgagaattttttgaaaatttgtatcaatttttaaaacaatcgttaataatttgcaaaaacaaaacataattccctggcgcctgtcattttcgtcggtttacaaaatttcctttttttaaatttccaaaaacgcacaaaattggccattttgcgtaaaataaagtttttggtgtgctaaaatatgtatcctggttattaaattttccagctttttagaaattccaatttttttttcggttgtcaaattcgcttttcagattcccagctgctttcacttgacaaactgcgtgaacagcttcaactctgtgcaccttctagcactaaatttccttctctctcctcctcaaaatcagcgccggaagtgccaaaagcggcgctaaatgtgtaccgtgacagtgagccgtccgcggtggtcaaatgtgtggaatgtttggcaccgcttcatcagcgtgtccaactgttgttgaacgagtttcccgaaaatggacaactggcctcactctcttcaaccattgacgcatttgtcaacaaagcgtcggccggtgttccgttgatgaaacatgcggcacagttggagagcattttaggtacagaaaaacaacaacattgcctaactttttcttttcatatttcgtaattcgtacggggatccgaggcaattttataaagttttttgcgaaaatcgaaaaatacttgtaaagttgggaaaattttacaaaatatgaaaaaatcaagggttttgtttcaaaaataagaaaattttattcttttgaattgcatttcgttaaaaatttttacaaaatgtgtttcgtttttcaatttcgtaattgtacgaagttgaatttcgtaaatttaaaaaaataataataatattgtagtaaagtgatggtgcttttgatattaaaagaactattccagtggcaccaaatagcatttaattaattgttaaattaaaaatatatacatttagtacgagctgaagaatgggagtcaattgcggaccgagcgcattcaattcgggaacaaatggtgccactgcaggcactgctcgtggaatggcgtcgtcgtgaggtgcactgttgggccgagttggtcaacatggtccgtgctgactgtacacaactcgctgtgttggcgggctggccgttgttcaaatgcgcactggacacactgcaaagtgaggcattgggcaacaacaactaaaaaattatattgggcaaattatttgggcgtttaaattcgtttaacaaattaattttcgttttttgtaaatttccctaacaaaaatttttgtctttaaatctgtattggtacagacaaaacaaacaaacattttctatttcaagttttttaaattgacaaaaatacttttttatattttttgttttctaaaaaaaagaaataatgccatggacgtgaggaggactcgaacccccaccatttttttctgttgtctatctcaccaaccacaaacaaaaaaatatttcgcaaattgagccgctatttctacatcattaccaggaatgtgtcggtaattccgattcccgacatttttgtggctcagaatttctgctaattccttttattataataataatagatgaagaacaacaacaaaatggtgctaccgtcgctgatgaaaatagcaacaaaaacacgttgattttggcctttgttgattggatgcacaatgcgaccgttggcgattttggcgcgcgtctttggactggccaattgctcaccaaatgccttcctgttttggcgccaccaaattgtgccattgttgttggaacattgtgccgtcatatgcgctcaacatgtgcccattttgcgcaattcaaccgaacgctacgggcccatttcgacgaccgttttgcatccgttcagcgctcgttgcacgacttttgccgtgcggtgcgctacaccgacctgaacgtgtggagtgtgcaggacagtgcaaggcgtgcgcacacgcaccttgtccgcattttgcgctcattcaaggtgagtattatgcgtcgattttcgactctctttcctctccattctctctctcgctcgctcgttcatttctctttctctaatgcttccgccaccaatgttgccattttcctcacccccgcccattaactcaactgctctgatcagatttaaggggagagatttgggatttgagtcagttgttgatcacttcacctttttgatcactcaccaa

SEQ ID NO: 11301 - DNA, 3866 bp, Heterodera glycines
  misc_feature (19)..(19): n is a, c, g, or t
  misc_feature (77)..(77): n is a, c, g, or t
  misc_feature (102)..(102): n is a, c, g, or t
  misc_feature (3819)..(3819): n is a, c, g, or t
  misc_feature (3829)..(3829): n is a, c, g, or t
ctaaaatttactattgccngaatagataaaattattataattgccttttatatgagttggcattgaccaaaaataanttcaatgggatttggcgtcaaaatntaatcctaaaagttccaaattttgaaatgcctttgaattttaatgccaaacgaaaaaacaatttttagtcaaaacgacaaatttgccctccggtgatgatcaaatgccggcacaaaatgagcagaccaaacaaaatgccgtgccgacaatggcaaatttgggtgaaccggtcaatgtgaagcagggcgggacactgaagcagatcaaagacagcatccaaatggcacagcaacagtactgggcactcagtggccaacacgcgcacatgggcaccgtggaatggggtggcacaaaaaatcgtaaaattttaatttaattaaaattatttaaaataaaaatatgttctattttaactatttaaattgaataaaatgatttgattcagaagagaagcagcaaaacacgaaaaagaaacagcagcaaccgtacaacaacagtgaggacatttcgccaaaagcgttgagcagtaagtgaaaaaaagaagcaaaaataaaaattgacaattaattttcggtccgattagtgctaaaaaaactttatggcccctcggggcctgagtccagagacctggacctgcttttgataactttaaataaaacatggtcactcaaaagaacaaattcgaaaatattatacagaaatttcaggttttttaattgtctgagtttcaacgatcagcataattttcaaaaaaaaacagaaaataattttcataaaatttcttagaaaaatgtaatcgatttttaagggctattaaaattttaaattttattcatatgtgtatgtttcatttaaaatctatttcccttaattggccaaaattttttttagcaaaaattgaacgtctgacgccaatggaaagggacaatttggccaagcaattggtgaacattgaggaccgattgcagaagacggaacgcaaattgcaacaaaaagagcaaaaagtaagcaataacctcacagcgatcaatcagccttaatgatcaatctgtgcatttttcttgtcaatctgtttctgatcgttaataattgacccatccattggtccatccgtttccgatcactgtcacttttctacagatcattgcatttttctatgtatctctgcccatttttctttttttctttcttcccataaatcactttccctccccacatctctctttctctctctctatttgtcactctctctttctctctctcgctcccctctctctctttctatctctcccctcacaaataagtctcttccctttctctctctttctctctctctctttctatctctcccctcacaaataagtctcttccctccctctctcctctctttctctctctctctaatataacacatacacacgcactctttctctctcatataacaatgttgatattttattgtgctaacagcaattgtctgagcactttgtagttacctacaccgaccacccttgctaattccatcgccactgctaccgtatcaactgcaccaccaagcccctttactactgtagttacaaaagcgcaaaaaacagtggaagacatcacgagggaatggtggaaggaaaataaggagaaaaagcacggggcagaacagcaaaggaagccgggacgacaaccattgcattctgacggtggacaaaaagcggttgtcgaagagcttaccgagtcggcagaatttgtcgcatcatcggccgaggaaatgccatcgaatggggtatgtttagggaaaatttggcatgaacttatggcggaagaacaatgggtctcggcataaatcgggacatatgtacatgaattgggacgccctcgctcgcaaagggggactggcgggagggattttaaacggtgctgggacgttagtcaaaaaccatcaaatgaataattgttaaaagaaaattattcataatttcgtctaaaatggatcaaattttataatatagatatttttcgatagccctaagtgttttctattatcctgcaaaatttttaaaaaattctttaagtttaaaaaaagttatgacctgaaaagctcaaaaagccaagtttttttgaacatttttagtcataacttttttgatacttaacgaaactttttggaattttgtaggctaatagaaaacacttagtgctatttaatgatatcaagaattaaaaatttagatgcttttgaacaaagttatatcaaaaaatattttcatttgatggtttttgactaacgtcatagcaccttttaaactaacaaattctttttaacaaaatgtattaaaaattaataaaaaaaaattttctccagtgtccatcgccggcccaaatcttatttctcttaaaaaatagacgcaaaatctggtcacaaaaagatctgggttttattcgagttgcaggaaatgtcaagccgaacatcattgtcaaactcaaatggtggcttcaaaactattgcttcatccgaaattggtggcacacaatcgacggtggttggcacgccggcactaaacagtgccggagccgcctcgcccagcgatggaacaaacagcagcagtgccaaaactgccagcgctagcgcgttgatgatgatgacacaaaaccggaagcggccgtcaccgccgacaatggcaccgcaaatggacaaaattagcaacgcaacgccaacaaaagtgccaccggttgtgccaatgatgccacggtatcagcaggcggtgcgcaatttgaccggccgcccgctggggcggctggacgctcgccaacgcaccattgtggcggtgatggagcagaagcgcaagcagttccgcaaggagggcgacatggcgacggcaaccgctgcggcggaagtgccatccccgcagcagaaaatgccgaaaccgcagcaaaagccgccggaaacgatgccgcagggaaaaaaccgcagcggttcgggacgaccgagcgcggaccagctgagcgtggacacggcccaggcgctcgagtggatgttggccaacatgaccaaatcggtggaggttgtccggcaccaatcgaccaagggaggaagcagcaaaaagttgctggccatggcaaatggtgatgacaatggcgcggagacggaggaggacagagacagggaccagaaccaacacggggcaacggcagcggacgaagtgaattttaaaacaaataaatgatttgtataaaaataaaatccctttaaatagttttcaattataatttcaataatttaaaatttaatttcattattttaaatacattttagtcatttaaattaatatatatattcatatttgttttatgaattgtatatgaattaataattgtttgtttaaaatccaattttttttacctatttaaataaaattaatttgttttttattcaccaataaattaaaaaataattcctatttaatttttttttaataaaataattttcattaccaaattaatttatcaaataacttttcccaattaggtacaaaaacgtcgtccgtctgtcgtttttccgtccaaacaatttgccaaattgcgcaacccaagcggcggcacttccgctgcggttgttgtccgtccggcattggccggagcaaaaagtcgcggcgccgacgcggctggcgatcaatttgtgatggcgacggcacaacgccaaccgcaacaacaacaaaatgccaaaagtgacaatttgaatgtgaacagtcgcgcattcgcgcccggcaaaccgttgagaattgngcctggctgngatgaggaggaatccggcgaagaaacaacagacgagc

SEQ ID NO: 11302 - DNA, 1528 bp, Heterodera glycines
  misc_feature (145)..(145): n is a, c, g, or t
aaagtagatcccaaagtcgggatcccgaattaatcccacgggatctctatcacgtccagtctctagtcgatagaaatttttattctttttaatgccgattgatctgatcaaattttttgttttatttattcttatggctctttcnccgctcgttcatatatttcagctcattttagcaagaattatacataatttttaaagttaatttaatttatttcattaatttttttgttgggtctaatgaaataaaataatttaattaagaaaattcgactaagtttttgaattaaattttatcaaaaattaacatctattaaataataataattacccacaaaacacaaaactcttctttaactgtattataaattttttgaattatataaaaaataataaatttttattaatttttaattgtaaatttcattttttaaaggaattggcacgtgcacaaagtgttgtcggaaagcagcagacgagcggcgagaagcagcaaaaggaaaagcacgcatcgccaatttcaatggaactcgaaattgggcggctccgtgccgaactgagcacgatggagcaacaaatgggacaaatgcgaggccgagaccgaggaggacaacggcaccaaaacgtaccaggcgaacaaccacagcgacaacagaacaaacagaaaaaggaggaggaggagcgtgaagaaatgggaagcaaaagcaccagtggaacgatggaaacttcaacaaaattgaggagtacagcagcaggaattgctcacaaccagcaacaggtgaaatgattaaatgataagagaaacatttagggggtgggccatcagtttggccgcccgaatccagtgtccgaaaccccgcatttttctcatcctaatctcgaaaaccaacccgcaaaactttttttttcatctacgagtcccaacccaaaaattttggcttccctcccgagtctcgacgtttttctcatcccgaaccttggacagcaacccgaaaaattttggccgcctctcgacccgaatcccggtattttttctcatcctaatctcgaatccgacccgaaaagtttggcctcccgacccggaactcgattatttttctcgtccttcggccacattagtggccatttgcctgagtgattagggggcgggagcgcaatgtctggaatatcaaccgtgcagcagaaaatgattgcgtctggtttcgggttgagaaagagaaaataacctctgtgaagcccctccattcataaccctgaaaagaaaagattctttcagggaaccctgaccgttttggtgtatttgtttccgttcccgaagccattccgagcgatcaaaatcagttgacaatttttgtttttcttccgatcactcggctaacaatttttgttttttccatttaatattccattcccatttaaaaaggcaataattcctgcttcatctcaattccattctggctctggtaccgctgcgcgttcaaattctgggaaaaagtcggaaaatttttccgccaaaatggatgggaat

SEQ ID NO: 11303 - DNA, 990 bp, Heterodera glycines
agtccccgtgtttggaatgccggagatttgagtcccacagattgaaatgctggtgggttgagtccccgtgtttggaatgccggagatttgagtcccacagattgaaatgctggtgggttgagtcccagtgatttgaaagcctgagaattgagtctcagagattgaaatgctggtggattgagtcccagagattggaatgtcattgaaagttggtgggttgagtcccagtgtttggaatgcgggagatttgagtcccattgtttggaatgccggagaattgagccccagagattgaattgctggtgggttgagtcccagagattggagaaaaagccaagaaaatgatgcgaggccgcgaagcggccgagccagtcgattttatcattcataattctataacacaatcgtactgcctagcgggggatgcgccgaaggcgctgaccccgctagttatttaaaagtcccgctatactctagtaaaaagcaagataatcttgaaattttatgtcagaatagcactattttacgaagaaaatataagatttgtggcaaaatttggtcatttttggacaaaaatctgttaacaaatcgcattaaaaattaaaaaaattttcccggcggcgcctaccggcaccgccggacgcccctgtccatctcacagttttttcgaaaaaacgctccgcaaaaaaaagcatttttaaaggcaaaatagtcatcgcttggcttttatttgcgaaaattggcctttttggtggaaatctttcaacaaatcagaacgaaattacaaaaaaaaatttccggcggcgccaatcgccaccgcccgatcctctcccctcgccctttaaaaattggaaaattttttaataaatgcgcgatccgtggttcgcggccgcggcaatttgaatgcgcaatccgcggtgctcggccgcggcaatttgaatgcgcgatgcgcgaccgcggtttttttctgtgcgcgccccacccctgatg

SEQ ID NO: 11304 - DNA, 2380 bp, Heterodera glycines
  misc_feature (2362)..(2362): n is a, c, g, or t
attcttttcctcctcttcgttgcttcagttgggtggcgtttaggaaatttttttctaaaagacttgaatcggcttattagtaagaacattagattcggttaattcaatggaaaataattttctgaggtttttattttgttggagtcgaaaaagttgaaccgcaaatgtcatttttggctgtggccgcaaaatgtccgaggcgcaaatgtccgaccgcatatgtcgggccgcaaatatccgattttcagtaggccgcaaatgtccggacaaatgtcctacaaccgccttggatgagcaaaatgattggcatttgccattgtcaaattatttcatcaaattcaaaatgttccctttaattaggccattgtctccaccatcggaagaagtgggacaatgcgaggaaaaggtcgggaagccgaaccccctgcctgggtccgggttttaccgggatcattaattaagttcgggagtccgaatttcttacatccctggtcctggtcccgtttccgatttcctgaatttcgaattttccaaaatttccttaggtcttctgagccacgggctgttcattgatcagcggaaaagaagcgaattatttgagaatgattgatctttttgatattggtttaatgttcttttatctttgaaatgattacttttgtcgatttttgttttaaattatgctttaaaaaggagaatgaatgaaccaaaatttggatgccatgctcaactcggtcttaaatttggcatttccttttctatttgtttataaaacaatttgaggaggggggggggcacttatcttttgaattttggatgaatgtttggtcagtcaaatcggcaaaagttgatgaaccaagggaagggcacaaaacgttgacatttgctgccggaaaaaatagataggtaattttaaaatgtttatattttaaaagaaatttcagaatctcctcgtcaaaaaaacacaaaattcattaaactaatttttgccggatttctgtttctctttcggttcggtaaacgaccgtgcattaccgtagttgctagtgaaggagtgacatcaggcaactttataattgcatgccttgcatttggcataagaagaattgtgaattttgtcaaaataaaaccaaatagagtctttttcgcgagtcatttggttctaaattacaaaaaagaaaattgtcgagaaaaatgaatgaatattttcttatttttaaaggaatttgtgggaaaaagaatccaattttctaaatctcttgctttttacatcttttaaataatattaatcgtaaaaaacaatcccttcaaaaaataatttgttttaaatggtccaaaattgccgcggagtcccaaattccgcgcatcacgcaaaaaaaaaaatgccgcgaatcacgaatcgcggtcgcactccagccatgggtgggtgccgtgccatctaaactattacctctaaattcccgcagtttgttgctcgtttttcttgaatattgcaggcgaaaattaatttttgatggaatcagcagaattgtcctccgccgtcatttcttctgctcgaattgaaattcagcagcaactgccgcgttcatttgtgacaacatcctttggaaggcatggaatgctgcggtaacactgacaattagcataaaacaataaaattgccaatcgagagggggagggaggggcaaagagttcaaaagtggttgaattaaaaacatagaaaatataccatttaattggtaactgtgaaatgtttttggctctattccaatgtacgcgtccaatcattgaccatccttagtttctttaaccataactcaaataatatacatatacatataggcattgggatatagcattgactggatgtagagctcggaattttgaaagtaccgggaccgggcttagccatttgaccgggaccaggctttgccatttgaccgggaccaggcttagccatttgaccgggaccaggcttagccatttgatcgggaccaggctttgccatttgatcgggaccaggctttgccatttgaccgggaccaggcttagccatttgaccgggaccaggcttagccatttgatcgggaccaggcttagccatttgaccggtaccaggcttagccatttgatcgggaccaggctttgccatttgatcgggaccaggctttgccatttgaccgggaccaggctttgccatttgaccgggaccaggcttagccatttgaccgggaccaggcttagccatttgatcgggaccaggctttgccatttgaccgggaccaggcttagccatttgaccgggaccaggcttagtcccaacaacaatcatgagcgccgctttgggaaatacaaccgaccngaccgattgacgcccccc

SEQ ID NO: 11305 - DNA, 1943 bp, Heterodera glycines
cccccccccccccccccggcgccgtcccccgccgcttacgccccatgaaagcagctgaaacatcgaaaaagcattcatagcgtaacaaaaagatgtgcgtcaaaatcataaataaaataaattgaaaaccaaaatcttctcgtgtattgccttcgatttaaagactaagaaactttgaaaacagcaaaagtctccacgacttttattgctgagaaattggaaaaaggccagtgttcgaaaattgctaaatatatttataaaagatcattttttgaagaaaaatagcaaataaagcgattaattttggcgattgagtaaaagtaggaaattttccattattgaattccctaattaaaccccgaccccgccccgaccccgaaccccgacatttttggccattttcggggttaaccccgaccccgacgcttccaaccccgaccccgacccttaaccccgactcggggtcggggttaaatatatacccctaagaatggcatttttgttaaggaaaggcaaaaaatttaaacaaaatttgaattttttgttaactattttgccaaattatattaaataaagtaaatttgcttttgtttgtccgtttttgttatgtggtatagtcgttagtgcttcaacaataacggtacttttcttatgagtttgatacctgttgatgtattctttttaatttatttttatgtgattaataggattttttaaaccaaaaatacccatcaaaagcaatcattcttgacataatttattgacttatttaacccaattttcctttagttgaaattaaaaattcaatttttttgactaaatcatcaaaatttaatatattttggagagagatcggcggtcaaatgttaatggattattccataatatttttagagttttaattggcacatatccaatggatgcgtcgagacgagataaaataaaatatatttaaacgaaaatagtaaaaatgaacattaaaaatgatcatatcactcctattcatcattataatccaaaatgatcgaccatttctcaaatgcataaatcactttcacataatcggacaccattttcgacgtggagacaaacgcctaaaaattggcacaatttttaaacaaaataaaatgattttttttttgttgctcacccaatgcattcattggcagggaaaaacataaaggcgacagtgttcaaatcggccaaattaacaaattcccattgaaccgcagtcgccgtctccccattttggcaccgtttcattacccatcggttctcctgatgatgttcgcttgctttgatcagtgtcagcttctccatggtccgttcgttagctaattcaaatggcacaatttgcggtgacggtggatcaacaataaattgaattttgtagctaacggaagtggtggcattgagaaatttctaacaatggggaaaacggccattaaatgcaatcaacaaaatcagatgattaacgaagatatggccacacctttttcaaagtgttgatgttgtcccattcgatatttggtggtttcaaatagcaaaacaatcgcttcagttgtccatcttttcgcggagtgtgcaaccattttgacagcatttggccagcagttggaattgcatttggctcgtcaacatcatcagtcgcatcgggcaacaaatagccggaactgattgaattaatgttgagatcagtgagaattgtgggcgaaatgaaacgacgcaaattgtccaaaaggaggccattgccgaaaatgctcaagtggcgaatgctttgtgcaaaaattggccaaatttcacggacaaaaacacgccaaattggctgctggtcatcttttgcaaaaggaacacacaagctcaaattggtgcctttgttccaaatttgttgattggcacggagaaattcaatgacggaatggtcgatgtagctgaaaagggaa

SEQ ID NO: 11306 - DNA, 3786 bp, Heterodera glycines
gaattattaccgcactggcaaattgcactatccgacttcggtgtgcggtccgttgtttgaggaggagttggaatattgggggttggacgccaatcaggtggagccgtgctgttggatgacatacacacaggtggagaatggatgaaatggcacaaaaaatgaaaaacaaaaaggcaaaaaaaagcaatggcattttatggaaatgccaaaaataattttacgtgaattatttcgagatgaaagattaattaataaaagatcaaattttattggtttatttagcaccgcgacacacaggagacactggcggtgttggacaaattggacacggacgaactgaaggacgaggacccgcagacgcaggagcagcaccggatgaagaagttcggctgggaggacgccttttgggagggccggctcaactggtggatgcgcacaaagcgtaaggaccgatgggaagaaaaacagcgggggattttggacaaaaaataaaataaatttaattccaaattcaaaaagaaccatttaaaaactttaatttgggacaatcaaataaaatttgccgattctttgttcttcggttcagcacggatttgggccctcttcgacgagccctattcatccacagctgccaaagtaaaaaatagggggaaattggaaaataaattagaaaaaaagaattaaaaattgaaaattaaattcattatttatttttttgttttttttcctttttttcccctttaggtggtggcttccattagtgtctgtttcatctgcatttccatcttttccttctgcttcaaaacccatccgagctttcgcattccaatccttcaaatttcgtaaaacattttaaataaattattttttataatttatttaaaattttttttttcctttagcaatttgtccgatttctcttcctccccgtcggtgcctcaacattcgcatattcatcagcagcaacagttccattcccacttcaatcagcccattaatgtgcaacgggtcgccactgagccacacaaaatatttgcccaagtaaacctttgaatttaagccgtttaaacaatcattatttatttttattaataccttttaatccattttattttgtttttcagattgaatttgtctgcaacatttggttcaccttcgaaatcctcgtgcgctttgtctgctgtcccaataagctcaactttttcaaatatccgctcaatctgatcgatttggtggccactttaaggtccgtccgtccgtttatccctcaattttctctcttaattaaacactttcaaattgtgccaaattgcctcatttcagcttctacaccgatgccgtgctcgttcggctgttcagggaccaggccccgaaggatttggtggagtttctgtcgatgattcgcattcttcgcctgttcaaactcacccagcaccaccgcggccttcagattctcattcacacattccgcgcatctgccaaagagctgatgcttttggtgagtcattcattaaataggttaattaattgcgcgtaattagtggtaaagcaatgggttttataaggaacattgaaacatataaataaataaaaaatactgcagaaattttttgaaaaaatgataattatcattaatgaaataataatttatgataattttcattttaataattaaatatttttacaataacaatcaatttaattttccaggtgttttttctgattttgggcgtcgtcattttcgccactttggtttattacgcggaaaagacggagaacaatccgaacaatcaattcactgcaagcaatttttttaaacaattattctaagaattattcaatttatagtcaatccccgtgggtctgtggttctcactgatcacaatgactacggtaatgtttcgatgtccgcaaaataatttaaaattcactcatttaattcaggtgggatacggtgacatgacgccacaggtaattaaaaaggaaaagcatataattgagaaacagagacagagttgtattgttattaaaattcatcagtcattggggtgtggaaatttttgggtcacctatttaggctttatagcatttttctttatgtattcccccccccccccctcatctcactccgcgcacccaaatttttgaagctaaaaatattcaccattggtacccctccaagccaaaatcctatgaccgttggaccgtccctggggtatgttctccaattgtaccctttccctctcccctggggccttccttattcaaaccatcattgttccttgtgcccgtcccattcagacttacctcggccgcctcgtgggcagtctctgtgccgtgatgggtgtgctgaccatcgctctgccggtgcccgtcatcgtgtccaacttcgccatgttttactcccattcgcaggcgcgtgaaaaattgccgcggaaacggcgacgcgttttgcccgtggaacaggtgaaaagggaaggaaccgcacacaactgacaacgcataggcactaggaaaaacgcatatttaattaactgactaattagttgctaattggtgggttgcattgcattgcttttgcttaggttcgccttcaatttcggcgacacgcgcaatcgtccattttggagtcgaacactttgagccgtgttacatctacacgaagaagcgcaatgtcaaacgcagctgcgaattcgggtaacaaattaaccaaaactttgactcccgaaattgcccactaattgtttttctctcaattttttgactgatcgctgctttttgctcacatttaggattattaactaaccccaaaggcatggttttgtcccgtggcatttttgcgataaaattttcaacaattttttcagaaatggcaatggaccccaaaagtgcctcgttgatgaagaacaatgtcggaccgcagctatcctcagacagcgcagctgaacatccgccttcttatcgtcgtgccgcgccgccccgctcgccctcgaggaatttccaaaagcgtttgtcgtcgacgcgtccaacacctgcggcgtcaccgacgcgcaaaaagtcattgtccgccattagtgcctcaggcgaaacaaaaggtggggagagacaaaggcaattaaaaaaataataatttattcaaaaatattttctaaacaaaaatttaaaaaatgtgggaaaattgcgaatgtatgcaaagtgtgcgtttgattggtcaagtgatatagacggattggttctgctggtgctccttcctcaactgactgtcccgtttccaacgtgtccaaaagtcgaatgcgtagaggccaaaaccggcaaaagttacaaacttaaaataaaaatatcaaaaaataataattcaaaaagttaccaaatgaaaaaaccacagaggggcgaatattgccttgagcatgttcaaaacggcgaacactgagcctatcaaatacataacggaggccaaagcgcagtaaaattgttcctaagcccaattagatacagaaattaataaatgaataataaatagataaattgaacattcaataaaaaactaccaaaagttggaaattgtaatggtaaaatgcgtccggggcactgaacaaatgtgccaatgccaagaagaaagtgccgaccacgaagaagccgtggacacagacggcgttgaacaactgaaagaagtcgacgacacggcccaaacagaaggggaaaagcggatttggccagcattggactgtcagcagaagggcgaccagaccgcacagctgaagataaattgacattttgacaaaattc

SEQ ID NO: 11307 - DNA, 972 bp, Heterodera glycines
ggataatggccatagatgaaaagatcactttgtggtggaggggcggtgaattgttttgatttgatggtggggggggggagggatgagtcagcagatgatcggctgacagaaaggaaagagcggtcggagacacagcaaaaggaattggggaagtgcttgaaaaacagaaaaagtgggagagaaatagtgaagggaaagaaagaaacaaagaaagagagagagagaaatagagagaagagagactgtgcaaacaaagcaaaaataaataaacgaaaagagataatacaaacttatgataatatttgaggggggtggagggggggaggagcttcaggaaagttctaaattaaaaaaaatggagaaaaaagttgggagagaaaaattaaacagagaaaaaacaatacaaaaaatagaaacaatttgaaaaatatttaaaatataaagaaatgttaaataggtaattaacgcacctgaatgaatcatttgccgatgaatcttaaaagaatcaacacaccatttttaagctaaaaaagaaatttcttaataaaaggtttaaattttaaatttgtaaaaaagcttttcaaaatgttaaaaaatttaaaatatgaacaaataattttttctttaaaatttatttttggattcgtttctcatgtgctacaaaaggagaaaatcaattcgatctgtgcaattttacgtcggaaagtgtgagaagaatgaataaaagctgttaaattgggccataaaaccttttagaacaaaacaaatatattctaaaaataatatgaatttaataataataataccaaatcaataataataaattataaaagtaaatgaaaatttgaaataatatttctttttttaaattaaattctaaaggcaacaatattggtacttttctgttttgaggtcaacataaagctcttattaagctctacaacatctgtgaatgagtttttattgcccatt

SEQ ID NO: 11308 - DNA, 2746 bp, Heterodera glycines
caacctaatgggagaaggacggaatagcaaaagggacggacaaaagcatacaaggcccatgaccaacgcagaacagtcgaaaagcatgtgaaagccatcggagatgagacccaacgaatttgtgaggaaaccgtagagaaactccacgccacaaaatgccaaatttgcacacaaaaaccaaaaaatgcgctgggaatcgctgttggcaagtatttcacggagctaagaattaactaataatttgcacattttgctatctcattaaattttctgaattttcccaaaataaattaccgtttctcggaaaaaacgaataagggaactgaacaaatgataattttaaagaaaatactgttccccaccgcgatgtcttctcgagaaatgcttcgccatgagtgaacaaaggcatgccatcctcggaaatgccgataaaatgtccgccaacagaacgacgagaatcctgtgtcgaagtcaggacgaaagttgctgaaattaatcggaaaacaagaaatatattatttcctatcaaaatgccaaatactaaaaaaataccaatggaaaaacaaatggttgcgatgacaatgcccgcactgatcccatgcgtttttgttgaggacgaagcttcgatccaaagccaagacaatgtgacaccgatgccaaacattgtgatgggagaccaacgcgcaattgccataactaatggagagaacggaacaatgatcaaccacgcccaaaatgacggaaataacggagaggacaaacgaacctgggtctgcgacatgctgaaaatgcaaaataaatcatgaaatttagaggattatttgggggaaggaaaaacataattaattcactataaaatgccatggaaaatcacctgaaaagcgatattatccgcataaaagtcaatgacaacaacgaaagcggcagcgaacagaaggagcaaagggaattccaagaaggaatggataaacgactgaagggaggcgaattaataaaagtaataatttaaattggaaaaggaaagaccaaccggactgaagacgagcacaaggacagcgaacggagtgagcagcaaagaggcgaccaaagaagacaaagcgtaaagacgctttggaccaccaatttcaacggccaaatgctaaaaatgaattgtaaataaaaccgaaaataagaaatggaaatactcgataattggactcgtaaatcatgcgaagaaacacagcaaagagcagcagaagcacacccccctaaaagggcagactttgggcaaaagagttttgaagacaaacgctgtgatcggagagaccgaaccatccgacgaaatggtaaaacacgtggttcagcccactttggtgtcggtgggattcggctgaaacaaagagacaattcaatacaaattctagtaacacagacgcacaatgattagtcagtggagagtcggagtccataatgaaaagcacaacccatcccaccaacagacagaccaatcccctcgttttggccgcacttccgctgccattgacgattgacattagagcaatcaaaatcacgctaaaaagaaaatttttgaaaattcttaaaattacaaattttttaatacgttgggctctgctcgaacattaaaatgctgcgaagtgggccacaaaaagtctgaaaaaataaattggaaaatgaaagaaaaagaaaggcgcacaattccataaaaccagaggatttcgatgagacatttgaacagagacagttgagcgattcggatatgcttaacaatattcgtggctattcataaaattataacttaaaaacccaccagtgactttcggattggtttccccgaagaaaaaggcttttgagcaggcaaaagtactccgagtgatctgaaaagcaatcagagatttagcagtcaaacgcaaagccaaaaacatcgtattcaacagccaaagaaggccgatgacgtggatttgggtggacaaaatgtctattaaaaatatgccaatgcatcgcaaagttttggcaacgatcaacaccagaaaataccaagcggatctaaatgaaattcagaaatgccatctcaaatgcaccgtttgctccactcaccttgtggaagtgggcgcaaatgcattacgatcgtccttttttaaaaaatcatgcgctaacataatcaacgaaaagcataaaaaaaatattaattagttgtgtttaaaaatacctaggtaatactagtaattaggaattaaaggaaaaattgttccaaaaatgaattccttttcagtcggtttcttttcagttacacgtcgtcattgacaaaaaaaaatcaagaacaaaaaatcgaaacagtatttttaatgaaagtattatgattttcttctgcccacttttaataatatttgtacatggtagaaattaaagtggttaaattaactagacaaatcacttcttacttcttttcagtaattatgaatcgttgaatcgaaagtcaatcatttttctcgggaaataaaattttatagtaatacaacttaaagtcggcttaacccaagtaaaaatgatgtgcacaaatggtttgaattatcgaacaaattccagccgtctttccgatcgtttacagcaatggtcaaagcaattcattcaatcagtccaaatattgagacagccaacggaatccctccccatagccctgacgccggagcaccgaacacatgaacatttctaacggtcgcgtggtcaagtcggctcgagaaactttcct

SEQ ID NO: 11309 - DNA, 2560 bp, Heterodera glycines
  misc_feature (64)..(64): n is a, c, g, or t
  misc_feature (71)..(71): n is a, c, g, or t
gacttaaattgccctattggaatgattttctaattggccaaccagtgcaatattgttggactcncaagtangtatttgagctgatcttctccgagtgcattcggtttgtcaattttgttacccaggatgagcagtggagcattggcaaccttaaaaaacccataaaatagcctaatgcattcgttcggacttgttcgtcttgtaaaaggctccacagttcttctcgtgcctcctgaatgcgttccaaatcggcagcgtccaccaaaaaaacgatggcgtccaatgcgggaaagtaactcttccatacacgacgcgcttgcacatgaccacccaaatcgaaagtggtgaagcgaataccaccgagtgaaagttcctcggacgttgggtgaagagtgggtacatgctgagcaatacggtcgtctttgagcatgtggagaagcgtcgtctttcccgcattgtcaaggccgagaaacacctataaattgtccattttaatgttttaatgatcctcattctattagaaatacaagtagaatttaaactttaatattgcataccaatttgccgctttttttggttagtcccaaatagttgagcacgccagaaaaccagtcgaggatccacgacattttaatgccttgaacttcatgtaagataaaattttcaattttgagagataattaggaatgaaccagacaatgatgttaaaaacaaaacgatttatcagtttatatgaagataaatgcttttcaaaaactataacatacaattcaaataaacgaaacttaaaaaaataaaaagaaaaatttgtaggcattaattaggggaatgatgaaagaataaaaacaatgagacaaactgctaaccagcggaattctctatattatttggataatcgagtctattgcgcttcttataaattgtgtctagaaaatgagctgctgtttcggctaaatccacggggattgattcaaaatgatcgttgataccctctaggagctgcaatcgtttataaaggcatttaggtcatgaaatattaattacctgtgctttcgagttggcacccgaccgattaggcaaattgaaaaatttcttatagcgacgaagtgttgtcgcagaaagctcatcaaatcttatctgaatggttcgtttcaatgaaaaaaaattgaattaaatttgtctcaccttaacggttttattgaaaccattccataagtttgaccaattttcctcacaatccgttgtgtgttcatatcggtcctaatttatggtaacggtagaaaattaaaaaataaagcacctgaaaggttcggtagcgctcatagagattttcatattgggtagagaaaagatgatcgaatgctttctcacgcaacgtttcattcgcctctgtttgctcatcttcgctggcccgtaaaaaagcatccacaaattcctgaatgtccttgcgctcatccacttgataattcgttatgtttagcttatatgtctgttcgttaaatttcggtgcgttcataataaatttctgatgcgtttgacaaatcattccatcactttttctcttaaaaggaattaaaatattatttagattatcttttgaaaaatgaaaaactgacttcttcgtaaatgtaaaaggggtaatttttgcgttttgcaacagtgacatgccatttgttcagagggatataggccagcctgcggcattcttcaaacgttccatcggcaagtttggtgacaattacacactttctaattctttcagacacagccattaatacactccatccatttaatgaccagatccaattcacatgcgaaatataaaaaaatgattaattgaaaatttaaaacaaaattaagaataaaaatgaatcaactctatcaaattaatttttttatctctttgtgttacctatttcagcttctttttccatatttctctaattaatttttcttctcgtctcacagttcacgtgtaaattttataatttaaagaaatttacaggcaaatcgtttcgtaaataaatcaattaggatctttgttatctgcagatttgcaattctaaaaaccaataaaacagactactaaaaaaaattcttagaaaagcttaaatacgcataaaattcctaaaaagtatgtttttcttgagttgacagacaatgatacaatacgatttactttcataattggcagttcaaaaataggcaaccgttttttaggtgttattgaaaaattattattacaaaggaaaaatggctgacgcagctgctcaagaacaaaaaaagaaacgcacttttcgtaaatttgtctatcgcggagttgacttagaacagcttctggaaatgaacgagtgagtctgagtcgtgcttccttttcaaggattaatgaccttttaggaagcaattcaaccaaatgattcccgcccgtcaacgtcggaagatgaaccgcggattgaaccgaaagcacaaatctttgctcgttcgtctgcgtaaggcaaaactcaattgtcccgagctgatgaaaccggagtgcgtgagactcatttgcgtgatatgatcg

SEQ ID NO: 11310 - DNA, 1071 bp, Heterodera glycines
  misc_feature (31)..(32): n is a, c, g, or t
agaagaattcgcccatttttacttaaatganntaaatagttgaaaaagtttttcaataaaaaagaagactttaactgtaaaaattaagaaatttttgacgttcgatcaagaagtgatccctgctgaacgtgatttttggttcttttccaatattttttttttataacgaatccatttttaagtctgatgagtccgtttcagtcccagctgtctagtcccttgtctttgtccttttagtttgtcctcttgtctgtctcttaattcccaaaagtgcaagaaaagaagcgaaaaacgaaggccgccctatgtcccatgtcactttgccctttgttttgcctttgccttcctccgttcggttgctcagtgccaaccaatcacagctgtccgtccgtccgtctgtctgttcttacaaattagttctatttgctgagtttgctatattgcattttgtttccgcgttctaattttgtgctttaatttcgaaattcctcttctgaattactgacaaaaattgtactttagggcctaattctgactacctaattttgcgaaatggttgtgctctcaaaacttggctcgccgcttcgtccgttttccaatgactatctcctttgccgcttccaggcattccgtaattatgcaatcaaaaaagaaaggccgccaccagcgaagattcaagtgccgccacccgcaaacgaaactggccattggaaatgtaagtttagtggacgggccttatgcttcggcaatttttaatatttttgcgttttttctttcgcatcatttcgaattcagatgagcgtgactactcctatgacctgcgttattcaaacccgatcaacaaatactccagttttaccaggtaaaattttggctctagtgcacttaatgagtccaatcgagttttatgagtccaatcaattgacaatacctggtttttatacaataactttgttcatgtcacaaagtctaacgaagctactagtaaaacatataaaatctcaacgtttaggcaattacgaaaaaatatatgattaattaagtaattgctgattattttggtttgtaact

SEQ ID NO: 11311 - DNA, 1208 bp, Heterodera glycines
aaacaaattatttttgttattatttagttatgacaaaatagggtaaaatttaaattgtttaacaattgttaaataatttaatttatttcaagttaaattatgaaagagggtttaattttcttaatattaaatcatgctagttttaatttcagactcttcattctttaattagtttagctatttataatcacgcactgttacgtgacaaccgcgccaacttttttttttggctttttaagtctctttatgttgttgtttaaattggcgtttgtatgtgtatcaactactatttcaactactatccatattcatttgaactaaaagaagaatagaaatatatttttatgtatattcgtttatatttattttttctcttttttaagttattttattttattttaatcataatttatatgattattacctattttctttattattatatatattttctttcggcgtaatcaaaaaaatgtaaaagacccactaaatgtatcctaatttttattattttttttgacgaataatggatttaattttcaaaatggtgttaatatttttatattgttgatagatatgtatatttagttttttcataaatgattatgagttgctttctaatttaatattctttttgaaattagtatattggaaatttattgatatttattcttttataaaaaacataccttttcggcacctacccctgcatttacggtatttgatcattaaaaatgtcaatgtaatggatacataattttgtttattgtttgttttatttctgctgaatttaaaatattttaatttcaaatggtatttattaattgtttctttccttaaaaattcaaatttttatgaaatatttttttattgttaatttaatttttacattaaatttttatcagttattttggcactggctgaccctgctgattagttttgcattcagttatattagggttcgggtcccgcccccgtcacccccgccccctaagaatggcatattcgtgggataatagcataaacttaaaaattcgcccgccagcgattaccggcaccgccgccctccaaaaaacttatttttttcttaaaaaattagaccaaaatcactaaatttggtcatttttttagacaaaatctctgttatttatgtcaaaaaagaattgaatcgaggcgatacaccgactaaaggaatgtggagcaacaca

SEQ ID NO: 11312 - DNA, 1332 bp, Heterodera glycines
aataattgatttctcaagtaatatggatatctttttaaaatttttgaaaaagttgtgtatttctgtataaatctgtagtcatttaataaacggattcattaataatttagtatttcaaaacttaaatgttcatatcaatgttctcgacaaaaatgcgattttttagcattcattttcatgaattaatattagattctcatgtggtgtttttaaatatgggaacttttataaggtaaataaaaagtatattcaaaatatttgaattgataaagatagctttaatttttacttaaagcagtcagccgaaactttttactatttttacagtaaattgcatattagtttaaagtaaaaggtttaaaatagcacaaattaataaaacatttaaccaatattatatagaattcattgttttttaatttgaaatgttaaatgaaatcaataatatatatgaaaaataaaaagtgaaattattttaaaagtaaatttaattgttttttatttaacaatttcaaactctaaagaatataagcccgaaacaaataaaagaaaattcaaaatgtaaaaataaaatattaactgatcaattgcaatttgtcccttgaccattagtttaccgggttgattttccttggaatctcatctaataaattcagaataaaacaaaaatttagtttaaaattttatgctgatataaagtaatgaaatcaaatttaattccaaaattgtattatgcttaatttcatgtatttttgaaaattattcttttaaaaaatattaattttaaattttgataaaattaactaaatttataaacataaacactcaaaattgttattgaattaaacaataagaatattcaaataacatgcacaatattcaaaaataaaaatatttacacaaaataaaacaatatattattatttaaatgcaatgaattaattcttacaaaataaagatgaatggatgttaaataagaaagaatactaaataataattcccctcaaatttaaaatttacattgaagaaatgaagaaaatttaattttttgtatatataccataataaatcgagaatttaaatttaaataatcaaattaaaaataaatttacattgaaaatattaataattatcatataaatattttatttcaaccaaagctaacgatgtgacgattattataaatacaggtcgataaaaaaaattttatatatacaataatacaaaaaacgttgaaaattactgaaaaatgagcttataaaaaatccaaaatttaaattcaaaaatatatcaaaaatttaaatcctactaaacataattatgagataaaca

SEQ ID NO: 11313 - DNA, 1556 bp, Heterodera glycines
ggtccaagacccctgcccctgtaaccttgaggtacaattgcactttttaaaaaggcaggggtccgggacccctgcccccgtggcctaaaaaacatttttttttacattaactaagcaaaaaccaaagacccttgccccggtgaattatcgttcgtcagaattgattctccgccgcgatgattgatccaaggattcccccctcttccccgggcaagttgttatttgaagtgaggctaattacagttgaaaaagagagatggatgagaaataaggaattataaaaataaaatattttaacattaaaataacaaaattccatcaaaactaattaaatgtttatagtaaaaaggaattaaaaaacagttattatattaaaatcagacggggggggggaaatgagtgtcgggatgaagggaataaatgttacacccagagggtgaatgggaaagaatggaaaacaaaagaaaacggaaaacgtaaaatttcaaataataatttaaggaaaaaacttattaaatacgtttttggttttaggaggtttaacgagacccttttttaaaaatgaatttgtttgaagtgatggaggactggaaattactctcacttttattgacggccgggaagggatagggcggggataattatgacgttaaggggagctttggtgcttaattctggaaattttgattttggatggacgggcgtggagggaaattgatttgcactcaaatagaaatgaaaaaagagaaagtggaaaacggaaaggccacgcaaaataaagaaaattcaaaagagattttaattgaagtaatttatttaaaaaattgctacagtataccttaaaataaataaaacaaattaaaagacaaatatcacaaaatcgaaaattaaagcaaattaaaagataaatatcacaaaaaaatcgaaaattaaagaaaaataaaaaattaaatatcacaatggtaaagtaaaatatcacaaaaaattgtataaaaaaatcgaaaattaaagaaaaataaaaaattaaatatcacaatggtaaagtaaaatatcacaaaaaaattgtataaaaaaactattacaaaagcgggacatgctgaaaattttgcaaattggcgagatattgatacattcccgctaatgcgatagtttatattatcacaaagaatttcatcactactttaatactagggatgccattttatgaattaaaatacttaaaaaattgatttaagacaaaaaaactcaaaataaaagtaatcataaatgttgggtcaaaagagtaagtcaaggtgccaatttgtattaacaatttcaggcaaaatccaattatttctttgctaaaatgtggattaaatcatttaaaatttacttttcgtttttaaaattgaagagacccaaaataaaattgcataactattacatatgcattaccatcatcattcaaatttcactccccaccacgtcacccactattcctcgtccattggctcctctggcccgtgaacccgcgccttttttgcactcggcagcttttccgttgtcgcaagtcgacg

SEQ ID NO: 11314 - DNA, 1197 bp, Heterodera glycines
aaaatgccaaatgacgacgaaaatccaattttttcataagtttgggggtgtaatttgtaaaaattcccaaaaagtcgatctttaggggagtattttttgccttttttgcatttttattgtgaacatttgccaaaaatggccgaaatatggactaaaaaggctaaaatggcgaaatatggatttatttgcgaaacgtgccctagtcataactttctttaaatttaaataaactttttgaaattttgaattaaaaatttggttgcttttaagcaaaatcacatcaaatattattttgatggttttttgagtaacgtcatagcaccattaaaattagcatatgtgatcagtcgtaaaaaatgtaaatttttaacctaaggtaggagaaaatcattgatttaaaaaaaagaaaatgtggctggcttcagaaaatatgcgatcgcgacgacagggtcaggattttaaatcaacttaatcctgacacttgcctcctgcttggtcatccacgactcggcctgctccatgtccctgtagaacaactgcaggtccatgcactgttcgtacaatatgcgacgttcttcccacaaattgttcaagctcgtctgctccgtggccaaattctgtaaaaaaaaattgttttaagaaaaatgaaagacaaaatttcatatttgtgatatgagcatttaagattttaaaaaattgtaattttaacttatttttagagtatcgaatcattattgtatattagtattttttaattattggaataaaaaccctacaaaaacttatttctatgagatgttaacccataaattggactcatactttttccgaatcagtttacagaatgatttcagaaacctataattttgtcaaatgatttttctcaaatctttgaaataactttgttaaaaaattgaaaagctaaaaatacaattataaatattctcaaaacttttctttatattgtatcagggctgcaaaaaaatatgcatattttttcctggcttctctatgctctaaatattacgaaaaacatcttcttctttttggtatttgcgtataaaagtcggtacttttatttgcatttttttgcatatttcgagatttttgtgcatattttacgattttgtgcatatttggtgtatattttcacgactttatttgcatatttatgcgcatattttggtcagttttcgt

SEQ ID NO: 11315 - DNA, 1218 bp, Heterodera glycines
tgtagaaaatttcatttttttaattttagattcatttttaggaaacttgcgtgcgtttgatcattaagattggaataattctttttttcaattaattttcaaaaggccaaaaagtgggaaaatagggtaaaacaatcaaaaatttcaaagcgaaaaccccaattaaagcatagccttaataatacaaaagtctgattcaaaattgataaataaaatgaaaaacttttaattggccaaaaatattgcaaacttaaacaaatttttgtcttaaatggtaaaggtaataccccaattaccgatttataatgcgcccacgcggcaacaacgcgtgcctccatcagtcctgtcgaagcttgcccaatcgcactattcacgtcttggatgaattgctccaacagttgcggcacatgcgctgcaggtggcggagtgtagatgcaattgccgtgtccgtcaactactctcacgtcaactgttcttatgttgccgcccaaaactccatggcgagccataattgcgaggtgtatggtgtcaacaatcttcaaaagtatgcgctttgttaacaggtttacgctaaaatagatggctcccggacaatccatcagtggacaatccgtcagtggacaatccgtcagtaagtaattcataagctaattatttttaaaccacagagatttatttaaaaccatgtgataattaatttaagtcgctaaaaatgttgattaatattttgtgatattttataataattatgaaataatctttttaaagaatttagtcaattaattgaagtataaagtaactagaaatgataagaatctataaaaattatatttattacatttaacaatcattttcgcaagaatttttgaacattgctcaaaaaaattttctgacgaatttccactgacgaattgacttattttttgaacaaggtatgaaaaatttgacgtatcaaaaaattattttgtggatgcattatttttttcattttccgaaaataatatttatgtagaaaaatttcatttttttaattttagattcatttttaggaaacttgcgtgcgtttgatcattaagattggaataattctttttttcaattaattttcaaaaggccaaaaagtgggaaaatagggtaaaacaatcaaaaatttcaaagcgaaaaccccaattaaagcatagccttaataatacaaaagtctgattcaaaattgataaa

SEQ ID NO: 11316 - DNA, 6339 bp, Heterodera glycines
  misc_feature (3320)..(3320): n is a, c, g, or t
  misc_feature (6254)..(6254): n is a, c, g, or t
cctttattaatttaaacaactttttgcagcttatcttttgaaaaaaactttttggggaccagggaggaggagggtggctggcggtgccgataggcgccgccgggaaaaaaaaattgaatatttgaacacaatacattgttcagattttgtccaaaaatgaccaatttttgcaaatttgagccagtttttttaagaaaattaaggcttttaagggtccggcgggaaaatttcttgaaattttggctatatattaacagattttcaatcaaaaataataattttaccaaaaaaactcaattcttaccagtgtatttttactcccgtatttgggtcaaaatttacgggagcgggagcgggagttcgagatcttccgggagcgggagttcagatctttccgggagcgggaatcccgtaaactcccgcgggactcccgctcccgccggactctagtattttttattaaatttgatcattgaaaaatgcaataaaatcgaaaaaaagtactatggtcgactttatggaaacttacaaaagttcccaaaatttggtaatttgccaatgcatttgcatttggtactttccatttttagggaatatttttagtaacggttaaaaattcgtcagataataaaaagatgatttttttttgacttttagacgccgcatgtcttaataagttttttacgcctgtatgaatcatgtgaagcacatataggaaggtgcttccaagtgttgccaatttcgattaagttgactgactaagaataattatatcattaatatttgggaaaaaaactaaaaaatgcttgttatcattagggatacgatttttaagcgctaaaaactgccaaaatagatgctaaaaatgggaaaaataggtgtcaaaaagttccaaatttaggggtataaaacgtcaaaatttattcaaaaaagtaaactaatcactattcagataaataatttttacaatcaaaattcttgtcaaagaaagtaaataaataaattgtgtagatgaatttttgagaaatttttaataggggtgtatttttctaatattttttgggtcgattcttagggtatgtttttcgtttttccagtcccaattttctgtaagtcccgaataaataaaacgtcaaaatatttccaaaatcctccgaaatgctaatgttcaatgtttgaagtgaagctaaaaactcgaatttaacccccgtttgagccgatgggcaaatttttcaaattggtaacaaaagtattaaaacattttttagtcgctggtggtcacatcggaggccatgcttcagatttggaatttctcgagccgggatcccaaccaaaaatcccgacctgcaaatttaattgcatattttatttaatattaattaattcatttttacaaaatctatctatttaccattttgcgtttttacacgtaatacattgattaatcttatataaaaaaatatttccataggaaaatttcattcatcccaatttatttaatatttatgtttaaaaaataattttctataaaattcacagagaataattgttgttcctgcttcttcaacatgatggcacgcgcttcgtttgctttgcctcttcttctgctactgcttccactcttttgtgtggcaatgaatgaaaacgatggcactgttgccggagagggaagtgccaacagcgaaacatggatagaaaaattagccaatttgctatccgaaatcggcaaaatttgtgatgtgtacactattttaccgcgcagtcactacaaaattttgtttatttttggaaagtttggtaggtttttttggtgtttatttggcgcccggaaaatgcgtcagttgtaaaagcgtcagtagaaaatgcgtcagtggaaattttgttgtcctaaaaacaagttcctttcgttttcgagatcactgaccactaatccagtatccatttcggtcaattccgatccccggacccgtagcgatcaagggttacatgacattgtgccccggacatttgtcgtcttttgacattttaaaatttttaggtgtaggcccaaagcggaaaagtatttttacttctatattacaatactaatgccacagagctttatttcaaaatatttatatcactgacgcattttccggtcatagtttatttatatttaaaaattattaaaaaaaagaatcgaaataaaattacttagaatggaaaaaaattaaatcagccaatgtattttttaaagataatatcaacgataaaaaagtgcagaaaatagaaattgagacggatgacaaaggcgactttcggtggaattttgatgaaatgatagtccaaaacaaaaccgtagcagctggagacggtccagaggttacggtacttctgtgccgtacaagcaaaaagcattgccacgtgttccgggtgtacgaaagttttgccgaaatgagagaggaaatgaccaaaaatgagggtcgattttatggagctttccaggtgatgtatgaacattatgggcattgtataagcatggaaagtggcgcttattttggcgaaacggagcaatgccaaaagagtgaaatgtcccaatcggatgaaaactcgggaatggcatactcaccagcatcatacagccacatctgtgatacgtacaccattttgccgcacacatattacaaaattctgttgctttttggcgaattgagtaagtttaaagaagaaaaatttgatttttgctaaggctaaattaatattaaaattccataaataaattaattttcaaagaaaatgcccacggagaaaaagtagaagtgcccaaaattgaaatttcaactgatgaaaatggcacctttcggtggaattttgatgaaatgatcgtaaaaaacaaatctgtagcatcaaaagatggtaaagttacagtgctattgtgcaacttggtaaaaaaggaatgccgcatatttcgcgtgtacgacaattttggcaaaatgaaaatggaaatggcacaaaatgagtgccgattttatgagcatttccaggttatgtatgaacattgcgaccactgtactagcatggaaaacattgggaagagaaacgaagaaggcaattaccttggcgaagtgtcacaatgccaagaacaaaaagagaaagatggcacgggggaacagaaacatcccaaattgccaatctcaacatttccgtcatttcacaccttagcatcaccggaaaatgaggcggaaaaagaggaggaggatgtagaggaggatgtgccacttctgctggaaagaggtgggcacgaaaagcatggacgaacccaccaccgatcattgagacancggcgggtgggccaaagccaagcggagaaagaggaggcaaattgaaaaaacggaagagagggaggggggaaatggagaaacagtgacgaaatgagagaaacgggaagcgaagcaaagaaaaaaggaaaaaacggagggaaggggaaacgatacaagcatttgttgataaggggattgtaataaaatgcttttaacatcaatgacgagattttctaaaaaattttgtacgtgattgaaacattttgagattttgcatgccaatcgatagactttatgctaaagcattttcctgcaacctttaagcacagattggttaatttagcacaaatgtggtccattttcagactaaatctgtaaataatttcatccaaaacactcaaagtttcggttcggttaacaaaccgggttccgacatttgcgcctttgcccaaaatcgggttcaagcttaagttctttcaatccctgatggcctaaacaacattaaataaacgatagaaagtgattgtgtctgataatttgatgattagtaaatttttgaaagaatcaaaattattcaaacagctcaattaacaaactagatgactatgatttcttaatttaaatgctgtttaggctatcagggcttgaaaaaattaaagtttgaatccgattttgaaaatatgcgcaaatgccggggctccaaccaaacgaccatgacttgcccaaatttgttaggtgttgtgccgtcaaatcccaaaccggcgaagtgaataaacaattattttattcaagttgggaagacacaaataaataaatgaagagaagagggacggaggacaaagggcgaatattgattgaaacaatataagcaaaataaatggttgacaactgaatgacggggaggtcagaggacgcggggtatttatggggggcagaagggaagagagagagagaggagagataaaggggagagaaataaaggaataaaaataatatgggcggataatagagtaccgatcccaacatcttcccccttaaaaaaatcttttccctcggttcttccgtgattcgtccgtctgacacgtccgttcaatgacagcagcgggtgccactacaggcaattgcgcttggccaccatgctgaaccagcggtggtgccaatggcaaatcaaacgcatcattgaacacgttcaatgcgtttgtgccgttttcgtcagtgcttctcacaagcaactgattggtatggaaccgtccgaattttccgtcaaaaaattcgacgtcgtaaatgacacctttacatttggtgacttttcctggacgccaaggctgagaaagacgatgccgagcgagaaccttatcgcccaaggcaaaagatctcggtttggctccatggcgcctattaaattgcttctccatggcctcgtctcgaattatcggtgcctttggctttgacctcaacaagtccaaagtcgtgcgcggtttccttcttagaaacatttcggccggacatttgcactccggcaaagcctcacaaggcgtggtccggtatgttgccaagaatgtggtcaacatttccgatgctccttctcccttgatcttccgacatgtcctcttgaacgtatcgacaaaacgctcggcttgaccgttcgacatgggattgtacggagcggagaacacataattgatgccgttttcggtcacaaattccttaaattccttttaagcgaattgtgtgccgttgtccgtgaacaaaatttcgggaaggccataactggcacaaagtgaccgcaatttgtcgattgtagccgcggaattcgatgaacgcatttcgaagacctcgggccacttcgagtacgcgtcaacaattatgagaaacatttttcccataaacggtccggcgtaatccaaatgaacgcgtttccatggtccgtcagctttcggccacgagtgaagctcagtattcaccggcatttttgcctccattgtgcattcgttgcacattttgacaaaattttcaatttgttcgtccatgccaggccagtaaacgtactgcctggcgagagctttcattcgcttcatccctggatggcctctgtgcagaagttgtaggacatccttttgaagcgatgccggaatcacaactctgtccgcataaagcagacattcatcctcgatggtcaaagggtctcgtcgtcgatggaacggaacaatgtctgcggccattttgttctttgttggtcaataagagcagacaaatttcttcactttctgcatcacctgatcgtttttcgcggcgttagccaaatcactgtgatccagcgggagagttttcgaaacaaaattcaacactcccgtttcattgctttcacgaatgtttgcaatgatcacttcgttgtccggcactggtgtcttcgcgattaggcgcgacaaaacatccgcttgaccgaaatcagcagtgttttggtattcgatttctaagtcgtagccaagcaatgtgattgcccatctctgcaatcgattcgctgtgcaagccttaattccctttttgttgccaaaaatggacaacaacagcttgtggtccgtctgcagaacgaagtgtctcccgaagagatacttgtggaatttttgaacggcaaagacaatcgttaagccttctttctcgatttgagaataattcttttctgctgctgacagggacgatgatgcatgtgcgatggcttttagacttccatccgaaaagcggtgagagatcacggctcctattccatgctcagaagcatcagccgatacaatgatctcttgtgctggatcgtagtgtgtcagcaattgatcagatttcaaaattttgattaccttctcaaaggcattttgacaatcttctgaccattgccacactttgtcctgtttcaacaattcgtccaacggctgtcggatgaacctcatggtcttcacgaanttgtggtaaatggtgatcattcccaaaaatgatcgaacctcggacacgtttgtcggaacaggcatctcagaaatcgcctgaatct

SEQ ID NO: 11317 - DNA, 1216 bp, Heterodera glycines
atttgcacgcctttcttcgtttttcttgtctcaacacacttccccacccttcgccaaatcattttgcaacgcttttcttccgtttttcttgtctaaacacacttcttactcattttgcaatgtttttttaaacagtgctctctctgtgcgtataatgaatgaataaaatgatatccaggcaaccaaatttattggcataattttgtttcaattttttagtgcatattttacgattttgtgcatatttgatacatctttggcaattttatttgcatatttatgtgcatattaatagcagaatggaatataatttaattgtaattgtttttggcaatttttacagacatggccgagtgttgttcatctgtttctgcttctgacaatggcactgctccttcttcctcctcctcttcttgggctgagttgggtctttctgatgcgactcttaacgctcttggcacaatgaagtcacttctcaacaatttcttaaattgttttattttcttcatttagtttcccttttccaactccaattcaaaatgctgtgattcctatcgctgttaaattgaaaaaagacataattggtgcagccgaaacggtttgatatccaattaatgctatttaattgggtctaatttttcaacatttagggcagtgggaagactctcgcatttgccattccgattctcgagcattggctgaccaatgcaattgccacaaatgtccaacattttccggtcaaaggctctctttttgcgcttataatttcgaccacgagggaattggatgttcagcagggatgtgcctaggtttcgcctttcgcattattcgcattttttggcgtttcgcatttcgctttttggcgcgaaaagcgacttttacacccctaagaattggattaaattcccataaaatttttcaaaattttacctataaattggctaattttcagtgaaaaccagtttataaatgatcaaaatttccaattttttccccggcggcgcctatcggcaccgccgcgcccccaaaactcctattttttcttagaaaatggcccaaaatcgcaaaatttggtaatttgatgaaaaactgttctcagcggcgcgccaaaactcttatttctcattagaaaaatgataaaaatcacaaaatttgatcattttttagtgaaaatctgtcaacaaattttaatcaaattttacaaaatttttcccgg

SEQ ID NO: 11318 - DNA, 2848 bp, Heterodera glycines
tggcccattttaaccctttcccccgttgaagagaaagacttggaattgctggccgtgaacgagcccaaactgatggagtcgtgtcgctctttggtcaaatggcagcggaagcattggaacattcgctaaaaaagtgaacaaatggaaagggccatgggttgtcgaatgatcacagcgaaacatttgtgcagagaaagtcgcgtgagcaatggttcgaacggatagcgcgggaagcggatttggtgtgggaagagggggaggaaaaagggcgaaagatggcacgacggactgacacggacgaaggaccgacaaaagagtgggtcaattgaacaacaatcggacaaacggtcgacttggcactgacaaaaacccatttcagggaattaatgagacagcggaaaagggccgttgagaaagaaagcattgaaaggaaagctgaagggaaatcaacaaaattgagaacagagagaacggaggattaaccaaagtgcagagggaaggaaggtgaaaattgggaagaggaaagtgagactggagaagggactgaagaaatgggtaaaacgggcgaagatggacagcggacgatgacgagggaacgcaggggaagagaggaagggaagtgaaagaggatgagagagtatgggaagtgaaagaggaggagaggaagggaagtgaaagagggagtgaagagcataaaatggaagaagagggaaaagctttgctagtgaaccattttctgtttgtttgtttgtcttgtttaatcttaagtttaaacggattgaacttttcttcgcattcatttgcttctccctttgcattatttgcataatggtggctcatttccttccgtcattggcaattgtcgaacttcattctctccccatttgtccctttcccaccccatccatccgtccgcactttgtgccatccaacgcttcgtcctccggcagcccttttctttcaattggccaagcctatctatcgacatctcttacgtatattgtcccgaacgagaatgaatgagggggacacaatttctctgaatgccttcccccgagggtattcttttgctttctcttcgtgctctgttccatttgccctttcctccgtttttccgccttttggttttggaagaaaaataacccttgaatttttcataggaaaaacggaggcaaaaaatgccatcggtcgatgagagagaaatgggggaaaaaactaaaattatatgacaaaatcattggtttcatgggtttttatcacaaatttttttttcaaaactaaaggatccccccttttgtttttgatagaattcaaaatcggtactttccatatagcgccaaatcatttttggaatttataattggctgtttctaaaaatgatgaagtctttccccccttaattttatctttttttttgctcatttcgccgcgtttagtccaaatttgccctttcattctttcgtccttttcatctttcaaattgttcaacaattcgtccaacaattgccattccgacatctcttcccgagcacagtaccttttccaataatcacaattcaacggaatgcctttgcgctgaaatggaaaagggccaaaatgcccccgggggaaaaaagacaaaagtttattttgcggtacggacaaattgtgcgaggccatgggagcgaatgttcatctgcggaggaagccgactgctgggaaattggaggcccgaaaaggcattggaaatggcacgagaagcggaggacggcgaagagaattccttcactgaataacgatttaagctcaaacaataagtcaaaaacaggttcatcactacaaagaagcggagaatataagtgagcttgggcagcagcagaaccgcggccaccgattgaccggagaagcggacgaaagagacgaattgcgatcatttcccactttggtcgaggcattgcaaagatatttttagactgtccgtcaaacagaacaagtacccggtgcttttcctttgtgtgggccaaaccgacaggcaattaacgattaattgactgaattactttaaaattccatgtttaattaaactctgttttaatacatatgtgccatttttggatgaacggagcaaagtgacccgagtgggctccaactttgccgcctgctccaaccttttggcaaggctaaaatgccattctttgaaattgctccgcctcccaccgcccattagggcatcaatttgcacagcgaagaattgctctccgatccgtcatccctgaaaagggccgttgcaatgaaactgatcactttcgtctgggtagaggacttggacaaattggaatacgttgcttatttcagacggcaaaatgtggacgcgattatctacgacaggtgaaatgcgcaactttatttttgagtaacagcccaatattttattttttgtcgtcgcaattaataacaattttaaaacaaattaaccccaagaaaatattctaagaatcggcgaattggaaacacgtcaaaatgtgttcgtcgtggaaagggaagtgaagagcgccctgttcaagtcgccccgcacttcaccttctctgtcgcgagcaaattcactgtttcgcaacagtcaaagcccgacgatgccggtggaagagccaaggcggtcaccctccgccagaagaatgttggccaacggatttgcccggcaaatgacaattgccgacactgactttttcccgaccaaatgagtgaaaaatcttatgtttccttttccgaagaatatccaactgaatctttctttattaatatgagcatcagaattgaacaaatgattatttcatggcgatttgtccgtccttttccttttcgcgcgtttctc

SEQ ID NO: 11319 - DNA, 2409 bp, Heterodera glycines
  misc_feature (104)..(104): n is a, c, g, or t
  misc_feature (109)..(109): n is a, c, g, or t
  misc_feature (113)..(113): n is a, c, g, or t
  misc_feature (2383)..(2383): n is a, c, g, or t
ttcttatttttaaaccagaatattgaggatacgaaacccaccatggagataaaattcatatttactcatcattattatcctatgattataggagaggaaatganatttnattncgacaattatcgcccttccactcatatatcaaataaagaggtcatatttgaaaaaaaggaaattgtctttcagccaatcaaccttcaccaaatctgcagtggaaaggaaaagggttcgccagtatgagagggagggattaaccttttcagccaatcacagttgaccattttatgcaaacgtggaaggtttctctcggtaaatagtcggtgccgggtaccgagtggtagtcaatgtttaccttcccactattcaatcaatcccctttccatcccactaaaatttactgaataaaaacggaaataattattttattggaaaattgtgaataaaattttggacaaataattctggattatgtgatataataagtttacgaaggaattcattaaaacttaatccaaacgataaaaaatacacaaagcaaatacaaaaatgggcacatgaattagacataggagattgaaatttttgtttattataaattattcctggaaaatcacgaagaaaggactttaaaacaatttcgttgattggaagggttaagctatcaaaataaattgcttctttttctaatccataaacaaataaagcaatccaatgtgatccaggaaattgatgtgggtccaaattaactattagagatgctggaaatcgtagtgatttggaatcaggtagttgatcgcatgggaaacatccaaggaaagtgcgattcgttatttctgatgccttcaatattttggtaatttgatgactatccatttgtcttagtgcgtttttccgtcaatgtgaactttaaccaaagaatcgatcgtagctcataaattattaaactgaggactgatagggcaaatatgactatcatagcccaacaaaaaacatgcgcatacacattagcttcttttggtagctctttgcaaagaggaataaatggaaaatttatagtttcagctggttgtttttgttttaatgctctgattgactgggaagtgattgtagttatttttgtctttgttgttgtattgtgtatagttttttgggttgttgaaaattttttattttgagttgatatgtttatttttgttgttgtaatatttttagtttctgaagcatttttaaaacccaacaatcttttccactctttatattggggaattttctcagtatttattccttcttctacaacaagtgcaacaattgattggaaaaatagggaagccaataaaattttcaacattaaaaatgattcaaatggttgtatcagttgcaatcgttctgtttttatccaaaaagtaaatagagtccgtttcacccatcacaataagtgtaattccaccatcgggtactggttttttgaattttatgtttacagctgtacattcctttttgatcagatcgaataaaccgccatgatcgtctccgctgtttgtcatattaaacacataaatacagtgagtgtgcaaaaatgaaaagtaatcaattccatttccatatgtagagttggcaaaaccaagcgcctcctgcgtgtcattgtagggacgaacaaatttccaattttcatagtcaatgtcatacggggcctggggataagagcgaccattggccacaacactcaactcccgtacattaaagtgctgaaagttgaatgggctccttttggtgttccccacataatctgaatttgcgacaagtcccattgttacaaggcgtggaacttggtccatgaataaatttgcattaaattcatagcgtccagggcttatgaacagtgctttcatcattgtctttcgtacagcataccgtgctggtttcatttccaattttttcgccaagtcaagagccaagccgtccataagacttgaggtacattgaaaagatcggcatcaatttttgcaatgtattgtgctgttcgacctcccaaatagcgttgtcttctacttttgaacccttcggaatttgtgttttgtagattgctaacatcctcacggtcgtatccggcagcagttaaatgcgaaacttagcttcaagtgattgcgaaagttcatgagaaagataagttttgtatgccatcagtgaatttgaattgaaaatttcacgaccgtttattgcaattttcatgtctcgtatgaacgtgtgtccaatcagttgtatcggtacaacctgatcattagcatccaaatgtccccattcaccatttggtggtgtcaattttcgcattcgaaattcggtcaaaaggtaacactttgacaggtcaatgtagttttggctcgangtgtattttaaaatggtaaggtgtgt

SEQ ID NO: 11320 - DNA, 2362 bp, Heterodera glycines
  misc_feature (108)..(108): n is a, c, g, or t
aaaatgcatcatagcccgaaaccgaagtgtcatagagaatgtgacccattttattcaatcgattatgtcaaattatacaataatgagtgaattcaaaaatttatcacnttcttaaatatcagtacgatcagcactgttcaataggaaaatggtactaatcttccgtcggtcattgttcttaattcaatttgaatttctgacacttcttttggtaaaacacgtgcgtataggggggagtcgtaaattttttcagtgtattctcccggcgttgctcctgacactgagacaacacggagaagagaactcagtgaatttccaacaatcatgttttcagtcaaccctttggcgtagacggcaaagcttgcaaaaaccacgtaaatcacttccatatttggcaatctcattgtttcttacgtgctgcgcgttttcaaaacctaatacataaccaagttgaggagaaaaagagataaattcaattctcgggtgtgtaaaaaccgctttaaaccgatcaagatttgggtgatattgtaactccactccttcaatgatttgtctaaccatccgtaagtttatttgtttccatttctcatctccaaacaagacggaaatcaactcctccacccggtttctttccgttggttcttcaatttgccctaccaaatcatcgattgtttctttcggcggttcggtaattgtcgtggtagtagttgttgttattgttgtctttttactattttcaggtgttatttcagtgactaactgagtttgaccctgattaatatttagacttttttcatttctctgtttgggtggtggtccaatggtatcaattgaaattgtctttggtggggacgtggtttttttctcagtaacatttgggcgtattggtgaagtgggtgtagatcgatgtggtggtgggactatttcaattgtactttttttgctcctctgagtaggggtagcagttatttttttctgagcttgtgacactatagcttggttcaacactggtaattgatgcttagtcttcccgacttgagatggtgattcgtcgttctttttgggttcttgattttgcttattcgcatgtatcgacggacttgtaacaggtggtggaggaatgatattttgtgaaacaccttcactattcacatttttcgtctgatttgtaggtagtgaaatattttgtgtgggcttctggtttattttttctgtttcgtgctttacaatttctgactctttttcaattttcggttgcttttcagatggttttgttacatttaaaatcgaatcagaaatgtcctcggatttagtttgtggctgctgtccaactcgtggtggagatgttggtactttaacatttagcgttacattgggactaacattaggttgtgactttggtacaattgcactaggaggtgattttggctgagaagcggcccgttttctttttattgacctctgtgaactatcttttataatcttttcaagagactcagcatggttctttagggttgaaataagaaaatttcttaaattttcaattgttgtgtttgaagctttcggggcgggtactcgaacaatcctaagcctttcattatctaaaccatccgtaaaatgtatgttgatccactgatcatctaaggttccaattgttgatggccaagaataggcataattaatgctgtgtaatccgcatacccaagagccattgaaatagataggttttggtaaacgaactctaaacttatttggtgtattctcagcgtagtctgggctattactggataaatgcacaaagaatgtgttagacatttatgcaaaaaaaataataatgatataatgctaagtttacaagtatttatacaagttgggtctcatgaatccattccctttcagggtatccaataaattttacgagtacttctgtcgttccgtcaggcattttccgtttccgaaaaactctctcaattctgtaagtcgtctcggcatccttacgtacgggtgccaattcttccgggtagaaaaatcctttaaatttctccccccttgaatcacgtagcttatatctcattggtttcatgtgacgtttgacggcatcaacttcgagaatttcgtcgccgtaattgggtatataacctttctcgaattgaccttttgctatgctcattcctaccagggttgttccgggtcgagaaaagtatccgccacgggtttcgggtcgggtcggccgaaaaatcatcgggttcgggtttcgcgtctagaaaaaggccgggtttcggatttcgggtcaattgacaaatttttaatttgtttaaaaatcaaatggtactgcaatatttgcagagaattgcgccattta

SEQ ID NO: 11321 - DNA, 2088 bp, Heterodera glycines
  misc_feature (2073)..(2073): n is a, c, g, or t
cccattttgataattatattttcgctaaatgcccctcaatttcggccccatccgtccgttaatcgacataaatataaatacaaaatatatttaattgaaatatcgcagcacttcaatgacgctcaaaatgctccagtccatgccaaccacttttggataagcactgccaccggaggcaaatgtaccggtcgatttggccaatgccattttcaattgatcaaaattggactgaaagtggaaatttaaatttctttttttcgattaaaaattcattaatatttaatttaaatttggttttttccaagaaaaaaataggaattaacaaaaagtttcgcctttctgctgctgatgacctttttttatttacgataaatatgtaaattaattaattttttcaactgtttgtgatcaattaaaattaaaaattctctctctctcaaacaaattaatttcagttaaattaataatatttttctgtaaaataaattagttaaattttcagaaaattcgttaaagccctctctcgtgagagtatgggaaattttgccgggttaaattttttttttttttaccctataagcctccaaaaatgcattgcgcatttcattgcctttcccagtcgaggcggaatttaattgctgaatttccatggccaatccgtccgggccaatgccgtcccggagacagccaacggcaagcgaaccgatggcattggcaaaaggggacgagggaggacagatttctgccaaaaattttgattcccaaattgccaaaaaattggtttagtaaaattttgccaaaaaaattttgaggccttcaaatttcaactttttgcctcccccgcggccaattcgtcgcccgccagcgcggccaacagcaaacgacacaaatcgccaattggcacatttaaagaattgtcaaattgttcatccgccgttgttgaaagggtgtcaagctgtttaatgcgttcaacgagttgttgctggtgttgatcaaccgctgccatctctgatcaaaattttagagcaattttttgctcaaaaaatagcaattaaatggtaaaaaaaacttgggaatgaacccaaatatggtgatgaaaaatgatggcacatgccattgataacatttaaatgacagatttaaaatcgcatttcagggcaatgataaaaattaggcacaatttaggccaattttcccgggtcattattatctggcttttgtgagagtaccaacattcaattatttgaattagaaaaaccacaattttcgggggttttgatgttttgcctctcgaatttgggttgtccattcatttctcggatgatttggtaaattgaattgtgtggcggcaatgaataaaatcttcctaacaaaaaaaaatttttttttttttttgtaaaaagccaaacgaataagttggaactaaaattctataacaattattaaaggcacaataataacacgcacaaacaaacaaacaacaacaaatggtggaaaaatcattgttgtccccccaataattatttatgactgtttccgttgtgccgcctcctctttggcctgcgcttcccgctcaattctgtccaattcgacatccaaccgttccttggcacggaaaacctggaaaatgccatattcggaatgaattttgcacaacaatttcaaccataaaattggtggtggcaagcatttaaggagcaaaaatatatatatatatcagaggggaatacgaaaagaatttttttttttttagctctttggccctaaaaatttgttttctgaccaatttttcagactaattcggctttatgggcacctaaatagttcatgatttagcaatttttcgctcgaaatttgtcaaaatatagtataatttaaaaaatgcccccattttcctaaaatttaaaaaaaaaaaatttttcatttcgggttaaattcatacatatacaaggggtgtctcgagacacccccccccaaaaaaactatttttttcttaaaaaaatagcccaaaatctcaaaatttggtcattttttagacaaaatctgctaacaaataacattaaaattacaaanaaaaatttccggcgg

SEQ ID NO: 11322 - DNA, 2396 bp, Heterodera glycines
  misc_feature (78)..(78): n is a, c, g, or t
  misc_feature (114)..(114): n is a, c, g, or t
ctctatgttttcatatgactaaaaacaatgggcgtatatctattgattgatgggaaaagcaaaaaaaaagaacagaanagccctttaaaggcgcagcagaaaaagccggaccgncgcaagaaaaaacgggcccgagacacccccccccccagacccactcggccgacggacggcccgaggacagagacacccccagcacagggaacgaacggacaaacgagcacaaaagggagggacccaacaaaacgccaagcacaacaccaacaacaaccaaaacaacaacaacagaaaccgccgcaggcaggaacagcgagccgccccagcgccgaacaagcgcagcgaacacgagcccacaaaaccgcccaaagcccgcacggcccagcggtgtttggacattcaaaatttgtgctgcttcctgcaataaatttatgcattcattaaaaaaaataaccacaaaaaatgcaaaaaatggttggtaaaaagacaaaagttaagggtaaaaacacattcaaaaaaatagaaacatttttgggaaaactcagacacgaaattcacaaaatttagactggccaaggcccgtaccccgccccccccccccgttcgcccgaaatgaaaaatgtttccaggaaaatttggcatttttttagaaaattttaatcaaatttgcttaacaaaatgcagtaatttttacaactttaaaaaaggttcaaaaccacaaaaaaaaataaacaaaaagattgcattttagccaaaaaattctaaaaaaaaaatcgaaccgattaattttacccaacatttattttgcatcgtaataaaaaagcaatactaaatggtcctactatttcacctgaactgtgatgcccagcctggtgttggtctgcaacgcctcccgttcagtggcacgccgtgccgacgccgtagaggacgtggcagaggaagttgaggccgtgttgttggcgccgccggcactatctgacgcggtcgcggcggacgcttgtcgccgggccgcttcacgtgaagctagaaaaaaaaatttaaaaaatttgccgtcaagaatctccatattcattccccaacccaaaagtagtttaccaatggggacaaaaattttgttttttaatttttattttcaaggcatggaccctttgttcccccaataaatcacccaccatctgaaagtgtataatatttttgacaatagagtgtatgaaacatatcataatttgtgagtactagtgtaaggtttaatccccatattttagacgaattttataaattttccaaaaaaatgtgcacgcaaaattttcaccggatttttggcagcttacaattaattccggcataaaatcgacaaaaatatttaaaaaataacaattaaactcctctcgaaccgctcgcgcaagtgcccggctgaccgccacggcgccggcagcagccaccttggccaattctttccagaccatttttaagtaaaaattttaaaatattttcctctaaaattcgaaatgtcgccaattttaaatttacaataggtggcataaaaaaaatgcgtttaaatattacatgaaataaccaacaaaaaacaaaatgcacacacttgatttatcatttttatttgaatcaagcatttgaaaattagaaaaaaacaacaaacaaaagtcaatctcggtaagacaaaatttgtggcgttgcaaattcggggtcaaccggtgcagggggaccgtacaatgtggtggctcgttgcagaaagtcggtgaccatgttccgcaccactgaactgaatggggaattccaatttaaattagcaataatctttttactaattataaaaaccaaagcttaatgatgtgaggttattttttcaaaataaaaaataaaattcgaatttatatgttcaaaaatttgggaatttggtctcctcaaccgaattcagacaactttgaatgtcgctaattgaaataggaaaacaaatttgttaaaatgtttctaattgtaaaattttttttagaatttatcactttttatcgtatttttttgtttgccatggaactttgatttagttcaaaaatggaccaaaattgcatttcttgacaaaactaaaatcagaaaacctcacccaaagaagagatggctgacaaaggcgtgcaattggttccgaaattggaaatccaacgaaaaatggactgtacaggtgcgcgtatcttgcgcatgttgtagggatgggccgaaacgccaagtggtgaccaaatggtggaacaaattgccatcccgcgtcccacgagccttagaaaaacagaggcaattatcattttaggtaacgaaaaaatatttgaataaaattgtaaaatttttgcaaagtgacgcctaactacaaaattccttttaaattttaaaaa

SEQ ID NO: 11323 - DNA, 4687 bp, Heterodera glycines
caaaaggggggggggataatctcctttattaccaaaataagtgcaaaactaactaaaaaacttaagatttaaaatttggaatgcgcaaatttggatttgtgagagatcccgcgtatctgcattagataccggcgcgcgacggggtcccggcgggattttacggggtcccagtccgcaatcccgcattttttgaaaattgtgggattaaaccgcgggatcccgtcccgcaacaaaattttgagttccaatcctgcagcgggagcgcaaatttgattttttgtccgggatccagcgggatccgagcattgcatttttttaaaaattaagacagaatgccaaatattttctgaaataattttcaaaataaattccattaaataaaaaaccatttttcaccaaatttaatccaaaatttatgaaaattttggaaatatacacggcgagtcaattttgggctccaagtacaattaagttggttttttcgtcttagtggtctgtgagttagtcatcaaaaagggggtctcaggttcaaatcctccttgtgtttgtgtataaatttcaattttttaaagcaaataaataaaatattaataaaaacagaacgccaaaagaacaaatacaaatagtggaaggtagacattatattttacccttgattttattaaatttttttagcttataactttgtcaataatagaccaaataaaaccattttatacttattttgaagggaaaattctgaagaatatttcttaattagtcaaaagtttaaaaaaattgtttattggcaaataaatgtttcatgtgttattttatatgttagagacatggaaatagtacactaaaatgagagaaaaagaaaaaactttgtcctgggtcaaaaaatttttccttgggtcagattttcttcaaattttgcataggcccatattttgaccccctctatcgaattctcttttgttttctgaaagtttcttttctaactcgagatcggctcttccatttttacaagggaaaatccccaataaagtttaagttttgcaaagttttggcgttctgattactaaataaataataaacttatttgtacttggagcccaaaattgaatcgccgtgtatacaaatctatggtcaggttatcatcagctccctcgaagacccccgggtagtgattgaggtactagttgggtttgtatccgccttttgggtcaaatttttcagaagcgtagccagacagtcagacagtgcactatttccttctttatttttctcacctcttcccttttcccacacacaatgctgccagccagcacaccacacggctgcttactgtctacccttccacccgccgcagccccacgttgacagacagtcagacagtgcactatttcttcctttctccagtgactaagcggaagaaaagaaggaaatagtgcactgtctgactgtctggctacgcttctgaaaaatttgaccaaaaatgtggatacaaacccaattagtacccagtgacgaaacatcagggagccttacgagttggcatagcacgagttatgtatgattttccattttaatcgtttagatagtttgacttttatcataactagggatggtaaaaatatggactaaaaatcgcgaaatatggacataaaatggtaaaaatctcaaaatatggacataaaatggcaaaaatatggacataaatttttctaaattgaggggtaaattttcaaaaaaacccgaccaaaaaaccgaaattttccattttttgcttatctttcacataaattaaccaatttttaagaaaatttaaatttaatcaattttttttgacaaaattttgctaaaaaatgtctttttcggagcattttctggtctttgaggttaaaacggccaatttagctgatgggggccgttctaataggggtttttttggaaaatgcctaaatatggacataaatcgcaaaatatggaaaaatatgaatatagaaatccatcttaaaagcttcaaaccaagctaaagtccccagcagctaaattagcctttttgagcccaaaacccgaaaaatttttcaaaaaatcattttttcgccaaaatttctcgagaatattgaataaatttaaattttcttaaaaattaataaattatgtcaaaaataagcaaaaaagcgaaaatttcgcttttgttgttgattttgcgctaaaaaaattaataaattttagcttttatgtttttttttcttttaaaatgattgcacgtaattgccgaaaaaattcgagaccaatttccgaatgttgactgactaattgcaaaacgaaagccgtctttgtcaaagcgccttaccgagtcaaaaaatttggaaatgtatctcatatgcaatttcaaccaataaatttgaagaaattttgcactcaattttgaaaaatttatgtccatattttgagatttttgccattttatgtccatatttgtggcatccctaataattaccatccctaatcataacgtttgccaattttcaaaatttgaaaagggcggatttaacctttacaaatgaaaaattatccgtcaaattgatttatttgattgatttgttggttgaggataaggtaaaacgcccggcaaatggtcatcattttgcaaaatattctcctctttggtggtcctcctctgttgcgttccctttttcttcctcttccaatcggtcattttatgccaaaatgtttccgccccttccgtttttgtcaatgatttttcgtttcccattggcacattgtccaaccccattgaaggcaaaaaacttcaaaaattgttttaataaaatgtgattttcgtgtttctttcatcaagtacaatccgtaaaaaataggaaaaatctaaaaaaatcagggctctctctattcatatacacggcgattcaattttgcgctccaagtacaattaagttggttttttcgtcttagtggtctgtgcgttagtcaccaaaaggggggtctcaggttcgagtcctccttatgttgtgtgttaatttcaatttcttcttttacagaagaaggcagaaatattttttattaataaaagttttcgtgtcaaaaaaaatcatattcaaaaagcgttggttacgtacaacatcgacaattttatgaaattttcttagcttataacttggtgaatactagagcaaataaaaccattttatgctcattttgaagggaaaattctagagaatattgtaaattttatttgggttggccttaaattgtggacttggctaaaaaagtattaaaattattgaaatttttactagggtcaaaaaaattttcctcgggtcagattttcttgaaattttgtataggcctatattttgacctcctctagcgattccaagtttattttatggaacttaagtttttaactcgagatcggctcttccatttttacaagggaaaatccccggaaaattttaagttttgcaaagttttggcgttctgattactaaataaataataaacttatttgtacttggagcccaaaattattaattcttctgctatttgtgtgacatcattcggaactcggccaaattgtgctaattgctgccaaaaatgaaccgacggtaaaaggattttaaaagtcacacaaattcgtcatttatttgactaaactgttttcccatttcagttggatttgcaacgacgtttggatggacattttcccatcctttgaccgtcctcaactcggcctcaaattggcacttctttcgccacgtttcgatgcgttggtggacaaacatttcaatggcaaaagcgaattgacaatttggagaacgatcgaaattcacaagggcaaaggaccagaaccgaaactatctgtgtggatggatgacaaatttgtgccatttccattgcccgaccgtccgttgcccagcaaaattcgctttaagaaccttcggattgagtaattaaaaatcaaaagctattgcaataaaagcattctttccatttttaggtacattgatcactccgtcatcgcttttcttcgttccaatcaccaaattttcgacaaaagaggcaccaatttacatttgtggcttccattatcaaacaccacggatggccagccaatttgggatgtttttgttcgtgaaatttggccaattttttcggcaaacattcgccacttacgctttccccatggtgatgatttggacaatttgcgtcgtcgcacttcgccgacaattttcactgatctcaaccaattgaattcaatctattctggtgatttgttgcccgctgcgattgatgctgattttgatgtgccaaatgcaacaatttctgctggccaagcattgtccaaatggttgcactctccgagaaacgatggccaacccaagcgatttcgttgtggcagaaatttgaacgcacaagaggacttcgattgggtcaacagtttcaaggaggtgtggtgcggagggaggggggagcaggaacaaatactgctgaaaatccccgaatgagaaatttctcgagcttttttgaactcatgagttgggttcaaggggtaaaccaaaaatacgtttaatggtcttaaatggcgttaattaaaaggtataatcattttttggcgtaaaaccaacgatttcagagtgaaatacaattttttgtttaccgaaaaaatggacaaaat

SEQ ID NO: 11324 - DNA, 4290 bp, Heterodera glycines
taggctgtgccacttccatccaactcatttgacgccgggcgagcccgattggtggtactaaacgactacaatgtgtaaagctgatagacttattaataagtgaagcggtcattaacaaaaatgatattaattatactaaccaagaacgattaggagaagccataaattctccgtccgaaaattggccaatttatttttgattgtattgtacatgcttctggtagtattgtacaacacaaaataaatgctaattgatttttatttgataaattagtaattaaagtttcaagtgagaaaaaatgtttaaatagacatttgagaattgaatttttattaagctcgtatttgcatggactaaaaagcgacaaaactggacataaaacataggctaaaataatctaaaattgggcaaatatggacaaaaaattacggtgatctaacagaagcagtcgcaattgctaactatttaatggagccggcgggaataaatttcatttaataattaattttaaataaattgtcaaaaaaattatgttcaataaatttaaaaaataatttaaaatttgttcaaactttggaacatgcaaataaagaacataatggtgacggactgagtctatgtgccttttacaaagatgaacagaaagatgtgggaaaaaagcaaaagctgagtcataaaagcaaaaaattggtcaaaagtttccttcaaattaaaaacattgaaaaaactctttcctgtcggtctttggattctttgggctttccatttttttttctggtttttctgtcgggacaagatattcaattggaatgtttgacacattcttactttttttctatttttttcatttcatataaatttattccttttttttaaaaaaagcgaaaaaccttattttactgaaaaatgtatcaatgtaagcgaagttataaaagttagaaatattaaaatttaattattattttaatttatttgctgataataaagcataatttagcttaaacttagtcaaattatcggaacttggtattcagcaatagctctacatatcccctctatcttatgcaattttaaaaaatcagcaaaatttacaaaagttgtaaccaaaaacttacgactaacaaattagtgattttgtcgctaacttttttaaaactcattaaaaatttttcaacaaaataataaatacatttttttgtttatctaatcatattaagttgaacaattttgattgacgaagttaattggccttagtaatttttgtttcagaaaaaccaattttcattttcttgatatgattggataacccaaagattttccattattctggtaaattaaaaatttttagtttcaaaaaatagcaacaaattattgagtctaaattttttgaaattttcgaaatacatcctttggtaaatttttgttcattttttaaaaaaactaatcaaaaaatgattgcaaattgctggctgaacaacttttcccagcactttaacaaattgaattaaaaggctataaatcttaaagcgtgcatattttctcccttttaatgtcgttttttggatcaaattttcgaaaaaaaattacagcagacaaaattgagtaaacccggatcaaattctgatcggtatcctcggagactcccaccaaattcacatctcattaagtgttcggttcaaaaaaatttgcttaataattgttcttattgcattttatatttcagtttcagttgccaaattttacttctgtttaaaaatggaaatcattaaaatgaaagcaaatcaaaagaaaaaccaataaaaatgacagaccatttaaagagacagccgtgggaaaagaaacacttaaaaagcagtcccaaatgcgggggatatgaaaattcgatgctcttttttgaaaaaaatacggattttgggcctgcttaaaaaagaaaatccgaaaattacaggaaaaaatatgcttcatccatttggcaacaattccttttcgctcgcctctcctgttcatcctatacctcttcgcccttcttctatactccttttcttcctccttctcttgctcttccttctctcatctcatttttctcttctccttctcttctctcatttccctttcttccttcttctcttctttctctctcattttcctccctgcttttcctttcctattattttttctgacggagcacgttcttcggcagcttttgttctgatcgacccttcttcggcaccgtttgccctggtaactgaccacctaaaattgaagaaatttaacactttttcgaccaccttcttggccacaataaaagtgcgtttaggcacccgtgtttgggcgccttaggtattcaaacaatttttatttgtttacttcaaacccaaaaaaacatggtgtcaatgaatttcccaggcaaacagttttcaaatgataccaagttttttgtttttgttaaattgggcaaaagttattgctcttgaatattcctgacatccaaaagtcttatgacccctaggggagtaatcgagctttaggactgtgattatttattattatgtatggcaatttaatttttttattagagttgttgtttgtttttgtatcaaagcaaaaattgatgaaattaaacaaattcagcttgctgatttgttgagcaaacgatttttataaaatcaataatttagcatagaaattgctaattttttgaatttttttcgttctttgaccttcaaaaagcaccgtaatttctataatcgtaattactcgtcaagtcacaaaataattaacttatgaaataaaaagtctcagtttggttgcttttttatgttttttaatacttccatctatcctcgagaagtgaatcaaaatgttttgagtagcttttcaaagttagagaaaaaatcgcatacaaaaactgcttcggattcatcaattttattttttatgattttttgagtgtaatttttttcgatttttaagcaaaatttacagaaaaatgccaaaattacaggataaaaagagataaacttttgaagctgttttcaacaaaatttcaaaatattattaaagttgtagagttaacaaattcggattaaatcttttgcattatgggtgaaataagctaaaaataaaataataagttagctgttaaatagcttcataaaattagtactttctggacaataaaccggtttaaaactgaaaaaccgttttgaccattttccaaaacaggttcatgaatttgatttttttgacaatttgaaaaggtaaccaaaaattttaacacaattttctaggtggtaggtttaagagtatgaaaaccacataaaaggaagatttttcttaaccaaattttttgagatttttagttttccccaaaaaatataacttttttataatatacatatgtacctcttacgtcttgttcttgaccagaaatccaaaaaaatttccggaattcctaccttctgctgagaatttttcctggaaccacccaccagtcccatgcctgcagattttgttcctattcgtctttttctaatccatttttccccgagtcaattacaacgtgtacaaatggtcaactcataataataattttgcaaattaagccgaagcctaggcccaagtaagcctaagcctagtaaacctagacctatatacgagtgcctttttaccagttgtcatgagacctttttctccaccttttttatcttttttcttaatgtactcatccaaagctttctctgctttggcaatattatttttttctgcttggcgttttgtcatttgctttttccgctgggaatttcgctgcatgtaaggtgctcaagagtgcctccaattccgagtcttcttcatcttcatagtttgaacatttttcatctggcttcaacttttctttgttttcaaatgtcaattcccaaaaaataccgccttttaattgtttctcatcttaaaaagtgaaaaaatttgatatttttgaaacaatgttcggtttttgccttttcgttcgtagttgagtcgcctgcattttcttaagtgttcttttgctttgtcatataatggaactttactttcaaaatctttaaaataagctttaattgtgactttgtgtcctgctgcttcaacactatccaacagcaaaattttgatgatgaagagactgaaggtggttagcattttcgtcgagaattggaccattctgcgagtgatgattgatgagctaaataaaaaggcttgtttgtgacttttttttaaagataacttcgtattatgaaaacagggcttcaatc

SEQ ID NO: 11325 - DNA, 1131 bp, Heterodera glycines
atttcaaaatatcacagctggaccaaccttagcgaaaagttttttaaaaaacacgctgtaaaagaaggtttgtttgatcagcgagtctttattttgaaaattttgtgatcgaagccctgttttaactcgatttatataataccgcgcttaaccattttgccaacaataaaatgcctatatttatgaatatagccatatgatgaatgcacttttgtgaaggcatctttttacgaatatgccatcacaaatgaatatatttatgaatatagccctatgatgaatgcacttttgtgaaggcatatttttacgaatatgccatcacaaatgaatatatttatgaatatagccctatgataaatgcactttggtgaaggcatatttttacaaatatgccatcacaaatgaatatatttatgaatatagccctatgatgaatgcacttttgtgaaggcatctttttacgaatatgccatcacaaatgaatatatttatgaatatagccctatgatgaatgcacttttgtgaaggcatctttttacgaatatgccatcacaaatgaatatatttatgaatatagccatatggtgaatgcacttttgtgaaggcatctttttacgaatatgccatcacaaatgaatatatttatgaatatagccctatgataaatgcactttggtgaaggcatatttttacaaatatgccatcacaaatgaatatatttatgaatatagccctatgatgaatgcacttttgtgagggcatctttttacaaatatgccatcacaaatgaatatatttatgaatatagccctatgatgaatgcacttttgtgaaggcatatttttacgaatatgccatcacaaatgaatatatttatgaatatagccatatggtgaatgcacttttgtgaaggcatctttttacgaatatgccatcacaaatgaatatatttatgaatatagccctatgataaatgcactttggtgaaggcatatttttacaaatatgccatcacaaatgaatatatttatgaatatagccctatgatgaatgcacttttgtgagggcgtctttttacaaatataacgtcacaagatgaatatatttatgaatatagcccgtatgatgact

SEQ ID NO: 11326 - DNA, 2686 bp, Heterodera glycines
cgctgacaaatgagcgattagtcaaaagtgttggggaggaggatctgaggaaaatcttggcatttcgggagcgatttgccattttatttattacatcgctctcgacccatgccaaaataaaagacacattaaatggtttataaattcaaaacctaccgaacttcctggtcgttaatttgacggggatatccgaccacccaattcttgacgcggtcactggtctcgaggaaacgcacgccgggattgatctgaaatgggaggaaggagtttttttgccagttgtgccaataattagtgcccgggaatcacccggtctttgaaggtcaactgtccaccgtctccaaatttgatctgtgaaattcaaaatttaatttcgaattgaaatgtccaaacacaaaacacctttggcatttcgtgaatgcctattttgatgtcgttctttcctccgacaagtttgacgccgaatttgaccataaattcgttcgaagcgccggtgccgatcttccgaacctccgcctcaatgtccgcgtagcgtttgctcgggtgcgtggtgttcgccttacaaaaatttgaaatggaagcaattatgtgcaaagaaaagcggactgtccctcataaacagcaaaatgatcagaataaaataatccatttctgacggatcaacgctctgatcaaaatttggactaacaattccctttaattcggcacggccgaccctcccctttttaacttttgttttgtatgaatctaatcagtgtagaaaaaaaacgaataaacaatgagaaagagcatagagtgagcgggcggaagtaatgcggcgggacataatttcgccgccgaaatttcgccggcctttcccaaaaacggttccgtataaaaaaaaatttcggcgaaattttggggtgcacccgaaataattgagctaacaaattaagcatagactaaaagtcagtaatcagaagatctatgactactgctggtgggttaaaattttttattttggatcgctttcgcttaatcggccaagtccccccccccaaaaaaagtatacgttaagcagctcccgggacacataatcggccattttgtccagtggaagccgttggctgggcagaatcacaatgcaggacagcgggaacagcgtctgaactcagttgggggaattccgatcacttttttcactctccgggaaggtaagaacctcgcggtctttctgctgacggacggcgggcaattggccattgattcgaatgtcctttttgacgcggaaaaagtccaccatactcattgcttgtccgtccacttcgaagcttaattaagaccgaagaatgaatgaataaagcgatgaattgggcaatttgaatatttccggacgatccaggccgttatttttttcttgaaaatttctaaagttaaaaaatttttcggagcagttccgggcactctctctcttccttttttggattgtgtgccatcaatttccaaatttacgacagccatttgtagccaatgcaatcaaatggcatatcaataacaattcagttggccacctaatgtcgttcatcttgcgctgactgatcgagtcgatcacaatcactcgcgacggcgcgtaggtcaaatagccgctgacgccgcggaagagtcggctgaattcgacccaaaaacggtccatttgtcccgggtcatttcggttggtgcgcttctgttgcagcatcccattgacaatgtcctccaaatttttgttggcaaaaaaggcacatgttttcactgaaacagtcaaaaaaatttttacttttcaaatttgtcccaaaacagaattttgggtcggcatttttcccaacggatcggcacggttaaagcacttacatataggcttttcatggtttccaaaacagtaatgaactgattataatagagtccaacagagtgccgtgggttaccggaaacccttccggcaaaaaccgatttggatccgtcctgaccgactgttttttcgatcaggacaacgtcatccgcctcccccccggcacccaccgtccgccaccaaagccgctttgggctgtccgccgttgtcaatgattcgcacgccttttgcgattccctcccgcgtgacaatgcccggcgcttgctccaactctttgcagatttgtcgcttgaagagacgacccgcgccgacaacgtcatgcgtttctctgtaagtgattcgaaaattggcacctctatttattgggtaaattaacagtttggccaagtgattaaacgtctaatttcttttttttgtttcaaatattttgtaactgtacgagggtactgtgcaaaatacagtaactgttgcccaggggcgtatctagaaacatttttcggggggggggggtcccgacctgaagacctttttttttttgctatttaaccaataactttttttccactgctgggtaacaactgcactttttcactaaaaatgacccaattttggccgttttaaggcaaaaaacttgtaaaaatagtggaaaatgtaggtccggcggtgccgataggcgccgccgggaaaaaattttggaaatttgagtgctatttgttacgaaaattgcctattaaatttttttattttcgtttggggggggggaattcgaaaaaattttccattatttgctggaaactttttaaaaattttcatttcgggggg

SEQ ID NO: 11327 - DNA, 1650 bp, Heterodera glycines
  misc_feature (1543)..(1543): n is a, c, g, or t
ataaatttattattttttgtgtatttatttcaaaacggtggcaaatccaagggtttggcaaaacgacacgaccaataaaatttgccacttttcacctcattgccaaatccttgggtcgcctggtggacgtgccgaatcagcgcaaagcaaacgccgcgcagaagcccatttttgccgtcgtcgccgccgcccttcgtcagacttttgttggttttgccgagttgggtgagttcgacgtcgtaacggaaggcgaaggcgccggtggggcgaatgtcaaaacttaaaatttaatgagttcaaatattttaattaatttccatttcaaaaaattatattttttaaagatctgataacaaaatgccatttgtggtcattcattttgccttacacgtaaacactgccaactccatcgacgtgtttgttgagcgtggccggcgggggaacggactgaaattacggtacggtattagttacggtacgaatacaaaaatattttgctaactcacagcagcaattttaatctttttcacttcttcaataaggttttccattgcaatatatttttatgctaaagttacaatattccatagttatttttacaatattttctctaattccattaaatgtaaatgggggacattaaacggagaatatttctttcaatttttatgtctttattttgaaatttttcgttcaaaaataatttttgttaacaaagaattattttcaggaaaatttgaaattttacatttaaataaatttaaatttattgcaaattgtggcaacagcaaatattgcaataaaataatgtgcacccgttaagcaaaacgaatgaaggaaagggtcaaaaatcgacaaaagaaaaccggagaaagaaacaatgaaaaggggaaaaggaagaaatgggaaaaggggaaggattgccagtaggaaaatcgaaataaatacgcaccactcgcccctcccctcccctcccctcccctctctcccctcttctttcttccccgtccgccatcagtcagtcgcctgtcattttttttccttttttgagttgccattatttaaatagctgcactctctctctcccctctctctctctgtttctctctatctctctctcgctttcggtccctctgctgcctgtctctctttccttcccacccttcttttttctttcactctttctattttctctcgttttctatgcatcttatctctctctctctctgcctaccttttccgcggtcttttcccctttcctcgccctgtcgctccctcttcgtttcctgcaatcttttcttcttttgatttgtcacttctctccccctttcccctccgattcttttcaatcgttggctttacaacatttatttatttctttgggctttagaatggaaatggtcgagctgtttttcttccatatatgaaaaggagtctcactaataatttgtacaatgtttaaattgatcagcaaatgtttgtaatgcgatgggttattaatgtcagatcgtaaccagggaaaataattaattagttaattacntcggcaccgccagaccacagcggaaataagtactgttataaaattgtcattcaggcaatttttttactttgacccatttaaaaaaaacaattcgaccgaggggaaaa

SEQ ID NO: 11328 - DNA, 3653 bp, Heterodera glycines
tttattgataaatcaatacgattttcaagaatcgcccgtcttaatttcgaaaaattaatatttttaaaatctcttctataaacattagaattattacggctgaatttttcttttattttaaatccgaccattttgtgatcggaagttgaaaaatgttccaatacaattaattcattaattaattccgattcattagtcattactgtctaaaatcgtattttctctggtcggttctttaacatgttgtttcaattgtctttggttcataaactcaatcagcatatttgacataggatcatttatatgttttaccttatttccatcccataaaatgtttgggatgttaaaatccccacagtatatgatattttcggaatcgctttgatccgaaataaatttgagtagcttttttgtattgtgaacgttacaatttggtggacgatatatatttaaaatttgtattggctttttgaaaagtaatttaatgtgtataatttcgctttggaattttgtccctgagaaaagtgtctggtaagggatcattgtttttattaggattgccgatcctccgcccttttttcagttcggtttgcataaacaatttggtattgaccatttattgtaagttccgcgtctaccgtatttctggagtttaaccaggtctcattgattagaattattgaagggtcatatttttgggttatatgttctaagtcagctattttatttgatattgatcgggaatttattaaaaggcaggaaatccagggattattttttatagtttttacaatttgtttcgttggtttgctcgcgtgtccctagcgagttctgagcggatgggggtttttcagggacctgatctccaaatcgaccacataatacttatattcaccagcggcaatattggccttgtaggcttgttgccgaagggagtataaaattttgagttcgttttgggtcatgtccctgcggactttgataaattgtggcaaattggggaattttttcaaagcgttacggaaattaaaaataaatttgtcacgcgaatatttgtcagaaaatggaactttcaaaattcggtctttttttacccctccatctgttagctgcgtcctcgggtggcgatgaatgtccggtgtcagtttgtcttttacgccgcattcatcagcaatttgctccaccaatgcccgttcgtccattgcctccggcaatttttcgatgactgctcggttcgccttctccttcagctgctcagagttgatgatcgcctcggtgatcatccgcgatacgaggccggtgccagcaaaaggcggcggttgaccccattggactgtgccgttgttggagatgggaacggacgaagagtgggaggcgtgctgggggtcagcaaatcgatttccacaccgattctcgccctcaacaagttgctgcaccaaattttccaacttttcgagccgttggataattgagttaagggcaggattccctgacccctcaagcaatttttcgagtcgttcgagattctttgcttacaatcagaaatctttttttaattgatgtcataattttggactttgatatttttataaaaattgataataaaaaatacaatacacctacataatgaacataaacaagccaaattagagatcggatacgggccggacccgtatacgggtttttacgggccccgtaattgggcggtcaatttcgtaaaattttcggtgaaaatcgaaaaagcattggtaaatattggaaaattaatgtaatttgaaaagaaatcaattatttctgtaccaaaaaatttttaagttattgaatagcattttgtttaaatttttggtgctagtgcgtttcgtaaaactacgcaattttatttattaatttttatttgtaaattgctaaaaaatattgtggcacgtattgtggaacatcattttttgattcttgtataatagcacctgtaatatggttttgcaattttcaaaaaggtaaaaataaaaaattaattggcttaatattattcaataaagttgaccgttgttgctataactatgatgtgtgctacattaataaaaaacaaaaacgttatgattgtgacataaaattgcatttaaattttgtggcagtttttacgaaacgcaccagcacgtaaatttttttgaaatttttttttatttttcttaattctttttttttacgaattggatttgtaaattcttcaaaattataaatcattttagtgaaaaactgtcagcaaaattcatgaaatcagttaaaaatcgcaaatttggtcaatttttctattaaatctattaacaaattgcaatcaaattttaaaaaatttcccggaggcgcccaatggccaccgcagtgccaattgttgtgttttttgaattttgttgcttaaaatttataataaaaattattataatatcttttagctttaaatattcaaaattgtatttattaaacctatttttatcaaaaagaaaaaaacccttacccgtatacggacccgtattatttctgaatacgggtttttacgggttagaggttttagcccataagcccgtaacccgtatagatgtcaagcccgtaacccttacccttatccgtattttctcaaaattccgatctctaacccaaattcactttaaattttaatatttaatcaaattttatgcaaaaaatgattattttggcgtaatgtattagaaaaattcaaaaaatctcaattttactggagaaaaaaaaagcccgtgtagcccgtgtcactttttacacgggcacgggctacgggcttggcattgacacgggttacgggctaaaaacccggaaaacccgtgtgcccgtgaaacccgtgtcagcccaaaaaaacacgggttacgggctacgggcccgtgaaaacccgtgcacgggcccggcccgtgtccgatctctaattttgactaacaataagcccatttcggaaggggaaatcagaagacctaaaaaatttaagcgcggagagcaaaaaaaaatcatgccatttttaggccaaaatttgacaaaaaaaaatagggtaaaatgtgggcccggccgtgccaaaaggcgccgccgggattattattaattataatatttactttttctcccgctttttaagaattcgaataacaaatgaagcagaatcattggcacaaatgttgaaactaattgcactgccctttttgagtatttgggtctaaaataataattgataatcatattttttaagatttatcattcatttctttaatactccattgatctgttgtgccccattttggtcccaatcccaacggacaatttgtgccaatggcagtgccgcatttggcagctttgaagaagcattgccaatgtccttgattttcaatatgggataccagctcttcacaaattcactaaaattagtacatatgtgatttacatagaaaaaatcatgatggctaattgtgctattaaatatgattgcgttttaaatatttttttatatttattttaaaaaattgaaattacagtgcagcaaattgtgtcacatcagtaaatgaacagttggagctggaattaaattgggcaacagttaattggcagatcactttttcttcaacaacaataaattcgtcaaa

SEQ ID NO: 11329 - DNA, 3199 bp, Heterodera glycines
  misc_feature (3182)..(3182): n is a, c, g, or t
tatctgattttcagttagtgcgaaaaatttcttcatacattacttctgtcaatggattagcataaaataaaaaataaaagaaaagaaaataaataatgaaaatttaaaatcgaatcaaattaaaaataattaatatatattcgaccaatttacaactcattataaagtaataaagtaaatatgatttatttctaagtttatttttagtttatatagaacaaagtctttaatgaattatgaaataaatacagaaataattacttagtgtataaccctcaataaaaaaatcaagacgatataaaaataaatttttatcaggttaaataattttaattggttaataatatcacattctaagattaatgtttttaaaagaaaataaaattaatattttaagaaattcactttaaaaatcctaaaatcactcgtcggcaatgacaagacaataatatattttttttagattttaaaagcttaaaaatttattcattaaataaaaaaattaatagctgcaaagtttgtatttaatttggatctgggttgacgagatcacagaagaatgcaactcatatggtggatgctaagcgatttgaaattcaaataatataattttacaatgaataatattattatctgttaaaaaaagcaaaagattatgtccaatttattaaaaattaaataaatattaaagcttaattaattaaatttgctcccgttgcaaactctgagcacgatacttttcgtacatatttttagaaatcaaaaaaaaaattatagattcaagaataaaagcattcagaaaatgtgagaataaaataaattaaggcatttaattatctaataaagttagataaaaactcaacaaaaaataatattttgggggattttcagaatttttgacatgtattaattattattcagacttcatacataatttgcggaaattattaattttaaataaaaaataatttatattttcaaaattttattatatgtaaaaaataaatatatataaagtaacagatttaaaaaatttataaaactatcaaatttaatcaaaaattaataaattttaaaatatttcctatttctaatatttaatattgctgaaaccgcaggtttagctgcgcatactagttgagaaaagaaaaagaattctaaaaaggtcaaaagagaacaaagaagtcgttgcaaagtattttgaaaatcatctttcagctgaaattgaaaaaacgccatttcgaatcaattgtcaaaagttataatgaaaaatagaattaatatctaaataatttaaaaaatataaattttaaaaacaaatagataactttattttatggattttttctttcctggaattaatttattaaccatagattgagtgaaaaaaaaaaacgaaataagtaaattagaaagagaaacatttaaaaatttggaaacatataaattaatttataggtaattcattattctaaataaataataaaagttacttgggttttgaaatagaaaaatgggcaaaaattatgatttaataaattgttaatataactcaaaaaaatcactggccataaaaaaggatatcgattcaaaaaccctataaggaaattaaatgaaaagaaaaaattaacaaaaatttaaaattactgtgtattttttgaatgttgccatcagcacccaaatcaaaaaaatttggactttgcttggaaatataattatcaaagttaaattgtcctttaaccttaaaataaattttatataattttaactaaatggcataaaaaatcttctttgtatgacatttaataaaacaaaaaatgttatcataaatgtgatttgttagccatcactaaacatcataccttccacgacagagtgctatacatgtgtcaagatacttctactcatattagaaaacaaaaattaaataaagtgaattaaaccgaaacccaaaatacaataaagatttctaatagtcagatacgtcaaaaacaaaaattaatactcaaaaagttgacaaaataaaataagaataatataaaaacctgatcatttctaaactagaacaagaccaagactacactaccatttttcgggcatttttcagtgatcaagaagcacgaaatgaaaaaaaggcaaaacgaagttaagcactacaaaaaattaatcaaagtgttgaatgaaaaataaaaaaatattacagaaaattgcattaacatcataattatgaaataatagcaaatattttctaagtaaaaaataatataaataggcttacatgctcgaccgaaatgtacctttgttaataaaatgataacatagtccattagtctgcaaatatttggccaaaaatcgcgtgaatatgaaattaaaattttcttaaaaatgtttggcttctttttcaagattgtttttttaaatgttttaagtactattaagacttatcattcattatacatgcatttttatgtaaatttctgatttatatttattattatttcttgttcgtatacagagtatgtattcactctgccatgcttgaagcaaaaatggtcaatatttttgaaaaaaattttgcacttttttcttaacataattgattaaaaagtccaaaaatttttcccggcggcgcctatcggcaccgccggactcaagtttaccaatatttttttagcatttgacacaaattctgttttttgtggctccggcgctgaaattttttgaaaaacaacactggtaaaaaaatatatagcccgaagagcaaaaaaaaaaagctcttcgggtgcccccccccccccgaaatttttttctggatacgggcctgctgtcacttaaagctgtcaaatgaaaattgaagctcaaaccctattcgtcacaataacgtgagaatatgcatttgcatattttttgcagccctgtttattagtgcttatcaacattcaaaaatatattttttaactcaatgtattttttaaaagtgaaataacacttttgcatagcagatttaaagagggatggattaattattgaaataaaaacattcttaaataaaaaaatgaataagcaattaatttataactataattatatttttcaaatttaaggttaaagaagaagtttcaaaaatattataatatttctctattcaaagaatcattgtaaatattttaccaaaaatgcantaatgaataattctaaa

SEQ ID NO: 11330 - DNA, 1409 bp, Heterodera glycines
tttaaataaatccatttaaaatcaaagggttcaattactgaataggtaaaagagagaacgccaacagcacataagaaaaaaataataataagtatattgcaagtacaatataatttattaattatttaatctctttcatttattatctaaattataaactgtaaaaaaattatatcaaaaaattttcattacagttcagaataatctctataatgtcatctcagaactcaaaattgaaaatgacactaaaaaggcaagtcatacgaattcgaagctaaaaattattcacgcataacataaatttactaaataatattatatcaaaatttaaaaaataacaaaaatttcggggagggggggggggcacccgaagagcttatatatatttttttaccagtgttgtttttcaaaaaatttcagcgccggagccacaaaaaaaaacaggaatttgtgtcaaatggtaacaaaaataatggtaaactggagtccgggggaaaagtttttggactttttaatcaattatgataagaaaaagtgcagaattctgaataaaaaaatttgctcaatttttggctgaaaatatatcactataacgtcactatttcgaacttttttcactattttctcactattttagtacttttatttcgagatttttcgtcactaaaagtcgcggccctagtaattttttacgcaagacctgtcaaattcctaccttttcgcctcaaggttttttatttttagagcctaaaaagctaaaaattgtttttgataaaatctatttttgcctaaatttaaaaagtaaaactcatttgggaattcggaccaaatatgggtgggtgtagatagttttcgagtggacaatttttttaccaaaatggttcggaatccgggtaaagtaaatgcttttttcgtattacaatatttttcatgttgattaagcatttaaacgagtttgaatatagaatttcctaattgctttttattaaaacttaaaaaaatattttgaaaaattccatttatcctcctgggggataaatggttttggctgaaaatgatgtcattttttcactatttctgactttttgtcactattttagttaactatttcgagatttttagtcactaaaaatcgcagtcctactgatatgtcctgggctggcagatgaaaattttcaaaaccctcatttggcatgcaaaaaaacctcattttgggtcaaaaagcctcatttttacaaatttattcaaaacacgtttaaaatgttaaaattatttttgacccatgaccaatttgagcaattttttgtttgaaataagcattttgtgaaaatcttagcatgaaaaattgaaattgatttttttttgcggcgctttttccaaaaacttttggggaacaagggggtccggcg

SEQ ID NO: 11331 - DNA, 1454 bp, Heterodera glycines
aaaaaaatttttttttttaatttattattgttttattttttagttttttgtaatttttaatgtgatttgttaacagatttctccacaaaaacatccaaattttgcaattttgagaaattaaaaaaaaagaaaaaaggatttttagggtacggcggtgccgatagccgccgtcgggaaaatttttataattttctggctaatggatttttatcgaattttttaatgtttttatttcttttatcattttacttgttaaaatattaactttgttgttatttcgaatttttatgtgtttttatttatcggaaattaaagcaactgtcgaagcgcagcttaacactcgaagtcgcagctctaaactaagtctaattttttcgaagcccgaagtacgaagccaaaaaaacacgtaattttcgaagctacaagctttaagaatgttttttttttgaataggtttttcctataaaattttacattttctttcttaatatacaaaaacagaaaagaatgaaaaaacaattgctttgtggggacctataacaacgcttaaaaagaatttttcaacaaacgaatttatttttagtttgccaaaatcatcaagtgtgtaagaaatttggtctcggttctccaaaatttagacaaggctgcgcgaaatttcgttttagtgtttccgtcgtttttggtacctgttgagtaaaaagatatgcatatatatatttatatatatatatatgtatatattcgttaatattcgtttattgtatttttaagatttgcaaaaaatgctttcatgcccccattacgaaaggctccccaggtcacttcattacgttaagctcgcctttggtgtgaaccaaccttataaatgtattttttctaattttgtatatttacttttatgaatttttatggccttccagatttctttgatttccaacttttttaatttttgaacaagcttcttatattttggttatttcatttaatttatgctaaataataattattattttcattcgattaaacttttgttgctccgatgctttacacttttttagggtactgttttgtgattttacatgataaattatcttttcattttatgactattaatataataataatatattcgaaatctttttatttagatttggcttaaattttatatcttggaggtttctgagcttgtaaacctgactctctaatacacttagcttttcatgcaagaaaatatttgaaacattaaaatcctggcctgaaaatttgtatttaaaattcaaaaaaaatcgtgctcttttttaccattgccttttttaattttttattagcattttttttgttttgtctaaaattattttcaattacatcgtattttatttggaccaaaacaaatatttttatcttttgggttacatgtaaagttataaataaattggtttccccacttccttttg

SEQ ID NO: 11332 - DNA, 1359 bp, Heterodera glycines
  misc_feature (1217)..(1217): n is a, c, g, or t
cctttgaaaataaaaaattattaattaggtatacaaatactaactctaaccaatttgtacctgttttgtacgcccgttcagtgactgcataacggtaagtgccatcacaatattcggcaacaatttgatcaatgtcaaattcgggcagatcaatttcagggttgtacaggattggttgacgccgaaaccatgtgacattgacaattttagcaatgtaagcatctgacagaaatcatattaaaagcttttaaatatacatataatttaaaaagtcattattcgctttataggcgaatttggttacattttgacataatttttgaaatttcgtctctttgatagagaatttagttttattagtttgcaaattttgatttaatgaaaatattgttgctcgaacttttccatagattttttatttccaaaaaacttaaatttataaaacagctaaaattttaaattttcggaaattttaagatacggaagttttaaatattaatttctttttgttgtttttttaaattaataatttgttttaagcccttatttatttcttttgtaatctgttaattgttattcacatgacagcacgcgaatgtggcactgttgctcgtccatgggatagtcttgcagctttaaattgcacgccaccgtcagtgttactcggctcgaatatgataccgtaccatcggtggagataaataaattaaaattgggtacagtaacttcatggaaatttgcttggcgagcattggcaaaatacaggtcgggcaacctgtgggaaaattcaattttaaaaaagaacaataaatatattattgtcagagaaaattttttaattagagggcaataaagaataattttattaaaagtaacttaaaagttaattgaacaaaatttttggttaatttttttttggggggggtgaaatatttggttaaatgtaaaaaagcatgttcaaaatttaaaaaaataacgattttttccaaaaagtttatgactaggtggatttaaattcaaaaatatttaaataaatatttagaaacaacaccaaaatatttaagaaaatatcgacaaagttgcaacaaatttttccagggttttgaatggatttttaaatttcaaaaaacaaaacaaaaaatagtggaaaatttttgaatttttccattcttagaaggtgtatttaaaaaaaatattcgacaaatccttcggtggtnggatttttggttttgtagaattttgtgatgaattttcgaaaagtgcgaaaaaatgctaaaacttctgatatgtttatataaatattttaaaaagaggcccaaaatattttttattttttaaatcatgccaaaattcttttct

SEQ ID NO: 11333 - DNA, 4447 bp, Heterodera glycines
ttttaattccgtttgaatttacttccaactgactgtacatatataagtcaacatcaaaagtctaaatttttaattaggtattaaatggaatataaaaatttaaatgatttttaatttaaattgtttttaattgaatttttaatgccgttcataaaccatttgagtttctcgaaagttgccaagactctcgaggtagaagcccaattgtactgacaaaggttcaccatttgagttcgatggaggtcgacgaatttttcgatgcaattcactggccataaatgttgtagctgactttgttttcgttgcacgaaatcgttgaagttttttctgttgattatggggaaatgcaaactaactttaagagaaaaaatgttgaaatttatttattcaaaaataaaaataccaaaagaagggcatatgccacttacacttttggtgagtatatgtccatttggaatgaacgaaattaaattaggaattgtttttcaaaatttagagttataatatattgatttcttatttaaaaaaaatattaaaaaatatcttttacacaaaaaataatatttttgaagcttcaaaaataattcttttaaaaaatcgctaatttcgtcttaattaaattataaatttattccctcccttgaccaacgactttcgactaattaataaacattagtcaattaatttatttgttaatccaaacggaaattttttagtaataattatgtactattttaaaaggattattatttaggtattttttttttaaatttaattactcaccaatcgattaggtgcatgttcagtggcacggtgatatgcgacaaatggttcatcagaatgtgtgtatccaagaatgttttgaccactcaaatgtatgtatttttaatatatttttgtataataaatataaataatataataaaaagaatattactgattttgatgaaaagcatataattgtagccaaaagctgatattgattttaagaaaaattaaagcaataactgcgttcattgtgaagaaaattttctttttttctaaaaatgattttattttattttcaatttccatttgctatattagcaagaataaattttaattgcgaaatatttgataaataaaataaatattgtttattcaaattgaaaaaaaaaaattaagaaatatttgtaaattagcacaaaaattaaaaaattattaattgaaaaaaaatatttgataaattattcaaatttttttttaaatagaaaattaaataaaaaaaaattttttgccctaaaattatcgaaacaaattaaaggaaaagaaaaaattactttaaattgaaaaagtgtgttgaattggctggccaaattttgggtccaataatgaggcgtgtaaaaatattttgagtgaaaaattgttttaacggaatcaatttggccgaaacataagcttttcaaccaacagctgcttttcttctgacccaaattatttaattgtttggagccttgacactcatggacatctgctgctgtttgagttacgttttaataaatcacagagaattatttaattataaacgggaaaaggaaatttatgtatttgagtttaaactaatgagaattttaattagttttttttagaaaatataaggagaactaatatgcggtttaataaatttttgtttttattttcttctataattaatgtagaaaaatttgtcttttttctaagttattttgacaaaaaaaggtgccatggatcgcaaaattacttacatttaccaatgttttgaatttttataacctattatttgatttttatgcatatttcacgtgcctaaaatagaatacttactgataaattttgtaaaaattaataagttattaccaccaggaacgcattttcagttttttaataatttttttctgcagttttttgactcccctaaaaattctcaatgatatatcgaaaaaaaagaaatttgaattcctgggcggtcagacttccataaatccaagatatttctcgcttcagattctcgacaaatccatctgttcatttcatagttttattgcttaaattcaccaattcttagacattgattaaattttttaccaacaacttttatattttgtgtgtgtttttaacttctttcataaagcttaaaaattatttttggttttttatgaaataaacgcaattaaaatttatttcatatttatgagtttattttatttgggcattgaagcgcatttattatattttattgtttgaatttaatttgaaaaaaattattcacaacggataaaaagttcatgttgacgagatttgctcatatttaaacaaaaaaaatgcagcacaattaggcacggtttctatttatattaattttaaacatttgaaaataatttttattcaattccaaaagaaaaaaaaattcgaacaaaaattaattttactataaatttacctaaaaaaattcttaataattaaaaaaaaatattaaaatgattttgagtgcaaatgtagatgctatttaattttcgaccaattatgtttaacgaaggattttgaattaattttaaacatttaaaacaatttttattcaatttaaataaatcttcgaaaaaacaaataaaggttatcattccattcttaatcactttttaagcgatgccctcttcatctccaattgttggctttagcctgcttctcgtgctgattgcacaaaatgtttttgtccaagggtttggcttattaaattccaaaattgacgctgcaagcaaagcgtcgattaaatgttgtgtgaaggaagcacatctgagtatggaatgcgccaaatcaggtgagtaattattcaattttttgtgcttaaattttttaggtataaataaattttcttttatttacatttattatttactggaattgcgtacattttttgcgcatttctattaaaattccacaaaaacgggcatttcttaaatgtaatattagtgctctaacaaaaaaaaaaacggtactagtatttgggtacggcattttatagcaattttcaatttaaaaaaaaaattaattgttctattcgcttcggaacacacgcaggcgaaatcgaactttgaaccaaaaaaaatgaatttaaccgactggaccattgtttatgttgaaaaaaggacaaaaagggacccaaaatttcatataatagcctaatttgacatttttggcatcgttggatagtcctaaatgattctcaattaatgtgcaaaattaatttgttgcgccttttctttgacagtttgtcgttacttcggcgacaaaaattaccccgacaaatgcaccgtgccgatcatgcacaacttcaaccaaatggtcgcctgttttggcgcacacacggacaaccgaggtaaacaacaaaaaaaaatgcatcattattttgagtgaataaaatttgcttaaaattgggttggcccactccaaatccccggcacggttttacaaatattccaaatgattctctatgaaatttccttgtcatggcatttaaaattttctcttgttttttgcgagttatattaattttcaaatatatttttaaattttgcattcatccccaaaaaatttgtctgagattagcttttcgtccccgatcaatgacaatcctgctctaaaattaaaactgaacaatacctagtttttaacaattttgcaaaagattaattttatctagtaactttgtaatggaggttttggaattttttaaatgaaataattatttaaattagaaaatgccaaaatttcatcatttaagcgtgttgcaagcgtaagggcgtcaaggcaccgtgccttgacctgtgcaacgggaagaacccggactatttgccggacccggcttatgtgccgtgcacattccctggcaaagtggacaatgccatccaaaagtgcaaccacgacgcatggaaaagaggctaaatggaactcggagaataagttcaatcagcagaggaaatattgtattaacaatagaaaaagaattgttgaatcattaaaaatgtaaacgttaagagtttcaaattatttttttttaaagaaagatagaataaactttatgatgaaaatgaaataatgtgataattatatggaaacaaatcaaagaaaaattgccaaaaatataaaaatggacataaattttcttcgggtgagatttctttaattttattccaccattaaatttgtttttaaattggaaaattgcaaaaaaaataaataataaataaattggacacagaaaattgacattattggatttgaaaataaattaattaaaaacaaataaacaaaaattatggtttggcgaaaaaattttttgttttaatttgcacatctatttttataagcataagaaaatgtaaatataccagggctcgcaaatgtgcttatttctaagataaaagccgaagag

SEQ ID NO: 11334 - DNA, 4345 bp, Heterodera glycines
  misc_feature (122)..(122): n is a, c, g, or t
tgattttgtacaaaatttaataaccggacccacccggtcgggtatggattttaaaaaccggggttcgggtgttgaaaaaaccgggtatatacccgggtcgggtacccgtacccgtctacccntagaacagagtgaactttaagaaatcccagagggtttctaattttattaaatggacaaaataatttttggtctttttgtgcgtgaacattgctgccaaaagtcgttcattgcataaagagatattggaaatgattaactcattcaattattaaagaaaacagagattcattaaaaaagcatttattgttaaaaatatggcgtatttggcttgagaaatgttaaagcacaacaaaaggtaaaaaatatacagaaataatggcaaataatttggtctggttttgaagatgacaatacaaaaatgtttaaaggttaagggtaaagtaacagccgaagggtttttccttaaataaaataaatctttttttaatctcatacataattaaaacataaggaaacccccaatagattgcattcgcattttgtttttgcttaatgatcagatcagaaatgctccaccaaaacttcgggaaaattctctgacaatcgaatacgtccttgtgccatattttccgttttctgcttaaaattgtgttggcctgccgttctctgcattccttcgtctccgatcggggtggtgggcggcggacccgcgggagggtggcgttgttgtgcgagtggaaaagtcggattgtggggcccgacggaagtgagcgaagggacaggcggaaggacggctctaaaccatgcgagtggtgatgaactacaaaagtgtcaaagttcgactttctccgctgttccgatccactcgaaccgtcgttggaattgttgcttgtttgactggtagtcgcaccgaactgttcctgctgcacccgcgccaatttgttatgactgttgctactcattggcattggacagtaatttggtgcctgttgtcgcggttgaaaagcaatgggcgcgttttgcaagttataaatgtttggggctgtaggataaggcgaaatggacggcatcgaggcatattcgctaatctgttcaatcaaataaaaatttatttatttctttgtgattaatttttattctgccaaaaataccatagaagttccggtccccaaattcgttggttggatgaaattgggttgttcctgggctctgtttgagtaaaggactgtcccctgttggtggggattggctatttccatgtgttggaattggttttgcatgttggacaatgtgccgtcttcgggaaacgatgcacgcaaattgagcaattctgaaaagaaaagtgcaattaatcagtacgattgtaataaataaataaataccacctgcgctttgttccccaaaaatgtaataacattgttccgtgaaggtgaccttgttgaccacatgtgcaatgaatttgtccttcagcagccccgaggcgtatttcctcgcctcctttcggtcgtccaatccatcgacatttccaataagccaatcgatgagagcactgcctaaacacacggaaattgctcttgtttttgtgccacaaagtttgtcaaacctaccgagaaaagacctgggaatggggattttcagccacgttcgatcgcgaatgtcgaggccggagttctaaagaataaaggtaaaatggagacaaagtgcggcgacagtgccaaaagtaccggcatagccaatgtttggatcactttgcgtttgtcactgtgtacgtccagccgatgttgctgttgcatggacagaatgactccgcccgggccgacgatcgtttgagccgcaccgccgccggaccccgtcgaagtgctgctgctggcgggcctttggctgggaacggaagtcggcggtgcgaaagtgtgcagaagggaggaagacgtaggcggaaaatggccagacggaatgggcgttggcgtaccctccgaaccttaacttaccaatgctttaatggttgaacaaaaaccccaaagttttgctgcacgagggaccatactcatgattagttcactttgacaaattttggctttcatttactacaatacataaatattattttagtttaacataatcaaccagttttgagccaccttttttattttgcccttaatggaaatcaacccaagcaacaaaattcgtctgttatagtcattggtacctaatttataagtattttccgacaaaaattggagtttcattatcaatggaaaacaaaaattcttaatgcctatccaaaattgttgtccgttgttcaataccaattcccacccaaattaccctcgggaatcgcgttcatcgcattcacaagagtgctggtcatgcccctgactgcgttggtgtgctgaacccacgcgtgggtgtcaatcggtctgaccggctcacgcgatggcaccgaaaaataattcgttcggttggcatcgaagcttttagcgactgttagctttatcggactaaaggtggtcagatttggcgttgtttcgtgctttcactttgattaccccctcgtgttcactgcccttttgagcacttcgactgcctggtcgttcttgaagttctcgaaggatatgtcattcacctgcaaaatcatatcccccggctcaatacgaccgtccaaagcaaccgcaccttataattgaaacaaaaataaaaacgaaaaacaattttccattaactcaccgccgggcataacattggcctaaaatgggattgcgaagggtagagcttatcttgacgggacttaccacataaatcccactgtcgccgcgaggacacgactgaccaacaatggaaatgcccaaaaaattcaccgtgttcatgttaagctgcaaatggcaaaatggggcaagtgtccccccccccaattccctctttaccgtcacagtaatcacttccaatgccatcgaagtttccgtcatagacgaaagtgaagaagttcgcgatggttggcgacgagttcgctggttctgtcttctcctcctgcggtgtatgctgtagtgctggcgtgacactgaagtgatgttgtccgttgaagttgacaaccttaaaacggtgccacaattcattgcttaaatcaggcattttatttttgggtgccatttgctgactctaattccgattttgcaattcgaatgtggctcagaaaccataaatttgatgagttgccaaatgcggcgccgccgccatttccgttgctgctgcttttgatacatttttttcttgaatgaccaacatcccgctcatcctcctcacattcatcattgccagaataataaccactcattaatgacgctaattattcaagaattcattagagtactaattaactccattatcacagcgaaaatcgggaattgagaataaagctagggtaagtctcattttatatttgggatttgttttcgggagcagttcgtttccaactccacggccgaaaaattttttttttcaaatctagaaatttgtaaagaaattttttaagcgattttcttaaaatcttatgatgaatttttagcttttgaaaaaattcccgggggaaataatacgggggggggagaaacggtgcttgtggaaatgtaatggaccctttattttctcccattccattccagatttgacaaaggatgaaatgcaaagcgattatttacccccggggggcagtgatggccaatggcaactcctaagggcgtaatccttcactgtcgcactcgaaagggaaagaagttcccgtccccgtctctctttggttggtcatttaatgcagcaaatggacaatccgtcacaacaaaataactctttttccggggggggggggcgagccgaaagaaaaccgcagcagtataaatgcgtgtccagacatttgctcattcaatgaatgtgccaattagaaatgtccatttgtcgttggaatttaatcctcccaattttgacattttacaattcattaattaataattttcaactcaccgtgactcatcgtccgaataaatccgtccttccgtctctgttgtgtaaatagtcgaatcttcgaaggctttatgacggttcccttaattttttttctacttccttgtaaatcaacttcaaaaaacataaacactccaagaccgaatatgatcagttccaccctgacatggaaatttatataaaaaattagcctaaaattaaaaagaaaaattcgcccaatgttttctataatgtcgtttttgactaaccaataatttcaaaaaaattaaaagcacctgagataatgtgattatcaagtcgataacgaggacgatacaaatgggagtttgga

SEQ ID NO: 11335 - DNA, 770 bp, Heterodera glycines
tgaatgaccaacatcccgctcatcctcctcacatttgtcatggtcagaataatacccactcattaatgacgctaattattcaagaattcattagagtctgaattaactccattatcacagcggaaaatggggatttagaataaagcgagggtaatcctcattttatatttgggatttgttttcgggagcagttcgtttccaactccacggccgaaaaaaatttaaaatttttttttcaaatctagaaatttgtaaagaattttttagcgattttcttaaaatcttatgatgaatttttagcttttgaaaaaattcccgggggaaataatacgggggggggggggggagaaacggtgcttgtggaaatgtaatggaccctttattttctcccattccattccagatttgacaaaggatgaaatgcaaagcgattatttacccccggggggcagtgatggccaatggcaactcctaagggcgtaatccttcactgtcgcactcgaaagggaaagaagttcccgtccccgtctctctttggttggtcatttaatgcagcaaatggacaatccgtcacaacaaaataactctttttcgggggggggggggggggagggcgagcccaaaggaaaccgcagcagtataaatgcgtgtccagacatttgctcattcaatgaatgtgccaattagaaatgtccatttgtcgttggaatttaatcctccccaattttgacattttacaattcattaattaataattttcaactcaccgt

SEQ ID NO: 11336 - DNA, 2337 bp, Heterodera glycines
tgtaataaaatttggtgcgctttagagcactttctcttcctaatatttatgaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctactcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacatttatggggagcaaaaatccaacgcagaattaaagtacaggctatagggaagctattcccgaaggattaggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctatttccgaaggattcggtctccccataaatctgggcgcatcgcttcggggggacggcccgagaagccaaaaaaaaaaaaaattattttgaaaaaaaattattaaaaggaaatgactagttactatttgaataggttatttcgcgtccgttcaatgtccctgcaaagtttggtgtgcgtgcttctgatcagtttctgaaaaaaaagttaagcctaaactttttggcctgtttaaaaaggaattaaaaatttttaaaaattttattcatctcccttttgatagaaaaagcatcagagagccttatttaacttttaattaacatttggtgcgtttcagagcacgttctaaaaaatatttatgaattaattttgcaaaataataaataattaatgaaaaagtcagaatttcgaaaaattttaaaaacaacaagcgttggcattttttcaggttaacttagtcctttacaatggagaaggcctgcaaaatttggagagattatatcgattttagcgcgctaggttcgatgaaactttttaaaatataagcctaaactttttggcctgtttaaaaaggaattaaaaatttttaaaaattttattcatctcccttttgatagaaaaagcatcagagagccttatttaacttttaattaacatttggtgcgtttcacagcacgttctaaaaaatatttatgaattaattttgcaaaataataaataattaatgaaaaagtcagaatttcgaaaaattttaaaaacaacaagcgttggcattttttcaggttaagttagtcctttacaatggagaaggcctgcaaaatttggagagattatatcgattttagcgcgctaggttcgatgaaactttttaaaatatgagcctaaactttttggcctgtttaaaaaggaattaaaaatttttaaaaattttattcatctccctttttgatagaaaaagcatcagagtgcctaaactagcatgtaaataaaatttggtgcactttagagcactttctgaaaaaaatatttatgaaacaaaaaaatcgattttttcaagtgtccaggtttggggtactcaaacatttatggggagcaaaaatccaacgcagaattaaagtacaggctatagggaagctactcccgaaggattcggtctccccataaatctgggcgcatcggttcggggggactgccccgaaaacaaaaaaatcgattttttcaagtgtccgtttggggtactcaaacatttatggggagcaaaaatccaacgcagaattaaagtacagactatagggaagctattcccgaaggattcggtctccccataaatctgggcgcatcggttcggggggactgccccgaaaacaaaaaaatcgattttttcaagtgtccgtttggggtactcaaacatttatggggagcaaaaatccaacgcagaattaaagtacagactatagggaagctattcccgaaggattcggtctccccataaatctgggcgcatcggttcagggggactgccccgaaaac

SEQ ID NO: 11337 - DNA, 4676 bp, Heterodera glycines
caaaaagtcctttatccacattagaagtttgccccttataccaattttttccaatttgtataaaggtaagttatggggcactgatcaaatgcttttttaaatcaatataaatacagtcaacattttttccaatttttatccggaagttttttcaaaagattttgggtctcgatgatgttaaaatttatatccgatataaagcattgatcaatttctataatattacccaagcatgaattgcttgggtctgtttcacaattattaaacgaattggcaaataacttggcaaatatttcacatttctcagcactattatgatagcatttatcttcataaatcagattaggtatttcaaagggattgacattaaatttttgtatatatttataaattgaatttcttccctttgaatagcctttttctcaatttggctatggtatttatttgtttgtatttttatatgtaaagaaatgctatcgtatagtgcttttttggatgggtcagttttagcttgcctgaataatttagacttctctttgatggatgctaataaatgttgtgggtatttgggagttaaatctttcttggtcaaacgctttattggaatacactcatttaaaatgtctaacaacactgttaaaggcggaatatttttgatttatgcaaaagcattcatatgacaaggcatttagccttgatgctatgactatattaaaatgtaacacattcgatggacaaaaccaacgaaagtttacgatctttgtttttggttttgttttaggagtaattaatgtgaaaaattgtgttaaatgatccgatgaaaatatgcctcctttaacagtacaatcagtaataattttttcattggccgaaaaaatcaaatctagccaggaattaattcgtgttggctcattcgtggccaaaacgtaagaaaatctgttgaaaaagtcacagaatatttcaccatatttactcattgaatagggatgcccatttttccataccaatccttattcggaaaattaaaatctcctaaagtcactgaattttcattaaaaaatttttgtaaaaatttaaacaaattttctgtttgtttgagtgttattttcggtggtttatacaccaaaacaaatctgatgcactgtaaattttgaagttgaataactaagatttcggaattaaattttgaatccgaaaattttgtaaaaaatccaatttcttttctgattagaataccacaaccgcccccacatgttttcgatttccttgatgagaaaatataattgtaattatcttttacccaagggcaaaaattgatttcttccccgtctttggtccaagtctcagtcattaaaaggatgtctattttttcggtttctaagataagtgcaatttcatcgattttattccttattgacctaatgtttattaggcagcatttaacattccctttattttttattaaaaagtttggatgagtaattttttggtagtaaagttataaaccaaaattgacttttgtgttgacgcttttaaagttgtgaccatttatccgaattaatttcctcttcctcgccggattccgacccaaaaacccgaaagatcgtactcatcggacgcacgcggcggtgaatttggagtaatgattagtgcgaaaggaaataatttggtggtttttctgctgtcgaaaatggtgcgccgaagacgaagacgacaccagcagaaaagaatagcagcaacaacaacaaaaacaacactccaccgaaggcggcagagcaaaaggaagaatgttttgtgccggaagcattgcccagcggcgtaatgtccgatttagcaaaagtgaacgcgaggttggccaagaggaagaagcagaaggctggctgctgagtgttgtgtgtgtgtgtttgtgtgtgtgtgatccatgaagaagtgtgatgattttacaatttgtttgtcatttaaaggcccttgtttgggtacagtatacaaaccatttttatacagtatcccttggcttcttctcgagcaaattgtattgtatgtatatttgtcatttttattacgctaattacatattaacttaaatagaaattaaaatcattctgattttacgtgtaattaccattttagcttaaaaaagagggaatttagtagaatttttgtgccttgataactctcgcaataggcaactcgtacaaaaataattctcctgggctctattatggtttgtcccccataaattttttgaaaaatctcgtatttttcgttattttcaattgtttatcacgtttatcttttttaaaccttttaataaaagacaaaatcaatgaatatgaatgaatttattttgatcagaatgatcaaagtaatcaaatgaattttctcaaattttttgtcttccgttttattgcgtagtgaactggggggggggggggtaattaagggagttaaaaagttataagaaaatcttaacttattaaagggccaccaactgcgtagtaatttttgcaaaaatcaattttggtgtaattaaatttttgcttagttagtttttggttatcaaaaacccccaaaataggtgctaaaaatgggaaaataggtgtcataaagtccaaatttagtggagtgtaaaatcgtaaaatcatccaaaaagtgtcgccaaaagcgacacaaatttcttggaaattttcatttattttttgatacttttcgtcgatcaattttcccattcgctcgctcctcttttttatgactcagctctttttctctcttcattttcgctatgagtcaccatttttaatggatttttgtccatctgtttgtgcacatttttcacgtgcctggctccgcccctattgatttgtgagggtataaaagccggcccattctccatttttttcactgatcaatttttgattaagtcagccggacagttttctgtccaagcaatttgcattaaattgtaattgtataaattgaataaagattaagaaaaggtcttaaatgggacactcaggagccctttaatacagaccattaagccattgacccccgttgggtcaaaaaaggcttaccaaaggaaggagaaaggatttctccttccaaattgtctcttcggtagaggagaggaatttcctcctttaatttgtccctttggactctgtgagtttctgtcttctggacagaaattcgctttgcttaaaagactccccccttctgccgggaagtgcaaatttttgtggctttttgcccacaaaaagcaacaaaattaaatcaaattaaataataatttaagcatgctagaattattctcagaaagcagcccataacaaacctccgtaaaatttaaaccttaattgaagagaaaaattaaatatcgacttagtgtttgcgttctgttagaataaggagttgtgtaaattaattatatagctcaaataatcactttcaagtttcaaattcctttttggattagaataagacgagaatttgcttatgcaaatggtgacgaattgaaagcgccaaatttttcttcaaattcatcttccatcatttttctttcacgattaattgctaatttggccattttttttaccaatttcgacttttcttctgctactttttcttttgtattttcatatatttcttccattttttggtcaaattctgtccgaagtttgccaatttccgtcgattgtttttcgctttttctctccaaattttgcccatttttttcttcctcttcaattgcatgatttgtttctttctcattttgcaattccatctcataatttccataggcgttctcacattctttttcgccctttttccaaaaacatttcgaaaaattattcagattttgaataatagaaattatttgcatgaattgccaatatttattaccccatttaaaaattggctttaccgctgacaattgatttgtcatatttgcgttttttgcttaattattttattaattaattaaatgatcattaaatggaaagcaaaaaccttcggcagatattctgaagaaatattcatacaaaatatgcaaatattttttgtatttttggcacttttcttttaaatcctctccaactttggcacattgccaattttttctcattaaatacacaagaccaaaataggccccatatttttgtaaataaaattcctttgatttctcaaagtttgaatattctttaagcatcctataaaatttctcaaaatttgtctcttgacctttcacaaattcagtgaaaattgcatcattagtcttaaattttggcattaattaaaacaatttgtttttaaaagactcacccataaacaataatcatcaaaaatcgatcggacaattatgtcattcgtatcaaaaattccatatttaacatataataaattattatcttccctttttgcccgttgttccgcttttttaaacatttcccctaaaatttcgttaaaattctgccggaatattccgtcgacactttcatttgtttggcacccataagctgtgtcaattgccaattgtaaaatcatttcgttaattggcacttttggtttttcgttgaccaattttacattataattcaatctatgctcatttaacaattttggttcaaatgataagtgaagagcttgtttaattttcttttataattccacgcact

SEQ ID NO: 11338 - DNA, 1363 bp, Heterodera glycines
cataggggagtttttattgcatttttgttaaatttttttgcaaaacgccaaaataggctttttcactttttcttcaggtttaaaatagagtgccacgggactgggaattttggcaaaaccgggaccgggacttgccgggacctgagaagccgggaccgggacctcgattttttttcgggaccgggaccgcaagaaaaaccgggaaccgggaccaaccgggaaatttcaaaaatccaaaaaaattttaaaaatttaaaaaaaaatcaaattttaatttatataaagtgaaaataatacaaaattatttggttttttatttaataaaacccaaaataaagctaattaaattaatgaaaattttcaaacaaattttcttcaattatttcaaacaattaatcatttttggactaaatcatcgaatattaatagaaattcagatttgattttcacatcactttttttcggagcgctttttcaaaaaacttttgggaaagaaggggtccggctgtgccgataggcgccgtcgggggaaattttaaaaatttgagtgagctttgttaacagattttcaacaaaaaaaggttggtttttgggattattaagctcaattggtaggattttcatttaaaaaacgataaaatatgtatcaataatctaatttctgtagagggattgaaccaggggaaagaagaagggaaagtcaaggagactagccactaggccatttgcacacttggaagtgttacttttaaagaatatatgtattaattatttttttaaattttttcctttgactctaattttcatcactaatttttcactcagacccccattcttaccagtgcacaaaatttactacaatatgcaaaaagaccgtaagtctctgtgcccaatacccgctgaagtatgggcactttctgaggtatgggcatatcaattttgatattgattcatctctactgtaaaatgcattatttctttaataaatactagtgatgttcgagaccgaaaatttcccgagactcgagaccgagactgaaaaccccgagaccgagacccaaaaaacccgagactcgagacttttttcaaaaaattttcctattcgcttaaaaatcgtttaaaaatttttttttgactctattcttaactaatttttggttttatttttattttgattcaatttggtacaatatttatcatttcaaacaagcacaaagcaaaaaaattagtttgttttcttcgcagtttttgtgtctatttaaaaaaataaagggtattttgaagctccggtggagccgataggcgccgccggggataatttttaaaatttgagtgaaattttgtgaacaaatttagtactaaa

SEQ ID NO: 11339 - DNA, 2013 bp, Heterodera glycines
tcaacattcaaaatgaaatcgatagtaaattttgtgctctttccaatgggcttactcaaaatttcaagaaaaattttcccaacccccttaggaatttttttcgaaaattttcccgatttcaagccatttttggcttttcagatcaccatgaaagagtgatctgatcatgttggcgtaaatgacttttttgacgagcataaaaagttatgttatcaagaattatttcagaacttttggccgataaaaaattaatttattttgtattttcaaatctatcataaacttatgaccacccaaaaatagggtgtggtacactcaggcgaaagttgctccgtcactaaatattccctagagaagataatgatgcctttggaaagcccacagaaaatgctataaaaacaccacaacattaagctaaagatttcattgaaaagttttatcaaagcaaattgcaattgggagcaccctaccataaacatatgaccatgacggctacccgacatttgaggacctgacatttgaggacccgacatttgaggacccgacttttgaggacccgacatttgaggatttgacatttgaggacccgacttttgcggatattcccgacatttgaggacccgatttttgaggacccgacatttgaggatattcacaatttcaaaaaaaatgaaattaaatcattataaaaaagagaaaaggcctttcccaagggccaacgggtgcaatgtatcaaaaagcattaaggacaaccgaataatttaaatatttgacagcacaaataatgatttcaaatttaattttggagattaacagcctttttctttcttaatgatttacaagtcatcctaatattcaatttgctcagactaacagcaattgaacacgatataaattataccagctgggaagctcctgtcaatctttgatcattttggatcgcatttaacacaaaaagtttgtaaattaaaatgtatttaaagatatatgaacttttttgcctttccccacaaaaaaatgccattcattagtgatgtgaaaatctttcactccaaaagggtgaaagcgaaatcaaaccctgctggaaactggaagtctttataaattgaaaatttttgaaaaaataaaaatgtaataaaattttaataattcattgattttcatgaaattattctaatgcgatttgttaacagattttgagcaaattttttcaagaaaatatatatttttagggtcgggcgatttttatttttttataagtagccctaaataaaaatgttctgagaaaatattttgggcttctctcgccataataacgcatagaaaaatatgatttaaaattccgggctctgttctaaaaacaaatcttgtctctttatgtttttttctttctcgaatactatcccctgagttggttcaactcattcaatccgctctcctttcttcagaacaatcattaatgactctgatattaaaaagtattataaattcattcttgttttgacttgtggtcctaacaatgattccacatgttaatagaaaaaaggggatcttcatgaattaccaaaacacaagtactatttaatgaagtagttaatcttaaattgtttttgaatatgaaactttagggattaccagcatttggtacaatttattttttgcttccccggccctcgggaatagctttttctctttttttataatgatataaataaaattttcattcattttttttgaaattgtgtatatcctcaaatgtcgggtcctcaaaagtcgggtcctcaaatgtcgggaatatccgcaaatgtcgggtcctcaaatgtcaaatcctcaaatgtcgggtcctcaaaagtcgggtcctcattaaaatttttaaaagtgcttaaaaacaggtacatgtgaatgaattcaaatgtgtaggtgagggataagagaagtaattgatttatttgctgatttttgtgtacaaaacacttaccaaagaccattctttcatacattcgcatcattttt

SEQ ID NO: 11340 - DNA, 2265 bp, Heterodera glycines
gacaatgatccgaacggagaaaacggattccattcttcgacgacgtatttattatttaactaaaaagaattccgtattttaataaaaaaaataaatattcaattttaaggtaaacgctgttatttttatcgccgcaataagtgaatataaccaaaaaactcgtgaagacaaaaataaagtaatataaaattatcccgctattaattctcgtttattacttatatgttattatgtttttaaacaataaaaattttctttttttagaatcgattaattgaagcgttaggtaagtttttacttttatttagagttgagcggtaatcggtaattgtaaaaaaaccggtaccggtactgaccggtaatgcaaaaaccggtaccggtaccaactttttccaccggtaccggtaccggtaccggtaaaaactggtaattttccaacgtaaaaatttttggataaaatttttcaaatacaaaatttttattcagttttcgcgcgagtgcctgttttttagcattagaattgttcagaagtatatgtacactgtgttgcattagaatgaaaggatgtcggaaaaaaattttacgaatttttttccaaaagctgtcagtttgattcggttgggcaaatgttagaggcgatttaagccttttggcccttaatttctcctgaaaacttagaaaattcaacataactctccccaaaagacatatttctgtacgcaaaataaacagaaatgtgaaaaaagatttgttctttcttatttagcatgtttatcagtttctttttagtagttgttgagatttttcttagttttccaaagtgtccttattctaatgcaacaccccaattttggaaaaaaattcgtaaaatttttttccgacatcctttcgtattcttattgttagaatcttaatattttcagaattgctacgtacagttaaaatttcagatcgattggttcatgggaagtggtcaaactcccaaaaaatagggtgtccttattctaatgcaacacagtgtatattgagggtgaccaagtatttttttcaaattcaggacatagaacactaaaattcagatgtagacctcaaaattcagattattgcaaaacaagggatcagcggccaattttccaattttgcgaaggggtctccggccatgtaaattaatgtaaatcaatgaccttttttgctttcaacaccgcttttttcgcggcacgttttttttagccagttgaccacttatgcatatgaacaaatgctttaaatgaaaataaataatttaatttttttttctcaaaaaatttctccttcttcaccaatttcctactcttttctcacgcagacccccattcttaccagtgcaaatttttaccggcggtaccggtactagacaaaccggtaccgatactttgatttttgaaaaaaccggtaccggtaccggtaccaaaaaaaccggtaattaccggtcggtaccggtaccggtaccggtaccgctcaaccctagatggacaaacagttcacttgtgaataatggtctgtaatactgtaagatattaatagggaatgtttctttcttttacagaaagtggcaccaggtagaaaacttatataatgtgtaagaagaagtgcgacatagatacattctatctttattataacgcgcgcaagtagatcgcacagaatataacttctgagttacaaactgttattatttcaagacagaaaatagatgaaaatttatattttaagatgatgttctcggtcgagttacagttcaaaagaaggatgacgtgccacagaagaacgggggacggaacacctatttcaagatggaaaagtgatctctaatcattcattctttgatttttcgttaaaatgagcaactctttctttgtaattttgcccagcaatacgccgggctttgtcggaaataaaacgaataaattcaaagtgcacttgccaaagaaattagtgtttgatgggcccgggtggatggtggacatgtctggcataatatatcccaacaggtgagttgtcttgcacagttttcgttgcaattgtacggtttagttgggcgactgtagggaccctggagaggcaatacgtagtggttcacctgcgcgatggtcgcaagttccggttcagagtgccaaggggtagcttcctttcgcctcagcagctcgaacgcggaatgcaccatggcatgatatcggaaaatggaaagacacctgacccgaaaaagtcaatacagtaccccgatga

SEQ ID NO: 11341 - DNA, 2639 bp, Heterodera glycines
ccggatgttctatttcatgaaaacaaaaattttttttgccataacatttttttgccaaatttgaatttatgtttgcaaattttttgctcaaaatctgtaaacaaatctccattaaaagccaaaatttactggcgtcgcctgcagtcagctatattttgttgaaaaaatggtgtgaaactcataaaaaggatcggctcgtctgtacttttaaaacagttttggctgctacgaaccctggtttttcgtattttgtcttcattttttaatacataaatatttaatttgttttttattttcatcaataagcatgcaatcacaagataaattagttatgccgttgaccacactttctggccacccggtgcgcatcatttacggcaccgcatggaagaaggagcgcaccgcggagttggtacgcagcgcaataaaagcaggcttccgtgccattgacacggcctgccaacccaagcattatgacgaggtgtgaacagaaacatattcattgcggcactaacttggtcaaaaataaaattttttttttgtggcataagaaattttgagggttgggcacttccatgtatggtccataaatagttagtattcattatatccatttaacgcaataatccccctgaaaaaaaattatgaagtgagtaatccgaagacctttttttgctcttcaggccaaaatttccaaaaaaaaaagtttctccggtgtaattttaaaaaaatttcagccgagcaaaaaaatcagaactttgtagccgtttttcaatgtaaattttgccatttttgggtcaaattttcaaaaaaaaaggtaaaatgtggttccgttagtgctattaggagccgctgggaaaattctggaaagttgaatttttttttgactaaaaaagcgtataacaaacagaaaaatgtctaattccaattaatgaccctatactagtagctttttttgcaaaagttgcgcaaattggaacatgaattagcgctttttaatggaaaaattttgaacacttccacccaattttttaaaaatctatcattacaattaaacggtgtttggctttaaaaatttacacaaaatttgcaataaaaattttttttttttcataggccctagttggcgtgacattggagcagttgctgcgcgaaaaattcatcagccgagaggatatttttgtgcaaacaaaattcacgtcgttggacggccaggacccggcacgggtgccctacgaccgaactgcgtctttgcctgatcaggtgctgcagcaaatggcgtattcagggggggagggaaggacagtggatagcccccgaaatcgaaaaatggaaaattttgaaaaattaaccggttttcttagccgtggtcccactaaaagtggccattcttagggccatcatttagaaaaaaaaggtttttttcccaaggtcgtggcacccatcatcaaccctttcaataaataataataataataataatgaaaaactgtggcgaaaaagaatataaagattttggaagagtaaaaaaaagggtacgggaggcccggaaaaatccactgcccttactcgtaaattttttcaaaaaaacgtcatatctcttttgtcaacttagtatcattttaaagcacttaatgttctctatatatatacatgcaaaataaagaaattttttaccaagttccgtaaaagttattataaaaatagtaattaaaaaaatatttcttttcgtccctaacctttttcattgctcaaatgttttgaaattttgcaaggaaatagaaaaccataagggctattgaatgatcccaagaatgtttaatttggtcgacaagccttgccttgagtaaaatcaaaaactttaaaattttgcacattttaatgcggaaatttttggtgtagataaaacagtcaatggaacgcagtttggcgaatttgcgcctcgattttgttgactctttggtgctgcatgggccaatgcggtaaattttttaaattgaaaaaatggaaaattgtgccaatttactcaaaataaagattttgtttaaattagaaaaatttccgacggtttctccgtatgagcaattttatttgaccctcaaaatggtcacattttaaggagttattggatgcccaaaatttaaaaaaaaacttgaggcctttttttgggcacactatgttcctctccccctcaaattttattcataggaatttttaaaaaatttaaagcgtttatcgaattggtaataaaagttttttacaaatctttttaaaatttcaatataaattttactgatttttttgggcagtacacttgacgaaaaccggttggtgtggcgcacctttgaacaactgcacggtgagggcaaaaccaagcgcattggcctgtccaactgttacgacttgcatttgctgcgcgcgctgtacgaggccgccaccgtgcggcccgccgtgttacagaaccgcttctacgcgcagtctgaccatgaccgggcggtgcgcgcgttctgcaagcagaacggcattgtgtaccagtccttttggacattggtgtgtttgtgtggggtttcacgttacgcaccacccctcccctcgtattgccctcccagaattttttaaaaatttacaaagtaaattta

SEQ ID NO: 11342 - DNA, 1006 bp, Heterodera glycines
ttcgcattattcgcattttttggcgtttcgcgtttcgcttttcgcatttcgctttttggcgcgaaatgcgacttttacacccctaagaattgattaaattcccataaaatttttcaaaattgtacctataaattggctaattttcagtgaaaaactgtttataaatgatcaaaatttccaatttttttccccggcggcgcctatgggcaccgccgggcccccaaaactcctattttttcttagaaaatggcccaaaatcgcaaaatttggtaatttgatgaaaaactgttctcagcggcgcgccaaaactcttatttctcattagaaaaatgatacaaaaatcacaaaatttgatgattttttggtgaaaatctgtcaacaaattttaatcaaattttcaaaaatttcccggcggcgcctgccccctcttcccaaaaagtttttttggaaaaagcgcgcctcaaaaaattgatttttaaatttggaataaaattttaaaaaatgacttttgctttatgattttaactattaaaaagttgcagaaaaaatttcgcttttcgcatttcgttttcgcatattttggcttttcgcatttcgcttttttttcatttcgcatttttcagtttcgcaaatttcgcttttcgcatttcgctttttatttttcaatttggcccatccctgctagccacatctcggaaatttaatgaagaatttttcaagaatattaaaaacatttttttttgttttttttctggcaattcagcaaatttagttttcaataagacaggttttcaagaataaaaactttaaaataaatttttttttttccattgggaccacaattcgacaccatggcctaaagatttagagagactggatccggaatctcaatctcaaaaccagtttagagaagttcaattgtgcataaatttccaagttttaagataagttaaagcaaaaaaaagtaaaaaccctgggtatactatagtcaaccccccggaaaaaa

SEQ ID NO: 11343 - DNA, 1168 bp, Heterodera glycines
  misc_feature (1112)..(1112): n is a, c, g, or t
  misc_feature (1148)..(1148): n is a, c, g, or t
attttttagtactgaattgtcgattttcactgggactcagttgtcccagtgcttagatggcatcggttcgaatttataccttgttttttagacttggctcatcaataacttccgaacgataccaagtttgtccgaatttggccgttttaaagggtcaggagccccccttttcactcaaattttcgagttttaaaccggttcaaaaaccggttttttggcatttccgcacctggagacctactttttcatgcatagctcctcgagacgaatcgattggtatatcatttatgccatttttttccgggggttgactatagtacacccaaaaccctttttaagtgcttggcaattttttgaaaatattttttgaattatcttaaaaatcactaaaaacaataatttattgcagaataaataaataaatccaaatgtttttgtaacaacaaaaaatgtcaaaattgaacataaaatgctaaacaattaaacattgcccacaatatttacgaattgtccgtttttgcttctttcacagtgacgtcaatggccagtgtcactttgtcctcttctctgttgtaaaagcctttgctcgggtccatcaattcctaaatggtttcataatgggccaattaacaggatgtccaattgccattctcttaccgaaaaagcgatgaaataagtgaatccacgccatgagcatttactgtcaaactcgtggtcttcgaattctctgctgaaatcgaacactcccttcttttgcgtgacaattcgaagaattgccgaacatttgcatctccaattttctaaaaattcaattttttccatttcggacaaattccacaacgtgaaaccgaaaaaagtcaaaatttcgacttcttgtggaattcagtttcgaaattgtccgggatgaatatgatattcttgaccagtagcgaacctggcaacatgccctagacacctttttaggacatgaaaattttttttaaaaagagggcggaatcggtagtatttattagtgctgttcgagaccgaaaatttctcgagacctagacttgaccccgagaccaaaacctcgagaccgagaccaaaaaacccgagattttcctgaatcgagnccgagactctcgaaaagaattagtatttatcgcctnattattttggaaaatttcgg

SEQ ID NO: 11344 - DNA, 1419 bp, Heterodera glycines
ttgcttgatcaatttcacctttttctgaagcggcgtcgcaccaaaggaaaaagctcagtcttttctctgctctttccgttggctttcttatccccgccaaaatcctccatcgaagtccttttatgtgcacagttttgcttttgcgctcattccaattgattttgcgcgaaaattccgacattttttcaatttccatccaaatcgtcgcttttttcggatatgaaattcgcttttggctcggaaactgaagtgggaacaaaagcccaccgaaaatgccacgaaaattcggaaggaaatgagaaatactgtccatttcttgcattgttaaaacgccgtatggaactgtaaaaagattaattatttcatttacaaaaaaaaggattgtgagatgtaccaatatcctcgtaaaacttttcctttgagatgagcggaaaacgaattttaaaaagtgccgggccgaggacggcacgacgatttgcagaggagcactcaatgtcatgttgacggcatttctcgtcagcccaacgaagtgccgaaaattatttgaaaaacaatttaattaatttaaatcggccataaaatttactgctttccaaattgaaatttctccattgatttgcaattgatcacgctccaaaatttcacataatgttttttggttaatccgcaaaaatgcgtccgatttgatcaaaatttccgcattatcatcgatgtaaagcaaacaacagttagcaaagtcctaaaataaaaatatttttgtaccagaaatggaaaaaagtcctaaaatcctaaatttcaagaattcgcttttgcgatgttccacaaaatttcaaagaaaaagaccaacacattggaaagaatgagtttatagtcaaccaattaaatatcattttcaaaaagaattaataaattctcttcagtatttgttaaattatacaatatttaaaattgcctttttcacctcaaaattgaaaaggcgagcctgaacataagccaaaaaaacattgcgcagttttgaaattggaatttgcaaagacggaccgaccaggccagggacattgtacttaattgctgaaacaaaaaagattcaaaaaaaaaaaattattttcaaggattaaaaaaacaaataattttatgtgaattttaatttaccggcgtaaagcaatgccatggcattgtctccgttcaatgcgctcaaatcgccagtgtaaatgaagcgcaacatcactttgaatgcttctgcatcaacatcggggaccaccacagggcaattagcagaggctaaaaatgaaaaaatttattgccaatgattaaaaccattaatttaataactatttaatattaatgttttttttaccattttgcgcgtttgcattttgcgagtcaaaacggaacattgcctcaaatacgtcggaagcg

SEQ ID NO: 11345 - DNA, 3330 bp, Heterodera glycines
  misc_feature (41)..(41): n is a, c, g, or t
  misc_feature (121)..(121): n is a, c, g, or t
  misc_feature (229)..(229): n is a, c, g, or t
aaaatgggcatccctatttcatgagtaatgtgtgaaatatntgtgacttttcaatagatttcttatgtttgcccacgaatgagccacaaagatttactcctggctagattgatttttacgnccaatgaaaaaattattactgattgtactgttaaaggaggcatattttcatcggatcatttaacacaatttttcacattaattactcctaaaacaaaaccgaaaacanaagatcgtaaactttcgttggttttgtccatcgaatgtgttacattttaatataatcatagcatcaaggctaaatgctttgtcatatgaatgctttagcataaatcaaaaatattccgcctttaacagtatgtttttaaaagttttatttgaattaaacaaccaataaagcgttagaccttgaattttttaactcccaaatacccacaacatttattagcatccatcaaagagaagtctaaattattcaggcaagctaaaactgacccatccaaaaaagcactatacgatagcatttctttacatataaaaatacaaacaaataaataccatagccaaattgagaaaaaggctatttcaaagggaagaaattcaatttataaatatatacaaaaattcaatgtcaatccctttgaaatacctaatctaatttatgaaaataaatgctatcataacagtgctgagaaatgtgaattatttgccaccttatttgccaattcatttaataatagtgaaaccgacccaaccaatccatgcttgggtaatattatagaaattgatcaatgctttatatcggatataaattttaacatcatcgagacccaaaatcttctgaaaaaacttccgaataaaaatggcacttctcccgataatattagttataaaattttaaaaatttgccattcttctctgtcaactgttattactgacttgtttaggatctcattagacactggttcacttccagacatctggaaggaatcaattgtttttccgctttttaaaaagggtgacaaaaataatcccgaaaactataggccaatttcattaacctgctcactttgcagggtaatggaaagaattttaagcaaaaatatttacaattttctattaaaaaacaaaaaaatttcggaatatcaatttggttttgttaaaaataggtctacaacgagtcaattaataacagttgtggaagattggtatgaggcaattataaatggaaaaaatgttgactatgctgatgatgttaaattatatatttgttataaagcaagaaccaaaacagaaattatgcataaagcattgcataatttatcagaatgggcaaataaatggcagatcagaatctcaattaaaaaaacttttgtacttcatttggggaataaaaaccccaaagaaatatataaaattgatggaaatataataaatgttgtggatacaattagggatttaggcataaatattgataataaattgcaattttccaatcatgtcgcacaaataataaagaatgcatatttacgtatgcgttctttatttcgggttattaaatcaaaatcttctaggatttggattactttgtacaaaacttatgttagaccgttattggaatatgctcctgaggtttggaatccatctcttctaaaaaatatttaaaaaattgaaaaatgtcaaaaatacttcaccaaaagagttcttttcaaatgcagccttccacccattccataccaacaaagattagattaccttcaactgccaacacttgaaagcaggcgaaagctttctgatctgttcatggctcataaaataatttatggccgaacagatcgaatccctttgaaatattcaaaccttctaaacgctttaacatgcccttttatagacttaactcgaaatataaattaggcaaaaaatttataccttttgcggggcgggtaacaaaaatttggaaccaactcgataaaaagcttattgaaataaactcattaaatcaatttaaaaataaaattaaaactatttcatttctgtaagattgaccggaaaaataaaagtcgaattattaattcattaaacaaaaagtgatttggtcattatattttattttttggcggcgatctcgtttttaattgtttatgcgctttcttgaggacattttaattaatgttttgtcctcaatgtaagcggatttttcccttttgtggactttttctttattgacaaataaaataaataaataaatcaaataaattttttttttcattttcgaaaagatttgttagttaatcttaataataagaaattttatcggattttaaaattattatttaaatataataaaaacatttggaaaaaactttttttttgttaaaaatatttttaattcgaatttttaattttcggtaatttctttcaaaaatttttttatcaatacacaattttttaaaattttccctacaaattaattttttttttattttccttcgaattttgaaaaacaaataaaataaaaaatacttgaatgcgtaattaatttaataataatatttatcgacaaaatctgcagatatcgctcctctgattcagtagatgttctttttatccgacttaattttgtgtcatataaagccaaattttgtcatgagtttcaaattgtccttttttgtacatttttcttcttcttctttcagctgtcccatcgacgcgcgacggtcgcgttgtgctcgtgccgttgcgaacaccgcgcgacaaattgcagcacgtattgcgctccatcgcgtggccaatgagccaggcggggctcagcacggtgatctgcgtgctgccgcttgtcttccttcaagtgattgcttgactgattggatgagctaacacttttacatattcgagatccaaatctcggccagttttggtggtctgtgcaagcgattgttatgcgattcaactgtccttgtttcgcaaatttatctcaagtcccgaaaaaagcatttctcgagcaaccctaggccatatgaatttctaacatccaattttctggcatctccaacaaatagggtacattacgtagtgatttaatttggctcaaaatcccacaaaaaattggatgatttttttaaatgttttattggttggggattagatttgattctcacaattcagagagagggtgcttgtttcgataaatctcgaaaagcggaaatttgcttcagaattacatcccgctcgtgttcgtcaaaaccatctcactggttgccatctggggactcttccacggcttggtaagggcctttatgccctcattttcagaattttcgggttttcttt

SEQ ID NO: 11346 - DNA, 2872 bp, Heterodera glycines
tagcagctgcggctttttaagactctttaattatctcctagtatgaattgtcctttattgtaatccccagttccactctgcactggttctcgtgcttttttgaatagggtcattgaaaactcatacattttttcaaagaatttttcaaaaaagaaaaattaaaatgtgaaaaattgagctttttcagtttttatagcaaaaaattctcttcaccgtttcgcctcagttttttttaaatttcataacttattttcttcaagaagtttttgaaatttttttttgagaaaatttcaagaaaaaattattaaataaaatttgaaagacggaactggcgagacggaactggtcagacggaaccggccccagacggaaccggccagacggaactggccccagacggaaccggtccttttagtactaagacggaactggcgagacggaactggtcagacggaaccggccccagacggaaccggccccagacggaaccggccagacggaactggccccagacggaaccggtcctcttagtactaagacggaactggcgagacggaactgtcagacggaaccggccccagacggaactggccccagacggaaccggtcctcttagtactaagacggaactggcgagacggaactgtcagacggaaccggccccagacggaaccggccccagacggaaccggtccttttagtactaagacggaactggcgagacggaaccggccccagacggaaccggccagacggaactacccgagacggaactgacccgctttgagctgtcttcccattattagatatattatttatagttaattaatgatcaactttttttacaattttgattcaacgaaagttttgtcaattctaatttgtaagtactttcgcggtttttgggtcaatttaagaaataatggaaaagcttagggtccagtggcgctgataggcgccgctggggaaaacattgaaatttttcgtgcacttgatttaatccaaatgtcaaaattttgctattttgagccctatttttttgaaaaattggggggtcttggcgtcgcttgtataaaaatgcaaattttgcagcgggtcaatggcaccgacgcgctctatatcccatttcgagttttctctgattttattggcttcaattagaatgaaaaatatattttcatgattaaattattaaaatttggccggacaaattaatttgaatattttgtctgttcctttcagaagcaattttaatttaattttttatgcgttctcattttcttcactaaagtaaattttttttacgctttttaaaatccgtttttttcttttctttgtgcttttcgattatctcaactaacaacaaatttttctttccattttgaatcggaataattccgttcgtaaattcgtaatttttgatcggggtccccgagccccttgaagcgtgcgtgcgctctccgaccccaatcccgctgacctgtccttcccgccggtgttccacgctccccgagaattattccttacacgagggatcggggagcaacctaataatcaaattacttcttattaattaaatccataaatttaagcaattaaattcaacccattttatcattgaaattttaatttttatcattgagcaaattcacatatattatataaaaatacctaaataaattattcatattttaactcatgaattcaacagatatgctataattatagaaagtaatgttacaaatcgagtattaaattatataaatttggtgaaatacatatttaaaaaaattaaacagtgtctagatcgaaaaaaacggacaaaaataccgagcacattatgcaagacaaacaaaaacaaaacagcgaaaaggatttatttatttaaaacaaaaaccaattttaaaagaataaaatcaggcatttaaaaatgattatttgaatatcaaatttatatttaaattgacaaatttgcaacttttatacggaataatgataatttaaaaatttatggccaaaggactgaaaaatcatattatcatactattgaaaagaaattgaaaagaattcactgacatgaagaggaatgggaggaaatgagcagaaaaagagctaattacttgaaaatattatattaataaactattgaacattaaacaaatgtttattttcaaattgaaatattaattaataccataagaaaattaattagaggcaaaaattaattattttttaaacaatttaaataatcatcagtgattggatttataaaatttcataatttacataaatctaattggaaaaatcattctaaaatacatcaatattataacatgaagaataaaatattgaaaatatttacgctacgatttagaaatttattatttttcctaaaaattaagcaatatttagcgaatgaccaacgaaaattgaggaaatcaaatagcgagagtaacaacttcatttttatcattgaaatttaacttcatttttatcattgagcgaattcatatattatataaaactacttaaataataatcattcatattttaactcactaattcaacagatatgctataattatagaaagtaatgttaaaatcgagtaataaatcacataaattcgattttagggggtgtatatttcgttttttgaaatcacgaattaggggatgtattttacttacattctcgtttttcgccaaaaatttttgtctccatttttcaaaaatatggtcaaatggaggtccggcagtgctaataggcgccgccgggaaaattgttttttagtatttttatgcaaattgttaagaaaatgcttataatttcaaaaaaatttactgaaatttttcttttttgggtacggggggg

SEQ ID NO: 11347 - DNA, 5347 bp, Heterodera glycines
  misc_feature (65)..(65): n is a, c, g, or t
  misc_feature (94)..(94): n is a, c, g, or t
gaaaaaatactaggaccgagagtcactgtacccatttcaatgccccaatttcaaaaactcataanttctgccatttacgctccatgaaaagttntagtcctaaaaacctttaattatttaatttaaatgaccaaggacaaacaaaatctttttttgttttaaaccttttaaaatttgtaaagattctcaagacgccaaacggtggtgacataaattcgaattcggcatctgcggcaacaggtggtcgtcatcagagaaaacatttcggcccgggacagaagcgtcgtgtcagttttggctcacaatcagaggtttttttggtacaaattctcattttggtgcaaaaatttcctttttagagcaatgacagtgcgattagaaagcacaaaatgccgaaagtggaagtgtcgacagagcaaatgacgacgccgaaagtcgggcagcaaaaatttcagacaaaaatgaacggaagcgcgtcatccggcaaagtcataaatggaccgcaaaagtaatgaccaattttgacaagcattgggcatttctatcgtagcaaatcttgggaaaaaatgaaattcaagaccaattgaacccaaaaatttaaaaatttcggggatagggttggaaatcctttaaatctggtcttataacgagttgacgttcattaacaggaaacttgccgaagaacaaaacagtgtgtcgccagtgcgtccgaacatgccgaaaagtgggggcaatgccaatattggcggcggtgccgccccaacaccgattccatcgcccaaaaatcagaagcaaaaacagcaaaagttggtcaaagtttacgaaagatggaagttttttgagggtttgataccaatgacattcgttttttgggtcagatttttgaattcaaaaattcgaattttgtttaattttaagagctttgtggtcaatgtttcataattcttcgttaaattctttttttattaaatatagacaaccttcaaaagctggacaaaaaaatgcaccaaaagctgatcagaagaaagtggcaccgaaaaatcagcaaaatgggaagccgaaaagtgaccaaaacggtgggccgtcgccgatgtccaaaaaagaaaagaagaagcaacagaaacgtgagaaaaaggagaagatcaaacagaaacatcagcagcagaaacaaacggttgacaaaaggaattgtaaattcatcataataatattgtttatttagggtcaaccgaatgcggaaaatttgaagaaaaacggtatagaaaagttggaggagggggaatttgtaactttttgaattttagaaaagaaaaatcacatgaaatttgcgcgagagtcggcggagcgactggaagaagcggtcaaaatgatacaggcgagaaaggagggcagtgaaaaggcgacgggggaagaaaacgtcaaaaaggacaaagacgcggtgtacaacatggtaaaaaatggggttggacattgcatataccacctatctatttgtctaattgtacagtttatcaagtccaccataaaaggggggaagtccatacaatcggaaccgactttttccgctcacgccaaaactttttcgattacccctataataagtttaaaatatcatctatatagagtaaactttaatgttttggggccctgatttgaaattaaaaaaacagcataaaaacaacgaaaagacataaaaaatgttcgcacaaagttcaattgatttggaatggttaatttgttttaaacagcccaataaacgtaattttatgctataaatagtagtgaacagttccaaatttaacttctttgtcatcttcatttcctttttaacagtttaaatgctattttcccctttttaggtggcttcttccctggaaactttgctgcccgtccgcttcgtttttggccgacttcgctcctccgctcggctggttgccaagcagcacagcagcaacattgtgcaggcagccacactgttggagccaaagaagttcaagcagttcgtccagctgttggacagcagcaatgtcgccaaaaagggtggtgttgccgaagcgacggaggacgacgaagaaaaagcagagcgaaaggaggcgggggaggaggacgaacaacgcgttttggcactgtgagttgtgtaaattgttgcgaaatacaacgaatgatataaatgccaattgggagcaaaaaagaaaaatgttggaaaatagtcgagcgactgtttaagaaattgggcctatttgaattcgacttatcttattgttagacatgacgtgtcgtataacgatttatcagttcgaggtctcattctcgatatgcaaacaagccgagaaattttgattttgaactaaaaacggtttggtatcaaccgataaatctaccatgtatgacacatcatttttgagatataaactgccccggacgaccaattgcacccacatatatttgaatctaaaatttagtcatttttgggccataatcataaaaattctgctcaatgatcaattgataattagtgtaacattgccatttctaaaatttgcatgttcattgtcacagtgccctttgtgtgctctccgctgcgatgtgtttgctgggcaatgcgttgcccgacgacgaggacaccgcccaacgacgtgaggaatatctgaacgagtcgacggaactgcgcaaaatggccaaggcaaacattcattggtgaatattgcattataaaaatgtcattttaagaatttgatgggcgacgccgcacaaaagcagaagaagcaattggacgcgttggtcgccgacatggcgcccgtcattgtcgacatggtcatcgcttgggcctcccgcacggcgtgggtccatcgcgcgttgggcgcctttgtgttgtgtcgtttcgccaaatggcttaactacggacattttgaaccaattttgaaggtcggtgttcaaatacagtcatcagcctgcaatttcaaaaaaattattaaatttcttggtaaagattttgaattttgactattaattatgcattttcctccgcgtttaggcctttgttgataaagatgccgaactgttgaaagaagagggggaggaggaggaagaagacgaaagtgaggacgacaaagaggaagaggacgaaggagtggaagaggaggagacgcccgacgtggaccccaaattggtggccgatgtgcgccgagcgatgggcaaagcggcgactccgaagaacgccacggaggtgccatccgatgaggacaactgggtaatctgagggaaaggattcatggaaatatttcttatccccccccctttttttgtctccgttttaaatttcgtttcccattgtgccaggaactgaatgacgagcagatgttccgtcttgaccacgacttggcccgtgcattccgtcgacatgcctcccaacgcaatgagctgtcgcgacaggccaacgttttccgtctgcgactcattgagttggtgtgcgcctatctgtcaacggcaccgttcagcgaagcgatggcatgttttttaatttatttagttttcactcattaattggcatttgcaactgggtacttattgtcagtcgctcaatttcaaaatttttcgtaaaaatcaaaaatcttattcaacaaaattttaccctagttgggaatagtttaaacatattttagattttttgcttctttcagtctctctccgtgcacattttctcttccgtcgtttggcgcacaaattccaaccacaaaaagttgggcattaagttggtggacccgattttacagcgcaaaaaggtgggcgaaactcctttggtgtcacataccaatgaccaattcattttctctgccaggagaacaccatgacacccaagcgtcttgccaagctgttcaagcagctcattgacggggcggccaccgttgacggaggcgaacagaagcagcagcacattgtcggcagacgcgacgcggcctccgcggtggtgcgggcggcgctgatgctggtcagtgtttttggcgaaatgtgaattccaattaaaaaaacgtgcataactaaaatactataagttgacacttttccagcaatggattggtgcatttatagcaaaattggtggggtttcaaactgtttattagatgggctgtccctgcttaccaggaaaattaaatggttttggacaattccgagtccttttgaccaaattcgagtaaaaaagttcaaaaaaccatatttgggagtcaagaattgcgaatccaagtttgactgggttcggattcgtctgggtgggtttcaatcgtgatcagaacgtctcacaaataattattttgacttcttttttcagttttctttggccgctgaccacacaaataaacggagtgcacccgaactgcttcgtcttattgaacagcaggtgctcggcgactattttcccgaagagcggaacaccaacaaagcccagttgcagtcgttgctgctgtttcggctgtgcgcgatatatccggtaatggcgcaatgacaaaaatgagggaatgaatgccgacattcttcaattttcgttacctaattgttggcctatctaattttactttatttcttccccagcaatatcttggtcagaaattcttgcccactattctcgccttcaccgccgacgccaaaatgtctgacgataaaaaggtaaaacgaatctgggcgggtgcattcttatggcattgtgccataacattcattttcgtacatttgcttttcagcatcaagcattcaacatggcacgcactttggtgaccagcagaaaagacgtaaagtaaagggggagcaaaatttaaataattttacaatttttagtcacccaaattctatgcaacagttttgggcgacatcggctcgtatttggtccgcgcagtgcctttgtacatcaagaaaatcgcagacgaaccttctcctcctgcggacaatgagaatgacacaattacgaggaaaagaatatgtgtgccaattttggcagctttccccccccccccaaaaaaaacagctttttattttgattttattgaaaagtttttcgatccataattagggactttaattagtttttaatagaagtttcctttcgcattcatttacatccaaatgtttttccctcccctccaggcacatcaattgttagccaaatttgtgttcatcctcggctggttcttccgaattgacggtgctgaatcgtccacggtgggaaaatgttgccgttttcaaatcgtaatcaactcaatacaaacagaacgtcatgaaacaagccgtcgcaacgacagccgtcggttctttagagggcaaacgatggtggaactgttggccaacgaaggaatga

SEQ ID NO: 11348 - DNA, 3536 bp, Heterodera glycines
  misc_feature (52)..(52): n is a, c, g, or t
  misc_feature (3436)..(3437): n is a, c, g, or t
  misc_feature (3484)..(3484): n is a, c, g, or t
tataggcaatgtttcgattgaccccaaaaatttttggacaaatataattganaatattattatcaaaaatcagctggcttttgtcccgttctctgcaaattcatcatttgctttatttggaactcttttctttaaattcaattttgtgtctttctaagtactgctttaacattggctccaatttcgctccaattttggcaattcaatgaaattttatgaaattaattaatttaaaattggatgaattttgattattttcgaattattttagccaataatcccttccaaataattcatataagacccagctccaattttggcatttcaatgaaatttacacaaataattcatttaaaattggatgaattttgattattttcgaattattttagccaataatcccttccaaataattcaaaattaatttttgtatctttttaatactactttaagacgcaactccaattttgtcatttcaatgaattttatgaataattaattcatttaaaattgggggaattttgcattattttcaaattattttatgtcataatccattctaaataataaccttattatttggtttatttgcacattttccaccaccattttgttccttctcatatattatttgcccgttgtgttgtgctgctgctcgggtcatgttttgtttgcccacacaaaacgtcgtcaagtcgctcaaccaccgcccgactaaagtccaacgattaatgaatgaatgagtgaccaataccaaaataataatcaatgcacaacattttaacactgattttgcgttaattaaaaaataaatatttatgttgtaattattttgattaattaattaaatttaattcgtttcattttttgtacttatttattttagtgtaaaaaaatgaaaaattggaaagtttttagcaaaaaaattttgtgaaactctcttttattaattactgtgaattcagtaatattttttcaaaaaatttctcggcagcatcgcctggtgcccatgaaaatacctgaaattatttcttggttcacattaagttaaaaaaaaaaattgcttaaaattcgtcacaaaataattaatgcttcctacttcaatttgggttaaaaattattttgacactaatttgattaattctaattagcattttatttgttagacaccaactgtttttttttaatatataaaacaatgaaaaattaatttttttgtgaaacaaaatgtgtgtaaatgggagggagtttttattcttttggtgtctaaaattctaaaaaaaaatctattatcattatttcttaaaaactcaacaatgaattatgtcttggtatgtaatattaaaattttaaataaaaattttttcattttacagacattttttgctgaaaaaattttgaattttccgatggaaaatccaagccaaatcgatctgtctccgtttttgcttttctttaattattcgccctttctccccgccggcgtcgtctcacaacagtggacaaataaatgcatttttcccattcacattttatctatcgtcatcctccgtccgacctctgcagtgactgtgctgggccaaacagcgctaaggctaacatacccaaaaataaaatgcccacaataaaatgactcatcgatgtaaaaaataattagattttaattttaaatgtatatttttttaatgttttttaatcgacccataactaattgtttattgaaaaagtaattagtagggctgcttaagagtcgaaatttccgagactcgagatcaagacccaacccccgccccaaaaaaaaggccgagaaatttcagtacaagttttttttttgagaatttttagaatgtatataaatattttcccaacaaaacattttttccaccttttcttttattatttttgtgggcaaataattaaataattatcatcattaaatatttcaaaattcataaaaatttaaaaggcctatgctcggcctaacagctaagaccaatccaaagcacccaaaaaaatataaaatattcacaacaaaatgattcatcgatttttaattttaaattaattatttttgaaaatacaagaaaaattttttttttattattattattattattattttcaacttaaatatttataatcaattaaaattagaatagaaaaaaataaacttatagaggcttaaagcaaaaaattgccaaataaatatatccagcctaaaggaaatttgtgcaaaattttaaggattttgtaaaaaaaccaggaatcacttattaattttcaaacatttgcatttaaaattcttttgtaaaaatattatttttatatttacatttactatttttaaatttttaacatcataattttctgtaaaacattttgctagcaaatgcttcaactcaaataaaaattccaaataatttggcactaaaatgctgcggaatattggcattttgtcattgttggcatttttcttcctctgtggcacaattaatggacaacaaccgccgctggccaatgggttggagccgactcgacaacgaattcgcaacactctcggcggtttctactcgggcaatgtgacactgtacttccgtaactcgccgtacaggtgccatgaaaaaaatgggaaatttattcaaaaaagggcggggcaggggaaataggtaaattggacacaaaatgtaaaattcgggtcgcaggcgagtcgtgatcccacccaaatcccgatcccgaacaatccctaagattttgaaaaaacgatcgggagcgatcccgagtcgtggtcccattcaaattccgataccgaacaatccctaagattttggaaaaacgatcgggagggatcccgagtcgtggtcccattcaaatcccgatcctgaccaatcccgaggcttttatttcggaatcccgccggatcatcgggatttgcttaaaattaaaatttaaattttgtcgcccaggcggtgccgatgggcgccgccggggaaagaaaattttgtaaaattttaactaaattattctgaaatttattgaaaattttttctttctagagttgagcgtgaattaattgtcgaatcgggcgcaacaatcacaattgagacgggcgtacaaatgtattttgacacgggcgttggcatgaaaggtgggtgtaatgtgacaattggcatttttgatcggcatttttaaaaatgccttaacctggattctatgttgtatgtggacctggaattcctggacaaaaatccagcaaattccaggtccaggcttgtcatggcctggataacaatgcctggacctggatttttttgaattttcttttaataagcaaacaaatgtttaaaaaaaagtcaatttattgtcttaggaaaatcaaaatgtttctctaattgacataataatattttaaaaatatttatcattttttgataatttnngaataagcatgatcactgaaaaaattctaaaaatattttggaaatcnaagttttcgtgcctaactggacatggatttcctgggcaaattctaggaaaac

SEQ ID NO: 11349 - DNA, 3266 bp, Heterodera glycines
  misc_feature (3201)..(3201): n is a, c, g, or t
attttctgtaaacattttgctagcaaatgcttcactccaaataaaaattccaaataatttggcactaaaatgctgcggaatattggcattttgtcattgttggcatttttcttcctctgtggcacaattaatggacaacaaccgccgctggccaatgggttggagccgactcgacaacgaattcgcaacactctcggcggtttctactcgggcaatgtgacactgtacttccgtaactctccgtacaggtgccatgaaaaaaatgggaaatttattcaaaaaagggcggggcaggggaaataggtaaattggacacaaaatgtaaaattcgggtcgcaggcgagtcgtgatcccacccaaatcccgatcccgaacaatccctaagattttggaaaaacgatcgggagggatcccgagtcgtggtcccattcaaatcccgatcctgaccaatcccgtggcttttatttcggaatcccgctggatcatcgggatttgcttaaaattaaaatttaaatgttgtcgcccaggcggtgccgatgggcgccgccggggaaagaaaattttgtaaaattttaactaaaatattctgaaatttatagaaaattttttctttctagagttgagcgtgaattaattgtcgaatcgggcgcaacaatcacaattgagacgggcgtacaaatgtattttgacacgggcgttggcatgaaaggtgggtgtaatgtgacaatcggcatttttgatcggcatttttaaaaatgccttaacctggattctatgttgtatgtggacctggaattcctggacaaaaatccagcaaattccaggtccaggcttgtcatggcgtggataacaatgcctggacctggatttttttgaattttcttttaataagcaaacaaatgtttaaaaaaaagtcaatttattgtcttaggaaaatcaaaatgtttctctaattgatataataatattttaaaaatatttatcattttttgataatttgaaataaagcatgatcactgaaaaaattctaaaaatattttggaaatcaagtttttcgtgcctaacctggacatggatttcctgggcaaaattctaggaaaacccatgtccttgtttccaggtcccgggccaagtttctaattggcataatttgtgcacgatttgcgtgtccatcaatttcagtctttggcactctgcaagcagttggcaacgaatttgcgcacattcaaatgctaccgtaccaagagcagctggtgtacgatagcaaattgccagaattacggctaattgacggtcccaccgtcaggcaaggccgtctgcaggcaaatttctttaatattttttttcaaaaaataatttacgaaatttaataaaagttcgttttcaattaaaaatgtttttttttataaaaaaaaacattgaattaaaaataaaaaatacgaggtgtacattttaaagccatttaaaataattgtctaattgagctgaaattttacaaaaaaaagacttttgctcaaaaaataaaaaaagcgtatttttcagaattattttcattgtcatcaagatttgatcaatgttggaattttttgaaattaactatgaatgttacagtctaaaaaactaataaaaaaatttttgtttaccactaaggttgttaaatgattttttcatctttttgttccaaaaaattaaaaattgtaattaagtaacaaaaaaaaattaaatttttaatttcgtaacgcctttttatcatttaaaattaatttgaaaaatgcgtaatacattttttgaaatttttttttttgattagattcgctttcgggaccgttggcgttccgtctgtacccaaatgacaaattggaccagtattgacacgggcaccgcgtgccgtaccatgggctatgatgacggcgcattttggcgcttttttcagcgcaacaacgacacttacccatttgtaatgccggcgcccaaatgtacacaacgccaaagtgggaaaattaaaaaattttaatgccaaatttaattttatttattttttgaaatttaagactctctgtggaactgtccaggctttgaggacaaagaacagattccgttgtccgaaaatttgtgccaaggtgaggacgacattggcatttattgttggggaaggccaactttcactggatgggctcgccattggaaaggtaaaatagaaaaaatgggttagaatttaatttaaattaattaattttatattattagatgggtgcattaatttaagtttacttaaaactattaatttaattgagtgagtttaatttggtataaattttttttttactttttattgattgaattatcaattttttatttacatattttgccaatttttcaagattaaaataatatgaacatttaatataattttaaacttaatcacctaaaacattagaccattcgacgcttttaatgattaaaatatttttgtaaacagatgaaaaaaagagattaaacttttatcacaaactcaaatttaaacaaattctcaagaaaaaaattgaaattttcaaatttttttcattgtaatttttcatttaatcttcttgggataataataataataattgtcctcattatagcaatttgtttttggattcattgccatatttggttttgtatttgtctaatgagctcattggaattcccaattttgcggcaatttcgtattctttgaattttggattttgttttttgatttgataatattgtttaatcgtttctattttttcagcaattgataacatttttcgctctgtaaattgaaaaaaaaacaaaaattttttaaaacattatttaaaattcaccttttgaattattttgttcaattcctaaattctttgcccatttttcaattgcctgaaaaatcacaccaaacatttgtttaatttttgctctaaattctttccattccttctgcgaatgttttccatttttcataaatttaatttttattttaaaatatttttcaacaatttctcttttttcatcatcagttttttgctttttcaccatttttccaacttttatttctttcttccatttataaatgcttctaatatttatgtccaaatattttgctattattttttggcatttttctctttttcccttcaatttttcattgaatttcgtttttaattttgcatatatttgatncaattgctttaacatttttacgtttttcctcatccgtataataatgcttttttgtcattccaaat

SEQ ID NO: 11350 - DNA, 1212 bp, Heterodera glycines
ttgtgtttatttccgtatgggggcaagtgggttgaggaaacaattaaaatgagtcgaattgatgggtgcatcatcttcactgaaatgtcttaaagataattttattatcagccaaggcttttttgtcgtcgtggaaatattgattttaattcaattagagggctctttcgaaaatgagtatttcttcatcgcgatcgaaggcaatcagttgcgaatggaaaataatttcagaatttgaagagaacaaaattgtgtttaattccgttattggggcaagtgggttgaggaaaaaattaaaatgagtcgaattgatgggtgcataatcttcacttgaatgtcttaaagataattttattatcagccaaggcttttttgtcgtcgtggaaatattgattttaattcaattagagggctctcccgaaaatgagtatttctccatcgcgatcaaaggcaatcagttgcgaatggaaaataatttcagaatttgaagagaacaattgtgtttaattccgttattggggcaagtgggttgaggaaaaaattaaaatgagtcgaattgatgggtgcataatcttcacttgaatgtcttaaagataattttattatcagccaaggcttttttgtcgtcgtggaaatattgattttaattcaattagagggctctcccgaaaatgagtatttctccatcgcgatcaaaggcaatcagttgcgaatggaaaataatttcagaatttgaagagaacaattgtgtttaattccgttattggggcaagtgggttgaggaaaaaattaaaatgagtcgaattgatgggtgcataatcttcacttgaatgtcttaaagataattttattatcagccaaggcttttttgtcgtcgtggaaatattgattttaattcaattagagggctctcccgaaaatgagtatttctccatcgcgatcaaaggcaatcagttgcgaatggaaaataatttcagaatttgaagagaacaattgtgtttaattccgttattggggcaagtgggttgaggaaaaaattaaaatgagtcgaattgatgggtgcataatcttcacttgaatgtcttaaagataattttattatcagccaaggcttttttgtcgtcgtggaaatattgattttaattcaattagagggctcttccgaaaatgagtatttctccatcgcgatcaaaggcaatcagttgcgaatgg

SEQ ID NO: 11351 - DNA, 1135 bp, Heterodera glycines
  misc_feature (57)..(58): n is a, c, g, or t
  misc_feature (81)..(82): n is a, c, g, or t
  misc_feature (89)..(89): n is a, c, g, or t
ggtgcatatctttcactgaaatgtcttaagataaattttattatcagccaaggcttnnttgtcgtcgtggaaatatgattnntatcaanttagagggctctcccgaaaatgagtatttctccatcgcgatcaaaggcaatcagttgcgaatggaaaataatttcagaatttgaagagaacaattgtgtttaattccgttattggggcaagtgggttgaggaaaaaattaaaatgagtcgaattgatgggtgcataatcttcacttgaatgtcttaaagataattttattatcagccaaggcttttttgtcgtcgtggaaatattgattttaattcaattagagggctctcccgaaaatgagtatttctccatcgcgatcaaaggcaatcagttgcgaatggaaaataatttcagaatttgaagagaacaattgtgtttaattccgttattggggcaagtgggttgaggaaaaaattaaaatgagtcgaattgatgggtgcataatcttcacttgaatgtcttaaagataattttattatcagccaaggcttttttgtcgtcgtggaaatattgattttaattcaattagagggctctttcgaaaatgagtatttcttcatcgcgattgaaggcaatcagttgcgaatggaaaataatttcagaatttgaagagaacaattgtgtttaattccgttattggggcaagtgggttgaggaaaaaattaaaatgagtcgaattgatgggtgcataatcttcacttgaatgtcttaaagataattttattatcagccaaggcttttttgtcgtcgtggaaatattgattttaattcaattagagggctctcccgaaaatgagtatttctccatcgcgatcaaaggcaatcagttgcgaatggaaaataatttcagaatttgaagagaacaattgtgtttaattccgttattggggcaagtgggttgaggaaaaaattaaaatgagtcgaattgatgggtgcataatcttcacttgtgtgtcttagagataattatattatcagccaaggcttttgtgtcgtcgtgaaatatagattataattcaattagaggtctctcacgaatatgagtatctctctatcgcgatcaaggggcatcagt

SEQ ID NO: 11352 - DNA, 2920 bp, Heterodera glycines
  misc_feature (2804)..(2804): n is a, c, g, or t
  misc_feature (2832)..(2832): n is a, c, g, or t
tgaatctcggaatgctcagggggaagttcaggtgggtctgatcccgacagaagcgagaagggcaaaactcttctgatcagtgatcaatcagaaagaaaggggagggcgagaaaatggcagggaaaaaagcacagttaggggagagggaacggaaaggacaaatctcacaaatcactaaccaaaatgagtggggggggggagggattgtcaaattgtggcacattccattcgacattttccgagcagtctaaagggaaagtcccgcgtttattgaccagtggggacatccatggataaacattttcgctcagaatgacgcagaaaatgcgcaatttcgtcatgccaatgctccgaatgaatcaaattgccgtcgttgacccattcaccaaagagcaactgctgcttcctgtgaatgtactacaattttcacacaattttgcaattgtactgatttcgttggggacttttttgacaattatttccattggattggccgcgtttttcactgtgaaacgaaatggggtaaatttaaaaaacaaaggatgcttaaattaaaattaatatttcagaagtatgtaaagtgaaaaacacaccaaaagcgaaacgggacgaattattatattatgatttgtatacaattgatttgcccagtttttagcttgctcattttggctgtttatttgcatggcttatttataaatgaacccaaaactctgcctggcaaaaagccattatgataaaaatatatgaaatccccctctcctctcctttgctgttttaaaacggcaacattttaataaataaatgttcaaagaaaaatcgtttggttgtggacaagtcagtggatttgtgggtgataaaataataacaatttgcagaaaacccaaaaaggacacacaaataaaataggaaaacaagaaaagtgatcatcgccataagggcaaaaagggaagcaacaatgacaaacaaacaaacacagcaaagacaggtgggccggcggagaaatgagaaagaaaaacattttatggcgaggttcaagcgaacgacggacttcggaaaatgcgtccccaaaatcggatgtatcacagcccacaagtatcaacacccctccccatagtcccatttcacttcccacccctctcctctccctcctcttcttccgcaatcttccgtttcctcaaagttcggtgtgtccctcttcgtctcccccctcctcgccttctttggccgctttctcctcctccgatgggccggcaccgtcctttccacccgactcgaggaatttgctaaattttttggaaattttcattggctccagcttggttttcctccttacctgaagccttccaaagtgcgttcacctgtgtagtcgatggcctggacgaaacttgaaccgttttggcaatttttagtgataaatcaacctttttggagtttgctgggaagtatttaatggttgggaatgactgaattttcacgtcctcaacttcgttgcctgtggcgtccattttggcaatgacaatgctctcgtggtctttgtacttaaacgcctcgttcggttacacagatatgttagaattacactgaccttctcgcccaatttgtcccaaatgggtgccaattgtttgcagtgaccgcaccacggcgcgtagaattcgaccagcacatttttggtgtcatcccgcgcgacctgttcgaagttctttccgaccagcaccttcaccggctgtttgttccagtcttctggcacttcttcgctcatcaaatgcggcttcagttttccgtccacgtaagtggaagtgaacttgaccacgttctcggtggtgatgtcgctccattccggcttgtatttggtcatgtcctcctccaacgaaatcagtcgaaccgcaggaaggtcctcctttttgagcccgaagaattccataatccttgcgttgtcctccacgtcggtgttaatgtacacgaagagaacctgaaacagacacaatttggaaaataataataaattaaagatagttttaccttgcccttaaactctttggcagcggcgcgaaattcgctctccaacttctcaaagtcgcttgactccttggacacaaacaacctgcatattgagacaaataagaaaatccaaacgtccccttcccaagtccacttacaaattgtgcgattttatttctccaccgaaaatgactgacgccgtctcttggctgaactccgagaccaacggcagacggttggactgcacgaacttcttgatgtcgtccacctcagttgggttgccctcaaattcgtcacggccctcgtcgaactttttgaaaagagcgatggagtcctccttcttcaactccgcctccttggcaacatccgcctcgtacacaatgccaaagggaacgtcatcgatggcaccagcaacttccaagtaagctttggccgcgtcactttctttgttcttaaatgtcattttataagttagggaagtatagtaaagcagactggaacaaacccaaaattaatccattaattggaaattgtccgattttaggttcacatttggttatgaaaataccttttattttcctttggtttagcacccagtaagcttatttttattgaattgatggaaagaagaagaaagtccaaaccttgaagtaggcaacgacaacgacttccgccgagtctttgtagtccttcaattcgtccgcgctcttcagttccttggccgctgggccagccttcttctttagccatgccacaattgaagcggcgtcccttccgcctccgtattcggtgggctttcctanaagcaatcatttaattggaatcaactanattttctaataaattttgctagttaatgtaataataagaaccgtttttgaagagtttcagcgttgggtacccccgcacttcaaagttg

SEQ ID NO: 11353 - DNA, 1328 bp, Heterodera glycines
  misc_feature (24)..(24): n is a, c, g, or t
  misc_feature (73)..(73): n is a, c, g, or t
  misc_feature (106)..(106): n is a, c, g, or t
gtaaatggtcgttagcaaatcctnttatccattccttctgctggaggtgatatgattgacgatcagaaattgntagaaggatatgatgatattttccaacaaatgnaagatggatgaataggttgggcgggagctaaaaatttggtaaagcgaaaaagggcggaatgtaaaaattgaccgaaagctccacaaaatttggtctaaatgggggtggagattggcggtggtgggcgctgtggtgagttggaatcggagaaatttggggcgagtgcgccaacagagagagagagaaaggggagggagtggaggtgaggggcaaaaagacagtcgccccgattttatccagcaattcgccctcgtcacttttgcgtggtgtgcgtctcaactctcgccgattggcggatgaattgtaaggaaaatcagcgatcgcttcgcttcgcgcccaacgaaaagaaactgaaaatgcgcgcgctgtttctcttctgcccatttccaatcactttttaagcgcacaaaacgctttgaaattggagagcggcgagggaaacgttttctaaactgaatgccaagcgaatgcattaacacatttgtacgaatgggtctgcttattgttagttgagttgggactatcgagagcgggttcgaatcccgaccggtggggattgggcctatgtttttcaggtctcaatccatgcccatcctttcctaacgaacgaaaaactcgcatttaaattttgattggaaaagatttattaagtaaaattgacaaacataaaaaatggcaacataaggcatatgttaaacgaacaaagagtatcagcagaaaaggcagaatgagtgaaccgtaatagtaaccctgaataatgataatataataaatgaaggatggaaccgattgtgaacagaaaagcgaactgacaatgagtaataatataaattaaaagggattctttccttctgggagaatgcaaaaatgaagacgataaataagcatttcttcaaaattaataaaattctcaaaattgcacgaacactttctcaatttggcccatccgtccgtccgccatttgtcacactctcaacgaatgcgaagtcgtcgccgcatcgccggttgctgcgcctccagcggttgcgcgcgtctcctcctgcagacgcaacgcctccagcatttgcttttctttcttgtcgcgctcgcgtttgcgctcacgcgccttcaacttgcgctcgcggatggaatactcttgcagatagtccacctaatcgaaggaaaagagaatagaaaaaaatagaaaaccacatttttgaattttcgaattctgttcaactcg

SEQ ID NO: 11354 - DNA, 1288 bp, Heterodera glycines
tccaacccgatgtcctcaaacatgtcgtcggtggcctccgcgtccgttgacactgtgtcgtcgttgtacggaatgtcggcattcctcggcttcctttcgaactgaattctccactcatcaaatgcaagttctaagtctgcccaccatcatttgttcgttgccagcaatgcgaaggaatttgaaatgagtgccgccgtcggcagtccgaccttcgtcgacgatcactttgtactttttggttcgcttcttcgtttggaactttccctccacatccgaaataaatccgtacatcgcgttgaacaactgatctttggcgaactcttccgagcacaattccacttcaattttgaactggaagaaaaggacaagtccataagcattttgcaatttcggcaaattcaatttccatttgtctgacgtaataatcatttacaagaaataaaaccgattttataaagaaccgctcacttcgtatcgctgaatggtcgtcccggatacattttgctcgtcaattcgactgtgtggcacaatttcgcgctgttcgtcaagttgacctccaattatttcatgagtcccactcttcgcattgaaatgggcatcaaatttgaaccaatagccaacaggaaaattgcggatgtgttcggccgggaaaatgaacaactgagtggggtacttgggcacgtaaacgaacttattgaaagctaaatgagtgaagaatatttggaaaatctattcaatattcaaaagaaaagaaacggactgttgtagatgaacccgtcggctgtgagtgtctccgttacggccaaattgtttgccttttccaccagtcgaagtgtttcagttggttgactctcgtgcaatttgaaacggcacaatttgtgcttgctagggcccgtgtccacaatgtaaatgcttaaggtgaattcatttgataatgtttctttcttccctacagaatctctccggtgtactcctccatctcttgcgccccctcttcaaaatcagtttccgcagcggcggcagcagcttcctcctcttctttacgaagctcttcattgaagaacatgtaaggcaaagtgccaagcaaacggtttggatcagccacaagctgaaggagaaacaatggaacagaaagagagagagaggaggaaaaggaagacagagagaacagaaaagagagaaaaaaggagaaagtgaagagaaaggaagagggtagacattgaaaggagagaaagaaaaggggaaacggtagaacagagagaaaggaagagataaaaaagagatagaa

SEQ ID NO: 11355 - DNA, 2890 bp, Heterodera glycines
atttccggcacaattgtgcaattcatctgaaaattgccataattctcacaatgcgaaatcgtcagtcacctgggtaaaaaacaaacaaaaatcaatgcgtgcggatttcccgccgcaaattgcgtttttattgtgccaaaaatgtctttgtgcaccggaagctcgtcgttgtaatttaaaacaaattggaccacgtgggaaagttagtttaaagaaccatatttaaattatttcatattaatgaattttataattattggcaattcgtgtgaagaaattttctaaataaatttgtgagaaaatatttaaatttgtctttgtgttgcgtaaccaattacgtacaagaaaatgacattgagaatttttttattataaattggcaacagcactcttttttaagtcacttggccaaataatacatatgaggcttataagaataatttaaaaattaggcgaaaattttaaattatttcagtcgatttgtaaaaaatattgaaaatgttcagattatacactaattgagaacattaattacccaatcaagtcaaataaatgtcttttttcgataatgttgttgtagcgaatggtggaaaagctttgattgcccttttaatggttttgtcacatgccactttggtgttcgtcacacttaaagcaaagttattcgtttataatattatttagaaaaattatggaaatttattcaaaagtttttaaaagaattttcaatttttatttaatttaattttttttcaggaatttgaatagcatttgctattggctgatcggtgccaactcggcatgcattgccatctattcgtttacttattttgtccaatttggcattgtgtttttctctccgtctggcattcctctctggctttgttgtctgctcgtctctgtcccacttttcttcttatgctgccaatacgtgctttttcctctgatcgctttggaccgattgatcggcgccgttttcccattaaagttgaaattaaaatttaaaagtaaattttaaaactattaatttaagacaaatgggctttctgtataagcgccgttacatgctttttgcattcttcgcttcaacttcgtttggcactgtcattgtggcattagcagtaaacgagtccattgtcaatttttcagagaagtaaattttaaaaactaaaatcaaatgtgtcccagcccattaattggatgcttgctttacatgattcgtcataaactatcgtattttctctaattatatgcccgtcattaatcttacccgtctccaattatctccccccccctttctgaggaggttaaaaaataatataccctagcatataatagagaaaataccgtaaatgaagttacggactaatagagaaaacataaagctgaaggtttaattttggctatttatgcggaaaatgaatgacgtatttttaattttttttaaataaaaatggaattaatccgactaatcatggctcatctgctggataatgaattcgctaattctcatattttttagattggttctttgcatgacttatgatccggtcccagcatattttgccaatttcagttggatgctcaacctgtgttccattgttctttatttggcactttggtttcgtgtgaaaatgatgtcctcatctgcttcaggaggcattattttaattggaaaattaataattaatttttgaatttttagcaatgcgctctaatgagacaattaatcggaaagttcttttttcactgatggccatttttttggttgaaacgttcggctgggtgttcaatttatctgttagacttttgctggttcaattcgggaccactgaaagcacaaaatggttggtattgagctatgccggttatctgacgcaattttcattggcactgaatgggccaattctttacgcgacgaggtaaatatttcaaaatagcctttttgtaattaatttaaattacttaaattatctctccattttagcactgaataccgtaccgcctttcgtaaagtgtttggatttggtcaagtcaatttgcctgcatttaccattcaagtggtcccaatgaatagaagcggaaaaactattggccaaagcggaaaaactattgcctaaaagtgatcagctttcaaatttgattttgataaagcttatgataacgaaaataccaaaattttatttcattttatttgtaataattttaaatattttttctttcacaaattcactcctaataatttgaaataaaagactgtttctttctgcaatcgtaaagatttcggcgagtgggatgtgaatattcttcagggtattggaatatctttggaagattattttatataaattttttagataacttttttttttagaaattttacccaaaacaattaagaaacgaattaaaaatggatattttgaacaaattagttgggtcggtccgggtctttcgttctggcccggaaatccgttccgtacagcggaggccgaacagaccagtgcagtgcctaatttggtgtcaattgatcgtccgttgaacgctccaatttttatgcgttcatataacttttgccatgccaaaattggtcccaataaatggaaaaggaaaataaaattaaataaaattcaaaatctggtcaaattctatcgcaaattttaattcatgcgcaatagaaaagacaaattgctctgcatatcaatggagtttgtgtcactttctttttcaactcctatttcgccattcatagtttcgttattttgtgccttctccatccacagcaaaatgtcaatttaaattatcgtagcaattaattaggcaattagttaattaattaattaattgcccatttaatgcctcgccatttatttatacaaaagcagcatttcat

SEQ ID NO: 11356 - DNA, 3195 bp, Heterodera glycines
tttgataaagcttatgataacgaaaatcccaaaattttatttcatttattgtaataattttaatattttttctttcacaaattcccttctaataatttgaaataaaagactgtttctttctgcaatcgtaaagatttcggcgagtgggatgtgaatattcttcagggtattggaatatctttggaagattattttatataaattttttagataacttttttttttagaaattttacccaaaacaattaagaaacgaattaaaaatggatattttgaacaaattagttgggtcggtccgggtctttcgttctggcccggaaatccgttccgtacagcggaggccgaacagaccagtgcagtgcctaatttggtgtcaattgttgaacgctccaatttttatgcgttcagataacttttgccatgccaaaattggtcccaataaatggaaaaggaaaataaaattaaataaaattcaaaatctggtcaaattctatcgcaaattttaattcatgcgcaatagaaaagacaaattgctctgcatatcaatggagtttgtgtcactttctttttcaactcctatttcgccattcatagtttcgttattttgtgccttctccatccacagcaaaatgtcaatttaaattatcgtagcaattaattaggcaattagttaattaattaattaattgcccatttcatccctcgccatttatttatacaaacgcagcatttcattcggcgaattttctttcgcctactctttttaggcgatcacaaatcacaaaatagttcagacttaaaacacacaactaactgtaccatttttggatcactcacgcggttaattagtggcataaattgtgacaatattttcgtatttaagcgattgtttctgtcatcattttgtcaccaatttctcaacaaaaaaaatgtccatccaaaataattttcttctttttgttgtctctgcgctgctgtttttcatcggcatggtttgtgttgttgatgcgcatcatcaccaccattggggtaacaaattgctattattaattaaaataataataatattatttttaaacgttaccctttctttggaaaaaaataataattcccaaaaacacaaaaaatcgcaaaaactttgtacaggaaaattgatgtttagaaatattcgggactcagttcgggtatctatctgtcccgtgatttagcattttatttgaaaaaagattaattaaatctgataaatttaggctatggagggactcaattcgaatatctatctatctcttgatttagcattttattttaaaaaagattaattaaatccgataaaatttaggctatggaggctatggctacggcggatggggcggaggatggggcggcggatggggcgggggatgttgcggctggggctggggcaaaaaataaattcattcatcttcattaaaagcgctgtgaaaattttcaattctctgaaaattttatcaatttaaattgttttgatgttattttaatcacatttaaatccgataaataaatcgataaaaatttattaataatttaattttttatattttttaaaatatttctgcgcattttcagctcggtcctcggtcttaataatataataattaataattccataatcaataaaatgccaattcattcttatatgtatagaattgcattttttgtaataataaattttatatattcgccataatttgcatataaaaaaaattaacaacgaaattatttcattttattaaaaaaaaatttaaaattcgtccatttcaattaatccgatgccttcccatccaaacttaactttatttttcctatgcgcattattacatttgatttctccatttttcattgaggaatattcgccagaaaaagagattttaatcaaaaagcgactgtttcacatggcacaggtcgaattttgtaaagcataaaaattgtaaaaaaaaaacagataaaattgtgttccgatatcccgcctaaaagtcagccaaaacgggggagggcctgtgacacttaaaaattcaattcggttttaattagagtttatgatgagaccgggactggtactgaaaaaacgtaccgtacaattgagtacctgagtcccgattttgaccgggaactagtcccagttttttcccgatttttctagccaaaaagtcccggtttttcgaacccgaaaagtcccggtcccttgtttttctcaaaattcccggtcccgtacaattctagttttaatgatgccaatgttcggtaaattttggtttactaagaaaactcttatgggagaaaatattttttttgttttacgaacccacacaccgtaaaattgttgaaaatttttcatttttatttaatttaaaatcacataaaattgtgttccgatgtttcgcttaaaaagtacccaaaagcgagggggccttgcactgcaaaatttcattcggtttttaatgatgccaaagtttggtaaattttggtttattaagaaaacatttatcggagaaaatatttttattttgcgaacccacacaccgtaaaattgttgaaaatttttcattttttatttaaatttatcttggctttgtgcccttttctctcagattgatccgcccgcgtcttatcggctcattttgtgggaccatttgatgccctttttcacttctcaaagggacaaagaattttgcgagaagcatttgcttgagaaagtgtcactcaccaaaacatcggagccattggattattttcggggttcggtgatcgaaaattggcaacaaaattaccaacactgttttgagcattgtcatgtgatcaaaaccaatgaattgggacaatttttgttgcgacgaatccccgcgatccccgtggacagatcaaatgggtaataagcaattggtttttacctatttcagggctctcattcgtccttgggatgccaaggacgtccttggccttggaaatcagcatttggaaatttaaaaaaaaattcaaagaaatttgataaatttttataattttcaacaatattttgattaaattatggcattatgtcaataaaaatgtaaattttttcttatggttgagaatttttgaaattttatgcataaagttactaatttttcttaaaaattaacccaaaacgccaattttggtcattttgaacaaaaatct

SEQ ID NO: 11357 - DNA, 1009 bp, Heterodera glycines
agttcatctataatttatttttaaaccttttctttccacagaatttcctcgtatacgactacattttgcgctataataattattgtcaattcttaacaaaatcaaatgataaatattttcgttattaaggcgagtggttttgggctatttcagaattttttcaaaattgcagattactgccgcgacggttacagtgtttcttctctagtaattatttttggcgttcaacaagcattatttatgaatatttttaatatgttggacatgaagattcgagttcatctataatttatttttaaaccttttctttccacagaatttcctcgtatacgactacattttgcgctataataattattgtcaattcttaacaaaatcaaatgataaatattttcgttattaaggcgagtggttttgggctatttcagaattttttcaaaattgcagattactgccgcgacggttacagtgtttcttctctagtaattatttttggcgttcaacaagcattatttatgaatatttttaatatgttggacatgaagattcgagttcatctataatttatttttaaaccttttctttccacagaatttcctcgtatacgactacattttgcgctataataattattgtcaattcttaacaaaatcaaatgataaatattttcgttattaaggcgagtggttttgggctatttcagaattttttcaaaattgcagattactgccgcgacggttacagtgtttcttctctagtaattatttttggcgttcaacaagcattatttatgaatatttttaatatgttggacatgaagattcgagttcatctataatttatttttaaaccttttctttccacagaatttcctcgtatacgactacattttgcgctataataattattgtcaattcttaacaaaatcaaatgataaatattttcgttattaaggcgagtggttttgggctatttcagaattttttcaaaattgcagattactgccgcg

SEQ ID NO: 11358 - DNA, 3560 bp, Heterodera glycines
  misc_feature (22)..(22): n is a, c, g, or t
  misc_feature (138)..(138): n is a, c, g, or t
ttcacggagtcattgtcgattntatgaaatgtcatcctgctggtcgctgctaatcagtagagtccaaaggcgtccgaccgaccacgctttcttgttgtctgctttacggcgattgggggtccaccaatttattgttgnatgacttgacgcacgtattcgtcttctttttatacccttctgtccagtacaaaactgcttaggcagtcctcctttgtccagcacggtgtctattcctcgctttccctcggtgaccagcgcctccttaataggcattccctcgttcccaacgcgctccagcactcgttgtccagtgctcaacgcctctgaccatactgtggtgcccacacgacgtaaaatgggcagaaagaagcgccaaagtcctcgaaacacgtcaccaacgcccgctccccgctgtgcgccatagcccctttgaaagggggtggagccccgaaagtagtcgaaatcgtctttttccgatccgccaccgtattgcatcatcatgtaatcgtcatactgcgcaatgcttgggtcaaacacgatatgaaccattttttattcaaatgaaatacaaaatgaacgatgagtgaaaaaatcagaaatttatcactttcttaaatatcaacacgaccatcgtcgtcccatacgcgaatggcaccagacggcctttgtccattgtgcgcagctcaatatcaatctcattgatctcccgtggcagtactcgcgcaaatattggcgagtcataaatcttctcattataatccccaggaatggcaccactgatagacacaaccctgagcaacgagctcagcgtattgccgattatcatattttcggtcaatccttttgagtagaccgcaaagcttgagatgccgccccgtaaatcaaccggatactttgacagttcatttgacataacatgcttagggttttcgaagccaagaacatagcccaactgaggcgagaaggacaagtggctgataatatcattcttgaacaccactttgaaccgttccacatcatcgcgatattggattgacaccgagttgggcacaaattggagcgagtctatttcaactatgaagctgttttctggtaaatctaactcttctagagttaacgcagccgagacaggttcgtcgacggtcggaatttgtttttcttttgaaggtaatccaataacagcccccgtcgtaggagaggaagtgaaagttttggtaggagcagttgttgttgttgttggctctggctgaggcggatgtgttgtagaagtgggaggaggaagtttaacagcaggcggcttaggcgatggtatttttggcgttggagagacctgggttgtggtttttgttgttgtttgagggatcggtgttgttgttgttgttgttgtttttgtatttttcggtgtatggacggttgttattggttgtgtgggagtcggtgttgctgttggtgttggtgtttgaggggttgttgttgttggctttcgctgtagaggaactgttggaggagatggcggtggcggtagcgttgtaggttttgttattgctgtttttggagggccaggtgtcgttgtcgtcgctatttttggttctgacgtctgaggggcagatggttttggcgggacaggtgttggcttttgctgttgtgctgatggctttgcggacgactggggggccggtgttgttgttgttgttaccggttttacggctggaggagtcggtgttgttgttgttagcggtttaaccgccggaactgggggtgtcgctataggagacgggctttttggatcaataattagtgtccctttttgtgttcgcatgtcatcatcatcatcgctcatgtgttgctcttcgccagcattcggatcgtacaacgggggagacccgagtcgctttccgtgctcatcaaacagcacgggggattggggaggagtggtgttgttcacatctcttctgtctctcttccgtggcggtggagagcccagcggctttgtccgattccgatcggcctcctcttcatgagggagtggcaacatttttgcaccgatatggttcctcagtgtagcggtaatgaagtctttcagctgctcaaccctgttatgtgatatcttgggcaccggcacccggatcactctcggtctgtcctcatccattgtgctacgctgtgtgaagtgaatgtcaatccattgtgcatccaatgtgccaatggttgaccatgagtatgggtaggttatgctatgcagcccacaaacccaagagccgttaaaatgcaacggctttgggagccggacccgaaatttattaggctgattgtccgggtaatccgtcacattgctaggcaaaaacacaaagaagctgttcgatgacatttttatttcacataaaaatatgaatggaatacaatacgggcgatgggtgcttttatcaacacattcgcgctcggggtatcctatgaacttgacaagcatctcagtggacccatccgccctctttctctttctgtacaccttttcaatacgatagcttgtctctgcatcctttcttacacgcgccaggtcctgctcatagaagctgcccttaaatttctctccgtgctcatcccgtagcttataccgaatggggcgtaccgctttcagcacctcgtcaacctccaatatttcgtcgccataatttggcaaatagcccttctcaaactgtcccttctctctgctcatgcgcacaaaatcgtctttgcggaagcgtggcggtcgtcgtttttgtggcggaccgtgtccatcatataatagcttccacaccctctgagcattgaaaaagcccacatcaatcggacgcattccgtgggcacgtgacggggagcggttaatcctgtccacaattttctctacagaattttcgcatatacgactacattatttgcattcatattattgtcaactttaaacaaaagcaattgataaatattttcgttattaaggcgagtggttttgggttatttcaaaaatttttcaaaattgcagattaatgccgtgtcggctaccgcgtttcttctctagtaattatttttggcgttcaacaagcattatttatgaatatttttaatatgttggacatgaggatttgagttcatctataaattatttttaaaccttttctttcaacagaattttcacatatacgattacattatttgcattcatattattgtcaatattaaacaaaagcaattgataaatattttcgttattaagacgagtggttttgggctatttcaaaattttttaataattgcagattaatgccgcgtcggctaccgcgtttcttctctagtaattatttttggcgttcaacaagcattatttatgaatatttttaatatgttggacatgaggatttgagttcatctataaattatttttaaaccttttctttctacagaattttcgcatatacgactacattatttgcattcatattattgtcaatattaaacaaaagcaattgataaatattttcgttattaagacgagtggttttgggctatttcaaaatttttaataattg

SEQ ID NO: 11359 - DNA, 1726 bp, Heterodera glycines
cgaagtgatgaaatatattcgtagaatggaagaatactatttattataataattctattaaaactaattatcaaccatcctccaaattggaatttcaaaatgacaatattgacaattaattttatttatttattacaaaaagtcaaaccatctctatttggtacaattagttcaaaattgtgtattgtgcagggtgattttttataatgtatatatattatacgaaaataatagtcgtatttgggtttttttttttaaagtttcggacccaaaaattggaaatcattttatcggggcggagtcattatttaaaaaatcatcaatatgattatatgaacaattatttataatttagctcaaccaaatttttaattcttgatatcattcgatagctctaagtgttctctatcagtctacaaaatttcaaaaaatttgttaagttcaaaaaattatagatagaggaacacaaaaaaaaaccttgtttttcgagcatctttggccctaccatttagggctatcgaataatatcaagaattaaaaatttggttgcttttaagcaaaattataaaataattatatcaaatcatattgatggtttttgcaaataacaacatagcacatttaacagctccatatggcgcaactgtcaagtatttaagcaaatctggacaattagattattattccaacaaatacataaacattgctatttatttaactttaaaattttgaaaaaatgaatagcttattgaattcgtattttattagaactatacttttcatgttcacgaactgagtgaggttttgggttgaacttaaaaaagtgttaataataataataataatatttacatttattgtaattattaattttagtttttttccagaataataaatcatacacatttacatttttttgggttcggcttagcttatccaattgttatttagcgacttaagaaattctctgaatttatcttttaaaatatttgtagcatcatatgtaaaaatatttaaattgtataggaaactaattttgaatttaccataaacaaataaatttaaaaaagtgttacagtatttgcccatttccgaacccggacccgaattcgaacagagtcggtttttttcaaaaaatgcataaaacgacttttatcgtgtagagagcaaagtcgatttgctattgtaaattttctgcttttttggtgcagtcaccaaaaatgatcagaaaaaagtgatcaaatgaaaaacccagcaaaaaattgatattttgattcattttttcctcttacacattaatggccatttgcaagggttcggacccgctcgacagatgatggattattttgaatttttttaaaactatttattattcgacctagcatatttttgttcagttatgttaatttcttttaagatgctatttgatagagaattgtttgctgatcattttaaaaaaaaagtttttgactagcaccattctaaaatttttatgaatttttaaaaaattgctaacttttatcgatttttcgggactttgatcgactttttctgatcatttttggggtcagggccaaaaaagccgaaaattggcaatagcaaatcgactatgctctacacgataaaagtggttttaaagcgatctgagcagtgacatttcggaatgttcccttgttaccaattttgaaaaaaactagggcactgctacagggtccacctcgtttcg

SEQ ID NO: 11360 - DNA, 2393 bp, Heterodera glycines
tataaaaacccggggattgtcaattgattggactcataaaagtgcactagagccaagattcatatgttcaattttttaaattttttggtattacttttctgaaaccaaatgaaacttgctttcgaatgagctcaataaagggtttaatttggatgacttaatagagcctaaaaataggcccgatccggtctctaacataggtaaattaaattaaaaacaaaaatattgtaaaaaaaacggtcgaactttgtagatgtttaagatgatgtcttgccggtgtatccggtgccaacttcgactgctcatcagggcccccccaaacaagcattgtcacaaaaaaatgctcaaggtttaattttatgacttaatcgccattcaataggtttggtatttcaaaaaaaaattttttttttttgcactgaattttatttgaatttaattgattccatgatttaaaatgtttcattaaggacggccaattccctaccaaacaaacaaaatgattcagcgccctcccgtgcccaatcaaatgcaatatttaaaaaaaacaagtgctgttccaactgcaacttcttgcgcttcatcatcccaaatatttgtgcgtttgttggcacttttgcagattaacccccccccccctgaaaaatttaaaaaaaaatgggccattttgtagggatttggaattggtgaaatggatgtcaaatttgtcattcccaaaaaccctcgtggacaagttttcccgacttatgaaaaaaaaatgcaaaacaaagttaccctcttgaatttttcgatggcactaaaccgcaaaaatgccattctttattgggttggttggcacctgatgtcactgactacccattagtaaacaattcaatgttgaaaaactcaacatatccattaaattcgtttttgtttctaggattctcatgttggtatttcaagtaccgctccgacttctttgcacaatgctcatattgttggtggtggtggaggtggttgtgtgagtggcggtgccaaaattggaaaaatcactgccgaccgacggttggggttcaccaagttaccaacggaccaactgcgtgcacatgttcaagaaattttgcacacgctcaacacggtccatcttctttattctcgttcattttaattggtcctcaaactaaaattttaatagatcgacaattttaggcctaaaatttcaattatttatcggtcggtactagcaaaaaaccgcatccgaatccatcaactctccaattttttataattttttaaaatgaagagttgatggattcggatgcggttttgcattcagtttctcataagcttgtgcattagatgggggtataaaaccaagaagttcaaaatgttaaccttgttgatcttttttttaattttgaggtgtaggcccaaaaccgaaaatatccaaaattttatttttatataaagcaaatctaaagcatttaaaatgtttcttttttttctcagttcacgcttagccaatgccatgacaaagtgtattggttttccactgttgtgttgcagcaactgcttgaccttgagctgtacaccgcgtgcagcaccgcagttgaacaatgcgtccacgggcaacagaagcgaatgcaacagcgtctgctgctgttcagcaccgaaaaacggaagttggagcaggaaaagaagcaattgaccaaccaaagggcacagttgacaaaggcaattaaaaaaaaaatttttgaagattttttatttttttaaatttttttttacataaaaatttaggaaaaaacagaattgaccaagtgcaaagcgcagctggaacagtcagtgaaaacgttggcacctttcgaggccaaatgtcaggtattaccaaccaactcaacgacaattctactttttttatgcaagaaatgattgtgctttaaaaattcagtgacaattctctccctgaaatggaaaaaaaaattaaataaaaattggttattatttttaagttgtttatcaattttacaactttcataactaatctggtcaaaaatagaaaagcatttcccttaattgtttcaaaagttgacttaaaaaatgtacaattgttttatttcgaaaaaattgttaaagagttatttggaaaaagaaaatttaggaccgaagaataataaaaaaaacttcggattttcacccacaaacaaaaaaataaatttgttttctggttacatgccttgttgttaatggaccatgacaatgaaactcggatttcagcagatataaattcccagttttcaatactcctgagaaaattcagaccatgaagcaggaggaggagaaactaatggcggacaaacaaaacatggccaaagaaagtggaggaaatgaagcggctcaatgaacagtgaaca

SEQ ID NO: 11361 - DNA, 1967 bp, Heterodera glycines
gcggtgatgacagacaacagaacggacacattaattaatgccgaattatttttgtttgccttttcttgctgtttatttatttctcttgtgatttttaatcaaatttttgaattaaaaccaaaaataaaattattgaattcgctgaaagtttaaattttggtgtttaattgaacatctaactgaaataaataccaactttataatagtattgtgttttttgatcgaattttctcgatgaattgtgccgtctcatttttattatccgacgaatggcccttctccaaacaatggacttggatttggtcgttggaaagcagaaaagcctaaaaggggaaaaggggaactccatgagagtgatcagtactgatcagcacagagtgtggtgaaggagggtcccagggcaaaggggagggggagaagtgaatgaatgtgaatggcccgacaattatcccacatccccaataatctccaattatccgttgatctcccccccccgttccgatcatttaatcatttaagcccccccccctcttttgatttgatcatctttccctttcctttgatcaatcccaaattcccaataattcccactcattgatccttcgcttcttccccccccccttcggcacttgccacaaatgcgctgcccttccgatcgttccatgccatcgtctcacgcactttcgctttgagttcgcctctcaaatcgcattcgctgctctgaaggcgttccgtgtcccttttctgcttccacaaattgaccacttcaccgccgtggacagtgaaaaagacggcggacgaacagcgaaagagaaagaaaataaatttaaatttacaaatataaataaaaaatatttaataatgtttaactgatcagccgccgatggaaaccattcaaaaagggaaggcgaaaaaagggcccccgggggaagcgaaaggacaaacaaaggcacgcgaacggactgctcaaagaacagaaggcgtttggaggtggtcacctgaactgttgtgccatggttaagcctttccatttccaatcgacaaattttggcaattaccgcaaaaatgccattctccgaagagcacgggcgaatgttgacaatctcttcgcactcggctccttctggaacaacgagaacaaatgttagtacacaaattccttcatgataagtgataattttgatgtcctgagggcatctaattttcttgcttcaaatcccgatcacttggaatttgaaatatttcacatattgggaattataaaccgtgtttcctaaaatacagccctcgggggctttgtttttcaatccccctcaaaagggagctttatttcaggggagtgtcctaatttagggggggggaggctgtgttttaggaaatacggtataagcaaaaaattttttgttcgaatgctaaattcaaggtatttctgaaaatacaatttaaactaaatttgtccgggggtttatttacagtaatcatcctaccggtggtgccactactgtaattcatgcactcattttctgcccctcctccccggccggtgctgataatctgtccggcagaagtgccaaccaacactttgccttttgtcccaagtgccatgcaggtggcaaatgcaccggcaattttgctgaaaatgttttcaatttcgacaaatttacaatgtaatacagtaatgtgcccattacagtcggccaccgaaacatttggtggcgaaaaggggcaccattttgatctgttgtctgtcctcatatggcgattggtcagcagaatcaaaggcagaagaagactcctaaaaggctttatgataagttcaaattactgagcattggcactgatcagtcgtgattgattactcaaacgagtcatggaataaatcccaggggttgatcagcccgaattcatagaaatgatcggtcatgattatacaaaattatcaccctaaggagactgaatttgcttgc

SEQ ID NO: 11362 - DNA, 3106 bp, Heterodera glycines
ttcagacagagtgacgagttgcgctaatacgcttaaagggatagagaattaagcatttaatcgatgcattgctcatttgtcagttggcacttaccccggtgctttcacctcattgtccaacatttccatcgcgacaattgccgatggcatttcagtgctgtcagtgccatcgattgctaccgaacggaaatgccgatggcgctgctgcttggtgccaatggttgcacggctcacggcatcgccctgactttttgcgcttagcgagcaaaaagcggtgtcaaagcagggcaaaagaacggacaaatggccttttgagaaggcagctgaaggcgagagaagagaatgaatggatcaacgggtttggaagaaatgaccgaatggttcaagcattgtgccaccatctcacggtaaatattctccgttgtttaatctcgactgatttcggcatttttgtccctttaattttttcgtctcgagagtgtgcttgcctgattccgatggtggcgttgccgttgcccccttgccgaggatcattcgctgcggacttcgctcgtcggcaagcaaatcccatgccaaaatgctaccgtctttctgtgtgttggcaaattgtccaaaataataaatttattttcaaaatttggcaaattaattaaataattcgatgggagaagccgagaacaaaagtcaggcgaagtttttgcttaccaatccagcaaaagcagcagagaaattgtcgggggcataacgaaaaacgattacttcctgctcacagcgtaaaagcctttaattaattaattaatttattttttgtaaaatgccattaaaattttctttgggtttttggcatgtgtttcggttccgactgtttggcttgatttttgacttgaacatcacgttttctgaccgttgtggctgaagttcaggactttccagtgcaaattctgcaacaaaactctttcggtgcaaccgcaaatctaaaaaaacagcaaacattttcaatctcccgcagatcggcacgacactcaccgtccgattttggcacaaataaaacagcggcaattgtgtgggggtcctaaaatgggaagcaaaacggtgccggcatttgttattgtatgtcaatgccgtactttggcattcaataattttcttccttgcttccctcaccttaacagccatagcgcacaaacggctttctgaaaatgaatttgaattggcatggcaaatggaaaatggccaaatgcctttgaaaaaagcgttgctaagcgaaaaggtggagaagcgcgagctgaacgccaagttggagttgtgctgaagcaatgggcggtgatctgtggcggaagtgtgcgcaagtgaaagaacgccgtccaccaactgaacaaacaaagcaattatttggtcactaattaatactgagactgataaaaacaccaaataaatgcaacattttctctgaattcggccaagatagagagagagtcaataccgaactcacaaaaatcaaccccttatttaactggatttgaaatttgaacccaaaagcctcgagtaataattggcaaacagcccaaaaaagcactgacatgctcaaccgccttcaggaaaatgttcagtcgtcgtgtgccgctgcttttcctcccctccgcccattgtttggcgttctgttgccctcccttttcggcacttttttcctccgtcccatctccgctccgttgtgtctctttcgtctcgctctctgttcgctccgtttgtgtgccaattgtcagtcgatgctccggcatttgagtgaaagccttgccaagaaagtgccaaattccactttttacattttattttgttttttctttacctgtgcctttccttcttttttgccgatcaattccatgtaaaagtccattaaatttgccgctctttctccatttttggcttcactttgtccactgcgcgagtgcacttgcaaattctctgccatccttcaaaactgtgatcagacatggcattgatcagttttccttgtccaatccccgactatttccatgaaagtgatcgggtcggatttcatccaaaaaaggggaacagcatgaaacagtattcccggctttttcctgcagaatcccgttccggtcctttccgattctccgaaatgcttttccgaaggaaagtgatcaatccaagcccagccaactgagtcctggatcattctttctgtaatgagaatgtagttcacctttcatcgtcgaagttgacctctcttcgcacttccgtcctcacatccttccccaattctttggtcctcaatttgccgccctcggcgatccttcgcagcaaaagtgaacttttgaccgggtaatcgtccgcttcctcttcgtcgttcctgctctcttgtccgtctttttccgcttcatttatgccaattttctgttccttctcttcctcgtcgtttccgtccgcttcgtccgcttcttcatccttttaaatgtcaaaatattctcttaagctttcaaatctttgagcttcatcccataaaaatccttctcctcccttcccaagacactactactcacaaagtcgctctcgtactgctcgaagtcgtcctcgtactgctcgtagttctgctgctcctgcatgtgctgttcctcctcattcttcgcctccttttgctcctcctttttgctccttttcctcccattttgctgctccttctcctcccttctcttcttcttttcctcttctcctcctccttcttcttttgacttttctttctttttgtccgtttttttcgttcttttgtccactttttctttttctgtcgtcgttttttctttttttgaccgtttgtcctccttttcactgatttttctcgattctttgtctttgctgctgtttttttgatttgttttcgatggtttttctgccaattttcggcgacgatcgctggatgacattttgtcagctgcgcgaaggataaaattttctcgaaatgtgccgcttttttgggttttttaattgatcatttttgttgccagggcaaccaaattttaagggaatttattgaaaataaatggggaaagggacaaatgaacattttttcactgcgcattgatcgacc

SEQ ID NO: 11363 - DNA, 1790 bp, Heterodera glycines
cgcaatcctgcattttttggaaaatgcaggattttcgtgttaatccggccggatccggtccggcaaaaaattttgaattccaatcctgcaacaggatccgcaaatttgaaatttccgggctctagtcaaaattgttgagtctaaattttttggaagtttttggtcacaacttttttactaattctttaaaaattacatagatagtagagaatatgagagctacattctaataccaagatgaataaatttgattaagtcttaagctaagttatgctttattatttagcaaataaaatttaaataataattaaatttaattattatgaacactgatatttttgtcacttcggctcagcacgtctcaacacatcccttatcctcctctgtctctcctcttctgatcaccctctctctctctccatccactcactctcttccctccccttgtcttctctctctctctctcacttttcccacctcttttcctcggctcgccgtagcgtgaacaatggtaaaccacgtagcgatatttgaacttcgcgtcatggtgcttctctgaactggccactctgaatggatgcttgtacagactcttccattcttcgaaggcgcagtcgaattcggcaaagctttcgaaatttgcgtttaggaaaatcttttcgccggaggaagaaagcgcggaaaagggacgaccaatcggactgaaaagggaggacaaacggaggagggaaaatggcacgaaaaagtgggggaaaatgggatcattttgaatttgtgccggtgattcgctgttgtcattaccgacagatgccgtcgtcgccttcgccttctcccaatttgaccacttccatcccttcgcttttggtcattttgctctcctcctctttgacatttggctgataaattgcaaaatgtttatttcatgccctgatctgatcatcccccccccctcagattgttccttaattggtccgttgactcgactaattgccctcccttttgctaattgtctccccgcttttcccacctctgccccttccgttccgttgtccgtccgttcgtcgcgcccattcgtcggaagggtgcaaagcgttttggccatttcaatttccgtttttgtaaatgcatttggcgacacatttcgctggggcggagaaggcgaaggcgtcgcccttttgttctgttggtgatcggaaagcttatcaagcaaactttgaagtgcgctcattttgaaaagggaaaaggaaaagctgaaaaaacggacgaaaagcaaaaatattggcaaaaagcggacaatgtgagggaaacacaacaaatgaatgggttaattgatcagaccaaccgaatgaggacggaacgaaaggactggtgggacagaaagtcgggatggaccaaaaagtcggtggctcaatggcattctctttttggcctttcattggtcaaattggggggggggggaatgtctgtcatttcaaataattgtgccttttgacagacgacagttcgttttgcctttttcatgagcaattagtgattaatggtgcttcgatttgcctctccatttgctcagttcgttaagtgtccctttcgtccgcccattttgggaaaatgccccggcagaaattgcctgtggcaatgtgaacaacaactgttggctttctgttgccttcgatggttgttgttggcagtgcccggcccacccgctgcagcgatggcattcccagcgaagtgacccatcaaagcccggcggaggactgaccatggcaagggatttttggcggggggggggg

SEQ ID NO: 11364 - DNA, 2260 bp, Heterodera glycines
  misc_feature (62)..(62): n is a, c, g, or t
  misc_feature (2197)..(2197): n is a, c, g, or t
  misc_feature (2201)..(2201): n is a, c, g, or t
  misc_feature (2203)..(2203): n is a, c, g, or t
  misc_feature (2217)..(2217): n is a, c, g, or t
  misc_feature (2242)..(2242): n is a, c, g, or t
gattgagagggaagacgcgaccagcgaatgaatgcagcggcggcggtgaccctcccgtcccnccggggtttcccctctctccctcccccgtgcgccctttctccgctgacccgtggagttcgtcgccacttccccaacccaaaaaactgtctgttccttcgcttcttcacaacgaaagtggcgggctgtcccccacggggaaatgacccatcgtttagttgggacggaattcgccgttgggttggccgacggaaaggtacaaagcggcggagaaaaagaaagaaaaaagataaggcggagggaggggaaaggggcgattgggaacggacggactgaccgatgggaggaaaagttacggtattaaaaacagacgaacgaatggaaagagacgggggggggggtcaaagagggaatcataagaggaagagaagggagtcatctccgtttatccactaataaattaatgcaacaaaataaatttgaaaaaccgaacagaaataaatgacaaaatgaaaaaaaacaagtgatataaaagaatgtgaggattgagttggaacataaataaaactgaacggacgaagcagcgaacggcggtgatatgataaaagggagagtaggagaacagacgcatcgcccttaagttcgttcctccgccgttattcatccagatcattcaccaatggttccatgcgattgacaacgtcggaaagagtggtccatggggacgaatggtaccaaataaacacgccgagaatctgtcaaggaaacagtttcatattcctatctaagcaaccgagaaaaaaagaatgatggaccgacctgaagccagtcaagcccttccaagcattgttttcgtttgtcagaccaatcgtcagaaagcaattccaaaatcttcgtatagccaatagccgttgtgggttttttgtcggttacggaaagctgaacaaaaacggatgtaagtaatcagattcgtattttgtgaccaaatgagaattacctgttttttgacttggtcccgtgttaatttggggctcggacatttaaacagtgacaaaagcaaagccaaattgtaatgacgcgactggcgggcagtggcaatggccttttcacatgcgccgcagaccaaatggtggaagatgaggtcgaagacggaggcggacggaccaagtcgctgctggggacggtcgttcagctgttgtttcagccaattgcccatctgaacacgctgaacaactctttctggaaaagaacatttgtaagaaacaaagaaaagcatgcgatcgctaaatgaatgaccttcggcattgtcacttttggcacaaataatgtcacaaagcgacagaatgattccctcggcttttatcccttggtcggcggaacgggacgatttcataacgaaagcatccaataaacgtaggagcaccgatggaggatcaaaggaaatgagaccgccggaaagcgaagggagcgcattcagttgcaagtcacttttgcccgttttttgtttgtatttggcaaaaaggtcctgaaaaatcaaagcaaataaaatactaattgtgagaagggcggcgatactttgatggttgggacaactttcaaacggcgcatggaaacagagcctaaatcgacactccaagcagccaaaaggttgcctgaaatgttaaaaaagtcaattagaaacaaaaaaaagtcggccattactcgaaaaggtgactcgacagcctcgtggaccaaatgcgacttcggacttgttcactgcaactggcaatcccccagcaatgcctttaaatacatttttcggcatacgttcgaccaaataacgtcgtttttttgtttccttagtgccatggtgcaacagtttcctaaaaatagttttttgttttatgagtaaacataacaaccaacaaaccttgactcgaaaagcgtatcgtccaacttcagtttcttttgcaaaacttcgccgttttgaaagagtttggtgtcttctttgtcaccaaaaaccgataagtcgagacgattttctgtgtcttctaaaatgcattttttggtaaaaaaaagaagaatctcaggcgattactaccgccggagtcatcagtgtcgtaaaaaacaattggtctctttgaagttgcgttgttattattctgattgtgcgttgtcatcatttggtggtgatggccctcttcataatcatcttccnactntnaataatgatgattnaatcccttgagtatttatgattatntaagcctaaagcacttac

SEQ ID NO: 11365 - DNA, 1156 bp, Heterodera glycines
cggtggcggaaagtggacatcatcatcattttgttttatttggtgtgtggctaactgtacatattattattattattattgttatgtttgctctctgagctgacgggaggaggggaggatgagaaaagaatgcagagaaatgtgtgtacaattaatttacaaaattatataagatagaagaaggaagcatcatcagaataattgcaacgggggtgtcgggaaaacccaaaaattgtcaagtagagacaaaaaactggggtcccaagaagacttgaacaacacctgggcaggagggggtaagtgaaaaaatcaaaaaaaaaaaatcatagaaaaattgggatcaaaatattttacactatcactaatttcctccattttctcattaaattagcaataaaataacgtgacaggtacaatatacatacataaacacatattggcacacaaatgcaaaaacaaaattaactgacttttatgaaacaatgatcattgatcacagaccaaaccaagaatcaaaaaaaaaaaaaaaaatcaaaaattgcacccaaaaatgataaatttaaaaaataataaattggttgaaattggaacccttattaaagtgctagactatattgaactgaccacttccacaatgctcaacccgatgccaccgccagtgccattgttgttgagtcggctgagcgcaatccgctccaccaccaactgtcgcgcgccttccgcatcaatttgccgttcgttccactgttgacgaccacggcacggatcggcaccagcagcagcagcggcaggagaggatgaagctgatgatgcctttttagaccaattaagcgctgaatgatgatgatgagcagtgggggtggcattattggatgtgccaccgctaccgccgcctccgccgttggcaaaaattgaagcggattggcatcgtgtgggcggttgtggggcaaacgactgcttcttcttctgcgggtggtggttgtgttgctgttgttgttgctgaaagccactggcgccatgactgttatgttggcgtcgaatctgcaagactttgtttttgttgttaaaatatccagaattattatgccatttaatcaattaagttttattttattttcaaaaatcgctaaaaaagttacataaaataatcagaaac

SEQ ID NO: 11366 - DNA, 1778 bp, Heterodera glycines
cggggggagggagggggaacaaactgctcccgataaaaacagatcaaaaattgatgatctgatcggtacacaaagggaatggacggatacatttacagacagaaaaagcggaagacataacgaaaaaaagcaggactgaatttgaaaactcaaaaatgaggatcaaatttcgcttccaaaaacgaacgaccgaatggaagaaatggagaatgattggaataattaaaaaaaaaaaagagatttcgcccctcgataaaaaactgaactgactgactgatcggaacgaaatgataataaccggacctaaaagaaaaaagaaagacagaaaaattggggggagggacgaaatgggaggaaatttgacaacacacaacaccacttctgtaaaacaaacacacaaaaatttatttcgtatgattaattaagaggggggtgggggaggacgagagtcgagagcgagcagcacttttctcaccccaaaacaatcagcaagaacaacacacctctttgttgaagagcgttgacaaaggcggccatgtccggtgggataccgcgcagtttttctggagagggggggggggggggggaattacccttaatatgtggtaataaaaaaaagcaggcaacaaaattcattgcatcccactactacaatataattggagaagagcagccagagttcgagagtgtcgagtaattgagcagggacggtcccaggggggtactcgggatcagacttttagggtcaaaaattcaaaaataaagttaaatggaggtcgggcggcgttaggcgttgccgggaaattttttttttttgaaaattttaatgtattctgttaaaaattgcttaaaattcagaaaaaatttgccaattttttgttgaattccctccaagcgccaaaatctttggattgtccttggaattgagtgtctcaagctaatgctcggcctcaacaatttgtcctccattttcgacatgccctaatgttccgtccaattcccgcgcggtgccatcaaacatcacctacccacaacgtagccgtcatgtggcaacaaaaaagggagttgaagcgatgtgccctcgaacaactgcggctgctgatgatgttcgttgcctcctctaccaccatcgtgttgatgctgttcagctgttgcatctgatactgcttgatgttgttgtcgtgacagtgccacgaggtgttcaatgagttcccgggagactgccggtggctcaccggcgtgcgcatcgcccacataatgttccaacaaaaagcgcatcttcaaaggtgttaatgttaaacgatttttttaatgaaaattggtgttcatgatttaaatctagctaataaaggaacattccgaactgtgactgctcatatcacttttgtaaccactttcatcgtgtagagagagaagagcatggtatcaaatttgctattgccaatttaaggcttacattttggcaccaactcgataaacggcttatatgtagaagaaataaattcaattaaatctattaaaaataaaataattaaaaaagatttggttacttttttgacttcgtttattgacttcccattatttgcttaatttatttaagcggagaactccgtttttattgcttcagcgtttaggtgaggacattttgagaaatttaagggattcgtcctcaatataagtcggctttttccccactttgtgcactcattattggcaattaacaataattaacaattatacaacaaccacctgcacactgttcagccggtagcaggtga

SEQ ID NO: 11367 - DNA, 1225 bp, Heterodera glycines
  misc_feature (1199)..(1199): n is a, c, g, or t
gggcttttttcctgtttatatccgatggatcgatcaggcgggattaaccccataatgaagaacatttttttttttttaaaaatgggccattttgccccccccccctaaaaagtactatttttggcccacagcgccaagaattttgaaaacaccggaagaaaaaaatttttacgtgccgatgccgataagcaagaaaataaaatcttggcgccccgctccgaatttccgccctccctccaaaaaaggcattaagaatggggtctgtaaaattcagtaaaaaatagaattcgggccaacttgtttttgccacaactcgttcctccccccccccccccaatttagatataaaaagtgccaataatttcatcgaaaaattttgttgacgttattagtgagacccccaaaattggacccccttcgggtcatgacaatatgaagagaagcagctcacgtggctccacacattcgataagcagtggtaacatcgcagaagatggcgatgcttccagctgatgatgattggcggtggtgatctgcagagatttaaaatgcaatacagtaaaagcaatcaatcatcaaaagatttttctattaggtattatccgatgcagaataacgagttaaatccgtgtctaagctaattatagctcaattaattaagattagcaaaaaattttttgacaaaaaatgaacggattcataaaaaaaacatttaggatttcaatagaacccattttattatatgacaaaatctctgctttagcttctggtaccaaaaatgttaggaaaatgcaaaaaaactcaaagtgcaaaaaaaaactcagttttgacaaaaaaaaaattccagaattttctcgaatttgatcaaatttcgaatcggcacaaaaaaagtccggcatttaaaaaattcgggtcccattccacccacacaccctgccgctgtttctgctgttgttgttgtactggttgttgtgtgaccgatcattggcaccagctgtggcaatgtgtgtcatcatcggcgtcgtcctttgctgctgttgccgttttgttggtggttgctgggtgaaatgtgccgaggcagaagaagcagcagtgatcagcgtaaccatttggtgccgctcctcctcctcctcctcgtgttgttgtacagctgttggtgctgctggtgttgatccaatatgatgggggttggcgtactngtgattgctgccgcatactgtagtat

SEQ ID NO: 11368 - DNA, 3334 bp, Heterodera glycines
  misc_feature (23)..(23): n is a, c, g, or t
aaaatttctgccttttatacttntttgaaaaaaccactgagaaatgtatgataaatttctggatatttaagcggtgaattccccaccaaaaccatccattcattcaattgcactcacttccattgtttccctccatcgatcgaatcttcatcctgctgctgctgtacaataaagataattcccgtcagttttttttgttttgtttatttaggttttcaaaatgtattaaattttgtgcccttttttcaggatggtcagagcaacaacggccaggacaagggcatcagcagcgcgcgcacggagcatcaaaatcaatcgtcgaaatgccaagaaagcgcgtgccgcaattggacgagccggacatgtgagtgacgcgcgagggggggagggggtggcaattagtacaccaattgattcaattcaactccctttttaaatttgccaattttcagacacgcaatgcgatcgcacgggagaagtgcatgatgtgcctgggcaaagtgagctccatgacgcgtgtgaccatgggctgtgtgcacgaatttcaccgcaggtggaggaggggcttaatgaatgtcaatcaatttagaatcccctgagttcgacaagtctaaaagccgagttttcctggccaaaatgccggaagttttgcttttgctgatcaccgaattcgaaatccgttccgatcaatttgaacccatgacctctcgagttagaacaagcataaaagccaagttttcctggcctaaattccgcaaacaagttttcaattgataccgacaacagtagagccaaatcctctaatctacgggtttttatgtgtctatgattttcaaaaaaaatggtgaaaaaaatttatgagtttttttggggcctagaatcccgattttattcatggtgatttcggataaatgcaacgctttttatcccctgaaggtgcctgtaccgctggctcaaatacaacaccaactgtcccgtgtgccgcttcaatttcatgcgcgcaattccccctgaagaaccggcggaggaacagcaacaacgagaagaaatgactatctgatcagatccatcattgaaatctctgtactatcataatgttgtgtattgtgtatatgtctgtgtgttgtgtgtgtactcagtataaagatgatgatactcggaagatggaagtttttaattgcatttccctgtaggtgttatgtatttagcggtaattaatggagtccggattttaagattgttgtcaatttttttttacaaaaaattgattacctttctagctatgtagctattttattttggatcaaaatatgtaaatgacaattatcaggttagctttgatcagtgtcctctcgctgtctctcactctctagctgattagagtcggatctatgtgcctctctctcattaagttcaggctcgcccatccacactgatcggagggcaaaaatgaggaacacagagctattggtatttcaatttttaaaaacatttactagcaaaatttgacgcctccttttttcatatttttggtccattttacaagactttgattagtttatttatatccacacacacatacacgcatatcaccaatacatacaatttaagtgatcagatattgattgatacatgatacacacacatcaacgaaatacatatgtacaattcaaatgatcaatcggataaatggcaatttcttatccttcttctgttgttgtgccatgatgctaatccaacgccacatccgcggttgtcgctgtcgtcggagtagtcgccgcttcagttgttctgtgttggtcgccgccgccccattttgaaataggtacttacttaaagccgacgataataatcgttgtcatttgttagtcgccaccgcccccgcccactgttcacgccgtccgattctgcccggcagggacactgaaaaaacaaaaacaaaattagaatgggcagatgaattaaagtggcaaaacttacaaatcaggtgaattgcccacaagtccacagtactgaaagagaacttggaataaatttttactatccaaacgaaatttggggtttccgtgtccgaaattggtcaaaacaaaatgtatttcatgttaatagctagggatgggatttttatgtgctaaaaatcctgaaatatgtaataaaataccgtaaatccgctatttgaaggcccctctctggtagaaggccccttccaatgaaaaaagttgatttttaggggtgtatttttcaattttcttgtatttttattgcaaatttttctcaaaaatgccaaaatatgtgccaaaaccccgaaatatgtgccatatgtttttatgtgccaaaatgccaaaatatgtgtttttatgtttttataattcgctctaaatcgaaaattgttcggagaaaatgttatttttgggcttctctcgccataactaagccgcagaaaaatatgtaaaaacataaaaatcccatccctattaatagcatctctgaaatgcttctaaactcaattttcgagttctatttcgttttagttccacacaaagtaaaaaacatactgaaaataagccaaaacaaaaattcatttttcgtgcttttatgagtcttgaatttgtcctgcttgaaagctcaatcctgaaaaatgttgtccattttttaaggacaaactagaaattttggaatgattacaaatttgcattgagactcaaaatacagcagcaaagcgattcccccgaccctcaaacccaccactccaccggttgcttctgcttctgttgttgttgcttctgctgttgttgctgacggattggtatacagaaggcagagaagctgggatactgagctaaaatgtaatggaaaattggtatttggtaaatgcaatgcattgattgtgaaaaagtcgggaagccgcaacaaattttcggcattttaaatggggtgaaaaaagtgagttcgggaaaaagcaaacatttttcatgattatcgggaagaatttgaaataggtataggttacttacttgaagagggaaggcggcgcaaaatagccgacgataataatcgttggcattataatattgtaatgaattgtgtgtgtgggaattggccgaaaattccgttccttttatactgccaaatatcccaaatttgtagaacaatttccctaatttgaaaaacaatttttcacatttctcttaataactttgtgagttcggcacggatcgagaccgagaatagaccatggaaagagcaactcgagctctacaaaaacctgtggtcataaaacccccccccccctttttcgaaaaattttttatgatttcaaaagtcatgaaaacat

SEQ ID NO: 11369 - DNA, 3029 bp, Heterodera glycines
gcagcacagcgagccgatcataacggcaccaattgtctttttttgtttttttttaatactttgtacaatcaaaagttggttgtttgttctttatatttaaacgaattttgagttttataaaaacactgatataattgataataagataatcaatctcatcccaaatcccaattatcaattgattcgttttattttgttctttttctctctctcctctctctttctcttcctctctctcttcatcctccattctctttcccatgcttctcctccaatccttcaaatggttttggaagtggtggaaaagcttctcgaattgtgtcgggaaagaatttgttcgggtcgggaatagcgcgctgaaagccgagggcgacgggagggggcgattcccgcgaatgaacggaagttggacgttgctgtacagttcgagcatgttgacgaggatttacggattcacgagaaacattttcttcagtagaggaggaggagggcgaagttcgcgaattctgatgccgcgaaacggcacgtccaatgccgggcgaatgttgcgaacggtccgcttctgatggggactgctgcgcattgcgacttcgctgctgttctgccatttcccatctctctcttcccctcgctctctcttcaccgccgtcttctctctctccacctctccctcctctttcgcgcactctctctcctcttcctccgtttccactttttcctgattgtccatcgtttggatatggcccctgaagtgggctgaataacagtgactcttctgtcgctgctcttccgtttccaccttttccccagtgccgtctcttgccctcctcttcctctcgctcactttgccctttctcatgccgtctcttgccctcctcttcctctcgctcactttgccctttctcatgccgtctcttgccctcctcttcctctcgctcactttgccctttctcatgccgtctcttgccctcctcttcctctcggtcactcggccctctttctctctgttgtttgttctctccgtcccatccattacctccgcgttcctttgcgcccctctcccattcccttgaactttctctctcccaactgcctctgcttctgtctgtctcctctgccttcccattgtcttttcccctctccgtctcagttctcctactctcttttcgctctgcctgtctcccctctgcttttccccgctcttccgcgttattctctcctccttcgtcttcctctcttctgttgccgtgttcttcctgtcttcctgtgcctcgcttgtcgtttctcattggtgcgaatcttccagcgagtggcacattctgtgcgtttcccatcactgctgctgttcccccattgtctttctcattatgggcacttctctcctcctcttcttccattctcttctttttctctccatttcctccgtcttttttaactctttccatgtccgttttgggctccttttccaccagaagttcagcccgttccttttttatcatcatttcttcgaatggtctttttggtggttgaggaaacggagcaattgtcgcggctccatcggatggcgccgcggaagaatttgtcggcacagttttcgtatccattggataatttccacgggcacttccttcctctttcctcattccgcttcttcttccactgtttttgtcctctctttcccctgtcccatttccattggcactttctcctctctctccccttcccctcatttctccttcttttcccctttctctctctcccctcatttcttttcttccgtttgcacttccttcttcctctctcattcctccttcttttcccttttctcttccttcctctctcatttcttttcctcctctccatttttgtccattttccgatgttccaaaaccatccgtttccctcgaactgttaaatgccgttgtcgttgtctgtcttccttcctcacttttgagatgctttgacggaggtggcattcgccttccaaagagaggcggcggaagagattggggggacaaaaagggagtgaaaggactgaacgaaggccgaggggggccattgccttaaaaccaaattcaacgaaataaaaaagacggccaaaactgaccagcggcagaagggcgaccgccccacccaaaaagagacgggggaagggcaccagaaaagccaagatgaaaagcaacgaaggccgaaaggaaaagcagcggaacaggggggaccatcggctggggaaggaacagtgacgcggaatgagcggtggccattcggaaagatggaagacacaaaagtggcgggagtgcccctcctcccgaacgccccccccccccctccgtaccggattgctccccgcccccccccccccccaatcccacaaaaaccgttcggattagccttagtttcctgttgcatccattacaaattattgtgttggtcttttgtacaaattatacaataattgcatcgttaaagacggcaaaatgttttttttttgtaatgaccaatcaacagaataaataaagaaaaagcagcagaacaatgaaccgattggtccggataaaaaatggtgcttaaattaataatacaaaatttggctaattcttcaaattcccatgtccttctgctgttgtccgattcctttcttcccgcccaatgcgttcagttgcaccaccataggattctgtgaaggatctttcgccttggctattttttccacctaaaaatgccgtttcgttgtgccaatttttttttgcgtgccaccgtttccgcgtccaattcgtcctcctcgttgcagataatgtaaatttgttgtcggatttcagttccgtgcaccgaaaaaacctttgaaaagtctttgagtgccaaacaacaaagcaacgacagccgatgcccttttccgccccctttcccaaatgtgccaaatcattcaaggaatggaggggggggggggggggcacaaaaagactttttccgtcccagaaaatggataattgggggtgtttttttggtcgttacaaagtttgaaataaaag

SEQ ID NO: 11370 - DNA, 927 bp, Heterodera glycines
taaattactcccaattcgtccattcgtaaaatttgttagaaaaggttcaaatggacccctccccccccccctcaggacgcactttcttctccattcgatggcccttctgttccattaccgttctgctgcttctcttggcattgaaatccatcctaaaaaacaaaaatttataattgttactagaaaatctcattaaatttaaaaaatttttaattttttcgggcggagtttgaatacgatgaagagggatggaaacgtattgcacctttcccacccacccgggcactctgtcctcctctgtgttccggcatcacttccggatgctttagtttgatgtgtctgatggctctacaaatgttgaacggaggtgtcacgggaaaactttggctgcaaattgaacattcgattagcttttctccaacaaattccattttcccgtcgcttattttctcgagtctcgccttaattttcgagtagaattttacggttatgtgtccaataaaatgtttactttgcaaagctcaaattgaacagtggacaaaaatgaacgatggaattttttgaagtgttttataacgccggcactaataaccgccgcgtaaatgtcggcactgcacaatttgcacttccaatgcgaatgggtaatggcagacacaaatttactctggcaaaataaatttaaaatgattccaaaacaattacccatttagtatcaccccttttggagctgcttgccgtactttcggcgtaatgaattgccttttcggttttgctcgtcttcctaaattaggtatacaataaaataattttagtggtaatggaacaattattgtcagtaaaaaaagaaaaaaatgatagcaccggatggtttcgatccatcgacctctgggttatgggcccagcacgcttccactgcgccacggtgct

SEQ ID NO: 11371 - DNA, 1321 bp, Heterodera glycines
ttttctgattagattttttgctccccacccccagcgaaaaaaatttatcgaaaatttctttatttataatatttttaaaaattcaaaaaaatatgaacctttttatttcctaaaaaaaaaattccggcggcgccttccgacggtaccgctggaccacccattttatcattagttgaaaattgaaccccaaaataacaaaaatttcgtcatagaaaagcgagaattcctgtttgtttttgtggttatgactatctgctgtgttttgtacttttgagctcgccacctgacaacaccccttcatccatctctgtgttcttaccacaattcattcgactgttggcgaatgcttcgcacgacgcggccaccgtttgtccgaccattggtccgtcttcgtcccgctcctccccgtccccactttcctcgtctaaactctcaatgtccaccaaagtcggatccgcaccttcgctgattctccgtaaatacctcgaaatcgctaaatatatgaataattaataaacaaaatggcaaataatcaaaaatcagtgaattttgtttttccgacccttttcaatgtaattattttgccccgtaccgttttccattgccatttcactttttaagtcttttttgaagcgaatgctccgaaacgaatgttcgttgggcaaagtgatgccaaagtcttcgccaaatttctccaggagtctggcgtttaccaacagttcttgcatgcacaagttgcacttgggcacttccacctcttcagggtgcacctcgtggaaatgcatgcccaattctttgctgaaatcgacaaataaggaaaaattgcgcaaaaatacaaacgaacttggacagaaacattccgcaccttaattgaagaaagtttgtttatttattttgcaaataaatattaaacagtctgtgccttctccgttttatcctttcacctcaaaagagtgaaatcatttaacataagtccaaagagaaagggaaaaacggcgaaggacacttcccaaaccgaccaaatgcactgcaaattctcagtggcgtcaatgtcggcgtcgataaccgcaaaatcctgggaactcaaaggttttccacccattggagttggaaattcctaaactgattagaaataatataattctgagccataaattcgcattgtaacaagccctttgaggccaagtgccagcgcatttgtgtgaggaagggtgccaagcattgaaatggcgcaccaaatggacaatttcgaattttttgttgagcgaagatgacgagtgttgcaagaggccgccacttcgcgtgccaatttgactctaga

SEQ ID NO: 11372 - DNA, 2813 bp, Heterodera glycines
atgatgaaggcacatattacgcgccaaaatgtaatcgtttcttcctaatcggagattttataaaaggcaatgaatttttttttattaaagtacaaaatttaaacttgagaaaatacacttttatatattgtaaaagcattttttctaaattttattataaatcaaataaatttaattttgcaaaatacaaaatagatttatttaggagtattatgacaatttttaatacataattttaaaattaattttataacttatgataaaaatattattataaaacactttaataaattattttaaacattaaatttcataaaatattaaattatttaaaattaactttataatatttaattaaattattttaaaaataaacttataataagataaatttattattaaactatttttactacattattttaaaaaataaattatgactttttcttttttgtaacattaactgaaaatgaaatgcaaattggttgtccatgcatttacatcatcatctcattaaggacggacgtttaaaagaaatgaaacaaaatgcgccctttccaattattattttgcttgcctcggggcgatgaatggaacatttatgatatgaatgactcaataatttgtgccacaccacaaaatgggccaagcaaaacagaaaaacaaaaaaacataataccctcaggggaatttcggcggcagaagaaaggcatttaagcggggccaaccacagaagaaaataattccataaaaaagtgggtggaaatttttgtgattgataggcgaaaattggtaataatatgtatttatataatccaaggataaaaaaggaaggccaaattttttattttttattaaaattgccttgaaaattttcatgctaataataaatgcatcttcgggcacagaaataaaggaaaactgaagctaacttcaaaaaaaaaattttttttttcttagcaaataaaattcataaaatgaaattcttttaaaccatgtatttttcaatccatgtaaactctcgtatccatggaagggtgaagtgagggcacgagtccaccccccccccccctccggccgaaatgaaattttaaatatttcaaaaaaaacgattttttcgagtttcggctagtttttttaaaataactcccctctaaaatttctctacgtagaccaaggagagcttgaaattttctaaattaatgaactaattaaaaatttattttataggaaaaataggagaaaaaatgccaatttaatttaaaattctaaatttccattagaacaaatggacttggaaagtgcaaaaaaatgtctttctgtgttgcttggcatttttcccatgggaatgattaatgaatgaatgaaaattttgtttttttgaaaaattgttgctaatgatcattagcacacacacaattaaagtactctttaattacaatattgcatttttaaattcaaaaataggaaatatttaggaaaatttaaaacaaaaatatagtgaagaaaaatgctggggtgtccagcctagcagatgatgccgaaagggacgggaagggaaaatcggggatttgatttgggggaagggaggaataagcaaaaatctgggccctggataaatgaacatccccaaaaatcagcagaaatcccatgggtgtgccactagaaccgaatacgtgtgagggaatggacaaaaaagaagcaaaataaattaattaaattcgccaaattaaaataaataaaatcgccaaattaaaaattaaattcgataattaaataataaaaaataatgtcccaaattaaataataaaaaaaaatttcgccgctccctttgctcctagctctcggattatgcccgccgactgaatctcgagagaatgaactcgttcaaaaatttgtgagttatggaacggaaaaaaatgggagaagcggggatatatgttgtgagaaaagagattaaatggatataaataatttgcgctttaccaatgggattaattaatatgtaaatttgctttagagtattgtaaaggagtatcatttcgttgaaaaatctctcaatcttttaagtatcgctaatgagtcccgtgaaatttttgacaacaagcagctttaatacacaaactaattttttcctttcttggccttacaattaatttaaataaaaacgccgacgggcaacggcatgccaaaaatgctcgtttttgccaaccaacaataagcgccaaatgggctttttccgaccggctttttataataactttgtttaaatggagctgattttaaccaaatttggcaacattgatgctaaacaaaagaggcatttttgggacttttttgggcatttttcattgaaaatttttaacaaattcccccccccccctaatttcgacggcggcataggatttggccaaaaaagtggtgtaaagctttaggagaggatctattggtgccaatgtcaaggacacttatttactcgttagaagggcatgttgttgtggcacgggatgggtgaaagatccgtccggaagaatgcggggcggagaagcaccggcatggaccaaatccaattgagctgtcccccgggggggggggggggggtgccatcgttggcgcggcggatggcattcgccccaagttggggacccacttctgtttcccccgtccccttttttacctctctaactaagtacacagaaaaacagacacacacccaaattattctgtggtggtgtgaatgttcgtctacggcgttagaaaaggatgcgcttgaaagagcaattctttggggggagcccaattggacgtaatgc

SEQ ID NO: 11373 - DNA, 3447 bp, Heterodera glycines
  misc_feature (3339)..(3339): n is a, c, g, or t
tccaatggccaccgcagaatcgttgcaatccaaatggctctccaattttgaaaaatttcattaaaaaatttttaatttcatttttactcaatggcccgtttattctttggcccaatgccaacgccgttgtgcccatcgctgggataaatgccaatgccggccaacagacaaatcgactcggcaaccttaataaatttaaaaaataaaaataatgttttttttggcaaattaataaaatacatagtaaaaattggtcagatacggtattgctacagatgtcaattttattaaaatcgattggatatagtaaaaaaaaaaagttaaaagttaaatacggaccatccatgccgaatagacacgcatacgcatgtagacaaacgccaatgctgcccatataaacaggctaaccaagctgtactcgtcaatttgtgggccacgaattgccttatagaaaacattgataaataaattatattaaattaaatcgagagtttcgtagtcttggataaagaattggtaaatttttttaatttctcggtttatgttatcccctccgttttctttcctcttcctcctccttttaccctactcttcctctttatcttccacttcctccttcttccccttctttttccccccctccccctctctctccccctcactctttttgtccactctctctcaattttcatcttcccttccgttcccattctcacttttcccttcccacttcctcttcttttttgccccattctttctcttcatgttccacttcttccttcttctcccctctcagcctcccactatttctctccattctctctctctcccctcttctaactctcttcaaaatatcatttttggtttctccgtacattcaatgggtcaagccaagtcatcaaaacaagtgctggcaatgtccagcaaagtgtttgcattttttgccatattaatggtgccaatttggtccattgaatcggtgtaggacgaacaatggcatccgcatatgttttgtaggtgtagtaagggccttgaaatagaaaaacaaattacacctaatataatccattaattattttttaatatatttttttgtaaaaatattccaaaaataaaaaaaccaaaattcttattgccatgtaatccttttgcttttgtctggtcattatattccattatcctttaaattttgatgcacttcagatcacttttacaagaggtatggggaaaaatcgcataaaaagataaaaattaatttaaaaaataattaaaaatatggaatttcaatcactcctagaagggttatttatttatttttttatgaaaatttcaaattaatttctaagtgccattttcactgacccgtgaacagcccagtgaagctgtacaggtaattgaacgcctccagtgcatttggctcgtgttcataacgttcagcagtgtcattgttgccattttttccaccatctgtgccatccttttttcgtcgaatgtccgcaatttcataagccaatccaatggcctgattattttaaatattttttaatttaaatcgactgtttgccgacccgcaatgtcatgatcagttggatggcattggtgacaaattccaggcggggcagacccacaaaatgttggcaccggagcagtgccaagaagatgaaagtgccaaaaaaggaaaagttggtgagacgactgaaagtgaacaaaaaattgataatacgtgagagaatcatgtcttgatgaaaaaaaaaatttaaaaaatttgtgaattgtatttggagtaagtaagaaaatgagctgatcatgaatacgatcagatctcggaccaggctttttagtaaccactgagctcgaatatgacacccattttgaccaactctgaacctcggacccatgagtaaaaaaaaccaattaaaattttttcgaaatgctagaaattcaaaaaatcagatattatttaaagaaagtctcaagaaaatcttttttcaaaattttatctgaaattactaattttttccaaaaaaacgctgaagtttttcacatttctccactattatccaaaatttgcatgaaaatgggaaaaaatgatcgaaataaaaaaaataagcattgatcggaagaaaattgtatatcttcctattttcaatgtcaaaacccacctcggacatctgacaaaagtgatcagagccaaatgcgcaaagacaatgatcagcgaacagagtgccatccaaccgccgacaatgtaagcgattgacagaccgatcagaccgtccaattggagacggatggcattcgaatttggcagccgtaaagcagcggcgatcagtgcagagaaaagcagcaacagggcgtaaaccagatcattctgaatgccgaaaagcatgagggatgggaaagaaaagtaagcaattttttgatatttctaattgttgcatttagaacccctccctcattccaaacacaaaaaattgtaggaatacgagacaaaattacgcaaattcgagaaattaacaaaactacacatgggaaatttcaaataatgatgtttacgaattttaatgaactttcttttttaaggagttttgggttcgggaattcgaaaatggccgatttaactccgaatttgggaaataaactaaatcgaaagcgtgtttaggccattgctttttgttttcccaaaatggagggaggaccttagcccgactgaagaaggttggtccggctgacaattgggtgggcggagacggaacaaaagttgcttcctcctccatgacactcaaaaaaaggattttaaattaaaatcaaaaaaagattttctctgtggtgtaagagtttcaagaatagaaatgaatgaatgaaatattgaaaatccaatttatgtattcatcattcatttttattgggtaagaactctacaaaattaaatttagtaaaaaaaattgaatagatatttaaatatacaacataaattcgtgtgtttatattatcaattctcattaatcagcagcgccattttttaatatcatgataaaaaatatttaaataatacaatgttgaattggtatgtaatacataaaaatagcaaatttattagatcaaaataggggagggagcccgtgctgcattaggggaaacaaaatccatgttttgtgattataggagagggaaatttgttgtcagaaaccgactgaaacccaacggatatgtagaaaatggccctgatcaatgcatgataaaagatggcaaagtcatcatgatcagactgatcaatgtggcaacaacaaacaatatccaatgaatggcattgcgttgatgcataccggtaacttttgttanatttgagcttcgaccaaaactgtgtgaatcacactgatcagccattataaaaaataacacaaatcatattccaatcacatcgggaatagagaagagaaagcagcagca

SEQ ID NO: 11374 - DNA, 4517 bp, Heterodera glycines
  misc_feature (2113)..(2113): n is a, c, g, or t
  misc_feature (2168)..(2168): n is a, c, g, or t
ttttataaatttcaaacttttttatttttatttttttataattaattaatttggtatatttttgtctaagatgttaaaatggttagaattaataataattattattgtccactaaatgacgggccgatcctccgttctttttcatagttttttatataattggataaggtattgcttcaattttattgttttatgcattaatgtgaggataaacttgacgtccagacagatcccgttggaaaaattaggagtttttgggggaatttttaatttattttaaaagaaaattgttcaaaatttaaaaaattttcaacatttccccatttattatttaatactatcaaaacaataattttcccggcgatgcctataggcacagcaggacctccccccctctcctcaagttcccaaaaagttttttttgaaaaaacgccgcaaaaaatggttttgtaaaatgcttagcggaaataattaatttttgaataaaatcattccctggaaaaatactaactatttgaggaaaattaaccttttttaattatttttttgttcaatttttatgtgtacttggatttcacaaattttccaccgttatgtacttggaaattggaatgcctgtacttggaaagtgacttggtacgatccgagccctgaattattaacataaaaaatcataaatattcttttctccgtctcatcgtcattcattcatttttctcttttctgaatatttttatgtaaattttttaaatttttcatcatattactcaattagagaggtgcgagagtctcatatttcatcttgacccgaaaatttcaacagaaaccgaaaaattttacaaaaaaaaaattgggcaaaaatttgagaggcaaaaacgtgaaagtggaccaacaaatatctcaagaaaaatttgaaattcagataaggaacaaggtatcataaatttcacttaatttctagaaattaaaaaaataaattaggtaactcaacaagaagcatccgttaaattatgataaaataaaagataccatctcaaaataaaatcgagaattctttttttaaattcaattctgtccaatttttaataaaataaagttttcaattatattaatggttgtgaaatggagagaaaaatgttaaaatatttaaaaatgttgattaatagttttcgtttttctgtttttttcccaaaagccccaaaaatatcaaaatattgatttaaaacttgaaaaaatgttttaatgcatagattgttttttattatgcaattttacgttaaaatgaaaattttctcggctaaaatgattattccataaaatttcacctaaatttagcggaagaaaaaatattaaatgagaataaatctaaatgttttgtttatttttaaaattaattttaacagataaattaataatttgttgaaaattttcggcggataccaaatgctgtgatgttaataaaatatattttaagcttaaaaataaatatttaaataagacaatgatttcttgttaggccaatcacatgttttaaattttttttattagtgatatcaacgtctaaaccaaggatggcacggaattccgagatttccgacattttggggtcggtattcctacttccaacttccgaaaattttttgatgcctcggattccatccctggtctaaaccagtggtgttgatcgtttcgtgtttcatgttcgtatttttcgtgtttttaaggcaatggctggaacggctaaccatgcaactttcatgagctttcgggtgatactaaatttaaccgggtttgaccgttttaaacagttgggggttcccttttttctgtatttttcgagtttttgaaattgttatcagcacataagaaaatgtataaaagggttattaattatgaagtaaaaaggaataatcttaaagaagaattagagtttttctttcttcaatctccttaattgtttatgatttgtcctccgtttttgcttcattcactgtaacatcgatggccaaagtcactttgcctcgcttttgtcgtaaaggcctttgcttgggtccatcagttccttaattgttcataattgggtaaataaggagaagtaattgtcactcaccancaatgaaatgacattggcatatccccagctgttcgatttattgttagaaacatgntcatcgagtttttctctgaaatccgcaacgccgctcttttgcgagacaattcgaaaggatgacaaacatttgcaaccccaatattcatctaatgactttaattatcataattattgctaataacatttaatttgcaccttcttttggagcattgcacaaaaggaaaatgcccaaccatttctcattgtcagtgcttccttttttcggatttatttctgccacaattttccatggaaatcctccgatgtacacagtttcacttatacggtcactcaaaatgatttctcgcgcaaattccgacacttttttaatgtccatcgaaattgtcctgttggatttgttgggatcagaaacgaatttctcaattttttatctgtctcggttaaatcgatggccagtgtcactttgtcctcattttggttgtaaaaaccattgttttggtccatcaatttcttaattaaccataattagagcaattaaggaatagaaatgaaatggccaacttaccgcaatggtaatgaaattgttgaaacagaaccagctctttttcttgttaatgacatggtcacaaaatgtcccagtcgaattgtccaaattgtcaaccccattcttttgcggaacaattcgaaaggttgccgaacaaacgcagcacaaattcgaatcttaaaacaataaaatgatctttttagtaatttaaattttttggtattttcctaatttttaccgtatatttccaataaatgtacaaatattagattaatttatggcatatatcgaagtttattgaattcctaaaatttcccgagaccgaatatctagaggccgagaccaaaaaaaaagaaactcgagaatttactcgagtcgagttaaaaatggaattaaatcgggaaaacacacccctaagaaatgacttgaaaaattttccgaaaatacacccctaagaaaagttttctcaaaaattgaccgccaaaatttcatttttttcttgataaaaaattttaggtttaaaaattttccttattcgaaaaacattataaaatatttaataatcattttaatgaccaaaattaagtttttggttaagttttacgtgttttgctcactaaaaaaccttaaaaattttttttaaaggccttttttcatgcctttttcgggatttttgtgccttttaatttttaaattttttggtacctattttagtgcctttttcgcgatttgtgatgccttttttgcggtctctagtaacatttgtacatttattggcatttaaaaaatgtttatgtgaaatatgtccgataaaaactaggaaagtgaaaattttttttaccttcttttgttgctatgtaccaaaggtgaaaggccaaaaacttttctctgttttttatatttattcttttttgtgccataattctccatccaaatcccattatttgcactgttttgctcaatcggcgactccccacagcttcacccgcaaattcggaaaatttttcaatgtccatcacaattgtcccatgaggtgaaattcgtacatggcacggaaattgcagtgggtacagtatgccgttggacatcccacgaaaatttggagggttatggtactcttccattccaatcacttcttccaccgttaaattgcgggatggaactgtaaaaagtgtgctaattaaattaataggtgtatttttagaattcaacccaattacaaggacccgtaaatacggtattttcgagttctaattatgattaaccatattttttatgccatcggacatctcataaaaattcatttggttatagtactggtctacttcttccgctgtcaacaagccgaaaggaactgaaattttggtacaaaaataaaaatctgttttatttttatatcccgattcttcgaacatcaatttgaattttttgttttaatttagttgcttctgcttcgcattgtgaaggtgttcggcataattgtggctttttgtctttgcaatgccatcgattcggaagaggcgaccaattgacaaacaagaacaaaaacagaaaaagtatctgtgctcattcattttatgttgcctttttccattagttcgttctttgctttttgtctaaaatttttacattttgtgaataaaatttgattttttgaatttttttgttgttgtaaatttcgggaggaatactcccttttctctccatttttctgccagttttcccatcgttttttttaaaagcaacatttagctattgatatgggtcgaaaaatgaactcaactacccattggcatttgaatttggattttgttatcttccccctccccccccctccattttcccatataattttttatcgaa

SEQ ID NO: 11375 - DNA, 2402 bp, Heterodera glycines
  misc_feature (488)..(488): n is a, c, g, or t
  misc_feature (552)..(552): n is a, c, g, or t
  misc_feature (2322)..(2322): n is a, c, g, or t
  misc_feature (2349)..(2350): n is a, c, g, or t
acaacaaaaaaaaaaaaaaaaaaaaaaaaaaaaaaaatatttttttttttttttttttttatagggggggggggggggggggggggggggggggaagaaaaaacaacaaaaagggggggggggccctctgcggtgtaaaaaaaaaaaaaaaaaaccaccccccgccccggcggggggggcgcggggggggaaaaaaaaaaaagtggtaaaaggggggggggttaaaaaattttggggaaagaggtggggggggggaaaaaaaaaaaaattttttttcccctttttaaaaaaaaccccccccaggggcaaaaaggcaaaggggttttccccccaatttcccttttttttccccgttttaaacccttaagagaaaaaaattatttccaattttttttttttttgaaacccggggggttcccaaaaaggaaaatagatcctccaagtttttttaaattgaaccaatttttatcatttttaaatgaaaatcntaccaatgagctaaatatcgcaaaaaccaactttttttgtgaaaatctgttaacaaatgcaccnaaaatttttaaaatttccctcggcggcgcctatcggcaccgccggaccccttctttcccaaaagttttttgaaaaagcgctccgaaaaaatgtgaaaatcaaatctgaatttctattaatattcgatgatttagtccaaaaatgattaattgtttgaaataattgaagatctcaatttagctagggaagcacgcacagaagtgattacttgaaaacaggatgcatatcctttgcaacttattaggagattctggcaataaattaagaaacaacaaaacagaaagaaatattcaaaagtgagcaatttttttcgaatgggccggattcttctgaacattttatttttcttaattttctttgctaaaaattatgacattattgcaaaactaattcacggcccttttttgattagagacaaatgaatatatgcgaaattttttaaaaacgtgcttagggaaagtcttcttatttaggatatttccttggcaacgatagcgtagattctagcaataaatttaataactacaaaagtgaaacaaaggctaaaatgtgagtgatttttttaaaaaaggccgcacagctttctcgcggaagcgtttttctgaacctttttctcagaaaaaaatagtcgtattataaaattaattttcacccattattttggttgttaaacaatattaatatcttacgcgttaggtaaagcgctggcaatatcgcttttttaaattggtgttacaacaagaaccttaaacgatatgtagcggcaccgaataataaaaataaattttttatcgtgttcacattgttaaaaaattgaaaatgatctcatcttgcatggattcaacaaaagtatgttggcttatagaagtgaaacggaaaaatgttcgaatatgagcagaacattaaagacttggtgaatcccggtaacaaaatctcaatttagctagggaagcacgcacagaagtgattacttgaaaacaggatgcatatccttggcaacttattaggagattctggcaataaattaagaaacaacaaaacagaaagaaatattcaaaagtgagcactttttttcgaatgggccggattcttctgaacattttatttttcttaattttctttgctaaaaattatgacattattgcaaaactaattcacggcccttttttgattagagacaaatgaatatatgcgaaattttttaaaaacgtgcttagggaaagtcttcttatttaggatatttccttggcaacgatagcgtagattctagcaataaatttaataactacaaaagtgaaacaaaggctaaaatgtgagtgatttttttaaaaaaggccgcacagctttctcgcggaagcgtttttctgaacctttttctcagaaaaaaatagtcgtattataaaattaattttcacccattattttggttgttaaacaatattaatatcttacgcgttaggtaaagcgctggcaatatcgcttttttaaattggtgttacaacaagaaccttaaacgatatgtagcggcaccgaataataaaaataaattttttatcgtgttcacattgttaaaaaattgaaatgatctcatcttgcatggattcaacaaaagtatgttggcttatagaagtgaaacggaaaaatgttcgaatatgagcagaacattaaagacttggtgaatcccggtaacaaaatctccaatttagctagggaagcacgcacagaagtgattacttgaaaacaggatgcatatccttggcaacttattangagatttctgggcataattaagaaacnnacaaacagaaagaaatattcaaaagtgagcactttttttcgaatgggccgga

SEQ ID NO: 11376 - DNA, 1605 bp, Heterodera glycines
  misc_feature (1567)..(1569): n is a, c, g, or t
aattttttttgagtttttttttttccaaaaaaattagcaaatttttgtacaatttatgttaataaaattgcatagaaattttcatttttttttccgacggcacctatcggcaccgcccgactcaaaaaaaacttattttcttgaaaatttgctcaaaatcgctaaattttccattttttggacaaaatttgttaacaatttacattaaaaattacaaaatttttcccggcggcgcatatcggcaccgccggacccttccttccccacagtttctcaaattctctttggataaagcgcgccgcaaaaaaagggtgtaactttcccaaaaaaaaatccaaaataatgtaaaattacttaaaatattttgatctttttaaaaaatatagaaataaactaaaaacagtttgaaattaccttttacatggttaaaaattttaaaatttagcctattaaatatttttaaaaaaatttattatatttttttttttgaaaaattccgacttccgagttccgacatttttggggtcggaattccgacttccgactccgaaaatttttggggcatcggaattccgacttccgaaaatttttggggcatcggaattccgacttccgaaaatttttagtgcctcggaactccatccctggtacccatagtgtggcttttcttcccatttctctattgctgcattatttcgtcactttcttttttctcagccgtatcttttcctgtctaccgctggcttttcctctagttttctctgcctctgtgttatttttcccattttcgtttttcagctgtacgttctctcatctgtctatcgttggcttttcctcccagtttctctgtcgctgcgctatttccccttttcgtcttctccatccccaatttttgcacattgctctcctctgacaaattcgattttcaatggattcattcactcaccccaaagagatagcaagcagtgcatttttcatcgtttggtcgtccatagggacgcacacatagagaggggagaaagggagccgcgataaaaatccatttttacttcgtcaccaattcattagtaccatttccatttacccattcaattttgtaatcagtggcgacgtcacaccagttcatttcgttaattgacatttttcagataattttcactgcttttgcatacattcattctcgcgcattacaaaatgtcgattatatcaagtaaaccgatgaatatctcgtttagtaattcgtaagtttttttttacgatttaacctattaaaacccattttccgccctttcagctgtagtccggattgcccgggcctcacgtggtgctcctgacatccctaacagtgagaacatagacagagatgcggttgctggtttagtaaaaagttgtacaaagatttcgcgtccatttttaaagttcactcactcccttccccaaaattctggtgcaggtgttgctgagggttggtgttgtcatctggcggagaagaacacgttggcactgtttattccatccaaacttttctcatctactttatcggtaccatttttgtggaattgattannnattcgtttttttctatttttcatccttttcagcgcg

SEQ ID NO: 11377 - DNA, 2469 bp, Heterodera glycines
acttttctcatctactttatcggtaccatttttgtccccccccttaaatttcgtttttttctatttttcatccttttcagcgcgagaattttgtcgatctgttggagtactgtgaggagcacttgaaggtccgtcgcattttggcttgcttcaacaagtcggacatcaatccatgccagggcattccacgcgccctccggtgaaattttggatgccaaatttccaatttaccgttttttcagttgcattggcttcaccctcctcccgcccgaacgttaccccgctggcattgacaagaacaccatttttgcgatggtttacaaaatctaagcgcagtcgacgtccttctccccccccccctttctctatctttgtaaaagatcgacacaattttaaacgagttgtattttctatccatgtattcctacagaaaatagcgtttttcatccatccacagtgatgtcaaataaaagtgtgaccaacaagcagcgggggttcaagccaaattcgcaattcaaaaacgattacgtcggctgtaatccagaaatataagccgcacaataagtcagatttgacggtttaagcattaaagaaaatcaaaggaacaaacaaatttaagtataagaaatttacttggttaacaataattaaacattttaaagaaataattttaaatataatttattgctggaacattctttgactctgcacgccattttggttggtttttacagctcatctctgctgtcctctttgtgcacagaaaaaggcgtttccaccggaatttgcccttaaaaattggctttaaaaatacggaagtgtagtgataaaaaaaattgttgtgcacccctcgatttttcaggtggtggggacccggcaatcctacacacaaattttggcaccgttaattgccctctaattagctatgcccaaacccatttttgtacgctttgctcatttcggttacctgccgctgcaattgtcacttccttctcgggccgatcaccgcccaatgtttttgtggcttcaattcggcgaacaacagacatcccggaaagcacctaggataataatgtcgatgtaaacaggcacaaaaatgtacccattttaagccgatttgggatattattccataaagaggggggagagtgatttacggctttaattggaattaaagcattgcacctcgggtctatcccaagaatttgggcagtccgatgaaaaaaatccgtgccattgttttgcggtttattatgcccattctccgcatatttttacgttttaaaattgtccaaaaactcactttcccaaaaacaacgtgtcgtccgtcgagccaagttgtttttttgcaggtgctacaaaaacggaatttgtttaaaagaaatttttaaattttaaacgaacatgaaaaattgtgacccgtttgtgtctttgccggaattcgccatgctcagctaaaccaggaacaaatcttaaataaacatgcctaaaatgaaaattgtcacccatccggcgccgtaatgtttcaatttgaagttttcatccgggaatttctcgccccaaatggacttcccgccagtgccgtcgcccttggtgaagtcaccgccttggatcatgaagtccttcaaattaaattaatcttttttgtattagtaaaaaacttttatattcgatggaacatttttgggtacttttttttttgccataaattctttggatttaaaaacttctcgaactttgcacattacaattaaaaaaacgtaaggagttaccgaataccaggaaagtttaattaatttggttgcttttttcaagaaaaaaatgcctcacagaagccaaagaccttaatgactcggtggaaaacgctgccggcgtaaccttcctaaaaagacaattggcaaaaaccggaaaaaactgcaaaattttacccccttcggtttcttggcaagttcaacaaagttttccacagttttcgggacagtctttccgaataagccgatttcaatgcgaccaacgctttcatcgccgattttaatgtcaaaatacacctaaaattatttaaacaaaattatgtgtgtgactcattttttttaattgaccttctccgttacttttggccccttcggtttttctgcatcatttgattgtgtgatgtttataattgatgcaaaaataagaatgaaaatagctgaccaaatgtacattgtttgcctccagaaaatggtaattgatttgtacactggtggaaaaaagtctttactcaagccgatcaaatttgaaaaaaattaaaatttcgactagaaaatttaatgattattttttgtttatgtgtttttacttacccctatttatgtgctttttatgcaccacataattattttgatccactcattcattctgagcatgagtcgtttgatcactctttactcaaaaaagggcggaaaaaagtctactcagaactatgaaaaa

SEQ ID NO: 11378 - DNA, 1157 bp, Heterodera glycines
  misc_feature (1050)..(1050): n is a, c, g, or t
  misc_feature (1086)..(1086): n is a, c, g, or t
ccgccccatccgacgccggcaaatgtaggcccccgctggtacaaacagtcgaagggacggaatggcggcggaacgatcggacgaccgccgggcagtgggaaaagcgcaggcggaggacgcggtgagaacacttgggaagaaatgagaaacgaacggacagtttagggaggggaaacggaccgaacaaacaaattggcggaaaacaaaacgccaacggagggacagagacagtgctaatacaaattgaagaagagcagacgaggcaaaagataacggacgaaatatacggaggaggaggacaaatattggcggaggaaaagagtgaagggaaggcggagaaagagagggagagagagcagggggaagatgagcagagacggcagacagagggacagcagcagcaacaacaagaggaagcagtacaggctaagggggaacagaagaaggggacggaggagacgcaagcgaatgcgccgattggagacgaatgagcagagggacagacagacggacgaacgacgcgagagagagagagaagcagagacggactgatcatttgaaactctctttcttcccccccccccccctctctctctctcactctctctttcttttgcctctctctcccttttccctactcttttcccccctaccgatcacctcaccgtccacaaaactcaattttttgtgcgactttcttcctttctttcgtatttttgcctttttgtgccattattcaactgattagtgagtgccatttgatcatattttagtgacataatttgttaaatcaattaaattggttaaaattaatggacaataaaaagtaaaattgcggtttttggggtgccattcattggcgcaattcaatcggacgaatgaatgaatggcaccgcctacagaaattagcaattaataaagttaattatttggttttattgacggtgttcctctcattcgttcttcagttagtcttcccctgttgcttttccaattccgttttccttcggcttttcctccctctcgatgggttgcaaagtgtgccattgngcgatgggccgtcgtggcgatgccaacatatcctanagaggcgcttggccaaagtgccccatttagcatgacaaagtgcggaccatcaaatggcgaagttcggcgcc

SEQ ID NO: 11379 - DNA, 3875 bp, Heterodera glycines
  misc_feature (3818)..(3818): n is a, c, g, or t
  misc_feature (3838)..(3838): n is a, c, g, or t
  misc_feature (3850)..(3850): n is a, c, g, or t
cagaagaaggggacggaggagacgcaagcgaatgcaccgctttgagacgaatgagcagagggacagacagacggacgaacgactcgagagagagagagaagcagagacggactgatcatttgaaactctctttcttccccccccccctctctctctcactctctctttcttttgcctctctctcccttttccctactcttttcccccctaccgatcacctcaccgtccacaaaactcaattttttgtgcgactttcttcctttctttcgtatttttgcctttttgtgccattattcaactgattagtgagtgccatttgatcatattttagtgacataatttgttatcaattaaattggttaaaattaatggacaataaaaagtaaaattgcggtttttggggtgccattcattggcgcaattcaatcggacgaatgaatgaatggcaccgcctacagaaattagcaattaataaagttaattatttggttttattgacggtgttcctctcattcgttcttcagttagtcttcccctgttgcttttccaattccgttttccttcggcttttcctcctcttcgatgggttgcaaagtgtgccattgggcgatgggccgtcgtggcgatgccaacatatcctaaagaggcgcttggccaaagtgcccaatttagcatgacaaagtgcggaccatccaatggcgaagttcggcgcccgtggcggcacagcccaaaaggacgcggccaatggcatcgttggagccgagcttatcgtagtccatcaccgtaatcagcagagataccttctgtatctgctcaaagggcacttcgaaggagaaggactcgttgtagtaggggttcaacgtgcactttttgatggactaaacggacagaatgccaaaacaactcacaaaaattacagtaattttttatactgtaatccccggccgtttaccgttttctttttctttaaccgtttgccgccctgcatcagaaccaacttcacgtatgggtctgaatggtggggtgataattaattgactggttacgctgggaattgggatgttgctttgtccatggtacggtgaccgtaccctctctttacagtataggtccattttcttacccgacagtccgcccacgtccattttcttcagattcttcgcttccaataccaccaccgttaatttgcccgccgtcggcacatagcgcaaagagaagcaaatgtcgcccaggttcttctcctcaaatgccatggtattaattggccgtgcctttcctttgttcttcgctaccgcttctttgtcgtccgggggcggctgaatgtctttccattcttcgatcacttggcccaagtcgattttgcccagcggaagtatcacttgtccgatctctgtcaatgccgaagcgataattaccacttaattacccctcccttccccccactaattacggtcgtgtttgctgaagcgatcgaagtcgtaaatagagaacacgagagtctgaaagagagaagggacgaattggcgctttttgcaatttgtgcgcttactttgcttggcaattcattgaacggaacctaaaagagaggcaccaattaaattaaaacggaaattgtgccgtttcggcatttgaccagccttgaagatgaatgtctcgttgaataccttaatcgatcaaaaattccaatcacacttttctttctgtctattttgcccccgttttcgcccttttggtccatttttgcccatttgtcctttttcgtcctttctcaccgggttcagtgtctttctgtgcactttcgtctccactttcttcttcttttcaggcaaaaggtataattttacgtaagggtcctgcggtataaaagaaaaatgaattcattagtataaacgctaattgataaaatgtcctaattaattgtcttttgtctaatgaattaattctctgctctgtctgatttcggcatgccattctctctctctttctctctctctttttgtctctctctttctctgtcttcgctttttgacacccaccgatgtgccggacatgtccatgccgggcaaattctccgcttggattacggtgactgccaactgtaatgctttcgtgtccaaaatggcttttcctttcccttcccttttcaatgacctgtccctgctggaagtcgtagtccaatttgtactgaattcgtcccaggttcacctcctccttctgttccgcttgtgccctttcgttctgttccatatgatctcccaacttttccatgtccgcggtgaactgaacgaacgaatggcattttgtggtgccactaaaagtgccaaaagcgatgcttttcatcatcagcccacttttgtcatttaagcggttcatttcgctttattctcaatgcttttgcgatgctttgttccccgagtttattaacctcgtcctcctcgtctatttttgcgaattttgtcaggctttttgttttctttccaagatcgttcagctaataaaatcggtaataattattcactttgaaaaagtaaaaggcatttacgacgaacagtttttagtcacagtatttaatatttgaccttttttaagacataaaaattattttttattttccattccattttatttcttcgctttttgttttctaagtaatttgtaaattaatgctgaacttctctcccttaatggcttaattagcgaatgtttgtcctgccactcacttaattgacttaattgggttgatcagtgtctttctaattgctctgatcagccgtggccaatgccgtcccttccttgcccctccctcactttgttggcaccgcccatcgctcccccggcgccgatgggtccgacggcgtccgccgctgcgcttccgctccttccgccgaaaaatgccttcagtccgccttggccccacttctgttgctgctgctgtttgttcttctccccgtgccttttcttgccgaaaatgcgtcggatcagcgcgaacaaacagccgagaagcaaagcaaggccaaccaaaccgaggaacatcacggcccaaccgggcgctgaaaggacaggcaaatggcattcccacaacggactgactgttaatacccttcattttcctaaatttttctatctctttccctctctctctctctccctccactcctcactatcttttatctcctctcgttttctcctcccgctctctccctatctctttgtccctacttccctctctctctctccctctcattttcataaatctaatcttcctctcccacccgtcgcctctctcaacagactttctctgccaatttggtcatgtctttgccgtagtaatgtcttttcgtcggtcaccaatcgtgcggatggctcgcgactggaagtgctaaagggactctgattaattggcatgcgttgtctttgatctcgccgcgcacccaattagtggtgtcggccgttgcgtccccccgggcgtctcttcccgtgccccctcctcctccggcacctcctccttttggccctgctctttccttgcgctgctccctttgcccctttggcttgtcccctccctctctcctttgcttttgccctttgttttgctttttccgctcttttctctgtccgtcttccgctccttttcctcctcctcctcttccctctccccctcttcttccctttccttttcctcttcttcctcctcttccaccacaaattcgtcttcctcctcctcttccaatttcaccatttttatttttgctagattttttaatatttttttccgtttttccaataattttttcaattaaaaaaaaatcgccctattncaagcacacacaacacatangtattatgtatntgtcagtcagtcattcagagtaatt

SEQ ID NO: 11380 - DNA, 928 bp, Heterodera glycines
gagagagagagcgagagatagagagagagagagaaaaaagagagagagagagagaaaagggatgaaatgaaaaaagaattattgacaaaaagagattaattatttgaaaagcgtcggagaagcaattaagttgtttgaattaataacagttcgtcatcggcgaatgaataaattctgtgcaattttctcgactgattttgccgaataaattcactttgctttcccttactaatgaccttctccgagcatttggccaaatcattcggatgacacggaaagcaacttataaagaggcggggaaaaagcattttgctcttatcattgagctttgaatattttgaggacaatgaaagggaaaaatgaacaatggcacgggaaaagagaaaaaagagagagggaaaccaacagaagagggggggggggaagggccacgaatgaaaaatgagatggcagaatatggcaatggcatttggatggaatcgatggaatgtcaggggaaggaatgaaaatggaaaaatgtagagagagagagagaagccgaaaagagtgggcaaaggggacggaagagaagcagacgaagttagagagtgaacgaaactgaaaagtgacaccaccttaatcaccagtcagcagagatgttcaccatggactgctcagtgccaaaggtgttgttagccgtgccactcgcattggatgagcggggcaatgccacggggattatccgctcaccgcgggcggcacaacgcccgggggattccctccccccccccaccgccctatgccggtgtgcaccatattattcgttattcccttcactgctcagctaatccctcagttcgcattgactcaaagaaggggaaaaacacggcaaaatgccaaaaaaaaagggggggggaaacagaaggaaaaaaaggacaaaagaacagaa

SEQ ID NO: 11381 - DNA, 3798 bp, Heterodera glycines
  misc_feature (3663)..(3663): n is a, c, g, or t
aacaaataagggaataggcggtagggttcgcgcggttgcttgcttaagcttaaggctgtgaattgcggagcgtttgacgattgagatgagagcactatgtgctttggatgaagaatgaattgatgaatgagtgggaaatgcttctagtgaaaagtggagattgttaatagcgacgcttttcccattagctgttgtaacatttaagagcccatccctatcgtggaaatcgaaaaatggaattgtccaggctcatcggcgattacagtaaaagataagtatgatattagtgttcaaagtgcaatgttctccacaccgcgcattgttgtactgtattagtttcaatagggaattgaacttttggcggcaatgttttttttttgacgaaaaaaatagaggagaaaaaaaaattgaccattattttgttgtttggtagcaaattgaattagttagtggaaaatcagcccaaaaacattgattaaattgataacagggaaaaaaaataaaaaaaataaaaatttgaccgttttgtggttttgatagtaaattaaacaaattaggcggtaatgacagactgaatcaaagaaatgtttgaacgaaattgaatgcagaacagaaaaattcgcttactgcacacattgcaatgccacgagcagtttgggcagtgcccaatgtccattccgtcgccaagcgcgtcatttgcgccatttccagtgtccacaacatgagcaattttcgggtcgctgctgatgttcgcgccattgtttgcaccactatcattgtccacatttcgcctcatttcctctgtttttgttggtcaacggcactgagatgggaatgggaatcaattagaaatgaatcgattttgacccttcgttattttttgtcgaatgccaaacttacgaaaaacttacagccatataattactgccgatagtgaagagagaaaaaaccaaatacgaaaacaaacacaaaaacgaaaacaaaaaaattttcgacgccctatttctcactctcgaaaacgaccaaaaaaaaaatctgtgtttttcttcatttttataattattttattcgttgtctgtctaattgcttttatttatttttttttggtttatttttgccatttaacctattttacttatatgtaattcatttctaatggtggcatgtccacagtaacgaccactgaaccctgtctcggccgccccttggctgtttgttggggggttcacatatttgttagtgttaggtggcaggtggccttggtttagcaccgcaaagttcacagttgccgaaaatgcttctacgccaccagcaaagcgcttataaatttgttaaatctcataggaaaatggcaaaataaacttttatataaaaatagcgcacaacgaacaaaaacaattaaaaaaaatagagaaaagagacaaatttaatggtcgatttcggcgatttttgaggagaaaaaatagctatataaattttaacttaacgccaaacataaacttatttaaatcattaattaagtattaataccttttcgaactcggagaagtgattcgaaactcaaaaataaatttgtaaataaatttgtccttcgctaaattgttcttagagatgaaaacaaaatgaaaaaatattaatgtcaacaaatgaaaagatttgtttctttgcactctgacgagtgttcaatggccaacgaataacgcccatcatccaattgcaaattctgcataaacagagggagggcagtatcaacacaattcaaaggagaaaatggggaaaaaatgggaaaggggggggggggcaaaatgtcgcgtctgttggagctgtggagattaaatcgttattatgagcaaaaatgctaattctccgctgagggcgcccaaattcaaatttttctgctatgtttagttaattcagtccccataaaattactgtatttctttcttactgtaagtaagttctggcggtttccttttggcactaatattcgccacatacatctgtattttagcccgtttcgcccttacattcaatttctgatcagtttgtctcattaatttgtgatctgtagggctcataatttctgatcacttgtgcttttcattttctgatcacttgtgcttttcattttctgatcacttgggcttttcattttctgatcacttgggcttttcatctctgatcactagcgcttctaatttgtttatagacgtctcttctcttttttagaggtattccttctcaaattttctctttttatttatagacgtctcttctcttttagaggtattccttctcaaattttctctttttatttatagacgtctcttctcttttagaggtattccttctcaaattttctctttttatttatagacgtctcttctcttttagaggtattccttctcaaattttctctttttatttatagacggccgtcttttctgactccctaacgggatttcaccaaatttaaaaaaaaaaattgcgcaatggttcaaacttacccatccttctgagctgttccaaactttgagtttggaaccatccggtgctaccagtgaaacgtggggggcccttcccaggatcgctgtagtccaaatattatccagaaatactttattgttccatctcaaacttgggtaattaaacctttgcttgtgaaatgtgaaatgaatggaaaatacaaatgacggatcgaaatggggaaggatggaactgatcgaaatgggaaaggatggagaaatgatgaaatgaaatgataaaatgctcgggaaatctcggaaaaggatttagcggagaagagaccagagaccaaacggggaagtgatcggaaatccactttacaaaatcaattaatatctaatttgtaataataatgtgttttaaaatttatttaattgttttttgataactcaaataatacattggtttcctgaattaattaattcgaaaattttgtccagaaactccaagctttttcgtattttgcctggacctggattttttttcatatttgacctggatctgtggacaaaaatccaggtataagaaaaatttaggttgcagaaaatagcttggacttggatccaggtccaggctgagcactaatttttattcttattatatatatgttatatcggtaaggggtttcgttgctaaaaccaatttctcgggatcgcgaataggtagggagctgaaattttgcatacgtatgcatcttgggacgggccatctgggaaaactataggtttttttgtccgacggccaactgagtcccagcggagctgaaactgactttgctgacagtctcagtgttacgaaaatttttgcttttgctcttagggcttagtgaaccccaaaaggcacaccccccaactgtgctctacaatattgtcagcaaaatttttttgatcagatcaaaggcctgacctgtaggttaggcaacgtaagaatcactttttttggacacttcagtaccaggcgaatagcacgcccgggtttgatctgagccagggggcgccagcagacttattgtagagctcgatgagctcgatttttgcaaattttaaaattttcaaaaatttcaaaaattttcgagttaggccccctaaacggtttttcagtttttgaattttaagattttttaacgaattttcctgngaaaacgaagaccacttccaaaacatcgtttttcgagctctatcgattggtaaaatttttaaaaaattttcgattttttccccgaaaatagaaaaattttttggcctcagcgggaacatttggagtcccgggccc

SEQ ID NO: 11382 - DNA, 4153 bp, Heterodera glycines
attaaaattgccttttttgtcgcagtcacatcgctctttttaacctcatgcaaatcgggcagatccttcagactctctccattttgccctatgaacagcgatttccttcttatttcggagaggttcttgcacgattggacaaggcattgttttccgtttttattcctttctttatttttctttcaaggaatcgatgactgtcgccatggaattgattctgaattccaaccccgcgtccatcgacaccatttttcctgtgcatgttgcggattccaacgggtctgaactcttcttacaaccggcctttgttgggacacttcgcgagattaatgttattgtgagttgggaatcaccgtggcaaattaataaatgctagttaatgcgatttgccatatttttatgttctttgtatattcgaatttttggttttaattttttttgtttatttttaaatttacttgtttagcaatcatatttgaagtctgctgcaatcgaagaaatcagtgattcagcattgcgtaagaatttaaagaacatactgaaacgcttgcctgatgaatttgttgaaaattcttccgatgttttaccttttgcgtcggaacattcgccgacttcgaatcgcttaaaaagtcttgcggacaaagtccaaaatgccgcttctcgaggccatcaacgccttatgcaaacgtcgtccgtctccaatttccgtagcatgggccagcgtagcaacaattttcccgcttcttcctctgtaaattttctcaacgatagtctcgcgaatgcaactggaaaaagtgggcaagaacaaccgacggcgaatgggcgtagcatttgccaggtgaatttatatttctttgttgtttaccattgccaaaaaatcttcaatctaactccgtatttttgagaatgtgctcttcttccacatccccgatcgaaacgaccccattggaatggactccgagggatcgatcatggaactttttcgacgtctccagtcaaaaaggcgaaagttggtgagcggagagaagaaaacacgctttttgacggctacggaaagcattggtcttcgattagtcaattgtattgtttttaaacacatgtttggccaattcagtgtccgacagaacagcgactgacgtggtcagtgacgaggacgaggaggagggaatggacgaagcagcggccggatcttcggtcagctcgtcaaatgacaatgttgttgatgaagtaaacattgaactgtttattttacaccaacagcattaattttttattttgagactgaagacatttccgctttgcccgacaatttttccgatgtcgttccgatcagtgccaacgtttctgggaggggttcgcccagtctcagcgggggacgcatttcggggcgcgaaacaccattttctggaaatgctcctgaacaaaacagcggtaaatggattaattgcgacaaattaaacagagttctttgtcagaagctgccaccatttgctccaccgtccctgccatcgccacgcaaccggtggaaccacgacgaactcttcccaccattccgattagtgtgcggaagcaaaatactgaaggactcgaggaaaaatttggaaaatttggtctcccaccgcaagattcatcaagatatcgtaaacattttgtttttaaaccattttgtatatttatttttgattatgtgcaggtgacgaaacggtgtcacttgtgagcgacagttggtcgacggatgtggtgactttgtctattcgaattcaaaaggttaactcactttttcgcaggtcgcctcagacaacgaagggttcaatgagcttcggtgtactgagtcggtcactttgggccttccgccgcaaaatgtccaagcgacggttggaagttccgtcccttccgccgcttctgtcgccgtcccttccgtccaacaacagcaaaacactccaaaagcgcattctcattatgtgaacaatcggtctgggagcagcagcaacactttgttttccatgcaagagaacaattcgcagcaggggacagcacaacttcaatcgaattcagcccaaattgaggcattttgaaagagtcgccaatattttatttttactcatttttatagacacaaaatgaggaggattttcgctattacgaccccaacaatttgacaagatgcagagcctttttggatgcaaagcgaaaactgagattggtgctcagttggaccacgaatttgccatacgcttctcattgtcaaacgcaaagaaataaaaacgaagaaaatgggaaagatttggccaatggaacgaacaaaaaccagacgaatggagcaaagactgagccgaacagtgaactggttgcactacaacaattcctaaagttgttgcttgccgaggcggtgaacagtcgtgatagaaaacagtcggcccaaatccgcgaggtccaacgctgtctgtccatttttgaaccgaaagggtacaattcgcttgtcgtcgtacaattctgtgttattttcgcagtgttcgcgttttgttgcgtacgttgcgcgaggagcaccgaaagaggacggctttccacctttacctgcaacagtcgcgtctcacgctgcttcaacttgacttttgcctggatcggatgagcagacgcattcgccgtgtcaaatcactcacttccgaatgtcttattgaaatgcttgttcggttcagtcttcaaaagaaggaacaacagttcttgcaacaatttctccaagattttcagcaattgaatgtccaggttaataattaaagtttaaaaagcttttttgtacatatttcagcctcggaatttgacggggtcccgactcgagttccatccgatccaaattgtttggtctctaatattggtatctgttaattaaggacgagaagattgaccttgtcgagtcgcatttgtgccatctctacgagcaactcgtcttggaatcgatgtggcggtcggcatccatcgaagacattgaatatgcacgaaaatgtttggagcgttctttgatgggacaaatttacgtttatgcgctcttcccaaacggtgaagcggattacttcagagatgagtcagttttagaatgctttccaagttcaaaatttaaaatgtttgaagggttctcaacaaatcggtccacaaactctctgagcttatttcggtcggccatcccgaattggcaattccgaaagtaagcatattgcgttgaagcaaaacttttactttcccacttcactcagaatctttatgcggaatgtccgtggccctctgctcaagctgaactgaacataatcaacgcgtacaaatcaccgcgagacaaaatggcatgaaatgatttacttttcaattcgaacaataattgtaattgccaggcatgcatcacccgttgctgtgagaccattgagaatttagttacgctttcctccggccgatcggcagcttcggcggatgacattttgccagttcttgttttcgttatcattaaggtgtgttgggctttatttttgattaattcgctggaaattattctttcaggcgaatccgccagctttgctctccaatttgcaattcatcgatggtttttacggaaaacgaatgcaaggaagtgaggcatattggtggactcaagttacaagtgccgtggaattcctcaaaacccttcttaataagctgtgcaattagtccttcaattatatcatcccagtattatgcatatcttcatcatattttaattgtctataaatattatttataaaatatgactaaacatttttgtatatcaaagtttctatcgctagaatactaataatataaacactgtatatacgttagtttttaaataaaattaattggaactgaccatcttcggcacgacaacgaggaactctttggcatcgatgccgaatggcgtcctcactatctttgcgcagcagaaaagtgattttaccatttatttcttttttggtattataaatgtgcttttgttgtctaaaatttcctcagaatttcactgattcaaatcgcaacaacaaaggccgtttttctggtcgatgtcctcgtgttggaagagagtcggacgatgactgaaagtcaatggttaaatttcttcgacgctcaggaacttgttggacgaactccgcatcat

SEQ ID NO: 11383 - DNA, 1532 bp, Heterodera glycines
aaatgtcaaaggattaaaattgtgcagaaacgggtccatttcgaaggagcccgacatgttggccagggagaaatgggaggaaagttcctgcgaaattttctaaaaaaaagaaagattttccctcaaattttttaaaaatgttctaaacatagtggtactattttcaattaactcataatgactgacacttatcaccagtgttaatgacgtgctaattataaacgtttctaaacaaagtaatttatgaacattttgctaatttgttaaaaattaccttatttatccccccctttttttgctaattatgccatttgcttttccttctcttttcaaaacccacccgagtgaagtgcactttgttgatgattgtgcagaagcgttctccgctgttttggccattttccgccgttttgcctctgctgcagacggcgaacagttcgatgaacaaacgttccctcatgtgccgtgccaaggcgcttatctcggcactgagattgcacatttcttagaaaatgaaaattcaattccaaattttttaaacaaacaaataaattaattaatgaattaactcacggtcatcccaaaaaataatgcccattaatccggcaaattcctcatccgaaatgcgcatcgcataaaagtcggagaagagatctttgttctaagcaaatggtggtggaaatgccaaattaaaaaaagaattaaaacacaattataaggggtaaatttcgtaaaaactttgaaaattccctttttttttgtttgattataaatttcggtttctaaaatcaatttttaaaattattgtcttaatattttaatttattttttgctcacttttcgtaaagtttctccaaagagtcgcgtaatttctgctttatgcattttgcactgttcgaccgcaaaaagatgatcaagttgagcaaggttaatgaaatggcagggggacatcagaaatctgacaatgcgcagaaagggggaaaatgcacacttatgaaaatcagcgaaaaaatggacagatttatggagtccaaattaatgcattaattaacaaacaaacattggcaccacggatggcattccgaggcccaaaaaattttcgaaaaacggaatcggaaaatttaaaaaaatataaaatataatgaaattttctaaatattttaataggctaaattttaatattcttaaccaattaaaaggtgattttttttatcgtatatttctatatttgtttaaaaaatattcaatgatttatttcatcaaaattttttagaacatttttggaaaagggattatttattacacctttttttgcagcgcgttttttcaaaattttctgggaaaatgggggggagggggggggggtctggggggtgccaatagggcgccgttggggaaaattttgtatttttaatgcgatttgttaacaaatgactaaattaattttcccattttttcttgaaaataattttactttttcccaccaaattgtgtcccttggtcattttgcctcttctcaccagacaattata

SEQ ID NO: 11384 - DNA, 3845 bp, Heterodera glycines
aatagttggccaccagcaaatgctaattgggaaaaatatgtataacaaaattatggggggggggaaatttggaacgaatgccaataatttaaaaaaaaattgcttggaattatttctagaaaattgttctcaattctcgaagttttgtaaatttttgttggcttttcctccttttgcccattgaatgtctgtctcactttgtcctcattttctttgccatttgtcgtgccgttcatttcatccgaaattcccgtcaaacgaaatgccgaaattcgcaacgattgaaactgaaacactttaattttaaacttaaattcccattttatttgtcttttttcattttcgcttacccttcgatagccgcgcacaatttcactgatcaatggaatttcattgtcaaaagcgcagaacgctggattaatctgaggccgaattatggcggatgaacagcaggcgacaaaaaaggcctaaaaagtgccaaaaaaagttaatttgatatgccaaatataacggtgagttaattagcactaattgccagtctggtcaaatcacataaaaggagcagaacatggggtgtgccaaaataccctcggccttattataagagtcaaaaagggaaacaaaatgggcgcaaaaccaccaacagagggtaaaaatggcaacattgggcctatcccatcaaaaagccataaaactttggagattgcactcaaatttatcatcaaattttcacaaaagttaccacggcggcgcctaacggcacagtcacacgaccccgtgcccatcgaaagtatgcgtcggatggggtctgattggcacaccctttgctcattaatgtgtggtgggccaactcgcgagaaaatgatcagacagtggggacgaggtaatcagcggaaattgattagaaagtgccgccacgtttaggttggcgcactcgctttttacgcggtactttttttgctcacgttctgctgctgctccgtgggcgacgcatacactgaagaggaaggggacgcgttgccgctgtcgccgcccccgatgggtcctccgccgacgccaccctccgcacccgcgttgtgctgcgcaggcggaggagcggtgaacgcggaagggagcgcgcattctaagagagaccattgctgcgcggcaggagaggcttctccgagcagtgcgtacagtttgcccgcctcggtccgaatctcgcgcgaaattgccgacgaaatggcgagcaaacttaaacagttgccaatgtggccaaccatgtgcagtgtgagtcatgtcaatgtttgaccattgttggatcaaacggaaaagcaaagagaaaagaaatcgccggaagagagagagtttaagccgtgcctttactatttttcgcctttctttttctctgtttgaatattttttcttttctttgccatcgtccggcacttcccacaaaaagtacaaaaattttaatttaatttgatttaactttttgctactttgggtggggggagtgaataatgccatgggtgggatcggatttggcacgtctcccgtctccctgggcccacctttgccctgcttcttcgttgctcatttccatttgttcgaattttgccatattttgctgctgctcagtttctctcataaaattattcggcctcgtcccctgtcgttggcacattgtctccgacaaactatttaaaaattaaaataataaaaaatcacaaaaaaaaaaatattattaatgttaatccgtagaaattggggggaaatttcaccataaacatttcgtgctaatcttcgggcttggcccactttccctccctttttccccagtaatcccccaggaaattcgccatctcaatgctatcgcacaatctcggacggatttgttgatgttcgccatccgttctccgtcaccccgacgccaattccatcatcacaatgccaatggcccatccccgcctcgccacttcgctgctcgccattccacccgccccaattcgttgctcgctcattggcccttgctctaatcccgcccatcttgcccacccagacgcgcatataaaaagaaatgaggcctcaactcattatcgctttttctccggccattcgcagccaaattctcgaaatccgacgaaatctcaccatttcatttcttttggcaatttttttccacaaaaaaaaccaaataaaaccaacaaaaaaaatactttgcgttcattcattttccaatttttgtcacatttcacgtttgcttcacatttggccctccccttgggctttccaatttcttgtccggcggctccttcagccgcttgtacccatttcggtccccaaagtcagcacctactgctttggatccattttccttcccttttttgggttttgactgttcggcaccaggaccgagccaaaccccccccccccctcgttctttttcccgtatttcgcttgcccgatttctgtgtgtcccacacacattgaatctgttgttggtggcgaatggcgttggcactttcgtccgccgtcctccgtccgtcgcttttcattttccaatttcgttttattttgtcggggcccaatttggtcacggtgtcgttggacagctaaaaaaaaatattaattaagcttttaaaatgtaaaatgcgaccgtccgggtccatgccaagcgccaaacatttggctaatcgacacgcgcggcacacacaacgcacttcttaaaatgtttggttagaaaatgataaagctggaaactaaaaggcctgaataaagcatcttttcataattaattacctccatgcggtgaccccccccccccgccccggtcaccgacccctttgggcgatgtcacagtttccgtcgtaacggcaccgatagacgcgtgccgcgatggtggagcgtcggaagaaggcggcacaagcgcggcatacctggcaaaaacagaaaagcatatgagtaccaatttaaatttgaaatgccaattcctgctgaatgccattgctatttgattagcacctgtacgccgaagtgcaccccgtgggcgtcgtcggcgcaaacggcgcaacaatcgtcgtcagctgcgggcgatgcattcgctgtgtcaacagttgccgaaatgggcacgagggacggcgagggcatctgctgaattggcaccgacacggcgggaggtcaaagaaagcgtaatgagtcaattatcgagagaaatggcggaaagggaggagagggagggagagaggagagaagcgggaggaaaagctaaacgaaaaaattattaaataaaatatattttgtaattttacaacagtaataaaaacgataaattgtttttaaccactaatatataaaatattaatataatatattttacatatacatattataattttacagcgtataaacaataaattgagggataaaaaagacaattcaatcaatagcatatgaaaagtgaatgatgagaggaaattttatatattcttgggcaatcattaagaattggtgtcccgacgaaaaaaatgttaaaaatttgtcgggtattttttctaggcttaaaaaatgcgctgatcacgaatctgagctcagattttgaaaatcattgatttttatctaagattttttgtcaactacttgatttttttcgatttttaaagttatttttttaaaagtttagcaatgaatttgggttaaaaaatactctgatcacgaatctaagttctgattatgcatgaaccttcattttgtctatgattttcatcaagtgtcataaaaaaataaaccgcagccaagcggactcgaaccccaggcccccgtctcatacgacccctagggattaataatatattcaaaaaatcgta

SEQ ID NO: 11385 - DNA, 2440 bp, Heterodera glycines
aatatattttgttaactgtcattttttagtttttctcttaaaagaaaatatttaataaaaaaatatgtattttctaataaataaaacgaaaaaattctttttaattgcttaaaattcaagctaaccatttaattgaggtaattgccaactagatatattatttaataaattctaattgattaataaattttcacattttttttataataccgtaaatccgctatttgaaggcccctctctggtagaaggccccttccaattaaaggcccccctaaaacacggtttttaatgggaaaacgatcaattttattaaaaaaagaaaataaatttgatcaaagtcgtacagtcgtaataagatttgattttatgttgctaaaaaatgcttggtaatcccattatgcaacaagtgagagaaaataaatgaatgaatgcggataatccgatgggtgggacgacttccaataatgggcttctctgctccatctccgcttaactcggcctaacgagcgcaatggataattctcaggcgccgcgaatttctttgtctcacttttctctctcttttggcctctttctctttttttggctctaattaattgccaattttatcaattttcatgaaaatttggtatggctccgtccgccttaaaacactcaaacagctgtctcatcgcacgcaaagacactagtgtaactaaaattagaatatgcgtgaaaacttttacgctaatcattacttttttcatgccataattttattcgaacaaatgaataagaaacgaggctttactaaattagttgaattgccacattcaattgatgggtccatcttatagagaaattggtataagcaaatttgtttaactaaatttattcaaaattacaaatttaccatgaaatttgaatgtaaaaatgcttataatgaataaatagaggtacaaaaaataggcaattcacatttgacttatagaggggttgaacaatagaaggcccgggccttcaaatagcggatttacggtaaattaaataaagcacgaaacgccaaacggctattcaattcaataatttaaaataaaagaaaataaagaaaattcattattctataaaaaacaatcaatactcatttaaatatttatataaaaaataacaaaaaaatttgtttattttattaatgataaattaaataatatatttaaaaattttaataagcaaattatggaatttcataaatttccctgaataattcatagaattaattgtctaatagaccgattattgcaagaagttgtgatgaaagaaaacacgagaaaatgattagaaaaaatgcaaaaaaaaaactaactatattatataattataatattaaaacaataatcaatgaccgccatcttgtagcatttagtggcttatttgctatcaaaaaataaaagtaattttaaataaaaaaggattttaaaaaataataaataaattcaaggcaataagtataaaagaatgattagaaaacactaagcctaaacaattaaattggtattttttattctgaaattttatttaataaaatctaatatatttaaatagatgaagacgagcccgaatgaaggaagtttgaagagcgatatgaaagaaaattttttttataaaaagtcaaagcaacaatgaaataaataaataattaaaaacattgattttaaccttatgattttccctatattaacaaaaatatttaaattgtagattttataataaaaattataaatgaatatatgtaaaaactgaaatattacaagtgacaaattaaaaggtttaaaacttgttttgattgaattgaattaaaatttattgtagaaatcgaattaaaccccaaaaaatatattagtgcgacaacgaaacatttatttccgctattgaaaaaataaaaattatataagaaaagcaaaatgacaattgtaaacagatatttagaaaaaatttcattaatagcaattcttaattgatatatatatatgtacaagtcaaaatactacagataattaacttagttattaaaaaagcaggccgaacactttggtcaaaaagaaaatatggcgtgcaaataaacaaaaattatctattcaaagtataactgaaatactaatataaaagcagaagactcgttacttgatttgaatttagatcaaacctttattagacatttaaaattcaaatcaaaatttaaaattttaagagatatttaataaagaaaaaatattttcaataatttattgataaatattgaaaattttgaaaaagtgcaaagatgtatttttatataaatattaatagttatgcttaagatttaataaaattatacattattcaaataaaaccccaacaaaacaaatgttttttattgcacaaataaatagaaaaagaaattacataaaagctccagacaatt

SEQ ID NO: 11386 - DNA, 1581 bp, Heterodera glycines
  misc_feature (233)..(233): n is a, c, g, or t
ggcaataagtaataaagaaatgattagaaaaacattaagcctaaacaattaaaatgggtatttttattttgaaattttatttaataaaatctaatatatttaaatagataagacgagcccgaatgaggaagtttgaagagcgatatgcaagaaaatttttttataaaaagtcaaagcaacaatgaaataaataaataattaaaaacattgattttaaccttatgattttcccntatattaacaaaaatatttaaattgtagattttataataaaaattataaatgaatatatgtaaaaactgaaatatttcaagtgacaaattaaaaggtttaaaacttgttttgattgaattgaattaaaatttattgtagaaatcgaattaaaccccaaaaaatatattagtgcgacaacgaaacatttatttccgctattgaaaaaataaaaattatataagaaaagcaaaatgacaattgtaaacagatatttagaaaaaatttcattaatagcaattcttaattgatatatatatgtacaagtcaaaatactacagataattaacttagttattaattaattgttccaaaaaagcaggccgaacactttggtcaaaaagaaaatatggcgtgcaaataaacaaaaattatctattcaaagtataactgaaatactaatatataagcagaagactcgttacttgatttgaatttagatcaaacctttgttagacatttaaaattcaaatcaaaatttaaaatcttaacaagagatatttaataaagaaaaaatatttttttattgataaatattgaaaattttgaaaaagtgcaaagatgtatttttatataaatattaatagttatgcttaagatttaataaaattatacattattcaaataaaacccaaacaaacaaaatgttttttatgcaacaaataaatagaaaaagaaattacataaaaggctccagacaattatcgaaacaaatataacctaccgaacgagaagaagccaaaaaagtaaatataaaatgaaagttggcaattttaattctgatggttatctataaaaataaaatataaatgaatattaacatttaaagttgaaaatttaaaatttgttcttttaaaatgttatttaaaattttagattcacaggatatactgaatgaatcggcattaaatgaattaaataaaatttgttaactttcaaggcaaacgttctaaataatttttaattatatgaacataaaattaaaattttaccgattttttttaatcgaagatgttgtatatttaataaatttattttacaaaatatttcaaaagttttaaattaataataaataataattttatatatcttaatgttttaatttaaacgaaaactaaaagcgtgttttaatgaaaaactatttgggtaaaataaaaaatcattattaatttcttcaagaaaggtaaaattcttgaccatgatgttttgttctatcctcttaaagttaaatcaagcacatacacattaatttattatttctagagaatatttgtaagtcatttgtcaaacgctccttaaataacatatttt

SEQ ID NO: 11387 - DNA, 2067 bp, Heterodera glycines
aattaaaaaaaaattacattcaattaatttataatattaattaaaaaaactaaagacctaaatatattagggtaggtcatggtcgttggtgctgagtcgatccaaaaaaaaaactcagttattgattaaataattagattaatttatattaatcaatgtcaatgaatttaattgaaaaataaattctttcagggaagaattgatatgaaaaaaagaccaaataaattttgcaaataatttaaaaattttaatcaggagattttaaagaaaatataaaatatttttaattaatgtaacattttaattcaagtatggaaattgtgtggtccttaataaaaaaaatcgttcaaattaaacaaaattacaaaatttaaaattattagattaattaaaattttaaaatggagaaagaataaataaaaataataaaaaaataaaatttttaaaataaataaataatatttctattgtaaatgaaaatttgcgctgacaagaagaaaacattaaatttaaaaatattaattatcctaaataaaatagcccatccataatcattagaaaatacatctcgtcttgcttgattatttatttattcttccttaattaaaaatttaaaaaaacaaaaaaaaaattaaattatcgaaaattcagaatattaaatttataattatgaaaaagcaaataaattttataaagtaaaataagaaacaattatagatcaatcaatatttattataagataaaacgttatgagtaatattagaatattcttcattgtttaataatttttcaaataattacaaataatttattatattaagtaaaaaataaattttattcaatgttgcattaattttaataaagatttttatcgtaatgaaattatccgatttaaaaatggaaaaacatttgctttactattaaagtgaaatgaaaaattaggctaaattgaaaatctatatgattaaaaataaaataagaaagtaaaatttgctaaagtgaagaattaggataacaaaataatgaaaataatttcttaactaatcatctgataaaaaattaaatgcatctcaaaatagaaaaaaaatacaaaatcaaaatatttcaaaaattttaattaattaattaaaattcttcaaatttataaactgatcgtactgtgggagaggaaatgaatcgaagcttagaggacatgaaattaaagaaattgattattatatattattaaaaagcgaataatttgaaatttaaatttataataaatttcatttataaaatattataaacaagcaaaaaaagaaaacagaaaaattaaaataaaatctgaatatttagcgtaattctaataaaaaaaattattttatagaatgaaaaacatgttttaatgaaaaataattggataaaatggaaattttgaaaaataattattaatattcatcaagaaattaaacaaattgtaagccttaaatgaaactactttttttgcatagtttacgttttaacttgtaccgaattatattaaataaaaagatttaaatgtttggaaaaaagttaggtttaaaccagggttgttccgggactagaataatattgggtttcggttcaattgacaaatttttattatatgttcaaaaatcaataaaaattttctgcagctcgccgccgcctgggcaaaatttaatttattttttgactatttgaatttgctcatgaatgaaaaagaaagaattaaattcgaacttttaaccgcctaaaattttttttgataatttttagatatttaattaataaagagtaaatttaattatgtttaattgcaaaatttaatttttgatggttcaattaattatttatataagattttatgaaaatttaatttaattctatttttagaagatatttttatataaactttaattgctaagaaagtgattatcctttcaattgattagcccatattttgggattttcacctcaaaaaaacatgcagatcttttattctgatcagaaattaatcataagaatttttatattggattttttaaataaaaatttttaaaattaaaa

SEQ ID NO: 11388 - DNA, 1012 bp, Heterodera glycines
tcctgctccccctccctccgcaccacacctccttgaaactgttgacccaatcgaacttcgcttgtgcgttcaaatttctgccacaacgaaatcgcttgggttggccatcttttctcggagagtgcaaccatttggacaatgcttggccagcagaaattgttgaatttggcacatcaaaaccatcaccaaacgcagcgggcgacagaccaaatgatttgattgaagtcaattggttgagatcagtaagaattgtcggcgaaatgagactacgcaaattgtccaaatcatcacgaccggtaaagcccaaacagcgaatgttttcagaaaaaattggccaaatttcacgaacaaaaacatcccaaatcggctggccattcgtagagtgtgatgatggaatcgacaaatataaattggtgcctcttttgtcgaaaatttggtgatttgaacgaagaaaagcgatgacggagtgatcgatgtacctaaaaatgggatgaatgcttttattgcgatagctctgatttttaattaccacatctgaaggtgcttaaaacggattttgctgggcaacggacggtcgggcaatggaaatggcaaagatttgtcatccatccacacagatagtttcggttctggtcctttgtccttgctaatttcgattggtctccaaatagtcaattcgcttttgccattgaaatgtttgtccaccagcgaattaaaacgtggcgaaagaagtgccaatttgaggccgagttgaggacggtcaaaggatgggaaaatgtccatccaaacgtcgttgcaaatccaactgaaatgggaaaacagtttagtcaaataaacgacgaatttgtgacttttaaaattcattaccgtcggttcatttttggcaattagcacaattttggccgagttccgaatgatgtcaaacaaatagcagaagaattaattgcgttggataaagcctggatttttaaaaaaaatatgtgaaaacataaaaatccgggccgggctctac

SEQ ID NO: 11389 - DNA, 2731 bp, Heterodera glycines
tatttgttgatcgcctcgatactatttcttttgacataaattgcacagatttcgactaaaaagtaaccaaaatttaggggttggggtcatttccctaccgccaattccctaccagccatttccctaccggccacttccctaccagccatttccctaccgccatttccctactaaggcatttgggccatttccctaccaaaaatttggcgctatattaaaagtgggtctttttgaaacaaaaggggggacccttttgttttgcaaaatttttttaagataaaaaaccatgataattttttatccggagttttaaaggtcgctaatcacgaatctgacatgtattttgactaatttctaatccctaacccgaactcgaatacaaatcggaattttgaatttttcaaattatgattttttgttcaaatttagattaggaaatcggaattgatcaaaataattgaaagattcgtgatcggggaccccaaaaacttttaatatagcgccaaaaatttttttgaaattttttggcaaaatttcaaaaatagaaagggtattttcaacattttgatgtttctcgtgaattataagacaataagttttttgtttaagttatagattagaaaatgcaggcaattctaacacaaaagaaccgtacaaagcttcaaaaaaaaaaaaaatcgaattttcgaaaattttagcgctatcaaaatgacccgacattcgcagaaatggcacgatgtgtcacgtcgctcgcgtttctcccaattggagacttgacccctggaatcattgctctggacatggctcttcccgacgaacttactcccgtccttgactggtaaattgacaatctcacaaattgtttagtatttattgttctttaattatttattaggttcatcatgaactatacgggtcgtcttaagcatgatggaagcagaacacgcccgcgatttgacccaaacatttggagtgtttacactcgaacattgcaaggcgatgaccgaacgaataacattcagaagccgcaaacagacgcctgcaatacgcatttgcctgttcacatccatcgatttggcatttcattgaccttctgcgaaaggatcaaaagttatcggatgatgacttcgcgaagtgttcaactggacaagacccaccgcaaaaggcaaagaaatatcgcgaagcagaccgccgaattctcacgatggttcaaaattatttaccactcaacaatggagaccccaatgtttttccacttgagcagcgctttaatcatctatttatcattacctttttgatcggaatttctcgaaattatgaaatgagaccgtgatttgaaacagataaaatgttatttaattttcttgcttgttttaatcgtactgtttgttaatattcatactttggtagggaaatggcccaaatgccttagtagggaaatggcggtagggaaatggcggtagggaaatggctcgatcccaaaatttagggatttttgggtaattttttttaagaaaaaaaaaatttttttttggggggggggcgtgccgataggggcgaattttaaatttatttctaacagatattcaccaaaaaaattaagactttttcgataaattttcgttttttaactatattaaattatcgtgaaaattttcctattcgcttaaaaatcgtttaaaaattttttttgactctattcttaactaatttttggttttttttttattttgattcaatttggtacaatatttatcatttcaaaaaagcacaaagcaaaaaattagtttgtttttttcgcagtttttgtgtcaatttaaaaaaataaagggtattttggagctccggcggtgccgataggcgccgccggggaaaatttttaaaatttgagtgcaatttgtgaacaaatttagtactaaaaatgacaatattttatgattttaatttgattagttcacttaaaaaggaataattttgaaaaattggaagaaaaaataactacttggaggggtactgatccaacgctaaaatgaagacatgaccaagaacacaacccactgagccacgcacactaaggtaatgaagcaaaaatataccaaaagtatatttatttctaacttacaaaaagccgatcattaggggtgtaaaaaaagtctcggtctcgagtctcgaaagtctcaaagaccgagaccgagactgaaaacccgagactcgagaccgagaccaaaaaaaaaccgagacttttctcgagtcgagaccgagactctcgaacatcactagtatatatgtataaaatatatatgtaatcctttggaattcggcccgatgccttggctagggttaggatttatatttatgaaaattgtgccccattctgaactgttcatttttccgcacttgcagcggtttaagcgcttttttgttgttgaaattgggtccgctccccgagaatttcttccccgaggagtcgtggactctaaccctaataacaaagtaaaaattaaaaaacaaatttataaaagtcaatggaaaattaacaaaaatcataaatgaatgaccaataaaagtgaccgcatttttgaatatttcatcatttagaaagcatccaaatcaagtttgaatttgggcaaaaaattcgcctcaattttgtcaccagaataaaacaaagaaacgaatggataaaaagaatcatcaccaaaagatgaagcaaccaaaagatcggaggaatctg

SEQ ID NO: 11390 - DNA, 2261 bp, Heterodera glycines
ttgaatttgtttgcagaaagcaaaattgttattatcttatctcaaatcatcacgagtaaaaaaaccattaaacggcttgtaaaattacgaataatatatattaacaataattaggccttaaaattattaatgtccaattaaaaatggtaatattcgacaaaagtatgttatgatataaataattttttgacaagtacaaaaaatatatatatttgaaatttctgctccaatatttttgcaccgtaaaaaacatatttttattatcattaacacttttagctacaatcaaaatagttttaataaagtttgaaactaaaaaaaataatttaaacccagaaagagcagagaattcttggttagaggatctgatggttattctaacaaaagttaaataaaaaaatttgatcgatcgaaaataaaattaaatctaaaattttcccaatttcaagcaattttgactttcctgatcaccatgaagaagcgatctgattaagtttgtgtaaaagacttttttgatcagtataaaagataaactagcatgaattatttcggatgcgggtaataattattagggactccatttttaggcacataaaatcgcgaaataggcacctaaaaggcagaaaaatcgtaaaatagacacaaaaatcctcaaataggcaaaaataggtaaataaaaatttttctttaacgctttttaggtagcaaaacacataaaaattttcaatagtaaaagaaattattaaatattttaagttttttcgaaaagaataaatttttaaaccaaaaatttttattaagaaaaaaatattaaattttgtggatcaatttttgggtaaaaattttcaattcttaggaatgtattttctgaaaattttttcgggccatttcttagggtgtatttttttttgtttttattgcatttttgttaaggattttttcaacaaccctaaaagaggcacattaggcacaaaaaccccgaaataggcaaatataggcattataaaagtcatcgtagacaccccaaaccatgtggaaatttttcgtacttatctgtgcatattaagtgcgcaaaaattttaggcatttgcctaaaaatggagtccctaatgattatacaaaaagaaaaataataagtcgacttaaacaagcaaaattttacaaattttatcactttgagtcaagacttttttccatcactgaatcccttttttcaatcaacaatttcgtgttttataactcaattctgaagcaattaaattaaattttcttcatatgtttaaaaccctttaattataacttaactttttttaaaattttataactataactttttatacttttgtaaaaaaattaataataatactttaaattattaatcaaataataagggatttggttactggaacaaaaaagcatgaagcatataaaaattataattattataaaataattaaaaataaataaaaatttttttattttgaaaaaacaaaataaataaatatattaattaatgttataagaaagatattaataaatgaatatcataatatatttaaatggaaacaaaatcgttcaatttaagactcagaaaatggagttttcgctactcttgaaaacagaattgttcaaaattggtcatgggaattagaaaaaaaaacatttatttatagaaaaattaacaaggaaatttaatttaatttcactgtctccaaataaaagtaatttaaaaatgtaataaataaactgaataactcaagttccaaaaacaaggactctggagattccgatactctgacaagatgaatcctaaatttagtaaaataaataataaaagtagtcctgtgaattcgaagttaaattataaacaattatttatttctaggaaaaagcaacaaggaaatttaaaatctctatggaatacaaatacttatggtgtgccataagttttgtcccccgaaaattttttcatattaaaattcataactccataatttttttataaatttgtatattctttttttatttatcctttattgtttattctttaatttcatcatattatctgtcaattttctcagccattttcccggtcatgccaaaattggaaattagcccactaatttttctcgaatttttttaggttaaaaaacaaatctctaataacaaaaaacgaagttttctataccatttaaatcagtataatccgaatatggtcttaaatatgttatcttttccacctgagcttgtactgcttcaac

SEQ ID NO: 11391 - DNA, 2705 bp, Heterodera glycines
  misc_feature (18)..(18): n is a, c, g, or t
aagcttaagctttggctntattttgtaaaatatgaattggcttttgtacaagtttatttgcgttttgtcgtggcgcacttttgctcacatagatgatatttgctattgtaaattttagggttttcggctccggcccaaaagtggtcagaaaagaaaaatcgttaaaattaaattactagcaaaaatacataatataaagtcctcttacattatgacaagttgtcaaaagatgataatttaatttaactttttaaaattataattgcacctaacattttataaattaaaatttaatatttgatttttcatttattaattattaccaggactgtcaaaaatatgcaaatgcatattttttctggattctaagtagtctaattagtaggaaaaacatcttctttttggtttttatcgggatttttatttgcatattttggccatttttcgtgcatattttttgacaaccctgattatttcttatatgctctattagaatatgctcaaaacaattcttatcaatctttctttagttctcggtaaaacattttcttgtaaaattttattgaccttattatattggcatgttgcgcggtgtgctgttgatagatgatgctgatttttgtcgtgcaaagatagaatgatttgcagtgataggtaatggaaattattgtatatgctcataaacaattttttttttaaatttaaactatccttttggatatttttactatatttattacctctctaggttttcaaatttaattaatctctcagataatcttttctcctcttggagtttttagcttatttaactcccttggatttcatggttaaaatttatattaaaaaataatcattgattttaaattaaaaaatgttaaattatttctttagcaaattacaaaattagaaaattgtgataattatttttatgtttttaattctaagtatttttaaatatttcataagttagactttttgaatttatattatgtattatcgaattattaaaaggtgaagatttcacatagaaaacaagggtaccaaacttttttcttctcaaatagactagttagcgaattttttgttataagaaaggaatactttttaattttgaatcatttttaatgttttttaattaaaataattacgtgcaatgaatttgctatcagtttattttaattttcttgaagaacaaacagtaattatcattgtttttacattttttaaaataaattttcaagaagtcttatcaataaaataagaaaaataaatacatattcgataaaatcaaaaaataaatttcattttagacttccatttctgaattttatcacccaataccaatattttgagctttatagagaccggacgggctctctgatacagaaacagggcttttttctttaactcataaaattatcaatgaaaaaattgaaaaaaatctcaaaatatctctatgcgaacattaattcgttgaaaaggaagtgaagcgtaatcctctggaatgtagcaaatgcaatcaatcgctacgaattttaaatcctatgattcagctgtttaaaataattttacgccaaattcataatccgcctatgtaatattgccgtatttaagcctttgcaaagtcaccatttttatcgttctttcttaataaattggttcgatcaaaattcactaataaattgtgaaaataaataattgaagtattgagaaatcaaataaaataaatttaatataaataaaattaaatatttaaagcagtttaaaaattttatcagttttattagccgataaaaagttgagactgaaataaaaactttagttattattttagaaaaaccaaatctaggaaaattttcaattttttcaaaattttcatcaaattaacaatttaatttattttgtattatttcttctttctaaaagtattttccatatcatctttcgccatttttcgagattattagcttaaatttagcagattaaagaaatttaccttaatttaggaaatttattccatatttatcacttttatgtctgtattttgcaattttgattcattttatttgcatattttgcgatattctgttcatattttttggcagacttaattgttatgcaaataattaaagatacaataattaattgcattttttctaataaaattcttaaaaatgtttcaattaaaaaaattattaatttgaaaaataactgcacttgtttatatcaatattattatgagtaatttactttttgtgttctacactactcattagtttaatttaaaatatgtaacgtacagtacccctttcccccccttacacacagtaacaaaagaaggcggggattaaggatcagcatttcgctgatccttttccccgtagggaaacggaatatcagttagctcccccggtcaattacgagcaaaactccggagaagaaattcttctccgtccctttcatcgagatcccaagtccctttcctcggttcccggacaaaactctcctttggttttttcatcccactcccatcccggaccgtccctcatcagaaatccctcttttggccatttttcactcaaatacttttggaattcagatcattttaattttcatcaatttcacattcaatttcaattccttcttttcacatttaatttcaaatccatttttcacatttaattcgcaaccattttccaatt

SEQ ID NO: 11392 - DNA, 944 bp, Heterodera glycines
  misc_feature (50)..(51): n is a, c, g, or t
  misc_feature (59)..(60): n is a, c, g, or t
ttcctgatttactcattaaaattccaaaagccgattccaataataaaatnnctaaaaanncaacaaaaggactaactattatttcttcccgtgtatcaaacaagagaagcatagaatgtcatttacggttcctgatttactcattaaaattccaaaagccgattggacggatagaatttctaaaaattcaacaaaaggactaactattatttcttcccgtgtatccaacaagagaagcatagaatgtcatttacggttactgatttactcattaaaattccaaaagccgatttgacggataaaatttctaaaaattcaacaaaaggactaactattatttcttcccgtgtatccaacaagagaagcatagaatgtcatttacggttcctgatttactcattaaaattccaaaagccgatttgacggataaaatttctaaaaattcaacaaaaggactaactattatttcttcccgtgtatcaaacaagagaagcatagaatgtcatttacggttcctgatttactcattaaaattccaaaagccgattggacggatagaatttctaaaaattcaacaaaaggactaactattatttcttcccgtgtatccaacaagagaagcatagaatgtcatttacggttactgatttactcattaaaattccaaaagccgatttgacggataaaatttctaaaaattcaacaaaaggactaactattatttcttcccgtgtatccaacaagagaagcatagaatgtcatttacggttcctgatttactcattaaaattcccaaagccgatttgacggataaaatttctaaaaattcaacaaaaggactaactattatttcttcccgtgtatccacaagagaagcatagaatgtctttacggttcctgatttactcattaaaatttcaaaagccgatttgacggataaaatt

SEQ ID NO: 11393 - DNA, 2285 bp, Heterodera glycines
  misc_feature (1974)..(1974): n is a, c, g, or t
  misc_feature (1982)..(1983): n is a, c, g, or t
  misc_feature (1987)..(1988): n is a, c, g, or t
  misc_feature (1993)..(1994): n is a, c, g, or t
  misc_feature (1998)..(2000): n is a, c, g, or t
  misc_feature (2015)..(2016): n is a, c, g, or t
  misc_feature (2024)..(2024): n is a, c, g, or t
  misc_feature (2031)..(2033): n is a, c, g, or t
  misc_feature (2036)..(2039): n is a, c, g, or t
  misc_feature (2045)..(2045): n is a, c, g, or t
  misc_feature (2061)..(2061): n is a, c, g, or t
  misc_feature (2063)..(2063): n is a, c, g, or t
  misc_feature (2072)..(2072): n is a, c, g, or t
  misc_feature (2076)..(2078): n is a, c, g, or t
  misc_feature (2081)..(2083): n is a, c, g, or t
  misc_feature (2086)..(2086): n is a, c, g, or t
  misc_feature (2090)..(2094): n is a, c, g, or t
  misc_feature (2096)..(2097): n is a, c, g, or t
  misc_feature (2104)..(2106): n is a, c, g, or t
  misc_feature (2114)..(2114): n is a, c, g, or t
  misc_feature (2116)..(2116): n is a, c, g, or t
  misc_feature (2118)..(2118): n is a, c, g, or t
  misc_feature (2120)..(2120): n is a, c, g, or t
  misc_feature (2122)..(2124): n is a, c, g, or t
  misc_feature (2127)..(2127): n is a, c, g, or t
  misc_feature (2129)..(2131): n is a, c, g, or t
  misc_feature (2136)..(2136): n is a, c, g, or t
  misc_feature (2139)..(2139): n is a, c, g, or t
  misc_feature (2142)..(2142): n is a, c, g, or t
  misc_feature (2150)..(2150): n is a, c, g, or t
  misc_feature (2154)..(2154): n is a, c, g, or t
  misc_feature (2157)..(2157): n is a, c, g, or t
  misc_feature (2160)..(2160): n is a, c, g, or t
  misc_feature (2166)..(2167): n is a, c, g, or t
  misc_feature (2169)..(2170): n is a, c, g, or t
  misc_feature (2190)..(2190): n is a, c, g, or t
  misc_feature (2194)..(2194): n is a, c, g, or t
  misc_feature (2200)..(2200): n is a, c, g, or t
  misc_feature (2202)..(2202): n is a, c, g, or t
  misc_feature (2205)..(2207): n is a, c, g, or t
  misc_feature (2232)..(2232): n is a, c, g, or t
  misc_feature (2236)..(2237): n is a, c, g, or t
  misc_feature (2243)..(2244): n is a, c, g, or t
  misc_feature (2247)..(2247): n is a, c, g, or t
tttcttaccgtgtatccaacaagagaagcatagaatgtcatttacggttactgatttactcattaaaattccaaaagccgatttgacggataaaatttctaaaaattcaagaaaaggattaactattatttcttcccgtgtatccaacaagagaagcatagaatgtcatttacggttcctgatttactcattaaaattccaaaagccgattggacggatagaatttctaaaaattcaacaaaaggactaactattatttcttcccgtgtatccaacaagagaagcagagaatgtcatttacggttcctgatttactcattaaattccaaaagtcgatttgacggatagaatttctaaaaattcaacaaaaggactaactattatttcttcccgtgtatccaacaagagaagcatagaatgtcatttacggttactgatttactcattaaaattccaaaagccgatttgacgtatagaatttctaaaaattcaacaaaaggactaactattatttcttcccgtgtatccaacaagagaaccagagaatgtcatttacggttcctgatttactcattaaaattccaaaagccgattggacggatagaatttctaaaaattcaacaaaaggactaactattatttcttaccgtgtatccaacaagagaaccagagaatttcatttacggttcctgatttactcattaaaattccaaaagccgattggacggatagaatttctaaaaattcaacaaaaggactaactattatttcttcccgttgtacgctttcgatggcgcacaaatgggaggggtaggaatttggcgagatgtgggggtgctgatgagttcagtggttggtagagggccggcgctgcttggtggtgctgggctttgagttgtggacgagtagtgcgagtcggcggggtgggggcggctggcgcaatggtgaccaggagagggactggttgtggcgaaattttggggtggacgcttggcggtcaatcggggatggtggaattgctgggggtcaagtgaggcgggaaagcgattcaaaatacactttattggagtcctcaaacttgggtaattaaaccgaagggggaaatgggggaacggcacaaaatgggggacggcacagaaatggggacggcacaatggagggaaaatgggggacggcacaaaaaagggggacggcacaaatgggggacggcacagaaatggggacggcacaatgggggaaaaatgggggacggcacaaaatgggggatggcacagaaatggggacggcacaatgggggaaaatgggggacggcacaaatcggaggacggcacaatttggggaccgaacgggagtggtcggctcggcacacgtcaacggcacgggacgggcggcattgagcgggcggtgtgtcaaggcggtagtcgggcacggcagggcacggatcggcatggcacagaagtcggcgcacgaacggacagggccaagagtcgacggcacgaacgggcgggcggcgcagttgtcggcggctgttgtcggcacagggggaaggggagggaggaaaaggaggacgaggcaatgcctctcagaaaccgttggtgtactgattggtggggggtttgtggcctccttttataccggcagtttctgcttgaacaattgtttgccaacttggcatgtccaaatttctgtccctaacatttgccaattttactaaccttttctcattttccagtttgtgccactttagccttttccagttttcttaacattttacaatttctttaatatcattcacattttgtctcattttaacatttgtttaaaatctgttatttcttttaacgttcaaattattcataattaaattttaacatttgataatttttcggatagaaaaaattgtgactaatatgactaatgttttttctttctctcattccttcatttcgttcacatttaattaattaatatttngctgtttnntttnnccttnntttnnntgttttttgtttttnntgtttttnttttttnnnttnnnnttcctntttcgcgttgtcgcgncnttcccgcgncggnnnggnnngtntttnnnnngnngtgggtnnntccttggncntntncnnnttntnnntgttntcntcnccctcccngtcnccngtnttgttnncnncttcccccgctttgttttgnttcntgtctntntgnnntttcttaaaggggtcttttgttcgngggnngttccnngtncggctgtacgataagttattcgatgggttaattatttt

SEQ ID NO: 11394 - DNA, 1728 bp, Heterodera glycines
ggcaattgcaaaaatgatgaaaattgatagaacgacaatttcaaaatggaagaaacattttggagaagaaattttggaagatttaaatgaatgattaaataatgacctttgtttttcaatggaacaaattttatttctaaaatgtattaaacgaaaattattcaaaaataaaagtggcaaaataaataattccataattattttagtggcgaaaagatttaaaaataatttgcaataataataataatagtagggctaaaatacacgaggtgtcccaataagttttaaaagtttcggttcgaaaactgatttatggtgagtatttctacgatatttgaataattaataaatttgtcatttctttgtgtctttaaaaaataataatttttaaatacgtaattaaattacattaaatttatttattcattcaatttttaattttttaattgaaaaaaaggtgctatgtcgatacttaaaaaccatcataatgggcgatacttaaaaagccatcataatgaaatttgggcgatacttaaaaaaccatcataataagaaatcaatatacctttaattaattacaggttcctttaattaattatatgattacaatttgaaattacatgagttaattacaattttaaaccaattatcccttttatttttattattttcctcaaattcacacatttttatttggagtaaaatttcccttttatattttattgctttcctcaaattcacacattttttatttggaaactttaattttaaaaaatatttcagccttgcttaagggcaaacaacaagcattttaagccaacatggagaaatgttcaaaggtccatccatctttgaggcgtaccacaagaacactgcgatctgtgcagctcttgtgtgtcgttttcggttgccgtttttatgtgatccaaaaattttaaattgataaattttttgattatttataccaaaaaaacaaatgctttcaaggtttgagattgaccaacgctggcctatctgttgaaacatatactcattgttaaaagtgacgagatgtcttgaattctcatcttcagtgccaactaaaaataatttttcattgaaacgttcagaagtacattgtcttgctataattttagcggtttccgtattctttttaatataatatttatttccatgcgctattcttattcttgaaagatatctttctaaagtaggtttgctgagtccaaaagttgtttggttgttaattttatatagtaattcattgacggttcgaatttcgttctttccataattattcagtagattttttattgtattatcattgataaatgcatcaaaattggacgttcgagcccctcctttgatttactcatagtgatttcgttttataaaaaaaggagtaaaaaaatacagattagtattggagtatatttaaacaaattcattcttaatttaaattattatttaaattcaagaaaatatatataatgtttttatttaataggctttgttgaaaattttatgaaataacaggaatgttaattattaaatgaattgccaaatattaaatttacattgcttttatattaacatttattaattcatattttaatgacgtatttccggctattaaatcatgtaattagttgcgcaaattccattatgatggttttttaagtatcgcccaaatttaattatgatggttttttaagtatcgcccattat

SEQ ID NO: 11395 - DNA, 1165 bp, Heterodera glycines
  misc_feature (48)..(48): n is a, c, g, or t
aaaagcaattttaaaaaagatcacaaagcaaacaaatgaatatttatntacggaataaggaaaagaaaacccaaagttttgaataagagcgaaattttaaaagaattcaatttttttcggatcaacaattgcttcaaaatgtccgctattatcataataaataaatagtgattttgtatcaggtttttgctttgatagaatctaaagattaatattatttttttaacaaaatgaaaattactgaaatagcgtccggagaataactagcccaggtatatttgattgaattcttatcattttgaacatttggactgcacacaacaatatttatattaaaaagtttagcagctgtcaaaaaatctatgtttgatgcccatctgaaagtttcagatgcatccattgccggagtattatgattttgtatatattcttctagttcattgatttggggataaaacatttgccaccaatttcggttttcaatcccttgcttatgctgataaagttcttcttccaaaaattccattaaatctcgtcatatttcttttgctgtattgtaattatcgtctccagtgagtagcaacgaaagcgctcgataaaaacagttaccatcaccaataattgacacgcgctttcctaaatattattacatgtccttagccagagttgcttcggtcttaactatacctgggctataagtatccggatctatttgaagattttttgcgaattcgaaatttggaacaacttaatttcaattcagtttaacaatatttttaaaaaagtaccataattataatcccatttatcgcaaaattcctccatttcatttaaattcattggattaaataaaattgcagaattgggtccttaaatatgcattaattttttgattattattattaaaaccgtcttgatcgtgaactactgtaatttcatcatttgcctcggcatcattatcttgtatggattttgaatcagttatattttatttgaattttcactttgtattttctctttctcttaagtaaaaattatttgaaacataatatatcttaccgaattatttactgttttagcgtttcccttagatctagctagcagagaagctgagcgacagacgcgatcagtgttgtgaactgtgccatatctgcgattcatctca

SEQ ID NO: 11396 - DNA, 979 bp, Heterodera glycines
ctgataaagaatctgaaataagcttttggttaggactccgttaaggcctcagaatccctgcataaatggggcttcttaggcatcattctgaggggggggggggtggtcaggttcggatcccgatgaagtaaatgatttttatgtattatttttcatgtttagtaaacatttaaatgaatttcgattttgaattaataatttttattaaaattttaaagaaattattttttcaaaaagttccatttatcccccggggggataaatggagacgggggattattgttcaacctcctcagaagggggggggggataaatggaaatgggggattaatggagacggggcgataattagagataatacggtaagttgcagtcgtggtggaaattggagcattcattaatgaactgcgtgattttccactgattgggcatgttacccacccgcccccttcaatagagcccctcccccgaatttttgccaaataccccgcaaagaacgtggcgagttttttcttacattttattgacaaaatacaattaatttcaattttttggcgctagagtcaattccttatcagaaaattttcccattgatagcgtgcttacaaattattaatctgctcttcgtcttgaaattgggtcccgacgagcataaaaaaatcccacagacccaaactttggatccatgtgtcaaaccaatttgtctcccatatttgccaagttttggatgcgtctctcaaacagaattggctccccaatattttcaggcaccgttgcaacccaagacgagtcatggcaacccggcatttatgtggacactggtgaagtagggactcactattatgaccttcgaagactgcggacggtgatgatgattttcgacccgttccccctcccgcaaatgctttttctcacattttatttttcggatttttaaatgttttggctgtccttgttttcccaattgtaaggacatttg

SEQ ID NO: 11397 - DNA, 2004 bp, Heterodera glycines
atggacagactgtcgcggtccgatcgtgcggtgactgcatcaattttttcacgttccgccggtgcgatgaagcattggacttcttgcagcgggaaatcggacctgaaaaagtggaaaattcgtttaaaaaaaacttggaaaaaatttggagaggatgatacagaaaaaatcggggggagactgacactctctgtttcaataataataaaacatataattaagttttctaagaaaaaaggcgcaacttttgttgttgttgttgcggttgttgacaaattgtcggaaaatggtcctgtacattttaaatatttgaaatttgataaagtgccaataaaatctttgaatgtaattcggttggttggctattatttagatggtttgtccattttagtgttggggaaatattgcccgaatcctatgtgtgtcggcactttgtcatacctcgaggacaacttgtataaaacctttgctgggtcggcattttgtccaacagtgggcagacaaattgcctaaaacctatgctttgtcgacacttggatctatcttggcttcaaaatctaaactatgtcggcacttttcatatcatgaggacaaattgaacaaaactatgctatgtcgacattttgtcccagaatgggcagacaaattgctcaaaacccgttgctgtgcggcactttgtcacatcaagaggacaaactgcacaaaacctttgctgtgtcggcattttgtcccatattgggtagacaaatttcccctaaacctagtcggcattttatccccaccatctaacttaaagagacatttcgtcaacaaatttcacctgtgatgtccagcgagtggcatttgtgccagctctgtcggctgcctgttggtctgcaacggtcatgccatttttgatcattacacaaaaatcaaatttgctgatgaattgtccactgacggattgtctattactgacggattgtccccgaatgtaaaatatcgaattttttggtcgaagtcaaaaaattaattgaaaaaatatttttaataacaaatttattcactctattcatgaattgatatatctttttttggggggtccatgatccaaatttgatcacttccatcactgatcaaatccacaaaatctgttgcttttttcacgacagataaaattcggttgtgtcaacaattttactgcgacataacggacaatgccttttacaagcagcatcgggatacttcattatattttcggcacaaatgtcgcagacgacagcatgcttacatggagtaaacagaacacttcgctgtaaaaaattgtaatacatttataaatagagcaaattgcgggacgggataccgcgcgggatttcgccggatcttaatcctcaatccagcatttttttggaaaatgcgggattttgcaggattagtcaagtgggtgctcgtcccgcaaaaattttgagtcccaatcctacagcgtgatccaaagatttgaaatttctgggctctatttataagtagaagtcaggcgtggtaatcgtggtaatcccagatgttcagagaaatttcctgaattttttttttgtcagaaaaaaattttttttaattttttggaggtcggaattaattcggaaatttttgaaagatacaaaatataaaataaaatcctttactggttaagcactgccggggaatttttaatgtggttttgttaacacagattttgtccaaaaaaggatcaaatttagcgtttttagcaaatttttgaagaaaattttaagaatgtgccgataggcgtcgccggtaaaaaattgaaaatttcgatataatttattaatacagaattcatacaaaaattgctaatttgttaaaaaaaaattcaacgaaccgaaaatttgcgactttttatcaaaaatttcgcaaaccggaattccgacccaagaacgccggaaatcggaattccgaggcttaaaaatttttcggaagtctgaaatcagaattccgtgccatccctgg

SEQ ID NO: 11398 - DNA, 3698 bp, Heterodera glycines
  misc_feature (51)..(51): n is a, c, g, or t
  misc_feature (53)..(53): n is a, c, g, or t
  misc_feature (56)..(58): n is a, c, g, or t
  misc_feature (60)..(60): n is a, c, g, or t
  misc_feature (67)..(68): n is a, c, g, or t
  misc_feature (70)..(70): n is a, c, g, or t
  misc_feature (72)..(72): n is a, c, g, or t
  misc_feature (88)..(89): n is a, c, g, or t
  misc_feature (103)..(103): n is a, c, g, or t
  misc_feature (109)..(109): n is a, c, g, or t
  misc_feature (113)..(113): n is a, c, g, or t
  misc_feature (116)..(116): n is a, c, g, or t
  misc_feature (126)..(126): n is a, c, g, or t
  misc_feature (128)..(128): n is a, c, g, or t
  misc_feature (130)..(132): n is a, c, g, or t
  misc_feature (138)..(139): n is a, c, g, or t
  misc_feature (149)..(149): n is a, c, g, or t
  misc_feature (160)..(163): n is a, c, g, or t
  misc_feature (168)..(169): n is a, c, g, or t
  misc_feature (174)..(174): n is a, c, g, or t
  misc_feature (177)..(177): n is a, c, g, or t
  misc_feature (181)..(182): n is a, c, g, or t
  misc_feature (192)..(192): n is a, c, g, or t
  misc_feature (195)..(197): n is a, c, g, or t
  misc_feature (201)..(203): n is a, c, g, or t
  misc_feature (208)..(208): n is a, c, g, or t
  misc_feature (211)..(212): n is a, c, g, or t
  misc_feature (220)..(222): n is a, c, g, or t
  misc_feature (227)..(227): n is a, c, g, or t
  misc_feature (233)..(233): n is a, c, g, or t
  misc_feature (241)..(241): n is a, c, g, or t
  misc_feature (248)..(248): n is a, c, g, or t
  misc_feature (252)..(253): n is a, c, g, or t
  misc_feature (260)..(260): n is a, c, g, or t
  misc_feature (281)..(281): n is a, c, g, or t
  misc_feature (287)..(287): n is a, c, g, or t
  misc_feature (291)..(291): n is a, c, g, or t
  misc_feature (296)..(296): n is a, c, g, or t
  misc_feature (304)..(305): n is a, c, g, or t
  misc_feature (309)..(309): n is a, c, g, or t
  misc_feature (316)..(318): n is a, c, g, or t
  misc_feature (326)..(326): n is a, c, g, or t
  misc_feature (332)..(333): n is a, c, g, or t
  misc_feature (337)..(340): n is a, c, g, or t
  misc_feature (342)..(342): n is a, c, g, or t
  misc_feature (347)..(351): n is a, c, g, or t
  misc_feature (362)..(362): n is a, c, g, or t
  misc_feature (367)..(368): n is a, c, g, or t
  misc_feature (371)..(371): n is a, c, g, or t
  misc_feature (376)..(377): n is a, c, g, or t
  misc_feature (380)..(380): n is a, c, g, or t
  misc_feature (388)..(388): n is a, c, g, or t
  misc_feature (391)..(392): n is a, c, g, or t
  misc_feature (396)..(398): n is a, c, g, or t
  misc_feature (404)..(404): n is a, c, g, or t
  misc_feature (408)..(409): n is a, c, g, or t
  misc_feature (419)..(419): n is a, c, g, or t
  misc_feature (428)..(429): n is a, c, g, or t
  misc_feature (442)..(442): n is a, c, g, or t
  misc_feature (444)..(444): n is a, c, g, or t
  misc_feature (447)..(448): n is a, c, g, or t
  misc_feature (466)..(466): n is a, c, g, or t
  misc_feature (481)..(481): n is a, c, g, or t
  misc_feature (483)..(483): n is a, c, g, or t
  misc_feature (491)..(492): n is a, c, g, or t
  misc_feature (494)..(495): n is a, c, g, or t
aaaccgttcagctgccccattcgacattgggtggaccgtaggcggaaaggngngcnnnangccgaanncngngcagacttttgcaaanncggcggagcgaaangggctnccanggncggagacaangncnnngggaannccgagccgangcacgaaggannnnagcanngaganggngagnnggcgggaagnccnnnccannngccanacnncgggccannncgagnaagcancgaccaanaccaggnaggnngggccgncagcacacgggccggcgaaancaaggngaanccgcncaaaaacnncgcnggcggcnnnccagggcngaaganncgcnnnngnaggannnnnggcggcggagngacannccncgcanngcnggaccacncgnncgannncggagncgannccgggccagnaaacggggnnccgggcaagggcncncanncgcacaaggccgggaggngcaaaaggcaagganangaggacgnngnnccggagtgacgaagggatgataattcgttcaccgtaggcgaggcatccttcgatttcggatatttgtgccttttttggaagaaaaggagacaatttaatgtcgtccaatttttgcggccatccttgtttggtgaaagcgctaatttgttgcaaaatttcgtcttttgctgtttcctccgctattattttcgcggtgatcggaagttgctcaatttttgcctcaaaaacaaaattaacacagcaatcagtgtcgttgcagatgtttgcgatgagtatgtcttccgatggcctcgggtaatttgcgatgagcctcgaaagtacatcggcatttccgaatgcctttgtgttgacgtatttaatatcaaattcgtaatttgacaaaattaacgcccagcgctgaagtcggctggctgaatatattggaatgcctttttttgatccgaagatggccagtaggggcttgtgatcggtcaacagagtgaattttctgccgtagagcatgcggtgaaatttttgtaccgcaaaaaccaatcctaaagcctctttttcgatttggctgtaattttgttgcgcagccgtgaaagtgcatgatgcgtgttcaatgacacgttcacttttgtcgggaaattgatggctgattgttgcaccaattcctccttttgaagcatcagcggccacaatgattggcaatttggggtcgaaatgcgttaacaataaatccgaaagcataatttctttggctttctcgaaggatttttgttgttcatcttcccaattccacggtacatcctttttaagcaattcatctaatgggcttcttatttcgcgcatttgtttgatgaatttgccgtagtatgtgagcgctccaaggaaagaccgtagagttgacttgtcgtgcggcgctggcatttttcgaatagcctcggctcttgatgggtccgggcggatgccattttcagaaattatgtggccaaggaaaacggtttctttttgaagaaaactgcacttttccagttgaattcggagaccgaattgtttgattttgtcgaaaactttggtaattgttttgacgtgttggtcgagagttgtgttggcgataatcacatcatcgagatagacaaatgcaccattgatgggtgtaattattttgtccatcaaactttgaaaaattgcgggcgctgattttatgccgaatggtaaacgctggcattggaaaagtccgcggtgtgtgttgattgtacacagctttttagactcctcagacaattccaattgcagataagcgtcgcgcaaatcgagacgtgaaaaatgctttgagcctgcgattgcattgtaaatgtcctctggacgtggcagtgggtggtggtgtagctcaagtgcgtcgtttaatcccgtggaaaaatcgatacacactcgtgttttgccattcctctttttgactgccaaaattggagcggcccagtggctaaattcgatgggctttattgcctccattttcagtagacgatcgatttcggcatttacgtcgttcaaagcgccatgtggaactggtcttgccttgcagtagataggcttagcaccgtttttcagaatgagattggccttgaatttggtgcagtgacctaattctgggctgaagacatcggaatgtgttgatttgagcgccgaaattaatgtctccgtgtctttgatttggttaactttcgttgaaattgtattgatttttggatgaagatttgggtgcataatctcttttgggatcacttccaaggcttctatccatggcatgcccaataaattatgactgatttcggggctaacatatgccaacaatttcattggtggacgatccatgtattgcacttcgcaccaaaattgtcctttaattgcaaatgtttggtcgttgcaatttttgacacgaatatgtgctgacttcaaaggcggtttgcccatttgaatccatgtttggattgtgaataatgagatttgtgcgccggaatcaacatgcattggataatctgagccattcactttgattggtattttccaccattttggatggtctgcgttgatttccatgcaatttaagtcgatgatgactgtgttgatttgtacatgcctttcagttgtattcaccgtttggatgtggcgaattgaagaattgcttcggcaaactttgccgagatgtccgattttaccacattttgggcatttggcatctctatgcccacaatcggagcgccaatgatttgtgcttccgcatgattggcatggacggtttggcaatttgtgcttgctctcatacggttttggaaccgcttttggtttggcatattgctttgttgcgtctgccttgtcctttacttgttgtggcttggcacgaatggcattggcattgtactgttttgtgctgagtgccaatgtgctttccttcaaaatttggtactttttgcattcttcgcccaattcctgcagggcgatgcttttcccattggttcgggcttcttccattcgctgaatacatcgctgtttcaaatccgaaaattcgtcgcgtaaagagatgatgagaatcatgcactttagctcttctttcttcaaatccaattcggcgttttcacacgatgaattgatttgtgccaaaagactcgaaaggtcttggttttggctttggcgaatttgaaaacagtcgaaacggcggaggaagagcgacctcgtctcaccaaaaatctttttcagatttgccacggtttcgagccagttgaattgttcggtggctttaggggcaatgctgtcggcgttccttttgtatttctcttcgtcttatttttctctcaatagctgtattctggatgtcatatgtgatgcagatatccccgtgttgtggacggattttcacgtgtagttttcactaaccctcgcatctccgattcggctgtcctcattatacttgcaatttcttgtggcgggcatcgtcatatcatcctcgtgatatcgttgtggatgccactgtgggtgagagagtggggaggtcgaagatcgagggcgggggcaaggacttctgatggtctttcatgtacggaatgtaatgggtggggaaggggaagatctgggtgcagttgaatggtcgatcatatcatatataatatttgtggggcggccgcccggcgctccatcgggcggatgagcgggggcggccggagcag

SEQ ID NO: 11399 - DNA, 5577 bp, Heterodera glycines
attgtggtttttggagaaggcaaaaaggattttttgtaaatgaattttgagaatttggtggtggtttataagcaaaaacccgcaaaaattatctttttttgccaaaaccttgttaataaaatggagttgacccttaaacagcgaaaattgtatcaaaaaatttaaaatttagctaaattttccaagggcatttatcgcaatattcgtaccactaagaaattttgaaacaatttaggcaaattttctgagttaagagcaaaaaaaagtctttcgcaattcatccaaaatttttaaaactttttttttttactaaaattttaattttaattggataatttgagttatttattaaaacgctttagaacaaattattttaggaaatttgcattgaccaacaagcattttattatgttgagcatttggtgttccaagttgaatggattgcatcggacaaatggtcgacaagtgcacaaatcaatgagcacgaccaaaattttttggcacaaattggccaaattctttccatttcaagggcaaacaaaatagaggacagtgaacccccaattttatcatactttgagttgaacgcccccactctgggccgattgaatgctttatttggacgattgtgccaaaattggcaaatttttgtggcaaaatttaacgacaaaaacactaaatttaacgcatggacgaaactgtgcaaaaagaatgtgtttaaggacttttatcagcagaaatgatggaacaatttgaagagatggcaaaagttattttatttatttgtttattatcttatcaagttgtaggaaaaagaaatataaaagcagacaaatagccaaatgaaagagatgcgaattgtatccccaaatccaaataaatccgcaaaataattgctttgtgaaataaaagttcttgaaatgatttttaccatgatcgggaaaatggcaaaaaaagtttcaatccaaaaacttttgttctttattataagaaacgtattttttcatggaaatacaataaatgctgtggataaaattgtgggtttaggatagggtttctgtctgttctcacttctaagaaaagttctgttttttgatagtgaccaatgttctatttttttaaattattcaaattttgtagtttattgcaaagtgtcattatctcgtctggcattttttaaatttgacgaaaaatttggttatttttgaacaaattctgtcaaaaacctagccaatattaaaattgtaaatcgcatgggaaactgttaaatcagttgaagtgacaaaagttgtgcaaataaatattgtaaaaagtaaatggataatcccgaatttatatgactcatcatcaattagtcatcgtcgtcattgttagcattggcagcagcggagaggagcaaatggatgcccaaaaagccaataagctgatggggcgtaagacctgaagggtgaaaacggaaagcagattaagaaggaataaaattatagagccccaaaaatcgaaatctgatttgtgtttgctcttcagtgatggtggtcaagtggtgctgaccggataaatgcatcaacaattgccttatttctagtaaaagatcgggaacagttcaaatcgccaacgcacgataacatctgcttaatgatagtttctaaacacttagtgcttccgaataacattaattctataaaaattggtagaaaaagaaaaaagttacgaacaaaagattagtccgtcggcgagttgacatgtaccctaaaagatctaggtttttaccatttatgctcgtaaatagataattctaggttttgtcaccccccccctgaaatttttgatgctgaccatgaatctgacctttatttttagccataacgtgttttacatgagttacgtgaaattttacgtgaaaaggtgaaaaatttaaaaataaaaatatttaattaggcgacataaaggcaacaaatttcgtaaaacctaatcaaaaaacatcattgatggcttttaatttgtttccttacatttaagccggtttgaaccaaaaatgcgaaactagaaaaaattttaagtttcgactttttgttcgaattcgggttcaaggttcgaattgggtcgaaatggatgtaagaatcggattctccgaccgtgaaaacccctaaaagactttgctccgagaaaaaaattttgaaattttttttcgaaaggggtggggcaccatcggcactgtttacctttttaaatttttcacgtaaaacatgttatggctaaaaataaaggtcagattcgtgatcagcatcaaaaatttcaggaggtgacaaaacctagaagtacccgtaaatattgttaaaaaatttatttgttcgaattcggggtcgaaatggaggttagttttgtgttctgcgccccgaaaaaaaaattattctaaaccacgcggactcaaaccaccagttatcctgccagcacttgaccacaattacaaaaaagttattttagcgtgaaaaacatatttttgttttgttactttttcctaactcaccttgttgggccgatcagtgcgcgcgcctttgtcagacaaaaagcgagcaatttcgaaattgtgcttcaacagtgcccagtgcaaaggcgtgtccccctccgaatcagtgctttcgatgtccgcgttgccctcctcaacgagcaatttgactggaggaatgaatagaaatgaattgtctttgattaagggtattttgctgtttcattaaatattgggtcactgaccaactggcaaatggccattgccacacgcaatgtgcaaaggcacaatgccacgtttgtccttactcctctgattcactttggcactcttcgcgaccaacaatttgcacagcgccaaattgcctttttgggcagcgaaatggagtggtgaaaaaaggtcttaaaggaagttcaaatcatatgaaaaagggggggggcagacagaaattttggcgaaaggattcagccatgtaaatggacgaccttctttttgattttaaaaacgttttttgcggcgcgcttttcaaaacaaaacaccccggtaaacacatcaccccaaccataaaaaagggggacgcacttttgaagacaatgactcactttgcttctttttgtcgcgaataaaagtgccaaattcattgggattctgtccattttccaactgaaaagcaggaatacagcgatttaacaactaattgttgtgcctattaccataatttccaccagttttgtctgttccctgagaagcgcagcccaaaatggcgaaagtttgtctgaatttgaaatggaaaaataaaaaaatgaatcaatgagacggcatctgtcacactgactcatcgtgacgagtcgaattgtaacggaatcggtgccatcggttggacgaattgcgcctttttacaactaaaaaagtgaaaaaaaaacaaatacaacccatgagaaggacaaaacaaaaaatgatcagtccgcccgcgcgctctttacacccgttgggaattcttcggtcagccaaatttcggttttttaagaaattttaaactcggagggggggggggggaggggtaacactagttaaaaattgcttattaacataataaaattgttgtgcccgggtgtggagtcccctccacgccaaattctgaaaaccgtcccactgctggtcaatggtttcgagaaacaacaaaacgaaaaattgaattactgtttgccctaccaaaagtttggccacctccgttttgtcattttgtgccgctacgtccagcaaagtcgcgccattctgctcagctcccagcaaacgcttcaattcgactgcatcgcatccgctgagaatggcacgcatccgcgcgacgccgccacttttggccaaagtgaacagcaatttgagcttgaaaacgacggctaaatttagtaatagcccacccctacctccaattcaaaacacgtaaatgccaaattatggcaattatgaattatcctacactcgagaattatgccagaactcggattcggaataaataggaaaatttgcaccaatccgtggtataaaaaaatttaaaaaaggtaaattggtggggggggggggggagggccatcggtgatttatgacagaaaaacagcatttctgagggtttttgggccttgaataaatccaaagggatttgttatggacgtctaaattttgttttgccatactttttcgctctcattggccatcactttgttttgagtgccggtcgcttttggttgctgctccgtttgaacaatcgcctcattaaatgccgccgccattggcgaaaggttggcgacggacacagtagaggacggagagggcacagcggcgacaatggcggaactctgtcgctgctgaccatcgacgatgctgccactttcgctgttgtcggccgtgccgtttttgagcccatcagaagcgaaagtcgaaaaaatgcagaaaatgacaaaggacggacagaggacgaagagaaagaaaacgaagaaatcgacaagaagcaacattttaagctaaacgatgtgaaatgataaaaatttagctgttttgattaaattttaaaagaagttaattattttgtgggccggcgtaggtgcctccagcaaggaattttcaaaaattatggaacaaatttgggcaatctttcggaattacggtcccgaaaaaaaaatttttttttaattcgtaaggcactttttctaggcttaaaaatatgctaatcacgatatgaacacggattttgaaaatctttgattattgtctatgattttttatcgaatatttgatttatgaaatttttttaatcgattttctggtgtaaaaaaatacgttgatcacgattgttacgatagttcaaaagatgaacaccgatccgcacttggtcaaatgaaaaggtgtcgcaatatttgatgactaaaacaaaacaaatagtcaaatttcgggaccgcaattctgaaagattgccgaaattcgggctcaattgcagtttacacgaccataaaaaaattacaaagttatacataactagggttgggaatttaagtcaaatgactttttttgctgattctaaatggcattaaaatggcttaaaaagtgttctaaactttgtttgaagcttctaacatactttttttgtaactttttttttacttttttacactttttgggatttttatgacttttttacacttttatgacttttttcgtgacttttttgactttttgaggccaagttttaaattaaccaatgaaaatgccgaaaaatacaaagaaaactccaaaaaataaaatttccatcggtgaaaaggcaatgaaatctggatgaaatttttcgtaattgttggaagaataacttttttatttatgttttaggtacatatttgtaaaattaagtgcctaaaaatccgatctctatttataagatgttattctataaattgttaaaaatgggattttttttaacattcgcctaatttttcagaaattttttgcattttttcgtgcttttttggattttttgtgactttttggcgattttttatgactgttttagtcgactttttgaa

SEQ ID NO: 11400 - DNA, 1836 bp, Heterodera glycines
cgaatgcgtttttcaccccaaaattggaaatatatctcatatgcaatttcaaccaataaatttgaataaatttagagaaattatacccccaaattggaaaaatttatatgcatatttttcagtttttatgtgcatattttgccatttttgatgcatattttatgcgcatattttgcgattttatgtgcatatttttgccaaccctagtgatttctatgcccggattgaccggctcacacaaacaatgaaaaagcatcaatgagatcaatttggagttcattttcatttactatccgtccattagtatgactagcttttaaaaatattttgtattttcatacattatttaattagaataaagctaaaacaatggtttagaaattttagaggccggtttatggtcaaattaaggttcattttatcaaatttttgtgaatgataaaccaaagtcttacattcataacctttgcttggcactttcttttggcgaattcaatttaaactcaagaatttcagacgatcaaaaattgtgtaaaatcatttatgttaaacggcgttcttttggcacacaacgccggcgaggttggcacggtcacactgaatgtcgttccaccagccgcacgggtgccacatttggacacactcttccgcgggctcatcatctgcgaatattttaattagtagggttgcaaattatatttgagaaaaacgcaaaatatatataaaatatgtaaaaaaaaaccaaaaaatgacaaaaactgcacaatatatacaaaaatatgtaaaaaaaaaaatattttttatgattttttaaggcaaaagttcatagaaagggataaataaggacaaaaatggcataataacctaattagctgaaaataatgttttaggtatttttaaaccgaataaattattttgtgctttttggaaattaaaaattcctgttagcctaggtaattagtgatgttgttttactgtaattccaattcaaagtgcccgacggctcctgtgccgaccacgggtagtccgcttttgaatctttgcctcggtgctctgccacatttccaaacgtggcttggctcccatcctccagcgtgcttaattgaataacgaagcggatttttaagaattacaaaaaagataattgaatattttaattaagcatcaataagttttggtaaaaaaataaaattttaggggaaaatttttcaaaaggaaaaaaaattaattacaaaaataaaaatgtgttttatgtttttagcttgtgcaaaattacaaaaaataaataaatgcttcaaaattcgatctctagataaataattcatttgtacaaaaaataaggtgaaatgagcagcatttcttaagtgaaattaaatacaaaaatatatttgaagaaaaagaaatttgggacgaaaaaaagcaaaagagcagaaaaaattctaacaaatgagtaaaattgaaaaagtaaaagaaataaataaatattatcgaaatatatttgagaggctgtacacctgacaaagcctccacggccattgcgttttcggtgaactccgacgatgaaactgagataaagccactggctttttggagtgcaaaatagcggattcttagcactaaattgtgtattctttaattcaaaccaattaaaaatcccccattaataattttccactcgcatggcgtccattttcggcgcttccgccaacggcacattgaccccgttgcacagcatgtaatcctcgtcgatcagccgtgccaccaaagtgttctcctcctccgaatgaatggacacaatttggcctcccatcgcggcacaaatcttttgtgcctgat

SEQ ID NO: 11401 - DNA, 1824 bp, Heterodera glycines
ctttttggaattaaaaattcctgttagcctaggtaattattagtgatgttgttttactgtaattccaattcaaagtgcccgacggctcctgtgccgaccacgggtagtccacttttgaatctttgcctcggtgctctgccacattgccaaacgtggcttggctcccatcctccagcgtgcttaattgaataacgaaggccggatttttaagaattattataaaaaagataattgaatattttaattaagcatcaataagttttggtaaaaaaataaaattttaggggaaaattaaaaaaaaaaaaattaattacaaaaataaaaatgtgttttatgtttttagcttgtgcaaaattacaaaaaataaataaatgcttcaaaatccgatctctagacaaataattcatttgtacaaaaataaggtgaaatgagcagcatttcttaagtgaaattaaatacaaaaatatatttgaagaaaagaaatttgggacgaaaaaaagcgaaagagcagaaaaatgctaacaaatgagtaaaattgaaaaagtaaaataaataaataaatattatcgaaatatatttgagagactgtccacctgacaaagcctccacggccattgcgttttcggtgaactccgacgatgaaactgagataaagccactggctttttggagtgcaaaatagcggattcttagcactaaattgtgtattctttaattcaacccaattaaaaatcccccattaataattttccactcgcattgcgtccattttcggcgcttccgccaacggcacattgactccgttgcacagcatgtaatcctcgtcgatcagccgtgccaccaaagtgttctcctcctccgaatgaatggacacaatttggcctcccatcgcggcacaaatcttttgtgcctgattttaatggcatttttaattaatatatatttatgttaataattaattgaatttaaaattatatttaaagattaattaaaagataatactgagataaaattcatttccgacgtgaaaattttgtagcatttttgattgttttctgcccagccaggaccacaagaagcattgacaagaaagggagaagcgaaagagacaacaattagcaaagcaaatcccatttaaacaaaaaagcgaattttaaaaattataaataatataatgaaaaatggaataattaagatttggattttgtttgcttaaatgttattcaaaatttcgtctttgtttaaattatttattttatttgccaattaatttggtgtgtatcatttgtttttaataagaataattatggggataatggaattggaacctttttcaggcattcaattaaagcataaaaataatgcataaagtgaaatgatttgataaaaatgattttttttagattcatttcttacaatgtaataaaatgcattatttttatatttcgctcaaaaatcttcattcgccattttaatcaaattttcaaaaacattttgaaattaaaaaagagaacataaaaaaagaaaaaagaaataaataaaaagaaatcattttaacttattattctaaataatctttaattttaaatttaaaaattaagaaattgaaatatttatagcattgtaaaaataaattatagtttatcccaaacggaattttggccaaataatttcaaatttggccatcttctagaactttggccattgcatcacatgcttttagtaatcaaacccgaaccgtcaacgaacatatgaggcatttgaaatgaaatttattcggtgattaacttaatttaacagcgaaacgattaccaaaataattaa

SEQ ID NO: 11402 - DNA, 966 bp, Heterodera glycines
  misc_feature (956)..(956): n is a, c, g, or t
ttatttcgtcccttttctgctgatgatccaatcgaaaattccgttcagcgttctgcaaattttttcgtcactttgtcagacaaaaaattgcgcatcccttgcaacaattcgagcacccatttgcttggactctgaattttattgacttttgaaaaacaaatgccaaatttaaaattccaaaaacccaaattttcaccctttccttttgttcgtccgtctcctccgttggccatccgttgtttaaagcatgccaattgtcccatttgtcagctttaaatttgtataaaaatatctcagaaatgcccttaaatgacttacccccttccaaattgctgggtggctcatagccaagccaagagatccagcagatttcggcttaaatttaatatgtatttaatttactgttcttttcaaatttttttttggtaattaatttgattgtcattttctattttaattatattaatttataatgtatttaaaataccgtcatcgaaattggcagatggagcaactgtttgttgcttcagcttttccatattcggatgatcaacttaaaagaataatttattaaaaatgaattgattttattattaaattaaatttattaaataaaaatttaaacaataaattcacccccttccaattcctctgacaatgatggcgcattttcctcccacagctgccgatcatctgtgagctgctgctgttgccagtcttcagtttggataaccattttagcgaaaagatttaaacaaaaaatgctctgaaaatgattgaatttacacaattttcattttttaaatggccaaaaatgtgtctttttgtcaagagaaaaatagactgataaaaagaatcaagaaaatgggagaaaaagaaaaaggagtgaaaaagtggagaagcagaaagcggacaagaaaaaaagaaattaaaattaaattaggaaactttcacanaaattttatt

SEQ ID NO: 11403 - DNA, 972 bp, Heterodera glycines
  misc_feature (17)..(17): n is a, c, g, or t
aattaatattaattttngggcgctactgaataaaaacaactcactttaagacagcgcttttgaagcagtcgaacaatttttgtattctgaaattggaaaataaaaatattaaattttgaattttatataattttcatataaattaaatattaattacaatttttttatgaattttaattatttttttcccaccattaaacagtcgagcactttgtcgcccttctgattcccgcaatatttgccaatgtcgtatttgcatgagttctaaaattgtttgggaaattgagtttaatctcgccaaatgatccatgtcccttttttctttacttgtaattcgtcgtcaaatgtgttgtccaatgcttctattttttcacggctgaacactaaagccttacagtcgggcgctgaaaaaatggcaagaattttattttttcgtagaaaaatttgcgatgggttcaaaattttgagaattcttgccggctttttcccccacgctttttaaaggaatttaggcactgtataatgttttaaattctttaattagttttttaaaaaggaaatcccaaatttgcaaagaatttatctttctccccctctcacgcactctctcgtccctcttttaaagcccctcccccgccgttggatgggctcccggacaatccgcagtggacaatccgtcagtggtaaatccgtcagtggacaatccgtcagtaagtggacaatccgtcagtggataatccgtcagtaactaatccataagcaaatttatttttaaaatacccagatttatttaaaatcatgtgaaaattaatttaattctctaaaaatctgaattaattgtgttatttttaaaaaaattatgaaataatcattttaaaagaattaaatgataatatctcgagatggacaattatttgaaaaataaagtaactagaaatgttaagaatctataaaaaattatatttattaaat

SEQ ID NO: 11404 - DNA, 1223 bp, Heterodera glycines
  misc_feature (23)..(23): n is a, c, g, or t
  misc_feature (1132)..(1132): n is a, c, g, or t
agtgcatctcctccgtcggcttncacattttgggagcctatgaaaaatggaaaaaaggattaattttaaatatttaatggggcagttgaatcggaaaaatcaggcggcatttgatcaaagctaatagtgatcggttgcattggtggttcccaatattaggaaaacgattatcgcaacaatttttgttaaaaattctaaatttcttggctaggtctgacgaggattccacaagtttaattgtccaaggaattcccaattttgcccaaaaaaaccgtaattgatcagttggcgatcaattagttaaatcaaaaatgcttctttttatgtgccaatggcaaatgtacttacagtattccgaaagtgcgtccctacagttctcctcaatgtccgggagcagattgacacgtgccgcacgctcgcgcaacactcggcgcacatgcaacgcgcactccttgcccaatgggttcgcctcatcgtaacctttgaatttttatttttttccaattatacagtatgaatggacgggtgtacggtacaagaatacctgaacggtacagacaggcaagcacctgaataaatttgtaaattatggggcaaactcagcgcattgagtcgcgataggtggctggctggcttacctgtggtcctgggtccaccaccactttttggtcctgtcctggcaatttgttggtattttcgtgccaattgtctgtggcatggcaccgcgtcactgcctcttggtggcacgcctcgtacagttgcgggtccaacgaccagtcacgggacatgaagtattgcacctgagcaaattacaaaataagaagccaattttcagatacttttctcgtccaagaatcccgaatgagcaggcaggtcggagagatcgggagctctgggtagggactcaacccaaaaatattccctgaaccacccgctggggtgaaagttttatgagaagtgccaagtagtgctgttcgagatcgaaaatttcccgagactcgagacccaaaaaacccgagatttttctcgagtcgagaccgagagtctcgaacagcactagtgccaagattactctttaaggaacgatcaacagtagtgacactcgagatttctcgtcaaaatttgaaatatnccccttaacgggtcgatgtgggcagcactacatttcgccaccgaaaaattatttaaatatttttaaaactaaaaactaaaaaaataaaaaa

SEQ ID NO: 11405 - DNA, 3230 bp, Heterodera glycines
cccacctttttctcgtccctctcctgcgcatgtgccatcaaacagtgcaccgttttgccctccgactcaatgtcgccctgtggcgagcagtacttgtcaatttcttgggcacagcccatcacaatttctggcgacatgcggaattcttggaccatcatttgacgatgtgtcatcatctcatgctgacacctgtgatcggtggggatgggattttatcgtcaaaaaaatcttacatttaaacccctaaaatgtccatatgtaaagttgtgtttggatgaaaattaacaaaataagaaaatgcatttacttgcactaattaattaatataatttgtgtctatcgaaattatactgtcattctccgactcccggaaaataaatccgtcagtggaaaatttgaaagtgagaatgacttttaaaataagattctgtaaccttaagtattgtagtgcgaaagattgaaatgcataacaatcaaatttggaattcgtcaattcatttaatttggtcattgaaagcaggaatgcgggatttttgtcaattcttgggtcttagtcggcaattttccgtaatccgtaattcaataaatttccaatgaaatttttctctttgagtatattttgtaaaaaaattcaaaaattctgactataatgaactgatatacaaacaaaatgccggtatccgattgccgacacggactttaaatggcaaaatcggcaaaaagtcggaaatgaagcatgctgttgtctcccctatgttcaatcctaatttaattcggatagccaaaaatgctgaaaatctataaaaattttgtgcactttttcgggttttttccttggaatttatgagtttcaggtaaaatgccgaatccgtccaagaaccggcaaaaactttccgctatatccctggattgtaagttgttaacattttgtgtgaattcacgcttataatttgcatacagtaacaggtacataccgaaatatttaatgtgtctcagtttttcaagaaattctgacaaatgacgaatttccactgactcatttcccattcacatgttcctcccccccccgccccactcactcatcagtgaatgccaaaaggttgggccattggcgttgtttggcatttttgtcctcctccgccttcttgcgctcgtgctcctgcgttttgaaatagtggagtccattctaaaattaaatttaaaaaataatttgccgtaatgattttgagttttgtacaatacacctcaaggcacaacaccacccagctgaggtggaactgcagcgatttttcaaagcccggctgcggcacacagcgataagcctaaaccagtggaaaattaattaataatttggaaatattttgtaattaaaattgaattggatttgacctgcaactctttgtcgcaagatttcagcagtggatgagccaatttgtagtcacggcctgtaaaaaaataaaagaaaatttagtgagcatcttacagttaatttgcgcaattccatggcccaaagcaaatttttgacgacgatttaaattcaaatttccagaaaatgtgacccaataaatggagataatttaaattacgcatttttttacagtaagtgaaaggtaacgaaaaatatttctgtaaaaatgtgttaccgtacccattagtccggctcgttccgacaaaatttttgagcacttaaaataaatatttataaacattaattcctttttaaattggcccacctgtggcgacatcttctcgtcctgcttgtgctccatcaaacaatggaacactttgccctcccccgcggggatttcgccacaaaatctctgaaaattgtaagaaaaattaagaaataatattttaaaatttttatttttaaattcttcacctctctgtcaatgcgacaagcgaagaaaagcggccctgaactttcggcatttttgaaatttgtcaaatttttcttttgtatttggcatactgtccaaatgccagtcgtccgactggagctccgcgactcgcatcacttccttgcggcactcttgcgaaatgccctccacaattttggctttgtacgcatcctttggcacattgaccatgtagccgatcaaacactccaaggtggagcctgaatttggcaaaattagaaaagttcattaaatttcataagtagggataggatttttaagggtgaaaaagtccaaaataaggccgtaaataagggcgaaaaattcgcgaaataagggcgaaaataaggtcgaaaaagtcaaatttagggtataatttttaaaattgctgttttttacatgaaataatttcagactaaggcaaacaattttattcactgattgcagttacaaataagctatattttagaaaaattttttcatttcttagggtctatttttgaaaaatttagtgtcgattcataggggtatattttttcgaaatttttttgggtcgattcttaggggtgtatttttcgttttttattgcatttttgttaataaattttggacaaaacgccaaatcagggcaaaaacttattttaagggcgaacatccaaaataaggatttttaagggcgaacatcaaaaataaggatttctaaggtcgaataagggcgtgaaaacgcaaaattttcagacaaaaaatgtgtttttcgtgtatttctcgttgagttaaagccgcagaaaaaataagtaaaaacttagaaatcccatccctaattatcaatcgaacagtgatcaaataaataaatgtgccattttgtcacggtgccgacgattggaaacattttggcggaagaaagcacgactttgtgttgttattatttccagtgttttgcgcacattttggacaattgtcatccaaaaaattcaaaagacaattttcgcagacaaagtgacgacagccgacgaaacaacttacaacctaaaaaatggtaatttgaagaaaacaattagatgggctgagacgaagtacgaaaagtgcaagtgatcaaattaaagcaaaataattattttaatccaaattaattaataatatctatataaattatttaaaacactcgctacataattaaacgttgtgagccgaagctacactatttaaaatttaatttagtcaagaaacaattacatttttcacattttgcactaaagatcgatgctagatcgtttcgtaaaatccgccattcgtgtgagtagagaaaaacgtcggctatcgacaatagaaaaa

SEQ ID NO: 11406 - DNA, 2377 bp, Heterodera glycines
  misc_feature (2280)..(2280): n is a, c, g, or t
  misc_feature (2339)..(2339): n is a, c, g, or t
accaatccgtccaagatgattgagttatcatttttgatacgcttaaataaaaaatatatatattttttaaaatgactgaatgttttctatttttcatactttacaacttttgtccgtcgtaaattcagcacaatttgtttcctcaccaattatgtcaattaaatccactgttgggtttaataatcgctaaattaatttaaattaaaatttaaaaataataatatattatttttacataatttttggctgaattttgcggttcttttccatttccatacaaagcaacgtaataatttggttgcattttttgtattcgtttaaatggggtgaacgttatattcactgcgatgttctccgtttgatttgtgtcgttgaagttttcctaaatgtccaagaaaatttgaaaaaaataataattaaaattgttttattatatttattaaataaaaatcatattacccaaagggcccgaagattaagatttaaatatatatcattttgtggtttttaataagcttttttgtgaaaaaatggcaatttctaagaaattttaatcaattttccttaacaaaatgtactaaaatttcaaaaaaaaaaatttccggcggcgtctatcggcaccgccaagtagtcttttttggcgaaagcgagtacaaattcctgtttttgctcttgggcgctgaattacgggcttagccccaaacggaaaagtaccgaaataattgtacatttaagtttaataaagttagaatttacaatttttatgccaaatttctttgttgcaaaaaaaaaatttttaaacgacttatttgggatttttttccctaaaaatgagtaaataatttgttttgtgccataatgaattagggtccttggcacaatcggacctcaatgatggtgaaattaaagtcagcaaattggccacaaaattggcgcttcggaatttgtttttgccttcttgccacagtcggacccattgacagtgtcacaatctgagaaaatgttttttcttaattaattatttaaaaaatgaattaattactaatttcaataatctgcaagtctttttcgtcaggagtaatgtgaaagcttgagccacatcggttggaccgaacttcatccgcttcaaatgcaaatttgcattggcgatacatcagatcggcacctatatataattaggtgctagtgttaaaagttattatatattttgaattttattaaatcaaagtggggccttttggcacgcaaaaaaacctttttttctgcagctttattttgatgagaaatgcacgaaaaacatcatttttagccgattttgctttaacttcaatacccataaatataaaaaaatattttagacttatatacactataaaaatttacaaaaccattttgcatttttatcaatattttgataaatattttgcgttttttgaaatttttcttaacaaaatgcagtaaaaacgaaaaatactccataaaaattgactttaggaaaaataaaattttttaaaataaaatttaaaaaaaaacaaaacaaaaaagatttgaaaaaagtcgcacccaatcttaaaaatattttgtcttaaatcgtatgaactttacctctgaaacacttgaaatgtaattaatttgcaaatgcaacattgaagaattttttttttcacttttttgtttttatatttgaattagaagaaaattttcaatttttattgctctaaatttctcatttttggtcaatatttttaaaaatattttggcattttttcttaaatatttatttaaatttttcgggattttttgtaaatataaatcatcaccctaataataactcttgaaaatttgttaaattaaaatttttagtttattatgtttttttttcaaaatttaggttaaaaaatcagaattggttaaaatatctttcagattcatgatcagggagagaccatccacgaaaatcgcagaaaaatttttcaaactaaaagccttttaataaaattaaaaatatgcgactttaattggcgccataattgtacaaattaaaaataatttttttaataaataaaaaaaaattaaaaattaccaacaaaagcttgtacagtgtcatcgcttgaaccacgatgctataaaaggaatacaaattgttttaaaatgtaaacattattttttttttacaaattccggtgctgggaaagcatgttccaaatttggcaccacacaattaattaaatgaaaaattggtgccacttcgagatcttcaattcccatgggccatgctanaaaattaatggaattttctattagtttatgtacatatgattaaaaaaatatattttccnaatttatttttataaaaattaatttataaattaaaata

SEQ ID NO: 11407 - DNA, 2309 bp, Heterodera glycines
  misc_feature (31)..(31): n is a, c, g, or t
aaggaaatgagacgcaagcaaaagaaacaanaatagcaaatgcttatatgatagacagcagagaatgcatacggaaacgaaaaacagtgtaatggaaagacgtaaagagtgacggaatagtgtgtcaaacagcaatgttagacaatgagacgcaagcaaacaaacaaatagcacatacttccatgatcgacagaagagaaggcatacggaggggaaaacagtgtaattgaaagacgcaaagaatgctgaaatagtgtgtaaaatagcatttttctctgccatttttcacaccccatgccctattttcactaaataattctctcttctataaaagaaagaagcaacggtcgtcacagcaggggcacgggtaaaaggcggggtgccagcagcacagttggcgccgctgccgagcggaggctgagcgcagctgtgtcgtgacggacgcgggcgttcgtcggtcggacaccaaatccgacgcggcgcggcttcggccattcaaatcaaacaacaaacccacaacaaaacagacacacaaacaaacacaaactctctaaccagctcctcagctcaaacgaggccccgcggaggaaagggccttgtggcctacggaagggtacaccggggcacaaatagtgtacaacgatcgccagttttggcgatctgggaaggatggaggcttcctcactttgtgagagaagagaaggaaaagcccaatgcgtccggagcggccaaacacaaataaagtcgtcctctcagccgatgaagcggcccatgcccccaatttttttgtttcaaagaaaaaatccattcaatttatagataaataatttcattttattattttcgttttctaaaataaagtttcatattgggagtcaaaacaattgaaaacaatcaggataatgtaatttttacgctgatcaaacgtccttataataaaagcacctaaaaatttggtatgcgtaaaattccattgattttatatcaaaagcaaataacacttatttgttaagaacatcccacaataaacatatgaatatgaccatgaccatgactgtattttccttttcgcaatttaaaaatttgtttacatttttagattaatttaattgaatataatttttcaaaacattgtattaaataactattttgtattaaataactatttatttctatatttttttgaaaattaatcattttcctttaatatatatttgtttctttagaagggtttttttcatttaattttttcaaactcatgcaaccagcctgaattcatgctgaaccttaattcaatgtcaagcgtggcatttgagagataatcatcataattaaatggggtgctctaaattaaaaaaaataataatttaatttatttaaaattgctttttgcacattgaatttgacgtgcacaatgtccatttttccggcaatttgtggcccatccggctccaattggaccgcatttgaccattggcttagctcatgcttggcacttactgaagcaactttaatggaaattggggcacaaattgtgtccgctgatgaaggggtcatgccattgatgaaatgatcggtggtatacttaatccaattaattaaaaaataagtttacatgactagacattaaaaatttttgtaaaacaaaagggtcgctcgcctatatggtttttaaaaaattcaaaacaaacactttaatagcgccaggattttttttttaaaattataaatcatcccctactgatcagtgatcacccttttccaaaatattttcctcttgaaaaatttcaagtcattctggcaatatgaatattttacaaataattgttcaaaaactccgtcaaaaatttttgcatttaaattgtatccctatttattatttatttatttattttttaaaattacaatttgtgaaatttgccgattcggaaattcagtctccatttgcagcaaataaattttggtcagttcaccattcggagcagatgtttggctccaactcaaatcaatcgtcatattctcattataaattgcctaaattttaattaaatcatttattaattaatgctaatgacttaaaaatttgggtaaaaaatttttcaaaaaaccgtaatagaaaaatttaatctaaaattttaaatttctcgggaagaattttaaatgaaatgagaaaaaattacctcaacatcttttgggacttggattttctgatgatgaccttttttgtcaccaaaatcttcgggtaatccaatgtctttgcatttttccagcattcgttattgcttttcctaatgttttaaataaaaatt

SEQ ID NO: 11408 - DNA, 784 bp, Heterodera glycines
caatattataaaatttgatacattttaggagaaattatgaatattctgtcaaaaattattcatttgatggttttttgactaacgcccattttgatggtttttggctaacatcccagcaccgtcatgagtcgcagccaccattttgggctttaaaaccattttggctcttatatagtttgaccaacataatttttagacccaaaaattatttttcatttcaaaataaaaaaaaattccaaattataggtttgcacaaggcccgttgatcacgaatccaaagcatccccgtatattttgttcgcttgataataaattttgaattaaaaaaaattattcactcattgttcgagtttgggtttatggaccttattggatgccggcttcgtgatcagcagcccacaaaaacctatataataatacaacttgggggggggggggctctaaaaaatttgtgaggctatattatataagtaagagccgcaattttattaaatattacgctaaaaattgcaatttattagaaaatagtaaatattaataatttttgtatttgccaaaattgataaaatgataatgagccaatttaactcacacataattttgtctgcccgtagggtacgcattttgtttggcattctgacaatgttttttgtgacgacttttggccatttgctgttgaggactgctttgcttttaacacattttcataacattttgcaacacatcgcgacaaacaattcaaatgcaaatttggcgaaatgcctttcggcggaacagaatggac

SEQ ID NO: 11409 - DNA, 1674 bp, Heterodera glycines
  misc_feature (106)..(106): n is a, c, g, or t
  misc_feature (1541)..(1541): n is a, c, g, or t
  misc_feature (1563)..(1563): n is a, c, g, or t
  misc_feature (1590)..(1590): n is a, c, g, or t
tataaattttgctcaaagaacgtgtccaaagattcgccgcgcattttaattcaattaaaatctgcaaagaacaaatattatgctcaaacgtgtccaaagatacgcnccgcatttaattcaattaaaatgtggaaaaacaaaataataaaggagtggcaaatttgaaaagcacatttacgctatcgtggcaaaacgtacagcgaaaattcaaatctagatacattcataggcatcagccaataaatgtatcccttttacccggtatataatagagaccaaagtgtgtataatttaattgctgatacaatttaatttacatacatttataggcatcagccaaaaaattaatgcgcttgtttagaaagggattatagaaagggattatttaaatcaataacctatttattctgcattttttttacatcaatcaattcttaaacggcaaaaatttaataaaatcctatataataaagttgagtgtctgtatgtatgtttctgccattgtttgaatttgtgtggcattatgttttgtttttgcattaaaatgcattaaaaattatttaattaatttgaattacgcttattatgtttatatacataacaccaattatttctccttattcttttatattttatctcgtaatttttttacattttagttaaataaaaatgtattctcctttgtttaaaacctctttgcctaaaagctctgtatctgtggaaagtcgtcgaaacaccatctaccttttgaacccaacgggcactgttaaaaaaatgtgtcgtggggaggctgcacagccgcagaaaggggcggatgccacggatgtcaagcagcagcagcaccaccaccagcagcagcagcgaaaacatcaggtttcgagcagcattttttgatggctttttaaaatgtaatcgtgttaaacctgcaggggactgaagccatccgagcggcggagaaaaaaggggcggatgccaccgatgtcaagcagcagcaccaccaccagcagcagcagcaaatgaaaaaaggggcggatgccaccgatgtcaagcagcagcagcaccaccaccagcagcagcagcagcgacaaccaatgaactgggcaaagggaatacggggggaggatggaaagtggtgcggactctgcaaggttgtaaaccattggccacacgaatgcccactttatctgaaccagcgtgaagacggcggggtgggtatatgtttgtaggtgattaaacaaatacttttataatcctttagaaccgtgtttcttgtctggcctgcaggggcattggtcacattcccacggaatgttgggtcatgagagagtggagtaagtggtgacgattatttgcgtttagcattttttttttcaagttggttgggccgtaccatttcttggccaagcaaagtttgaaggggcggatgccagcgagcttaagcaacatgcttgtttcgcatgcctggaagtcggccaccagctccccagctgcagagcgtaagttgggtggggatggggtcctttcttcacgaggatgacaancagaattataccttttattggncgttgccccataaggggtattctttanatacacctacagtgtacatttgcaggtcctccgcgacgaattatcgcatttcgccggaggaacaagtcatccagcggatggcat

SEQ ID NO: 11410 - DNA, 1259 bp, Heterodera glycines
  misc_feature (1113)..(1113): n is a, c, g, or t
  misc_feature (1254)..(1254): n is a, c, g, or t
cgctctttctcaattgtcgacagtccatcaaaattcagcagctacagctcgcaattgagaagtcgggggaatacgcggcgcgcaagtttatgtgctgccaatgaatcctgataaacgatcaatttgcatatttattataaaattttgttttttggattatttcgattcaatgttttcttatactatagtccatggatttcattcaggtcagagtaatacgcatagttaatcgatattgccaactaatagcattaatggggaagtatctacattttagaaagctttataggggagggtagggtgatcaagcaatactatattaagtggaatagttatgagcagacgccatggaataagcatcctcgggaaataaaagattagaggctaaaacaattacctttattggcatattccaataaaggtattaactgtatattttatttttctgaaagacaccccaaatcgagtttgtgatatagtaggctaagacaattacctttatcggcatatgtcgataaaggtaattgtcttatatttaaatcatttcctattcacaaatcaataaaagatatactgcatacatcgtgatgtctttgagagtgactaattagtgcatctctttagcccctgttcgctacattgtgaaagatggcttcgccagcttgcataaagtccacgtggagaacggaatgtcgaggctggggccgcttttacaaaaagtcgccttggccgagcacaccgaaaatgggtggcgggtgagcaagggcggatgcactggtggcggtccgtccacatcacagcagagcgagggcggatgcaaagtatgcggagataaggcaaagcggggggagggaatgagcccaagatggtggagaaaatggagggcaaattcattccatccgttttagaatatccttatagtatatttttcatcagggtgctgacagcggtaccgatggcggcgtctacagaagcacagtctgcgcttgggaatgggacgagttctaaatgaaggccggatggatgttggcggcgtgtggctttttttttcacgttcaataatcatcctattccaaccaccctcccggtccccaactcgtaatctatgctggntgtggctgtccccactgggacggacaacaggaaagaatttacgggatggtttagaattattttggaaatggaaactcagggtcccccataagaggggactctttatcccaaacggccctctttagggccatatagagtaanaaagg

SEQ ID NO: 11411 - DNA, 3895 bp, Heterodera glycines
  misc_feature (2182)..(2182): n is a, c, g, or t
ggttccgggccgggttgcattttcaaaaacgaccgggttccgggcccggcctctcaaaacccggtcaacccggttaacccggtcaacccggatttccccaaaaatcgccgggccgggttgccgggccgggaaaacccggtaccgggcccggcccggtccggtctctactaatcaccataatttatattataaatcatacttgaaaaaaaatttatattctaatttttaatgagtaatctcatttgtccatgatgtttttttagttcgttagttgactcaaaaaattaatggattttaggaaaagaaaggtttgacataaattgaacaaaggccccaactcaatgttttgaaatgttttggtagattttcaaagattatttatgaaattgtcttcgcttctaataatcaattaagaatgggtgtttttttgaaattttttgttgttaaaattgttcatgtttatgacattttaataacatatgaacagagttattaagtattctcttgatggtatttagtatttcgcatattataaaatgctttaattcaaataatttaaatttaatgacaatttttattttattagctgattttcatatcattttttgatgtttacattaaaatttgagattagtcacatgtataattttaaatttctaactgattatagatttcttataaattattttaatgcttaacttatgttggaattgttctaaccttataaagtatattttaatatttttctgttgattaaattcttttttttggctcttcttatgcataaaatgactacaattttaattttatgctttcattaatatatttaactgtttaaaatatatgttctcatttgtaatatttttacgcaaatttggtcagatttaaaataaatcagaattaaatacaaattttaaaacatgaataacaaaacaagaaaaaatttttaaattttatattagaaaataatcgattaaatgatgtgcaattcgctttcgcatttttttcgtttcgcatttttgctttcgcaaatttcgctgaagcctttcgcattttatttttcgatttggcccatccctgatacatatatatcagggatattgcaaaaataaaataaaatatgaaataaggaataagaaatacgagaaaaactttaaaactgttgcatttctgtaggaaatattagatttattattacaaatgattatttcaagcaagaattatgcattttattcaacctgagcttgtactgctctaactccattcatgaagttggagctgtacaggtttagtgagaacctagagaccaaatctaaggctatatttggactcagcgtggtcaatttacccagtttaggaattcccaacaccacttcaaacattttgttatttgatggtcttgaaaaatgccgtttttggagattcattattcacattttctatgtttatgtgtatattttcattttctttaaatcagccttcaaaaatacttaccccaaaaatgaccatttttactttatcaactctaactccttattgacttttccatttctattgaccttttgcctgaaaatgccaacatcttatcgatagtaaaggacaaattttgaatctttttttgttgaatttttaaaaataaatttttattaaaaaaattttggtgcaaaacttatgtaacacctaagtaaaattattttataatttacttttcatttattttcctgtaaaaattaaatctttataattggttctataaaacaatattatttcggcttttaataatcgactttgagaattgagggtttatgtaaaaggcttttatttttattttttgattgataaaaatttataatgttttagacatttttattttagtatttaaatattgttttcgtttatatattataatgtaagaattataaataaataaattattcatttgtaatattttttttgaattttatttttttcttagttcacagaaaatccttttttttattctttgtccaattttaaagttaaacacattttgttttcattttttaccaatttttttagcaaagttactaagaagttcgttcttcgaacaaatatttttacattttcatcataaacattctctaattctttcaataaaaatacaaagatttgtttcattgtcatttttttatagttaattatnttcctaaaagatggctttctgaattaatataattgattttgtaacacattgaattgtgattacgattacaattttaatttttttctattttaatccattgtaattaacaaatcaaacattgtattaaaagtgtaatcataacttatttaattatgaaacataatttccttctacaatattttatgtgagacccaaattaatttttaatatttttttatttgatgcgttttaattattttttaaaaaggattttttgttgtccttaaaaatattcttgcttaaatatttttttacaaaataatctcgcaatgcttcccacttgcacggtttttaatttcttttttgtgtatgaaagtgttttcatatgttttatttctctttttatttatggaaactattttttctttgtctattatatgtaataaaaacgaaaaactttttttaatctaattcccgtttcaataaatttttcttttatttttaaaaatgcattaaaagatttaaattagggggcacgaaattaaacatagagagattaaatgtattgaattaattttaatttattaatttcacaaattttttcaatagaaatgtttttaaatttctaatttgatattttaaaataaacaatttgcgataaaactaattacttaataaatgatatataatatataaacgtttattttcagtaattcattcattattttattttattacaaaaatttataatatttaggtagtttaatattttactttgttttgcttttttaaatttattaaaagttttttttcataaagataattcattttaatcaaataataaaactttataatataaaaattttattcttttatattttaaatttataaatttaggaaaattttatagtctaatttcatggccatctgtccagagttttgacattaatttttaagtttgaatttatttaaatttactttttgcgtaatgaatatttattttgtgataattatcaatttaacgttcaataccgccgggcccaaaaatatatttttttcataaacaggactcagaatcgcaaaaattggtcactttttgatgaaaatttgttaacaaattccaaattctgaaaaccaaattcattttaagccaaatattatattatttaattaatattttatttacttaatctgataatttgttataataataacggcaaaaatttattattttaattctttgtcgctggaattcctccaccagcgaaaagtgatagaaataaaattgccccgtcctccgacccgacccgagacgctttttggacttattccccgacccgacccctgacatgtcgcccccgaggtccccggcccccgactttttgccccccgaccccccgacactaattcgggggattggggactccgagcgttttaaaaatttaaaaaattatttcaacaacgaaggggagaaaggttgaaaatttttgaaattttgaacaaattttttaaataaaattcattaaaattacgaaaaactttccggtggtgcctatcggcaccgcctgccccccaaaaccccaaattttttgctaaaaattgtcgcaaaatgcaaaatttggacaatttttggacaaaattctcttaacaaattatactcattttcataaaatttttaccgacgttgcctatcggcaccgccggaccacttccccccaccccaagttccaaaaa

SEQ ID NO: 11412 - DNA, 3302 bp, Heterodera glycines
tatccgtttgtgaattatggtaaaaaatctgcttgcatttttgaaattttccttcgcttaagacaccctttatccggtgggggtccctaaaattgtggtgagcagggaattcgatgtgaattggacggtgcccgacgatgtgccctatgatggtctgctaaaggtgaaggtcatccccccaaaggaactgctttatcctctcctccctatgcatattgataatatgcttctcttccccaattgttatacatgtgcgaaaaaaacgaagaaagagtttgtgttggctaaggatgtcaaaaaatgtaaccatcggccagagcggagagctttgattggtacattcacttcgatagaactgcggaaatccttggcgttgggatatagagtaataggcttctatcgggcctatcactttgagcaatttgacagtcagctgttcaaaggatatgtgcgcatgttcttgaaaataaaggtggaggcgtcgggctggccctcggaggtgagaaatgaggaggaaaaaagagcattcatcgaaatgtacaaggccaagtacaacatttggttggaatatgataaaatggtgtttaaccatgggctacgtatgatcgctaaattggtgagaaaaacaaataaaattcaaaaaacaaataaatattaagggattgaacagtttatgggggaaattttcaatgaggaacacactttctgtgactgagattgttaataatttggaaagatggacggagctcatcaaagatgacacgattgagtttaaaagaccgattgagataaatgagggtgtgatgagagcagtataccagaagaagcaagagtttataaaggagcataaagtttcgaacataattttgtcattgtggaccacgagtgctgccagggtaaagctgtacgagtatatggagcaggtctacaggaaggagggttgtaagcttctatattgtgacacaggtggacagaaataaaagacaataaaattaaagtattaagattctctggctttcgctcatctgaaagggcgctgtcctttggaggaggggaaatttttggggtaaaagatgttttttgaaaatttctataaacatttgttcagcgagatgactcgtgagtattcagacagtgaaattttggagtatgtgtcggcgggtccaaaacagtacgccttgaaaatgaggaggaagaaagatggtgtgatttggcataaaacgaagatacgggggatgacgttggacaggaggaacgaattcagctatgaaatgttcaaggacatggtgttgaatcatcgggatgggttcaaaaaagtgtttcgttatcctgagaaaattgggccgacaagggactgtcgagtcctctcgagggatgtaatgaaagaatacgagccagtgcaaaagaaggggataattgatgatgaatataatgtgttgccatttggatatcattaaaataattttgtgtttgtgtttattctttggtttgtttatttcattcaatatttacgaaaacttttttatgctaattattttttaagaatgtccaagaaaaatttccaagaaatttcaaaagacgtaaggcgctcgagaaatacccgtaattatttccggaagagcccagacttgggcaagtattacgaagaggtggaaaaacatgtgaaggaaaacaaaaaatttgggattaaagaatatgtccgcacgttttattttaaatgtccaccaaatgaggatcccgaaaacaattttaaaaaaatcctcaaaaaattgatgtccgaagcaataagccaagaagccgagccaggatggaaaatttcgaaaatttctgtcgatctgtactgcagtgccctgtcggaccccgtgatcattccggctcgccccttccaacaatcaaacccagacattgttttcaacgagttcatgcaccgacaacaatcatttggagagctgaatctattggaagagagaatttcgattattattgctacatatgcttttcctgaaaaataaattttttttgatgaaaaaggatgtttttatttaatgttttatacgcttgtattttaaaaattatttcgctaattatttttagttttaaatgtactcgttcaaaaaatattttgaaactgctcttgagaaggaagactttttctggcctaagaacagagctgaggttgaagcgatgttgattgaatcatcccaatataaagtggccatacaccgggattatgaaagcccgttttccggctacatagaaatgcacgaacacacgtctgcgttttgttttaccatggttgagcgagatatgcgaattttttatgactcaggggcgggtactcctatgggtagatacacgttggtactacacggcatcgtacaggggaactattgggaaatgattcgggattgggactccctatttttttcttctggttttactgggagggaaggagctagacaaaccgcaacggtttttttaggagtcgtctttttctggcaaaggtccaaatgctaaaggttctggcattagcttggggaaaagaactgttgacttccccaattgaagtactattaaatgttttctttaatcgtatggacaggtctttaatgattaaaaatctatatgtcattattattacagagaattgcttgcctcttggtcattgctctatcgggtccctccaagtctctttgatatttctcgtcgaagtgttgcagaaaatatgatggaagaatttttagaactgccatcacactttcgaattgctttttataataaatattaattgtgtaatttatttttttgccttagttatagtcgaaatttatttttatacagacgttttgggggtgttgcttttttcggcgtgaaaaatgtagaaaagggtgacggaatggtatgaaaattgtttaaacacaaaaatttatttttttaggaaaaggttaaaaacttggttgggaccatttgtactttgaaggttaatgtgagtgtgaaagaatatggtggtaagaagggaatttattatactttgattgatatttatgaaatttgattttttttgtctataaatgaaatgttaattttttatttaaataaaaatgttttttctaaaactatttctgttgtctttcttggtaattgggggtcagtgttggtgtgcttgtcgaaagaagaaaagcagcagatggatgcctccccgaagggttgttgaaaagtaatttaagatataattaggttaactaatgaggccaaaaactttcattttctgctcctataccatggttgaagctcaaattatt

SEQ ID NO: 11413 - DNA, 1621 bp, Heterodera glycines
aatctttgcaataaactttttaaaggtgtgaaaactctctccatagcagcatttagtgcacctggaatcgaaaatttatacttttcattcttaggaatgctcgaaaaaattcaaaaattacccggtcttattatgagtgaatatagaaaacaggccttagctatgcagaaactagaaattggcatcaaagaaacagatatatttaaatgtcaagaagcagagaatatatcggacctttgtttttcaaagataaatgaattcgaaaaacaagtgcaaaattatcggtttaacatgagaatgttatacaataaaattagaataactgcagtaaagcatttgtttaaacctgaaaaagaaatattttttagtccttttagaatagaaagaaatagagaaatattttattctaaatctaagtatatttaataaaaattcaatcttacaaaatcaaataatcgcgactaattaaattatagctcgcatggttttgtgtaatatttgcgcgcaactcgtgcaaaaaaaaggggttaagcgcgccacgaagggcacaacactctcctacaatggggagggaggggggcgatcgccggcgcgctctgtgaagggcacaacactctcccacaatgggaagggaggggggcgatcgccggcgcgcgctgtgaagggcacaatgtggcggtaaaatttacacccacatttgtggccttatactactcctaccttctgcaattcttgcgtggactgttgtttttaccataggttccagctctttgtccgctttccgttaattctgcatttaaaaaattgttcactgccgtcactacacgatttgcaagctcattcacgccaagctgatcctcaggtactgtgctaaaatacattggtgtaagttgagcaatgtagtttttcgagtttttaagagcttgttttgacatatctgcgtgtttacggcattcattcaagttcttggaatcataatgtatctaatttccgctttgcttcggccgcctttttcgactcttgtgaaatcttttccacaagttcacgcaaattattctcaatatttgatagcctgtcgaaccatttctttaaatgtggagcattaggtgcccgtttgcgggctttttcaactcggttgagggctgttttagccttttccgcgatatccgctgcattaggagccaatttaacggtctctttccacgattgttccgttactcgttaggctaagtccatgcgctcttggtctatcgtagatattttaccatgttcaacaatgggagtgggtggcagttgttccttttgcgggttttcaccttctaattcacccaattgtttgtcagaaagttgctctggtcctgtttcacgtcctagttccttctccgatggttttggctcatctccacgtggtagttcaatgtcatgtgttgctggtaaaggcgcttcacgtatcagttccttatccaatgttttagatgaaggcacttcacgtgtcagttccttatccggtttaggtcgcgtttctggttccaattctttatctgcagaagcagccgccgctctttttacccttttttcttttggaaactttacatcataggccgattgaataaatgctgtt

SEQ ID NO: 11414 - DNA, 4285 bp, Heterodera glycines
agcgccatcgccggagcagacggccaatttcgaacatcccaaaggtggagttgaccagttttgtgagcactgaccaaatgaaatgttccgcagacggtcatcgaagtaacccctaaaaaatcacaacagcctgagaaagaccaagacgggggggggggagagggtcggatgatgcgtgggggctataaaaagaggaacattttttgaacgaccctcaattggccaattgtgtgtcgtacgagggaagcctgttggccgatcccttgtacaactaagagaataaattcaccggttaaatcctgcgcaaatggccgagtcgactgtgaagattggctgtccgggcgaatgcgaatgatttgaccagaatcactgccagaaaatatttcttcgtccagcagacaaagtgcggttgaagaagcaaatctgaaaaataaaaatttaaacaaaaataggcagcgttaacaccgacttatgcactcgcggatatttggctaccgacgatattttcgcaattccatccgccaaattcgctccatttgatgccaaaggactttccacaatttgcacgtctcccgctgttgttgagacgacaaattgttgagcatttaccacgctaaagtacggcaatgattgctgtccaattcccttttcgctcaccaaatgtcgccgacatcgcaattgggcaactcaatccgtccattctgaacaatccgtcttccgccttcctgactctgttcgtcgcgctgttgttggaccgtccaaagtgtcacatttccaccggaacccgcaggggaacaccaagtgccggtgacgaaacgggaggaatactcagaatggtcatgaaggaaacgcacctcaaatgcaaatcaaatcaacaaaaaaagaactttcgcacctgctaaaggcacctacagaggaaattttacggccgcagaattttcgcacagtttcatcaccgtttggccccgtagaattcccaaagattgcgctggtggcaccggtgttgtcctccaacgtacccattggcaaaaacaattcacaacaagacacagaaacaaacccaccaaaacaagcaaataaacaataaaaagcaaaactaacgcacttcgagtggactttaaattcagtattttttgtgttaatttaatcaaattaattgtaagagaaaggcaaaagatttaatgtgtaaaatatccgaataaaaagcatcatttgtgggtgctggaactcttggccattttggcaatgcgcacattggacaaaccgacgaacgacgacatcccgcaaattggcacgatcatttgatgccgcgaaatgcggtccatctgggtaagcaaaatttaaaaaaatgaggaggggagagttgcaaatcacctttttcagacggtgaaaacgctcgctaaggttttgaggaatttgtgaaggagaaaacaaaattctgtcgataacttaaaaaggtaacagtctaaaaatcacataaaatgacatcgaaccgtcctcctccgccacctttccgccttcgtttccgactttttttcgtttccacgagtggtcgtcaacaggaggaaaggaacagttccgtttcatcgaccccaacttcgttttgatttgtctaacatttctccattgttcaaaacgaatccgcgcgaaacgcttcaatacttcctggaccatctgacaaaaaggggaaacaaaggttgtggattcattaattaaaataaataaataattgcattttgaaaccagttgaaattcataaatattggtcgtgcaactcacaattcgcgtggtccctttgtgtatattatttccagggtaaatgttggtcagaaggtacttaaattttgatgacgaaaagggaatgaattttgggtgcatttgtttcaaataccgaatcagtggcaacgccgtgggcagttcgaatgtgctgaaagaattgttcggtttttctcagtgaaaagctatcccttcaaatccacctcacgaattgccgtgacagaaaggaaaaggacgcaattcgaatctttgcacaatttacagctgaaaaactcggccatgcattttttgtccaagtgccgtaagacatgggcatctgaaaggagtgaatgagattggccaaggcatttgcatgataagcgtacgcagatgggaaaaggctcaaattttgcaaaacaaacagggcaaacaatcgcattagccacggcagttttcatcggtctattctcgggaaaatctgaaaattacccattaaaattgttaaaatgataggcatttggtgtggggcgctaaaacagtaaatcattattttatgttcgttagaacccttaaaatacaaaattaaaaaattgttagaaagaaaacgttgagtaaacagtgggatgggtggtggtggtggtaaaaggcgtaatgcacccaaacgtacaaatccgaagaccacattccaaaactttgctcggaacggacagtgtattcggtggcattcgatggtcaggctctttcgataggcaaatagacgaaaagcactgtaattaaaacaacatctgaaaatataaaacggaaacaactaaataccgtattattgtgagggtttgggaggaataaattgcgtgagacaattggcagacgtttattgttaacggcggattgggtacgaaattgagggactggtctttgtgcgagaaggtaacgcgacggtggacgtgaagtgccaactttctgcggtttttgttgcggcatttggcaggtttcattattctacataattaaaaatttggtgaattgggacagtctcaacttcagcgtcagtgagttgaatgaacagctcagcaagccttgccaatttgttttccacgttacaaatgcgctcgccaatttgcgttatttgagacagacaataaatgccatcgcaaccgcttcgcatgtgaggctcataaaatcgctaaaaacggaaatgaccgtcaaagggttcttgccttttcaatgggggcacttactctcttcgtcacgggatcaaaggcacctaagaaaaatggaaaacattaaaggataaaaccaagggcgtagtcaggaaagggaaatccaaaaaaatttaaaaaataataattcaacgaattttttaagcaataattctaattaccttaattattcaaaaaatagactcccaagtagggatttctaaaaaagaaaacaaccccctaaaaacgaccccccccccgaagccaagggtctgctggctacgcccttcacaaaaacttaaacgaacatcgttcggcgttgccttcctctttctgatgcgaatgttggcagtttcgtgagttacaattgtctgctaaattgtccaactgcccatttgaattttctccacttgaaacatcgattatttcatcttcacagcaattttccgttgaaacctgaaaatttaatgaacttgatatttataatgtataaaataataggcaatttgaaatcgttaaataaattaatcccaatataatagaacattcaaaaataccaaaggcgaattctgaaaagcggaactaatattcgaagtatgagcacatgacgaaatcccttccattaattgataaattggaggctccgattgtggacgaagactattttgatcagtcagaaaactatcattttgattgcgggttgtagcagacgcactctttcgcactgattcagagttggaccgtgtcggttttgccaatcccacttcgtttgagttctcatttcgtttttgtttgccagatactaaaacgtcgaattgagagggtcgttggccgagcaaatcattgactattgaattgagaaatgaagatttaatcgcctaaaggaattagtgcttttttcatggggaaaatttaattaaaacctcatcagtcgaattctgttggtcagatggcaaaaatgaagaagaggagcaaggttgaccatccgtcttttctctgtcgtcactctcgtcaaaaattcggcaaatttggttgcaaaaatcagaacgaagtgaaggagaagcactgttgcatcccattctgtcctcctcacaaccggcaaccgccctcaattcgttgtccttttcaggtgaagacattaaatcaaaatcagactttatagtgaattcagttggacatgtattatccatttaaatacaaatattactattttagttgagcctgcaatgctgaaaatcaattttttgcggcgcttttccaaaaaacttttggggaatagggggccggcggtgccgataggcgcggccgggaaaatttttgtaatttttaat

SEQ ID NO: 11415 - DNA, 3426 bp, Heterodera glycines
ttttacccttaattcacctttctctgctccttttctttctccaattcactgattttttccaaaaaaattttctcgatcattttgaatttttgacaaatgatctgcggtagcttaaaaatcgaaattttattttttgaaattttccctcaccttttgtctgttctttttgttgcttttccatttcactgattctttccaaaagtttcttgtgatcattttgtaattgtgagaatcgttcctcaacaccagcttaaaatataattatttaataaaaatggatgacaaatgatattttatccttttaagaatatttaatgccaactaatgactgattttgaactccgaactcgtgccactgaactataaaagtgccaaaaaaatttacataaaatatgttctgttgaagaaataacaaaaaataaagataaaaacaaaacaaaagaatacttttgcggatcactgttctgggttgaacggtctatgagtttattgtcaataaagaaaaagtccacaaaagggaaaaatccgcttacattgaggacaaaaacattatttaaaaatgtcctcaagaaagcgcataaacaattaaaacgagatcatcgccaaaataaaatataatgtgaaataaaaaataaaataaaaatacaataaaataatagtgaccaatcacttttaattttaatgaattaataatttcgactttaatttttccagtctattttacaggaatagagatagtttaaatttatttttaaattgatttaatgagtttatttcaataagccttttatcgagttggttccaaattttagttaaaaactaaaatagggtagggtcgtccctcccccaagccgaaatgctggatggagattaacctaacaataagcaccaaatcggctattaagcagcaatcgatgataaaaaatttaaaaagataaatttacaataaaaaagcttcatttttaaataaaaagcaaaaactggtaaaaaaattaaattttttattctaaaatatttcttttgaaaattaaaattttctctggaaacaaccacccgaactgaagacagaaactacataagtctaaataaaaaagactcgtgtaagcgtaaaaagttgtgagagcttttcctcagcagcttaaattaaagtcgaattaattcaaaaaaaatttaaaatttatttagttttctgcttaccttcgtttgtttgcgtttccctttcttcgttcttttgctcatcttcttcgtctgttggactaaactcatcatcatccgatcctaaaatatttaaaaaatcaaagttttgcgctacttaaaaattggtcacattaattttttttaaaaccatagggtccctttgggttagcatatttttggttcgtaaatttattcccaatgattttcatgttttttgatcgcgtgactttggcatccatttctattcgatttttggttttcaatttgtgatccttcctctcccctttgtgacagtataattttgatactgtgttcctccaatttcctaccgtttccgtcttgtccaaacaaatcagcagaacttgcgattgatggttccgctgtgttagctcgattcagctcagcaattctggcaatcagaacactcatttcctccgatgtgctcagatttggaaaaattgctgaaaataaaataaataaatttattaaaaaattaattattttaaacaaaatattttacgttggagtggagagaattcgtccgctgacgaaaaagtggtggttaatgatggcattttattttcaaaatctaatattggaatcgaattttgtttttaaaaagaatttaaggttaagaaagtcaattgctgaatttgcttacatatttatacgccaaaaagtaaataatttacggcaaaacgatgacccaaaaatggagaaagcgatgggcaaaaaaagataaaagaattatcgttcattcatctttgagtgttcggcaaacaatgttccaaaaaatggcacaaacaacagaaaacggcaaaaaaaaaagattgggatataaaataaacaaatataaaaagattggataaattgtagtgaacgccaagggaaaaaaagggtcaaatgatataccactctcgaggagctaagcacgaaaaaatattttcgagttgcggaatgccaaaaaaccggtttttgagccggttcaaaactcaaaaattgagagatttggaactataactttttttaaacgatcgaatcttgacaaattcagtaccattcggtaaggaacataaccaagaggacaaccgactggattatggatggtggaattttttgcagaataatatttcgattttaaataagcttttatattttaaacattcaaaaacccaaattacaattgaagaagaaaagcataaaaaagaaacgaattggtcaacaattattgtatgttcttcatccgagtttccaaatcgaactcgaaaaagggcataaatttcgcctcaattttgtcatcaaaagtggccaaagtaacgaatggataaaatgaatcatcagcaaaagatggagcaaagagaaaattagaaaaatctgtgaaaagtaaagggattttctgtaatttaaacaaaaatcaatagcataaaattttaatttaaaatttgtttaattatatatttgtgccaacccaaacgaagtccattctttgtaaaaaagatctgtcgcgtgatggaattaacaccaattcctacagtatcgccaatacagtaggaatattcgacatttgcttcctttaattcttcgttaatccaaacacagccattactttcatatgcataagtgtcctttttatgtcgcactgatttatacgattcatctgtctgctgtttaatggcgaatccaaagctaaaaaggagagagagagagagagaaaagggtaataagcagggaacggatttatatgtgctaaaaaacgccaaatatatccattttggccaaattccaaaaataggaaatttaattctccacaaaattcaaaatatgtaacaagtaaactacaaattaaaaaaactttttttatgcttattgcgctaaaaaaccagcgcacactcgactacggcgaataaatttttttaacagaactctttaaaaataccaaaaaaatttccggcgccggcccacaaattctcataagatttcaaaattgaagcgaaaattgtccatttttcagtgaagtccaaagaaaaatattcaaaactctttttttctaacgcggcgcctatcgcggtaggggcagaactcgtcaggccaattccgtctcagcaagttcaaaaattattatttttttgttgataaaaccaataaaataaaagcatttaacttatttttcaataactgaggccctgtaaaaaagagcagttattattctcacgaaaaaaaaatccaatt

SEQ ID NO: 11416 - DNA, 1739 bp, Heterodera glycines
cgaatcccaaaaataaaaattttcagtaaattttttgaaattttatgcaattttcgtaacaaatggcattaaaattttcaaaatttttccctgaggctcctaacggtaccatcggaccccccattttatcatatttttgaaaaatggagaccaaaatggcaaaaaatagtaattttttggtgaaaaacggctaaaaatttttagatttctcgattttcgattcccgagtcgagaaatttctcgggttttttgggttctcggttctcgtatcgtttctcggggtcatttcccggtctcggttctcgtttctcggtaaaaatattttctcgcacatccctaatatttaccggtaaaaaaggaaaaaaagcggcaaaaaattttttttattgttaactaaatttttgcataccgatagagaaaaaaattaggcataatgtaattggcgttttgtttttacgccaacgatttttgccagattttttacttttttaccgtccatgggtaaaacataattttttgggttttatttcaacacatttgctttttaagctagattacacagtttctaaccatattctgttaaattttcaaaagatctaatttttgataaattttttttatcattctcggcaaaaacgaatattatattcttgatcagcgacccttaaaaccccgatgaatatgttttcagggccttggtacattaaaaaataacatttcttcaaaaaaactaagttcgaaagaaactttgaaaactcgaatattttaaatgcaaattctgtcttacattattcaaaatcactagggccgcgacttttagtgacaaaaatctctaaatagttaactaaaatagtgagtaaaaatgccaaaatagtggcaaaaagtccgaaatagtgacaaatagtgacataatttttggccaaaaattaagcaaaaataatttttattcaatgactgcagttgcaaatgaagtgcatttcctttctaatattttcttagcaaaaattgacctttttttaaaccaaaaattttgccaaaaaaaaaaactttgggatgaatttttgagaaaattttccaaaaattttttggtattatattaggggtgtattttttgaaaaattttttaactcgattcttaaatgtccattttttgattttattgcattttttcgttgccggacgaatcgtcgtcaggacgaatcatcactttttctgtttccttaaccatctgttcctttatcaaatttattatttaaatttcttttcttttcatttcattttattccgtcctcaatttttttaatgtttggccaaattccttttttaactcataaatttgtttatgtgttagaggttataatttaaaatttaatctttattcttcagcaaaagctttaagaattaattttttgaatgtgattaatgcatttattgccatttgagttttttgctcctatatccttaatcattgctttttacatttgaatttcctgtgttcgttatccaacaactataaatttgtaatattaaataaatctttgctttttaattcttagtcatttttagccataatgaatttaaacgaaattttaattcatataaagctgactatatatacgtgtatatagcttgttttatgtacattaatttcatcccaaaattaatttcaaaaattttcaataattttagttattctatgtaaagcaaatgaatatgcgggtcaatggcaattcgtacaa

SEQ ID NO: 11417 - DNA, 3224 bp, Heterodera glycines
ataatcatcgaatcgcgggtctcatggcaaaatgggagatttttaattttactcattaagcagttaatcatttgtagaaaaaatcggcccggacccggacccagtcctggattttgacgaaattttttttaaattattcaacaagaataaaataataattccaattcggaccgaatcgcacaaatttggagatttttcaattacacaatttaagcaattaatgatttgttcttgagtacaaaaaacttaatttattggcttttgacgcccttttcattagtcatcacttctcaaaatgatgaagcatacaacgagcagcagcagcagtaacagtggggatgccaaggtctgtcctgtcaccatttcttggcaccctttcccaccgccacactaattttgccacgaacgtgtccccattttgtaggacagttcatgccatcgaaaccagcgttccatgtcattgggtggaccagcacatgagtcactgttgtccaagcaacattcctcctcccctccacagacggtggagctgagccgggccgacaacggtgtgtttttctgtcgaccgcaggcctataaccagaaaaaaaatccgggaggggaagccggagagctttttattttatttttttactcttcggtccaaaatgaactatattttcggtgccgtagaaaaaaaaacgggaaattttggcaattttgagacctaattttggaaaaaaacatgcgaaaattgggacccggcggtgcttataggcgcccgccggggaaaatttagaaaattagggtcaaacatgaattcaatcgagtaaaattttaaaaaaaaacatttttcgcacaaaaaatttaatttttcatttggggaggggggctggtccactggcaaaaattctgacaaattttttttttaatttttactcatcccccctaggcgactgtgttgtgttggttgtggaaaacacgcggttcattgtgaacccggctttgctggtcgtcaaaccggacacaatgctgggacgaatgttctcgttgagggcacgcacgggcggcgggacaagtaaataaaaaacaaattaattcagtttatatataaaaaatatttagcgcattttaaaaaatggcaatgcatccctttttgaaaacaactaaaatttaaaaataggaaaaataaaaaaccactgggatttcaacaagaatttgtcgaagaaatttctcttttttacatttcgacccaaaattttgttagtgaatttttcaaaattttatcccatttacgaatataccaaaattcagagttgaaaaatctcctttttataaaattgttctaacattttgtcactgatttttatagaattcgacgcaattagaattaaacgattttaaaattagacactctgtccgtgccctcgtcgtcgtcgtcggccaatgaccccggcgccgaccgtggctcccccagtgatttggtgcgtcccaacgagcgcaatgagtacgacgtggcggagggactttccgccgcttgtttccgtgttgtcatggtaaacggagacggctttatagccccgatttgttacgcttgactcgcttttcaaggacttttaccaccgtggctttatgcacgtgccccagtccatttctgtggccgaacttcgcgaggtttgccatttgtatgggaagggccctaaaaatggcattttttgtttgattgagtatcctcactcactcaggaattaccctattgtcctaaaactaagatttttgactagcatcatgagtattcgatggaaaatttgattcggaggataattttcttggcattttgccgctgtcgcaataattacacttttttgcttccttaggcatgtgactatctgttggtgccgttcaatgtacacaatgtgaagtgccaagacctgcgcggtttgctgcacgagctgagcaatgagggggcccgggcacaattcgttgtgtatctggaggacatcattctgccacaattggtcatcagtgccgaggcaagttgtccgtgtccaactccgaggggtcaatatgtctccatgccatgctcaaagaaatttcagaggatgcctagaaatatgaagtcctttttctttccatagttagactcggttagttttttgtaaattttgacccagaaatacctaaccatttgagcagttttgggcatgtttccgagattaacgaaatgaggagggcgaattcaagtctttgttttttggtgtcaaaatctacgacgaaacgaagggcttttttgctccttggtccaaaatttttctcaaaaatttttcgtatcacgggagaaaaaaagaacacatttttcgcatatttatattcaataaatggggccatttttattaaaatttttaatattttaaagagttaaggagtccggtgctgcgtgccgattagcaaattttatatgattttaggaaatgtgttttgaaattgatgcaattcactcccccctcccccttggacattcacctgcccattgcaacaactttttacgtactttttctttcctttcagcgtggtgagcgtgagtgtcacattgtggtgttgctggacgaggacgtggtcgactgggacgaggagtacccgccacagatgggcgaagacgtgacccaagtggtgtacaggtaaacgccgagcgcggggcaccacccaatttgttattttactacactcgtgattatggattttcatttcgcaaaaaaaatccctgcatttgtagcactttccgattgcaccccaaaaaaccgtaaactttacatgaaaattttactaaaataaaatttttcgtgaaaaatggttatgaaccgaaaagtcatgtatttttggcactatgaaacaacaaattattaaaaaaaacattttttttattacgatattacagtacgccgctctacaaattcttcaaatatgccgaaaaccgcgatgtggccaagcgcgtgatgaaggaccgcgagctgaagaagatccggcttggcatcgaaggcgtaaaattttgttaaaacaaaaaaattcccgcgaaaactcttttttcccttgctgtaatacagtacccgacgcacaaggagaaaatcaagcggcgcttcaaccgttccgaagttgtttacaactatgtgcagcgtccatgtacgttttctggacggtgtaaaaattatttttgaattgttgcacttttttattggtgcatattttca

SEQ ID NO: 11418 - DNA, 1392 bp, Heterodera glycines
atgttattttcctgaatttttcgttgaaaaaatatttttctccaattttttgaattttcggtgggaaaaaaataaacaaattaattgactcttaacacggagactgaacttgttaataaattatgattttttatttcccaaaaaagtgacgggtctgtatttttccccttaaattttacattttttacaattcgctttttttaaattgcccctcccctccctttgccaatgtcagtcctccactgctcctgggagaaggaggaggcgcgttcccgccacgtggactttgcctgcccaattgtgaagagcaagtccaacccgagtttggcttccgccgcctccgaccctttgccgcaggtgccattttcagaggagacaattttttttgaaatctgtgccgttttcttacaattttcaaaaaagtgatttatcgcttttaaaagtaaattcaacaaagcatttgagtgctttttaagcctgcgccgttgcaaaacaacatcaacaatgggtgggcggcggagaatggtgccggcgaacattcggccaatttccagcaacggccgacgaatgacaacgacgggagcagcggaaatgagaatgaggccgttcaccacccaccaccgccctcctcctcctcacagcaccaccaccattcccaacaaccgttgttcctcaatgtcggctcggcaccacccaactacggtcacaacggcaacagtaacaacattggcacaacgccgcagcaactaccgtaccatttgatcaataatggggcaggcggcacacagacgacggtgagtgtgctgaagtgatggggaccgggacaccactggaacgacgcggattttccgggatatataaaagcgaattccaccggaatttttaacaaattaaaggagccggtggggtataattcccccccccccctccaattttgagttaggattcagccaattatgctgtttcttgcatttttaagcgtcaaccattgcgctctccgcccgcaaacgtgcagaattcggcagcggatgattgaggcttaatggtttctgatgatatttttcaatttccactcttctgtctcattttgttcctttgacgcatttattttctatgcattcgtaaattgaaatttgtcataaatgaagcaaaagccattgaaggcatgttccgcgtattgatgggccaataattaagcataataatactggatggttgactaattagccgaataattaaacataatggaatggaatgcgctcgcagatcacccggaacagaacgcaggagaaaacaattttctattttatggtaatccttcagaattgcggtcccgacgaaaaattaattaaaaaattttttttttagttttttctagggtgaaaaatgtgc

SEQ ID NO: 11419 - DNA, 1052 bp, Heterodera glycines
cgccctagaaaaaactaaaataaaattttttaattaatttttcgtcgggaccgcaattctgaaggattacctattttatttcatactttgtttacactttttgaaataaagtgagagtgatcattttgtgacttttgaaaacaaaaaaaatcaaaaaatggaagggggagcaaagcacgctattaccattgttcgatctggtgcgtgatatgaatcactatttcccattttggtatcttttccgtatgtatttaaatgcatttgtaattgaaacttatcaaaagaaaaagcatggataaaatgaattttcttttcgaaaaaataataaagtaaaatacgtacaggttaaatgtttaagaaattaagattaagcagaagattgatcatcggcacttttctccgtttttcgtttaatcgctttcactttcttcctcgaattttccgttgaatgctccccattcgccatttcgtccaacccaaccttccaaatctgatcatccgccgaattccaatggaaagactaaatcaataaccaaaatcactgccagcgtagtggaccgattagagtacgctacactcccccgtgtcgtctctcttcccccgaaaaaaaggagttaattttttaacaaaaaaactaaaaatttctaggaaaaaatagaaaaattttaatagccaatttgcgtcgctgatgggggcggctactgggccccataaaagcaaaccctgaccagcataaaccggtacccatcattttatacattaattcgtgaatttaaaaaaattgaaaaattttatgtttggcttgaatctggctggatccatgcttggatttcgtaggtcagtacccaggccatttttggcaaccgggattttatccagaaatccaggaccatgccttttttaaaatgcacaatgttcatgacatatgttaagttttcgcaataattttgctgtccgaagatttgatcaaacaaaaaaagatatttttacaaaaaaaaaattatttttaactaattaaacggacgaagatgatttaaaaatatctcccgacc

SEQ ID NO: 11420 - DNA, 1874 bp, Heterodera glycines
  misc_feature (1749)..(1749): n is a, c, g, or t
agcagatttgattgaaaataactgctaaattctggatccgacaataaaaaagtgcccttccggctcaccaatggcgtgccgtccagacgggcacgtgaaatgcgaacaaatgttgctgtttcatgattggcacattcaaacgcgccaaatgtgccgggtgtggcgagtgccaaaagcactgcaacaaatggcaccagcgcaatcggtgccggaggggacaaatgccgaggacgacggactggtgccgatgatgtgggtggtagtggtgccgaacacgacaatgttctgttgttggcacgacgcattttcccggattgagagaaattattcggcgcgacctttcgagggcataaaattgtcgatgaatttaattagacaagaatttcggggataaaatgggtacaagaataccatgggatttgaaaacggaaaattcgctggccgcggcacgtcaaatgagagaaatagtaggcaaaaaaaaaggagggattgatctgacttgcactaggggttgtcccaaacgaagcatcattatcactaataatggatgcgcgaatttatgtgtcaagggaaaaccctcctcccggaaaatggggtcgagtaaaactctatactgtaacatctgtacagtattattgaccagttctggttggtctacacttcaatgaagggtaaacccctgcctgaatcgggaacatcccgatttattgagtcccaatcccgattctcgacataaatcccgaatccatgtcatagtgccggaggcttaaaactcgcctcgcacattcacaaacgaatgttgtgcaaacggttttccgtaatgggataagacggtggaaggggaaggaagaggaggaggaggcgaaggaatgggaacacagcacaaccagagcaaaggaagacggaggatgatgatggtatggctgtgaccgcaacggaatggaaggggggggggaagaatttgggtcataaacccccgaggggttctcatgcccaacggggcgggagggggtgggggaggaggtgtttcgcagcagtaagtggataataccgccttcggaagacactttgtgtgttatagagagatgctcatccgactatctcgaatttacaccgctattttggcgggatttacgcgaaacttcgtaaaaaactggcacatttgccctaaggccacatgattttcgagtgtcgagaatgggtgggtcaagaggcgggagacaatgaattagctagcattatattatgatcattattgcctccttcatgatttacgctcttgaaagcaccaaactagatacaaaaacgtgatgcgtgttactctcttctttttactattgtcccacgcaaccctctatcttattggctaatttatattcttattaataatatattatttaaataagttacttgtataatatcaactttacaatttaataaaaccgaaacaatgtataaatatgtttataagatatatattttcgttcatcacttataccaaaattaactatattaattagattcattaaatgtatatttaatttttttcatttctcgaacaatacacaaggagctgtgcactctaacagtggcgtgaacacaaaataaaatcaacaatttaaaataacatattaacagtagtcaaaactcccataaatatgcgtcaaatcgcaattctgatttttttaaaccatttattattgtataggaattaattttgtgttatttttttaaaatctttactcctgntcctaattgattaaaacactaaaattagtcacaagtcattggaacaccaaaacgtgttcagttgtcccgatacggcaataaaaaattctatttggaagattttaaattttccgtttttatactcc

SEQ ID NO: 11421 - DNA, 1820 bp, Heterodera glycines
  misc_feature (56)..(56): n is a, c, g, or t
  misc_feature (71)..(71): n is a, c, g, or t
tgtagctgcactttcttgcactgctttgggtccaattcaaaattcaaaaatttttntaatagactgaaatntaaaaaataaataaattcgtgcttttcgcatttttccatcccgatcaaaaagacaaggaaaattttgaaaatcattcccttgcagaattttctgtttcattctcgagacgtgtccaattaggtgaaaagtcaaattttcaacggcacaaattaaattaaattacttttattcgtttttatgtataaaaaatccacgtccaaaaaaggtaagcaaaacaaatgtgtatataacacagagaagtgcgcaatttgatcaaacatgagaagtacacacaatagacgggggacgtgtgccacaaaattggccgtacaaaagttgtgaaaaaatcgcgggaatttttgagaaattttaaggcttatgttagccaaagagatccggatttcagctgttgaaactcccaaaacttcccacaaaagttcacaacaaaatgagatggtcaaacggtaagagaatacagtaggaacaataagtatatgtaaaacaaatttaattttgtatttacgttacggtatcaccgacccctccgactgtggaatgggcaattattaatttacacacaaaaaacattgggctcataatttaaatgcctctaacacgaggcttacaactagcagcaatagcttttgtgaacatagcggtgccaaaataattcagaaaattttttcaaagtacgacccctgcggcgttccattttttgtcctcagtccacaaaaccataataaacaaaaagcttctgtaaaaacaatactttatatgtgatcgataggcggggcgacacagaaaattaactctttttaaaataaatattccaatacaataaaattttgttgcagcacaaaacagaacaaaacataaacccataaacggggaggaggggaagcatggcgacggcatatttaacgaacaaacaaaaaaatgatggcattttatgagaagtgagaggggcgggcatttatatgtgtaaaatgtggggtgatcaattttgttgttgtttttgtacgagcagttcagcagaagcacacatatatttatatagagaggaaggaaagtaggcagctttttgaggtaaaaatgtgtagtcgtcaattgaaatggtcggatgatgatgatcagcgtccaaaatcgtgagaagaaatgatccgatcagatcagcagagagtgcagtcagagcaggccgatcagtcgcaaattctccttgacgatgatgtccgtgacggcgtcaaagacgaacctgagcaagggggtgggaaatgtggacgatttgggaaataatctgttgcaataaaacacaaatgaaataaaaataaagagtgaaattgggccgggccaagaaaccgagacttttctctggccaaaacccagcagcaggattaagcatatggctactgtttttagattgtgggtcgagaaatgttcgaaatgaaaaaaatggcattttttgtacgaaatgccagtggtccatctgtttgcaacggtagaatatgggaaaagcatgaaagtgctgaattccttgtgtaacaatcccacaaaatatgtcggactaatattcgagttttaagcaaaagcatttcactcggctgaaactaaagcgagagaatggtcgtatttgacagcaagagacagagacccgaaattgttattattacgtctttccaaaatcccccccctttcataatataagggataggatagataaaaagcggaaaagcaaagacagagcgttcacaaacagacagacatttaattaa

SEQ ID NO: 11422 - DNA, 1876 bp, Heterodera glycines
ggcatcattatcatcatcattagcaacaaaatgccaacaacaatgaacaatcgtcatcagcggcaccaataaaaaagcgagaagcatgcattcaaaacagcaggccacactggcgcaggttctccttcacaatgatgtcggtgaccgcgtcgaacacaaacctgatgtgttggtgtcggtggcgcaggtgaagtgcgtgtagatttccttctgcccgtccttccgcttgttcaacgactcgaactggtactgaatgtaggtggccgcctcctcgtaagtgtttgagcctgggggtgaaacaacaaataaataaaaatccagacgaattaccctattttttaattataaaataagaaggacaaattttttgaattctataaaaattttttgcttaattttatttacaaagagttttccccgagtccctacattttttgcttaaatttgacccaaaaatcgttcaaactgagcattcttgagtttaaatgtctgctaatgagttcactgaaatgccgcctaattaattgcaaatctgaagtctcttttttcttttctttttttttgctcttcgagctaaaacttttttcttcagttttattgttcgaaagttcagcgcgggaagaaaacctaggtattttttaaactaattttggttgaaaaaggaaattttggtgcttgatgcctgtctcaccggtgtattcggggaagcacagcgtgagcggtgacctgcgaattttctcctcaaacaggtccttcttgttcaggaacaaaatgatggacgtgttcagaaaccatttgttgttgcagatggagtcgaacaacttcatgctttcaatcatccgattcttggcgggacaaaaaggagtcaaaaaaaatttaaaaaatttccaaaaaatttgctaccatttcgtcatcctccgccaacaccatgtcatattcggagagtgccacacagaaaatgatcgccgtgacgccctcaaagcagtgaatccacttcttccgctcacttctctgccctccgacgtcgaacattctgccaaaaaaggaggcatttattttttatggcgacaaaatttttgaaacaatttagggctataattttggatatgtttaaaaaatccattccaggcccgtaaccatgggagattggttggtaattacttgtccgaaccgtggactgaaaagcctataaaaatagggggtgaaacagcgaaaaatttacgtcgatcgtcgaaatggaaagttttttcacatttaaaatttcccaatagaattaattgacaatagacaattttcctacagcgaaccgtatttagaatacaatgaaatttgttagaaaaatggaaaatttacagtccattgtaaaatgaatgcaaggaatcaaaatgaaaaaaccacgatttaaaaataaaattttgcgcccacttgaaattgagatccttataagtgaaatgcgtctccacaatgcccgtcgttttgacccgtgtgcggagtacgtcgtcctgcgtcggcacatagccgggctgtgcaacccggtccaacgagttcaagtagtaggcagccgagtcgttcagttggtactcacgcgagcgctcaaagcactcctggacgcctgtgtcggcccacaaatgtttcatcacggaggccaactccaatggcagttcacctgtgtgtgtttatttaatgaatatgttgttggcggaaaaaatttgccattttggtgtttacacttttataggttaggggttgacaaaaaatctgttagattagggatgaaaaacccaaatggaggagaggacaatttgcaacaaaaagaaaaaatttgaagctaataagaattatatacacattttaaaaattacttatcatgaaaata

SEQ ID NO: 11423 - DNA, 1947 bp, Heterodera glycines
  misc_feature (43)..(43): n is a, c, g, or t
  misc_feature (49)..(49): n is a, c, g, or t
  misc_feature (51)..(51): n is a, c, g, or t
  misc_feature (54)..(54): n is a, c, g, or t
  misc_feature (61)..(61): n is a, c, g, or t
  misc_feature (72)..(72): n is a, c, g, or t
  misc_feature (85)..(85): n is a, c, g, or t
  misc_feature (90)..(91): n is a, c, g, or t
  misc_feature (93)..(93): n is a, c, g, or t
  misc_feature (96)..(96): n is a, c, g, or t
  misc_feature (98)..(98): n is a, c, g, or t
  misc_feature (103)..(104): n is a, c, g, or t
  misc_feature (106)..(107): n is a, c, g, or t
  misc_feature (112)..(112): n is a, c, g, or t
  misc_feature (115)..(115): n is a, c, g, or t
  misc_feature (119)..(119): n is a, c, g, or t
  misc_feature (125)..(126): n is a, c, g, or t
  misc_feature (131)..(131): n is a, c, g, or t
  misc_feature (133)..(133): n is a, c, g, or t
  misc_feature (136)..(141): n is a, c, g, or t
  misc_feature (143)..(143): n is a, c, g, or t
  misc_feature (145)..(145): n is a, c, g, or t
  misc_feature (155)..(155): n is a, c, g, or t
  misc_feature (161)..(162): n is a, c, g, or t
  misc_feature (167)..(167): n is a, c, g, or t
  misc_feature (176)..(176): n is a, c, g, or t
  misc_feature (183)..(183): n is a, c, g, or t
  misc_feature (185)..(185): n is a, c, g, or t
  misc_feature (191)..(192): n is a, c, g, or t
  misc_feature (230)..(231): n is a, c, g, or t
  misc_feature (234)..(234): n is a, c, g, or t
  misc_feature (252)..(252): n is a, c, g, or t
  misc_feature (255)..(255): n is a, c, g, or t
  misc_feature (283)..(283): n is a, c, g, or t
  misc_feature (291)..(292): n is a, c, g, or t
  misc_feature (297)..(297): n is a, c, g, or t
  misc_feature (313)..(313): n is a, c, g, or t
  misc_feature (325)..(325): n is a, c, g, or t
  misc_feature (331)..(331): n is a, c, g, or t
  misc_feature (339)..(339): n is a, c, g, or t
  misc_feature (342)..(343): n is a, c, g, or t
  misc_feature (347)..(347): n is a, c, g, or t
  misc_feature (350)..(351): n is a, c, g, or t
  misc_feature (357)..(358): n is a, c, g, or t
  misc_feature (369)..(369): n is a, c, g, or t
  misc_feature (372)..(373): n is a, c, g, or t
  misc_feature (378)..(378): n is a, c, g, or t
  misc_feature (381)..(381): n is a, c, g, or t
  misc_feature (385)..(387): n is a, c, g, or t
  misc_feature (395)..(395): n is a, c, g, or t
  misc_feature (400)..(400): n is a, c, g, or t
  misc_feature (404)..(405): n is a, c, g, or t
  misc_feature (408)..(408): n is a, c, g, or t
  misc_feature (414)..(414): n is a, c, g, or t
  misc_feature (421)..(422): n is a, c, g, or t
  misc_feature (432)..(434): n is a, c, g, or t
  misc_feature (436)..(436): n is a, c, g, or t
  misc_feature (438)..(438): n is a, c, g, or t
  misc_feature (461)..(462): n is a, c, g, or t
  misc_feature (477)..(480): n is a, c, g, or t
  misc_feature (482)..(482): n is a, c, g, or t
  misc_feature (485)..(488): n is a, c, g, or t
  misc_feature (504)..(505): n is a, c, g, or t
  misc_feature (508)..(508): n is a, c, g, or t
  misc_feature (519)..(521): n is a, c, g, or t
  misc_feature (529)..(533): n is a, c, g, or t
  misc_feature (536)..(536): n is a, c, g, or t
  misc_feature (545)..(548): n is a, c, g, or t
  misc_feature (556)..(556): n is a, c, g, or t
  misc_feature (561)..(561): n is a, c, g, or t
  misc_feature (563)..(563): n is a, c, g, or t
  misc_feature (566)..(566): n is a, c, g, or t
  misc_feature (569)..(570): n is a, c, g, or t
  misc_feature (572)..(574): n is a, c, g, or t
  misc_feature (576)..(576): n is a, c, g, or t
  misc_feature (579)..(580): n is a, c, g, or t
  misc_feature (584)..(584): n is a, c, g, or t
  misc_feature (586)..(587): n is a, c, g, or t
  misc_feature (593)..(595): n is a, c, g, or t
  misc_feature (597)..(598): n is a, c, g, or t
ggatgccaaagaaaaaagttatagcgaaaacctataaaggggngaaaancngcncacaganaaccgacaagnacctttaaaacgnccatnngncgncngaaanngnngaaanaancccnaaaacnngggananccnnnnnnancnccactcttanaaggcnnagaanccaaagggncgaaaancngcgagnngccaaggggaaagaagcgcaacagcaaacggccgaacnngcngagcaggaaggggccgangancagaaaaaggcgcagcaaaaggacccancccgcgcnncggcncccaaacggagggaangggccaagaaangggagncaaagggnaannaccnaannaggaannaagcacacagnaannaaacnaanaaannnccaggganacggnacgnnagncaccanaaacaanngaagaaggcnnngngnggccaaaaaaagagcggcaaaannggacccacggagaannnngnccnnnncagcaacaaaccggannccncgcccgacacnnngaagcagnnnnnggnaaaaccaannnnaaaaggcnaccgnanccnaannannnanagnnggcncnncacaannngnncaaattggccgaagcgcgcaagaattgtttgttcgtcgttttggagctgttttcggacgggcacaaaaagacgcaaatgccgaaagtgatcagcaattcgttagatgttttcccactgatcggcgcgcaactgatcaaaatgagcggtgatcaattggtgacagacgattgggttgccaaagagacgcaaacgttgggcgtgtgcactgcgcgggtgggtgaaaaaacatttgggcatttttgtaaattccgattttaaatattaccatttcagtcctctgactctgaaaagatcccttctgctgctgaccaacttttatggcccggtcatttgccgtgtccttgtgccaaaaaattcggcggcaaatgcccaaacggcgaccatttttgggggtgtgagcaatgcggacagactttaaaatttgcgaaacagaagaatgacgacatggaacagaaagtgagaaagtgccgtcagcatataagcgccaaatgaaccgaaaattatcacaaaatttggccgttttaaatttataatggccaattgaaatggccgtttctttcgtttttgaatcgcttttatgccattcactttcatttgatcatttgcccccctccaacaggctccgatcagtcatttgttctgcgactgcggtggcactcgtgtcgatcacttgactttccgttgcgccttttttgctgaccatggcgaccaattccatgcgtttacatcactcgattttctgaacagagaattggagcggcagagcacaaaggacatagtgaagaaccttttgctgctgggcaaaacgggcaacggcaaatcgacactgatcaacgcgatgcatttttatgcccaatttgacacatttgaagacgcattacaggtgagtagtgattgctgattattgcaatacaatgatatagaaaaacaaagttatgctagggctatcaattttatgtaaatacatattttttcctggctttttagtaggaaaaacactttgtttttttgggtttgcgaacggaaattttttggaaatcctcaaaaaaaatcaaaaattttggcaaattttcgcacatattttcatttttttaatgttttagtatttttgaaaatttagtgatttttttttttgaaatgtacacttgagatataccaaaaagtaattttttaagtgctaaaatgtgattctaagctatttaggttatttttgtggcattttgtgccctaccgtatatgctctaattatagcccagtctctattaatcccgcagtctcaattatcccccagtctacgaggtgtttttgaaaataatccctctatcataatcccccagtctctaattat

SEQ ID NO: 11424 - DNA, 975 bp, Heterodera glycines
gacacgcgtggcaccgaaatggacaaccaaaacatggccaacacgttcggctttctccgtggctatgatgcgttgcacggcgtcggcattgtgctgaaagagaacgacaaccgtgccgacgcttccttcaattactgcatcaacggccttctgagcaatctgcacaaaaatgtggcacaggtgtgcttttggcacaaagaccgaaactttaaattttcgagttacgcatttttggttcaaaaccggcttaaatactagtacaaggaacccattgaaagtcatcaatgtttcaataaaaaatttcattttagagcaaaaatttgaaaaatgcctgcttcttagtcgattttgtttaaaatgatcaatttttatgatttatttctcttttgccggcggcaacaatcccaccccttccctcttttttcatgtaccttttctcaattttgcagaacatcgtttttctgatcacccattcgtcgggctcgggaaaaacaattgccctgttgcgcaggctgctgaaaccaattgaagaaaaggccggcgtaagtatttaatgttcttacggctgctgtttttaaatgcccatggagctacggcaagatttttgatggacttttaccaaaaacagtaaaattacactatttttgtcacagcaattactcattatccggcttcatcccttgttatccaggtgaaaattccattgaacgaaagcaacgtgttctcctttgacaatgccccgtttgaagcgctttgtttgatcaaagcgatgggtgtcgaatatgacgtggaggaaatggaagaattatccagaaaatggaccaaatcagtgcagcaattcaaacggttgttgaagcatttggccactgtgaagccccatttgactcgggaaacgttgtcggtgtatgccgcgcgttgtgccattgccgacattatgccaatcattgcatcaaacggggagcaaattcaagtgaa

SEQ ID NO: 11425 - DNA, 2314 bp, Heterodera glycines
  misc_feature (29)..(29): n is a, c, g, or t
  misc_feature (31)..(31): n is a, c, g, or t
  misc_feature (74)..(74): n is a, c, g, or t
  misc_feature (187)..(187): n is a, c, g, or t
tgcaatacgacgggaggcgaaattcccancnggaagctcagatggtgcaaggcgtttagaaacagagacagatnacagaaaggcgctttttgttttggtcgtggattgttgatggtgaaccgggtgaaaattgcaaggtgtgaaattttgggagacgcttccgaattttttacacctcgaaaattgntgcttcttctgacatgcattttttcttagagaattttctataaaatttttttttttgcttttttcttgaacaatttctaagttagtagatttttttaatcaaaatttttcggcggggggtggggacgatgcgtgtccagacatttgcggcccgacttttgcggccccgacatttgcggctatgtctaaaatcgggttcaaatctgagttttttcaatccctaatagcctaaataacattaattaaatgataggaagagattgtgtcggataattaaatcaaaattcaactttgagtccgattttggacataggcgcaaatgtcggggctccgaacgattaggggggaatgatacggggaggggaacaagctgatcccgatatgcacaacaccagtctaaaacaaccaaaagaactgagaaaattatgataaaggcgaaaaattaaaattgtaaatttcaagcattgcaaatgcagctataaagagcatatgatcgtggacactgaacaagtcgtgaaaaagaatgttgtggccgactcggctttgttggcacggatcagcgaaaagcgcaaggaactgagcacgaaagaggcattcaaacagcaactgattgaggaacgcgacttttgcttcaaagaggcgggtgtcatcaaagggggagagagtgcgggaaaacacgggctttatttagctaaattttaagattttcactggtaccccctccaagacctacctcactaaataaaattcatcgcgaaatttttctgaaaatccacaaaattttacaattttttgtggaaaacaaaaatggtatgaaaaaaaggtcgtcgacctccctcaaaacgtaatcctaggagtatccctgtccaacccccttctataccgaatactttttttaaaatttttcggaaaattatttcagccggccaaatggttctcctttctgaagtcgtcggctatgaaagcatacaacgacaacatggagagatacatcgaattagcaattcaagacgcagagctgagagagacttccaacgaaggccaatcgaactacgaggagcaaaaaaagaggaccgacgggacccgagtcggttcatcagtttagggcagaaaaagcatggacgaacctcacatctggcataaaaaaatagttgcagggttttgttttagggaaaaaaagttttcctgaagagatgatgaaaaaattaaaaattcaaacaatttctttttgaatatcacaccgttttaaacaactttggcatttttcctccggctttaccacattttttgtaggcaaattagtgacgaaatatcaataccatacaattttttcagaaattgttggagttttaccgcaaagagcgcgacatgttcacagagggactggagaaggcttccgtcaacgtggaggagttcaaatttccgaccgaaaatgttgaacaaatttttgacggacttttcgcattggaaatcaccggcaaacaaatgaaggccaattacgaaactacgaaggaggcgcagcgagagcatcagaagcaatccaatgccgaagcaatgcgcgcacaaaatttggtcaaggcaaagccaacgaaatgccaaagtggtgggttggcgtggcgagagtcttgaggccggatttatagttgtgcccgagactgtttgtactttcatttaattctcgaagaagtttgcagtgccgttcaatgaattatttaatttgctattttattttaattgctttcatcatttagcgtacaaccaaaaggcgattcagtgctatttggacgaaatgactgagaaaggccaacaacagttgggccagggttggaaagcggacggaagtgccgagtgggtggataaaataaaatttgcgaaatatttttattgtttttccagggcatcgtccaatgttgacatgactgatggaggggaaagcgaaggtgagaaaaagggggcattggtaaattaaaatgcaaatggcacagagaatgtgtgccgtaagaaatcggaaaacggactcaaagaattccttaacttaaaactagggtaggtcgggactgggaattttgggcaaagccgggaccgagacatttcgagttgaaaaaccgggactttttggctgggaaaa

SEQ ID NO: 11426 - DNA, 3054 bp, Heterodera glycines
  misc_feature (44)..(44): n is a, c, g, or t
  misc_feature (71)..(72): n is a, c, g, or t
  misc_feature (125)..(125): n is a, c, g, or t
  misc_feature (132)..(132): n is a, c, g, or t
  misc_feature (207)..(207): n is a, c, g, or t
ctcgcatggctgccactgggtggcctaatttttcattttatacntcagcttctcttcatattcattcacanncaaataattaactcccatggctggccaacttgatggcattacttttcattttntattacntctcattaagtcttattgctgccgccacttttattttcctcgtcgttgtaattaatttcttatttataactcgcncagccggagggaatgaaaattattattcttgacggttgctgtttgaaaaaatttcctatttgtttcagattttgttttttatagatttgtcatctgctgctgacagaaatcctcaagagtcggcatgtttacgcattggaaaatttgggaatgtttgatcgacaacatagtggtacagcttaaatattcgtgaaaattcagggattttcgtgtaaaagttcttttttaatttatcaagtaaattaatttgaatactattttaaaaattagaaaaataaatggaaatgttttttacaaattttcgggaatcataaatggtaaattttaaaaattgcagttaaattcatcaataaatgaattgtttttcataaaagtaaaagctaacagaattctgaaattaaaaaaatttaaatctcattaaagacaccaacaccgatttggagtgcaattttgctcatttttcaacactgagtaaaaagtaaaaatgattttttaatgtcttttagttcatttttttatgcttttctgctttcatttttgcattattttttttcttctttcaaacgaataattttttagttagttttagtattttaaggtgaaattaatttaaataaataattgaataattaattaaaattactttggtcagatcaaacaattttttctgaggtgcattattctcttcatcagcagcaaatcttgaataattgaattgcattttttggttattctgcagaaattcactgacaatgcttctccatttgacgatataatcctaaataataatcattaattaattacaccatttagacattttaattggcagccacctgttccatgcctatccgttcctcaaccagtgccatttccccagtttcgtctcgcccactctccggcatccaaatccaccaagttttcggcttcaatggaacgatgccaaagtctcccggcacaaaatcgtccgttttgtacatgccattgaactggttcaacttggagaagcccatctttgccataaattccatgtccaaacggcgctttggctcccaattgtccatgggatgtttgttgttgaacaacattcggtagagcagcaaaccgacgaatcacaccaagtctttccccaatgttgtgcttctgttatcctgaattttatttaatttatgaatatttatttgatttggataattaaatgggttatgatttgttctgggctcataaacagcacatctttcagccaattcatctgctttttttgtctctattctgatgggagtgtcctttcccttgggtctttgaccttttccaccatttcgttaaattcaattttcaaatttcccgctaattgttcgtcgtcaaatcaaattcattttggcgaatcaccgaaaaatgatcaaatgtcaaaatgccatcaaaaattggctcattagaattctgctgcttttttatggaccaattttgtgaggtcaaaacggcaaaaatcaaattcagtgcaatttttgcgattgttttcgatgacactttgtgataaaagccgtgataagccacaacagcggccaaatattcgttgagagggcatttgaactgtggcgttttgtccacccaattcattttccaaatttatttttggtttaataattttcttttcaattgcttctaccgattttttaggcgctgatttttagaaaaatatttttgagttaaaattattacaaaattctcaacttaaatatgccattttatttgtttgcccttactaattcgtcatggattaagttggatgatgcaaatcttaacaactaattttgcaatttcaaacaattcatttttttatttttaatcattaaaataaaaaaaatgcaaaaaccataagattattttccataagaatgattttcaagataataatgaagaaattcataaaacaccaattaaattacgaatttaattattgtttgggcgctaacataagattattttccattatgatcttattctgcacaattcatgatgatggagtttttttgggtacttttcgttatgcgtacacagggccaaattttaaaaaaatgcaacaaaggagcgacgtttgccttcgcacataaaaagctaaacaatgatgaatataaattaataaacattagtaaataaaataaatttaattaaaaacataattaatttttacatgtttctgttttggtagcaccgcaggtggccggccacgcattgttagagacggaggcgagcattaattaatgttaattgcactctcattagcgataataatggcagttcattacatggcctatttccaaggacatccttggaaatacaaaggactatttcctcccaatcccacaacccaatttaaatacttgaatactgatttaaatcattgatttcacttcaaaggcaatgaagctacttctggatgagcttgtgccaatttgtgctgtaccaaatttgccggaagcagccaaattgcttggcaaaaacaagccaatgatgaaggcgaaatgcttaaacaatgccactaattgggcaaattcggagctaaaacagttttgttgaaatgcataattaggtttttaattaatctatttgattaatttttcaggtggacatttgacgaacagtgatcaaagcacggacattttgttcgaattggatggtgccgaaaacttttttcgcgaaaacatttaatgctaatgccaaaattgcacacggcaccggttgtcgcttgtcatctgcaatggccgtgtatttggcccgaggacataccgtaactgaggcagtacagtatgcgaagagttttgttgaataacatattggctactgttgagc

SEQ ID NO: 11427 - DNA, 1076 bp, Heterodera glycines
ttaagaagtgatcgatcaatttgaattgcggtgttggataattaatttgacgtttataaaactgttctttttgttgcggtgatcactaattgtattatatatatatgtgtgtatatatgcctctaggataaattaagagatttctgaaattccaggctcattcttttgggtcggggtcgttttcgtacgagcccaagtttttggctataacttttaaaaaattaatttgactaaaaatttatttcaaaaaatcactaaaaaacattcgctattcctcgattttgaatgtttaaaattcattgttcgcaattttttattttcgtactaagattccggcaatagtcagaagtttgtttcccccattttttttagaaaaaaacataaattgaaaagcactgtaaatgcccgaaatgctaaagctaagatttgacatgacataatactttttaaaaattgacgattgaggtgctactaaattgttaacatatcttttatttcagcagaaaaccacaaaatatcataatggcataacacaaatccaaattgatcagtccaatggaaaaaggataatttttatgtgcgcatcaataattccataattcaaattgatcggatcacttctccacaattcatccatttattcacttctactgctgctgatcacttgggccgggaatttcgtcgagaagtctaaaaatagttaaatacaataaatttgaaatttttgaaaatcgctgacccgtcaccgacgtgatcatcactataaatttcaatgtcaattctgttccactgataataatgatgccaataaatcgcctcctcttcctcttcccattttgtccatttgctttcgtctcgcgcaattggacaacggaccaacagaaaacagtcgtgatagtcagcagttcttttcaatgccaattgttcacgggtcaattcattggttagcgcaaatggcacaacggcgtcagcgaaagacggcggaaatcgaatgacaatgatgaaattgacgggagatgaagcattggaaaaatgcctaaaaatggggggacaaatgaaagtgccaaataaatcaa

SEQ ID NO: 11428 - DNA, 5040 bp, Heterodera glycines
taggataaattaagagtttttttgaaattccaggttcattcttttgggtcggggtcgttttgttccgagcccaagtttttggctataacttttaaaaaattaatttgactttaaaaaatttttttaaaaaaatcactaaaaaacatctcgctattcctcgatttttgcatgattttaaaattcattgttcgcaattttttattttcgaaactaagtgttcggtaatagtcagaagtttgtttcccccattttttttagaaaaaacataaattgaaaagcactgtaaatgcccgaaatgctaaagctaagatttgacatgacataatactttttaaaaaattgacgattgaggtgctactaaattgttaacatatcttttatttcagcagaaaaccacaaaatatcataatggcataacacaaatccaaattgatcagtccaatggaaaaaggacaatttttatgagcacatcaataatttacttaattcaaattgatcggatcacttctccacaattcatccatttattcacttctactgctgctgatcacttgggccgggagtttcatcaagaagactaaaaaatagttaaatacaataaatttggtggaatttttaaaaatcgctgacccgtcaccgacgtgatcatcactataaatttcaatgtcaattctgttccactggtaataatgatgccaataaatcgcctcctcttcctcttcccattttgtccatttgctttcgtctcgcgcaattggacaacggaccaacagaaaacagtcgtgaaagtcagcagttcttttcaatgccaattgttcacaggtcaattcattggtcagcgcaaatggcacaacggaggaagcaaaaggcaaaggaaatcgaatgacaatgatgaaattgacgggagatgaagcattggcaaatgcctaaaaatggggggacaattgaaagtgccaaataaatcaattcaaaatcaccgctttgaagtcttcaatgtcctccgatgccaaaaacgcatcattcatgtccaacggacttctcaacacctttggcacattgttatgaagcggagtgaaaagccatttggccaacgcttgcccattcgatgccatggcattgtcatcggccggaaattcggggaagagatcggcagtggcataaaatgtgacaatgcgtaacaacggacattcgttgagaaatgacgggacgatttgtcgcaaacgatggaaacttgtggtagacaattccaagccatgaatgttttgtccgagcattggccaaatgttgcgaaaaatggagtccaaaatgcgatcactcgtcgcatcgaatggcttcgaatccgacgactttctttggcaacggctttagcggaattggcatcaatttccaatcagaattgaaaatttccatttcatttgatgcgccatgctcttcaaatttgcgcccaatttccatgaagttcaacgtccattttcgagttttgaagtgttcatcgatgtaatagtcaaaacggtggctgatcagtgcaattccgaggccaagttgtgacggctcaagcaaatcgaagacacaaagccaacagtcagcagaaataaaactaaaaaattaaattaaattttcaatttggaaatttattttttatttttacattttattttttggttttttgagacggtcccaataaatccaaagaatggcacaaccgccgacaaacattggcacaccgaagagactaaaaaatgagatggaaaagagtaaatgttgagaagaaatgcgaaaaacgtacagaatcatttttgaagacattttcagggagaaaaagtcggagagagagagagacgaaaacaaataaatggcgaatgaataataatggaaggtagaggaagagcagcaaccacttttatacgaatttattggttcatttgtacggttttccattttctaaatttttagtaattatataacgctctctcccctcccccattttcttccattcactcacttttccttaaaaaacatgaattttactacgcaaatggtgtggcggggggttgggacagcaaattgatcggtctcttctcaacaattcatttcattcacttctgctgctgatcacttgggccgggagttgaatcaagaagcctaaaaattgaaaaagcaatgaccttgaataggaggcattcattcacttaccaatcgccgatgtaattctcagtataaatacgaatgtcaattatgttccattgatcatcaatttgccagttaatcgcttccttttcccattttgtccatttgctttcgtctcgcgcaattggacaacggatcagcagaaaatggcaagcaccgctttaaatgatgcaattttcgacgtccaattctcatcataatctatgtacaacgagaatttgtacatctttggcacattgttttgaagtggagtgaaaagccatttggccaccgcttgtccattcgaagcattggcattgtcattggccggaaattcggtgaagaaaccgccataatagaaggagacaaagcaaagtgatggacattcattaagcaatgacgggacgaattgacgcaaacggcggaaaaaggtggtgttaattgggcaatttgtggcaaaaagttgggcaaaacggtggagaaaagcgatgacattttggtcgatgtatctgtaaaattaaggaatcgttttacaaacaaaaaacattcatttcattcacttcattgaaatggaatcgccaaatttacttgatctcgatgcattcgaatccgatgactttgcgtggcatttgaatttgcggaattggcaaaagtttccaatagtgattgaaaatattcatttccttggtgccatcctttccatttttgctatgaattcgaataagtgccaatgtccatttgcgagttttgaagtgttcgtccacataatagtcaaatcggtggctgatcatcgcaattccaaggccaagttgacgcgggggaagcaattcgaagacacaaagtgatagccaaattaattggacagaatgaggctaggcttataaattgtataattttgcaaaaatatccaaatgagtaagcggcttttgtccttcgtttggattcttttatttgaataaatttgatattattaaaaaattttctgcgcatttgccatgatgaagaaagggaaattatttgatttggtgaaggcttttttagttcatataaatgtatattttgcatggaattttagagttgagcgggaccgggaattttgggcaaaaccgggacctaatcggattgaaaaaccgggaatttcccggtcccggtcaaaaccgggaccttggtactcagttgttcgtattttggtcccggtcaactatagttcattttcttctttgtttgtgataatggataactgagtcccgattaaaaatggacacttcagtaccttggattttttggaaatctttcaggaaatcgttaaatttatcctaatgatttacacagacaaaggttgattgatcattccaacaacaaaaaaggaacatttttcatgagcacgtcaacaattaaatcattcaaattgatcggtctcttctcaacaattcatttcattcacttctgctgctgatcacttgcgccgggaatttcatcgagaagcctaaaaatagaaacacattaaatcctaaataatttattcattcactgacccgtcgccgaccttatcgccaaaaacttcaatgtaaatttcgttccactgatcagaatcttcccaatcaatcgcttccttctcccattttgtccatttgctttcgtctcgcgcaattggacaacggaccaacacaaaacagtcgtgatagtcagcagttcttttcaatgccaattgttcacgggtcaattcgttgatcagcgcaaatggcacagcagaggaagcaaaagaaaaccaaaagacgacaatgaaattggcaggagatgaagcattggcaaaagtctgaaaggtggaaaaattgatgaagaaataaacgcatttttcggtttggggagggcggcacaaaaaatcaaagatggcattttacagtttagatggtccgttggatgcccaataaatcgtgaaaatgtcaaataaatctattattagtaatcaccgctttgaaggcttcaatcctcgacaccaaaattgcagcatccgtgtccaaatagcatttgagcacttttggcacattgttttgaagcggagtgaaaagccatttggccaacgcttgtccatccgatgccgcggcactgtcatcggccggaaattcggtgaagagataaccgtcataaaaaatgacaaaacgaagtgatggacattcgttaagaactgatggcgccatttgtcgcaaatgatggaaatgtgtggcggtaatttcaatgctatgaatttttttcccgagcactggccaaatgttgcgcaaaatgagtttcgagatgcaattgcgatcactgtccgtgttgatgcacaaaatgatttgacaagcggcaaaaagaggacgaaaatggtgaagaaaagtgatgacatttcggtccatgaaactgaaaatgaatgggagatgttgcctaaaaacttttacatttggccatatcttacaagatgttgatccgtttgaatccgatgattttttttggcaacggtttttgcggaattggcaatggaattcctccatcggaactgacaatttccatttgcttggtgccattttctccaattttgcctccaaattgaacagttccgaatgtccatttgcgcgttttgaaatgttcgtccacgtaaaagtcgaatcggtggctgatcattgaaatgccaaggccaagttgcgaaggcttaagcaaatcgaagacacaaagccaacaatcggcggagatgaaactgaaaaaagggaaaacaaaattgaaattggcattttaattttaaattttacattgcttttgccagtttttcctccgcttcttttcggcggtctgacatctaggagggcaaattaacaagacagtttttgacacttttcagtt

SEQ ID NO: 11429 - DNA, 1246 bp, Heterodera glycines
aaagtattggtataacagtttgtttcattcagtgcctttgacattttcgtgcgctttgtcggagaggcacacccagcgttgcgcttaaagaaactgatcgaacttaagcgatttgatgacgcattggcattcgcaaagtcatacaaccttccggcagatgtaatttaatttaacgcttttttattcttctaatttacatgtttcagtcggtgtacatcgaacttttgttatattatcaagagcaaattcaaaacggaaaggacggcacttatgaggaggaaacgtttaaagaactgttgcagactctgcggatgctaagcgatcacaatactgtaaatttttcttttgtgaactataattgtgtggtttatttttaattttacaggctgctgaccattgtgtagcaattctgaactttgtgaaccgatacgaacacatcaagacgattctggacttcgcaaaggcactcaagataacgggtgctaaattttgacgagtttgtacaatattcctttgcttacagatgagtacacacaaaaggaaattgcccgttttcgttatgaattggcctcctatcgcatgctcttcgaggcccatggtccaagctttgaacgcgactccccatggcctcaatttctgtcgagtggcagtcacaaggagttttttgacgcattttgcgaggccggccaaatgacgcaagcccggcttttgctctcccgctattccaacattgggcaggagttgcaagacgaaaaatcaatgaaaagattgctcacggttttcaaatctactcttataggcatgtgcctctttcaaattttttaaaatttgctttccgttcagaaaaaccgcatatcagtggagcaatcagtgaatttgtggaaattgagttggttccgctgcttttaacctcaaacaatgcgctcaacacgaagatcatctgctccactttctgcgatttcttcgtcgacatttcccttcttctcgaacgacttgagccaaagagtttccctgacgcatcgcttcattttgccgagactttcgaccgcgccatttctttgcttcgcgcagactgtcgtacttcggagaaacacgtcttatttgtctgactttgaattaaatgatcgaaatctcaggtcacttttctgcacattctccgacaattgggcgcgagtgaagagaatggtggcctcctttggcatttgaaacggctcattcgaaactgagaaaactctgcaaatccaca

SEQ ID NO: 11430 - DNA, 3112 bp, Heterodera glycines
  misc_feature (3086)..(3086): n is a, c, g, or t
gaaaactttgcaaaaatccacacggttttatcaatgtccgatgtcatattctgaattcttggtctgtcttattgtgagaatggtaacaatcattgtttgattgcttttttgttcagaatcatgatgtcaactccatctgccaccgaattatggaccgaatcaggacgacgtcatcagtgcgtgaaattgctgaacaatttgtctttccatacgttgaagagaatggtcttgacaggaacaaagtgctctacgactacataaaggtgtttgttgtcagctcgaatttgctgattaatccgaaaatgttcagcaaattgcgagttcatactattcttccacggctgctggccaggcgcacacttgggatttgctgtgtttgcaaataaccgagctgatcactgatgccaatgttcggtgtcgggcaatcatcgaaattgcgagtggcgctgtgccgccttggtccccacagctttcgaaggtggtcagcggagtcgttgctcagggagacaaaatcgacccgcaactgtacgtcgtttccattcttggatttattttcatttggttttctcctaggataagttcattgcgcaagcagtgcctttacgccgatttgggacaaatcttcatccgatacgaaattttgttgagcaatcgctcgcgcgtaattggcggtgccgggctgcgctcgttgttgcagtacatcttcaaagtcagccgcagggacatggcctccaagttgcaggatgcgttcagagtgcgcaaaatttgacaccctttttccatccttccatacaatttaaggtggttgagctgtacgaggagctccaaacgaagtcactgttttccgccgtcgactgctattaccttttcgctgttgtccttatcaaacaaatgacagatgaaaatgacgtgagcaactttgatgggcgtgtacatcctcaaatatggctgtattcagatgaaatctctcaccgatctgttccaactgatcaaatcttcccaagaggcggagtctgtggcgcagaaactgaccaatcatttgaagtgtcttcttaccccgaccaaaattaaggtctttttttgactcagatgcttgcaattagcaataattagtaattccgctactatcattcgtcccatttgaggctgtcgtcccgcaacgtttggtttggttggcgtgtttgctttgtgtagccgagagatatttgccgccttcgtctgcagtgaagctgattcgcgacgcacgagcaatccgcaaactccaaatagaccaccaaattgtaaaataatttttaatcatttgcaacattttcctaatcccaacaacaagtttgatgattttgatttagctctttggcttttcaacattccgtgaaaaagaccaatgcgtcgtttatctgaggaaattcattgaagcgccaaatgccaagtccattgtcgaagtgcactcttttggcactttgttatgccttgatatcaacgaaatatgtaaagcaattatcggcgtgcacatcaagaatggactccccgaggcagcactaaacgtgctcaagtacgacaaatccctttttatgacttttcacggccgatttttttaggtattttacttcggcagtccattcgccggcaaaggcacatttggtcattgcgttggacacatgcacttttgtgtgttggaaactcaccgagtcggtcagagaggagcccgcaaatgccgacattattgcgttgactggaagcattgttcgtgccttccaatcagttctgccaaaattgatcgattggtcggtcggtcttggcgagaaccgatacttcgagtctttttcaaaggtattttaatgtgaccaattcgacttgttgcatttaatccgataacccctgcagatttctcgatacatcggcttcttcaatttggtgctcaaccaatgtgctgcaaatgatgacgtgccgaagagttcggaatcggaccctgccatcggagacatttcttgcgcgtccataaagagcatttccgaaggcactaaatggttttgctttcttacaagtagcatacgtttgttatttctttttcaagttccaacagactttacgtgaccaaagcgcggactggtgtccttttgccacacctcgagggcaccttgtacaatacgatttcagttgttaaggcagtgtgtgtcgtggcttcttccgtggtcgagtcgcctgtcgatgcgtacggattgacacttgaattgtcaaatctcaaattttttcctttttcagtagacagcgtgaggaattccatgaacaaatgcgcgagtcttggaactgtttgtttaacaaccatctgtcaggcggacacattttgctggaaattcaagctcgcaaattggccgacactcttggtaccagcaaattcgtataaacccataaaaagctgataccaaatataatttagactgttttgcctcaactcggggctctgttctgattggaatcgaacgacaagtcttggaattatgcaagaaaatatttggttttcccgtcgctgatgtccaattagccgcccatttgttgctcagtttgccgcttgacgaaatgcgcaaggtgagggcatttttgctcatttacgcgtatttattttaggtgtctatttatttctattaccaattccgttttgacagaatctccatgaacttcgacgatgggctcagtcacggaagaatgttcgttacacgttgaacctaatttgtgtgtcattgttcgtgctcactgttgcggaccaagacatgaacctcatcaaacaagtcgcggtccgtctcctttttcccatttattaatagaaactaaatcccaaattttaaagatttggcacgagaccacccaatggcagaagcgtttgatcaaacagaatgtgaacatgggtactaagcagctgaagcgcgacaacgtttacgagctaattggcgattttgcaaaagcgctgcttccctcctcatttctttacggctattgcaaagaggcgaattgcgcaccttcgtccattttggtcaattatgctgttgaactgtgcaaattgtcctcttcttaaagaaaacgatgcgaantcgttttgaactttgcattgaaacag

SEQ ID NO: 11431 - DNA, 1387 bp, Heterodera glycines
tcttccgacttcttcatcagcttcagcacttcatacccgacagagttttgacaacaaaaaattgtcatctgctattcacgccaaagttgaaatttttttaaagtgcttttattttatttctctaactttagtctgccgttgatgaaattttgggcgaacgtcagggcgacaccacacttttgcacacaacacatttgtttgacgcaaactgccaaatctgcaaggaagaacaggcgaaaaagttggcaatgcgcaagcgtgccgaagaactcgagtccaggctggacgaacgggtcagagagggccaactggagggggtggagcagacggcaatgaaagtttttttccagataaaactcaagcaacagcagcaaggcatgccctatttcccgaacctggacccatccgttcgtaccgaaaactgggacccgtccattatctctgcgttgtccggttcctcctcggtgatgcccacctcgcggcaccatcgcacggcggcaagcggtagaaaatgtgatgtgccaacaatggtcggggaattttttcttggcagatttcgatccgcctctgtcttccgcgaccggttgcgacaccaccccactgatggactcggcagcaaatgctccagtcagcaacagcggctatgaacatgacccattggggttgaacaatgtccaggtagtgtagtaattattcaaatcgccctaatggcttttttgagagacttaaaaatcattcattatctctaaggaattgcatcgttttttaattgattaatcgctccaacaggttggtgatccgctgattgacgatgagcaacagcagcgccacccggaaacgaacattgacgaagatgaggacgtacttcgatttgatggaggcgcttttgacgacaatgactacggagaagaggaaggaatgacggagtttaatgccgatgacaacaataacatgggcaaggaaaataatgcttccaatgcttgtgagttttatggggcgtggcagaggtgtcaaattatttttaatgcgtagttagttttaaacaatccttcatccaagtttcgtcttttttacatttgtaaatatgatgccattttcagcacccgttcattctgatgtgcttcaacaaccgctggcacttcagcaggactttggcactcctccgatgtccggtgtttccaacggaggctttgacaaagctgatgacaatgccagccaacacaggagcggtggtgtttctgcccatcgtcgcactaccggcgacgcgacggaccgtcattttcagcgcgttgtggtgggattcccctccacttatctttaagaaaaatactgctattgtataaaagaaatagcaataaaaaataattgttaaaaaaaattttcagcc

SEQ ID NO: 11432 - DNA, 3222 bp, Heterodera glycines
  misc_feature (3181)..(3181): n is a, c, g, or t
tgcttccatgcttgtgagttttaaggggcgtggcagaccgcgccaattatttttaatgcgtagttagttttaaacaatccttcatccaagtttcgtcttttttacatttgtaaatatgatgccattttcagcacccgttcattctgatgtgcttcaacaaccgctggcacttcagcaggactttggcactcctccgatgtccggtgtttccaacggaggctttgacaaagctgatgacaatgccagccaacacaggagcgctggtgtttctggccatcgtcgcgctaccggcgacgcgacggaccgtcattttcagcgcgttgtggtgggattcccctccacttatctttaagaaaaatactgctatagtataaaagaaataacaataaaaaataattgtttaaaaaaaattttcagccccgaccgccacaaacgccgccaccgcaacggatgccaagtagaccagtctctgtcggtgctgctggcactgttttgccgcgcccatcggatgcgatgtcagaagtgcacgacatgccgcaacaacatctcttcaatgagcccgaacagcagcaaccattggacccgtggaagacgtaaaccatgactattccttttattaggtcgtttcaaaaaatataaattctcgcacttttcttgacataattggtgtaattctatggcctaataggtcggtattttgatcacataatttgaaaattcatttcttcaaattttattaattttttggaactttactaaagtactattttaagccaaacttaatttaaattatatttatgtaggacattattaaaaagaacgacccaataaatgacaaactcatttccagtccaatcgcatttacctttactttatgttttgtttagcgagtctttgttggtgtggcgtggactgtttgtgttcagcaaacaaggcttctttaactgtacatgcacagctgtgagcggcggtcttgccgtgttcaaggcgagccgtgagatgatggcaccatcgtcggaaaacggcagcggtgacggaggaggaggacgtattcatcttatcggactgtcggattcgcgtggtgtttgggaatacgttatgcaactgagggaaagctggaacaaaatggtgtgtctactggtcatcaacagaccggagggtaaatatttctcttccttttaagtttttctaattttaaacagctaatcaattgtgcttttttgtagaggaacaagatttcctcaactacatggactgcttcgcgttctacaaccagggcacgcaggtgggcgtgctggactttgccgaccacccgaccatcaaagacggctatgtgttcacgctgagcccgggcgaaccgttgccatgtgagagttttttttaatagcaacttattactgactatgagaatccccttttccgcaacacattgtttaatggtaaaatgccgtctgtgaatgttatgtctttcagctgtgctgttgccgttggacggtgtcggattgcccgagtggacacagcacaacgggtgcattatgctgatgattgtccgccggatggaccacgaggataagcagtggaagcgccaacggatgggcatgggcgttggggacgaaagttggcgacgtcagcagcagcaacacccccaaatgatgccgatggacattccgctgacgccgattggccgcgggggaggcggcgaacgcatggcacatctgctcagcgaccccaggttggactatgagcttaccactcggatgggctctcggctgtaccgcttctcgcgcctctacaaatccatgccaatgattttcaaccgaatcttttctgaaattaacgtggacaacagtgggaacgatgagaatgcgaaagtgtagtagagggggagagagatgggattataccgaaaagagtgtttttctaaaaaatataaatttttcttggcatattggatgggtggtccctcttttctctctccctcgtcgctctctctttgtgccatattccggtttcttttttttaaactgtctttttcttgctttatattttacacattcagctacaaactctatttttgagaagaattaaaaaattctatcaatttgctttatttgttttcattcatttttctgttggtctctccgattttttgccgatcttctttttttgctgccgttttcatttttaattctgatgcgggatttttgtattgtcttttccatattctaatattattagcaattctttttgctaaatcttaccagtacctcccccccccccctgtgtcttcttttcacacagctcacatttgcctacgcattgttgaatctgcattttaataaatttctttggcactggcacttggggaaaaccaaattttgtacaaaatttaaaaattccttttacatccatcggttgactattttttggatacctcactaaaaatgtattcgagaaagtgaattttcacttttggtgtaattatgtgtgtggtgtcttatcgttcttgcgcatctccacaacccacaccatccaacgagccccgtcccattgtgtgttatgtgtccatgaaaaggtattgcaatgagccgttctaatccatttttctcccctttaagccgccgttttcgaccggacgacatcgattttgccgccaatgttgagccgacagatgcaccaattgttggacccgtcggtccccgctccttcggcaggcgacaaatgcaaatgttcgatccatgtgggaacacgcctcaccaacggcaccattctgcacaggtggttgcataaacatttacaaagtgccaccgcaaaaagtcggcattccgactttcccatccttaattagcattgtttactctaccttttgctttcagtctcgtccgatagtgtccccggtgatgttttccgagatcagtccaattggcccaccatcgatgtcgtcacgcttacagcagcgttaccatcctcaacagcgcagttccgatccaatcattggcggtgctggccccagcggttttggtggcacaactgaatcactagtgccgcatttccaagcagcacattcaccggcggcattgaggcagcggttccctccgtctgccggcagctttaacagcccatcaatttcgtcggtattttctgcagttgaaccgaaacggatggacagtccggctgcttntcatcatcatacatcgctgccttccgtctttttgacggcat

SEQ ID NO: 11433 - DNA, 938 bp, Heterodera glycines
cttttggcgtgggtttttttgttttagcacatattttcttccctgagaaattttgaatttttacaattccttttttttgactatcaaattccaggcaaaatattcccgttttgcatgattttttcaatttaaggtaaatttgattttagcaaagaaaattccgaaaataattacatctttgagagcgaaaaaaatttacgtcaaaaagcgttataatgttttttattagctttatgctaacgaaattgataaaaaataagactgttttgaaaaattcacttatttttaagcagttgttctgtaaatattttgcttataaaattcgtaatttattttatttcttgagcaaatttttgttttttaaaattgatttattttagaaagaaatgaatttaaaaatttttaatagttttaaattccctaactttagaatgttttcaaccttcttttcgtcttttttcacgatttttcacccttatttacggtcttaagttggacttttttcaccctttaaatccgatccctaatcataaggtgaacatgtctgatgataattttacacctttagagttgaaaaataaacatggaagaaaacaaccatagaaccgcggttcaaatggcatacaaatttcgtttaatcgattatgactctcaaggacaaataacgcctattaaactccaaagagttttaaaaaatggcacgcaacagctttttaatttggagacgtgtcgtttaattgttaatcagttcgatgagcaacgttgcggttacatcggtcttgccaaatttccagcgctatgggatgtatgatataaaaaatgacaaaataagcaaaaatattattttaaaataaacagaaaaaattttttaatataaaccaaatgttttataattattgtcccaaaagtgactccattgaaacataaatttaaaatga

SEQ ID NO: 11434 - DNA, 3728 bp, Heterodera glycines
tttttttaaaaatatgttttattttttcaaggctatagttttactacccccgtttttcaacattctgctacaccatttcgatcgaactaaatctggtatttttttttgcttaaaaaatacatccttcaaaaggacgaatttacttcgatgattttattcatcttggcatatctctaaagcgtcttacgccacccttccgtaatgctgacacggaccgtgacgggcgcgtaaatatacgtaagcaaaattttatctcatttttaggtgccaactcgttaatttttagtaataacataaaatttttcctccaattttttttttgcactaaataaaaatctaaatcagtttgcatctaaataaaatatttttcaacgaattatttaattttgtaaatctttgaagatttcgaggatttcatcttaatggtcttgaccgctgaagtttgatttctctacacaacccaatataaatagggatgatttgattaaaaataccacttattctatttatctgtataaaattcttaattttaaaatcaaaaaaacaattgcaaatatataaaaatatatttatgatatttaatacttatatggcaaatcatacacttgctaattcaatgtttacaccctcgtacccattaagcaaaaaaaaatgagcggattaaaaagattccaaattgttccatcctctcaaaaaagagtgaccgaagattttccaacgaatccaaaagatcttcgtgccattattcaatttaactcccctggcctattctatgtccgtgccagaattgccgatcttcagttttccctatacaaggtttcgggtcgtctattctagccaacattataaagtagcacggatttaggcctgtcctttgaagaattttggcacattttgtaagaaaaagcttgacgaggagatgtattgtgccagttgtgcccaccatgctaacaaggcaatccgcagtatttacttgagattggagctccgcgactgtgaagatccggagatttgccagactgttactgtcttttccaccgtagcggaacattacctgggcctcaaggttgaacgatttgccaaaatggtagaagagcagcctgaacagctcgaagcgttgcttaaatctaagattgagcgtactgtcaccgccaaacttagtataaaggttcacaaatttactacggatataaatattatctttttgaatttttaaggcaaagggtgagctcaagacgatggactggattgttctgtccatacagcatgagaacggggaaaacgagggagatgatgagacggctcctgatgaacaaaagaaaactgacattaataatgaagatggagaaataatcgagattgagaacactagcgtgcattcgacactcttaggcccaccgcttaagaaacgtgtaaaaaagaactgagtcgaatcaatcggcttcgtctctacggccaattctttgtagtagtctttggcctagtcgatgttaacccggataaatatttagaaagggaaagagagagagaccattttgttattatcagtgattatatgttttcttcgtacaattcacccaaaatagtttttccaagcgttcacagttgaaacgacaatgaaaaagggacaatccgaaacggctatcattcgttcatcatcatcggcaacagcgcgcaatgacaatacggtggcagcctcaaccttggatggcaatgccaaacggcaacgtcgtaatagttgggacttcaagacgatggcccattttgaggagaagcgccctaaaggggaggaggatggacatagaaaggtgaagcagcctcagcagccagcacccttgtttgagcaaaaacaacactacgtgcaccgagtggagcggttcgcactgcagcgccatgtgaccgagtttgtgctgaacggaaaacacgatgagccggaagaggcgcttctccgcgccttcgagcatatcatcgctcgtgcaatccgaaacgcagaggattcccatcagcaaactgacgatggaagaggcacatcagcgggcgacagtgcacatcgtcaacggcgtgtcacaagacttggagttttacttaatggtagaggtgagatttaccgtcagcgttattcgctcttttgttaatgtaaaagttttctttgcaaaacaccaggtctaaccgacccgattgtgctgcccattcgtcctccggagcaaaacacggcagaagtgttgatggctgagctggacaaacttggccagtcggatggcgatgaggatgtgcatggtggagggatcagcaaacgttctttgttgctcagcgagccaattgaagtggtcgtcacatgtatagcacctccggttggtgcggcgccacgtttttaccaataccagcattggggttatgacgaccggcagctgatccgtgtgatgaatcaggacgacaacttttgttattccatgcacttgttgccactcgtgcgtacacggatcaggaatttttaaaggcaacttcgcgacgacaagcccgaacaggggaggatgatagtcttcaatgggatacggtgccagctgagattgcacaacgggtgataacgagaaaagacttttgtgctggctacgaagcactaaaccgtctggtgtccaaccgggagcggatgaacgcagcagtgacggagctaatgcaagctgcaggaattccagctgaccaagagtcgtatgggatggagcatatcgaccaaattcagcagttttgggttggttgttggtgttagaatgagtgctaaacggtagttttttaaaccaaacaggaccaaaactacgctggcatatacagaattgtgctgtttgaggatcactccgaagagttgcctcgcccaatttggaagggtccaatgggacgccgcctctgtgtgtcactgtttttgtcggatgggcattattatggtatcaaaaagatacattgctttttcaaattgggtcgaaaatattgcgtggactgtgaatgtgtttacacccgtgacactaagcacacaatttcatgcaagagtcgctgcccacaatgtgctaaaggttggtatttgtgtttgttgcgccagcagatggccaatcgttttttttgaattttggttttatgccctttatttccttcttgatccagttggcccccagtatccatgcgttaggcagcaaggcgtgtgccttcattgtacccgatgtaatcgctttttcttctcccgatcatgctttgacggtcaccggggcagtcagacatgcaatttgttgaagcgctgcactatttgcaaccgaaccttccagcaggaccccaagcgtcctcataaatgctacagcactttttgtacacgttgtaaggtattgcattttcgccatatcagattggaaataaacaaatcaaaattaatgtgattaggtgtaccatgagaaggatgctggttgctttatcaagaaggttgtggtaccgaatgaaaagcaacagtaccgcatcgtgtgctatgacacagaaacgagattggacccattggaagaggcagggcagcagcgtcataaagtaaaccaactttcagttcgtgttacttgcactgagtgctgtgattctgaacgtggggtgcggacaaattgccaaatttgtatttcggagtatggaacaatggaacgaataaaggattggtatgctgttcattaaattttccgccatacattgctgtgtcattaacagga

SEQ ID NO: 11435 - DNA, 4435 bp, Heterodera glycines
atcaaatagttaatataatgaaaaatacagtgaagtatgtgaggttaacagaaaggaaaacaaatatttttgcattttactcatcgtcgtttttccgttttcaaaatttaaatttgtttcttaacaaattcccaattttttcgcaatttctccatcaatttttgcgtttgttttcactccgtatttctcccaaattgcttcctttattttgtcaaattgttcaattatttctctcttttcaagcgttgaaaagtgctgtgactgtgctgaaattagaaagtgccgacttttttggaaaaaatagtattattttttgctgaaaattttagattttccttggtggtaccactccccagcagcacagacctagcctctcacccaaattttccaaaaaatattgctaaattttcaaaaaatcgattttttttaatgaaaatctcctaaaaatggctcaaaattcggttctagtcggttttatgcgtcccatggatgaccgaccatccccagtttcttaggccataacttttttcttacttggtcaatcaatacccatattcttggtaccaagcgaaagataaaagtctcgagattttataaatgcaagaaaagagcaaatactggcattaaaaaagaaattacaatgaaaaaataccaaattcaacttttccgagtataattttttgtctattgcctttagctaaaaataaagttatacaaaagcttctatagaccttaagcttttgtttaataccaagaatataggtattgaccaagtaagaaaaaagttatggcctaagaaactgggtatggtcattcatgggacgcataatctgtcatgggacgcataatatgtcatgggacgcataaaaccgactagaaccaaggttttttgggaaagtgtcaaatatgcacgaaatgccaaaattgcaaatatgcatataaatcgcgaaatatgcacaaatatgcaaaatatgaatatgtaatacggcctagaaattttgatgccctatatatgagtgtcaattgatgacggaatgccaacctgacatcggcacattcaaatgaagtttggttgagaaaggtgtcgatggggtccaacggaaaacgatgagaacgatcattccaaagttcggaagaatcgacaaattgacggaacggaccagcaggccactaaaatagatttaataatgaaagacagaaaaaaaagttggaaaaaacgactaaccattttgacctgttctggttcgatgccgtaagaacaaaaagggaggtattccaacacactgagtttatttttggtgaagaaacaaaacaaagtaagagacggacatatcgaagctaaggggggggggaatcgaaacattacagacagaaagatggacctgaatttggaatttgagacacgacgggcaaaatcatcgacactaaatgaaaaatgaaatgacagttaggagagaatgtatcactcaagacgaagcaagtcagtgaccggttgatccttcagaggaaacatgaacttagccctcggctgaatgctggcaaaaatctcatctacgcaatcctaaaacacaaagtaggcgacggacgaaatcactacaaacaaaaaacgaactttgattttcgaacccgaacactttttatgtaagacacggtggaattccacggttggttgggggaagaaggaatcgaagccatgatgacctgacaaaacaggcattttgtgtttcagaaagggaatttgctgttacaatgccatgaaaactttggcattaccagtcattggggaagtgatcgaagagcgatagagacgaaaataaagtgcaattttcccgagttttgagagcagagaacgcgcgacttgtggctgctgtttcatacgcttcagctcactaaaaagaaagcatttaattttgatctgcatttctttctgacttttcgatcgtttccaaattacgtccgaaaacagttaaatccaattcattttcctctttttcctccgtctcatcagcagctccggaaccacttattataacagacaaaaacaggataatacacaaaaaataacgaaaagagaatgaatccatggattctgaaacagtgcaacgatcatcaagtaaagttaaaggatgttagaataaaaacttaaaaaaacaagttgggcgtcgtccgccggtgtcagactgtaccgataccgaccgtccaaagaataccaaaatggagaaagaaaaagaaaatcaaagggaaaggaaactcctcggcagagtgtaaattgtgaaattgaaaatgtttataacggcacaatttggctttcaattgttaattaatttcatttaaattatgagaaacgagaggtcagtctctgttcttcttctgaaggtgggtgacgttttatcagtgatcgcatcccgtcaaagtgaatttgctcatcgttggcttccgtcgttggaacatcgctgccgaagtgcgaaaggaatgaggaggaggagaaggaccagcagcagcacagacattccgagggctggcaaaagaaacggatgaagtgacggaaacgatgacggcggaggcattttattggcggtggtcaaatgggttgggttgccattctctccggtagctgtcgattggtcattttgcgttccgtccatcccaaacaaatcggcagagaatgaatactcacaacggtggccatgaaagccggaagaacagctaaatgagcggacaattagcacaaccccactccgtcttcgctgttttttcaaaacattgataaatgataacacaccgacacattggcacgtggtcactgccccccgtcaacagataacagccgccaccattgaagcagtaattctacggcaaaagactcgcataaatcattttgcagaagaaggaccaactgaccttatcaaagtgcgaagggcaggacaaagcgttgggggccaatgtcctaatcagactgattaatctaatcaactcttgggtgtattgtcattcactaattaccaatttgtgtccaattccctcgtcgtttcctctcccgctatttcagcattttctgtctctgtttcggtcgtaaacgaagtgattgtcctccaacttttagtcaccgtctggagcagtgccggaggcattgaacggggatttgctgttaatggcggggaaagagagaagcgcaaccctcctaaataagaaacaaattccatcggtcggtgccaaattgaaatcagaggaaagaaaccgaaaactgaccattgttggggttgttaaaatcgacgaatgtccggtgaataatggcggctgagaaaaaagaggggacacggacgaagccgaggaaggcgaggaacggcacgagggacgcaccgatcgaagagacaatggcgaaatggccgatgttgggaagaatcggatttgattggtctgtaagaaaacggagaaggattagctgggacaaacaaacaaatggcacgatttatggacaatctccccgaaattcctactcatttccttttgtatcgaggaaatgaattcaggaaaagaggcggagagagccgagaaagggccaattaattattccaattggtgcagcgagcgatcctttgcggtgggtgggcatttgagaatgaaccaaccacacacacagcaacaccggcaacaatgaccgtaaagggaatggggcgatggagggccatccgagggggggggggtttatgaggcgttcaattctgtttggattggagtgaattgtgtggactgagtgggagaggcggaggggggggggggaatgggaaccaagggaagcgatgccatttgccgtcagcgattgtctctttgggaatgaatgatcatcgaatggtttgatgaatctcgaaaagtaatagtcattttgtaattcatatttttctactcttatgagctcaaataaagaaaaattaaatgatcaactgcgaaaatcagtgaaaagatcaaaagtggtaaatgtccttcattaacaatggcaatggccaatgttctgctgcttcgatggtcggcctttcattcattcattcaaattcagtcgcctcccctttatttattttttgtacaaaaggccacaaagaaagagagagaagagagagagagagagtaatttgcttttgcttctctccgcgccttttctgctttttgtccgtttgtccgcttcttcttcattcccacttgctttgctcacttgcaatattaggctgtgtccgacaaaattgtgcaacaggtgcagccaatgaatgaatgaatgaatgaatgaatggtggtgaagtgagaacaaaaaaatgagaggaaaaagtgggagaaggaagagagagggatggggtggggagaaaaggaagggaactgattagggaaaagcccaatcaaaggggggggggatgggagcgggggggggctgacgatttacagattg

SEQ ID NO: 11436 - DNA, 1190 bp, Heterodera glycines
gggaggatgtcgttttacagattgcgagtgttaggttcaacagattgagaatcgggcaccctcccctccgccctcctttcccccctccccctcaacattttctcctcctctctttcctctgccattggccggcctcgcctccggcgctatgctccgatgcgcagggacaaacattggatgagaaggaagagaaggctcaaggaaattgagcggtgcaattcgttagagaattaatcccttttagaaggatcaaaaaggaagcgtaaaaaattgccgcgagtggcaaaaacaacgacaaaagtcggggaggaagtgttaaatgtttgttggtcatcagtcagagggaatgaatgacctttgcgatgtttgccaattgcgtccaatttgtcatgggatacaaatgaaatcgaatttcgataagccaaaataatcaatggctgcgcagaaaaagggagcgcttccgtttccgtacgcagccgaactggggacacggcaaacgcgaccaaacaactccgtcaacagcaccaccaatccgagtctgaacagttgcgtttccaaaggccagcggtaaagaatgccgtggcgcatttaacgtgtcgcgtcattggcgccattggccgaaactcatcagaggcgactgttgacaacggattggctaatcattaagtaatgattgatattgtaaagtaacggcaatcagataagcggtataggactgaaaaaatcaggaccgggatataccgtgacccgcaaagccgggaacggaaacgggacctggattttcaatcggaccaaccgggaactaaaataattttaaaaattgattatataattactcaaataaacttgtgcaaataaattaaaaatcttcaatattttgcaaaaattaaatcaaattatttcatccaaaaaaactaaataaattaaggaaatcagagccaagagattcagcagatgttggatctgtgaaccgatgagaagatggaagacgttttagcagttttactgtttggatattgagttaggtatgtaatgagttttcgctacgcttccattctcatcatttagtcccgaccctaccttaaacggggtctgaactggctcacaaacagtgaaattcacagtaattttgtttcatgcaattgggtaattatgatcgatcatcagtatttaaagccccttgattggca

SEQ ID NO: 11437 - DNA, 1708 bp, Heterodera glycines
  misc_feature (1655)..(1655): n is a, c, g, or t
ttccaacaattgaaaattgcagttttattttaaaccccttttacccattcctctctttgtcgctttgggctacatttgttgggtatttttcgattttgggcctatacctcaaaattaaaaaaagaacaaagactgggggggggggggtgggattaaatgcataattctttacaatgctcgcgccaatgaaacttgaaccttcagcgcgcgctctttcttgacctatttaaaaaagttgaggtgtaggcacaaaaccggaaagttgccaaattcggtactattcggttatgtggtcacacccttccacatttaaaaaaagaaaaaaatgtttctcatttatgcaaatccctttggcatgaagactgaaacggcgtggcgatgatcctttctgacattttggctcaaattgcgacttttatgccacctaaaaattgttgggcgctatcactggcgaatattttttgttattttatagaattatgaggtatgaccagggcggccaagtgtccttatttgtaagatttgtccttatttggaggtgccaactcttagaaattaaaaatgtccttatttgtaagatttgtccttattttggcacgacctccttgctttgtgcttattcatggatttgaaaataaaaatgcaaaaatttaatattttttaattacttattgttttttattgaagcgaatatttgaattaattcctttttgtaaaaaatttcatttttctttagtgtaaattcgttaattttaaatgcccaaaatgcccccaaaacgtaaaaataatctcttttaaaatggtcaaaatttttatttttcctccgacggcgcctatcggcaccgtcgggccccaaaaacttattttttcataaaaatgggctcaaaatctcaaaattggtcatttttttggtgaaattctgttaacaaatttcattttaatttgaaaaaattttcccggtggcgccgataggcgccaccggaaaccaaaatcccaatttttcttaaaaaaattagtttaaaatctctaaatttggtctttttttatacaaaatctgttaacaaatcacatacaaaatttcaaaaattttcccggcggcgcctatcggcaccgccgggcccccccattcccaaaagttttttggaaaaagcacgccgcaaaaacattattaatttttaaattttgaataaaatttttcaaaatgctgatttacaaaattttcagttgacaggccttcgtttttatgctaataaaatgttgttttaagtcgttttttcatgtttttattgcgtttccttcgcgctactatcagttttagaaaaaatcttatttttggggtccgaatcttagttttagcctcatctgtccttattttgaaaataaaaacttggccgccctgattatatggaattattttcttgcttaaaaaattgtttttttccttcgactgtagctctccgggcattgttcgtaagaaaagttttggccgtcaataaaatcaccaacaaaagtgccgtttcgccctggccaattgacaaaaataagcgctttctggatcttttaagcgcaaattaaaagtgttgccgcaactgttcccgggtccgagtcattggtgcaataagttctcctcaccccctagcattgttttcacccangagaaattattcatttgtttctataaatgtgtataaaaagcgtaattttcgtt

SEQ ID NO: 11438 - DNA, 3436 bp, Heterodera glycines
aatagggaaaatatcgtaaatatgtcatatatttaatcaaattctagcttcacatttgcaaacgaaatacatacatttctcaagattttttgaaatttttcattttgttgtcagcgaagatttttcggaagcatacaaaatcattaaaaatttcgcaacatttgggaaaaaaatctattcttataaggtgatgtttttataaaatttgcaaaacactgatccttagtgtgtacttttcgattttgtttttcattaaatttgctgataataaaagagtatttcatgtgattagtggcaatccatggtgacataaaacctgaataattttatgtatgtcaaaaaaatggttgaagaggaagctctgaaattgattgattatgacggtaacactatcataccggtggggcttttcggaaaaacgacaccagaaaccaaaatcccaatttttcttaaaaaaattagtttaaaatctctaaatttggtctttttttatacaaaatctgttaacaaatcacataaaaaatttcaaaaattttcccggcggcgcctatcggcaccgccggccccccaattcccaaagttttttggaaaaagcacgccgcaaaaacattattaatttttaaattttgaataaaatttttcaaaatgctgatttacaaaattttcagttgacaggccttcgtttttatgctaataaaatgttgttttaagtcgttttttcatgtttttattgcgtttccttcgcgctactatcagttttagaaaaaatcttatttttggggtccgaatcttagttttagcctcatctgtccttattttgaaaataaaaacttgaccgccctgggtatgaccgcttaaccgaaaagtaccccaaattctttacataacacccatggtgttttccccctgctgaagttaaattaattaaaatttttagcgttcattttaaaattcaaaacttccaaccaattctcttttcgtcaaaatgctttctccattctcctacgacccgttctatcgccgttcgttgttgcctatggccacggttggcaacgtcctttcgcccttccgccagttggagcgcgaactcgaccacttctttgacgggatgcagcccatggtgggggcttattcgacaatttgccaaaatttcaaattcgtttatcatttttgttttagcttcgtgaccacgccgctcagctgaacgtcacggacaagggcgaactcacttacaaagtgagaaggcacagaaattcaccgcttttcgtggctaattttcaattccatgaaattttcaggtcgatgtcagcggcttccgccccgaggagatcaacgtggaggtgattggtaatgaaatcatcgtcaatggggaacatcgcgagcagaacgacagtgagttttgccattgttcgagtaattttatcggggttttggattttggtgagacaaatttcagggcttgagtgttaatggattcatttaaaatgcttttcggaaccatatttagccaatttaggcttacatttagcgaatcagagaaatatcgagaaacttctttcaatttggaaaatttatgtccgtatttctgccatttatggccttatttttgcaaacccttgattttttacgtcccaaaatacctttgaatggatttttcgaaacgcaaaaatattttttttcgggtcgggcatattccgaagttatgattgatttaaatgcaataaatgtctagtcataatgctgtttttcgatgattcgttgccccctccacctcaggcgaatcggtccaccgtcagttctcgcgccgtgtgctcatcccggagggcatccaaaaggagagcatcaagtgcgagctggacggcggtcgcttgtgcatctgcggaatgaaaacggctggcgaaggcggacgtaccatcccaattgagatgaagaagaaggcggccgtggaacatcagccgcaagtggagaagaaatagagggggacaaatggagacgacggaccgatcgatccattaatatgggtctcctcctttggacattttaaattattttcaacaataaagcgttttttctattccattgaaatggcgaagataatattagcaaaaaatgcacttaacggtttcggtttcttaaaaaattcgggcactgttcaaattcgaaacatttgcaaaaccgcacctcgcgaaaatttactgaaccggttggcttttaaatcccaaaaaattagtgtaggcggaaaaaattagtgaatccaaaagcaaagtaatttataaccatttaacacacattaattagccaaaaatcccaaatttactgaagcgtaaagccaatttatttgcgttcaaatacaaaacaggaaaaaaagtgtcattcgcgtccatttgagtgattgtggccctaaagagggccgtttgggatagttttttccgtccgatcaccaccgctttcatcatctcctgctcattttgacgaggtgtacttcgtcaccgccttggtcccctcggacacggcatgcttggccaactcgccgggcagaatcagtcggacagccgtctgaatttcgcgcgatgagatggtggaccgcttgttgtaatgggccaatcgcgaggcttccgccgcaatgcgctcgaacacgtcattgacaaaccttaaaaatgggaaaattgagaatcttgggacggaaaaacgccaaattgggccttacgagttcatgatggacatcgctttggaggaaatgccggtgtccgggtggacctgcttgagcacacggtagatgtacacctggaaagccgggttaaatttataatttcattttgttaagccattggaaaactaaaacagaaaaccctaaaaaattcagaaaaaaacctaccgagtaagactccttgcgggcctttctccgctttttgtctcccgtgcgcaccgccttggtcgacttgaccgccttcttcgctcctttgccggatggttttggaggcattttgtcgtcgaaatgtggagaggcgaaggttttgttgaagagagctggtgaatcgattcgtttgctttctaatgaaagtggggaatggggcacagtgagcccttttatgtcgctaaagtggagggaacgcccatcccattgacagacaatgcaaatccccggtgggagcagagaaaaatggacgagagagagtgtgtgagagagaaagtaagacggcgtcactttttgaaatggatttttttcaacacgaaaggagtctccgcgtgcctgcacattttagccgccattttttcttagcataaatagcgcccacggtcattctattcctcacttttcttcttttgctcatttgaatttgctcatccatccaactaccaagcaaaaatgtccggtcgcggaaaaggaggaaagggacttggaaagggaggcgcgaagcgccataataaagtgagt

SEQ ID NO: 11439 - DNA, 763 bp, Heterodera glycines
  misc_feature (712)..(712): n is a, c, g, or t
ctctagagtcttttttgcaattccgaatcgattcccccccccctaatcttgtgcctttccctcaatgtttcgtcttcgtacgcttctcagactcgcaaatattttcttctgtttattcgcgttgattcgacaaaaaatagcacagaatggcatttgtccactgggctttgtctggggaggacgtaagtgacaaacaaatggttgggatcggatgaaattcttacaaagggactgatcagtccctaagagacagaataaacgtcgatttcggatcaccaaaattgaactttcgcaatttgttcttatccgattccccgcttcttcagagtgcggcctcggcgtcgtttgtcctccgtcattgccgccttttcacgtgcgtttgttttcaccgttataaattcaactttccaacagtttcggttccaatttcggcttttcctccccattttgccattgttttgccattgttttttgatcgtttttctcctgctgttggtatctttgatcttctccctctcccgctttttcagtgtctacgtagttcgtgctgtcgtgaccagcgcccgttgttcgcgcgtctcggccccatcgtttatccgcaagatttgttgggcggcgctttcggtggcggctttttccccggcggcacttatggcgggcgattcaatttgaacagtcttttgaaggtgagctgcttcgacaacgcgtcaanctgctttctctacgaaacggaatgtttccagcccatttatcagctgtgtat

SEQ ID NO: 11440 - DNA, 1840 bp, Heterodera glycines
  misc_feature (1813)..(1813): n is a, c, g, or t
acttttcccctcgccctctccgctgctcaaatgcacggccattgccattccccggccaatttggtgcccccgcttcttcccctctttcccacgcttttcctcctcttcttcggcacttcccttcccccttccttcgcccaatttaatttttgccgtgataatttcgcccgttgtccgttgtacttcagttactgcttcgtctccgcttatcagtggtgcatgtcgacgcactgtcgtcgcacatgcggtttctgctcgtcaaccggtttcggcacttctccttttgttcagcaacaacagccgaacgttttgcagcccattgtacaaccgatcattcaaccgattcttcgcttaacaccctttggcaacaattttggtggcactttccccaataatttcggcggcactttccccaataatttcggcagcacttttcccgtcggcggtagcacatcattttcaaattttcctggccagccaaacattcctacgatttttcccaacaattttcaatttggatttaacggcggatttggcagataaaaaaacattggacattcattcgttgtcaatttgttattgtaaaatatgaatttcatttaaaaatgcaaataatttttaatgtttttttcttccaatccgttgaattttaaatttgctcactcagaagagaatctttgtgtaccaagctgtgtaagcctccgtctgaaaagatgtttcggcgcgcactttgagtgtcatcgagtggaagccggacagttcaaattgacgctcaaactgaacaaaactttaaatttgcccatctttggttggttaattgaggctaaaagggtactcatttggcagagatcacttgctgattgaaaagccattccttagtttgggcaaaagcatcacaaatattccttcttccattgagtccccgtaagttctccccccccccaattgtccctttttctccactcacttctctgatgtccaaattgctcccggcaccgaatgagcgtttcaagaatctgttgtgaatggcttcgacgtgatgggacacttcccatccaattggactcactgtttgaggtggaaaatcaatttgccgtccttgaagaagccctgctccatcatcgaccatccttcaatcatttgtccatttgtccgttgaatgatcacccccccccaccccccgatttaccttcgctgctcgtcgtcagatatgccacgtgcaccccgcgggtcccttcgggtggcatttttcactggcataaaagccgtaatcaccttaagctaatgtgtgtaagcgaaatggcatttattaagctgtaattgtttgcttacttcggatgacatttcgggccgagtccaagtaagtgtgccttgggtttttgaatttgtcggcttttaaaaatcataaaccaacgtaatgttcattgtccgtgctccaaatttcgggattggattgatggccaagtcaattaaatttggtggcggcaattctttgaagtttccgctgctgcggtccatttgccaaaggccgatgaagtcttggaccggcttcaggtcccagggaagcatgttcatgttgtaccctgtgcaaaaaacggaccataaaataactagcggaaaggtatggcgtaaaaatggacacggtcaatgctttatccctaacccctcccacccgaaccataagccaggggacacgaaaagtgcccttctcttacgatcttcataacgggagcaaacaggcggaacaatgacgagaaaggagaacaaaagcagaagggagaaggagtgctgacgagaagaggaagagcaacanaaagcatccttaattgactgaaatcaa

SEQ ID NO: 11441 - DNA, 1409 bp, Heterodera glycines
ttcgggtccgggattcgcaatggtcaaaatgaacgtacagattcgtactcaccgaccctgaaaactcttagaaacatattttcagtgacttttaaaaagttaaatgtttatttcaaaaaagaggtcctaccatccgtagtataccttttgattttccaaagcctaaaacatttttactttttgataaaattcaaaattgaccacttttcatatagcgcaggaaattgttataaatttcgccatttttaattctgtaaaatcttaagaaaatgaaaaattttgggtgaaatatcggattcggaattcggagaaatcaggccgggataggattacagggattgaaatcacggttttatagggatactgaattatatttttaagccgtcattcatcctaaaattttcaatctcgaatagctttactaagaactttttcatttgcggaattcattaaaaaattttcagaaaaagtattaattgacaacaattgcaattgccaaccaactttctcaaaatgtcctcctcgacaaatgaccccgtgtcggagtttctcgcccgtgaacaatcggcgctcgccgacctcggcgatgactttgtcgctgctgtgcccccacctcagaccaacaacggtttcatatacattggaattaattgagtctttttgagcaaaacaatgcgaaattaaattgggaagagattttcttgaataaaggcctcccaaatgatttttctgtttaattcattttcagatggaattctgctgaccaatggtggctcagattttggatccattgcaaatttagactcatttgacgcaaatgaacccaaattgccggtcaacggagtaaacggttcgttttgacctatttttttctttttgactatttactatgaaaggaaagggggaaaatggtattaaaataacaaaatacgtaatcatttcgtgaaaagatattttttctcactttatctaaattaagccagtgatttacaataatttgtgaaatttgttccccattttaaggatcgttgcgcggaagtccgtccttttcccattcgcgcagccaaagccaacaactcgaagaggagccggagaaaattcgaaaatggcgcgaagaacaaaaggagaaaattgcggagaaaggcattgtttgaattgccatttttaaggataaataattatttaaataaataagtgcttaaaaaagaaaatttgattcattttaagacaaaattgaggagcagaagaaggaggaattacgagagcaggccaaaaaggagttggagcagttctacgcccagcgaaagaacgaattggaggaacggaaaaagatgaatcggtaaaaaaagggagcacttgcaattagaggaaggatttggtaaaggacagaaaagaggggattgtgacgg

SEQ ID NO: 11442 - DNA, 3345 bp, Heterodera glycines
  misc_feature (1929)..(1929): n is a, c, g, or t
ctcacttatgttgcccgatcaatccgctgccacacgccttctgaattgcaccttagatcaggaagtgtgtcactcaaatgcaccattttgccgggccgtcttttaggttgccatagttgtagaaccggggggagattcaattacacctgcacttcctcccggggagagtcctttgcaagtgttgaatgtgccgatgggacagaatgggtgacccggtgtacgcccaaaggacacccaaactccgttgttctttcgtggtcccatcccaaggtagagactaagtgccgagtcgattgcttttccgcaaatacaatttgcgcttttccaatcagtggggtctttaccacatgccacattcgcggtgaccgttggcctggcctggctcttcatttttttgttagtcattcgctattgccctatgttctgccccgctgtttgttgtttaccacgaattggcacgggggtggaaaggcaaggtgatgataggccaccgagaaatcggacagaaagggtccgcagctcaagaggccgtaattgggcccgcacgatgtgacccagcttaattgccttatttgccccccccttttttctttcactttctttttcagttacttttaattttttaattgatttttcttttctcttaaaaataggcaaatttcctttacaattctgaatactctccccaaaatgatgaacaacaatgcgatacccagtgttccgcggccatacatggtggcctcgtatccaaccgatggatacgtcatcgctggtccacccacaaatggacagttcttaatggcaccggcctttccgggtgcccccttttcgcaccaaggccagccggccacgtcgccacccggcccccgatttggtgtccccggccccctgccgatctgctgcgcgccgccacacccggtgccgttgatgccttccgcatgtccaccgaccggccagcctgaacctcgccatccgaacattgctccgactccacaaaatgatcaccgtctcatttggaccttctcggagttgctgcgtgtggcgaatgttcagcgaaatctgatggagcgtatggtggtgttgctgactgccaacaaaatcgggcagcaagttaagggggccgctaacaagggtggggaaaacgtttgcgtaaccgcaccaaggggggtacgggtgctaagggcggttcgggggcctcccgccctaaggctaatcaagggcaggcactggcgcccggcccatcttgttttcagggaccacaggtgcagatcggtccggttggtctggttgaaatgccgtcgctggccagctccaaaccccgaagcagtggccccacccccgccagtgcccccaacagcgcaagaaaatgaaggggcagttgcgtcgtccctatctgcttgagccgtgcggcggggggaatctgtctacgacagtatcaaaatgtttggcaaaattttttggtattagcaacaaatatttttggggattaatttatgcaataattttggcaaaaatatttcttgggggattaattggttcatcttttgtcacgttctctaggttatcataaacaactaatctgggccaggcccgtcccatcttcccctctcgcattaatctcacaggaacaccatcgcaactaaattggcacggcacgtgcaaggttttggcctcctccctttcttcatctgttgcactttgctctcctccgattggctgctttgcctactacagtgccttcaccccgatgtgcccgcccaactctcgccactcgccccgatgtgcccgcccaactctcgccactacttaagaacgaacggacgatgcaaaaagcactgcttttcactttttgctgataccaacgactcaacaaaccatcgcttttcctgtgtcttttgctccaaaaataaacgaattttccgaatttcngcccctttttttgtgcttttccattgctaatttgggactccgcgcagcggttcccctattcatttgcttttccgcgggcttttgcccacttgtggcccttttgtgcctattcgcctatagtttgcctttcctcaggcattttccctgggcccccttgtgcccatttgcatttccctttgcctttgggtttgttcccttgtgcctccttggctttcgtcggcatttgtcccttgtggccctttcgagcccatttgccgtttgttgcttttccctcggcaattgcccacttgcggctattttgtgccgacttgccttccgtcggccactgtccgcccttttttggcccgtctgtgcccctttgattttctcggccatttttccccctttttttggcccctttgctttccctcggtggtccctttggtggttcacccatttttcttttcacgtggcagcaaaataccactttgttggccacaaatatttttattttttttatagatgcttagtcgcgttcaaatagacgatgaaagtactcggcgctatatataacttcactaatcgatcttgggtcattgacgacgttaataattcttaaaagtggagccatctggttgccgataattgtgttttctattaaatttggtgcataaatgtatagctgacttacaccacccgtcaaagctggcatataaatcgcctcttccgcgtgaaatataaaaacgagcacatagacgagttgttttgacaaatctatgtgggagacggcagagaatagatagacaataaatttttggtcaatgctatcatattgaaattgagcatcctcattggctaatctctcttttgtttgtggtcctttttcagcttccggcacttctttattttcaatatccttacgtttaaaatgttcaccagtgcttcattaagcctatccaccattccgctacaacccttttctgatttatcattatattcctcgagaattgatgtatatttggtttttgcatgtctggcaattccctttgcgacgtcggctgatttctttgcttgtttcatgtcattatttgccacatgctataatgttgtgtttttagatttctctacttcttgaaaagatttaagttcatttcgagatgtttgaatttgggttcccatatctgccattttgtcaaaccatatttttatatcaggctcttctaaaatttgaggatttgtttcccgtagtgtgtttatttgggtttggatggaaatcgagatattattgatctgattgaaatgtctttctacgtatctaccggcgcgttctgcggccctctttgctacatcggtttttgagtctttggtttcttcaagccctggcttctctctttccacgttgttttttgattttgtaatgatgtctgaatgcttcgt

SEQ ID NO: 11443 - DNA, 544 bp, Heterodera glycines
ccccccccacttcccctcctcccctcctcccctctctactgattttctttaactactaatgctcactctctttctccctgctattagaagcttttagtcccctcctcctttttccctctatcttattttcttttttttctttctcctccacccccccccccgctctctctctctctcgctctcctctcctctctgactctacctctctctctctctccccccgcctctttcgctctttctcccccgccctctctctctctctctccctctctctctctctccccgcctctctctctctccccgcctctctctgtcgatggcctggctcgttcggtggcgcccgtcctgtcacagtactgaaaagaaaatgggaacaaattagacacaaaatgaacacgaacggagggaaaagcgggccaactataccattttactagtcatggaacaatgaaattttgggttttcgggcccgaaattggtcaaactgtacgctgtatatgttattggcacttccgagaaggctcaaaatcaatttttggattct

SEQ ID NO: 11444 - DNA, 3766 bp, Heterodera glycines
atctctccctctattactctctctctctcacacacactttattttccccattctcattcattgggcggttgctctttcttctgctgctgttcttccttcctcacttatcctcctcctgctccttctcctcctcctcttcttgctccacatttcccatttcctcctcccgctcccatacaatcgattcctcctttctcatttcttcgctttttcctacccattcaaaccaaacatttattttatctttcttttcatacatataataatgctatataaaaaataaaaaaattttttaaattatttaatatacttttttaatttaaatgcccaagcattagcacatcagattatcaatttgtaaatttacataattatttatttaaatgaaatttctaactacatataattgtctacattcttttttcacaaaggcgttttacttttttaatttaataaaaaattatatgtatcatgtaaattaccattttttaattgaataattttaaataatttattttcgatataaattttgaaaaaatgatttctgctaatggtggcagcgccgccaaagtattaaaatgtctgatgtgtggccagtcggagtcacgcagcacgtttatggcacatattgcagaacatttgtaagagcataataattaataatgactaattactgtacccgaaaatacagtaacccattttttaattgaaatttgtaggaattatcgacctcaccaatgtgccgaatgcgatttccgatcagtgactgctgaacaaatggctgaccatgaagcaactactgaacatgttggacagttatacgtacgtttaattggttcaaccattaatactaatatgcaaattgattttccaattaattatgcatcatttgtattaattaggcatcgcgcaatccctacttggaccggctgtgccgttttgtgtacaacgactgcgattttggggacaaaaatgggggtctcgagaaagttttgatgcgcaaattggtcagcacagcggacgaggagcagcagatcatccgccaagcggttggcacaatgatgaaagccgaagaatggtgggatccatttttgtaaatttatatctttataatgtcttggttacggtacctttgcctttaggttactgtatgaaacaaattttaatttttttttttgactgccaattaaattacaattaaatttagcctaggcctagcaaactaagattaggcctaagcctatgcacgagttgccttttgtacgcgttgtcatgacactgaattgggtgctcaattcttatacatttttgtgccggatttagtgccaaagtgaacagtgccattgagtccgcaactgttggcggtgatcaacgcgttggacaaactgtacaacaatggcttcaacaacagcagcaccaccaccattttgatgctgccgaccaccagcaacaacagcaacaacaattctatgtacagtcaacatcatctaccgtaaccggcaacaaccgtaacagcaacaacaacagcagcaaccaatcccagcagcagcagcaacgtgtgtccagtgacgagttgaagctggaacaactgttgatggacactgttggggttggaggcggagcagttctcggtgcggtggccaatgtttcagcggctggcggtggtgccggtgttgtggcacaacaattccaccaggcatggcatggagaagagatattttccttttcttctgaacttggcatagaattgtgccatctaaacctgtttttgtttcttgcaaaaaaaacatttctaagtttttaatttaaacttgtttttaatgtgcaatttcaaaattctcacctaatccgaagctgggctaatagaaaatttcataaaaaatattttaacgatttatttaaacatagaaagtttcagaagaatctgcgttaatttgccatttaaaaaatcaaataaataaatatttttgaattttgtcattaattttgctttaagaaatttttttctaaacctccccttttatgtatatgcaaaaagtaccggaaaaatttttttataaattattgtgcaatttgagaaatcaaattccttaattgccccaattttatcttaaaatagattttgaattttcatcatttgacgcggatttaggcgaactttttgggggatgacattggcgctgcggatgaacaacagcaggacaaatcgccatcagcaaatgcgtgcagttcaatgcttcaacaatttatcacacaacatcaacaaccacaacagcaggcggtgagtgatcggaactgtgccgtggcattggcatttgttgatatcaattgatcattagtgatcaggatttaacaggtggcagtctggtgacagtattttcttgaaataaatttgctggatagacagactataagccagcagtctaatcaaaattttaacaatttttaatttttttttatgaatgattgctttcagtaattttataaaaatttatttttagaattatttaaattttttgttgtgcataaaaattttttcataatattttaatttttaatgaaggctccagtaattttttaaaatttatatttaaaatttatttaatttttgttttaggcgtggaaaagattttcataacttttatttaattaattaaattatcaatttgtttaaatattttatcatttacataatatttttataaaagtttttaaatatttagaaaaaaaatttccacgaaagacatttcttttaaacaaattttttaaaatttaattaataattttcaactgaaaatttgtttaaagttgatgacacaacactttgacggggttgtcgagcagtacatccatggccagcagcagccaccgccgccgacggcgccgcttcaattggccaacggtgaagcacatggagaacaacagccaaagacagtgaaggggcacaagccgtgcaagcaggtgttcgagaatgtgcaggtggggaaaatggaaaaaaaaagttaattaaaaaataaaaagtgaaatattatttaattttaattttaacatttgaaaaaaaatgaaaatattttttcatttcaataattgaaaagaatattaattaaaatggtaaaatttaaaagaatttttaaatcaaaaaaagtatatattaaagcataaaacattttgataactattaagaaaaaataataataagcataatacctaaaatgaaattaaaatagaaaaaaaaaatttgctaaaataattaattaaaatcaaaatatattatagtaaactaaactttttcaataaaacaaaataaatattttacagtgtttgaagtgtcgtcaatgggtgaaaggacgtggcatatgccttttgtatcacatgaatacaaggtgagagaatcacatccttttttggagaatttggcattttgtatttatagaattataaaaatttatcagattttttgaataaaaattttattattttttaaatttcctcatcgaggatgagacttgttccggcatttttcacgtttggattggatttttatattccaagctatgaaaaatgccatttttcagccatttttttctctagaaatttgacattttcttcccgccaaatttggcattcctttttttaagatttttttatagtgggaatttggcattttctcaatttagaccttccatttttagatattatttttcgtgggaatttggcactttcttttctaccaaatttggcattcccatttttcaaccaaatttgg

SEQ ID NO: 11445 - DNA, 1406 bp, Heterodera glycines
tctagagtcggtgaacaaatttaaaattttaaaaatttaaagggggtcttttaaaactttgtttaagtgggcaaagtttccgtcatcaccgcagcttatataaaattttgttttgctgtgcacatttcccaccccaccacactttgcctcgacatttcaatattatgtccaccaaatttttaaataagctgaatgtgtgtgtttataagcaatgaaaaaaaagaaaaattgtgtgggaggggtgacgaattttgatcaaaaaatgtgaagtgatcggagaggggaaaaagtgattggatccaatggaatgaatgaatgatgtgttgggaaaggtcgctgttaaatcacgcgctaattccgatcgaaaaacattgagtgatcggaaatggaacaaacaaaaaatggatacggaaggagtctgatcaaaaaatgttgcaatcggaaacgaaaaaccgaatttttgttggggggaaagtgtgagggtggaaattaggaattttgatcgggcaaattagggagtgatcagagagactaaaaattattcaatgaaaaatgaaggagggtaatttgtgatccaaccaacccaaagaattttgatcaaatctttgagcaatcggagtgatcggacacggaaggacagaaaaccagataccgacgatggatggatgaaggaggaagcctgatcaaaaatgttgcattttacttgatcagcaacagattcccaacccatggagttgtgatcaaaaaaaaactgtgaatgatcggagagggggaaaatgggttggacaatgaaaattgataaatataaatgccactgatcaaaaattttatgtgatcggagaaggaaacaaaatgaaaaaggaggaaaaattaaatttaaattaggaaatgcatttttgagtgatcaaaaaaaggaacaaacaacgaaaaagatggagatttcaatcaaatacaaatattttagtcattgaatgaactgatcacttcgaagaatttgaaggcggaaggaattcttatagaaaattgtgcatatttattgctaattagagagaggaattggtccgaatgatcggtaatgagttgaatgttccttcataaagtactgatcaaattgacataaatcaggggaaattttaaattcaggttctgactgatcggaaatttttgcaatttgcaatcaatttgaaaggaacggaaaaatgttgatcaaatcgagattttaatcagtggatggaggtgatttaagtaagcatttaagtaaacaaaaacaaaatcggattctgactaaggccttaatccagatccagatcgccaattttttgatccacccggacccaaaaaaacacctgggatttcaatcaaaaaaatccgatttgaattgatatgtaaaagtgatcaagaatttg

SEQ ID NO: 11446 - DNA, 2275 bp, Heterodera glycines
caaaaaaaaaattaataacaaatttttttttgatagaaattcattatcagcgtcatcatcatcaggacaaggcaaacaaacagctgagtcgtcagcaaaaaaaagagatgtttttttcttcaatctttgtaaaaatgaaaggacaaaataaagaaaaaatgttttttttaaatttagtaagaaaaatgattattaaaaaatattgaaaattggaatgcgaaagagtaaatcataaacccaaggcttcaaaatctgggagctggaatgtgaggcttaaaaatttcagaactatcggatattgtcccaaaattttggtaaatgaatcaagagccttaaaaaaagaaagaaatctaaatcggaatttcaaggttctcaaagtttcggaaattaggttatgaggtaaaaaacaaacaaatttaaaacccaaaaaatttccgtatttaatgggaataaaatcgacaaaatctcgaaatatttatgtctttaatctcattaagtttgtaagaaaacgatgcttttattgaaaatttgagtttcttttttttaaatttcgagtcgacattttacctttttcggtattttgtcgtttttttttttaatcggacatttttcccccatttagtgaaaagaaaatcaaaattgcttcctcgttttttaaataaataacattcattaaaaaatattaatgtcagcagataattttgtccgacaacaatttgcggtaaaacgacggacggtttttgtccctttctcatcaacaacaaacaaacaaataaatatgtaatgatgaataatgacaaaacaattaggtaattagatgaacaacgggttcgctaaacatggaaaatttaaacaataccaattaggtgttaataaattaaatagcgcgctaattgatttgtgcgttaattagcacaaaaaggcacaattaattggtcgctcaaactttcaggtgaaataacacaaaaaaatgtggtggcaatctttgacgaatttgtacaaaaattttgcacaaatctgcgaaatggatagtgggtaattagggggtaattcaaatcgtgagtgtgccctgcggcaagtaattaacaaattaccgcctttaattacgtaataaaaataacataacaatttttattaccttagacaagagaaggcttgaaggggttgaaaaaacaaagaaagagataagttaacatttaattgaattttcttgggattaaaggacaataaattggaaaaaggacatttgaacacagatatgttaaatcaataaatatattttttaatttagagtaatttaactattaaattgatttgcacaagttttaaataaacaaatatatttttgagtaatttaaaatgttaaattaatttgcattaatttaaaactcatatagttaaatttaaaattaattaaaaaaaatatattggtgtaaaactgtgtttttgtggataaatggacttttaagaaaagggaaaaaattatttgttttccaaaaaaatgaaaatgtaatacgacggacacaaaagggcatcattcatcatccatttcatcagcaaaaatgaaaaaatgtgttatttgtttttaaatgtctctccacaaaaagggcggcgggcggcccagacagacgacgaaagcttgggaaaacaataaaaacaatgtaaaaattgggaaaaaacaaaataaatacccaaaagttattattattaaaaggaggaattaaaatttcaaaaaaaaaagttttgagggggttgggttttttaattttaaaatgatgggcgaaatgaacagattttttaattgtaatttatttttaatttaaataaaaaatatcgagagaggggtggggcattttggtgccatgggcgccgccattggaaagggggccccgtccttgaaaatggaacaatttctttcaagaatgtccttaggaaaggggccccgtccttggcaataaggacgttcacgtgaaagaaatcctgtccttggaaacggagtaccttttcatgtttttttctgcgtcttttttaagatgtgtttttttttttttggaattttctagtagcaaaaaaatgagtttgaaaagtttcgttttttttttaaattttgtacgcaaattgcaatgtcaccttgggaaaaaggggcctcccgtccttggggcactgatttgaaacgccccttttaagcctaggcttatccgtccttggagaattcactaaattatttgctatgtgcataccgtatttgctctttttatcccccgcggggggatta

SEQ ID NO: 11447 - DNA, 1683 bp, Heterodera glycines
tggagttctgaactttattacatatacaacagttgccctcctgttagcatcagcggacgacccctcgtcgtacgtttttctgtttttcattttgaactttcggctggttaaggtgttgatgatttcagacaacatgctccaaacggtgagtatttttttgagccttttgtgaatgcccttaaaaacggaagtttccttcgacaggacactgtagtcgaggacacttcacgctcattcataacggacatcactcagaagagtcagaagtccgccgtattgggagcccttaagaaaatcaagaatggttacatcggcggggctcggtaagaaggcattttgaaatttaaagtttataaaaattaagtgttgtgatgggaaatatttcggacttttcatccaccacatccgtcagcaaattggaattccaagacggaagtgttgaacagttgttcacaaccaacggagaagctcagccaagaagccttcctcgtgaaaccccttatgaatcaggtgcaaaacagcgattgcaactgatttaattattatatgtcaaataagggacccctcgaggaactttgagacggtcggattcagtgagaggacgttggttcaaacagtttaacactgtacaagcggcttccatgcggtattattataagataccggtcggcatggggatccggccgggactcctggtcccggttttatttggaacaagcactgggattccgtcccgtttttttccaaatcccggccttccaaaaacccggtctctgtttattatcataataggttgattttggtatttattgcgttttttagccatcgttcgattgttttggacagcaatgatgctggttgtttgttcatatttagcccttcgatatttccgctttagacttgctgaaactacgcttggccaatgcgacagtgaaaaaaataatggagccgactgtggaggaggaagaagcggttggtttatcataagtgaaatggggttggattcggccgggttgagtcgacctccccgaacgggtggaacttgtcgggttcagtccccccttcctccgtgatcgttcgtttcactatcattcttacaatcagcctcagcatactcatctcctctcttcttaccacaccgactccatcggggagaacagcaaggaaaggtctgaactgaccgatgattgacggaatcggacccaacttacgacagattgcaacacagtcaattagaagagatggaagttgcggaccttatcacaatgctagccgaaactacactgctagatgaacaagcgagcataattcattttctgtggttgaaactcggccctaacttcgacacgaagttggccaacatcggcggagttacggttcgcatactcattgaggaggtgtacatcaaagcatgcgaatcgcgcgattggtcctgggctcgtcttacggccggactgcttaaaaaacagttggacgagttggaaaaagcaggtgggaaatttgctaatggcagcgaatgttgattaatccgtcggcagaattgtcggcaatttatttctataaaacataaagactccaatggattactatcgtttgatcaaagagtttaagtgactcatttgctggttcgtcagaagcaaataaccgtcggaatgccatccaaaaatgaagaagcgataacat

SEQ ID NO: 11448 - DNA, 3309 bp, Heterodera glycines
  misc_feature (38)..(39): n is a, c, g, or t
  misc_feature (3266)..(3266): n is a, c, g, or t
aaaaacaaggaagagctgtgcaaatttcacccgtgtanncagcgaaggtctgacaaactcttaaaatttctttgcatatcttttcattctcacagatccgaattcgtttattctggctcaggtccctttcatgtgtttcaatcactgagttttgttttgctccttccgttttcaggagttgattgtctcactcggttcgttggtccgcactgatccgcgattgtttgtcgaaatgttccgtttgcgtatcggtctgataattcaggttcatgactgaataaaattgcgcgtttggcattgttgtgttaaatcgctttttgatctttcaggtgctagcgagtgaactcgccaggttaaggaatctcaacgctgaagctgccagccaacatttgctctcggtcagcccatttgaactcaaatccatgctcctttcgctgttgagtgggcggctgcttgaagaatcggctgggcccggaacggaaaacgaattcggcgtcaaagggttgcgaacgggaattggcagcttcagaaaacaaattgaggagagaaaagtgcgattaaagctgatgtatatagagcagtcactttttgataattaagtcgatgcgcgaaagggcaaagtcaatgcgtgccagactgagaagcagcgaaaatttggtcggcaagaaaatggcttcttcgtccgcctcaaagttgtcgtttgcctctttgactgctcccacagtggcaaacgccgaagaaagtccgtcggacagtgaagattcgttggccggtgaagagtttcagttcggcatttggctcagacaccgacgcatcgacggagcactgaacagagtgccgtccaatttttatgcggttgtcctcgcacagacagcggatttatttctcaatggaacaactttagaacctttgggataccgtccgaatgtttccacatggaatttcgattgatgggattgttctcagttatggactgacccaagaaatgacccgaaacgaaataaaatttgcattacaggtaaacacaacaatgaaaaaacactgttaaaaataatattcattgtcaggtcgaacaagtattgaaccaggtgggatggatgttttatgaatactgaccaatttatgggtaccatttgttgacttttgaagattgctgagccagaataccgagaactgattgtcgaagtgctgactctgctgggcaagttgaggcttctgctgatggccgaccctcaaatccccgacggtcgtccgtttgaagtcgaatacgtgctacagcatgcaaatcgggtctttgtggagcacaatgtacaatttcatttgcttcagtaaccactttttgcccactggtcattttaatgtttagttcaaaaatcaatcactttaggcagaaatgggcacaattgtgttagagtgctgtggcagtgggatcggatgtgacggtgcccgtggaatttgcaggcatttttacgacacagcaccggcaggcgaatttggcaccgttcattatataattcgtgctgcgatggatattttcgccccttcctagtcacactgcttgtttcatagatttattctgttttcgtaaacaaattgcatctttagccgataaacatttactattgagtcaatcaattttcgaactttatttggtaataaaatccacaaaagacaaaagtggttcgtcgttttgtttcacttagcacattcattgatgagtgtttttctgaactccgtcagaaggctgtccgtcatcagctcagccatgaaatttcttaggtttttgttctttggtacaattggcacattgttttgttcagacaacaagaagcgattgacatcgaccgggagctgttcacctcgtgcggtttcagcgtggaccaactgatggaattggctgggttggcctgtgcccaggcaatcggtgaaacgttcgaaaagggtaccttgaccgataaattaaatttacttggtcacctaaaaagtgcctttccttttttcagggaacgttctcattttgtcagggcctgggaataatggcggcgatggactcgtttgtgcgagacacttgaagcattttgttcgtttttatgttatttgttagggcatttcttttttgggcaatggtaatgaaaatgttaatcaaagacggacggagaattaatttcccatttgaaagggttaattttaagaaatttaagggattttcgccttcgattctctgtccaaaaccatcacaaaatgatctgatgcaacgattgatggtcaatgcttttgataaatgacgaatcagggctgcacgaaaacaattttttaagaaaatgaaacgaaaaataataatttttcacgaaaaaaacgaactaaaaatttactaaaacgaaaagatttcgtgcagctctggtgacgacgaactgatgtaaaattatttcagcttcaattggaatgcctcggcattcccttcgtcgaatcattccctgaccccaattctattgagaagttcaacttcctcgttgacgcaatcttcggttttagctttcgtcccccaattcgggagccattcaacaaaattttgaagcaaatggaaagtgtccaaaatcgtgtcccaattgtgtcaattgatattccttcgggtaaatttgaacaaccgacggatttgtttttaataaaaggtcaacccaaaggttgggacgtggagaaagggcccccggatgaaaagagcggtttgcccattctgagccctttggcactcatttcactgactgccccgaaacaatgcgcacaattttttaaaggagaatatcattttttgggaggccgttttgtgccacctgcgtaaacttttaacaattttttcttgtgaaattgaacatttaagcttggtacagaaattcggacttgaaaatatgccaccatatgaaggatcttcccaatttatgcgtcttaattgttaaataaattgattatatatttttattctaatgcagataaaaattgtaattaatcaataaaatgaataacaacaatcaatgcttatatctcatcatttcattcttaacagcattgttcataataaaaaagaatagaattaatggctgacgaaattagaattttagcgaaatgaccgctgaaattcagcagcgtcattaccctcacttctgtaattttgatgatcttcttcaccagctgaacgtcataaccaaagaaagtttagaaccctctgaagcagtgcaagtgaggtattttggtgagtatttattgttcgtatncacaatgcattttaggaaggtccatttaaacagcacccgctga

SEQ ID NO: 11449 - DNA, 1531 bp, Heterodera glycines
  misc_feature (1481)..(1481): n is a, c, g, or t
ttgcggggcccggcccggtttgacattgcggacactgccggagaccaggcggactataagcagaagttgctgcaaatcggtcaaacgtacaatgacgaattacgcaaatacgaggaggtgactaaaaaagctctggtcttaaaaattcatttcaatttggctcttgtcgtttaacatgtcaaggcttgcaacgagtttacgcaacatgtcatctcactgttgcgggacatggccacggttcgaccgataaacaatgatgaagtaagaaacagctcaattcctgacccaattgcctttccattttcgatgcaccgaatggttgggatcatccaaaagaaattctccaccatccaagtgcagctgaagcaaagtacttgcgaaaatgtgatggtgcttcggtcgcgttttcttgacgcgaggtaattccattgttaagtttttgaatttaaatggacaacattgcagaagaaagcgtcggaacttcagcaaacaggcgacggaagtgctcaatgaatacttttactcccacctgagcaacccctacccaagcgaagaagtcaaggaggaattggcacggaaatgccaaatcaccgtgtcgcaggtgtccaattggttcggcaacaaacgcattcgctataaaaagaacatcgccaaggcacaggaggaggcgagcatgtacgcgcagaagaaggcacagcgtaagtggcctcgaaaaggcggattaaaatacattgcggtgaaacaacactatgtcccggctaattagctgcgactcagctaacatttcaatatattgcaagactatatgcaaccgcatgtcgcgaaaaaaaccataaaaaatattgataaatttagttgaatagcccattatttgtttctcaacccaatctgtctttcttttcagtgacccttttgcttattgtcgatgtttaaaaacgaagcagtggcgttaaattttaaaaaagaacaatgtcgtgactttgtcattaatttctcacatttcacttcttcagcttctccctacggcgttttgtccggcacttccgctggggccgttgccgtagcggccaattcgatgctgagtccgtacgcgagtatgctccacgccggccagaatgatctgcagcaccaagtgatcgccagtgggttcgacttggcatcttctgggtacaacccgcagttagtaagtttcccggatttggccgaagttgggactttattgtcaacattggcaaatttcagtttcaaatgggttacctcccatcacaacagacgtcgacttcgtcaccaagacaatgacgaagaatgtaactgaaagcaataaactcgaagtttcaatgaacacataaaatgaccacatgcagttttaatgccattttaaatcgtcgtaaagagggggcggaggagaattcgcttctttttctttacatttaacaaaaactgataaaagtttaaaaggaaggggaagaatttttttcaanaaattgtaagagatattcttacaattaactaattcacttagatttctaaa

SEQ ID NO: 11450 - DNA, 4663 bp, Heterodera glycines
  misc_feature (1068)..(1068): n is a, c, g, or t
  misc_feature (1073)..(1073): n is a, c, g, or t
  misc_feature (4638)..(4638): n is a, c, g, or t
agagtcatatcgtgccacaacagaatccaaccgacactgacgctcctttttataccactgaaaaagtgttgaatggcaattcgtacaaaaggagtcacactaatggcacattattcacgtacgtgtgaaattcataattttaaattaaaatgcttgctattttattaaaacttttaaaaaaattttacgcaaatattaaagattgtttgtactgtaatccataaaaaaatatcaaattaaagtttttttgtaccgtaatccgtaaaaaatcaaattaaaagatttaaaaaatgccttataaatcagtttctggtgcgaaacggtgatctgttggattcgctcaaacaattccacaaatgccatcgctgttcgatttgatgggggcagaaccgaattaaattgttgattattgcctcttaaatttagttaatttttaaatttaattattttcggagtaattaacacctacctaattgtcagaatgatgacaaattcggcaagcgattgcttgtccggtgcatcaaaagccggattatcttctggaaattggttccgctccatattgatggaacgcgcaaaaatgcaaggacctgtcaggaataagtttaaataatatttaattaaaaaaaattaaattcatttgtttttttcctgacaagaatttttgcttttaaaaaattatttatctcaatctgatttggcttaattttttacttttttgaataaaatttgtcattttacactcctaaatgggttttttaaagcctaaagcctagctattttggcggttttagagcctaaaaattggtgttctagtgaagaattgtttcattttttggagcatattaaaccatctattaaattaatgatgtaacccataaaatatttaaaaaataattaacaaaaaatgtaaaaagctgcagtaaaatgccaaaatttgaataaaaattcaaaattcagtacgtatgaggtaggaataaaaagctcaaatattgaaaaaaaaaattcgtcgttagtgccgcacataaattcataaaaaatttgagatttcttttatgagttcattanattanatttttgcattcactgtgaagaaaatgtatcattttttggagcatgttaaggcatctgttaattaaagcacgtaaccttataaatgtttaaaacattaaaaaataattaacaactaaatcgttaaaagctacaataaaatgccaaagctataatgaaaattcaaaaattcaatacgtgctatgaggaaggactaaaaaactcaaatattcaaaaaaataatagttaaggccgcacataatcatttgtaaaaacgaaatctagtttataattaatagggagagataaattaatttaatatttttttaatattatcaccattatgttccgatgctgacactgatccgccgccaaagttgaaagaatcgggcaacagatgaaaggaaattgccgccgaacgtggtgagaaggcgaagaagcacaaaaaggacagcacaaataggaggaacgggagagccttatggaggagaaaaaaagtgatttgatcagatcagtggaatgatcgtaaatgttgaaaaagtgatcagaaaatggtgatcaaattcacgccaaaattaaccaaaagtccttgataaaagattttttgaaatcgttgaaaattatgaaaacggaaaactaaaattttcgttaagaaaagctcaattaattattctttcccaaaaaaaaattcaattaacaaaaaaataatgagaaatgaaatgaataaaattattatttaaatattgaataaaataattgtataaattatttattaataaaattgaaaaaatattcataattatggtaaccttaaacagatttggcagtgaagcacttgtcttcaccaaatggaacaacaaccgtttggtggccacttccacacaatggagcagttgcattttgtagatgagaactgcttgctggtctgtgcaaaatttaactcattttattatttgaaattttaaaaataggccaaaattttttttattttttattttattggcattgccaccacaaagttttcagtaaattatttgtgaaaattttaaattgttagagttccatttgcataaatgttctccaaaatattaaaatcttaattgtgcgcccaaaattcagagattttttttttgtaaaaaacattccgccaaatccagggatatccatagcattttcttgttttttaattttgccgaaatgcctgattctgccgatgcacatccaaaatgctccgttgccaccatcatttgctgatttgctgatgccatactgcagccacctgttcctggttcagctaatgcccatgggtaattattatttgtcactaattgcggttcattatttgttgttgacgatgacgtcatcatttcatgaccattaatggtacaaatttggtggtaaacggatgttcggtttgattgaccagcagcagcttgttgttgctctccactaatgtttgttccaccacaagcattaatattcatgttgttgttgatgccatcattatcatctcgactattcaactggggttgagaatggttttaaatttagacaaaattttcaatggtatcatattttattacggtagtttaaatattaaaattattgaaaaatggactaagtattcgaatctaaatcataatgaagtccttccatatgggataacaaaccctaatttggtgccgtcgctcagatttcggcgttggcgaacgcgaatacatggcaatttgtcagcaaaacattatttaaatatatataatttgtgaacaacactaaacattttttaaataaataaataaaaatgattaaaaaaagtaacgaatcaataattatttttaaattttaatgtaaaaattgtaaaccaattaaataaaatttaaatttaaattttccattttgaatttcacaaataaaagtgcacagatttggggttggtggatgagtttagtgcgaacaatggacacttttgaatatttcctgctggtcaacccgccgcgttgcgttaggcgatgacattccgccccccaaattggtggctgatgacgacggggcaacagcaggcggccggccgatcagtgtccgatcaaaaccccaggcggaccaaccggtatgaacgacgacgacaacgccgacgacaaaacaataaatggcggaggaatggtggtgatctgatcacaattcaaaatgtgtgtgtggatctcgactgctgatcaaaatgaaaaagggaagggatgtgacaggatttcaacaaaatgaaagggttggtgggattttagggaattatgagccaccggcttagttataaaagttttgaaattttattttattatttgtatgataaatttaagttttttatacaaaaacgataaatgaaaagcatattggaattccgaaaaaattatgagttatgaaaattgttttttcaaatgtagataagatttttattttcttaagagataacatattacataattttttctaatttttaatatttgctgggtaagaaaaaattatatatattgtgtcgaaggtttattcgcaaatttgaagatacgaaatccattaacaatttagcacatttacccaaaaaaaaagagaaaaaaatgtcacattgatggcaaatatataattttgatttttttacttttaccaaaattattttgacaataaatattttaaatttatgaaaacatgaatttggggctcaatcacggcaatctatattcataataaatccatttggtgcgcaaacgctgtgttgaactgctaaccaatcccataaatgtcaatcagtcaatgttttgtgacctaattaatcccatttgaacatatatttgctgcaacttgcgctccgtcgagaaatggtccatttttatttaatatttaataataataatagaatatttaattataaataaatttaagaaaaattgccgatttgtggcacaataagatgaagaatttaaattagttcttactttatatgttcaaatatgttttcttaaatttacaagtgttttataaagatttgtttagttttattaatagggcctgaaaaaacataaaatcggaaaatatgcacataaaaggtgaaaaacacgcacaagaattttctaaatgagaacaattttttccaaaatttcttaaaattcattgaaatttgaagttaaaaacctgaaaaatagcaaaaatggtatgaataatttttttttgtttgaaaaaaatacaaataaagcctattatttattaatttaaagaaaaccgagtaaaaattcgaaagtttcactttttgtatgagttcccaaaacggaaaagtaccggcacatcacgcattaattaatgggtccgattgacttcataaattgattgattaattgaccaaaattaaaatgctttgtttactttaaaaaatgacaacagaaaaaataaggatgatatagtcgaatcgaataaaaatcccgaaaattgaaaataatcacaaaatgctaagcccaactaaaaatcccgaaaaaggtttaaagaaaaaatcacaacaatccaattcatcaatcacaatatcatgcaagcttttttaatcatccgatttgnaaaatatcatcaagtatatgaataa

SEQ ID NO: 11451 - DNA, 2518 bp, Heterodera glycines
gataattttttaaaaattccaaatcttttcacaacccgatagctaatctaggtagcgaagctcaagaagcgcgaagcgctttatcccagctaaatagccgacggttcacgcacccgctagttactatatatgttatattgacaaggagtttcgtttgcaaaaacaaaatctcccggccgaaggccgggagcgccctgaaagtgatggaagggtcttacaactttttgaggagaatccgggaaaactatagaaaaaaattcagcgcggacgactgagtccctgggaccgatttctcactttttcttgcgtttgaaggcccctaactttttttctaaaacccgaataaaaaaattcccgctgtgagggcactccgcagaagtgtcctctataatccagtattttttattttttgatcagaccaaatcccggacctgtacagacacggagactcagttaatttttttttcccacttcagtaccaggcgaataactcattaggctttgatctgagcggtgggtcgccagcgggactattgtagagcttgaaaagctcgatttttccaaattttaaaatttcaaaaattttcaatatttttcgagctaggcctaaaaaacggttttcgggtttttgaattttaggattttttaacgaattttcccataaaaacggagaccacttccaaaacatagtttttcgagctctatcgattggtgatatttttgaaaaaatttcgattttttcccggaaatagaaaaaatttttggcctgagcgggacatttgagtcccgggcccataactcgtcaggggttggttttagcgaacaattgccttagaacatttttgtagcgcattttaaatgctatcgaatggtgtactataagtctggaaaatttcaaaatttttcgagctaggccccctagaaattttcaaatttttttttgtgtgccaaaatgggggtgaaaattttttttctggggtattttgaggtgctgaatacgaatataatgtttattttaagttttggaaattttagaattttttaaaaattcgaaaatatttttcaattttttgacccttgggattttgggctaatatttgaaaattcataactcaatgaaggactggtcaatttaagtgaattaaagctttaaaaatggagaaaaatcaggagaattttatgggttttatttggattttctagcataaatatgaaaaaagttattccagaaattctggaaattttcgatttttcagaaaaaaattcataactcggttctgaaaaatcactctggaaaaataatatactagaaaaaatcgcaattttttgctctattatataaattttatttcatatttttatcacttttttaagaattgttataaaaataaaagtgattttgggattcgggaccaaaggggtgagcataggatttttgagtgaaaaaattttttcgacaaaaattttccaaaaacatgtcattagggctatttgaggctgctgatcactaatctgacatcagatttcagctatgtcatcgttaagccctcagaatccccgtgtgattggggattctgggcataattttttttgggtggggcaagttcgaagccggacggtgtacattatttttctttatattttgggttatttttcaatgcttttattaatttaaatgttttgcttttattaataattaaaaattttttaattttaaattaagttattttatgattaatgttttttttaattaaatatttatttgtttttcaattaaataattcatttgcattttcaattagaatttgtcaaaaaataattttttaatttaaataaatattcaatcatcgtatttccaagttttttctcttataatcactgttgtcccgggtatttgcttatataaaaatatccatatttccctctttggctttttttgtgattttttttcagctggttgtgtacataataactttttgaatggacattttccctttttgaccgacttcaactcggcctcaaattggcacttctttcgccatgtttcgagcttttggtggacaaacattttgatggcaacaaaaaagtgaattgttttttaggggttttattgttttttatggattttctgccaaaaacgggcctccaatttcaaacgttttttgtctaaaaaccactgaaaataaaaactttttttcaaattctgtttttttgtttgtaaaagtgcgctttttaggaattttgctttttttacaattttaattcttaacattttcagcattttccctttttgatcgcactcaactcggcctcaaattggcacttctttcgctacgtttcgatcctttggtgaacaaacatttcgatggaaaaaaatgaattgtttttacatacttcaaatgtgcaatggttggtttttgagaggataatacaataatttacaaaattagcttggtttcgcaaagcatacgcaaagattggtggtcacaaatttttagaaatttttttattacggcat

SEQ ID NO: 11452 - DNA, 2290 bp, Heterodera glycines
gttgaattttcaggcgtaatttcccatcatttagtaaagtttttttaattttggaagtggtaaattaaaaaaattaaaataattaattaagccaagattaaagttatggaaatgaaacttgtgattaattcgcttgaatttttaaaatgttctttaaatttaaaatgttcgtaataaataatatttttattattttttgatattctttcggcataactaatttttttttaatatgtcatctatgtttttttatttcaggttttacttacaaatgaccctcagcagttaattaagccggaaatcagttgtattccgcaaaagcgctgcatgaaaatgagagatgttgatgacctattagagaagagaacaagtggttgaaaagcagcttcagccattagcataatgtcacattaatactaattaatgcataaatttgactattcaaatgtttattaaaagtactgataactatggaaaccctaaataaatcgaaatgaggcgaacctaaaaaattataaaagaatttttgcattaaaaaaatattttatcgaaaaaaaaaaatatttttttgggaattcaatcacccataaacctaaagtgaggctcaccaaactcttaagggacgccaaaaagaagagaattataagtcgttacgaaacgagccaaaaattcataatgatggcgatttcgggaggtaataagaaatggaaaaggaagaattgacattgaacgaagcaaaagtattttaaaaaatttaattagttttttcatatttttgcaaaatattaattgcttaaatttgctacgtttttcactttttggcgatggctccttcgattgcattcggtccacaagatgcgcacgttgcggcaaatattgaaaacttttcgaatccgtgcgtatgcggtaccattaggctcagttcggcgagctgagtaaaacggtactgaatacgcgcagaaccgttcactttaagacaaatagcaagtgtcaaaaattttttttgaaaaattcagtggtcaccgaagtttacgctttcggcatttgtcgaagagtgaacggttctgcgcgtataaggcaccgttttactcagctcagcgagctgaatctaatggtaccgcaaacgcacggttttggcgactttaggacaaattttttgttgtctttgtgccaaaaaggggccttcattttcaaatgatttttgcctaaaaccaaattcaggccattttttaggttctttgctttttttttgcaattttatattttaatattttcagcaactgcgcacaatgcttggatggacattcttccctcttttgaccatgctcaactcggcctcaaattggcattactttcgccacgtttcgaacttttggtggacaagtatttcgatgacaaaagcaaaatgacggtggaccagaaatcgcaaaggcaattttgaatgcggtaagtttttaaagttttctcggttccaaaaatggcccgaaaattaaaaaaaatcaaaatttataattttattgttgatttttttgtttgtgtcagttttttttttattaaatttactgcaaacattgcaacatcaaagaatggtcatgctgtaatgatacgaacataaaaaccagttttgaaaattttgaattttcgattttttgttagaatccaagtcgggggttcggaattggccaaaacatgtatcattgtcgggatcagcgaccccgaaaaccccgtaagacatttttttactgggccttacatttatatttttccattatagtcataaatttcttagtttggcaattacatggcataaaaatttttttttagaaattttataaaagtttgcttttgtgtaaaattcgctcagagcttcggtcaaaaaatcttgtccacccttattgcttccctttccgctaaattattatttttcataattttagttggtctgcagcgatgtttggatggacattttcccactttttgaccgtcctcaacccggcctcaaattgacactgatttcgccccgttttgatgttttagtgtacaaacattttgatgtcaaaggcgaattttttccaaattttggtaagtcttttgttagtttctttttttttgtaaaagtgattggtttttttgttacttaaaataatagtgtttttatggaatttaggggcaccaaagctttctcgatttcaaaaaatggctgaaaattattttttttttcaaaattaactaattcattttgattttttgtgttaaagtgccggcttttttaagggatttttggtcatgt

SEQ ID NO: 11453 - DNA, 1687 bp, Heterodera glycines
  misc_feature (1499)..(1499): n is a, c, g, or t
  misc_feature (1644)..(1644): n is a, c, g, or t
  misc_feature (1653)..(1653): n is a, c, g, or t
gagagaagcccaaaaagacatttctctcccaataattttcgatatagggactagagcaatttataaaaacataaaagcacatacatattttggcattttggcacataaaaaaatgtctcacatatttcggggtttggcacatattttggtattttgagaaaatctgtaagaaaaatacaagaaaattgaaaaatacattccttaaaatccaccttcttgtcctattttaaaacattttcaaaattttttttatttacttcgaatagtgaaagtggtaaaaacccaactcgtactggtaccccgactcgtactaagattcctaactcgtactgtgcaacaaaaaacgaaaaaaaaacacaaaatcactcaaaaatttttataaagttgtttttaatttgttaaaaaatcgaaaaaagcaagcaaatgatgaaaagctcgaacaatttaattgaattcatataattcatagattttcatgcatttttgcggtttttaataaaaatgaacaacctaaaaattaatatattattctttctcatgattcttcgatgcatacttatactttcacagaaaaatttgttctgttttttcattctataaaaaataacagcattttttcaataatagatgatctatggcgagcttttgtttctaaaattatattagatataggatttaaaatgaattaaattaataaaaagattatgtgtaataaataatacattgtttgtctgttcatgcattcatcagacattcatagttagtattctttttatttatttttgtgtatttaaattaatatttaaatatttattcaactttttgacctcatatccttttatgtcatttatgtaaaaataatattttcatattatgcgttttaggttttgatattgcgaatgctcctttatgtatagagaaatacattttttaatatttttttgtcaaaatgtgataatttcttattttctctaaatatgatgaaataaggttttaaaaattagagcaaattgtatattttctagggtgtggcttcggagttttcattagtgtaattcttgacataaaatcaattttatttttttaaattttcttgtcttctttccctacattgagagagaatgcaacgaaattcaaatgttttttatcagtaaaaataaaaattttatttttcaataatatgataaaataactaaattgtttatatttgtttatcattcacattcaagcttttatttttgtattattcattaaatatttgtattttacaaaattattttatctacttaagagttttattgttcagtagaacatgaataaattagtagattaaccttttttatttttcattaaatatttactataatgaattcttttgtattgatatatttccattaataatccattatttttattaaaaatttattaaactatttttaatgattttagtttttctgtttttttttagttttttttcctaatttattttttacgattanattttttcataagagttattcggctctccttacggagcgaattattttttctaatagaatatctaaaaaatacgaaaatgaagtttattcgtatgctataaaattcatttatttttatttaaatcattcaaaaataaaaatgtcngaactctgngattccgactgccgatcaattgatcagcagaatt

SEQ ID NO: 11454 - DNA, 2775 bp, Heterodera glycines
caaaaagaaaattcaaaatatgtttaatttttcactcgaacccccattcttaccagtgcttgtttttcccggttgccctaccgggaccgggaaatagtttttgaaaatccgggacctcggaggaccgggaattcccgccacggtcccgtcctaccctacatgaaatgtgttgatttgcgattttgcgggagaatgagattttttggaatttttagcacataaaaattccatccctagtaattagaaatgttttgaaattctaacgctctgcgaaaaacccagtaataagtataatgtgatttgagggaaaatcaaattttgcttcggggattgtaagcacagtgtcagatgaatgcgatggtgaaaaagtttatcaaatgaaacaaatcataattaaattttattcttttgcgacataaaatttgccagtcatattagtaatttaaaagtaaactcaaaaataaacaatttttaaaaactcttctatttcaatgtttgtctctcgcccgcgccggtcacaattcgttgtgtctgaaaactttcaaaaacaaaaattaatcgtttaaatattaaaaatatatatttatatataaatatatatctatgtatatacagtgcagcatcacgaaggattttgacaacttcgacgtgtccttttcgtgcagcaatatcaattgccgtgtctccttaatttaatttgaaatcagtgaaaaaaaaaaatatttaaattcttgcaacatttttgatatggaaatttttttaaatgcatacttcataagctggggaattcagttcaaaaaaaaccgtgtttgaatgagaatatttgtagggataatttgccgagagtaaaaaaaagagggagaatttttgacgcctcaatttacggcctgctgttgccagtccatatgtttaaattgtgcatattgttaagtattcctccacagtcctatgggctgcggcgccactctcaaaaaaattagtaaaacgaaacattttatttattttttctaaatttttatagtcaaatctaaaaaaattcagaaaatcaaattttcacagaaagggaggggaatagtagtgatggtcccattttcaaccccacgcgatttgtggggctttattaaagggtgaggcactaatggagggttgcgggaaaaatttattacttaccctttttgtccgcttggtcagctcgtgccccggccttcaacaatcgctgtacgatgtctttcaagcccaaattcgatgcccacattaacgcggtgacgccggccgggtcgccatgatgcacattggcaccattgttgatgagaagatcaactatgtacaacagccagaatgaaaattgcaattcgtaacgggtgaggggggggaaggaaagttggcaaaatatttgtcaaaaaatggattcacaaattttatttatcactaatttgagtttgagctatatatttctaattattatttattatatgggaaaaatttgtagaaaatttttaaagaaatcattttacatattgaaattcaaaaattttttattagattttgcgccaaaacccactatttatcaattaaaaagctgaaaaaagcggactcgctcaaaattttcttgcatagaaaaaagttcttaaggaaaaacttcaaaatttcaactttttcgcaattttcatgtataacttttttggtaattgtctaatcgcgaagcaatcgcttagaaaaagcttctaaacacattaatcttttgaatgataccaaaaattttggatttggatgacaaagaaaaaagttatagaaagttataggcccaaacgtgggggctgaactgaggtaaaccggcaaaatagtgcaggatatcaaacggagaagaggacaaaagtcgccgctaaacgtcgccgggatataaaattatttttaaaaaatcaaaaaatttgttactcaatatttaattattatttattttttgcgtcgacgtctttgttagggaaaaaacccaactcgtactgtttttcgacaaaaaaatagtcataacttttgtaaagttgaccaaattaaacattctttgtatcattctatagctattaacgttctttatctacctaccaagtttcaaaaaatttgatcaagtttgtaaaaaattttttacgatttttggctataacttttttgaaaagcaataaaattttcttgcattcagcagttcgattagagaacgttaatagctatcgaacggcaccaagaattggtcgattttaacaaaagttatgacgatttttttgtcgaaaaagtacgagttgggtttcgtctctttgttagttatgcaccacaaaaaaatgaaaaatttctcaaaaattcttctccaaatttatttatttattttcttgacaagaatttctattttaaaaatttttatctcaatactaatttggcctaattttttttttttactttttttgttaaaattttaccattttacaaccctaaatttgaaatttttagcaaccttttaaccatttttagtaactattttgggggttttttagaaactaaaaactaattattttggcagtttttagcaactataaatcccatccctagtaaagatgaaagatgtgaccagtgtccagccgggcattgttgtcacatgcggccatcagtggtgagatgccaaattgcggcgcgcccacgtcgatgttggccccgtgtttgaccaaagcttggcatacttcaaagtgtccatccatggcgccaacccaaaggggcgaaacaactgaaaat

SEQ ID NO: 11455 - DNA, 3734 bp, Heterodera glycines
atttgttaaggtgaactttgcgcgctatttgctcacccacggtgcaaacgttggacgcttggacaacaccggtggatttttgtcaaatttctgaattttttgtccaataatttattgttcccgtttcaggaagcgttttcgcactgatgctagctgccgaatctggtagtttggagatgtgccgtctgttgatcgaggaatgggcagctgaagtcaaccagcaagcaatcgatggcacgacacctttgatgggcgcgagcagtgaaggacgcctgaacgttggtgggttgaataaattggaaaatcgataacatactacctgactctcttcattttcagtgatttatctcatcgatcatggcgctgaagtccaacacacagacgccgaaggatacaactcgctgatgcacgcggtgaagaacgggaagactgaagtggcacgacatttgctgaccaatggcgcaagcactgaccaagtgggcaccgatggtgggcacaacttcattcttttgatgaatcattacacaatttcccctccatttctaaggcaaacgggcacgggacttggccgaagaaggaggacttgccgaaatgatggacatttttcgcactaccacggcagccgaacgaacggaggcggaccattgaggggtgaaaatgatttttttaaatttttcactgacataaattaaaaaattcattttcagatagcaaaacgacgaccaacagcagcagcagatgacaatgagagggaattgcggctcacaaacaatcggacggatctgatttatattcgatcattttcatgtatgatgtattgcaaatgtattatcgccatgtatattttgatttgcttgtcacgctcggatatttgctgctctgattgtacatattgtattattgtgcctaacaacattaaatactcgataaataaattgtttgtccatcaattcttggtcattttggttttcttttatcgaagaaattacagcgagttctccagtagagttcattcgcatcctcataatttacaagggttgccagtattgcattcagttgctgaattgcgtccgcaaaatgaaaagatcaaaaaaagggcggcaccatctatagtactaccttaaattcttcaaatattatttggatattataaaaaattatatgaaattttttcgtaaacttttatttattaaaaagaaagttattttatttaaaaattttgaactttctttaagtaatgaataaaatgatagttttctacaaaaatctttaaaaaaatttgaaagagatcaacataaggaagaattgaacctttgaaagaagtaaatgaagccaagagactaaacactaagcaacacaagtaataaaatatctcgttttaaaaataaatattaattcaatttttaataaaactttctttcttccaactttgctaatattttgagccagaaccccattcttactattttcggacccggttggacccggacctaccttgacccagtcgggtacccggacccggcctatattttagtcggaatgattattgtaataaacaattttggtattgattaaaactggtgatttcatctttattgattcagattttgtgaacttatttcaaaattttggattggcagatcatttggagtaaatcaaaagattttatatataatatttagaagaaagtgacaaatcactcagaaaacgtttatttaaattttgaaaaataaatgttctgacgataaagccgggactgtgctcaaaatcagaaataatatgaaaaaatatgtcaaaatatgcaagatcttaaaaacaatgcgataagcgaaaaggaattgaagcatgcgttatctcgaaaagccaaaacatgatgccaaaagtacgatcaatcatcagaaaatataacaattttctttgcaagttcaatcaatacatagccagcagcagcggaacagagggcacaaaaagcgataagtgaggcacaaatgatcagagacaaagtgccgacaaagccatggaacatcaaaagtgccatcgcaaacattgacaaagtgagcacagtcaaactgacgacattcatcacgagaaaagggaaaggcaattgtcggctcaggggattgccaactgcaaaaacgcagcagcaaatggacgacgaactgagcccaatgcacgcaaaaagcagccatttgaacacggacaaaatgacgacactgaaaaaagggacggacataacggaaattaccaacaacttttaaaaaacggctcccaattatttgctttttttattgtccacgatcgctgtaatcatttgttagaaaataatattttgcaaaattttggagcatcgtttttgactttgattttgggcctttagtggtgccaatagcggagaaaatttttaaaaattatggtatttctaataaattttgaccaaacacgtaagtttttagcagaattttgtaaatctagaaaaaaccacactcaaaaataaacacgaaaaactgacaattattgtggatttttaggctgaaatttaaggaattttgtgcccgacgttgtcgaaaagcgctgtctgaaaatttttttctaattttcttgtttttaacaaatattgtcaaaaatgatcattttcacgaaagaaaatcatcattccactaaagaaattaatgacccttaaaagaaagaaaaatgcttcaaaatcagtatatttaggagttctgtttaaaaccgtgtctttttggcccatttcatgccaaaaattgcatgccctcttatgccccttttttgaagaccggcgctcccgttttggactttcgagattggcattcccggtaattaccctaaatcagcatccgtttttgcttgcagctgatcgtaaacattttgtccagcaattgcactgctgttagtggtgttcgtcctgctgtcattgttctgatccgcttctgttccattatgggcttccatttcgattttctgtgtaaaatcactcattttcttttaatttctgatcattataaatcattcattattcatttacctgcactttgagattctgatcagtgtgatcaagctgaaagtgaaaagactcggttgtggcgttggtgcgcgaaacagtcggcgtgggcataacaatgagaagaaggccaacaaaagcaataagaaatgcgagaaattgcattttagaatttcaaaaatagtatttacaataaagtaaaagttaggatttattttatttttattaatttttgtacgaatatttaaataaaaatgtttggctgaataaattggcagtaaaaataatggtttattataatggtgaaatcgcagatgtgtgaactgatgagaaaatgttgagatcattcagcagattaactggtgcgggcgaatgcgattcatttgcatatgtaaggcaaagtaaacgttaaatcagggttcggatcgaaaatttttcaaaatcaggccatcgggcccaaaaaatcagattgtggggtcaaaaatcagaacattttgcaaaattgcttcaaatcagttatttttacaattaatttaatcaaaaatcattaaatattatatttttcgcctccaattatcatctttaaaaattttgggaggaaattagcaaatcataaattttagtgcattcgggataaaaaaaatcagatttttaagaattttttgcggcgtatttttccaaaaaacttttgggaaatgggcgaggggggagggtc

SEQ ID NO: 11456 - DNA, 1416 bp, Heterodera glycines
catttgcgcatatttccaaaatcggattcaaacttaatttttttaaagccctgataacataaacagcatttaaattaagaaatcgtattcatcttaagttttaatctgattttcaacataggcgaaaatctggggtaatcgataggaatgtcaaaataaaaaagagaaaaaaaattacatttgtttttgctgatttttgaaaataaaaattttttgcattaggatcgatttctaatgaaaaataatgaattgggcattaatcctcttgaaacaaaaggccggcacaagagcaacaaccacagcaacagatcagagccgaactgccaatgaatgccaaaacaccgacaaacccggaaaacaccaaaaatgccatcacaataatagacaaaacgccaacaatgaaaaacgctggcagcacccacttcgtgatgctaattttcttgccttttgccacaaaaaagcacgtgactgacacaaaaattgcaataattgtgaacaaaactccgccaatgatgggccaaatgaggctgaaacatacataaatcattaaaatcattaaggatattgaatttggtgagggatatttaaatatgggaaaatgggcacgaaaaggcaaatttggtgattttaatggaaattgtcgacgatgagataacctacctctcagcaggctttgcatctgccttcttctgatcagtcccgtcattcgccttcttctgatcagtcccgtcattcgccttcttctgatcagtcccgtcattcgccttcttctgatcagtcccatcatttttctccacatcaaattgctgatcaatctgctgaccatcttgcgttccagtaaaattgacgatggttgcggtggtgtgatttgccgattcatccggcacagccaatgagaagaggaggaggacaaagaaagtaatttgattgattgttcccattatataatccgactatctttgaggcatttatttttaacaattttttaattattcatcttatttgaataaaaaaatagggatgagatttaaaaaattgaaataaataattatttttagtaagcaaaaatatttaatatttttttttttgttcaattgtagacggaatattcagtttcaaaaaatatcttttgttcgaagataatttattttctcttagcaaaaccctgctacggaatcagcgactgaattagataatggcagattttttaaaaatttttgcacaatttacatatcatattacattaaaatcttcaaaaagttttttttaattttagcccaaaatttcattgacatttttggcgcaaaattactaaaaagcacaatttttttttttatggcgattaaatttttaaataaaagtggagaaaaaaaataagggctgaagaataaaggtcttcggttcccttttccggaa

SEQ ID NO: 11457 - DNA, 1442 bp, Heterodera glycines
tatttttcatattttggcattttggtccatattttatgtccatattttggcatttttcaaaaaaacctctattagaacggcccccagcagctaaattagcctttttgagcccaaaacccgaaaaatttttcaattgaataaatttaaattttcttaaaaattaataaattatgtcaaaaataagcaaaaaagcgaaaatttcgcttttgttgttgattttgcgctaaaaaaattaataaattttggcttttatgttttttttcttttaaaatgattgcacgtaattgccgaaaaaattcgagaccaatttccgaatgttgaccgactaattgcaaaacgaaagccgtctttgtcaaagcgccttaccgagtcaaaaaatctggaaatgtatctcatatgcaatttcaaccaataaatttgaagaaattttacattcaattttgaaaaatttatgtccatattttgacatttttgccattttatgtccatattttgcgatttttggtccatattttatggccatatttcgcgattttatatccatatttttaccagccctactaatgatcaattaattatttaaatttttaatctattaattagatttgttgaccataattataatttgattattattttaatatttcccaaacaaattgcatttttgtgagagaaatacagtgccagaaaaattcttgactcaaacctgaaaaactatcttatagttcatttaaaaacttgaaataattcatgcttgcacaacttttggtgctgatcaaaaaagtctcttacaccaacttaatcagatcactccttcctagtgaccgggacacccaaaatacactgaaaatcgggaaattttcgaaattcctagggggttgggaaattttttctagagaaaatgggcaaggccactggaaagagcacaaaattctctactgatttgaattttgaataatggggctacgacttttacataaaaagatatacttggttgaatatttgatcaccataaaaatgatcaatttttgatcagcgccataactttttctagaagcatccaaattaaacaatcttggcatcttttgatagccctgagtgtcctctatttgcctttaaaatttcaaaaaatttggttgtgtttcaaaaaagttgcggcttgtaaatttcataaaattgatttggtaaacctttttgaccacaacttctttgaaactcaacgaaatttttttgtattttacaggaaaatagaagacacccagggctatcaaaacttaccaagaatgtttaattgggtgcttctataaaaagttatgttgcatgaaatttatcaaaatataacatggtcgtgtctttttttgtggtcgtgtaaactgaaatagagccaaatataattataattatggtaacaaatctaagaaatagattaaaaatttaaataa

SEQ ID NO: 11458 - DNA, 2557 bp, Heterodera glycines
agagaaatttggcaaaatataacaaatttttggccatggggaaacattgacggcacggacacatttttagaatatgtatcaatctaaaacaattgccatagcaccgtcccatgggaaacttttcataaattgggcttctcggaattaagtgaaagcccccgaaagaattgggaataaaacaaaatgccaatctcagctgaaaaatggcaatcccagccagttgaaagtgccaatctcggctgaaaagccaatttcttccggctgaaagtgccaattccggctgaaaatggcaatcccaaaccctgagaaaaatttagaatcccactaaaaaattcgttaaaaatttaaatatcttaaaatagaaaaaaatgcttagaaattttccgggcatttgtctccattccgaacccctgggagtcgaaaaatatggcctaaggcatgacgatgaaaattcccggcactttgaagcgatcagcgcgggacacaagtgccgatgaagatgatggtggcggtgattttgacggcagcagcaacgagactgagtcggacagcgctcagtttggaagccaattgaaaagggacggcgccgccggagggataagcattggcacttttcttggcaacatttcggcatcggcacgcgctcaactgcacaacattgtaaacaatgcgagcatgaccaagaaagagatgagcgaagcattggacacatgggcacaagcacagggccaactgttcaatgtgagagaccgcgggggggggagggtgatcagaaaaggtggataattgaaaaggaaaagtgatcagaaaaggtgaagcatttgactgatcagaaataaaagtgatcagaaaaggtgaatcattttgtgatcagcagaaggaaaagcgatcataaatatgaagcattggactgatcagaaataaaagtgatcagaaaaggtgaagcattaactaaaagaaggtgaagcgatcaagtgaaaaattgactgatcagaaggcaaagtgatcagaaaaagatgaagcattgactgatcagaaggaaaagtgatcagaaaaggtgaagcatttgactgatcagaaataaaagtgatcagaaaaggtgaagcattgactataagaaggtgaagcgatcaggtgaagcattgactgatcagaacgaaaagtgatcagaaaaaggtgaaggattgactgatctgaaggaaaatgatcagaaaaagataaagcatcgactgatcaaagcgaaaagtggacagaaaaatgaagcattaactgacagtcatgggaatttgttaaaatgttgaatgaaatccattgcccctcggtgatcagactgtttaccttggcctgaaagcggcttatgagtcggcacggcaacaattggaccaacggcacgcggcacagatgcaaaaccaaacacaggtaatgaatgagttgatcatttaacaaccaaaatgccagattttttgaaacttttcttgtccccgaccggcaatcaccgaaagtctcatccccgaaaggtgtcggggatttaacccaaattaagaaaatcgttgactaatttttgatttggattaaataaagattaatttcattgatcagttacattttttttttggcattttaggcggtgcgcgaggcggacgccaaaattcaaacgattgccaagtgaattaaaaaatagaaaaaacgtaaacttttatgccattttcagcaaccaattcattacattagcggaggagaagcaacaaatggtggtgggttttcggacgaatttttctgagaaatttttcatgaaattttggagattttaaacattttatagggggatgatctagaaattatgatgaaattctgatttttgtcatttggaaagttttgaggagtttatacattttagattttcttgggcttagaagggaaagaggggtgccaaatttcgaattttcacactaaaatttatggcatttcatcggatatgccatttttaaatcagaatgcccaaatttgttgaacatcattcttccaggaacaaatggcaaaattcccagcggatgtgcagcaaacactgctccaatttgcgccctatccgtacaacaaaaagtgatgccgaaaaacgaaatggcacagaaaaagatggcatttttggcattttgtcgaaaaaatatgccaaaacaaaacaaattttgacaccccattttcatacttgattgttttttattggttatggaataaaaaacattgctccataaaatttgcaaaaacaaaaaaaattgggcaataaccccgaggataaagcggctggcacggcacgaagcggctgacacaaaaatgtcagtcagtcagtatatctattgcaaatgtgccttccggcgccgcttcttccctccccctcccggccgtccattcgtcacgaaactttgcgccaacatgaaacgaaatgccaatgactgactgagtgccagtgccaatggcattccacccactacatgaagaatccccccgagggctgctgccaacaaaacttcacaaaaaagaacatcacccgccccctcccccg

SEQ ID NO: 11459 - DNA, 1885 bp, Heterodera glycines
  misc_feature (52)..(52): n is a, c, g, or t
  misc_feature (57)..(57): n is a, c, g, or t
  misc_feature (67)..(67): n is a, c, g, or t
cccgccccctcccccgcctgttttggcacttttgtctttctgagggcacggnacggnttttttcggnttggccgccgcccacccgcctaatttattcttggccttgctcgccacccccactccattcttggcacaaatccccacaatttgctcatttttatatcttgtcgatgagccgggggcacagaaagcgcaacagccaaatcaatttaattgacggaacttttgttttgccataaaaatgttgcgcaaaactatcggcagaattaattacgggttactgtagtccagaggcaaaaggcgtacagtagaatttgacattatttcaatgctgcccatcgctttgcttctgcaatcaagctaattgtgtttaatgaattgagtgactctcatttggccattctataggattatttggcattttccttttttaaattgttttcatgacgattgttttttcaattttgaatatttataatttttttattttcatttgcctattcgtttttttaacaattttattatttgagaaaactttatccgaactccgaattcaccaaaataatttatctccgagaatgggagctggttatttatattcttgaagttttactcctcctatgaaaatttaatttatgagagcgtccttgaaaataaggacagcacagtattcccatggaaacgttcacgtgcccaatcaataattggcagagtccggaacagggccggatcctgtcagggtttttccgaactcctgatcccgaaatccggctctactttgaaaaattgacgacctggatcagaaaaaataggatttttaatccataaaatcctgtacggatgcaaattcccgagttctggtcctggtcccgaattttacataatttcgggctctaataatacattttggatcactattcaggggatttgtgctgaattggattttgtatttgtccaacacctaaatctgaaaaattggatttaaagacaaattctgaaaatcgggatttaaggactttcaaggacaattttttcggcttaattcactgccgtgcccattccatcaagtgcctgtgaccatgaaaagcatgtcaattgcgttcagaggtcgaatggcggaggaggacagcggggggaagaagaaaaagtcggacgaagtcagtctgatgaggaaaaagtcgtgccaagaacaacaacaattggctgctgctgatcagcaacaacaacaacaacaggacgagaaggagggaccgttccgatcggtgagcaaaaagtgatcggagaaatgtgtccaatattttgtgggtcaatcactccgatcgggtgtgctttggaaaagtgattggaaaaatttattaaatcgttttaatggactccgatcgtagagtgaaagttttcggaaaaatgcctaatgggatttttaaaagtgatcaatatgctatcggtttaaccaattagcgattttccaaagtgatcgtaacagttaaatgcagttcttgcagccaatcgcttaaattagccaagtgatcgggaaaaactgttcaatttatgtgagactattccaatcaatgtttctgatcactgatcgattccaatcgatattgaatcattgggtctaagcctaattgatcaggcaaaagaaaatcgagaaatttatctcgagtctagttgtttgagcatcactcggttcactaattgttctgcttaagtgccttcatttgtaccgtaagccgttggcggtgagttaaattattatcattgttactgtaatccgatggagaaaagtcattatgatcaacaaaaaggtgaatgcactttgtctggcctttctgttcatctactcttttctgggcggcttcatcttcctccattttgaggagccaaa

SEQ ID NO: 11460 - DNA, 2469 bp, Heterodera glycines
  misc_feature (1928)..(1928): n is a, c, g, or t
  misc_feature (1956)..(1956): n is a, c, g, or t
  misc_feature (1959)..(1959): n is a, c, g, or t
aattttaaactcagaaaattgccaataaaggtccaactgattggccatttcccagcacttatctggcgcgaagaataattaattctttttcaaatggccatttgggtcagcggaaaatgttgctgaaatctgagtattaaatgaccatttgggaaaatgggttttagtttatcccaaaagcacttaaatttccattaatagaatttaaaatggaaaaattttttagtttcgaaaattataaaatttaggttaaattctttaacggatttgagcaaaattatttaagatttaaaactcgaacaaattttcccacctctttcaaattcattaaattagaaaaattaattgcacttttgggttttcaattaatttgttttaagtttattttaaaataataataatattttccatttttgctggactcatttgccagtactgttttttaaattcgtcataaatgccaatatggatttattggtggttttctgccactgaatggagaagggcatttgttcaaatttttctggcatcaaatatttttttctaaatattggcatgaccatgaatttattttttcaattttaaataataaaaagatattttattttgaaaatttagttagatctacatttttaattataaatcatttaaatggaagaacagcggcgtccaatctgcgactattttgccataattggatatgatccggccagtggactgaaggttcttcaaaataggggctgggatttctttaattttccattggcattttaaacaaaaagtcaatgagttttttgcccacggaaaatttttaaccgaaaaaaaagaaaatcaaattaaatgtcaattttttattggatttttggataggaaattgacgaaattgttgataaattttgaatttttcaatttattaactatttttttaatgagttggggaagcgttttgttgagaaaaatgattatcaaacagacgctcaagcaaattttctgatgaaatttaccattttatatgtaccaaaaggcccattttaggagggattaaatttaatccgggtaagccgaatgtgggccgggtgcttattttcctctcacagaccgggcccatgtcgggtccggctaatgtaagtcggttgagctgttggcaagccggatttttgttccaaaaaatgccggcccgaacaccggtgcccagtacaatatctccatttaaagaaaaaatggtgggttaacccctatttcattccagcaagagcgcattgccgaatttggcgacccatccttggccacctgcagcaccagcagtgggccgccggtgcgcaagtcgccactggacgccacttatgagccaaaagtgattgcgcatttcccgacggaacgcccggggcgcccatttgcgccagaaatagcatcggtacaaaaatggggggaaacccggctttagaaaaattttaaaaaattccaaagagcctcagccaaggatttacgagtaaaaatgtattttttggatgggacaggtgacaaattaaattttattcgtcctaaatttcttaatggactactccttaacgggatcgcaaatgcatattttaaaataattaaaactctgtccttttagcggcctttgaggcataataatttttgggccaattttgccataatttattttaaaaaaaccaaataaatttgatttttctaaataaaattcatttaatatgtacctaattaaattatagctcgcattgccccagggcattcggcttcgaacagaacggaatgtgccccgggagccttttttccactcatttgtggtcattcgcgaaggtgtgtggccatttgagtgaataaattataccgcaaaatgccattaaaataatgaacaacacaaattttagatggttctcggatttacgggtgctcattgattntctttgaggtttatctaattaattttanaanatgtgaaatttgtttttttttttttttttgcttttttaggagctttcttccatcgaactccgacagcaaatgtatgaaaaaaggaatattgaaatatataatatattcaattaaaaatgtccttacaaattaggcattattggacatttatggctcaatttaaatttttttaaaaattaaaaatacattaacaattttttgggctgacaataaaataatcatacattaataaaggggcgagggtcaaccaaaatttttgcgaagggcatctcaacgccgaatttgacaacttcaattttttttttttgattttgtccaaaaaataatcaatttttgcgattatgagccaatttttttttaaccaaccggccacacctcgatgctaggggtccaccattttgggggcctttgcgggcgatggagaggggggggggaggggggaggttctgtttcagtcttaaaaaagacaatataaggatcccccagggtaggtatcaaaaattatgaaaa

SEQ ID NO: 11461 - DNA, 1694 bp, Heterodera glycines
tctttaaaaatttgcaaataaattttctaaaaatttggtaaatctaaggcaaacaattcggcaccaccagtggtggcacacattcggccataaatgccggcgactgttcggcggatgcacggcgcgaacatgaacatgtcacctattacaagaacccaaagagtccgctgttcatctccaaatgcttggccatcattacaccggtttgggcgggcaaaagaaaaagagatttgacaaacaaaaatgccaagagatttgctgaacaatatgatgataatttgattggcaacgatgataaatctcgactaaaattcccgagaattatagttttttgtaggagtgggggtaaaagatttacataattcgtccaaagtactccttgatcattatccaaaatttaatgactaatcctgagaaatttttgttttttggctacaaaaaagagaattggaattattcttaattgctctaagtctggtcataaacaagaatatttggctaggcgcctgaatgtagggctctgcgagagtctcgactctcgtatttattgggcttccttgtctcttaaaatttttcgggttttttgacttaaatttttttgtaaattttaatttaaatattttctcatcccgttggttgatcagattcctgtcatttattcatccgagaatttgttgcacaatttgtgggcactgatcagcgagaaatttccgctcagagaatactcagtggaggacctgcttcattggatgttacacgaagtaataatcatcataaatgatgattaagaaatttaaaaaaaaattgcgaaattttttaaatctaataattgactaaaaaaatttcaaaaatttttggctctcaaattttactggccccattttatctaaatttggaccttcgtataaaaaatgtatttttacatttatacccaacggcacaaaaaaatcaataaatctgctaaaattgtgccattcccatccactcttcctttttcagctttatttgccggcacccgcctgttctgcacagctatgcttctccaacttccatttgttgctccgtgtgccgtccgtggacgaaatgccattctttgactatcccattgaaacacttttcgcgcacattggtgttgaccaatttgtcaaactgttgaccagcttcatgttggagcagcagattttgctcatctccaaaagtaagggaggactaatgattattaattttatattttggcccaattttggaagttggccaataatttatgctaattaagccataacacaataatcggttaattgtaagattccaaaatgaaaaagtttttcaagaaaaatgagcaagtttttttggaaatttaaccaattttgccacaaaattcattaatacttcgaatttttcccggcggcgcctaacggcaccgcggacccaccattttacatatttttaaaatttgccactttttagaatttacgaaaaagtatattagtccttgagtgcccttgaaaatcgtgtccttcctttatgtaacagatcccaaattctaaattttgtgcatttgtacagtcaggcccatttctatccttgaatagccaacaatgttcttgaataaccaatgggataaaaatggaaataaaatttgaattttgaagaatttccaacctagggcttcaatgtcgtcgtttttttaaaat

SEQ ID NO: 11462 - DNA, 1445 bp, Heterodera glycines
  misc_feature (125)..(125): n is a, c, g, or t
ttttttttttgtttgcttcttttttagcaaaatttgttcattcctaagggggcaaaaaaaaactaataggataaaggagacgcagaaataattatttggattttttgatttaatgtccctaaatngtggaagaggatctggcccagaaatttttttgtcaaaatataaaagctggttgatcgaatttgatttcaaataattcattttacagattttgttgacacgaaaatgttgcaaaatttttgattaaattaagacaaaattatgaaaaacacaaaaccaatcaataatagtctgatcagggctaatgccactgattgctcaagatattattggtcatttcctttcaaacagtgcaacatttgtttgttggacatcgatgcgcgacgcttggaagtgccggaggatttgccatcctttccacgccaacagcgcatgatcagcgagatcaacgcattgattgcccgatcagcatctgctgctgatcagcaacaacagaagcaggcgggggaggacaaaggcgtgcatacattttatatgcgggtaaattctatattctatatgttatattttgatgcataattggtatacgattttttcaattcgtctatatatacattatattatggacaagtatatgttgttgatggaattttattttatgaatttttagaacatttgcttgtggccaaaaaattcgttcataaaaatgcattaaagacaaaaaaaaatgaatatttcatttgagtaaaaaataaaaagaaaattaaaataatttaaacaattttttttacaaaatgttttaaaggaaacgtgataaattttctgggaaaatagttatctaataattaaaattttcatttgtattacgaatatgtaattttttacaaataaaatatagcaaatacatatttcctggatactaatactcaatcttttattataaatatacaaatttgtatgcacataaatggcgcattcaattatttatcaatttagcagtatattttaaaatgctgtggtgctctagccctgaaaaattgaatctaaggttttctggaataaaaatttccaaattttacagggcctccaattcaatgcggccattcgtcagctgtttctggaccattttgtctcactgttctccacctatgaggcgtatttgcttcatgccggcacggagcatggtggcattgtgtcggtgccgaagagtcggcgcaagaatggccgaatgtttcgagagtcgagcgcaaattttgacaaaatttcatttctggttgatcagccggagtcggtgctctcatttctgagtgcattccttgaaacacaggtgatcatgaacgatcgatcgatcaatagggctcctgattaaaaatttgctttcagtgatacctttttcttcattgtaacaaaacacaagcttttcttttcggtagacgtaaaat

SEQ ID NO: 11463 - DNA, 2412 bp, Heterodera glycines
  misc_feature (158)..(158): n is a, c, g, or t
  misc_feature (2338)..(2338): n is a, c, g, or t
gtttcgtacaattttgttaatatgtcctgaaaaatgcagtttcgagtcaattataatgcctaggtcacgaacattatccgattctgaaatcttttttgagttaattaaataatcttttttcatattatttttccctaaataaagaacaaaacatttcnccagttgaaatttctaacccatttatttttgaccatttttccaaagcttcaattgctttatctaaatgatttgttttatcatcattttcatgggcataatataatttaacatcatcggcatacatttttatgccaactgatgatgcttcatttgcaataaaggacggcagatcatttataaaaattaaaaagagtaatggccctaagacacttccctggggcactcctgaaaatattctgaaactttctgacaattcttcgccaattttaaccttaaaactccgattttttaaaaagttagttaaaaaattatgaatttttccttcaattccaatctttttgattttttgaagtaataaatcaatgggaacagaatcaaacgccttgacaaaatcaatatagattatgtcaatttgttgattcttttgtatagaattatatatatcgtccatcatttttaatatttgggttgtagtcgatctattttttaaaaacccaaattgttctttatcaaagaatcttgtactgttcagaaattctaaaattttgctactcaaaattcgttcaaaaactctacagacagtgctggttaatgacaccggcctgtaatttaatggatcagttttttcgccttttttgaaaattggtaccaccaatgatgttcgccatatttccggaatttgaccggaatccaaaattagcctaaatatatctgctaatatttttgtaattggttctgcacaattttttaataaaatgtaaggaacattatccggtgaagtggaattacgccggggaagtcttcttaatatgttccaaattattcccgcattcaattcaatgtcagaaagtttaatcttattctgtgttgattgagtttgtggaccattaacaattgattttcttaaaaaagacttttgaaatatttctgctaatatcttacatttttgaacattgctggaaaacatatttccagcattatcaattaacgtaggaatttcattaacttttgataatttatttcgaataaatttgttaactgagttttgcccttgtgaaataatttttgactctttttcatttcttaatttgtacaattgttttttcatttccctagaaataattttgtaatttaaaaagagatcacttttttcagggaatttttttacaagcttatgtaaccgtaatttctctgaaaataaatctcttattttttgaggatacgattgttttattatcgattttagaggtctattgggtataaaagtatcatataatttcagtactttatttaagaattctttatatttttgatcaacggtgtacactgattttattgataaatcaattcgattttcaagtatcgcccgacttaatttcgaaaaattaatatttttaaaatctcttctataaacactgggattattacgccggaatttttcttttattttaaatccgaccattttatgatcggaagttgaaaaatgttccaatacaattaattcattaattaattctgattcactagtcattactaagtctaaaatcgtattttctctggtcggttctttaacatgctgtttcaattgtttttggttcataaactcaatcagcatatttgacataggatcatttatatgttttaccttattttcatcccataaaatatttgggatgttaaaatccccacaatatatgatattttcagaattactctggtccgaaataaatttgagtagctttttagtattctgaactgtacaattcggtggacaatatatatttatgatttggattggttttttaaaaagtaatttaatgtgtaaaatttcgctttggaattttgtcccagagaatagtgtctgataaggaatatttgttttagttagaattgctgatccaccgccctttttctcatttcggttcgcaagcattactctatatctaccatttatagatagttcattttcaattgtatttctggggtttaaccaggtctcattgatgatgaatattgatggatcatacttttgtgctatatgttctaaatcagatattttatttgaaattgatcgggcatttattaataggcaggaaacccagggatttttttctcccttattcctaatttttttgtttggtttgctcacgcatccctagcgagttctgagcggggcggnggttttttcagagatttgatctccaaatcgaccacaaaatatttgtactcacctgcggcaatattggcctgata

SEQ ID NO: 11464 - DNA, 2555 bp, Heterodera glycines
  misc_feature (60)..(60): n is a, c, g, or t
attatcgattctagagatctgtagggtataaacgtatcatataatttcagagctatattnaaaaattctttatatatttttgttcactgtgaacactgagtttattgctaaatcaattcgattttcaagtattgcccgacttaatttcgaaaaattaatatttttaaaatctcttctataaattctagggtttttatgactgaattttacttttatttgaaatccgaccattttgtgatcggaagttgaaaaattttctagtactgtcacttcattaattaattctaagtcactagtaattactagatctaaaatcgccttttctcttgtcggttctttaacatgctgtatcaattgtttttggtccgtaaactcaatcagagaattagacaccggatcatttatttttttactttattttcatcccataatatatttgggatattaaaatcaccacagaatatgatattttcagaatcactgtggtcagaaatgaatttgagtagttttttattattatgaactgtacaatttggtggacgatatatatttataatttgaattggttttttaaaaagtaatttaatgtgaataatttcgctttggaatttttcccaaagaaaagtgtctgataagggatggttgattttaatagaattgccgatcctccgccctttttatcatttcggcttgcaagaattaatcgatattgaccttttactttaagttctgattctactatatttctggagtttaaccaggtctcatttattagaattatagaaggatcatattttttggctatatgttctaagtcggctattttatttgttatcgatcggccgtttattaataggcaagaaatccaaggattttttctccggtattcccaatttttttgcctggtttgctagcgtatccctagcgagttctgagcgggcggggatctttcagagatttgatctccaaatcgaccacaaaatatttgtactcacctgcggcaatgttggcatagtaggcttgttgccgtagggagtataaaattttgagttcgctttgggtcatatccctgcggactttgataaattgtggcaaattagggaattttttcagtgcattatggaacttgtaaagaaattggtcacgggaaaatttgtccaagaatgtcacctcaccttcaaaaattcggtcctcttttgtcccgctctcaggtcgtgtcctcgggtggcggtgaatgtccggcgaaagtttgtctttgacgccgcattcttctgcaatttgttccgccaatgcccgtgtaaaaaaataattttaaaaaaatgagacggcaaaatcaaacaaaaatttaaaattataatgaattttttctaacccccctccccctccattgagactcttggtcattaaacaccactccttttttgcgtgaatgattaacagttctaaaaaaagaataaactaaaaaactcatattaattttttttaaatcattcaaaaaagcaagctaaaaatataaaagataaaattactcaccggcttctcgatcaccatgtcattttgctgctgcttgtcgccaacagcgacagattttatcgatcgcccgctgttttttcccacgccttgttagtgatagtccaattaagtttttcctctgtgccccgccccctcgcatttttcggcctataaaaagggcaacatttttctctcacatatgctcacttccacatttccattcattcatttctgctgctgcttaataaatatatatttgtgaaaagagtccgggggatttggtcgggacggtttccccctcccccttctgctgctcatcgtcgtcgttgtccgccctcaccaccgcttagtcggtcttcccccgcaggagtctctcactcctgcgggccttcgctttcaacagctagtccgtcccttcccccacatttgggaaggcacggccgagaaagggaaagggggaagcaaacagctgattttgcccttggcaaagtcggctctcgccctcgctccccacaaaagtttttgtcgtccttggctgcgacaaaattggagccccgtaggggtcagttgttcctgccgaaaggacctgacctccatcaatcggccgtagccgtcgatcaaaaagtcttcgcccgccaaggggtgaagaacatcggctacagtcgccgatttactttctccctaccgaaagggaggaaggctcattcggccaccagtcgccgacttcttcgtcttgcccaaccagtggcaagactcattcggcctcagcagccgactcttcgtcttgcccaaccagtggcaagacactcggccatcagcagccgactcatttagcctaacccaacaaagggaaggctcattcggccatcgccgccgctcattcgcctaacccatcaaagggtaggcacattcggccaccagtcgccgacttcttcatcttgcccaaccagtggcaagactcattcggccatcgccgccgctcattcgcctaacccatcaaagggtaggcacattcggccaccagtcgctgacttcttcgtctt

SEQ ID NO: 11465 - DNA, 4128 bp, Heterodera glycines
atggatcacaaaacgggaaatctcaggatggggtgcgcgtcccttcctacaaatttctcttttcgtctaaccatgccccctttttgtgcactatttcgttttaaaaattgggaacatttttttgtttgtttttttgaaactaaaatgtaaaaaattttaaaaaattatttctgattttaaataatgcttctgtttcgaatcttttgactctaaggaattaaactgtaatttttagaacaaataattctctgaagttttgaacttggcttttcaatgtttttaagtcccaccgtgaggcgggacagttccaaaatttgtaccacattttactgtggaaagtccaagtaccttaaggactacagaagagtcaatggcagcagtcacctttggacagttatgaaaaagaaataaggaaatattcgatggggtgcaatcctttaaaaaattactctcgtcttctaccctccctctctttttgtgcactgtttcgttttaaaaattggttccgaaattttttgactctaagaaattaaactgcaatttttagaacaaataattctctgaagttgtgagcttggcttttcaatgtttttaagcccaccgtgaggcgggacagttccaaaatttgtaccacattttactgtggaaagtccaagtaccttatttggacaattaattgtcaacgaacacagtcgcctttggcctcttatggagcagaaaaggggaaatatcagatggggtgcgcgtcccttcctaaaaatttctcttttcgtctaaccatcccccctttttgtgcactatttcgttttaaaaattgggaacatttttttgtttgtttttttgaaactaaaatgtaaaaaattttaaaaaattatttctgattttaaataatgcttctgtttcgaatcttttgactctaaggaattaaactgtaatttttagaacaaataattctctgaagttttgaacttggcttttcaatgtttttaagtcccaacgtgaggcgggacagttccaaaatttgtaccacattttactgtggaaagtccaagtaccttaaggactacagaagagtcaatggcagcagtcacctttggacagttatgaaaaagaaataaggaaatattcgatggggtgcgatcctttaaaaaattactctcgtcttctaccctccctctctttttgtgcactgtttcgttttaaaaattggttccgaaattttttgaatttgtaccacattttactgtggaaagtccaagtaccttgattggacaattacttgtcaacgaagacaatcgcctttggccatttgtgaaacagaaaaatgggaatatcagatggggtgcgtcccttcataaaaagttctcttttcgactaaccatccctccctttttgtgcactatttctgttagaaaattttttgtcagcgtcaacagttgcctttattgttttacagttttaaaaaccaatcattccagttcagtgcctcttccctcctttgttcaatatttcttcatcgacttcaatcaaatgtgctaatttcatctatcaattaaggttgcaattttttaaatgccaaaaaaagcaaaatatgcgaaaagtgagtggcgcgactccgactttgtttcattttgggaacactacgcaaagatttcaagtgaccgatgtttttttcacgttttcaaaaaatgattaaatagattcaaaactcattattattataaatcagatatttttagatgttcccaagcaattaattgattttttcaaacatttgtttggtttttaaaacaaatttcaaaaaatccaggtccaggcctggatccaggtcccgaggagcgatttttttccgggggaacggggattttcctggatttttgtccaggaaatccaggtccaggctttttcaaaatgtcgagctctaaatttaagccctttttagtcttcagtcccatggtccgaattacgtgtattacctgtcttttagaaaaaacaaacaaattaattagcaaatgttttgtgtttcattaaacaattgcagtgcatttccctgctgtcccttgctgctgctcacctcggcagcgaacttgacaccgccgcggacgaaagtgccaattccaccgacgacggcggcccaaaaaatggcaaccgaatgccaaagagaggggcggacagccacggccaggaggaggacgaccagcaccaaactttgcaaggttttttgtttgcttgcttatcatttaaatcgtcttggtgcgtagtttgagactctaacgaatttttgctttgaattcggtttttttgtttggtgaaaaatattttgcaggcccattccattacttgacagttcggtactcttgcagtttacgggatacttttaacatacattttagtaattttttttaggttttagaaattagtgaaaaataattttcaaggggttttcgaggtcgctgatcatgaatgcagcaatccatttttgccaattccgtacccctgacccgaatttgaacaaattcgaaattttcgaattcagaattagccaaattttctttgaatacagctgaaactgccttttaattgcggaaaaaatgcatgaattataataccactgtgatgaaattggacggactcaaaaaaaaaacttaggtgctcctattcgaagcaatgcaaaaaatgggaaaacatttctctgcttcagacgctgctccactgaacgaattggacgcctccgccgtttatttgccgtcgttggccaagcgcaaaaaatgccacaaaaaggcgaaacaacggcaggagcaaaaatggccaaggaaaacgaattggaatcagcagcaaatggaggacaatgagcagggggaggaggaaaatgaagacggaaacgagtctatggacgaacaaatgaaggcattccgaaagaccacgttggaccatcgcaaacaatgtccgtttttgagggacatgggattttcttggccatccctctaatttcgaccttggcatttttaaattccatccgtttttgaggggcaaggattttcttggccatccctctaatattggaccttggcatttttaaattccaatcggttaatccgccgtcccccctcattttttttggtaaaattaaccatatttttgatcaaagaaaacaactaacgggaatatcggttcttcgttaccgtgggaaattttgtcgatggaattttaaattcattcttatagacttcgattggtttctttttttcgaatttgatagagtctccgattggaatcacaaaaaattgtttggtttttgtaattatttggttcgtctaaaatttgttgcacctggggggtttggttggtgtcaccggttgtaaaaattatgaccatttctgccaaattccttgccaatttgttaccgattttagttttttaattttaaaatttcattttacagaggagcagaaaaaacgtgaggagcagcaaaaggcgaagcaacgacaggggcaccgaaaggacgaagaagaatattttgatgcatcgaaaagtaaattttaattgattttttaaagaaattttatagagaccgtaaaaatttacggttttttattattcttacaattagtaaaatctggcaattcacaaaaaatgcaaattttttgtattttttacgaaaaattctaatttatccccctttcattttccatattttcagtgagtttcaaggcggcccatctacagcaaactgttgctgcagtgcgcaattcgcttgttggcggctgtggcaccgccgcggggagtgtcaatgccatcgatagcgccggcaccgcaaattcatccgccgctgtcgcgtccgccgggggcagcgacgatttgtccacccgagggcgtgagtaccgacgccgagggtttgtacggcgaggcgggcgtgaccagactgggcccgttggagagcgaattgcgtgcctatttcgatgtgcactttgccaagtacgatgccggacacatggcccaacattccgctgcgtttctgaaccgcaaatgccaatgttgtgcgaccgatttgattaattgatgatttggtccggtgacattttgccggggtggagtgagtgttctgctcacaattcaacccccacccca

SEQ ID NO: 11466 - DNA, 855 bp, Heterodera glycines
aaaatctgttaacaaagcacacccaaaacttcaaaattttctccggcggcgtctatcggcaccgcctgccccctattcccgaaaatttttttgaaaaagcgcgccgaaaaaactgcttttgaaaggcgaaaaaaaggtcatcaaaaaaatcggcggccgaccccacctttgctaaattttggccgacccccccccttttaatgtatgaccaaaagccaagggcattgaccagtaaggaaaatgttatgttcttggaaattgaggagatagtcaatgattggacgcataaattgtacaagacccagagaatttgcggattttttttctgggagtagacttcgtgctgggggggtttagatttttgccgggtttaccactaattacaaatttgcccaattcaaatatattattttgttccaccttttctgtccagatcccaaatcgcatcccctcgtgggccaaacgctgaccattggccaccattcgtacgcggtccgttccctgctggcggagggcggctacgcgttggtgttcgcggtggaagcgctgaaaaatggtataatttagggcatcgtgtggggttggccacccattttcatgctctcatccacccaaattcggatgtttggcaaagcatgaatcgagacgcgtcatggccgagagaattctcaacgattttttttttttgcgattcgtccatccgacagtcattttattcgatcatagtgaaatggtcttttttatttgaaattttcttagaattttttttgaattctttccaaaatcgcatttcattgcacagatcggtcccaccacccgaacaatgagtgcggcggcggcgctggcggtggccaa

SEQ ID NO: 11467 - DNA, 2445 bp, Heterodera glycines
  misc_feature (12)..(12): n is a, c, g, or t
tttccgtagctntggaccaaatgggatctgggtaaaagtacctgtatgaaattgttagccaaaacaagacaatggatatgtatgtttgtttgtatgatgttaggtcaaatcccctaaaaagtatcaatgggaaaaaagggcgcccgggaaatgatgcgtcagtggaaagtttattgtcataaaaccaagttccttgcgttttcgaggtcattgaacaagaatgcaggtatccatttcggccaatttcgaaccccggaacccgaactcgaacaaagtgttttaatgctatttgcagaataataaagcgatgtttagccttaaatcagcataacttttttcttagctgggagccaagacaaaacaaggatattttatgtttgtacggtgttaggtcaaatccccttaaaaagtatcaatggtaaaaaaatatcaatgataatactagttaaaatttaattattcttttaatgttatttgcagaataataaagcaatgacttaaccggatttaatcaaatctaactgaataatagagaaatctttgctttatttaatttttaaagaaaataaatttatatttagtttttttctgaaaagttatcaaagaattaaatgtttcatattttatggtctaagaaaaatttaaataacttactttagtttaatttaatttaatttgagccgtcatgattttttattttgcaatttggaagccaaagaccaagattttgggacattttataatttagtaaacttacggttagataattaaataaaaaattattagtaaaatcatatttattcactaatccataaatatgtattgtagaacataaaaggtaactcgcccggtgggactcgaacccacgaccccagcaatccgtgccgtgctctaaccaactgagctacgggcgcctcttttagaggttctctcaggtcctttatcccactttctcccacactccgttccttctggcatcacattccgcctccctcggaagaccggtccctcgggctctccttggcccttcaccgacggacttggactctccttggtccagtggtcccggcagtgtggaggggatccacccaggagcgccatgtagaacataaaaggtaactcgcccggtgggactcgaacccacgaccccagcaatccgtgccgtgctctaaccaactgagctacgggcgcctcttttagaggttctctcaggtcctttatcccactttctcccacactccgttccttctggcatcacattccgcctccctcggaagaccggtccctcgggctctccttggcccttcaccgacggacttggactctccttggtccagtggtcccggcagtgtggaggggatccacccaggagcgccatgtagaacataaaaggtaactcgcccggtgggactcgaacccacgaccccagcaatccgtgccgtgctctaaccaactgagctacgggcgcctcttttagaggttctctcaggtcctttatcccactttctcccacactccgttccttctggcatcacacaatggcaaaacttataaattttaaaattgttaaaaatagtataatgccattaattgccaacaaacatttcgccaaaaaatgccttttaatttttaagatatttcaattggacaaaattctaccagaagcgatgggtgccgactgtgaagacttccgccttttgtcagctgtgtgaaatggtgcaccaccaaatggaggagggcggcgaatttgtgggccgaaattacacagtgaaatcgcacaaaaaattgtggggagctcaaagatgtcgggagaattatgtgcagaacgactccaaaacccccagaaaaaatttaaattttgtgatttttgtgtttttgatgtatttgaaaccatttgaatgtttttattgcttattttttatggagttttaattaattaagaattctttaaacggtgttccaattataataattcaccaaatagttgctaaaatggaacaaaataatcaaaataaaatgctttttaaagtgtggttttaagcttattcaaatcagcactttttgcttgcaaataaatatttagaatttcgccaagagaattttagttatgccgatttgaatgttcttggcgatgtgtatattaaatttcccgttatttgttgttactagcggggtcagcgcctttggcgcatccctcgctaggcagtacgattgtgttatagaattaagaatgataaaatcgactgggctttttctccaatctctgggactcaaatctccggcattccaaacattgggactcaacccaccaactttcaatgacattccaatcactgaaaatcaccccatcagcatttcaatctctgagactcaattctcaggctttccaatcgctggaactcaacccaccagcatttcaatctctgggactcaaatctccggcat

SEQ ID NO: 11468 - DNA, 977 bp, Heterodera glycines
cttccagcggtcgccattctcactacattttgttgctttgtcttttttaaccaattggcaccgaattggcgaccttcttcgccttcccctttttcaattgtttcgtcttccaaatttccaaactttggaaattcgttggatgcagcactaaattagtttttgttacagttacaaagtgaaaaagtacggaagtaaaaattttttaaaatataaaaccggttttccaggattttagtgttttgaatgaaattcttccctctgccaaaacaaacccctaacattagtctattaaaaaaagaaaaaaggatcctgattagttaatccctcaaaaagttatagtgtcacaaccaaattgacctaatttttggcgatacaaaagtaacgaagcaaaatctttaacagacactaactcaatttcaaattagcagaatttaaaaaattattgctaggctaacttttgatgctgaccaaattttacaccaacttgatcagatcactccttcatgttgatctgagaactcaaaaatggcttaaaacgctttatgtccttttctacataattttgtccgtttttcggcgtcactttgtccccccccttaagctcagcagctccattttatatgtttcgagttacgtaagtacatatatattaaaagaaatactccatttaaatttccaaacgcaaataccgtggtgagtcgaaggacaaaaagtgcaaaatttgttaaatttttgataaaacaactcataacttttctcagacgcaaccaaattgcacaatcttggtagcatacaatagcttatccgttcaaatgaatgattagtagggagttggacaccgacagaaaaatcctaacgtgcccacaaatggctatctcttttttgtatccaaattgcgcattaggtatttcatacagtgcgtatcaaaggttgccttttcttatccggcaaaacgaagcattagtagggtgttggac

SEQ ID NO: 11469 - DNA, 2688 bp, Heterodera glycines
  misc_feature (2632)..(2632): n is a, c, g, or t
atgcgaataaacaaaagagggaggatcaacagaaaagtatcaaaattaaaaaaaagaaagcttgcgacaattcaccgcaaatacaataaaaacattttaagttttacctctccccttttgtcgtatctgattgataatatgaaaatggtgaatgttgcggttttatatatgatttctaaacaaaaattaatttgaaatttccaatgagaaattatttaaaattaaattaatatttttaattaacaataaagtgatttcaattgctcatccttttcaaattatcgcttacctttacgggcgaattcatttctatttctaccttaatttaacaaaaatagtcagctttccaataaaagttacaattgtaactatcgtatgtattgttctcgttgttcggtcgtatctctctttcccttacttcccctctctatcccccctccttctctctctttctctctctctctctcccatctctctgtcttccccatctctctctcactcccccatcagctctctctctctctctctcatcctttctccttcttccaccgtttctctccccacccacctaccgtaccacttgcaactgtagttccatttcgggcccctcctctctcacatatcgtatgccaacttcgctcagtttaagaataaatccctttttctctgtccattgcattaagcggtctttatgttgaccaaaataattaatttgtgaaaaaatttcattgttttctgtgcccggctttttcaacacaattctataaaaagtgttgggttcggacaacggcggcaattggccatggaatttgccgtgaagaaaaagccgaacctttgggtcggcatttggtgtaaaatagccgatgaaaaacttgtaaattttgtctgaactcggctcctcaatgacccattcatttgactgaaatggtggtgattaaattctttttcaatgacccttaattaataatttcaattgcgtttgaatttttgaattcccaacccaaaaattcgaaaaattaaataatcaattaacattaattaattaataattatttttaattactcttttctgtttgcccaaatccgttaatgattttatttgcagtttgattcgtccaattcgttctttttcttcctttgttttcatctcaatttggaagtctttttttccaacgacatctatttgcttttccttttcttcgcacttttcacaattcactgtcactctgaaaggagtggatggatcggccacaatttgaccattaaaagtttggacagagtttgaaatggagcaacatattgccaaagtgtagaaaaacaaaaataatagccaataaaatggcgacattcactgaaaaagacaaaaatgaaaaaatgtaaaattcgtaaaaattattattttacattaaagccccataatcatggctttaagaaaaatgtatcttcccccatgttttacgtaggaagacaaaataaaatatttcgtgtcaaaaaatcgatagaatcgataatgccaacgcaaagaaaattcatggaaaagtagcgaaaaatatttatgaataaaattattataaatcagaagacacaaaaatagttttaaaatgatcaaatgttaattatgaacagggctcacaattatgaggctttggcctcattttgtggttttttaaaaggcaaatgaagcatgatttttacagtgaagctttgagacattttttgtggggttttttttggattttttgcccataaacaaacaacacaaattactattagaaatatttgcaaaatattaataaagatttattattatttaaaaaaatttccatttatatgaatttcacccagcaacaatatattaaataacgtcaaaactatgtattcagagtagaattcgcttcttttcctcttttttcccaatctttcggctgtcaataatcaaaacacacggagaagcgcgcaatttcttaaattaattttgagttaatttggaatttcttttttgggtattattttaatttaattagtcattagtcacgcttgggtgcgatccgggccgaccctggggaggcattgggttgtggggacaaagctttctagaaagtccaattaaaatggtaaagcaattgtatgcccatttttacttataatgttccatccaaaacggcagaatttggccgtcatttccggcaaaattcagcgcatgcggcaaaaaagggctcacatctttttctgtgggattggtcgctttgaacgcttccactgaacagataaacattcattgtgaaaggattaaacattttaaaggaatttttatttatttaattttaaaatataattaattcgctttttatttttaatttgaaatttaattaatcgctttttagttttattttggacagtattttccgactgttttcacatttacccgccaattggcagcagtaaaacgcccgttggccccgcgagttgacgcatttctccgagtaaatgtcgttgtacgccgccccgcattggtcctccgcccatttggccgcccttcggccccaccacgggtcgtccagtgccatccggcacaattcgacccgcgtcggtcgcagttccgcaacaaaggcactcagcggatcgactcgancctgcgatcttatgaaaaaacaaagagaaaaacgatgtgtcaagagtgagtagtta

SEQ ID NO: 11470 - DNA, 678 bp, Heterodera glycines
  misc_feature (577)..(577): n is a, c, g, or t
  misc_feature (610)..(611): n is a, c, g, or t
accaacgcagggcgggcggagggtcagtaagcattgttgagtgaacatgtctgtccaaccgaagctagtggtcattaattatccccttgggaattcttttggtgcatttctgaccgagccaaagccaatcgaatggtaattaataatcccttggatgcattttgactgtataatgcccacggaagtgtcaataatatcccacttggaattgaggtcaagctgtgagtcaatgattaattgtgacagttgtgactatgcaaaacccaacatcagatattctgtgcttgagacagctgcctcttttggcaaggtgccaaatttaacccagccgaaaaaataagccccgcctactcggtggagtataaatagcctgtcatttccagcaaaagtacattttttccattcatttggaaattttgaaatttttctgcaaacgactaacgcgctctttcccttttgcttcctcgctctctgtgcactatttaaaccaatttaaccataaccttttatttcctaccatccctttaaatttttgcattccctctttcttcactattaaaccgaatcaccaaataanaaatataattccataatcttcccataacctatnnacatataatttaataatattacaattaaataattattacaaaaatacttttaatttctacgtatcct

SEQ ID NO: 11471 - DNA, 1671 bp, Heterodera glycines
ctcttttgtgggctgatcgcagctccagagattttaacatgcacgctaaagcttaatgatgggccgcggtggctatgagtgagggtgttaattacatttggaatacaaatttagagacctcttttgtgggctgatcgcagctccagcttaatgatgggccgcggtgtctatgagtgagggtgttaattacatttggaatacaaatttagagacctcttttgtgggctgatcgcagctccagcttaagggccgcggtgtctatgagtgagggtgttaattacatttggaatacaaatttagagacctcttttgtgggctgatcgcagctccagagattttaagatgcacgctaaagcttaatgatgggccgcggtggctatgagtgagggtgttaattacatttggaatacaaatttagagacctcttttgtgagctgatcgcagctccagagattttaagatgcacgctaaagcttaatgatgggccgcggtggctatgagtgagggtgttaattacatttggaatacaaatttagagacctcttttgtgggctgatcgcagctccagagattttaagatgcacgctaaagcttaatgatgtgccgcggtggctatgagtgagggtgttaattacatttggaatacaaatttagagacctcttttgtgggctgatcgcagctccagcttaatgatgggccgcggtggctatgagtgagggtgttaattacatttggaatacaaatttagagacctcttttgtgggctgatcgcagctccagagattataagatgggcccgttcatgataaagcttaatgatacatttggaatacaaatttagagacctcttttgtgggctgatcgcagctccagagattttaagatgcacgctaaagcttaatgatgggccgcggtggctatgagtgagggtgttaattacatttggaatacaaatttagagacctcttttgtgggctgattgcagctccagagattttaagatgcacgctaaagcttaatgatgggccgcggtggctatgagtgagggtgttaattacatttggaatacaaatttagagacctcttttgtgggctgatcgcagctccagagattttaagatgcacgctaaagcttaatgatgtgccgcggtggctatgagtgagggtgttaattacatttggaatacaaatttagagacctcttttgtgggctgatcgcagctccagcttaatgatgggccgcggtggctatgagtgagggtgttaattacatttggaatacaaatttagagacctcatttgtgggctgatcgcagctccagagattttaagatgcacgctaaagcttaatgatgggccgcggtggctatgagtgagggtgttaattacatttggaatacaaatttagagacctcttttgtgggctgatcgcagctccagagattttaagatgcacgctaaagcttaatgatgggccgcggtggctatgagtgagggtgttaattacatttggaatacaaatttagagacctcttttgtgggctgatcgtagctccagagattttaagatgcacgctaaagcttaatgatgggccgcggtggctatgagtgagggtgttaattacatttggaatacaaatttagagacctcttttgtgggctgatcgcag

SEQ ID NO: 11472 - DNA, 4144 bp, Heterodera glycines
  misc_feature (3531)..(3531): n is a, c, g, or t
  misc_feature (3545)..(3545): n is a, c, g, or t
  misc_feature (3551)..(3551): n is a, c, g, or t
  misc_feature (3572)..(3572): n is a, c, g, or t
  misc_feature (3577)..(3577): n is a, c, g, or t
  misc_feature (3586)..(3586): n is a, c, g, or t
  misc_feature (3588)..(3588): n is a, c, g, or t
  misc_feature (3600)..(3600): n is a, c, g, or t
  misc_feature (3602)..(3603): n is a, c, g, or t
  misc_feature (3629)..(3629): n is a, c, g, or t
  misc_feature (3639)..(3639): n is a, c, g, or t
  misc_feature (3692)..(3692): n is a, c, g, or t
  misc_feature (3698)..(3698): n is a, c, g, or t
  misc_feature (3719)..(3719): n is a, c, g, or t
  misc_feature (3729)..(3732): n is a, c, g, or t
  misc_feature (3741)..(3742): n is a, c, g, or t
  misc_feature (3750)..(3750): n is a, c, g, or t
  misc_feature (3769)..(3769): n is a, c, g, or t
  misc_feature (3776)..(3776): n is a, c, g, or t
  misc_feature (3782)..(3783): n is a, c, g, or t
  misc_feature (3794)..(3794): n is a, c, g, or t
  misc_feature (3808)..(3808): n is a, c, g, or t
  misc_feature (3841)..(3842): n is a, c, g, or t
  misc_feature (3854)..(3855): n is a, c, g, or t
  misc_feature (3867)..(3867): n is a, c, g, or t
  misc_feature (3880)..(3880): n is a, c, g, or t
  misc_feature (3891)..(3891): n is a, c, g, or t
  misc_feature (3901)..(3901): n is a, c, g, or t
  misc_feature (3941)..(3941): n is a, c, g, or t
  misc_feature (3952)..(3952): n is a, c, g, or t
  misc_feature (3982)..(3982): n is a, c, g, or t
  misc_feature (3993)..(3993): n is a, c, g, or t
  misc_feature (3996)..(3996): n is a, c, g, or t
  misc_feature (4001)..(4001): n is a, c, g, or t
  misc_feature (4009)..(4009): n is a, c, g, or t
  misc_feature (4012)..(4012): n is a, c, g, or t
  misc_feature (4073)..(4073): n is a, c, g, or t
cgttttccccccgagaaatttaaaaaaaaatttgataacagaaaattttcaagaaaaaaatcttagaaagttttttcataagaaaattctaagaaaaaaaattcgagaaattctcagcgattttttggaaatttttttgaaaaattttagtaattcaccataaaaatttgtcgaaaaaatttttttttagaatttcttaggaaaaaactaagatttttttcttgaaaattttctaagttagcaaattttttttaaaaaatttctcggggggggggggggaaacgaggcggggggaactgatatgggggagggggaaacgagctgctcccgtcccggacctccccccccccccaattttccccaaaattttaatgaaaaattcgtgccgtaaaaaaaaatttggaatttataagaccccacaatttgccctcaggccattcctcattctccgagagcagcagcagcagcaatggcacttcaacaagcagtggtggctttaccagtagcagcagcgaaggcgagcagtaccagctgcaacaggacgacgacaataaccatggcaacgggggcaagcagttcagctccattattccgggcaattggtcaccagcggcggtgctgacgacgccaaaaagtgccgtttccatgcagcagcagagcatcatcaccaacaaaaccagcagctgttacattcgtgccgtcgacgacaatgagaacaacaccgcgaaggcgaagatggtggctgcaggtgccacggcatcgcccgtcgttggcattcgcatggacccgctgcatttggtagggcggggcgccgtttttttttcattgagctgtgcgagggtctcaaaatcgagggcatttctcggtgccctccccctccccccccccttttttttgccattctcggtctcgcgttcgcaaaaagcactttgctcgacagtttcctaggttagttggatgcactatatttaattctcgagtcttgtccctcataattggtcggcggcacgtttttccttggcacggcaccaatttttgtagagaattttgggcccgagagtctcgagactgaaactcatattctccgttacccgccgggggttttccatggaatttcaatatgtcaatgccctcgagcgcatccatacaatgttccattttttaaatccctattttccacagatccaagcctgctacccgtgacacgtgccacggcacttttcggcgccatccaatggcactttttgtccatccgttaattcattttcatttaccatgttttgtcgaacatattcttttttttttaatttatgtgttgtattagttagtattggtgttgaatatgtttttgaacacatcatccatcacaatttttctgggggttgacgaccagggatggattttcgaggcctcaaaattatacggaaatcgaaattcctcgcttaaaagtgccggaaaatcggaaattcctcgccatccctggtggcaaatggacgggaacattttcaaaacggaaaagattgaaatttcgaaatgtaaaattttttgccgaaatttcaaaccgaaaatttttggttataaattcataaatcaaccgatttaaaacatatttttattattttttttagaaattttccatcatttttttttgtatttttctctgtctgactgtgtgttagaaaagtctcttacattttgcacactttcttctccacttactcatttcgcgctccttttacgtattcgcgaaattgaaaacaattcgaatttggcgttttgcaaaaccgaacaaaaaaaaacagaaaaattgaaattccgtttttgctcagtccaaaatgtttggtcggtcggacaaaacgtcaacaatttttgtcattggcacattttttttcttaattggaccgatcagtttttttgttttgttttactcattttggcacataattttgattccataatttgtcttctctttttttcagtattgttttagtgatcaatcagtagtactgatcaattaattgacttaccttatgcatttaacagttcaaaatgtccccccccccctctctcttttttttttgttaattgatggcatttcgccaattttcctctgtgaacatttgaattttgttcgattcctccctttttaatcactaatcacctccccctcttcttctgttcaacttctgtttaagttgttgtacatttttttattaatcagtttgtccatcgccaacacacttcctcactgatcagaaataattttgtttcctagctttgaagtgatttttcgtcgatttttttatatttttaatttaattgttggccatttggcccctctgatgatgatagagttgccggtatttccggcacggtctgcgcgtctgatcacggcatttttaaaaaggaaatgttgctgatcaccgaatacatctgatcactactgatcggcgcgttacggtaatccacaaaagcattgatgtacgagaattcgtcaaagtaccgaaatcggcggaacattttctgatcacttaggattgattttttccgtgatcgtgtccaaaattatcaatgttttgcattagttcgtcccgcagttacggtaatctgatcagttcccgtattgccgcttaacagagacacattttattgtggtgccgtgatcagatgtcggcttcagaccaaaggcgtgtaaaatgccggtgaattatgggcacaatgtctgtccgtctgtccattgttgtcccatgaattctctctctctcactcccgctcaaacacacacatatctggtcatgtctgatcaactctctcctctctctctctctcgctacaattctcgttactgttgtgctattcttaaaaatgtttttcgtctcccccacgctctctcttctcatctctcacagagatctctcaaaactctcctcatttttcatgtacactctaacttcactctgctgtccttatctgtgagctctctcgctccctctctttctcccctcactctctccattaggcgaactccttcaatgctctcaaacacacaaaaaaaatgttttttaaaaaataataattatatttaatttttattttttagatagattttttcttttcgctatcgaactaaatcattttttgcaaaatggacgatgaaaaaaggcccgaactgagtggcaaaaaacgcactccatcagagagaaaattttaaaaaatcccccgattttccagggaaatttttcttaggaaatcaagcgattttttgaaaattcgagcgggagtaaatcatcgttcattttcaaattttaatttttcatccattcattccttttctcataacattttggacacggctccgctcataaacaatttgttcccattgagcgtcctgtcactcaaaacttttttttaaaattttcttttttcaatgcgctgggaatgtcgaaaccaccattcgtcaaagagaaccagtgtaaaacaaagcaaaacaaaacagagaggaaaatcgatgatatttttataattttcaanaatttttttaaacnaaattncattacctacatttttttttntaacnacatttttntnttaataaaaaancnncatccaatcatttacattcataatcncaaaaaattnttctacctcctctctaacaaaaacctaaaattataaacccctaaaaccttcanaaactnttttcattaccataaaaattntcaaaattannnnaaaattttnnatcatttnacaaataaataaaaataanaaatttncaatannacataaaaccnaaaacactaatcancttaaattacaaaaaaatatacattcatttaannataactcatacnnacacattttttnttctcataaaccncacctaaaatnacactaaatntcaacaaaaactccactcttacaccatcaaataattattnttcacaacaanaaaattcaactaacaccaataaaacaaacnattacacaatntcnttatnatttattnatnataattttaaattacaatctcaacacaaacaaacaaaaacaagaaaaaaataagggtcatnccatactttttaaaatgtgtaacacaaatagtgagagaaaaacctttttcaatttataaaaaaacggagac

SEQ ID NO: 11473 - DNA, 2939 bp, Heterodera glycines
ttatttatttactttttaaatttatttcttcaattttcttttaataattaattagtttctcatttgcacctcatcaaccgatgcaaatgtgctgctgatggacattatttggtgctcctctgctgttttgctctgttctccttcccattggccgaccattcgcaatttacccaaattgtgcaaaaatgcgacggtcgttgtgctggccgaagtgaaaagcgaagcgatcagaaaaatcagcgaagaagtgatcagaacctggccaagaaggaagaagaagctgctagctaatccgatggcaaaaacagaagagaaagtgccattttgaagaaaatatccccagtaaaaaataaaatttgttcaaattcaacgccataaactcatttggcaattttgaaaatttagtgacttaaaatgtcaaaaaacggtacgcttcatatatatctagctcaatactgacggttttggttaatcatttaggtgatttatttatttttttcctaaactccctgggacctgaaaatgaaagcaaacaaattttttctcaatttttttaaaaataatttctaaataaaaaataattttttatttagaaaaagcttttccttaaagttgaagccctggtttatcaaattaaaaaacacataaattatttttagcttttttttttactaattttaaatttataaaaatctctcccgccgcttttccttttatttctcacccgtacgctgcacgtcatcaccagggcggcgcaaaacggcagcacaacggcggcgagcaggtcaagcaacacaacgctatcagcagaagaggaggaaatggcaacagaaggccaaaatgggggaggagagaagcgcaacggcgcaaaagcgttgtggaagagcaaattctgaaaagcaaagcgaaacaaacaaattaagaactaattaattaattaatgtataactaagccaggggtgcgatctgtccttatttataagatttgtccttatttggaggttccaaatcttataaaataaaaatgtccttatttataagatttgtccttatttcgggctatcgttattagctcaaaaataaccaaaattggggcaatttttagacaaaatctgttaacaaatcgcattaaaaaacacaaaattttcccagcggcgcctatcggcgccaccggacgcccctgtccaacccccaaaaatttttgaaaaattcgccgcaaaaaaagcgttttcgaaggcaaaaaaaggtcgtcggcttggcttttaatttcaaaaattggcctttttgatgaaaatttgttaacaaatcataacgaacttacaaaaaattttcctcggcggcgcctatcggcaccgccggaccatctcccccccccattctccaaaattccttggttggaggcgaaaaatacaaaagttgatgctatattaattgaataaagtgttatacaagcgatttaaagcaattttgcaaaatgtccttattttggacccaaaaatcttattttttggccttgatgttcttattttgaaaatttttcgatcgcacccctgaactaagcaaaaaaagaactaattatacatatgcttacaatatggtcggatagcacgtggcacaccgtggcgagcattgccatttggtccagcagttgggccaatgcaaccgcaccggccattgcttggccacaagtgcaatgtgccaattgatagagtgccccattcttggcaattcgacgcgatattgagcagagatggacagctgaggcaaatgtgggtaattaaagaattaattaggggtaaaataaacaaattaattaattagggattatttagaattaaaatactttgtttaactaaaattttaaaaacaaataaattgttttacaggtaaatttactggaaagcattgtgagtgccgaagcgaatgccaacgaaagaagtggcattgccaaaggcatctgagcaaaaagcgattcaaaaaaaattattttggtttttttacctcaatttttctgccggaataatccgagaaaattgccggcaaaatcacatgaaaagttacggccaacaccaaagtggtcactgaattttgaaatttatttttctaatttttaaatgaccttttttgttaaaaataattaaatgggacttcctttttaaaatccaaaaatgtttttaaatattttatggtatttttaaaactattttaatattatttatcaatattttcaccaatgatagccaatgagcagcggcccaaccgacggtcccattccgagtggggctgaccaacggcacccgccaaattgggccgtttcctgcgacaaaactgacggaaaatgtgcgaaattggcatttacagaaagagatggattaatatttgaataaaaattaaaaaattaaatttaaaaaatagaatgtattgaaacgaatgaaaaaaaactttaataaatatttaacaataaaaaatattaaatttaattttaaattactaaattttttaacttaaaatttatttgatgctttttcttgtattttaagaaagaaataagggcaaatttggcgatgaatgggcggggggagggcacaaaagttggccggccaaaattcgttttgtcacattgacaacaaattcgccaagggtttggccaccccatcgtcggcactaatttaatatttgagtgccggcaccgagcggagacgaaagcatccggcaaatttggcaaaatgcctcgaggggatggataaatttgagggaaataatccaaaatgatttttgaaaattcaaatttaaaattccattttattttaagcggaaaataattgacaaaaatttgaaaccatttagaataaataatttaatttatgacaagtgaaattgccatttgctgacaaataaattcaaatgaaaattttttattggaatttggccaagaaaaa

SEQ ID NO: 11474 - DNA, 1326 bp, Heterodera glycines
agtaaaaattgagaaatttaggcaataaaaaatgactttttgctcctatttattatcgatacaaaaagcaaatgcttcttcccttaaaattgttcccgggggaatttttattttgctaaattttggacggacttttgttgctctctgatgagggccaggatggcacaatttggtggtcgatgatgctaatttcggcaaattcgccaaaataaatttagggaaatcaaaaaatttgaaaaggtgtttgattttttaaatagtgccaaatttagtgaaattccaaattttcagggccgcctaaaagaaaaaaaatatttaaaaagtgaaataagatttttggaaatgaggtgataaattcgtcgctaaaatccacagtaatccaaaaacccactgatcatttgagtttataaaacgctttttgaatatttattttttaggtcaaaagtatttaaaagttcctaatggaatattattgaaaaattatttgcattgaaaaactgccaagagacataatgttccatttttattcgggaatgaaatttaataattgttaaatggtcattattgaatttgtttgtgctcctcaaaagcattccgacatcgccgcgctggtcagtgcctgggcgtccgcttgcgcaagtccaagtgccaatttgtccgcttcctaggggaaagcatacacaaacaaaatgctaatgaattctcatttttagtgttttaatgcaaaaaaattttttttttaatttctggaaccctcaaaaaaatcatacaaatatctaaaaattcaggacacttgggaaccctgatgggtttttcagtgaacaaatacaaaataaattaaaaaattctattattattaacgttttttaatcatttacaaggctccgcgaaaaaaacgatcattggtttttaaatcgatactttatttaacaaaaaatccaggccagaggcatgtgacccaggcatagtcaggcctagatttttcctgggttttacctcttccgcaacggcggcgcgtgccgcgcgcgttttcggcgcggcgctctgttgtccaccggttttgtccgttttgcagcacggacagatcagtccgagctcaacgcgcacttcggcaggcaatgcagccaaaaaggttctctcctggcaaaatggcacattgaaaaacacaaaaatattaaaataagtgatttaaatgtaaataaataaataaaattaaaaagtaaaatcttttgaaatttaaaaagcgctctttttcacatttggccatagacctagaaaataggccaatcgtgtgataatgattagagatcgcaattaaccattttt

SEQ ID NO: 11475 - DNA, 5110 bp, Heterodera glycines
  misc_feature (38)..(38): n is a, c, g, or t
  misc_feature (99)..(99): n is a, c, g, or t
aaaaataactcacataattatgtattgtcaagtgcttntagccatacaatcggcacaatccgttcaaagcatacgcaaatgccgccactccgtccgacncaacggcacagtgcaggtcaattagccaaccaattaaacggcacaaacaaaaaagacagtgataggcacaattacagcactaaagatgaaaataccgtagataggatggagacaccgtacttttggggaagtcaaagactcggaaaattgttgtaatttggttattatgatatatgatcatattgatcagtgatcactttatgatcttttctaataaattaatatcggagagagcgagagagaattaattagtcgaaaatttatttcaaatatcaaattttaatgctttttacacagaagcaattaaaaaaaatttgcaggtcaaatgcaacaaaaagtgaccaatttgcggattggactgattatgagaaacaatgctttgatttggtcgcatttttattattgaaattattttccaattgtgccaacaattcattttaagatgccattgctcaattttggcctttgcacgccgtaatttaccgcttttgaaatttgaaattgccaataaattaattacttttttcagcgacacatgcacagattatgacgtcagaaagctggtccaattcagtaagattttattaaaaatagtaatttaatttaattaaattgcaattttcagtttatgaagcggccgaactttcgatgggccgcaaatttgtttgtaatgtgaggaaaaagcaaattaattaaatcatttgcttaattactttcgcttttttaggtgtccgtccactgcagcaattcaagacccgaaagtcaattgtaccacgacggaaagtcaatggtacgaaaaggcaaaatttaaaaaaaagaaaatttaaataaattttaaaatcgtttctctgctcaaggccgtcctttgccttctgctagccatcggctcccttatgctttttggcactttctacgacatttacgtgcatcggccactcgaacgtgccgttcttgaaagtggccaaactgtaaaaacaaaattaattcattaattaattaaattaatttattaattaaacgaattagggttttattgttttttaaattatttaaatgattttgggctcttttccagaacaacaacaacaagcagcagctgaacattgcacgaagtgttggccaatccaagacaattttgttcattcgattgttttccgtggttcgctttgttcaaaattttacaacaaattaattgccattaatttgtttttggcccgtaatttggactatataatggacacgcggatggaggagggccaaattcggtgtttgcatggtgggagaattaagcaaattttcactaattgcaacaccaatgaattaattaatttttggtaattaggtgcccgttttctcagcatgtgttgggtaattaattaattaatacacagctgttctaatgattttgaattttacagataatctttggccatacggtttgtcccaattgttttttttatttattttttaataatttcccattttcagtattattacattggcacttctttcaccggcggtcttttgactttgccctttgtaaaaaaacattgttaaaaattcagataatttactccaaacgctgcacgaattccccaaatatttctacaatcaattggtacataattgtttaaatttattatttttatttttaaattattacaattttaataaattatttttcggttgtccaagctccgctcgcggtcgactcattctttctgctcagcggccttctcaccgcgtacatttttctgatcaaattgcacaaaaatcagtttcgtatcgacgcggccagcacatggtatcattgtttaatttaaaatttaattaattttcaaattatttttttttgcttttttaggttgccttattatggacgccgatatttgaggcatttcaaattctaaaatgccaatttgattttgtttgttttttcctttttaggctaactccaatttatgttttggttatgataatgaaaggtaatggccagcccatttttttgattatcaatttttgttaattgaactttttcagtcactgtgctcacttatgtctctgagggacctttttggaggccaattgttagaaaatattccacaaaacttaatgatgatggcatttttaattaggacccaaacttttgtcgagactcttggtgggccaatctgttgtacataaagaattttgtgggccaaggcgactcggtgaatttgagagcagcaaattaaattataatttgttgaattttaattacccctaattattttacaaattacccctaatcaagtgcatgggttggacttggtatttggccaacgatttccaactgtacgcttttgcacccattctgatcatcgcgttgcacaagtgtcattttcgaatttgtttaattaattttttatttatttaattttcgatataaaatgggcggcgttttctttggccttattttaatggccatctcttgcgcaataaatgtgctgatcactgtgcaaaagggctatcctcccgcccctcttttgacgtcgaaattacaaatgtaaaaataaaaataataattttttaattaatttaaatatgttttttcagagtggcaattttacccgattattggaacgatttgtatggtaagaaaaataatgtgaaaatgaactaaaataattcttaaataaaatagaataaattgaaagcatctgataaggctttttaatgatttctaaaataattaactcaattaattaattaattgattattaattgcccttttagtgaagccatacattcgttgtggtccttacataatcgggtgcattgttggctattttttggttgaaaaacggacacaaaacaatttccgaatgagtacggtagggatttggattgttacggtattatacaatttttgtttttcttttcagttccattgttccattggctggtccttgtcaattgtgctgaccatttattccgtctttggccttttcaatttcactaaaaccggcgaaatttcgttgtggtggtcagtgagaaaaataaacctttttttcttgcatttttttttgccgatttaaaaattcattttaatttgatttatttctttttaataccctttattactattattataatcaaattccatccggtctttgacttttttctttgatcaaattgattaataaaactttcatttattcgaaattactccaatttatcaagaaatcattatctatgctctctttttgtagttttttaaattttaattgaaattcaaatccataaattcttttttattttccaaattaattttgccattttcttccggtctttgttgtacaccgtcttcggtcggttggcattcgctgttgcgttgggttggacaacttttgcgtgtgaaacgaaccacggaggcaacaattgcaaaacatattttattaaaattaaatttattaattgcggcgttaaattcatataataaacatttttccgccatttttaagcaatgataaatgccattctcggccacaaaatatttgtgccgctcagcaaaattacggtaattttaaaatgaaaatggaaaacaatgccgaattgatattgtttcagttttccgcttatttgttacatccaattttgctgcaactttattacttcagtcggccttcggcttttcattttacccattcatttcaattggtgccaatttcacacaaatttattttaattaattattattgttattaattttaaacaacaatttttaagttttatttcttataaatcagttgcacatgttcttcgccgccgttgccacttcttacggttgtgcgcttctgctgagtttggccatcgaagtgccggtaattaacagaaatgacaaaataaggccgaaataagcatgagaaaatctttaattcggcacaaaaacgagcatttggaacaaaaatgccaaaataggcaaaaatagacgtgagaaaaagcatccttgaaacttcaaaccaaaattaaaattcattttcatggtagaaaaagtaacacttgtttctttgttttaataaagcccctgggggttcattctccctttcgaattgggctttattagaggtgacaagcatattagaaaaaaagagggcaattagttattttcaggtggttaactttgacaaattaatctttgggcccggcagcggtggcgccgcctcgcgccaacgccgcagcgccgaacaatcgcagcagaaggagcagcagcaaaacggcacggaaattggcatggcaccggcgcaacaggcgaaaattgaaaaattaaattaaattagaatttaaataatatttttgaatttaggcacaggaaatgcaaccattgatgacgaagaaaggagaagaattggatgaaaaggaagaaaaagaagaagatggaggccaaaccatcaaacaaattggggaagaaaatgcagcggagaaatgaaattccattttcatgtatgaatgaaaacatagttcagttaagaaaatgccatttgtaataggtgccaataataataaatgaagcttctgcggttgtcaattagtaaagcattgagttgctcaaacgtttggccaaatccaagcctttgaattgtgccgttcgtctgatgattagtgtcttcttcgggcttttcttttttgaattggcgtttcgtttcgctttatctttacaagaaattcaaatttaattgtttaaatcattttgttcaattgatttatttgtttttcttcttctcagattgccccattttcttcttctgttattgtcccatcgttttgtccatccgccgatttttccgtttgcattttcggatttattcgttccatcgcggcgaatgcgcagaaaccaatggcggagccgacgaaccaactgaagtcggcgacccattcgaagttggcggagggacggaacaaagccgaaaaagcattgggcaacaaagccaaaaatgggaaaaaagagggaacacggcattcgaaatcagtg

SEQ ID NO: 11476 - DNA, 968 bp, Heterodera glycines
  misc_feature (15)..(15): n is a, c, g, or t
acaaacgaagtggcnaatgttaatgcgatgggacgccatcttaaaacagacaaacagaaatgccaaattgaaatgccaaattgtaaatttggcttattttgggtcccatttttcatttttagccatgattttttgggcgatttaagtcaatgaaattccccactgatcagcgagtgagtgatcactgatcagaccgtcaaagtgagtgcgccaacggtcactgccactggcgagtcgatttgcgcgaccatttcaattgggtcggtggtcatttggccaaacacgggcttagtggcggagattgtcagcacggtcagagtggcgaacagcaaataattgatgggcaaaccttgaaatggggggatgctaatttggcataattattcataattaagttcaccgaaaaaattgcccaatttgaccgaattccacgacttggcgaagcgcgaaaagtcgcagaaactgaaaattgcgctgcccatcgaagaaacgattaatgccattgcggaaaacattgtcaaaacggtctcagaaagggacagcggttcatctgcagtgaatgaattggccaaattaaaacattttttggataaataataaattataaaatttacaattttaattaaaattaattaattgtatttatttttaaaaccgttttaaattctcaagtttttgccttttcaccttcaatggtcaaactcatcctcaaattggccatcccggcggtagtcaccaaataagcggccagtgccatcattaccacgtaaacggcgggtccggccaagtcgatgagcaaacggacggcggaaaggccggcacggaacagtgcgacttggacagaccaaaaaagcacaaaggaaagccaaccgagcggggagagaccggcaaaacgaaggggggactgaaacgggcaggggggaggaggcgaaagggtttgcattggcacaataaaggagggactgaaa

SEQ ID NO: 11477 - DNA, 5537 bp, Heterodera glycines
  misc_feature (54)..(54): n is a, c, g, or t
  misc_feature (63)..(63): n is a, c, g, or t
  misc_feature (158)..(158): n is a, c, g, or t
  misc_feature (1112)..(1112): n is a, c, g, or t
gcatgcgaattttgaggtcatccttggacatcgtcgtgcattcttctcactgcntgattgtcntgctggggtggggtcgacacccatgaaaacggcacgtgccgacccaccacgtgttcatgtgcgagggcgcagatgtgcacgcccctttcgcggcncaatgagcacaacactcatggccatcgtggcaaacgcgctttttgggtggaggaggctgaaaaagattaaaaaattcataaaaaatattcaattttattaaaatttactgttggagaaggtgtggtcgtgcccaagtgaccgtcggttgattttgttatttgctgagatgaagaaatggtggttgtgacggcctaacaaataagggattttgtgtatgtaaatcccttataaactaatgccataatttgaaaaattatgtaaaggaattttggcatttaaaaatatcgaactgtaattctttgtgatttgttaaatcacttgtaattaacaaaagttaatcaaaagcttatcatctattatcggataacaagttttattatgatcacaagggccggattcttaggttttagttcttttttctgcggctttgtttcggtgagaaatgtatgaaaaacacatttttacaaaaaaaagaggaaatataattattttgtaactaaattgctgaataagttatttacatcgattttaattcattctcattgaaaaaaagcacagatttttcaaaattttcgccaatattttaccatttttcgtccctatttcgatccaaaaattgggttttttcgaccctaaaaatccaggcctaatgatcacttaaatgaagctgggggctcgagtgtcggcacttaagtgtaccgactccactctttttttgaattgtccactcactacagtatgctttccgtcgcactcgttactgtcttcctcctccgacgaggacgacgaactgctgctgctgcttttactgctcgacttgtggtggcgatgtttgcgcgaagagcgaccaccgcagcgtggcttatgcttacggtgtttcttgcgtttggcttttccaattcaaccattgggaacgatgaaggactaacagaaaaataaatattcaaatattnaaatgtgattgaataaaaggaaataacaaaaattttattatttatttttctttttttgtatttatagaatttttttttttaatgattaattatagaaaaaactcttattgcattggttctcatggttttcatttctatatagaattttttaaaatcctgcagcttttggccagaaattctttattccggagtttttttgttttaaaaaaaattgcacgataccattttatattgttcctcttcatcacattccttacacacacaacaacatgatggattttgagctgcaaaatatattaaaaatgatccgatgcattttatttatacatttttaatggtttactgtatgatgaggacacggtagtgttgggtgtgaatgtgcctaaggttgtgctgctgcttatcgtggaaagggtgatctgatcagttggttctgtcgtcaaaagagagggtgacagagaaaacacagtagagaagtgatccgatgccgttgaagttgtttccccaattagggttgtatctgtcacattttgtacttatttcaagaatcttgtttcattcgtttaccaatattggttgaactggtccctgtcgtaggtgttgcggttgtctcaccaagttgagttgtacctgtaacatgtgtctattaattacatgtttcaccaaatcagttacaatctttttaccaagcgtggttgaacttgtctcggtttgtggtgttgttgtttcaccatgttccgttgtcgtgcctttttcgcttgctgtacatatgccattaatacaaacggaatcaaaacatggctcttcatctaatgaacaaagaaactaattaagagtaatatttaaaagggttcaattaactgttcccctgaaaaattgagcaatcgcctccggactttattttggcacaacataagggctcaggagtttgttgctttgtcaaatcacagaaaagataacttaactgcttggctaattaatggcatcattactttattataatgaatacttaaatggagaaaaatattacaaaatatttttccaaaaattttctttttaatcaaattttattttaaaaaacttttacggtgatccgcatccatttgttgctgtacacgatggtcttgtggcatatgtgtacaaattgtcggtgtattcattgcttaggccagctaaaataaattatgaaataattagaatgtaatagtgccgagagtaaaacataattttatgccataaaaagtttcagttatttgttctaagttttccaggacattgcagaatattaaaatttaaaaccaaagcattgtgaaaggcaatatgacacctttaattaggagaaccggatcctggaatgggtacattgttgcactgaggcgataattttcagaccctgagcactgaaaaacaataataaaataaaattatttttacgaatgccaattttttcgattctatttcaaataaataatttcttaaaaattgtttaaaaatgtttaaaatttgaattgtcaccggaacaatttggtcatcgggtgggtattgcgtttcgcgctgctcacgattctgccacttttggcgccactgctcccaaatctatgcccagtaataataattaatatatttgataaaattaccagcagtatatttctaaaacttagacccctccacttaaattagtcttaattgacacacataatcgaggaagcagtgataaacgaagaaaattgggtcttctgttgatgtttctaagcgtgtctaaaaaggttaaaaaaataccgcaattaattttaaaaaaataataatataattattaattttaaaacacttggaattaattaataaatttaccatttgtcctcctatccatgaatgcacataattgtggatcaattccaatgcgttctcagattctacgtccggtatcgattgagtgcattcgctggttggagtctgaaaatattgggaaaaacaaaaattattatttttaaatttttttactgcatttgtaaaggcaaaaaagaaatccatgttgcttttcgttagcattgagagaactctaaattaattggataaaaaaatattagtgcgcttttttactccttttctccaaacagccgaccatttaagccgaggtcacggcgaattttgccaccgctcgactgaatatattttcattcaagtcatttgaattaatctattgatgagatatgtatgaaacgaataattagggttaaattaaaatcattgctacaaaaaatgaacttacagtataccaattggccaaaaaaccgtcggcaatgaatttatttccgttgtcaggagcacccatgaacaatttgctccacatgatcgaatctgtctgcattaaaaaaagtattatttatttttcgtaaaaattattttaaaaaaacaattaccgctttcggcaatcgctggtccaatgtaacgtcccaataaggaagacacactgatgggtcaattgcgcgaattgcgatttccatcataaaacaatttttttttgtttgcattaaaatttcggttgataggtcattttttaaatccgccaaaaatgtcacacgtataaattcataagttgtctcagtttcaaccaaattaatattccttggtatcatccaatagcactaggtgttctctattcaaatataaatttatgtagaaagaaaaaagttattatcataaaagtaaaaaaaaattgggtcagaatgttttgtccataccttttttgaaattcaataaagtttttaatattaaatattaatagagcatttcttagagctatcgaaattccattaaagtttgaattctgactgtagattttttgtacttttatggccataattttttataattgaaaaaaaatttcgaaccgcttggcggatttatgaaacaacccaagacgaaaattttgcattaaaaattatcaactgatttatatggaaaaacatggagatattcgagggtcggaactttttcaaattcaagaacaaagatcgacaatgagtccgagaatggagaaagaaccgaggcgccaaaaaccaagaaaactgaccttttcaaatattcacggtgccacaaaagaaaggtggggcccccgtgggcggaagggattaagctgggattgcagtggaagaaggacagccggtcgtactcgtgggaaccgtaaccgttcttcatttggagccacgcgttgtgctaaatggcaaaaccgcctaatttctgcagaatcgggcaaaacccggcctccatcacaaaatatatcagcaatctccgagacccgttcattgtttttttgaattttagtcttttttggcatcccaaatgcagtgatgttggagtcatggcatattgtacaaaaaaagtcttttggcaaatgcctgaacctgtaaaggcattctctggtcgaattaatagaaactctttaaaaacattaaaaacataataataatttaaatgatttaatttttgattacttgaaacaatcaatttttatcgcttcatgaacaaattttaaatcagacagaaatttagtcattggtgcctgtacctgtaacgtttactgatattttttcaggtttaacctgtatctatttttctatataaaaattttttccggtctctgatccagataaaactcggttcctatttattactttagagtttaaacagtttccatgcagctgtacagtggcaataaatgagctaaagcctatataaaatcaatgctcttacaaatcgctctctccgatcatcgctgagcatccggtaatccattcgcttccaacgacacaaactcttatccggtcaagcgccctgttgatgttatctcacggttctacacagctaacatgccggttgtatagacgatatccatatatctaaaatcatgacaaacctataaccttgattatgattctatgagtctcacattacagcgattcgcgcgcacagcaatacataaagactactccacgagtaagcttatcattatcgaactttagacacagtcgcattagttttaatgagttctgataatggcaaacacaatattcgcagtgaatcattcacgctggtttaatgcgttgccgacaacggatcatgtcgactgtctcgaacggcgtgcaggactagatcaatctatacagggtcagaaaataagtttatccggaagagcgcatgcatgatacacgtgtaatcggtcagcatttcttgttgcatgaacacaccatttgatggaatattacacttcgatccctatggcgtgataatattcgtcgatatttttgatgtaccagaccaccctgaacacgcaggtacggtagccatatgtcaaaaatcacaggttactcatagtagaggtggatgatgaagattatgtaatgtaaacataggtaacagcaccgt

SEQ ID NO: 11478 - DNA, 4375 bp, Heterodera glycines
atttgggcatggggagccaaaaggtacagcgaatttcaactgtctacgcaattctaaaatgcaatttcaggcaacaaattttgcgttttggtggctgtagggcaaaaggttacgcctctaatctatcgactcgaccacggaaaaccaacgccacaactcattggcaagatcgaaccggccaacggactgaacacggcgatgtgggccccgcagggcggttgggtggtggtgatgggggtgaacacgtccagcggaattgtgagcttcatcgacgcgacgggggcagaggcgaacaaagctaaaacgattgagcatacttcactcagtcaggtgggccactgtcaagaaatacaaatgatctttcaagaatatttttgcaatttgtttcccattttcagggttcttgggacccgaccgggcgatactttgccacgtgcactttcgcgggaaagagtcgctatgagacgggctatcgcattcactcgttccaaggacgtgagctgcgacgtaaggcggtagacgccctgctgcgattcaaatggcgtccgcggccacccgtttcattgtccgagcaaaaagtgcgggagactcgcaaatcgttgaagcaattgtcagcgaagtttgaggaggaggacaaaagggaaatgctcaaagtgtcgaaggtaaacacaaaaaaatatattggggaccgattgatggcggaaaattccctttttaggaaataattgaacagcgcaaaaaggcattggaactcttctcgaacattcgcgtcgctgctgctaaaacatacgaagaagaacgggaaaaacggactgagctcagaggcaattcatttaaattctaaataaaataaaaagcaattaaaacaattgtttaggtggcattgaccaggaaattggcgagaaggacctcgttgaagaaacaataacagtggcactaaacacggagaaggagaaaatcagagacgagagcaaatagaggagagaggtgtttttcatgcactttaaattatgttttctgttaattcattgttaaatatgatatgtactcgagtttattataaggtcggcaatttcggttaaaatttattccgaatttcgggactagcagtacgtatgtgggtctaccacaacacaggtacaatcaatagacgtatttaatatgcagcgtaagtgggtcagaacagcaaaattgaaccaatggcgctgctattcgttcggattgtattaatccattttttgtcaactgtttctgacccacagtttccgtaattattatgtgtacaatttggggatattatggatggggtgggccaaatttacaaggtaataaatatcttccggttgtttcgttttcactgtccttcttcgtccctggagagtccggtcagctctttcaccggacattccgtctcccaaatcagcaaatgcgccaaatccctcgctcgaatttgctctgtcattgcgcttctttcgttgctctccttcttgtcatgagggattacatcttcgtcacctattgtgtttttgacatttttaaaacccaacgatcttttgccccccccccttaaataatttctttcaacgtataaaacaaacccaatcgaaaatcaatatatccatcgccgccggacaccatcaatgcttttttcgtctcgacactttgtgtaaggtcggaaaatccctctgtaaattttggtcgtttaaattgtttatctgtgtgtgtaaaaatggtcaccagcaatcaatggtagcagaaaacggacagcatctttgtggccatggaagctgagctgagcgtttgtaatgtcacagaatggggtggaatttgccgtggattcatcgcccgacgaatggacacgaatcacttggcctggcgtccgtccccggtcgaggtcagccacaacagtcgcactgctcctttctgacgcaacaaaatccaaatatttgacacaaatcgcttgacctaccttttaaagggattgagacgattatccctgatccggtgcccacccaaatccttctgttcagctcactcagagaggtgattcgcaaatggctgtcaagctgattagcccctgaattgacgaaaggatttagaaatgagagagcaaagcggaagacgaccaagcattttggagatgtaaggttccacgtcaacgtcctgaagatgttggaaagtttcgctgtggaagagacggatgcacgagtcgagtcggatggaaagccaaacgccttttccacagcaaatcatttgtcgaacttgggagtctttcctcgggtgggcagtgaaaacatgctgaaatacgggtttctctgattgtgagtaattgttccgctgtttttcatcaacctttattttgagggttgtcgggtcgagtaccatcacacaattcctacaggcagcccatacatttccgccaacagtgcacaaatggcacaccgaactggtggcagaacccaatttgaccacaaagtaaccactggcggaccattccccgactaaaacgcaaagatggcacacaaaataacacgaattaggtattatcaattaatggaactgtaagtacagtactgacttgtattccggtgaaaaacagcgactgaaccattggccaatgcggcaaacatccgcccgtttaaatgtctaattgaaaatttaaatttgccacaaatgatgacgtacaaaattgagagaacggcatccggcattttcacacgccgcaaacatttgctccaatttcgcacagccgaatggatgtgaatgctgaatgtatgaaaataaaacacaatattatggagaataactcccacaaaaagttctccagcccaatccacatggttgggaggctcagcaattcactctcagcgccattggcacaccattcgtacgagttcaaagcgtcacgaacatgcaaaggcaaattggcaatggccgaaagggaccctaaaagtgaccaaaatagcattccaaggcaaaagggcttgtatttatagtgtcattagtaaaagtgttaagaacagcggagcaaataaacaggaaaaattgaaaaagtaaattcagaaagcgtgattattaattaaaatggatggaaccgaaaagcgtggacagagaaaaaaaaggatggcacacctccaccttttattttgtttgtttgtcctcaccatccgtcaattttttcatgacaattgtcgcattttctcggtccattttttctgacgaattttcttcgccgaattcaaagggaattgcttctgttctatgcagtgagggcttattgctgctgagaacatcttgaaccgattttggggctcaaaattcataatgggagaattttaggcacatttttgcgaatgaattcgaaaacacttacttttcgtttcaccgttcgctccgatggattgattaacactgactaaaaaacaatttcaaatgaagacaatttcaaagcacttacgttttctttttggcgacaatttctcattgggtggtgaaaatgttggaatttggtcctcctcttcacatttttggagtgcaacgaattcaatggatcccaaagatttgacttcctccacgagctccgccgggacattcactgtcgacaaatattccccggaggtgcacagttccgagtcgacggacattccctcgtcggacagtcgcgaatccctctcacgaattcctaaaaagcagcgaattaacgcaccagcaaaatacgaggcaaggcaatggacagtgaaacacctgctgcactcgcgacacacaaaacgttgacattttcgatagaaaagccggcaaggatattgccgggctgattggcctccaaaatggagacgaaggagcgctgctcgtccgagccacaaacccacaaaagactcgaagcctcgaggagtgtggagtcccttctccgtctccgtttcgtgtgattcttcgactatatgcaaaaatgcggataaatccccaactttctaatgggtaccgtctgttgttgattctctctcaagagcacctcggggtcacagctcaacattgggtctcccacaatgtattcgccgtccctaagccccccgtgcagtgccgacggagcggcacaccaaaccttttccgaataaatgaaacaatcagaaaaaagaaaataatcacttttaaagacggcatttgttccaacaagggcctaaaattgagttatgaaaaaaagaaaatgattagtaaaattgcgacctgcaattgaccggaacaggaattgagatactttctgtggctttgttggaagtcattgaccatcctttttagggaaccaatgaatattcgaggcatttggccaattcccgtcatagcgtaggcattcggaaattcctcctgcttcatgtactga

SEQ ID NO: 11479 - DNA, 1710 bp, Heterodera glycines
gtaaggaaatcacaaggaatgaaagagttaatggacttacaaactccaaatggatttactccgcctttgtgccaattcttcttcgtgttttttggcccttttaagttccgtgaatttgaccgtctcctgcagctccaagaacttttctttgtattggttcttctccatgaccattcgtgccatttccacgcgtgtgaaacgtttcccctgggaacggtcctccttaaaatgggataaaagtgctaataatagtcagacaaattaacaatttagaacatttgatgaatgggggggggacccaaattcatgtaaaacacaaaaccgaccttttcgtcaatgacggtgtccgaattgttcattttctccttcaattccttcatttcgctttccaactcgcggattcgttcagacattttcaatttgaccatctccaaacttcgcacctcctcgcggaacacttctttctcactgaatgaatcggaaattaaaattaattttcgaataaaagcaatgcctggaaagctgatcaacttgggcaatgaggtcgtttttaacaatatttaatgcgttttttgtctccaacagttccgtgttctctctgatcaaattctccacttctttgcccattcctaaacaattaaatccttcaaataaaattttaaataaaaaagaaaggttgttatcacacaaaacaagcaaaaaaggaccaaacaccatcacaaattagcaaataccgataaatgtgtcgttgactgcaaaaaacgaaaaagttttacgaaaaattcataaatttggggcaattacccgccgaggcgaactctgccggatcaactaattggcctgaggttttgggagatgaggcaaaggcgcaaatagccgatataaccgagaaactgacttggcccaatactcacctgtaaggtcggcacccaaagaaacaccgtcgccatcgtcgacaacgtccctgaaaatggcaagtgtaaactaaagtaggacgggctcaagcgtccaacaggttttaacagttcgacatagtttggtaaattacaaaaaaatataataaaatcctttaccggcggtccgtgctcgctcaattttatcggacttttaacgggctgaaatttcgcggagaattccccccccccaaaaaatatgaaaatcctaatgctaaatcaataaaacattgttcccgatgtttgttaaaaccagctaaaattcccaaagaattctttgatgaatgctttgtcttttaattgggcattgactgtcccccgctggcacaaaattcggccgtacaattgttccatttgtccggcggtgctttgtcgcccgtctttctcctccttcacttccttctctgttgccgcttctttttccttctccgtgtcggcgcgtggagtcgcgagaatttcggccaccgtttgctcttctccaaattcttcgtgccaatcccctttgataaaacaacgggtgaattacttctttatctcgaagaccaaagcccactttcggtgctgatgtgatttgccaagttcaagtcggcatgcgtactctgtgacatatgcgcactgatcaggtcggaaattccagcgtacatttgtgtcgatggcactcattgccatagtattcctcaatttaaatgccatttccgtatgatctcaggagaatcagtaatttcgaagatggacctgattgtttttgccaggacct

SEQ ID NO: 11480 - DNA, 5204 bp, Heterodera glycines
taaaagtataaaaataaaccaattttacgagttgtcaagtttagttttctcttccaaacacgaatggtataaaatttaacaccaattttttcagctattttcccattaattttccaattcgtttttgaattgaatttttttgtaaattcttttttcactttttcaaattgtttaacttttactattttttgctgatttgaaaattcccttaataaaccttaaaatgagacaattagtaaaattcaaatatgccattgttttcttaccaaattcgttcttccatttataaattttctttcgactaattcccaactatttagcaatttctcattacaattgagaatgggacataagtttataaacgctatatttttgccattcctttttcatcaaacaaatattagtaataaatcttcactttatttgtctgtttttgattctaaataattcataatgccataattagcgttttaggagaacttcagtttacaatattgcgaatttcaaggaatttttgttaaatttaatctccacttgaaaaaatatgtccttatttttgcaattttaatattttatttctcaaatctcatcttctttaataaaaaattaatccaaaccccccccatatctgaacaaatcctgtgcgttttcaggccgaacaatgttgatctttacactgataaacacgtccgttcgcagcagaccaaacaatggcaaaaatttcttgaaaataaccaaaaacactatttttaattaattaatttttggtttatttaagtgattaaattttgtttaccggtggatttttgatgacattaatctcaaaccattgcatcaattttgactattcagagccctaacccaaatagcaacaacaggccgaaaaagaattttcggtctttaaataaaattaattaagtattatatttcctatgtatttgtaaaatgtcacattaattagcaaaagactaataaaattatatgccttaattgctttgcttatttgtccacgattatggccaaagaatgacgtgtcaaacaatcggatgcccacctcgagcgccaccttaatttgatggcaaaaattacttctaatttgaaaaattggcaaaaaaaattgtttttttaccaaaataaattgttccgcctccaattggcgccaacttggcgaacattgaaggccaatttttggcataaaattgccagtggacaaacaccaccgtccgcccggcacattaacgaaattggcgatttcttaaattaaattttatttaaaaagtcaattcttaaatttgaattatatttaaaagaggaaaatttattttatttttttaagacatataaagtttaagccataaaaactttgcttgattttgattaaattgtttttgtttcttatggcagttttacaaaacgagacttggcacaaattaggaataattattactttttgattgacatttttttgtaaattaaatttgtttttctgttttatttgcttgctatttccaataatgataagaacctccgttagacacacctttgtaattgatttctatggtttcattgatgttgcgataaattttgaacaaataaatctgtgaatataaaattcaacaaatatattaaaattaaattaaaattattttaaaattattttttgtttaattaccgggcttaaagaatagctacgctcctgaatgttgctcttctgaaaaaaactatattaaaatcaaaatttcgttggtgttttttgaaaaacaaaatcccagtcataaattgttcagtagtttgctaaaattcaaaaaataaactatttcttcgtttccatgaaattaattaaatatcaacgcacttcgcttccggtggcctccgatttttttcccaagtcctgaatttgtttgtgaaaaaatcaaaaattaataaaaaaagagaaaaaaaacagaaccaaaaataatataaattaactaatttaattgaaacaactcgaagaaaattaaagtaaaaattatactattacatttttttaataaaaaattaaaaattaactttaataatttattttaaaataaataatgtaaattatttagttcatttattttttttgaataattttttaaatttttgtgttaatctttttatttttaaatttgaataaaaactttttaatttttccaaatatttttcaccttttttctcaatttgaacagtatttgtacacgataagctgtgcctgcaacgctttgtcttgtggcattgataattttgacaatatcaagcaaagggatgcccccggcagaccgatcggagttcaatttttgggccgcaatttcggaaatttcctgtgattaaattaaattttcgagttctacgtcatttgttgaaaaatacctgccttcccttaagttttttttcgataattaccaagcttatctggtagttagttcacttgagcatatttacacaaaatacacaatcttttttggttttcttcaaaaatttcaacataattttccaacttagtgaaatgccagttagtgttttcttagaaagataaatatttcagcttaatgcatcattttatatgtaaaaaaatagttttgccatgacatcaaaaaactgaaaattttggccttttagtcccgcttttgctgaccgtgatttctggcaaatttacacaacacggcacaacacggccggccacaatttgttgatgaagcaaactaaattcgtcaagctgttcaatctccgtttctgcactgtatggaggaaaacgtttggcccacgactcttcttcttctacttccttctcatcttggtctctttgaacggcctcattagcagtaagcattgtgaaggccggagaattttaaattttaattggataaaatttttcaaaatttctttaatttcactatgtgaagctaaaattcttgaaaagggctaaatatggtaataaaaatcatttaaatggaaaatataaattaaaattgattagtttttgggaaaacgaagacaaaaaatgaaatatttcaatgtctagctttatttttgacgcgaaaaacttcaatttaggtgtataaatgtctaaataacggcaaaaaatgataaaataggggcaaaaattgataaacaggtgcgtaaattttaaaaatctgtgtctttttcaagtaaaagccatgaattcgctccatagtcacaaatcagtatcgatccgccgactaggatttatccatatggaacaacagcttttcctatttatttgttgtccctcactttaagatgctaccgatccgctctcatcttctgaaatgcttatctgctgtttcaaagaaatcaatcgatcaatcactttcgcgtctttgctagattaaatgttacgtctttgaaatgagcttttctcgagctgaagttaatattgtaaggcctggaccggaaatggcattttattttcccacgcacatttattactccgataaactcctcccatcccgaggggcgcttaaaaggcaatggagagccagtcaaaggggcagtcggatcagtcgggagccatttcagtggaacggccaatcgatccccgcctgggaggatcccccaggcatccatcaacatcccttcccttccaagccctgaggggcctaattacggacgcgtaagagggtcccctggactaatttccctcataagcactgggtagtgggacatcacggctttactggtagcaccggatggttccaaccctatgcttacagggcttgggccatgggaagagggggattcgagtggtagaccgacttttcaggggatgtttttgtgttgcgcaaagcgccaatcattttagagtcctggccaggccccagcaaccccctgggaatcaacaagaagtatcaaatcaaaaattatcccacgcgtggttcgataattattttcaaaaaaaaaaacccaaaagtttatccatgcatggtttcgaaaatcctaattcaaaaataaaatattcaaaaattatccatgcatggtttcggaattttgcggttcaaaaaaaaacctcccatacgtggttcaaaaatctttacagtcaaaaaaaaggggtgatcgaaaaagggacagaccccagaaaaccctcaaaaatggaatttaactaattcatggagctcaaaaagagagacaaaaacaaaataaaagactaaaaaataaaattacgaatgaattaggcatttttttagaggtactcttaaaaatgagggtgaatttaattaaccccacggggtctaaaaaagtgttttgctccttttggcgaaaattaaaatctgctcaattttaatcggaatttcattaacccttaggggatcaattaatttgaaaagccataatcagttaatcataaataaataaataaatgactaaataaataataataattaaattgaaaaagatagaaaaagatattaaaatcaaaaaacaaataaaaacaataaataaataaatttaaaattaaaagaaggaaaggaggattgaaaatgcaaatcacgtgcattgagcacacatatttagtcatttaaatttgcgtctcctaaaataagggaaaatttaatgaaccccacggggtctaaagaaatattgtttttgactcatgacaaatcccaaattgtcgagtcttagtatccctgaggggaacaattaattgaaaaatatttaaaaaaattataattaaaaaagaggaatttaaattaaatttaaattaaaaataattattaagagaaaacaacaaaaaaaaaaagattaagatatttaaattgaaaaagtgggaatggaattgaaaatgttaatcacgtgcacggcagcgccggattgtcggccacagtacagtgacaaagagatggtcatctcttccatcgcttagccaccttcccccgcgtcccatcttttccatcgcttcgtcttcccccgcgtcccatctcttcgttccccccccctcttccatctctttgtccctccatatcccatcaccccctcctagcaaattatgcgttgaatggccaatatgtccattccgcaacatttaagtgtaatgtatgggaatggccacaaaaacggcaacgccaacgaaggacgattggctgccgtaaatcgtttagtgctacagtggcttggcttcttcccgaccgacccactgacatcccccccaagcctttccctctatc

SEQ ID NO: 11481 - DNA, 1097 bp, Heterodera glycines
ccaacagcaacagcaacaacaacaacagtcatcctccgactgttgtcagacgtgtggctgcgcgtgcggttgctgctgccaaagcagccctttcttctgtttcacgggcgacactttggtaatttaaataattcgcattagcaattaattaatgaatgttaattaataatcattaactttacattaattattaattgacaatttgaaggtgcaactcgtcgacggaactcagaagcgaatggacaaactgaccatgggcgattgggtgggcaattaattgaattaatcactcaatgataattaattaattgtcgctatattcattttaattgctttttgccacgagttcaggtcgtttctgccaatggttcccaactgttgttcagcatggtcgagtcgtggatccatcgggtgaattcacaaaaaataattaattattccaattaaaattgagaattgaataaaaacaaattcagaagccggaagaggaggccgaattcgtgaggttacagctcgaagacggacgaacgctcaaactgacagcaaagcatttcatttacgcctcaaaatgcagcggagacggcggtaagcagaaaaggggtcattaggtaggcccagtgttttcaaacggtttcggggaaaacccggaccgggcaagaaaaatcacagacccagtgtttcatcggaccggggcccgaaaaagccgggaccccggtcccgtgccgtacaacttttgtaaccactattcaatcagtagacggaattttgcattctaattttgaatggtttaaaatttgcagaaaatcattcttctgtcacttttgcccttatttttcctgcaaattttcaactttgtttagccttaaattcattgaaaatttgttgttcaaattggttgatgtgcttaagggtacgtgccgatggagtgggcgcgcgcgcggatggtttacgcggacgaagtgcgcgtgggcgactgcgtattcgcacaagacgaggcaaattcaaagccaattaaaatgcatttaattaatttgacaattgcccttttcagtccggactgatggctctgttcgagcgccgcgtcttaagcattgaca

SEQ ID NO: 11482 - DNA, 3389 bp, Heterodera glycines
  misc_feature (39)..(39): n is a, c, g, or t
acaacgtgctgcagaagagcttcttcaatgtttgtatcncacggattggcatgatttgaaatgccatccattgaattttcaaattccaattcaattcacagaattggaaaacactgccactgattgaccaaatttacgggcacgtcagcgaggaagaggtgggcttgtggcaccgccaatgccaaaatgtccccattttactcatttgcccacttaatgttcagatcgaattcccgggttggctacgtttcctggtcgaacatgtgatgccatttgttgtgccaaagtgaccgtgaaaaaagcattgtttatacatttaaattaaattatcatattgtttcaaaaattaacttattggataaattctgttacacaatatttccaaaaatgaaagggaataacacgacaaaacaattaagccaaggggaagcggcgggggggggggtccggacaatccatcagtaatgtgttagaatttttttttgagaaatgatcaaaaatcttgcgaaaatgaatgctaaatttaatttaaaaaaaaatttatataggtttttaaaacatttatagttagttgccttaataattgaatttaattgatcaactatagaaatttcattaaattattaaaagtgatcacttcgtatattttttaaaaatacacaaattatcaactcccttttttttaacgatttaaattcatttccacatgataataaaatatagcgttttaaaaataaattttgctgacggattgtccgggatcaagcggggaatgggggaaagaccgttgctaatacgatcattaattagaccatagacccaaaaggaaatggcaattaaactgaaatattttatttagtgaaacggctgtcaatacatcataacaaaacaaaacaaaaaagcgttgtttgcggttcattttaagacggagggaaaatgctaagggaaggggcgggcgaagagcatttgtaacatgaggcgatggacgcgtaattgtaagcaccgcaactgaaaaggaaacgggggagagacggatggacacggaatgtgccaacaaactcgaggcattcccaacgagaattgcgaatggcaaataattgatcgtcggtcggcactccctcacggcactgacgacacatcaaaaagttggggaagttaagaaaccagcaactgaaggggcaaagaaaaggtaaaacactgaaaacggaaatgctggggacacaaaatttcgccgagacaaaatgtctccaccggtttttaaaaaatagaaatttttcaaggaaaaaatcagaaaaatcagaaaattcaaaatttcttttcttcaaatcttctttcggcggcgagatttcgggtgcacccttttaaatttaatttttcaaaaaaacaattttttttttgaagagagttcagtggtgagtaaagttgtcaaatgacacttgcgcatagccccacaattttaaaaagattttttatgactcaaaaataaactgagcgacattattggcaattggcgccacggcactgttttgctgctcggttggaatcgactgacctgacacaataccacgacccgtcgtccaacgactcgccaccgattccgcaggaaaagcctttggactttggggcgccgcatttgaagcagtcctctttgaaattgtggtgtcggcatctgaaaaaatgagtgtcaattattcttttcattttgaattccgtacattccgcaaacccatcgcaattgttgaatttgttggcgattctcttccggtgccctccctttgatacatttttggcacgacaaatgggtgggaaagttacgccacaaacagctaaaaaggaaggggcagggtaatataattagcttaatcacgaaagggaaaatcccaaaaaatataaaaatgtacactaaatgccatgtcaaacgaatatttctaacagttcaacacctcagaggaatatactccggcattatattctgcactcagtccgaataaatcacaatttacccgtgaagtaccggcacagttgagctacaactaagttgaaagcatcaaatgccatagaaacgggaaacaaagacaaattgggaagtgggggcaagtcgaaccgagacagacaaaacaaagggactaaccactgggccaaggggaacacagtgcaatttagaatatttatgttacattgagctaaaaagcatttccgagatttcccatggcttttgtcattgttattaatggttttgttcaccttgagcacacccaatactgacaatcagaagttgcagggagttgcccttccgtgggccgtggcgcgtcgcaatggtggcacgtcaaattggactcgtaattgtcaaaatgacacctaaaaggcggaaaataattaattaatgagggatttcttgttgcccttcataacagaaaaaggaatttaggttaataacagtaaaattttttaggtttccaagatgacgccaggggaacaggacaaaatttcgcctggacaaaatattcgccgccaaaattttaaaaaatttcgttggcgaaattatatcccggcgaaatttcggtgtctaaattttggggtgcatccgacgccaagccctttagccataaaaaaaaattaggatggggaacgcacatatacaatttttttttttttttttgctcttcggcagggctaaaaacttttttctccagtgttagtgttcgaaaatttcagggtataaaatagaaaatattagccgtttttttgcaggaaaatgacccttttgccggagaaccaaaattagagacaaacgcactcagcgcattgccaacgcgaactgtgaatgacgccaagttgctcatccgtcggttcttctctgcgacagtggcgacacttcgaatagttggggaagttgagaaagccgcaactaaacatttgaaacagaaaatgcgatgaacattctgtagcttttgcatgacatgcaaatccaagtaaaattgttttaacggatgcaaattattctattcaatttttatgttagtcaataaaatcttataaaaataaaaaagatttttttgtgttatcacctacctataagaacgagcattctgtcgagatttgaccaaaatagtcaaattgggagactttttgaataatagacggaaaattataagaaaattggtgcctgtaggcaggaactgtcccatgattttgtttggaggtatcgccgccccgggcaatgatttttttttcaggcgccatcggtgaagaaagatttttttatagtttttcaccaaaattgctaattttgtagatttttgaaaaattttattaggtgatggagggtaccatcaaaattatcttacaattaaaaatggaccaatttttggtaaaaaaggatttataac

SEQ ID NO: 11483 - DNA, 906 bp, Heterodera glycines
  misc_feature (875)..(875): n is a, c, g, or t
ttctgatcactttgaaactgttcgaattgttcaacgcaatcttaaaaagagaaaagttaatttcaaaacaatatgattgtaaattattcatcgtaaacctaccgtatttttcctgctgttgggaatttgccactttattgatccgttccaaaagtttcttctgatcattttgcaactgttcgaattgttcgacagaaacttaaacatgatggaaatttttttttgtgaaaagaaggcaacctaatgaacccaaatacgttcggtaaaattcgttcgttcttaagttttcaaatttgtttggaaaattgcgatgaaaaattacaaaaccgaaaagtaaaaagggcgttgtcgctggaataggtggaggacttttagctccccgcccgaagccgagggtcggctacgccctcccttgaccacaaattaccaattaaaaacactaaagaagcaattgttttcctcactcaaaattcaaaaccatcacttcatcccttaccgttattcggttcattcgctgaatttgaagacatttttataaattatataattgtttcttaaacatgcagattattaattagtttagttacatatgaacagtatttaccagcacaaaaatgggtaatccttcggaattggtatcccgaccgaaaaaaacaaataaattttcttacaaaatcacttttgttaggttaaaaaaaatgagctgatcacgaatccgagttcgggttttgcaaaatcattgttttcgtcaatgatttttcatcaagtacttgatttttctttgaaaatttttgttttctaaaattttggttttctttccaaaacatttcgaactaagtcaaattttacattcagaatttgcttaagtatacaanacttctatgggttttatcctttcgtcgatgc

SEQ ID NO: 11484 - DNA, 4331 bp, Heterodera glycines
atccatactcaactcatccatacccaactcatccatactcaactcatccatacccaactcatccatactcaactcatccatactcaactcatccatacccaactcatccatactcaactcatccatacccaactcatccatactcaactcatccatacccaactcatccatacccaactcatccatacccaactcatccatcgggatccgggacgcgaaaaataacggaattcggaataaacgaaactattacatatttacttggatgctcgaattaattaaaaaatggttaactccggttgctatgtttcgactagctatattactgctgacctgccctttaattttgtgtatggaatggcaaggctttatcattgacaaattcggatatttttttccggttgcggaacgtgatgccgcaacgcttttgacgctgattgctgataacattgaaccgggaacgttgattgtgtctgacggatgggccgcttacggagggattcagaatatgcagcagcgatacgaccaccgctgggttaatcaccgtgttttttttgtagacccccaagaccggtgccgacatatttgtttcagtacatgttcagaagataccacggaaacgcaaaaatatttcagcatattttggaagaaatgagattaaattatcccgtatagtttgaactattgagaaattttgtaaaaatagattagtcaatgacggaaaattgtaaatgcactgaaattagagaaaaaaaattgattggacgcataaaaattgatgggacgcataaaagtcgatgggacgcaagtttattgaaatgttggatgacattagcacacaaacaatagaagtacaatatacgcgtgcattgatcggaattaatatacacaatatacgaatttggggggtgccaacaaatgcgtttctgtgataattgggccatcaataattcatacataaatacggatattttggggagacaaatgaatttattaaatatcggggtcctcatttgtttttcgctcgccaaatcatcagagttctgcgaggctcatccgatcgttcacaacagcgcatcgcggtactcccaattgtcggcagttgtctggacgaaataacgcggatggtgatgccccggcaggtgattgtgttggtcaaagtacttcttaactaaaaaatgaaatccattagtttttagccttttgacccctcattcaaaacccactgagctttgccagcgttttgtcgcgatggaacagtgcagtggtgaggtggcgccatattttccgactttcgttgttctgttggtccatcactggaatgcactcctgccaaaattgaattgtccattaattttgagagaaaatgtatgaatttccaccttgcgcacttcagggctatccttgacattggtgaagagttggaagtcaccgcgcgctatttttcgcaggaaaatctcgccgttccacgcgcctttgagcaccattgacgcccgccgtccgccgtcgcgtgaaatttgtcccgaaatttgatgggcccgtccgagaaaaaagggcttcgccagaaactcgatcgccgccacgaatccactctgcgcacaacgtatttcgacctttaaagaaaaggaaaattcaatacaaaaacacgaatagattcacacccactttgccagccagttcaacccaaggggtggcgtgacaatcacgggcgacggcatccgggaatgtggcggtgtatgtctcgttgtgctaaaagaaaaatggtgaaaaacatcaaaaatggccagacacattcgtgaacataccctcccaaatcgcacaaccatcgttccgacgttgtgcacgcccagtgaagtcaatcccgcgatgaatggctttgattcaatttgagcggtgcacgaaatggcagagtccgggtgctcagcataaaaggcggagaggcgcgggctgttgctgatgtgttccgaaatgaaggtcaactgaaaatgataattgtaatatgttgaatcatgagacccccgcccccccgtcaaactcgacctggttggtagctgatccaggaaaaggtcctctatccgtgagttcaccgctcggcaattggttgggcaacgtccagcgacaacgaaacgtctcaccaacgatgggagtgtacggcttttttgcgacaccttctttccgggcggggaagaacgagttgaggtaaaacttgagcacggcaaggaatctgaaaattaaaaaatttgaacatttgtttagggcggagggagaaaaaaacaccacctcttctctggcgtgttttcggtggatgcacagaccaattcgtcggggtgggctaaaaacgggaagcactgttaaagttaaaatttcaaaatggaatgccactcactgaagaaatcagcgtacatttccaacatcgaccgtcgttcaagaacagaaattggtaacactaaatttgtcaagcccgagcggagaacctgtaatttactttcacattagaagtttattttgagtcatgagtctgtccacctgtttaaacaagtcctggatcaccccgttgccactgttggaagcgctttgctgatcactgtcgtaaattgcgtcgtaatttgttctgtctgcgtcgaagtggccccaatcaggcaaagggaattgtaaattagcattagccatttggctgaaatcggggactgaaaattaattacaagaaattgcacaaaacgaaaaaaattaacaaaaatacttagggtttttagtttttcaattttagattattttggagcaaaaaattaaaaaaatgacgattacaaaaaatttagtagatgaagaaaataaaaacaaagaaatgtaaatttgatacggagcggagcaatttatatagaaaaaaacgaatgacaaatgaaacggaattttggaaaggcacacggttcacacatcggaaggatatttaaatgggcatttttgcgctttgttgttcattcgtcgcaatcactgcaccacacataaataatattttgtccttcttcctcctcccataaaatgcttcttcctctcccttccgttttgtgcccttttcaacttttgcttctcatcgtcggcgctgtgtttattattctcgctcagtgctgtggttgcggtgggaagaaggtaagcggacatttcaaaaaacaaaatgccattcattctaaccatttttttcattttcagggaaagaaagcggataaaaaaggtgaacggcagcagcagaggacttttttatttatacaatgggggaggggaagccactacaaattaatgtcatcaaaaaatggcatggtttgagtgaaccaatcctctaacattttcataattaagtgctgctctgaaaagaatttttgcagttttgtgggcccgatttttttttcttctaaattcgtacaaaagcagaaaaaaatctattgttatgggttttcggttggggtcgttgatcgcggaatttgacattcatttttgtacattccgtatcccggacctgaattcgaacgtgaactcagaattcatatttatgttcgagtctttaaattacatctcctactcaaaaagcaaaaaacaattcatttaaatgttacagcaaagaatggcgctggtcaggcgaactcgggcgaacgcagcaaattggagaagtcagccgtaggcgtcggcaacggatcaccgaaagaagcaggtaaaaggaggaggtgtagaggagaaatgtgatttgtctgcgagtttaattttccctttttcagccgtcccggccaccacgccacagccagcagcaggagaagcgagtggtgagagataatggggagacgaaaacggcaaattcataatttcttttgttcgttcagcaaatgccgcggcgaaagcggagggttcgcagcgcaaaaaggaaaagccggacattttcatcacgaaaaaattgcctgagaacaagaagcgcgaattcgtttcaggtagagcgaagcaaggaatacgaataagggcgaatttttccaacaattccgttccttttcaggcaaaaacccggactacgagacgctcaagcagttggacatgcaaatcttcctcaagaagaaactgtcgggaacgcaggcgaggccgcacgacttccaatcgcaagtgtcgtcgcaacaatcggccatgtagaagtgtgcacagagtttttggtggagtcagcagtcagtgatgatgatgataaatttgtgttgtgtcggatgcgcccccgttttaccaatgctatgaatgaacaacagttgtgacaccaccgcatttatattgttaaacatttgtgtgttatttgtgatgcatattta

SEQ ID NO: 11485 - DNA, 4910 bp, Heterodera glycines
attaaatagcaagggtacgaataaatgaagtatagtcaaaaccgtgggggttgttggacaacaaaccggaacagcttacccaattttacacgcattattattcgatgttaggtgaaaaaaaatttttgtgtgtggttgggaagattcagcctttttaggccggaagcaaaaacacgcaacggaaaaaaattttttgtagtgcctgttaaggacagaatttttaaaaaaagccgtcccgggctgattattttagaagtaaaacaacatggtcgacgaatgagcgtgaaatgcgatccatgaccgcctcgggcattcggaacgtgtccacaaacagctcgggcaaccgcagcggacatgtgtacgcaaacgcagccaaatggaggtatacggcggcaacaacggatggtaggatgtgggccagcgcgtagcagaccatgacaacttcactgacgaagttcgcaaatgcccacacactctttgacggcgaagtgtagaagcgatagcgacgcagaaactgcatggagtatggcacgctgaggttaaacttgagcacggacaacacctttataatgcgcacacaaagttatgactttttgaaattttcaagaaaaatcgtgaaaaacatttcaactttatttctttaacaaattttataataataagtttagttatttaaaaaattcgccggtgagatttggggtgtacacataaaaatccggtaattcaaaattaggtttcctattcacccgcggttccatgcgcaccaacagttgcaggatcgtcttgttagttcctgggactaccaacagagagcggtcgagaatgtgcacggataggctgagcgtttcgatggtctgcgttaagcgaacttgtacctgaattaataccgtttcaccagttttcaacatttttaaaatggacataaacaagccaatcgacaagaattgtgccaccaccgaatttcaaagaggacatcggcttctcaatgttttgctgttgaggttataagactgggaaatgactcattttaatttgctcttttatcattaatattctaaaaaccatattttttaaattctttttgtcaatgcttttcgaattcggttcatttgttttggtgggttaagtgttgatgatcagccgaaaatggcaaagaataaagaaccttattgacttgaaaaaaatagggaaatgaataaggttgttagatgagaacgacggactgccatgaaaacaaggaaaaatcgaataaacaatgagaaaatttttcaaaataaataataaaatcgtacaaaagtaatcatgtaggtaaataactgttataaaaaaatttttatgagaaaaataaataatttatttgtaaatttaaaataaaaaatataattattatttcagaaataacaataatttgataaatctttttaattacttaatttaatttataaatattattttaattatttggtcaaccatttcctttaactttaaagtttggaaaattccgttaattatttgtttattggctcccttcccttttgataatttatttagttggctcgcttaaggagtactgtaattaattttaacgaatagaaataaaaattttattatgatgttgagaaaagttcttcaaccataaataaattaatttgttttaataaaatcaaccctaaactggaggcagaaattaaattgtattaaaaataaatttattaagaaaaaaataattttttaattatttataagaaaaatgaatatttattataattttagaataataataattaatcattttaaattaatttagtttattaattttattttacagtccctcaattcgttccattcaaagcgaaattttgtcaaaaataatgttaattgatttgtttatttgacgcccttccagcaccatgcccttttgataattgaaaataaattgtgcatgatattataatatttaattgagaaagaaaaaatatatttgcgaattcaaaatggaattttttttaattaattttagaataattatttataattttatttgtgaattaaaattaaattattatgttgtttagaaataccaatttgataattcttttaattaattaattaggaaaattccgttaattgatttctttattgggtactcttttctggaaattttttaaattaattttagaataattaattatttatttaaaatttttttatttgtgaattaaaaattatatattgtttgagaaaaaacaatttaataaaacctattaataaattaggaaaaatccattaattgttttctttattgggtaccattcccccacccttcccttttgataatttatttatttggcgcgcttaaggagtactgtaattaatttgagcgaatagaaatacaaatttgatgatcttgagaaaatttatttaacaataaaccaaataaactgcttttaataaaatgaaatgctaaaaagggacagtataaaatatgtatcaaaaataacattttattaagaaaaaataaataattttagagattttcgagattttataaaatatcattattattagttttacaatttaaaatattaattaatcttttaataattaatttaataataataaaatataattttaattatacggtcccccattcttttttcattcaaaccaaaattagtcaaaaatccgttaattgatttgtttattggtcacccttcccgcattcgttccatttgataattgattgtttgttttagccctttttatgggtactggaattaatttgtactgatagaaaattttgataagaaaattcataataaataaatttatttgtttgttaataagaacttcaaaagctaaaggcttacggtggctaaattgtattaaaaataaaattttattaagaaatataaataatttttaattatttccaaatttaaattgaaattattttattattaattttagaataataattaattaattaaacgtttttaataataaatttaattaataatttttttaattatacggcccccatttcttttttccattttaaaatcgaaaattgtgaaaattcgttaattgatttgtttatttgacactgttgcagcactctttcctttcttcattgatttgtttattttttcatctttaagggctactgtaattattttggattaaaataatgatgcaaaaaattattcaaaaatcataaattacatttagataaaaaaaacattcaaaagccaaagggttagaaaaaataaatgtgcatcaaagtataaacattcattgagtaaataaataattttaattatttgcaaattaaaaattatttctttttttaaataataattaattaattagaacattttttaaaatttaataaataaatattatttaattatacggccccccatttctttttcgctttaagtcaaaaattgggaaattccgttaattgatttgtttatttgacccccttcccttctcgccacccgaactcgccatttcccttatccctcgctgcaacccttcctcgccactctcgctgccgagcaatttctcgccatttttctcgttgcaatgtactctcgccacactctcgcccccctgccactcgctgctgcctactctcgcccccctgccactcgctgctgcctgctctcgcccccctttccccgctgatgacgtcattttttccctttatgagagcaaattaatgtttatcatccattgccaatgtggccgagtggttagtgcgtcagtctggccgccccctctggggttcggatccgcttggtgcggggaatttttgatgaattttaaatgaatttaaattcaacgtctttgacctttaagacgtttaaaataatttaaaattaaataaatttaattaaaataatttgcataaagtcgcgcagtcaaaaaagtcgcgcaccccctgcaataggtttgggtttcaaaaaaaaagtcgcgcaataggttttggcttcagtactgaaaagtctggcgctcaaatggcccgcgctcacttggcggcgctcaaatggctggcgctcagttggccatgcacccctcccacgcctatggggggctaccgtaatccggacaaaatggagtctctaactactattatgagcgctaaaattatcagagtgccgaaaatcgcatgtgatctaagcctagaaaaaaatggtgtaagtaaaatcgtaattacgctcaaaaagctcctcaaacaattttagcgcttccaattccttctacaatcgcctttatacatcccattatgacgctaaaattatcagagtgccgaaaatcgcatgtgatctaagcctagaaaaaaatggtgtaagtaaaatcgtaattacgctcaaaaagctcctcaaacaattttagcgcttccaattccttctacaatcgcctttatacatcccattatgaacgctataattatcagagtgccgaaaatcgcatgtgatctaagcctagaaaaaaatggtgtaagtaaaatcgtaattacgctcaaaaagcttctcaaacaattttagcgcatccaattccttctacaatcgcctttatacatcccattatgagcgctaaaattatcagagtgccgaaaatcgcatgtgatctaagcctagaaaaaaatggtgtaagtaaaatcgtaattacgctcaaaaagcttttcaaacaattttagcgcttccaattccttctacaatcgcctttatacatcccattatgagcgctaaaattatcagagtgccgaaaatcgcatgtgatctaagcctagaaaaaaatggtgtaagtaaaatcgtaattacgctcaaaaagctcctcaaacaattttagcgcttccaattccttctacaatcgcctttatacatcccattatgagcgct

SEQ ID NO: 11486 - DNA, 1137 bp, Heterodera glycines
tttttcttgaacagcagtcatctctctatgatgagtccttctcctatttttcccatttcccaccattgccattgtgttcgttatcatcgcaaccattgccgaaagtcggccgattttgtgccgattttccgcaaaacttttgccatcgatggaagcggcagaaacaaagcacaatgaaaggacgaagaatggaatgagcactttgagaaacagcaaaagtgccattgtgaagggagaaaaaacggagacaaaataacggagaaaggacggattgaaggaattcagcgaggcgatgttaccggtgccgaaaaaagctgaaatttagcggttttttatgagtataaatggaaattaattttgaatttacccatttcaattgaagcgaccaaacaaagggctcttagaaattcggaagttgaaagaatttgttgaggaatgaattcatctaaatgacattaaaatattatagtttttcattaaattattttttgcctttttcattgccaaatttcggtgccctttctctgattgtaattgctaaaaatgtggccaagtcaatgtttggatgctctaaatgaacgtaaagcatcaaaaaaatggagaatattggcaaaaaaagcgcttcatggccaattgaaaggagcacaaaaggtaactgaaaaataaaaagagaaaatgttaaaaaagatttaaacaatttaattatttaataaatgaattaaatataggaaaaagaagataaatcattaaataataaatggatatttaattaattgggcagactttaagggaagaaatccaaaggattaatcgatcagaaagtcgcgcgggggaagcccaaattggaagaacaaatgccaaaggcaacgaaagccaagcaaagggacggattgaggtggaagaaccctaaaaatgaacaaaattaaagcaattcttaggtttaacttatcaaacaaaaaagccaaaaaaagataccgtaatttcggtgaacaaaagtaatacggtaaggaacaaatgaatacggtaaacggccaaaattgacagatggggcgaataattgaacgatttttgatgcgaaatataaaagtggagggcgaaagaaacggcaaactgtgccaaaagcacaaaaaaagcatt

SEQ ID NO: 11487 - DNA, 744 bp, Heterodera glycines
tggtatagtcgagtgcttcgtggacaggaccaagccatttcagacaaacctaaaaacaaaggaaacttttgcaatttaatcgaacaacgaaatatttgatgtccaaattgagcagacggaacagaaaaacattgacaaaaattcatttgtcagctttgaattgcacgaaaatcctgctgctagtgggaatttccgtaatttctgtttaatttattttttctgaatattcccgcttattccatttgctaattcaaggcaaagtgatcctccgatctcagcttttagcttcaggtcactcatggcccggttaaagtaaaattcccggttccatgatgcttcaatgccatttgagtacggcaacaatccaagggaaagggacactttttgctcttttctggcacctcccacttttcatttctgtccccaatttcctctgtgcctttttcaattttccctcccccatttttttccaattttcctaatttctgctgaccttcgccgccgcttcatagcgtttcagttgtgccagtctttcaatttccgatctgatttgtcgcaatgcgtcgaatcgcaatgctggtgcttcggtaaagaaaatgcgaaacgaatgcgactgtctctccgcgcgcactttgctgtactgctccaccatctgtttgaaattggcaagcgccgccaaaaacttgtacttttgcggtgtgcgcaacacttccaacggtgccgtgccaaaactgttcacgggaa

SEQ ID NO: 11488 - DNA, 3106 bp, Heterodera glycines
  misc_feature (100)..(100): n is a, c, g, or t
acggaatggcgttccgagcagcgcggactgaagtggggccaagtccactggggccaacgacaatttgcgactcgcaccgctcggctcaatgccggcaccncaagccaaaaatggcacattcacttcgtcgtcagttccgtccccttaaactgcgtcaatggccaataatacgatgaaaaaattgggcgattgattaccatgtgagccccaatcggtcatcccatggtcagctgtgaacaaaaaagcagtgctgaagtttggaggttcaaatttgataagcttaaattaggaaaacttttaaaaaaatcggaccgattgtcgccgaaaaatccctcaaccatttgaacaatgccgcgaatgccctcgtcgaccgtggcaatgttttttaagtactgttccgagttcggcttgtgcccatgcccattggtgtcaaggccgagcaaatgaaggaaaaaaatggcacgacggaggcccaaaaggcgacttttggcattcgcatcggaacgaatttcatcaaaaaacaactagagaattaaaaaaccattataactaattcgggttcgctttttccaatttgtccaccaccttaaccctatcaaagacccatctgtccaatttggccgcgtcttcgtctgaaaaatcctccaattcgggcgaataagcgtcggatcgcacattggccacattttcggagaataagtgcacaatgtccggagaaccccaaagaaatgccattgaggattggttcagagtgctgtcgaatggcaccggattgtgcctgggggcaaaggattgcaaataaaattgaataggttttaatttatgaattaagccctttaagacccaaattaaactttctccattaatttttaacgaaatttgcatggattaaatcgccatgttataattaattttagctgttaatttttaaataaattaaatgttcccctttctatgcttaaagttcgctacttccatcctcgtgtgactgcgctaacgtcctcataaaacccagccatcatcgccacatggcccggcctggactcagttggcacatgactttccaaattgccccaggcagcctcaaaaattgatttttttttttattaattaattattttttacaacttttccatcacgaataagcccatgcaaaaaaggagaaagatgcgggtgttggtagaatgttcttgctcgaagtccatcttgagaaagtttggctttcatttttaatttgttttttttaaatttttattttcgctttaaatgtgtccaattctcaaagtttcatttgttttaaaattacctttaagtaacttttactggtaaatgtctcaaatttgtttgacctgccgagaaaaaaacgatgcgatcggcgggcgtaaaactctccgaatttttggcgattttaaaaggccgcgccccgcgcacaattggagaagaaaaataaatgtcaaagacggcgtagagcaaaagcaaatggacggagaagccgacgaaacaaagcaaaagccgaaaaatggcaaagggagcgatggaacgcataaaaaaggcaatggaaaagccaaaaaaggcaatggcacagccaatcggtgaaagatggctgggatgatgaataaatattttatcagaattttaaacaaaatttactcgatattttatttttattttatagagaattaaaaaatattggatgagaaaacaaaagaaatattttcatttgcgttgtgttttctaagcttttaaaacgaaattcaaaacaaacgaaaggaaacccaaaaataaattcaaaccaaataaacaaattcaaaattttattctattttattcattagcaatttatcatcatatttgtccaaatttccaaattcccccggggcgtctataggcaacgctggattataaaactgctaggatttcttaaaaattggctcaaaaccacaaaatttagtcttttttttgacaaaatctgttcccggcggcgccaagaaatgaaattaataatccctttaaaaaatgaattttttattataataataattaaaattggaacattttaagaacacgagcccggcttttctggacccggcagtacccggacccggtttttgctcaaatgcccagacccatgtaaccctattgaaatctctacgattaaactttttctcatttctattcaaacaaccaccattttttgttataaaacaaaagcttcttttttaattcaaaatttagaaaatcatattaaaataaacattcttggcattcttcttctctatctatgatatttctaaaaaagttatgacgaaaaattgcaaaaaaaaaaaaaaaattccctttaaaaaattcattttgattttaatgtttaattctttttcaaaaaatctttactgaataaaataaaatcatttaatgaatgtcgaatgtttgcctgatcacagttttgtctcttcttttcatatgcaaatgcgtgggtgattggtctagtggtatgattctcgcttcgggtgcgagaggtcctgggttcaattcccagatcaccccagtttatttttacactcagaagagaatttgttgaaaaagtttaaaattttatgatatccatctttaattggtattttcatttaattttttgctgtttatttaatcgaaaggaaaggattttatttcatttaattaacaaattgttggatttctttaaaatgattaaacaattaaaaagcacagaacagagaatgcatttcgaaaatcactcattatttagacactgaacttcgccctccgttatttttgccaaccattcgcagtagatataaacgcaggagaagaagcctaaaataggaaaaggcaattcaaaaataacacagtgagtaattaatgaatgctaatgggtaattaaaaattgattaaatcagttaattgattgttaattggctgccctcaccgttcgattcgcatacgaaattgcctcggctggtcactccgatctgttcccagcgctgaccgtcgtaacttttgaccaacaacggaccaccactgtcgccctgtgattcagaagggtaataacaggtaagcagcttttcactgttaaatgtatcttacaaag

SEQ ID NO: 11489 - DNA, 2905 bp, Heterodera glycines
tattttacgtgtcaaagggtgtgcatttaagccctccctgtgcttgcccactgcatttcaaatagctggtaattcttatttctccggcctaatccagaaaaaatcactatctctttttttggaatattttacgtgtcaaagggtgtgcatttaagcgactcgctgtgcttgcccactgcatttcaaatagctggtaatttttatttctccggcctaatccagaaaaaatcactatctctttttttggaatattttacgtgtcaaagggtgtgcatttaagcgactcgctgtgcttgcccactgcatttcaaatagctggtaatttttatttctccggcctaatccagaaaaaatcactatctctttttttttggaatattttacgtgtcaaagggtgtgcatttaagcgactctctgtgcttgcccactgcatttcaaatagctggtaatatttatttctccggcctaatccagaaaaaatcactatctctttttttggaaaattttatgcagcataggatgtgcctttgagctattcgctgtgcttgaatacatcatttcaaaaggctagtaatttttatttctctgacctaatccagaaaaaataactatctctttttttggaatatttggactcaacccaccagcatttgaatctctgagactcaattctcaggctttacaatcgctgggactcaaatctgcggcattccaaacatgggactcaaatctgcggcattccaaagacaatcagacagtgcactattttcccacctatcctcctcaacttttttcaaatcattttttaacgcaaatcattaacaaaacgccacacaaattcaaacaatgacaccgccggaccctaaaaatccttaattttctttaaaaatttgctcaaaatcgcaaatttttttttatttccaaacagaaatttcaaaatcttaaaaaattttccacaaatatctaagaaagaaatttttttctttttatggagaattacttactaggttttcctgtactaatgcactttaccaaaaaattattcaaaaaattctttaaaatttttttatttttttgaaattttattattgaagaggtcatttattgacgcctgaagtgaaatagaggcgaaatcttacatggacggtaaaaaacgaaaaaaattgccaaaaaataattggcgtaaaacaaaacgccaacacactcaaattgaaaaacaaattatattttcaaaaagctataattggataatttgttattaatgattaaataattcataaactaacagatagaatcaaaaaataacagatgaatcgatgcagaatttttttctctatcgctatgcaaaatttggtgcggatttaacatagagaaaaaaagctagacatagaaaagtaaatgtagttttttacattattaagaatgaagagatagtacataaaattgagataagtaaagataaaaattaattgtgacagaacgccaatttttttctgtaattatccataaaaagatttattgtcgcttttttttcttttttaccgtccatgcttacatctggcacgatttatggtcaattttgtgtgaaatacatgtgaaaatttaaatttttaccaaaccggaaaccgttccgggcccggcaatttgaaaatccggtttgaccggttttccggtttgaccggtttttgagaggccgggcccggaaaccggttgcttctgaaaatatcagaccggtccggtccggcatttttgagaattccggtctctaataggtacatacacacactcaactttattatatatgatggtgacccgtttaaaatgcatgttccgagtggaaaacgacgggaaggccatgagacgttcagcaaatggtgcgaacaaattaatccatccatctttccctccctcttttatacccccccccccccttattttctccgtaggttttgttgcattcggatgcgagcgcaaagggatgggtgatgatgaaaatggtggcaaagtgctttatctgctgctgaccactcggctgaacaaaggacatccacgcaaaattaaggtggcatccgtttgatccgaccttcgagttttcttgtatggctcagtggtttttggaagatagtaaagggtaaggggatggtggttcgagtccgccccacgacattaatattatttttgtgaaatttagttttaaagatttttgccaaccatgggtaacaatcttgttattacttgaaagcgcttgggaaggagtctaagcaaattttaagcaattcgatttttatctgtttttttagttgagccatttctaccgactgtttgacaaaatgaagcgcaatgggatggcaaccattcaatttgctgacccgaacttgacagtttacgtgtcgcaggtgtgcctaacaaaaaacaaaccaaacaatgagagtaacacaagttaaaatcacctgctcttatgcatttcaaccctataaaaaaatttttggctctaaggtcgtgaaagcgtgtttataggtgttttatgggtcgaaatttttgactttttgttcgaatttgggaccgtgattcgaagttggccaaaatgagtgtcagattcgtgatcagcgatcccgaaaacctatatagtcgtatgttttttgtttgaaagtgaaaaaaatgtaaaaaaaaatatgtggcttaaacagcataagagccaccactctttttatggcattttcttacttttaggcagaccctaaagcactttgccagtttttgctgcatttgaacggcttgttacgacatgccgttgatgccaacattagatgttccgccccgccatgttcatctcccaccaatgtgccgtcgtcgccgccgccaatcgcaacagtttcgactgtccatcgccaatgcacttcagcaa

SEQ ID NO: 11490 - DNA, 3712 bp, Heterodera glycines
tgcgagattaaagcaaagattgacttttaacaattaaacttttattttttgttttttacgcatacacattcaaaagtcttttttactactccattacttttatgcttttgttgtaaataactatgtacatatgtattcgaagattgtgcatttcattttgctatggaagtgattgaccctcgaaacactttattgtcaaatcaagaagtattggaacttctgaatcaagcaaagggacgtcatattccaacaaagggtcagcaaatgaatccagcccaattaaatctcattcattacctttttcgaaaatataattcccttccattttagattctcagaatcataacacaattgtgtatgaggcactaaagtatttgaatgaaacccccgcgactgcgcaacgccgacaggacataatttcgttgattaatgcgctgaaaaagttcaaattgaccggagcagaggtcgtcttgcaaataaatagcaacatttggcacctatcaggaatcctgcattatttaaatcatttagtaaaaattcctaaatcgaaaaatttgactttatgttcgagtccggggaccggaattgatcaacaaaagactgggttcataatcagcgacccaaaaaaacctagaacttttttaatgatataaaattttttgaaaattttattaaagtccgggtccaagattttcagccgggtatcgggtccagccgggtcctgaaaaaatccaaaaaaaatcaattcttttcaattttttttcatgaaaataaaagcttatacttttaaaaaagcatgaaaaatattaagttttacaaataaacgctttattaattgtctaatttttttattgctatttaaaccatttttttgcggtgcgcttttccaaaaaacttttcgggagcaggggctgtccggtggtgccgataggcgccgccgggaaaaattttgaaagtgcttcgagttgttagcagatttattggaaaaatgaccaaattttgtgattttggccaatatgtttacagaatttcttccaaaaatgttcaaattttcaagaaatatatagggttaaattttcaaaatttcttatggggaaattataaaaaaaactaagaaattttttgtaaaatactatgaaagcaacttttaagctttatttacttaatgataaaatggcagttttcaacaaaaattaaaaaaaaaatgcgagaaaaaacatgtgatatgagaaggaatgaacttgagcaaataacgaaacgaatccaacagaataaccattaggccacaggatcgcactccttaacaataaatattaaattttttccttcaactttggtcaacattttgaccctacccacattcttaccagtgtatttttggacccggacctaccggatcgggtactggattttcaaaaaatggggtctgggtcttagaaaagccgggtatccggatctggacccggtcgggtgcccggacccgtctaaccctaagatataccactcattttttcacatttatttcacttcacagataattcaaattgtaaatctacgaccaaaacaagcagtagaagtgcaactgatcgttgaagaatcggaggaaaggcttacggaggagcaagtcgatgaattagttgagacaatcatcaacagtttacctcggaattattaatggacttttaatattttaattcgaataaatcattaaatgtaaaatatgtagaaatcaactgattatttaccaaatgttttgtcttttatcgtttttcatttttgttgttatttatcttcgattatttcagacaaatgaacaaaagaactctttggcatatgcttctcaaaaacaaaatttgcaatgattgtgtgcgacgtattattttggatggcgcgagagttcaatcgacctccagtgtttcaaaaaggtgccaggggtctatgttagcagaaatgtgccaattttatgacttctaccccttaaaatgcatatttttcctgcgggcattttttaaaaaacaaatttgaaaatgcttttttatgcattgaacttattcctgtgtgtgccgaatgtcgcctattatttttagcttaattgtgcataaaccaacacgggaagaaattgcgcaaagagtgaccaaactgctgagagagttccacttggccaaggaatggcaaacaatcgaaggcattggcagggaactgagggaacagttgctgaattacccggccagtcgaatggtggtcattgaggtgttactcaataagaaacacccaaaattgccttagtttgaagcaaatttaggaccgaatcgtaatcaaaaatattaaaagatggtcaaaacgatgttcgaacgagcaaaccaaggcattgttgcaacagtgcttggcattgtgtggaacggtgccggaaacgaagaacccggatggcattgtcgcgttttgcgaaatgattaagccttcttcccccccccccccctacactttacaacgcctcctcgcccggtcaatgatgcctttgcttatccaccctctcccccttcccccacataaagcctttaaaagggattgttccctgctcctttttgcttattccctttctgttccctattcgtgcaatttccgctttttccattgcgtcccatcgcttttcaccgttgcatttcttcgccaatttaaagagtgatcgagaaatagtgatttgttgaatttttgtgtgaacaatttttgagtcctattcaagagtctggaagggttaaaatcgcattgggcaaatccccgccaatcgcgacaatataatagaaaaatttcctaaaatagaaataagaaaggaaatacacatgcaccgccactgctaaaagatcccagatcctggttttcgaatcccggttcccaggatctccatttgatcgtttcccttctccccgtttctcggtttgaccatgatcactgatcacccccaaggatttatcaacatttactcttaacgaagcattttagacggtttcattaccacgagacgatacaattgcaatgaacaagtgaacattgataggggagattaaatgtttttttagctggacacatcattgaacgaatggtgtttgaggagcagggcgtttcaaactaatcatcttgggatttgcaacaagcaaatgaggttgtggttcaacgttgtctgctcaccctaattgttgttctcaagtgttctttcccaaattttcagtgcctgaaaaaaagcaggagtaaatttttaaattttttgaaatacgacacgaaaattgtgcagaatttttcaaaaattttcccattttttcttggaatatttcagttcgggggaggctcccgccccttggctacggcctgttgtccctcaacgcttaactaatgctaacccttggacattttagataaaacaaaaaatgaaaaacgaaatttttatgatggtaggccgagcgtgaatgctgagcgccgctacatctgaacgtcgcctccaacttcttggtgagtttttgcaggaaaaccctgagttttgcctcctcgggttcgttggggttgttttttgaatgattgtctttacaaatttacattaataagtattaaatagaggtcgaattcggggaaatttgcggtccgaaactgccaaaaaatatctcataaataaaatttttcacaattttgtgtgcatagacgcaaatttatagggcaaaaatgt

SEQ ID NO: 11491 - DNA, 1385 bp, Heterodera glycines
tatcatgcttttttatcttaaaaaatttttgcaaatcaaaagggtccccccttttgtttcaaaatatgtcacttttcatatagcgccagtgtttttatgtaataaagaaaaattcaactcgtactggtactttttccaacttgtacttcgatttgagataaatttctgtttttgcacaatacgaattgggaaaactatttcgaattgggtagcaatcagtacgagttgggtttagtccgctaaaaaagcacccaaaaaataggctcaaaaactctgttagaatttcccatgctatgagagaccatattttacacttaaacaaaattaaaatggcaaagaaagaagcaataacaacaagtcgcatatattatacatatgtacattatcataacattacatagtgggacaaatacaattatcagagcaatacaaataatgatgattattagggacgtgaattttaggttttaactattttttttgctcaattgatttgaagaaaggagctcaaaaacgcatttccgcataaaaatttttcgattctgatgtcattatcggtcactagaaatcactattttggcgacttcgtcactaaaatagttaaaaatcactattttggcgttttgtcactattttttcactattttgacatttttgggcaaaattccttaacaaaaattcaataaaaccaaaaaatacacccctaagaatcgagctaaaatttttcaaaaaaatacacccctaagaatcgagctaaaatttttcaaaatatactcctatgaaatcaaaaaaaaattttctcaaaaagttactttcttggcaaaaatttttaatttaaaaaatttttttaggtaactattttgggttttttggtcttaaaaatcccagtccaactcatttgcaactgcaaatagtgaataaaaattagttttgctcaatttttggctgaaaattatgtcactattcgtcactatttcggcatttttactcactattttagttaactatttcgggatttttcttcactaaaattcacgtccctaatgattatcaatcctttttatcatttattgtccatcagttttcacttcgcatttaaaaatccaatccgtgtccaagacaaatgtgccgccggcagccaccaaatgccaaaatgctcacggcacacgtccaatagaccctccacctccaacacggttgtgggaagacatttgacgaaggaatcgcttctcccgcgcaatatttgacatcacacaggaacaaatgatgcaaatcggaacacagcagatgacacaaacacaaaccaaaatgatggcaatagtgacacccacagtaagcttcctgaaattgatgaatggagaaaattactgtatatgagtgtattt

SEQ ID NO: 11492 - DNA, 3821 bp, Heterodera glycines
  misc_feature (28)..(28): n is a, c, g, or t
ggcgtactatctaatatttttattattnaggaaaaacaacatttacttcgctatgtttagcttcttttctatatgttagatccacaggaaattttgctgcatcgattaatgctgaatttatttttgttaatgctctatttcaaaagttataagaaaaacaaaattttaaagcctcataacttttctctggtacaccaaatcgcttagcattgcttagaaaaagcttctcattatcaagagctttcgaaagataccaagattatccaatttggttggcaaaaaccttcaaaaataattcccaaatatggtgattttttaatattttggacaaaaataaatgaaaatattcatgttacacaacggactcgaaccaccaccctttgtccctttactatcttacaaaaaccactgagccacacatgcaaatcttttctggtacaggagctcatttcccgggcccgtgccaaaagaatgaggtaggggttaacctaccctcagctgcgggtaccccccccccccccgacactaattcgggggattggggactcagagcgttttaaaaatttaaaagttaattcatccacgaaggggggaaatattgaaaatttttgagattttgaacaaatttaaataaaattcattaaaaattacgaaaaactttcacggtggcgcctatgggcatcgcagaccccccaaaaccatcgtgtcgatcggtaatttttcaaaatatgaacaccaagaccgaaaaataagattttagggtcaaaaataataatatttagtaacattttttcaaatcagtaaaattttacaatttatttgatcaaaatgctatcaaattttatatttttagtctcccattataaactaaggacaaaacgaggttaaaacgaagattttggccccaaaaataagattaaaaacggctttttacattgtaaaaacagggctgctaactgaaaattttcaaaaccagcatttagccaacaagaatcatcatttggggtcaaaatcagcacttaaatgaaaaaaaacatgcttttttgtgacgcgctttttcctaaaaaattttttggacacaggggccggcggggagaattttttgaaaatttgagttcattttgctcacagattttcaccaaaaatgaccaatttttgcgcgattttgagaaaatttttaagaacaattttgcggactggaggtgccgataggtgccgccgggaaaaaaaaaatgaaaattgggagtttttggtagcattttttacataaaaaaattttaaaactataaatatatttaagaaatctgaacaattttcgtcgctaccccaaaatcagaacattcttataaataacgcactcttgttggcgctaacgaaatcagatgattaaagtgaaaaaaggaagatttacgagcatttaaaaataaaaatagagtttttcgttaaaaaatttcgttgatcactacccgatcggggtccccgaccccccgacaattgactcccccccccccccgcccgaccccgacatgtcgccccccgaggggtcggagaggaaccctaaatgaaatgtaaagaaacaaaacagcgcaaaacgaacagagaagagtcgtcgtaatcaccacgaattggctcaattggactgaaaatgaggggaaaacattaagtggaatttatcatcagcaaatttgagaattagggggatcgtattcaaacaccgacaaatgttcggaaacatgcacaaaaatgggaaaaagtagggtattgggaatatgttacccacaaaaattggaattccgagtttaattttcgttttttttaataggagggcctttaaatttattttttttaggatattcaaaaaattgctgtttatcaaaatcacagcacctgctgctgttgttgttgttttgttgctgatgacaaaagccatccttgagaagcaaagcgacaatgagaagaagaaaaagcaacagagaattattcttgttggaagccatggcaaaaaaaaagaggacgaaaattggaattatgtcgaatttgaaaaaaaatgattaaaaaaatgaatgcgaaaagttgagaaaacaaatcaattaaataggtaatgaatggtcgggtcggggtcactttggcgcgggccattttggcgccgcgaactttaaagtgttataacttttttcttatccaaccaaataaaataattttgataccattaaataggcctaagtgttctttattagcctgcaaaatattagaaaaaataaattttgttacaaaagataatagcgtgcggcgccaaaaaatgccccagaaaaaggtcattttttgaggttttttggccataacttttttgtgtttcaattaaattttttgaaattttgcaggctattagggactatcaagcgctttaaaatgatatcaagcttatttaatttgaatgagaaataaaaatgttatagcgtttggcgccaaagtggccggttccctgaatggtcagtagcagggttgttccgggtcgagaaaaatatcgggtcgggtttcgggtcgggtcggccgaaaaatcatcgggtcgggtttcgggtcgagaaaaaggccgggtttcgggtcaattgacaaatttttatttgtttaaaaatcaaatggcactgcaatatttgcagcgaattgcgccatttataggacgatggaaataaaaccaaatggaatcaggtttttcagccatctgctttgcttaaattcaagaaattcatacaaaatatctttagaaaaaggataataattagagttgagcggtaatcggtaattgtaaaaaaaccggtaccggtactgaccggtaatgcaaaaaccggtaccaactttttccaccggtaccggtaccggtaccaactttttccaccggtaccggtaccaactttttcaaccggtaccggtaccggtaccaactttttccaccggtaccggtaccggtaccgctaaaaaccggtaattttccaacgtaaaaatttttggacaaaatttttcaaatacaaaatttttattcagttttcgcgcgagtgcctgttttttagcattagaattgttcagaagtatatgtatattgaggatgaccaagttttttttcaaattcaggataaagaacactaaaattcagatgtagacctcaaaattcagattattgcaaaacaagggatcagcggccaattttccaattttgcgaaggggtctccggccatgtaaattaatgtaaatcaatgaccttttttgctttcaacaccgcttttttcgcggcacgtttttctcaagacttttggggaacaaggagggccggcggtgccgataggcgtcgccgggaaaaattttgtattttttaatgcgatttgttaacagaatttgtaaaaaaagaccaattgattaatttttgggtttttaggatgcttaaaatgaaagaaaaaaagttggaatatttttttaaattaaaatttcaattaaaataatggtaaagaaaatatgaagaatattctatcccagtggggaattgaacccaagcgagaaataataaaatcagaaggtttagccacttgaccacttatgcatacgaacaaatgctttaaatgaaaataaataatttaattttttttctcaaaaaatttctccttcttcaccattccctactcttttctcacccagaccccctttcttaccagtgcttatttcgacccgaaacccgacccaaaatcatcgggtcgggtttcgggtcgagaaaaaggccgggtttcgggtatcgggtttcgggtaacccggaacaaccctggtcagtagtagaa

SEQ ID NO: 11493 - DNA, 4146 bp, Heterodera glycines
ggtctatagtagtgagaacattaagaatttcttcgtcctcttcgggttcgaagacagttcgccttaccacggtgcaattcccttgtagtgatgtcctgttatcattggtgtctgaccattcaagtgtatccactttatcaaccaattgatctaacctagtcgtaattgtgtccatgtttgcattcatatcagctgttgtttggttaatggcatcagtattttgagtcgccctcctattaattacccttaaactgcggttggtggcatcctcaagacgtattacaccttggtgaaccttatcaataagtgagattggggcattagaatttggaggagcgcttatattttggaataaatttctttcaacaattgcaatagttacttggtcttccattctatccagaggatagttcacaaatgacataatttcagtgtattagacttctactatttggcttagattaattagatgaatgagttaaatgagcactcaaaaaaaaaaaaaaaaccaaaaacttttcttatagtcttacgactaatcagtgggaatgagatagatttgcgcagtggtgagtaatacgggaaaggaagcgtgcaatttaggctgcgcggatacttatgtatgaaagttttttggctgtgtgcagtagaagtagtagctgggaaattgttttgcgattagaaagagcttggaaatgaaaatgatttgtggctggagagacggaatgctttatgcgggttgtaataaatttttttacgccccattttcccatcgcgataatatcggccgcggcttagaaatcatcaacattaagtgactgtaatgagcaaagttcatatggaaatgctgctataataatacagtaactttggatacttaattcggaattgaaaatgagtatgtgaataaacgatatttgaagtgaattgaaaaaaaattagagatcgaatttcagcgaaaaatcgaagggggagaaaaaaaaaaattatgaatttgacttactgcaagggcaatgccattggcatgtgggacacactccgaatgcggggcatgcgttcatgttcgattcggccatttcggcgatgttcagtgcctaaataataattatttcaaattggtcaaacataaaaccgtcgccaaatgcacacgaaaaaaatgtgtataattaacgaaaacttgagaagaatggttttttcttaaccacttgttaatttgtaacatgcatggtacatagcgttagacactttaattgttgaccctatttctgagaatttttgtgtgaataagtcgaagaatcagtaatatcagcccaaaaattaaaataaaccttatgtaccagcattgtttaccacataataaccattcactgaacaagtgatgtacataccaaatgtgccggatgcgttgagtgtctgtgctgagttcaaaactgaaatttactgaaaatttacagaaacgcaagcaaccaaaaccgcgaaaaacaccgtaaaatacgtgagaaaaaaaaacaactcaaattctgtcaaatacgatttcttgttcgaaatgagtgaccattaattaaacatgtaaggaaaactcatgttccaactgccttttttgtattagagataaatgagtaattaggacgatgaatatgatgtaaaaatggcaatttgtatggcatgttaaggcatttggcatttttcaattatttattttttatgcctttttcgacttttttttttttttttttttgatttttttttcgatttctcacttattgagggcaacgaaccacattaggtcatcccgttggctgatttggggaaatatcgcatatttgttatgggttaggtggcaagggggcctccgggatttccattgcgattcacgctacccccaaaaagtttcgatttcgaatgtttttttttttttacttcttttttttcgttttcatttttttttttaatgccataataacaattatatatatatatatagtgtatagaaaatagataaagataaaaaatgaattgataaaaagccacttggaacatttttaatttattaaatttgggttattttggtccccacaaaaaacataaatattttcggttgtctttttttttttttttttttttttttttaacaaacattcgcgtcaaaagaagattgtttttttttatttttttttttttaaatttacttaactaattattttaatgactaattagatttatgaataattaattgattgtctacctcaaatccaatgccaaatgctgattgcttagattccaattaattaaagacggtaattggcactttaaaataaaagagaaaaaaaaaattagctaaataaatatttttcaaaaattttctattcctctgacgagggcacttggattaaaactaaaataacattttgttttgttcatcctctgacgaggggaatgactatcgctgcacattgtaagtgaagcgacgccaaatcgtcgtccatcttttgggtttttgtgcttcattttgcttttggcgaatgaataggggcacaccagagaacaaatttgttattttgcttagggcaaagatcaattaggcccctctccgcacggcgcatatttacgatttgaatgtttatgttaatggtgaaaccaatcccattttgtttttctctctcttaccgtaggtaagttcattgacgctctacagtaatccatttttaaactgatcagcactgggatattaggcttttcactttagctcttttggcgtttcacttttgagactttggcctattaactttcatttctgggacatttttcttgccaaattttgagtgatcacttttgtccattcatttctatagcgctttatttttatagacgtctcttctcactctcttttgtaaaagtattcttttttttatatttatagacatctcttctcttttttagaggtactcgttatttctttctttttttttatttatagacggccgtcttttctgattccctaacgggaatttctcaaaattaaaaaaaaaataaaaaattttaccacggttggtttcttacccatcctcgccatcggcgtcatttccgaaccaatgaggttcggaaccatccggtgctaccagtgaaacgggcgggccctcccaggatcattggcgaccaaatattatccagaattactttattctcccatctcaaacttgggtaattaaaccacacgtattggtgaataaaacgaaatgtgaaaatgaagtgaatgatggatataacgcggatggcgaaggatggaaatgaaatggataagaaaatgactgattgaacggagataaagagatgggaaagtgaaggaaaatgcgggaaggaatttgtcccggaaaaggccaaaaatccaattaagaaatcccttttacaatccctttttcaggattctcggatcagaacaagattttagtaaaacaaaggctcgggattcccgggaaaattcaattatcccggcttatgacccccggtcaaaaaaaatatttgtatgattattttaatcattcaatcatttgcaaattttgctcgaattttaaaaaagtattacaattttttttacgagaaaatttaatttttcaatttatattatattttatttgcacaaatttttaggaatttattaattgcaatgatcttttatataatatgtttggttttaattaaaatattcattttcattttgccataatttttaagaatattttattacaataaccaaataatttgggtagaggtataaaataagttgaaaacataaaaaatgtgcatataaatagggttttcttttagttttgaattgcaagtcttaaataattaattcagtgaaaaaaattcactttcaaatattttccagccttaccgaattattttttttgaaattttctgaattttccatgtttcaagttcattaaggaaggtgatctaatcaaattggtgaaatcgattttttatgattagtgtcaaaacgttacgttaaattaaattttttcacatttttctctgagcttaagcctgattagttttgttcaattaaaaatccacacaaagcatcaacaaataaatgacccttaattaaaaggcacctaatcaatcgtcaataacccttaattt

SEQ ID NO: 11494 - DNA, 2201 bp, Heterodera glycines
cttttccgctaaattattaattttcataatttcagttagtgtgcagcaatgtttggatggatattttccccttttttgaccgtcttcaactctgcctcaaattggcactgctctcgccccattttgatgtactggtggacaaacattttgatggcaaaggcggagtgcagcgcaagtttcaatttttctcaaattaaccggtcaaatgttttaaggcctaaaatattgaattcggaaattcaaaattgaaaaatggaacatttttcattgaaattgaagaaaatatttattttaagaaattgtaatttcaaactaaaaattatgacttttttaaaaatagaaaaatcattaacattgatgcgtgatataatttccatcccgcaattttttgtataatttaaaaaattctctcaggaaattactgtttggccggttaaaatctttaaaattcatcgattcgaacatgattagattcaataagaaaaaattttcagatgccatatatacaaaattatggcaaagtgtacaataagcaaatagttttactaacccaaatctgaggttggttaagaaataagtttgtacactttggcacgcataagctcctaaatagaaattaagaaatctttacgcttgacttaaacataaatatgtacttaaaattattttttttatattaccaaagtcaattgtaaagatttctgtccttatgcccactttaagactcacatttttatttgtttcaaatctcatcggtctgctttgcgaccatgatgagatttgtgcacgtgccggtctgctatgcgaccatggcaacatatcggtcagcttagcgaccatgatatgtcgtgcacacgccggtctgcttcgcgaccacggcgaggctggtctgctttgcgaccatagccattagtgtcggtctgctttgcgaccatgacacagtgccggtctgcttagcgaccatggcatccatatcggtctgctttgcgaccaagatattggattcacgaccagactttttggttcagttatttttccccatcgttaccggccaacatcctgggcgaagctggtcccgcactttgccaagaccagtggactggtgagaggtgacgttaggataaacaacggacccattttccaactaactggaacctgctcctccgggagatgtatgttcaggccaataaatggaacctgctccttcgggagatgtgtgttcaggcaaacaaattggaacctgctccttcgggaggtgtgtgttcaggcaaacaaattggaacctgctccttcgggaggtgtgtgttcaggccaaaaattggaacctgctcctccgggagatgtggtttttgacatgtttctatctgcactcaatgccttttgtgcaattagggatacgtgagcgtcctgcctgatagatttctgcagcgacttcattgtggcgcaggacgacgatgatcattattttacacattcgtacattttttgtttataaatgtttatattgtgtgcaataattggtcaatattcctcaaatacctttgccacactcgtattatcccattgattttgtttttcagatgccttctaagcaagaaatgctgaagatgagaaagaaagaagagcacctgaggcggacggagaaatctgttagtccaggtcgctcacctatcccaaattgccctcctaagggcaatccaaactgtctgattttggagaaaccattgagtgcagatgagaatggggtggcatcacacccgggcactaccacgcccaatattggtgctttacaattaagcaccccggcctcttcgattggaaataaaaggcggcaatttacatcggcctctcaaaatattgagacatcgccgcgcagcaaaagggggaaggtcgacgatgctgaccgaccaaactctgctattgaggctattcgttgtacgcctgtttccacccgtagagggcggccagctaagaaaagaggtggcccaggcaggggcagaacaaatgattcgttgagcgaagaatcgtcaatggatcaaagctctgaagctggcataaatgtagcggttttgcccaatgtgcctgaaaaaataaacttcagcacagtgtcaattaattttgctacatcgcgaaattttgcctgtaaaatttggaaatgggcagcaattgggctttacgaacgtgatggcgaaacaccgatt

SEQ ID NO: 11495 - DNA, 2385 bp, Heterodera glycines
  misc_feature (10)..(11): n is a, c, g, or t
  misc_feature (23)..(23): n is a, c, g, or t
tgaaattgtnngatgatcaagancatgaatgctggtggggcgtctgttcacagaaattggcgagactgatcagaaatctcaaaaagtcatcatcctcaactaaaaactttgcgcctgcccgatgatgaagagatgacagaaaatatagggcgcaatgagtgcagtcaaatgtctccatcattttggtgaaattttaaattatttatgttaattatgcatttttcaatcataaaaggatcactttaattttttaattaaaaattgcttttcaaattcattaattttttgacaattgtatcttctttggcctaattatgcacttttctacctaaaaatgccttcttcgtttgtttaattattttaaaatttcatcttccattcataaattatgcatcaatttttattgaaaaacgagttaaatacaatttatggtgtattgatgagaaagacagatacatcagaaaacaaaaacattacaaagtgtggccaaaattcttcacattgaaatcgctgcctataattcccttcccaacatatggtcggtaacatttctgtaggggcatggatacgaccctccctccctcccgaatgttcggtcggaggaagttaggataagtgacaatgattggctcataatcacccgttgttgcgtaccgcaccacttcttctttgaacgtctcgtaacgcatgccttggttgttgatcacgtcgtagttcagcgtcaatccacgcaccttgagcacgtattccttttcggcatccgccccagctccctttcgtcgcaaacacagaccatactaaaatgtgaaataatcaatacaaattaatgtataaacattaaacttacttgttttgcacccccactgcaaaactccacaatgtcgtggtccgggtactcgtcagtgaactggcccaggtgtggaccagttttgagcggacatcgctcctccgggtggacgaggatgagactgtctgtatctaaaaaatatttgcaatttattttgtgtaattttgttagggcatatgtaccggtgtagagtagctcggaccccggcgacctaaccacattctgcatggctttgagcagaacaagtcgcgcagcggaagtggtccacagagagatgactaaagttataaaattagcacaattttataagtttattctcaccgatgtttgagcaagcgtgctcatcgacccattcctttttgtggaggtaggtgatgaggatgtgcatctcgtccagctgatcaatcgatgtgacttcgatcgatttgttgtccaagtattcggctagcgttaccgggtcgtccgttataagtgtctgggacagaccgaaatttcgaagcgaaaaacgtccccctgaaaattacattttttgtcaaaattcatatgtcaaaactcacataaattgttcaggcagagctttgccagggaccgtttccccttgttgaccaccatttttgccgggtcaatgttgatgccaaactgctcagcacactcttggacaaattgttcttccttctcagcgtcccctcttatgctgctgtcaaaaccgcttgcctggatcttctgggccatgaactcagcaatgtaggggcggaatagtttgtcgtcgctctgttcgtactccagcacgcggaacaccctcgtgacgcggtaaccctcgtcgagcgctgcgttgagctcaatcgatgtacaggtgctgacccacccgcgttgttgatcagtgtgctgacagtggtagtcgttgtccacgcctccagttggatattctttggcacaggcgatgcacagcggaaagcacagtcggtcgtccactttgaccggtaacactgcaacatcgatttggcggggtggcacaaccaagactttgagcagcgccagcgggaaaggattgtccgctgcgcttgtccactgcacttgttggttcagcacgtgcactttcgggtgtccaacaggatagcgagtggtgaagcttaagatttaaaatttatttgtcaaatggagaaaaagaactgactttatgtaagggtataacgacgtgaagtcgtaataggagatcttctctccgggccccgccttgcgcagcaatttcagtggcccggtccgtcctcccgtaaatgcctccctgatcaccagtggcccgtcatccacgtagttcgcgaaggatttcctcatggctttgctccgctctagcatggacgtgattttgcactcccagtacacgtccacacgattcactcgggcccggatgtattccatccgctttgcgtcgcgctcccgtacctgccccgctgtctttccgtggggcaacaacatgttatcgattggataacatttctaaaaggcgtgccaagaacagccttaaaatattaattttttat

SEQ ID NO: 11496 - DNA, 2632 bp, Heterodera glycines
gagtacccgtcgcagcatttcggggttaaaaccaatccggaacagctctcggaagacaagcaccatatcgaagcgaccgccaaaatgcgagtaggcataggtgtcgaatttattgggcagttcgaacacgagccaattcacaaatggctccagtgggttctcagctatcacttgcttgtccacgtatgtgcccaagaatcggcgttgacagaacacaacggtccgatgtggtccacagatttgacatcctgcagtttccctcttccatttgccgttttcaatgcagtcggggcatgcaacccgggcagcaatgaagtttggctgatgttccctcttatcaggttgttgggggtccatcgcctggtgttgcatagtctccaagtcaaaggccacaatccggtaggggtcgttttctttcggttcaatttgctggatgaagcagcccctctcgggattgtggtaggtgttgcataattggcaatacgtctcgtagcatttgtgaccctaatacaatcgcactttttaatatatttttcccattattacttttcttccatttcgattgttgtcgcgaacattccaaataactccacactctttgcactgcttcgattcgacacaaaagtttgatgtcaaatggtgttgatgacagtcgttgttgcgaaatgccttgttgcaccccgcacattcacggaaaaacccatccaacggagagcaggggaagcgaggtccaacacgagaacaaagcatgcagcgtgctttgcaagaatttagatgtgttgatggtcgttgatatggcttctcacattcaaggcagtagtgttgaccaaacaagccatattccttctgcacaccatcaaaatggccgttgtttaggtagagtgagattggtgtgtcgtaatagttgttgatgtatttgtacagcggcttgtactgacccgtggagccaaaaataaacacagcaaaacgatgtcgttgctggctgttgttccaatggtccaccacccggggcacaacaatttcagcatcatacgcattgagtccaggccgtgcgccaatttgttgcatcagttgcaaagcatccctttgaagacaaccctgttggccgtgttggctgtgaaggtagcgatggaacttccaacttgcccagccacggcttttggccaccattgttgcttgtaaggcataaaataaacagtagctgcgctcatcaggattgtttatcttaaaacaacccatcaaaactgttgctttatcatggaccgaaccttaatcaaactccgatcattaatacgatggtgaacaggtgctagagctcgtcgtgcgcctcccttcaacgttcttttggtcggcagtccaggtcgattaactgtcgtcacaactacggtaaaaggttcaccccacagtgtgacgttctgttgcttcttgctctgtgccactttgacgaattgatttaagatggtgttgaccgtgttgtccgtgatttgccggatagggatggggatgtccccgccagtcaacagtggactactgatgaggcagccgaggtgtgtcggatgaattccccgctcacggctgtctgccacagccgcatcaatgctgtactggaaaatgccagcaataagtccttcaggatttgctgctgctggtacgtcctcaatgctgaaccgcgacttggctttgctgtactgaaagcgcggcacgtgctcgatagtgctgtccagctttctaacgtagtcttttgcagtttttgatgtagatgaggaggtcccagcaccttcttggaccatttctcccaataattcgttgatgagaaagcggcgccgcggctttttattaggcattgatagaagataatcaatagaaaaattagagggccgtttgggaggttgattttgcattattcaaaatctaattaaaggaaagaaatgagtgtgaatgataaatgaatggtcaatcgagccaatttatagcgatcatattgggcatgggaaatgtgaaatcgattccattaaaagttgtaattgcaaaaccaaccatgacctgatgagcagcgcactgccacccatgaagcacaagacgacagggcacctaaacggctcgtaaaattagacaggtttattgtattacctcaaggcctaaaagacattaaaaattgctgccaggataaacggggctctgtaaatcgagcaaccgccctggttaacagcaaaactaataaaatgtttaaatttaataaaaaatgtggactaagaaatggaaataattgtgtcctggcgcgcttataaagcctcccagaaatcgacaagctcctcccatcaatcgataattttcgatgccatcccgaaaggcggctttttcaaattttcctttgaagtaattccctcgggaattgagagtgcaatgagcacttatgaataattaacgacacctaagcaacagaagaattatacatttattgatttaacatttttcgtaataaaacaatcgcgtacatgtccggacttgcacaattattaagaatacttagaaattgtgtaaatgaatcccccagggacatatggtaaataaaaacaatacaatgggcggcacaagtagagagtaaaggggactggtaagggtgagtattcct

SEQ ID NO: 11497 - DNA, 4112 bp, Heterodera glycines
ggggtctgttgatgggcaagtgcccatggggctggggggctgatggggcggggggtctggtgatgggcaagtgcccatggggctgggggatgatcggagaaatctcttataatctgggcttggacaagaaacgaattaaatcggtactataaaaaatttgtgaccatttatttctaatttaaagtcagatccaaatacgaaccttttttaatgtggacaaaaaattcgttcaactcgtaggcattaataatatggactataaaaaagttccctttaaattatcctaaatttatcaacaaaaaaatgtgtgaaaataaattattttccaaaaaataatttttccttttccctccattcttcccatttgaaagagtaatgatcggtaacatcattcttgtccttttcttctttctctttctttcgtgttgctgcgcttctctcgtcgcactttcttccttcgtcctccattctttgctcccatcgctctctgtctctttctcgttcctctttttgttgctcccaaacatgttgccgcctcagcatgtcactgtgccagccgccccgctcttgccgtctttcttccgcttccctcctccgttcttcacgcctgagacgcgattcttcctgccatctcctctcgcgttcatcccactccaccatttcttcttcggtcagggcaaaaacgacttggtcgtcgttttgagcagggttttgcgccataataaaattgaaagaattttactaaaaaataaaattaaaaaagctattgggtagaagtaaaaattttatatcggtaatgaaaattttgagtttcttaaatagtcacttttttacattgtaattctgacgcaatcctaatttagtccaaattcagcaaattaaattagtaaatgaccttcaaacttgcaaaactttttggtcttttgtgcagtaaggctcaaatattacactagaaatcatgcgattctattagtaacgaaaatgtttcgtttttttttgcaagaaaaagttgcgattttattagatatgccgaaataatgaataaaaaatttctctttttctttccgtacgatatgggctaaaaaaaaatttatttttcgggtttaaataaatgcttaatagcagttaatcgtattttattgtataacattttcatgtcaaatcgataatttggcacttgtttttggaatttatttatcttcgataaattggtatctgacatattctctgcttcttgacatttaaatatatttcgttctttgataccaatttctaatttttgcatagctaaggactgttttctatattcatacataataagccctggtaatttttgaattttttcaagcatttctaagaatgaaaaatataaattttcgatttcaggggcactaaatgccgctatgtagaaatttttcacccgtttaaaaagtttatttgcaaaaatttcgagattaattgatcgtttaagtatttttccagaaattttccaatttctcgtaattttgttttttataaaattaatttcttggtctattgtcgacatctgggattatagttacttctagtgttatgacatcatccaaaggatagaaaagcgaatataattcttcttttaataggacatgttggaacaaagcctcagctgtgttttcgctagggcatctaagagggcaataaaatgattcaaaaccaaaagaaatcttcagaatgcttttgaattttccttgttcatttttataaattttttcgattattgatgcgaggatatttttaaaattttcctccgcattaattaggaaaggatttttaaaataaaatttggttttatattttgtaaagccaaattttaagtcctcatgacataatgactcaattacagaacacccttccattttgagtgtggcccttttagttttttggttcttatatacccatatgctcccaaacaattgtttggagcctattttcataatttaacatttggctctgcaccctccgggactcgaaatgtaatcttcgggcttccattaatgaattttgcgattgttcctcgagctttgttgcctggtcaaaagttttgcatctctcgaaatcacgccacgtagattcggctttttctgactccaaattgattttgtccaggattgtgaagatttcccaaattgaatcggacattttaagatataattctcgaataccattagcgtaaggagccttttctctagattttattgcacgattaagtgtttcgcgagaagatttggcaaaatcgcttacttcatccgttagcgcagctacatcccgccatgctctttctgtctcttttttgcagcttccaataatatggaattagctttttctgatttttcagaattcatttttatttaattggtattttttttcttgatcctatttatagtttacaaacaataaattcatctctaaattcagtttggagtctcggatttttcttagcatcatcaactaattcttgttgtcacccaaaaaacattttgcccccgcagaaaaattatgatattttatgtcctcttcgatttcaatcaatatagtgtcaggatgatgattgtgtcggcgcgtcattgtaaaaaacccttccttttcaaaaccccagccctggcacccatgtgaattaagttcacatttccaccaaagtttgaacttggtcgttttatgtttgtaatagcgataaccatcacaaaatttccctttggcactttttattgatactagttgagacattctctaatatgccccattaaatgcacacctctatatatttttaggtgaaatttcacctattttcacctgttttcacctgtttccttttcacctattttcacctgtttcctttttcacctgtttttggtttatgtcccacaacctttgattctcatgcagtttcattttctcgaatttttatttttttcttaaattttataagcaataaattcatccctaaattcttcctgaggtctttgcctttcaaaccgtatttggttttcgcgcattgtttcttttagtttatttgccaagtctccaatgcctaaatcgggctgcgagtaagcggtccgataaatttgcccaatttcttgccgataatttttggctatttcgattgattgtttggcctcttctgctaattcttgacacatagttaaatcttttctgtctagacatttttccataccttttttaatatttttcatatttttttcttctttttttattttgtcaaatagggcatgaatttttaaaactccatctaataatttgctatgccaaaaattcacaccaggtttatccgggtttttatttttaatattttgggcttcaaccatggtattatgtgcagaaaaagaaaattcttttgcttcgttatctaacctaattatgtctctaaatacgccttctacagttcttcgggcactggtaaattgctctttttcttcttttgaaaggcaacaactttccgttccgaccaacaagaaccaaactagaaataattttaagtaaaacatttttatttgaaaaaattaacaagtttatttatagatttaaaggctgacaatatcaatcaaagagtaatagatccccttcttccctccgaattctttcaccctcgccccgactttcatagtgcacacggcgcccgccaaacttttgacctcatcctaaatttaaatgtatatggatttttaaaaaagcgttgcgttatcatcccattctgtttcccacgcacaccgaaaaatcccacattttccaaaagccctgtatcatctgccacagacaccttcaaataagatgtcatctttttctcagccccgcaagaacaagcccctttacggcataaagtgcatgcctaacaaactgaaattttctttcatttttattacaaaccctgtactccgcctccatcacattctcaattctcgctctcacaacaaaaactcttccgccttcaataatctcgaaatttttaatttcagcgattgtttgcattttctggagattctaccaaaaataataaattaaaattgattaaatataagggtcaaaaccttcactttaaaaataacatgaacgtttaa

SEQ ID NO: 11498 - DNA, 2077 bp, Heterodera glycines
  misc_feature (100)..(100): n is a, c, g, or t
ttgtccatgatcaattttagcaccttttgttagaaatatgtaagcatttggtaaaattttaagcatgaaaaaccgaagttgatttttttgcggagctttntccaaaaagcttttggggaacaaggtgggccggcggtgtcgataggctccgccggtaaaatttttgtgatttttaatacgaatttgttaagagatttgtccacaaatatggccaaattttacgattttgagcaaatttttaagaaaataaaggatttatagagtccggcggtgccgataggcgccgccgagggaaaaattaagaattttgactatatttttagctaattctcattaaaaaattcttaattttgtggattttcggaaaataattggttatttctggtttttatgaaaatttaacaaaaaatcacaaaaaaacctcaaagcctcattttgaaaatttagcctcattgacctatcaaaaaaccacaaaatgaggctaaaacctcacatctgggagccctgcttatacgggttttttgaaaaatgcccaataagtgcataaaatatgccctaaaaacccgaaaaatgcccaaatacgcactaaaatatgcattaaaaactgccaaaaatggcttttaaccatcaaaaaaatgccaaaaattgtgtaaaaattcagaattgactttaaaaactccaaaacaatgactaaggagcttttttagacaattgaaaaaaattttgaatttcaaactttacatatgcaattttgaatttttttgaatttttattttatgctcaaacaaaattacttttttttttatcttttgtatcaaaaatttttaaaaaagttcttgcaaaaagttcaaaatttttcaatttccaagcgtgtattttttttaattcccaaaaagtcgatccttagggggtgtatttttcgtttttattgcatttttcttatgaaaatttgccaaaaatgaccgaaatatgctctaaaagcccaaaaatggcaaaatatgcatttattctcgaaaacccccaaaatatgcttttatatgcactaaaaaccttcaccaaatcaaaaaattttaacgtagaaatgctatttttgagcccctttcttcatagcatatgcgcagaaaaaatgcaaaagcatataatttagccatagttataaataaaagttgatccgatgtcaattcgacaactgacaactgagtcactaaaagacgcttcagtaccggggcaatcaaacgcataatagcatgctttggtccaagctaaaaacacacttactatccaatcgatttgtctcgtcgagagctgtcgattgataccaattttgttcaaagaattttcatttatttttttggtttattggtttaaatccggtttgttgacggcagatcgatttttagacttagatcattgagagctttcgaatgttatttgtccgggtttgattatttttaaaacaacccgtataagtgaggatatccaaaacttttatcgttaataacttgaaggaaaaaaaaagattgcctgaggcaaaaaatgaaagataattgagcagggtgtgaataatcaaagaaaaagaaatgtgcaaagagacggtggcactgctgctgaaaccggctcattgaagtgtcgagcatcatcatcactttgttggctgtcatagcttaatgacttgtttcggaatcaattcccgataaaaagattcccagttagttccaccaaattgccttctcagctacgattgcctctatttaagctaaatttgtctttagctttttttatatttaagccatggtttttgcatcaattaataagttgttttttttaattttatttgttaattgttttttataaacttttaccattgacaaaacaatgcctttcaaacaaatgcactgcttgctctcgttcgccattttgttggcacttttgtcattaatcgatgccattggctttccaatgcaacaacaatgctgttgtccgcaacagcagtcgagggtggtggtggcggtggcggcggcggatgctgcggatgggaaggcggagggtgcggtggcggtggaggtggaggcccaat

SEQ ID NO: 11499 - DNA, 1714 bp, Heterodera glycines
  misc_feature (80)..(80): n is a, c, g, or t
  misc_feature (1663)..(1663): n is a, c, g, or t
gactaatgacaagcactttagcaaaaacaaattctaattcaatatatttaagatctttttatgaagctttataatatttntaatttgcaaaaaacaaatataaaaattaaattaataaaaaaatatttttttcgattttttggcaatttttgggaaaaggtaacactcagataaaacttgctaaatatttttcaactaattttttctacgcattaccaagtcagagagccaaatatttgcgttcctttgtgagaaatgtccaaaatcctgcgttctttggccattttgttggcatttttatctttgactgatgccattggcttcccaatgcaacaatgttgttgtcccatgcagcaacagtcatgctgtgggggtggaggaggcggttgctgtggccggaagaagcgcgaggcagcggcattagaagcggttcagccccacttcaaatcggacgaaacgccgtgcccacagacagagtggagacaagtcattgacgaggttggcaaactgatcacttatccaatcattcgcatatccctaattgcttgctaattttgtagagcatccgcaccgacgatgccattggctcggtcaatgccattcaaactgctttgtaccgccgctatgccaatcagaagttcctgatcacctgttcggcagctgatgaggacaaaactggcaccaacaaagtgcacttcagctcatccggcgacggttactgtaacttggtcaaagaacgcatttggtgccaggcggtcgcgctgagcgtgtgaaaaacgcatgctatgcataaacaattaattctttttgatctttgattaattaagttaaataattttccattagctaattcattttaatcttttgattcatttgaaaattaacaaaaattaatttatgatattacatatattaggtagcttttaatttttcgaattaaattcatcgtcaatggccatacactgtataaaagcattgcttctcctgaccaatgaatgacaacactttagcaaaagcaaagcaaatcctaattgacttcttcttcagttttcgctgaaaagttttagtgtgaaaattaaaagcgtgctaaaactgtcaatgggcatttcagaggaaatttttcgcatccgaattaatcaaaactaattagaagattttttaagcagcacaagaataaaaatatgtagttgagtttatttcttaatatcatgaacctaagaaattcgtctattgatcagtgggcattaaaataaaagtaatttttttttattggacaaaaggttactgaaatttttttaaatttcttatatttctaaaattttaaaatttgttatacttattgtagaccaacttatacatgtctgttggtaaacaaattgctttgtttattcatccgtccgtctatcccatgccgatcgcttaattatttatcagcctcaacgtgttgtgtggtatcagccgatcacaatttattcatgattattcctcccctgcttatgtctacttatttttcttttgaagccccctttggtatgcaattttattaccgccaggggcaaaaaaggtttcacaattgatggattagggcaatgagatcggaaagataaaacaatgggatgaataaatgatcgggcggatggaccactgacgggttggtcgctgnaggggggagggacggatcggtctgcccgaaaaatgagccaaagtgcttctg

SEQ ID NO: 11500 - DNA, 2046 bp, Heterodera glycines
  misc_feature (7)..(7): n is a, c, g, or t
caattcncaatataaaaccattcaattcttccacaattaacactaaacatttcttacctcccccctttgggagattatctctttcttccctttatcccttcgcccaattaatcaacacaattcttctcgcattagcatgcacacatcaaagaatgtattcccttcgcatttacgcgtaattatttccctttttaattttcatatgtctaattttgaataccacactaaatcaccacttttcgcccaattaatcaaactcatggccatttcggctctattctatcaacactttattgcttgattaatcatccaatttagaaaaaacaatgtcttcctccctcataatgaactgcttaattgcccttaccattctggctgtgtttgtgtccaccatcgatgccattggcatgccaatgcaatgttgcggtcagcagcaacagtcatgctgtgggggcggcggtggcggctgtggtcgtagaaagcgcgacacggaagcggttcagccccacttcaaatcggacgaaacgccgtgcccacagacagagtggaaacaaatcattgaagaggttggcaaactatcactgatccaatcactgctgtcttatccctaattgcttattttgtagagtatccgcgtcgacgatgccattggctcggtcagtgccattcaaaccgcgctgttccgtcgccacgccgaccaaaagttcctggtcacctgctcggcagctgatgaggccaaaaccggcacggctggcaccaacaaagtgcacttcagctcttccggcgacggttactgtaacttggtcaaagaacgcatttggtgccaggcggtcgcgctgagcgcgtgaaaaggaataatccgatgaattttaaatagttaaaaatggtaattgtcgatcccattatatcataatattgtgcaatagctgcattagagtttagcgtttattatttaaatttgcataaataataaatcattttgctcattgttcctcttcttcctgctttgatcattcgatggaaaatgccaaattctttctcaatcttcgcctcggtgccttttgatttcctgtgcctttctcacataattccgtgaagtttgtcggtccaatccgaatgtctcctgcacccaattgaccacactttccgtgctaatctttggcaaatggctgctcaaatgattcaacagcacattcagcagtttttggctctaaattcttaatttttataataaaataaaacgagttcataataaagtgatatttatcacaggctttaaaagggtttttttaaataatacatttttgtggaatatctatcaattttaggaaaaactaatttaactaaattcaaaatagactcctgctggaagactattcggttctgagatgtccaattaaatccggcataatgaaaattccgagttggtcggtttagggcgttttaaatttaaagctggaaactgcaaatggcatctgagaatatgatgcttatcacaatgattagttctatatccgacttaccagtcccggctcttccttctccccactctcgacatccgctgctcccccctcggcagtgccgtctttctcttccccgtccgttgtcactcgtccgtgctgagttggccggcctgacttactcggcgggggacggccctgggccgaggtcgacgggcacagaaaaatgagcaaaagtgccgagaacagaaacaaaaatagtggaacaaatttggacattttcgcttgttttatctgactaaatttagattcagactcaattagtgattcaaatttttttgatacgaattagagcaattattttgtaaatcatttgattgaatgaaaataaaataaaatattaccggtttaaattattgaggcgaataaaaactttgaatgaaaatgggatgcaatgacaatgagtaatgactaaaatgaactaacacacacggaatcatcattaacatttacttagaccaattatttgttagcacatttataaccgctgtttcttattactacaaaacggaaaaacgaaatgtga

SEQ ID NO: 11501 - DNA, 280 bp, Heterodera glycines
tataataacgctgcggacatctacatttttgaattgaaaaaaaattggtaattactctttctttttctccatattgaccatcatactcatactccccccacccttttcttcttccgccacccacctcccccgctacgcgccgctcctctcctccctctcttgatagtttaaactgaaggcgggaaacgacaatctgatccccatcaagctagcttctgcaggtcctgctcgagcggccgcccggggatcgatccccgatctagtaacatagatgacaccg

SEQ ID NO: 11502 - DNA, 1381 bp, Heterodera glycines
agggcaaaacggacagggagcaccagcaaaggacgggcacataaatggccacgaaaaagtgggcaattaaaaaagcaaaaaattaattttgtacgatggacaacatacatatgtcgcataaaatttatttaattttggttaatattaatctgggtcaccaaactcaattttgctcaaaaacgatcggaatcgatttagaagtgcagaaaacgatgagaaaaaatgccaattatgggctcgttgccatttttcatgaaaaaatcaggtactgaagtaaccactttcaataggactcagttattcatcattaaaaatgaaggaaaaatcataaaatcaagagtgtggagtcggcttcctgcacaatttaaaaaaatgtatttttaaattttttgtataatttttccatttagaaattggaaaaaatacttcttatctatttacaatacattttgacactttaagactttttcatgcgttatttaacgtcggacaattcagtcccctttgaaaatagacacttcagtacccgattatatgaaaatattagcgcgtcttaatttgtattttctcatcgtttgggccgttctaaaccgattcagaccggtttggagcggttttgagtttggggacccatttgtcagattaatattttccttaatttttttttctaagtaaaatttagaataatttgttttcattattatccaaatggaataaatttgttgagcagccaacagcaattgacgaagaagagaaggcgcattttgatgagacgaattggcaactgcactttgacgcactgattgatttgatattgaaaagcaaatcatttagagaaaaactcacagaaggtaaaaattaaattgccaaaattaaaaaatattaattttttattatcaaaaaggctttgataatgatgaaaatacaaaacagcgctttttggaatttgtcctgccaaattatcagaaagcggtgctgaaactgctcaattctggtgattttgctgaatttgagaatgaaattgcattgaaaatggagcaggaaaatggagaaataattgaaaaaatggacaaagaaaaagcaaaagccgatcagaaaatgaaagaactgatcggggaagaaaaaaggacaaaaaagaaaaacaaaagagcaatgaaaaggaaacaaaggcaaagatcagcagctgatcagaaagagggagagagtgagcagaaggaggagaaaggaaaagaaagaaatagggaagagagtgaaaggatcagtgaagagagtgagcaggaggaggagaaaggaaaagaaagaaatagggaagagagcgagcagaaggaggagaaaggacaagaaagaaatagggaagagagcgagcagaaggaggagaaag

SEQ ID NO: 11503 - DNA, 3089 bp, Heterodera glycines
ggaagagagcgagcgaaagaggagataggaaagaaagaaatagggaagagagcgagcagaaggaggagaaaggaaaagaaagaaatagggaagagagcgagcagaaggaggagaaaggaaaagaaagaaatagggaagagagcgagcagaaggaggagaaaggaaaagaaaggacagaagaagagagtcaatggaataccaaagagagtgagcagaaggaggagaaaggaaaagaaagaaatagggaagagagcgagcagaaggaggagaaaggaaaagaaaggacagaagaagagagtcaatggaataccaaagagagtgagcagaaggaggagaaaggaaaagaaagaaagggagaggaaagtggacaggattttgctagagaggaaaacgacgtggaaatagtgaatgaccaaaatggtggtgagagaaagcaagcaaagaaaaattgtgaaaacaattcaatggagttaagagaaaaacaagagagaaaaattagaaaagaaaagaaaacgcaaaaaagagagagtgcgcaaaaagagttgaaaagaaaaaaagacaacgatggaaaaagtgagagaatcagtgaagaaaaaattgaagaaaaaggcagaaaaaacaacaatgagagaaaggagagcagagaaaaaaatgaaggagagagtacgcaaaatgagaggaaaagaaataaggaaaaaagaaaacagaaattgaaagcattggaggaaaataaggaaataaacataaatagttggaataaaacagcaacagattcagtgacaacagaagaaagtcaaaaacagggacaagaaaatggggaagagacaatggaaaagggaggaaaagcatcggcagagaaagaaagggaaaaatgccatcgaatgttgggagcggaattggcaaaagtcaatttgggaagtaagtaattacaattaaaattatgaaaatttgtttaatttatccattcttaaagcacgagatatttacattaaagccctgtaaattttcggactttaatttttatttcttagggtttgaaaagcaatgattttcagactttttgccattttgccatttctgtcctttttgtgccgtttgggtcttaaaattgcatgatataaaacaaaaattatttgttggtttgcaggtttcattttgaatagctttttgcactcaaattaccaagaatttctggcaaatccaaacgaatcgaagcgatgctttttggacattggagtttatgtgaatgaaatttggcacagaatggaaatcattggaatattgagcaattttactggggtaaaatggatggaaagtgcgggaattgtggtgaattgggaaaaaacgatgaaattgaggcataaatggcgggaaatggaaagagaatttgcaaatattagcacaaaatctgatgaaaaagcagtggatttggatgagcttgagagtaatttgcacaaaatgctgaaaagtgtcattttaacaacggagggaattttaattgacgacggacaaatggaagaaaaaagtgagcaaaatgagcgaaaaaaggtcaaaatgcaattgcacctgaacaaattcgccaaaacgatcatttggcaaaggcgatttgagaatgattttgcggaaaagaattgggaaaatttggatgaaactgagcaaaataacattttaaaaatgctaacattcaatcggaatgacaaaaagttggcacatcgtttcaacgaacacttggaaaattggaggaaactgacggagcaacggcaaattggtaaaaatggcaaaattaaaaattttaaaataaaaaatattttaaatttagataggaagttgtttgaccaattttacaaacacacaacccacagttttggcctcggttctgtccatcttggcgtaaattttgctgaaaacactcagcaaatatattttggcagtgcaaataatgacagaatgcatttatccattgtaaaattttaattattttaaaaatgtgccgaaatttgtcgtcgaattatttttataaattcaaatttaagataaatgaacttcttacggaaaacggatacactgattgtccatcggttgagttggcattagacaaagtcaaagaaattgtctcgaaatgggtcggtaattaacagaggccagatttttaggcaaacaattctttaaataggcatctcaaataacgtgaaaaaagaaatatggcaaaagggcacaaaatttaaaaaaggtgtcaaacttggcaaaaaaagcggacaagggaaataattgagtaaaaaatattttaaaaatcaaaaatcttgactgaaaaattaattttcaatatatgacttttaatttaagtttttattggaatatttttttaaaaattgggtcgattctttggtgttttaagttttttgttatatattttttaaggaaatacagaaaaagccacgaaatcaaaaaaaaaagttacagacattacaaataaaaaaaggcacaaaaaggttcacattcgaagctctaatctaaataaattaaaatttatttttatttattgccaccattttcaattcccccccccccccctaaagtcgaacaatgaggcgcgactgctcctgaccggttcgtatgcattgggcacccacgcgcggggctcggacatcgatgcgatttgcattgtgccacaaaagttgggcaaaaaggagcaaagggaacatttccacggcaccgctttttgtgatttggacaacaaagtggcacaacggcaatgtgaagacaactcattgtattgccacttctgtaaggtatgccccgactttgttttttggaaggaggaaataaggactgctggacgcattacggattccgtaattacggctttttagacacccaattacggattacgggttagggattttttgggttttctataattttgatccgtaactaaaacttttttccgaaacaattcttaaaagattaggggcaaaacaatttttcaactttttttccttttattttaatttatcaaaaactttcaacaatttcttaatcaattatcattaaaatttggaatttttctacaaggactcaaaacaatattg

SEQ ID NO: 11504 - DNA, 1098 bp, Heterodera glycines
tgatggcacagttggccaaccaaacgattccccaggaggcgatgctccaggcattgtccggtgagtcatcgtccaacagtgatcaaagggtgattgatcagtggtggaaacatttcataaaattattttttaatccctcactccctttcctatgctatttttccggccttgtcgcgactttcagttttttaaaaccgagactgaggctataacaaccgggaattcccgacatggtcccgtttccgagccaatcggtcgtttattatactgatatggagcttttgtgaatggattatttggtagaaaaaaaatttttcaatttgttttttaggttatttagcaaacgacgcaattaatcgaatgatcgaacatcggaactttgcgaaattcaaaaatttattatggatcattaaattttgggcaaaaagtaattttaattactaacaaaatacaattcaataataaatttcaggcaatttcatttacggaaataaatttggctttttcaatggaatttctctggcaattttatgcacaaaaatattcttgttttatcctaatgcttctgttatatttttatttgagaaatttcttttgattattttaacatggtaagcgataaaataaaattttgatttaaaaaaactttttttgttttttgaggaattggccaatgccaataaaaattgatgaaaataaaaagggcgaatttgaacttttcaattggaggccgtcgcgcattgaatttgaaaatggcgaaatgcaaatgccaataattactccgattggacttggtcaaaacacaagcaaaaatatgaacaactcgacaaagaaaataattgaaaaacaattgagacaaagtctgattttaataaaataaatttaaaaatttttaaataaaacaaatttagccctttctcaactgagaacactaaaaaatatgaagacaagtgacaaaaatgaatggaacagattatttcctactcaaaagtttattgaaaaggtcggccatcaatcaatattcggggttggtccccgaccttcggggagagaaaagtgcggggaccggggaggaggaaattccccgaaattatttgt

SEQ ID NO: 11505 - DNA, 5149 bp, Heterodera glycines
atgttaatgatataattaaatgaaaaaaacaaaaacaaagaatgtacgtgaattaatagaaatttggaaaattaccaaaatccacaaacatactgtaattgggttattgtatgctggttcccataccaatttatgcttaatatttcaaatctttattctaccgtatctcgtttttcaagaattctgacttactgaaacgcattttccattgacccattttccggagtcacaatgatccctcctcccctcaaatttttgggattttctctgcatatttatgccaacccaaaatcattacaattacaattttgaaattaattaattaattgcattcaataacttattatttcgttggaaaaaaataatattattttctttttgttgctttgtgctgctgttcgttcgtggaaatatcgctaatttcgtcacggtgttcgcccaacccattcattagtgcataaatgggtggggtgcggagcaaggcagaactctcttctgcgcgtcatttgacagccactaattaatttattttccaatttttcttcgaagaatgaaaaaaggttcaaaacacacgcccgcagcaaagccaaatggaggggacgaagtggtgaaaggaggggtcttctctcctcatgtgatcatttgcgaacattttcatttgggagtcggttgcacatcttttttttgcccactgttttgagtggaagagtaggaaatcacgttttcatttatatacatacaaaaatatatccctttaatttaaaaaataaataaaaaataataattttttctggcttttccccgctgcttttaagccatttgaagtatttcaacaatatattcaatataaaaataatacataataataattttatggcttttcttcgctgcttttaaaccatttttcaagtttctatttcaattccaatacacatataccaggggtgggcagcggacagaaaaatcccgcggtcgcggattcaatttgccgaggttgtgaatcgcggatcgcagttgcgtcccacccctgatatatactacaagcttggtgttatcaatccttttttaattgcacataaaatttttctgataaagcaaggctacgctctcaagtttttttttcaagaaaagcaggcatcaaggtttcaaattgaagcttttgacgaaaagtcgctctcaactttttatccaagataagcgggcacagaaggccttcaaattgaagcttttgactaaaatttaaatttcataacaattttttcagtggcacacccttttttaaacacatttgggagctctgtgataaagtgataagtaaaagcagggattttgatggcggaaatttttgcaattacaaattttattcaattttgaaatgcgcaaaaacagagattttaattaatttttgtgcattggaccccttaactttatcgcttacaaattagccattcaaatattagtagaggcattcaactaatattgaattatgaaattttgggttcaattaaacacatataaaataatgtcctaacccccccccacccttttttatcgaaaattcgcaacatttgcaatttgtggcctccccattttttgcattgtttcatatgtaatggctccccatgttacaacactttttttgctgataaatttactgcaaaactcttcccgaagaaatttttgcaattcattgatatcaattaatgtttaatcgttggccagaaatttgttgcgtgatttttctttgtttaattaacgttaaatacgaaagaattttttttttataatttggtgagaaatacttacttaaactgattttgaaaaaaattaattatttattattaaatttataaaattttatttttattttttttaatttttaaattgatagttcggtttttttgaaggggtcagtcaccccatcccaaaaatcagggaatccccaccattcacttatggaagtaattcattaaaacagtccatgtaaaaatattgataacgaaaatgtgaacttttgcctttaccttctccagcaaagaaatgtttatttaaatttagaaaatttattctcttacaacatttaaatccgcagaaaatgctctcattgatagtcatcgtttgcttctttgggattgtgccgaatttgtcaaaaccgatcaaactcagaaaccattctccaatggatgttttggtaaacaaaatgtaaaataaaaattatttaattaccaggataatattgttttcattcatcccctgagtctcatcatttaggcttctcataatccgggcgcacttaataatccgcaattccacatttttgggaattgcaaaattttgttggattaatctcttgaatcccgtcctagcaaaaattttgaatcccaattacgcagcgcacaattaaaatttttttaatttatcaatccgtctgccaggatttcttgatattcatatatatttgccattctgttgtagtttatggcctggcccgaggcgcgttatccactggaattgccttttcaccgcgtggattgctttagtgagatggagaggcgacacatcgtgccacaagtcatcacttaccggctggaaaatatcaaaaaactccgtaacggggttggttgaacattatgcataaaactgatcaagcactgattagtctggatagggcctattttcctggtcattattgcgataccaaaaagagtgataatggaaatgggagtatttccaaagggggcggccgtagctcagtcggttagagcatttcaggaaatggaaaggccctcgttcgagtcccaccgggcgaattagcttttatgtctgctgacctggatggattgactaacataggccatataaaaatacatatcatcgatcagtccgacaaaccgcgcattttttatggagcactagcatatacacattaaaacattaagatatgtttggtacgaatccctacccggagccgagtgactgtcacacagatgaacacaaacaatgttaaagtaagaatttgaagcagtacaccgacccaaaatcaaaaccccagactaattatgtaactttctctccaaccttgggatagaagaatttttttgctatgttttgctgtgaattttcagcataattttaaccctgattttttttttgtaaaactattgaattaagcaatgacaatttactaaattaaatttttcccaagagttatgtgaaattcatcgctggttccacgcagctaagcatgccactgcatactaatcatattcattccggtagtttatttatttattttttgaaaaaaatttttttgcattatttttcaaaagttttaaaaacaaaaactagcaatgcgatagacatcgccaagaaaatgaaaatttgcccgatttatcaaccacattttatcccgtacaagcacaatttttggaagattagttggacaaatggtccaaaaagtgacccgaatcaccaccaaaaaaaacccttcactttttctacaggccaacacgaaaaatttgggccatggcatatgccgtgccgttacgcctacattgtgttccgctcccgaagtgatcagcttgaatgggtggagttccggcttgagcccgaactgaaagtggactcggccgatgatcagcgcaatgactgcgcatcggaggaacacaattttgccgaatcgctgttgaagcattgaactgactactgattggagtgtgacatttgaatgtgtgggttgatcgacaacctcaatcattctcattcattcatataaatcacacacacacaatcagctcaaaaaagaatctcatttttttttacaaaaaataggaaaccaaattttgatcaacaatcattttttatcagcgaaattatgtatttgttttgaaaaattcgttcaaatattatattttaaatattcaattatacatattatttctttgaatatttgttagtgattttatggcatagcaaaatttaccacttttatttgaatgtgataaaagcatcacataatatcatcattataaataaaatatgaaaaaaatgtgtgcctttttgtacatatcacttttctttttcatttaaatatagttttttttaaatttataaatgcccgggattatgtattatattaactagctttcataaacctaataataatctaaaaaataatggcattcattttttttcaaatttaaacttatgcagttgacactaaaaagtagagttgtatgggaccgggaattttgggcaaaaccgggaaaaaacttgtacgtgtttttcagtaccagatccctggtcccgtacaactctactaaaaaagttaaaatttttaattctttttccgatttctctctctctctctctctttctctctgtttcacacgaaatcaacactatttctctctatttcaaccaatgctttttctttgtgcttccttaccagacagagagaggagaacagagaaacaacgattgttgtatgaaaaggaaaagcataggcgaaggtgagaggcttcaatgaatggaatgatcaacgaatttatccgattgatcgatatggatcggggaaaattgtttgactaatgatggaatttcaggcagtgtggtgaactaagccgaaagaattatttgtgtctcctgggccaacccttccccaaagcatttagcttcatctgagcctggccaactctttgcacattgactttgccttgccttccgaaccttcttccttccactgcttggccattgctagaaacaaaaggctttatttaatacatcgcatagaaacacaaacatatggccattgggccaaacaaatttttattcctttccatcgcttcccaaccattgccaaaacgaagcgataggccttaaaattgaaggccaaaatttttgtacaaattctgggttcatataaattcggatgatttcaaaaaaaaaaagttctgcatctgtgccataaaataaccttaccgtatatgctctaattatagcccatgggggattatttttcaacttcctcagaaaagggggataattagagactgggggattatgatagagggattatttttcaaaacacctcgtagactgggggataattggagactgcgggattaatagagactgggctataattaga

SEQ ID NO: 11506 - DNA, 1696 bp, Heterodera glycines
tttaattttttttttgttttataaatatccccaaatgtcgggtccctaaatgtcgggtcggcaaatgtcggtggtttccctaagtgccttatgctcaaatgtcgttcgatccccaaatgtcgggatccccaaatgtcgggtccccaaaagtcgggtccccaaatgtcgggtccctaaatgtcgggatccccaaatgtcgggatccccaaatgtcgggatccccaaatgtcgggttccccaaatgtcgggttccccaaatgtcgggtccctaaatgtcgggtcgccaaatgtcggtggtttccctaagtgccttttgctcaaatgtcgttcggtccccaaatgtcgggatccccaaatgtcgggtccccaaatgtcgggattcccaaaagtcgggtctccaaatgtcggaatccccaaaagtcgggtccccaagttgcaaatccccaaaagtcgggtagccattttagctatggtgtcatcaagtacttgattttttcaaaaattaataggcggtaaaccggttaactttactggtcccataaaaagggcaaaaaaaggtcgatttttacaattctgaaaagtactcgggggttatcaagggcgctgattacgaatctggtatcccttttcattaatttcgaaccccgaacccgaactcgaacaaaagtcgaaaattcaaattcttcgaattttactgttatattcgaacatgcatagaatggctcatttttgctgttgcaatggcctgtggttgatttttttttgctagttttaatcaattttagaataaaagttcgaaattcaaaaatttgaatttttgacttaatgttcgaatttgggtccggggttcgaaattgaccaaaatggatgtcaaatttatatcagcgacctcgaaaaccacaagaaagacgttttacatgactttaaaaaaaagttattattttaaaaatcatagacataaaatcatagactagttgatgccgacaaatctgataagaatatgggtataatgccaaaatatggatataatccggcagaggacggttcggtgccagcccaagttttggactacaacatttttcattgttgaccaaatctaataatcttggtatcattcgaaagctttatatgtttagaagctttttctaccctattgcttagcgataagacaattaccaaaaaagtataacatgaaataacaaaaaaaaccaaaattttgaaagttttttcttaataacttttttccaagctaaaatttcgtcctgttccgatagaaatccatcatagaagctataaaccaagctaaaaacatgtttttcgttcgttttagcttcccacagtccatgaaaaaaaattatatggatttccatataatttgaagtcctaatgattatgtatttgtttgcttttatttccttttttaaggcttgttaataatattgttgtcgggggtgggggagctcgtcccacaaaaaagctcagtgtgggcgttccacaaaaaactcagcgattgattggtcattttccggaagcctatcgcaccactttcggtgcaccaaaagtgcctgatccggaacccggaccggcccggttaagaacaagtttttgttcagtttttcaagggctatctccaaggccgggtccggttcttgatccattcacttggagcccgtcatgggtcggggacatctgccgg

SEQ ID NO: 11507 - DNA, 790 bp, Heterodera glycines
ctatggtacgccccactgagcagagaaaagcctagtactatctcgtcgtttttctttttctttgtaatttctctcactttggcgtactatctcttcattttaattatgtaaaaacaacatttacttctctccatttaacttatacaatttgcaccaaattttgcaactatagagaaaaaaattctgcatttttctatactgattttatttttgtttatacttccattcaaaaattataaataataataaaaacgcatttcttttttctctccttttggcgtactattttcatgtctctaacacatgaaaaaacaccaaatttgaaaattctaataattttggttataaggatacaaaatcactttgaacattttagaatcaatagaaaaaagaataaatttagcattttggttagaaagagctgcctaggacttgagttataacatgataaaagtttgaaattcccacaacttttttcatatgagttaaattgcttagcatttgcttagaaaaagattctccttttcaaaaactttttagataccatttgttcagttttattgggtatgaagctagttatggctgatcaaaataaacagtgcaaaaaaggcatttaccttgtaaattttgaattagcgcgcaaaaaattacgctaattacgctatttggcgttatgagtaattttgtctgacactggcgcgtacccatagtgctgttgtttatgtttatctgagtattgtcaagctcaactgaaacccagtaaattattgttgaagggaattaaatcatt

SEQ ID NO: 11508 - DNA, 2492 bp, Heterodera glycines
gtaaacaatttttgccaaatatttcctcaaatacatttggacatttaaatttctaattgtaagggaaataaaaatggtaaaatggatacagatcctgtgtccgtctcgggcctgttttcaatttccgtcatttcactgattgaccgattttggcttttaacagtgtctattttttcaaaatccactaaattggaactttgacattatttgatatccccaaatgtcttctattgataatttgcggatttatgcatatggagagggcggaacgggtaaaatgggttccttcaaaatgggacaaatatgctatccagaaaaaaacggaacgtaccccttcaacacgagcagggaaatgccgaggaggcgacagttcgcatggcgtggcgaaagacgtggcggcggcgaaacgtacggcggacggagggagcagcagaggaagggaagcggaagagcggtggaggaaggcaatgctaacagaaaagacgaaacagcggaaaagcggagggacagcagaaacgaggcgtcgcaaaaagagagggcggaggaagcggcggaagacggccaagcggaggaaggcacgggaggaggaggagacgaagcggcgacggcacggaaaaggacgacggcaccgaggacaaactgcgacacaaagacgacgaagagcggaccaaatgaggacggggcggagacgggcactgaccaacagcagcaacaacagtccagggactactggtaggggcacacggagaccagagacacggggtaatccttcggaattggtgtcccgacggaaaaaaagagtaaaaatttttcttgcacttttttctagggtaaaaagaactgtcacgaacccgaacccatgattttgcaaaatcattttctttagtcgttctaaaatcgtaaaaaattaaattagacttctctatacatttaatagctcattctaaaactttttatgattttacatcagtctgaaattgcttttttaccgccaataaacctttacaaaattaaaagtttttttttttgaaaatcaacaaatgatgcttatacctagataaaataaatgattttgcaaaatccaaatttgggttcgtgcttagcgcatgttttactctcgaatgaataagtgtaaagaaaaattagctctttttccgtcgggacaccaaattccgacagggtttacggacggctcggcattttaggggcacggcacggcattatgggttatatttctgttttcaagcatttaatacacattgtaatgagaacatgtttcgtaattttgacaatcccctctcttattccttctgttactaaaaaaggacgcggaaaagaatctctttccagaaagaaaaaaaaaatgcaaaattcggtgattcataaaattcactgattcatttcttccattatagaagaaatgaatgccttcatcattcattctctgaaaaagaatccctgttttttatttgcctaattctaatttttgctttgttttatgtgtttaccaggcccgtcgtaaccacttaattttcttcataaatttgaatcactattttcacaatatttttttccaacaaatggcaaaaatttcccatatttttttttctacggcgccgaaaatttaggtcaattattattgtacaacattttttggtcggaagagcaaaaaaagctctttgattgtcccacccgaaaatgttttctgtttttcactgttttaatgcttttttgcagttttcattccttccaatttaaaaaggatctctcatcgcaattcgtttcctattcgctaccctgcccataccaatgggttttctctctctctaattttctctatttcctattgttttttccatttctttttttctctcttccccgtgctctttcgtcgcctcccttttccgtcgtttctctcttttccgagtgcctctgcctttccacaattctttctttctttctttctgcactgttgtgtaatattaatatatgtaataacctcattagagtcctcccgccctcttttagggtctgatctgatgctgatcaaaattcactttttgttcgttaattttgcattctttttcctcggttggggtggcggatgattttgattttgctgctgatcagagggggttttgtcgtgtgtctgtattgatatggtatgatttttgatttgctgttttcacctccatctcttcagcacccgagcggtgctcccccaatataaataatacatcaaaattttcaatttttttccactcttctctcttttccctctcataaactcgtcatcgtgctctctctcacaattccatttctttttttctcattccaacgttagtcatttctcccaacattaccactctctgcccatccgtcgctctttttcttttcctcctttcttttgcttttctgtttcttttcccattccccttaacattgacactcttcgtcctctctcttccgtcttctcctctttttcgcgtgtg

SEQ ID NO: 11509 - DNA, 1347 bp, Heterodera glycines
  misc_feature (69)..(69): n is a, c, g, or t
aaatttaaccaatttgttaggtagtctgcaaaactccccccacgccagtaaatttcaaaagattttggncaaaagggaaccctttttttttactataatatttgaaattttgcaggctaatagagaaaacataggcctgtcgaatgatatcaaagttcaaattccgaggaaaaaaatctcggactcaaaaaaagcagacaatttgcattatacaggtccagacaggcccatattcggggatggggatgggggtgaataaaaattaataaattttcaagaaaaatgggaaattttctaagaattttaaggcaaagttattaaagttcatcaggtgcctcagctgaaaatttttttttctggataccggcctgggtccaattaggtattaaaaaatgttaaaaccaaaacgcgtgaaatatttggattttcataaaagaaaaaattttaggccttcgcttgccgatgtttggaccacatcaattttaacaatgagctcacaatgaaacagttcttgaaagttaacaaccaatttttgtgcgaaattttggacaatcttccgcaaaagcacagcggcgaaattgccatttggaattcggtaaaattgaaaaaggcaacaaattaaaattaattaatcaattttattaattaggcactccgttgggcggatgagcaatgtgcccaaaatggcaaagaatgcacgggcgaaaatcgacgccaaatgctcggcccggcactttacaaaattcgttttccgctcatgtcacgggacgaattttcgaaaagcattggtactcaaagggtcggaagtatgccgtaaattcggggctcagacccccaaaaagtcaaaatttttcatggcaagactaaccccccccccccgaaaaaatagtctcttttttggcgaaaagtggctacaaattcttgttttttgctcttacaattagacagtaacatttttttccatgaaaattttataaaattccattttcagtcccttccgacgtgttgaccaaggacgagctgctcagcgtgttcctgtcccatccacctgaccatgcgctgcccgaaatgtacccgttgcgttttcccactgatcaccgaaaggacctagcgtcgtcgcctactgattgtacaaaatttttgattttttttttacaattttcggtttgtacccctccactttttgggagaatttttttgttttataaaagccatcatgtttccaggggttttgaggttgctgatcacgaacgaataggacatccatttctcccaattcgaaactcctgacccggattttgattttccacggattttttaaaacaaaaatttctcccacaaatgggg

SEQ ID NO: 11510 - DNA, 3590 bp, Heterodera glycines
  misc_feature (21)..(21): n is a, c, g, or t
  misc_feature (57)..(57): n is a, c, g, or t
  misc_feature (61)..(62): n is a, c, g, or t
  misc_feature (67)..(67): n is a, c, g, or t
agtcgggttagagattagaantggtcaaaatagaggtgagatcgtgatcaggaccanaccnnccggnaaagagttttcacaaattattacctcaaaaattttacaaaccaaaaggctccccccccctttggtttatacactttgcaactatcgccaggaattttgaaaaagtcgtatctggctcccaaaattaaattgtccaattagtggcaaaaatttttgttgtcgttaattaataaagttgactaaatcatttgaaagtgctccgtgtcaactatataataacaggagcaggtaaaatttcaagttaccatagtaataattcacatgcatttattactggcggcggtacataaaacggtggtagagaaaaaacaacaaaaaatgggtcatttttgtatctaattaattaatgtatagtaattaaaaccggagagaaccattcatttagtaattaaccaattaaaagggagcaaagcgcgcaaacactgcttgtaattgcgtgttctgcagctgctttactgctgctgatcatttgtcctcagcagaaaagcagttcattagtgagtgttcgtaaagcgatgaaaaagcgggcggagaacggacgaaaatgaattaaaaaatgaatggaaaaagcggggaaaattaggtaggggaggggaggcgagatgggataaaatcttaaagggattacgatgaaaaaaggaaaagcggatgaacaaataatagagaggggggggggagggaggcgtaatggggtttttttggggtaaaaaaaaatttaaattaatgaaaagagagaaagggcggcacacttttttgatgaaaaaacacaaagcagctgccaattattattgtttattttattatgagttgtttgtgatgcctaccaaaatatgatcaaaagtcatttttaaggaaaaaaaaaattaaaaaactttcaattttgttaaaaatataataaataattgagtaaaacagacttgctaacattattttgtaatggaccattttattaaatagcacaattaatcgttcgtaagaatataaaattcacgaaaatcagacttttttcccgagtttctgaattcagattatcagattacaattctcggaaacaaggccgaaacctgatagccatgaccatgaaagaacacgagaaattgtgggattggcaaaaacctttttttgtcgagagtcgggattaacaacaattatgtttggtttatgaggcaccgggcaataatgtcaagaggagagagagagagagaagtagagaagcaaaggcaacggtcggaaatgagagaatggcgggagccggaaaatccgacactggaaaatccgacaccggaaaatccgacaccggaaaatccgacacaagcagaaaatccgacaccggtggaaaatccgacacaagcagtaaatccgacacattggaaaaaccgaccccaactttaaattttaaaaataatttttgattgtttgagttagtaaatatttaaaatacatataataaaagttaaatacttaagttctttaaaataaatatttttattgctataaaatagatttaaggtaggcatataataatcatattatttcaatgtcctttttgatcatctcaaaaaaattgtaaacaatccggcaaatggaatcagaggaaagggcatgaagcataagaaagtgtacgtggtgcaagacatgaatctcacagagatttatgcgactcgcaacaatcgacaacccttttattatttgccatcaatatcccatcggatggcagaaccaattaatttttttaaatccaattcgaaaacttgataaacttgccagatattaactcaaacaatcaaaaatattttttaaatttaaagttggtctcgtgtcggattttcctagaggcgttttaacagagggggccgttccgtttcaataaatggatttaacaaatcttaagattttcgaccccccgtcccaaaagaagaaaatataaataatttattctaataattttcagcccaacagaaggggaggctgacgctgaaaattgaaaagttttccgatttttctcgcggcggagaatccggcactgaacggtacagcgatgccgtgaacatccgaggcttttcattcaaaattttggccaacacttacacaatgtctgctgacaagagcaagaaatgtttgggctttttcatcgaatgcaataaaaatggtaaaatattaattaatttattaaaaattgaatttgtaatacgtacagataagcacaaaaaacgcattttccgcttggtttggggggtgtctacaatgacttttataatgccaactttgcttatttctgtgtcccccccccccgcatcgttcccccccccccgagaaataaaaaaaaaatttgctaacttagaaatttttcaagaaaaaaatcagaaagttatttcataggaaaattctaagaaaaaattttttgagaaattttcagcaattttttggaaatttttttgaaaaatcttagtaattcaccataaaaatttctcgggggggggaaatttttttcttagaattttcttgtaaaaaactttctaagatttttttcttgaaaaatttctaagttagcaatttttttaaaaaatttctccggggggaaacgatgcggggggggggaatgaagtgcacccgtcaaaattttacttttcaaaattttttaataaaaatcttgtccattccaggatctgattttgactgtgctgttgaccgttggctggatgattggcacgctgagtttttcgctttcggcacgtgccatttcagaggcgacgacggaagagaatgtgaacaaaacaatggtggcgcatggcatttgcgatggggtgaagagcggggacgaatgcaggtgggaatcgcatgcgacgcacgcgccactctctgctgttacggtgagcaaagaaaaaggaaataaatgtatgggaaagaaagtgcggacgaatgaaaggagagagagaagagagaacgagaaaagaaaacccaatgccaggggcagagagagagaaaaaaggaagagaaaaagaaagaagaggagcaaacacaaagagagagagagagagagggaagtacagaaaagagagtgaataagaaaaaggaaaatttaatttaattaactttttccctcatttttttgtagttggccggtgttggtctgttcattttgtttgcctcaaatatttggttcatctataaggtatggtatactgtgtatttgtcctaactacggtaaccaaaaaaaaattctgcgcaggagacgccgtttttccgggaacgtcaggctcggcgcaacacacacaacaatttgccgaccaatgagccgtacactttggaatgagtacggtacggctacagtaccgttcacacttttctcttgactaccatcgtttttatccgtatgatatcatgagtttctcatcaaatttttttattttgacattatttttttctcatctttgcacccttctttctctgccatccctactaatttattggatcgaaattttgaagttacgtctctctcctgtcggattatggaaatccctctc

SEQ ID NO: 11511 - DNA, 1044 bp, Heterodera glycines
ttgacttggtttcttgatatcgaagctgttttctacgctatttctaaaacggttataccaaaccccagatttttgaatccggttttcagaaaaaatgccttgtggtgaaaacaatatttcacatttcactccataactttgtgagttcggcacggatcgagaccgggataagaccattggaaagagcagctcgagctctacaagaaggtatggaaagaaaaaatagttatttctgggactttttcagaaatcagaattaattctccaatgtggcccaaattttaggcccccagccacagccccttgcttctcccagttttaagtcttggatttgtcaaataaattcaagacttcaaattaataatcaaaaattctcttaaaatttttttgaacccaattcaaaaaaggaaaaaaatttgcagtcaaaaaattattcgaatttctccaattttgtttccataatttccgaaagttattcggtatcataatgccaaaacaaaacgaaatcgttttaaaatattcctttctggacttgacttggtttcttgatatcgaagctgttttctacgctatttctaaaacggttataccaaaccccagatttttgaatccggttttcagaaaaaatgccttgtggtgaaaacaatatttcacatttcactccataactttgtgagttcggcacggatcgagaccgggataagaccattggaaagagcagctcgagctctacaagaaggtatggaaagaaaaaatagttatttctgggactttttcagaaatcagaattaattctccaatgtggcccaaattttaggcccccagccacagccccttgcttctctcccagttttaagtcttggatttgtcaaataaattcaagacttcaaattaataatcaaaaattctcttaaaatttttttgaacccaattcaaaaaaggaaaaaaatttgcagtcaaaaaattattcgaatttctccattttgttacataatttccgaaagtattcggtatcataatgccaaaaaaaacgaaatcgtttta

SEQ ID NO: 11512 - DNA, 1192 bp, Heterodera glycines
  misc_feature (33)..(33): n is a, c, g, or t
  misc_feature (42)..(43): n is a, c, g, or t
  misc_feature (1043)..(1043): n is a, c, g, or t
tattcggtatcataatgccaaaacaaaacgaanatcgtttannaatattcctttctggacttgacttggtttcttgatatcgaagctgttttctacgctatttctaaaacggttataccaaaccccagatttttgaatccggttttcagaaaaaatgccttgtggtgaaaacaatatttcacatttcactccataactttgtgagttcggcacggatcgagaccgggataagaccattggaaagagcagctcgagctctacaagaaggtatggaaagaaaaaatagttatttctgggactttttcagaaatcagaattaattctccaatgtggcccaaattttaggcccccagccacagccccttgcttctcccagttttaagtcttggatttgtcaaataaattcaagacttcaaattaataatcaaaaattctcttaaaatttttttgaacccaattcaaaaaaggaaaaaaatttgcagtcaaaaaattattcgaatttctccaattttgtttccataatttccgaaagttattcggtatcataatgccaaaacaaaacgaaatcgttttaaaatattcctttctggacttgacttggtttcttgatatcgaagctgttttctacgctatttctaaaacggttataccaaaccccagatttttgaatccggttttcagaaaaaatgccttgtggtgaaaacaatatttcacatttcactccataactttgtgagttcggcacggatcgagaccgggataagaccattggaaagagcagctcgagctctacaagaaggtatggaaagaaaaaatagttatttctgggactttttcagaaatcagaattaattctccaatgtggcccaaattttaggcccccagccacagccccttgcttctcccagttttaagtcttggatttgtcaaataaattcaagacttcaaaataataatcaaaaattctcttaaaatttttttgaacccaattcaaaaaaggaaaaaaatttgcagtcaaaaaattattcgaatttctccaattntgtttccataattttcgaaaagtattcggtatcataatgccaaaacaaaacgaaatcgttataaaatattccttttctggacttgacttggatttctgatatcgaagctgttttctacgctatttctaaaacgggtataccaaacccca

SEQ ID NO: 11513 - DNA, 1109 bp, Heterodera glycines
aaatcgctgcagttttctttcttcaattactcctctttaaagtcctttaattacctctaattttttgttttaagggcgcatttcttttgagaagggttcccaaaatttcgacatgcacttcgccgttttccaatattcgtgcctcaagttcggaaatctctttgaagtcgccgcttttgaagcgttgcgaaatgactttcaaatgatccaacatttgctgtctttgttcgctctccgcttctccaaagtttatttcgtccacaaattttgcgactgtccttcgcaattctttccaattttcactttccaaggccatatccaatttctgctccatcattttgaaaaagaggagcatttcgacactgaatttggccctaatttgccccattttatcggccgagaaaaatttcaggtaaaatatttcgcaccatttttcttcatcttaatttgcgatgatttgtctgtttttgtgcttttttttcttaccaattttttgccttttcaatgtgccgtcatttttctgttctaattttttcaccataaaattgtctccgccgaacatttcgccaagtctctgatgcaaagtgtcgaaagtgtgcctcttctcccaccacacaattttggctgctctcaatcggaagttcaattcgttctctcccgccactctgtccgcttggtacagtttcgtcagcgttcgctgttcctccggcgccgtctccaatgtgccgttgtccagcagttgctccaactccgtcttgtacccttcctgcactttgtagttgaacatgctcaactcggatttaatcgtcaaatttcctccgtcttttctgatagtttcaaatcggtcgcaaatttcaaagtcccttttggcagaaacaatgcgcaaagtgtccaaataattcggcccaaagattttctcattgataatgatctgctgcagagtttgcaaatgcacgcgaaatgaccaaaggagcttaacggacggacttgaggcgataatttatcttatattcgtagtttaagtgctgactctctcttagaatgcttttacctccccccccttttaaaaggcttttccccttttttaatgcttttacctcccccccccc

SEQ ID NO: 11514 - DNA, 2427 bp, Heterodera glycines
  misc_feature (2407)..(2407): n is a, c, g, or t
  misc_feature (2412)..(2412): n is a, c, g, or t
aagtgttccacggcaatcaattgcttcatttgaattcgttcatcaaaaggcaattcattgtcaggtaataacaaaaaattggcgaataattcgtccaatgaaataattttggccttgcctaaatgagacagcactaattagtagagattccgtattttttttttggaaaatacggaatttgcgggattaatcccgcgggattccgtcccataaaatttctttagttcccgcagcggaatccgcaagtttgaaacttccggtctctattaattaatccccatttctaattgctttccatccataatattttttatctcaattttaattgagaatttgccaatttccctttgcttttcccctttagtttggcccttttctttgttcgcttctctcttttcgattgtttaccttgcggggtgaatttggccaattgaattaaacacacaaaaaacacaaattttgtgcacatacgaaacagaaggaacattcggaaatttaatttatatgaaaaagtaataattattaattattctaaaattattgtcacaatgaacaaaatcaaaataaaatttgggctttttcttgtggatggatgacgtgttattgtaaaattcaaaatgcgattcggtgccttaataaatccaataaatcccgccccctctaagaaattcccagctaacaaacgtaaaatcaatgagtcacttaactctgcttatgttttatgccataattatgtatgcacaatatgatttaattcattgattcgttttgccaaattctttaaaatattttgccaatttttagtttctttttttattaaattaatttctttttaattcatttgtaattgaattaactgtgaattgttctgtttatcgtgggaatcatagaaaattatgaataataataatgttaaaatgtcaaatcaaaaccattgaatttctcattttcattcatttgttgcgcatctgtgaaaaacagtgtgtgcattaaataggacgaattgaaaggcccatttgaatttggcgagtaaattggcggaaaattttgcacatcgccgttttcatctttcattaccaatccggcgacccaaacggtgcaaaaggcatttttacttaaaaaaatatctttttgaaaatgcttaaaacattaaaaaaaattaattggggggagcagctcactttacggcagataattcgaatggaccaataaaatcattgactccctaattaaccgattaattttagcctatcgtttacttaattactattttttcaaattaccctttcaaatctttgccccgcgtcgtccgttccaattgcggaatttggtggtaatgctccaatttttcggccactttttcactgtttgcccattcaaaaagtttccaccgaattttgttcctttgatagccgcaatttgccatttgcttctccaaattggcttcacaacagaaaatggcagcgaaatgtttgaatttttgttcatattttattttttcaaaaattcttttccaattttgaggattttcttttaatttttctttggctgaattttattttatttcaaaagtttcaaaattttttttaattttaccaatttttaattcctcactgattgttttatatgtaaatttattagtattaaacgcggcattttgttcaggaaacttaggagagattacattcattgaacattggccaattttgggcggtggccaaaggcacacaattgggtttaatggaacggcatttagcggttccaattcgacaggaacatttgaccaatcccttaaaaattaattgctaaattaataaaaataaataactaaatgccattgggagaaaatggagaaaaattggaacaacagaaaggacaacggcgcatttgggaatagggcacagatttttgtggccaaaatggacaaagtggcgccgttgaaaaagccgaaaattgacgagtaaatgagacggtctgaaaaaggacatttgcgtaaactctgaaacttaggcttacttttcgcccaaattttaacagttttgactaagtcagacaacactttttggtcctgaacaagtgataattggaatttgcaggagtgatagccttaaaatgtcaacaattatttgtcatttgaagtcatttacctgctaaggcaaaaatgccattttccgaagtgatctctcccacgatttgatcactttccaaaaactttgagtcaaaagaatccgtggaaaaataaattcgcggcaccggcacaaatatcagatcaacttcgatgtttgcgtaaataattctcaccagttgaactcgtcccgtgatcagagtgattttcgctccatttaatgcctaagtcagtcaatataatttttgccaaatataaaatatattttaattaattaatcanaatanatgaccattccaaat

SEQ ID NO: 11515 - DNA, 1782 bp, Heterodera glycines
aattaaatgaccattccaagtaaagaaaacaaattgcctttgatttgcccgttaaaattgagttcatcagaaagcacacaaatcaaatccaagtcggacccgtccaattcggtgcccatcaaatgcgagccgttcaccagcaaatgggcatctgagagagcgaatttgattttgagtttaaagcattcattgccaatttattttggtaaattgtcgcgacaattcattaattcatttatttacccgttcttttgcccgacattctgttcacccattcgccgatggtttgttcaattttgtccataagttcgagaatttgtcctcttttaaacgaattgacagaatgcttcgaaataaactgataaatctaaaaaccaaaaaatgtttttaattgcttattaataaattaaacttcttcggatattttctgatcgttttctcgcaattttggctccgttctgatcaaattgtactgactttgttcgatgttcggcaaacactttttgccttaattacccaaataattaatttttaaattcacttcgattttcatttctcacctaatttgtgctgtttcagcaccgtttccattgcttttgcatatttttctatttttctttgtccaattttttccccattaaaaattcctttcattttttccacgtccatttttacaattgatgcgaattcttccgaattgatcaattgtttggctttaagagatgaaaaggaatgcatatgcaattggattagcattgtgccgacggtggcattgccaaaagtgccaattttgaccggtttttgcattttttctccgttataaaatgtttcagtcccttttctgaatttattttcaaatttactttttaaataaattaattttattcaatcaaatttatatatttttttactcttccgttgtcaaaatgaatttgtccaattcattttgcatcagcagcagtttctccatcacaaaatgcgaattttgctcatttttctttaattctccgtttagaaaaatgcgccaaaattcgtttaatttttcataagttttaaaatcagtcaaatgcattctaacgaatttcattttcgcatgcgttgttctgacgaacatcgaaatatgcaaatattccaaatatttttctgcttttaattcatttttcaagtaaaaaacgtacaacttggccagtaaaaaatcatttagcaaatcttattttgaaatttcaattattaaagtccattggtaattaattacctgccaattttttaattaccattcgctttttctccgcctttttcggcttttcttcacatttcaattcgcttttttcttccatttgttcccatttttggtccaaagtttcttttccgtttttctttttgcctttgctttttgcctttaaattttctcctttttgttgttcgcttttccatgctttttctctcttatttccctcctctttttcttttttcgcttttccctttttcttttttggccatttccttttttctgtccaattgtcacaataattataattacttttccaaatttgctccgctttttctttttctttttcaatttcaatttctttttccttaatttcttcttttatttcctctttttctttttctttttcttcttcttcttcttcttcgtttgtttcttttgtgtctttaaaaatttcttcttcacattcagacgaagacaaattgccaaaagtttcttccgtcggagaataataatcagtgaactgaagttttggaacatttgaacaatttaat

SEQ ID NO: 11516 - DNA, 2197 bp, Heterodera glycines
tttttcattatgttacaatttaaaaattgttctgcattttttaactgtacggaaatagcatttattttgagcagaatctttgaagaaaaaatattgaagaaaagttgaacggaagttgtattattgttattataaaatgtttaaaattattatttattctataaaataattaaatttaaatatttttattgacattgagcctattttcggttcacccacactgatgagactattttcggttcgtatctatacgaaaaaacacaaccgaaacggatttacaaataggtatctgatcaaattcgatagggtttctgtgctgctattcattaattcaaaattccgctcattcttcaatcttccgacaaacagagcaaaataataaacatcgttcggacttggtcaaaatagattccgtgatcactgactccgtaaaaccatggatacatacagattaatgtatgaaatacaattttaaaatcagtggcaaaaccctggcgaccttcaaacgcttaaatattcccttttattttcccgccatcaaaaatcaatttttcttgctctgctgagtttgttgtgctctgtgctctttatcttttctttcaaaacaatttttctcattctttattttattttttagtcttatcaataattttcctgagtacacaaatttgtacatttttacttaaataattaattaattcttctaactttaaaatgacattcttttttaagcacaattatccgagccgcacaaaaatctttgaacacactcacttgtgttttgaaaagagcagaataatttgttatcccgtactaagtacgaataaccccattttaaccggtgcaaaagtctgacagaatgatcgggataccacaacaaaaaaaaaacacttaaattcgggaaaatttttgaaaaaaatcccttgggattgcaaaaatttgttctgtaaaaaataaagaagcctatcaggggtggggcgcgcacagaaaaaaatcgtgcccgcgcattcaaattgccgcggccgcggatcgcgcaaaaaaaacgccgcggatcgcacatcgcggcgcggtcccagccctgaagcctatcagaaataggacaaaattctctactgaattgccttttgatggtgggtcaacgacttatacttctgatgctgataaaaaaacctttttggatcaactttatagtagccccattggaaaaacataatatttgctgccaaaatttttggaatgggttatctacaacatttcattaagagttatggtatttgcatacagtaaagctgaataaattatgtatgcatttttacagtagttggaagttgagccaaacaaactttaatgaaaatgtttaagaaattccacgctaaaaaggaatttcgtgcattaagctgaaccagaaagattaatttcgaccatataaatccgcgcccattaataattaattataaggctcaaataattaatttttgaagtgtgaatgatcagcagaattgactattttgccttgtctccgattattgatttgtctcgcttttagcaatggcatttctcctccctcggcttgccctcgcctcctcctttcttgtcctcttcgccccattgtccgattctgccaatgttttgttctcttccacatcgctttatcctgtccaccgctttatccaacgtgaattggcttctgaactactgcgtcgtaatcactcagttacttggtttgaatatggcttaagcccggtgcgtttggccagcaaattttccaaagacctttttaattgacagaatcaaatatcactgcctaaagggattgacgaaatatttcttcaagttgaaaattccccgaaaacagctgcactcaaaaataaggccggcaatgtgcagctcatttcgaatgaccaattatggagggagggcttttggcaacccgtggaaaagcccggcggttggttggccagtctggagctgtgtgagagagttctcgaacaacctgaacaccgtaaagcatttcaaactctgctcgagaaaccattcgccgtcgtcgtggtccataaaaatgtttcttcttaacattggtaaccaaaagtctcgaataggtggacgatctgtacaacccatgcggccttctgctggcaggactaaagcgggctctggtcgtatattggtctatgaccggactccgtactgaatcggc

SEQ ID NO: 11517 - DNA, 2635 bp, Heterodera glycines
tttgtcggcccatcttcaccagttgtgcatccatcagcacattattctgcgaagggtcgacaaactctttcaggtggaaagggcaatttgtaatttaagatatccaattaattactcatttgaaatccaattaaatcacttttattatacataaaaagcggagtatttaaaagtgtaaaatcaatctgccgctggaaatagcaatttaagaagcatttccctggaaaattgcctgattcgtttaccctggagcggaatgcctcctttaacaaaagtgaataacccgcccattttcgatttcgcccgtccatacagtaatcatttcataattgcctcacttcaaaataccgtatcccataaagtgccacgggtaaattttgtcggcggattgcactgcaaaaaccaaaccaaatggacaatggacagagtaaggcaaacaacaaataatgcacgcactcaatgctcattaataatgttgccagaaattgctacaatttgtcaatgcttcttccgatcagaaaggctttattttaattagtggtggattttctgcccaatggtcagacgccccagcggaagtgatcgtaagtgtgctgagaaaacaatttatgttaatgttttggttggtcaaattccaaggagaatttggttggtgccattcgcgagttgccagacattcgctttgtctggcagttcgatggaccagcgttaaggaacactccgaagaacctttttgcggctgaatggcttccccagcaggaattgctcggtcattgacaattaattattcaaaattgttcatttacgagtcaaaacgaaactttctcgggccaaatggcaaccaggtggcattagtaaatcaaaatgcctttcagctcatcctaaatgccgcgcccatttgtcccacgggggagtgaacagtgtcatcgaaagtgtttggcacggtgttcccgtcattgggtggccgttgagcgccaatgggagggacaatttgttacgagtcactgctcgtcaggccgggcttatgctggacaaaaagcgaccgtccaaacaagaatttatctcggcattccaccgaatttacatcaaacattacaaggaagagatgcttatatttcaagtgggcttcccaacaaacatcgaatgccacttaaataattgtgccaaataaggatatggtcatcgacgtgccttacaccgagttgaaccactcggccttttgggtggaattcatcgttcgtcaccaggaagttccccacgcccgctcgggtgcggacgacctgaatattttccaggtaattcgcctcttaaaaggctgctgatccgactcacttaaacattcagtacttcctcgttgatgtgatccttttcctagtcggcctctcactgctcgtcctttaccttttcattcttttgctcaaattgttcttccgtctgatcatctttttgatcaaatggcctttttccgccggttggggcgctatcaaagagaaaaaagggacaaaacacgcaatggctaagaagagagactgatcgacataagcaaattcacttaaaaccgagctgctgactgatttaactggccgtttttgctgagccaatttttaaataaatttttagtttccatggcaacgtatattaagattttctcagaaaaacccattaagtagtgtattggtaatataaaattctcattcatggcctttctcctaatcgcccctttggtcgacctttgtttcaatgctgcatctgtacttttgttgccagacaatgacattcaactaacgcattttctgtaagcaatttgcattgactaatcgaccaattatcgttgcaaataattacggatgaattttttcatttattaaaataaggaaaaaatagatatttgttagttcaaatatcggcgaataagtcagaatacgactgcttttccacctttattttcagccttcaagacactgtgctggtcttgtccatcattggtcttgccattcgcttctcctccacatttgtgttccaagctggccttatcggtcacttgctccgtcgcttttccgtttccatcattttctccttgctttacctcgtcctctctattagccttcacatattttcactgcgtgaaaaatggggcaaaaagagttatcactatgcatcacccctttttgtggctgttctcttcatgtttcaaagaacaagtggaataagaaattgaaagcaaaaatgaattcaaaattatattcagtgtccgtactccactattttctgtacaaacggacaattttgatgcttaatgaaccgaaataccatcaaaaatcggagtggctattgaataaaattagcaaaaatattggagagaagccgcgagaatgatcagaaataacgatgtacctaattaataattttctttttttattttaattctattacctaatatggtttgtcccccataaattttttgaaaaaattacggttttaacgaatcgggtagaacatatttccttaggttttcggggtctctgatcacgatccggcatccatttcgaaccccgaaccgaattcgaaaaagtcaaaaactcaattttcaacaaaatttacatttattgcacaaaatgcatagcaacggacaaaa

SEQ ID NO: 11518 - DNA, 3727 bp, Heterodera glycines
  misc_feature (3702)..(3702): n is a, c, g, or t
  misc_feature (3717)..(3717): n is a, c, g, or t
tttttgtgttgctcacccaatgcattccatatcagggtaaaacacaaaggcgacagtgttcaaatcgtcaaattaacaaattcccattgaaccgcagtcgccgtctccccattttggcaccgtttcattatccattggtcctcctgatgattttcgcttgctttgatcagtgtcagcttttccttggtccgttcgttcgctaattcaaatgtcacaatttgcgttgacaatggatcaataataaattgaattttgtagcggacggaagtggtggcattgagaaatttctaaacaatggaaaacaaaaattaaaatcagttgcttaaagaaaatatggcccatctttttcaaagtgttgatgttggccaatccgatatttggtggcttcaaaaggcaacgcaattgcttcagttggacatcttttcgcggagtgtgcaaccattttgacaacatttggccagcagttggaattgcatttggcccgtcaaaatcatcagtcgaatcgggcaacagaacacaaaagatggaaataatgttgagatcagtgagaattgttggcgaaatgagacgacgtaaattgtccaaaaggaggtcatcaccggaaaagtccaagtagcgaatgttttgcgcaaaaattggccaaatttcacggacaaaaacaaattggctggtcatctagtgcaaaaggaatactcaaccacaaattggtgcctttgtcccaaatttgctgattggcacggagaaaagcgatcacgggatggtcaatgtaactgaaaatggatggcttttattgcgatagctaactctgattttgttgaatgacctaatctgaaggcatttgaagcgaattttgctggtcaacggacggtctggcactgaattcttgcgacgaatttcgattggtctccaaagcgttaattcgcttttgctgtcgaaatgtttgtccaccaaaacttcgaaacatggcgaaagaaatgccaatttgaggccgagttgagcatggtcaaaaaatgggaatgcaaatccaactgaaatgcggggaaaacagtttagttaaatgcaagaaatgttttttagaatgagaggaaaatggaaaaagcaaaattttttggccaattaggcttcgactttattttccaaattggcaagcgaaggcaaaggaagcaattcgaacaatttaaatttgttgatcagtcaaaggtacttgccctgtctcaaaataaatcgaaaacaataaaattatgctttatgcaaaacgaaattaaagacaacgaaataaccaaaacaaacacaatttcaaacaaacttgaaaaccagcgagaattagacacagacgaaagtaaatcaatcatacaattaactttttacttcacaatcataagaactaatcaaaaaacaaaacaaattatttaaggtcaatttgaataaacggaacgccaaaacaaacataataaattaaataattaatgaagtccaaatgatatcacaatttgagtgtgatggactttgacacttttataacttttttagaaaaaccaaattcattaaatctattatgtccatagaacccattttaaaaattccctatttgaagcattagagtggctaagtctaagacttcaccgttattgaatttcttcgaatttcccgagtgcgttgtctcgccatgttggagtcgaaaaattgaaaattttaatgtatttttttttgtaaatctttttcatacaattattttagacgaaattaaaatattctttattctctcttattcagtcttcttagtaattaatttgaaaaaaatagccaacttaggtaaattcggacgttttgccaactaatttcgtcaattcgtataaattgaatgggccatacagttttgtaggaatgggtattcaaaaaaaaacataatataataattgcattcaattcatattactaagtttttggatcctacttggtgagggaagcaagaaactcatttacaaatttagtgctttaacaaatacccaaaaacggaccagccctttttggtgtcacaaaagtaatgcaccaaaaactaaatatggcctcaaggctgcaccatatgaaaaaaggcttgagatatgaaaattggaaaaattaagcactagaagggtcgctaaatgatatgaatataagtttcaaataattagagacacctaactcatttagacccaaaaatttaaaatgaattttatttgtcaaatatcaagcatgttttttgcaaattacgtttttcattgaaaatgaagttaaaatggattgattataaaaacttgaataatattaggtactgttttataaatatgaaataattattttttaaattcaaaagacaatttatatagaatatataaatttcattaatcaatgaagcctacggatccgaccactgcacggatgccacgcatgttccggtagctgttactgactaacagccgcaactgtgcacccgttactgcctacttctcgaagggctagggacagcatgcaacaacagaaccatgcatatccttgaattttaaatgtaataacaatgtttcgctttggtataacttgaataatattaggtactgtttttggcatttggttagaggtgaaagaggtttggagttgtttcaatgctccactgtagtcttgacaaaagtcatttgagagtcaattaactggtgaagaccgttttttgggaaattggagaatattcggtttcgggacagggtcttttcgtcattgaataattaaggcgaatgaatattttcacaaccatgcatatccttgaattttaaatgtaataacaatgtttcgctttggtataacttgaataatattaggtactgttttataaatatgaaataattatttttagacaatttatatagaatatatagaatatataagactagtgatagtccaattaagaacaattaaaaacattctctataaaatcgaatatcgacaatgaagcaaagcaacacaacaaaagacactcctcctcaaccaaaacgctcaatggcacctgctctggacctggacccaaacactgccgcactcgtagagcaagaacgccaacgcccattggtgctcattggcctcccggaaagcaatgctgttcgcccatcggagcgtgttatagatagataaatttttgtaatattctgttttactctattaaaatattgaaaaagatttgtatatatttcgccttctttcaagttctttttcttgataatatgaaaagtcttactcaactgcaataatatatacaatgcctaaacaattttaaaatcattatcaatataatttattagagaaattaatgaatacataagccagtaaataatttacatttttccattggtattttttaaattcatttataaatttaattcttcatgataccgctggaaaattggaaatcaaacacgaaaagaggtaaatgaaattaattatttgtgacaatttaagaataagtgattatttgttacaaaaaaaagattgagaagccaatcttcacaacttccctagctttttatcattattctaaatttttgaatataatttttaattcagtggtttttatttaatttttcattttttacccaaattattaacttttaaattttattaaatggcatttatgcatttatttgaaattttgttgttcttatttgaattcgatatttntctcttttggtggtnttagtttttg

SEQ ID NO: 11519 - DNA, 1079 bp, Heterodera glycines
cagaaatttattattgtttcatttttatttaaatatagtttttaatcagtgttttttatatgcagttgaaattgtgttgtcaatataaacaaatgtaaggacaaaattttttattatatgaaattcatttttttgcagtcttttgaacatttatgggtgccgagtcattgcgcatgaaaacgcaaaaatgaaaacaaccaaagcaaagtaaatgaagaatttaacgcataattaatattaaaaaagattaatttaattaatttatttaataaaattattaattaagcaaattaaataaataacactcttttataattaagttatttgtaaatccttaataaatataagcaagcaattaattcaaccaatttggatatatgatatcttgaaaatgtccccttttgaggttaataaagattgattttattacataattttttatataaatactccggctggtaatttatttccattttctcattaagatttaaaaattgtaaaattaaatattttaaaataccttaacaaggtgctattgattatttgtacgtttatttttgtttgctataaaatatattttctctatgcgtactttttaatatatttttttaaatttttgtgatccaatgttacattatttttgttaagtgattcattaaatttcgattataattttattacttttgccaaaattctggtctgaagatgaccgcccacgaatccatatgctttctgatattgagctacataagatatttatatatataatataattttctaatcgtttacattgaaatttttaaaaatctcaactttttaataagttactaaagggaatgagaaactaagaacattaaatatcagtggttaataatttctttaataagtttcagtataatgcgattaaaattaataattgctcacataatattatttaattttaacgtaaattttcttttttcttatatttttcaccccaataaaaagctgcaagatattcgttcttgtcaatggcataagttcttcgaacgatacaattattgttacttaactcagggattaaaaatataaagtaatgt

SEQ ID NO: 11520 - DNA, 3343 bp, Heterodera glycines
  misc_feature (884)..(884): n is a, c, g, or t
tcagttttgattacctctcttgctctgtgggtataggtcatagacctaccatcccaagggcaattcggtagagaattttgtcctctttctgataggcctactcaaatttttcagaaaaaatttcctaaccccctaggaatttttttctaaaattttcccgatttcaagccatttttgtcttttcagatcaccgtgaagaagtgatctgatcaagttggtgtaagagactgttttgatcagcatcaaaagttaatctaacagagattttttcagaattttatcataataaaaaaatgagttttggtcgattaaacattttgaggcattacttttgcaccgtcagaagggggggtcaattggatcatgaccaattttctcgtcaacaaagggagctatcggggcagtttttggctatttattagcgctgtaattagtgtttcttttggtgtaaataagacttttttcaccattcatttttgagaaaaccagtttaaaaaaaaatctttttttttgaggcaatacttttgcacctgactgtataactaaatttatacaatactttatgtgtgtagagttggtaatttatataacaataattcactgacaataaatatacatcacaacaaatgtttaacaatagagaccggaattttgaaatggccgggaccgggacattttcaaagtttttgaaattttaattataaatttaaataaattgcttcatcttctataatgtttaaacatatttaatgtaaaattagcataatttattggagattttatcttttcgatcgtcggctgttgcttcgcagctttttttgggattcttttttcgtcttttccagctcttcgaaatttttgacatattcagaattagcatgggnatgtgaaaaagatgcattttgagtgacttggcgctgaagtcagacagcataaattcgggaccagagcgtttgggcccccgtttttgggccccggggtcgtttgggcccctgtttttgggccccggggtcgtttgggcccccgtttttgggccccggggtcgtttgggcccccgtttttgggccccggggtcgtttgggccccaacccaaaaatagaaaaatgtgcttttttaaaaattaagattctaaaaactaagcctgagggatccctcgccacttggcataagttaggtttaattaacattcgctcattttttacaattttacttattccaaatcctattattttttaatagctaaccaatttgatgtacattctgatttggacatttttcagcaatggctaacccaattgcaaccaaaaaacaaaaagtaaaattgtcttacgaaggccacctttacaccttcgctaaaatgagttctgatgggatgacaaaattttggagatgcgagttcaaaaaatcaatttcacattattggagtttctccggggaatttctcgcaactatcgaatgaacccgtgattttttgttttattgtccaaattaccttatgaacccgtgaatttctgttaatttttacattttttattgttaaaattattgttgaatttatttttaaaatgtttattttacatttttatgctgaaatttaaaaagttgtttttactgtgatttttcatttttctgtacttggggcccaaacgaccctggggcccaaaaacgagggcccaaaaactggggcccaaacgcccccgactctaacaggaaagtaccaactatttgaacaataaatgtccaaatatttcgaaatttagatttttgcccgtatgttaaaagattttgtaaaaaatattagcaacaaatttaatattcgacttgcaatttcaatcttaaatctgaatttcgacattttttggtctcggaatctatacatccctggtagataatagcgataaatcaaaaaaccaagttgtccatctttgatcacccaaaagagttagttgtaccgtaccgcttttgattgccctaaaattattagtaagcttaatgtgatgtcagaaggaagtgaaaggagcgcccgtagctcaattggttagagcacggcacggattgttggggtcttggtatcgagtcccaccgggcgagttaccttttatgttctacagtaatacaatcaaaagcgaaatcagtctttttgcggagcttagagtcaatatttgtgggacaattaccacaaatgatcaggacaatcgccacaaatgatcaggacaatcgccacaaatgatcaggagaatcgccacaaatgatcaggagaatcgccacaaatgatcaggacaatcgccacaaatgatcaggacaatcgccacaaatgatcaggacaatcgccacaaatgatcaggaaaatcgccacaaatgatcaggacaatcgccacaaatgatcaggacaatcgccacaaatgatcaggacaatcgccacaaatgatcaggacaatcgccacaaatgatcaggacaatcgccacaaattatcaggacaatcgccacaaattatcaggacaatcgccacaaatgatcacagattttttgccttatttttttaagcaaataaatttactttgtcgttgtgatcaattgaagaaggcttctccgattcgtcgcacatatcagcagttcttggcgatgcttctgttagtgatttggctaaattttcttcaaaatcaaattttggcacttttcggcaattttcttccgaaaatttggtgccgacacttttttcttcctttttatcatccaaaaatgttgcttttttctttatttttatttgcattgaatgattttttgaaacctcttttttttcctccacatttttttgctcttcgtcctgcggcttctgctcaatttttatttttcttttggcctcctcttccttcaatccatgattattttgtttatttgaattttttcttggaatatttttccataattcgccaaacaaatcatcatcatcatcatcatcatcatcatgtccaatgcccaaaattccgtcaatgttcatgatatgataataaatcagatgaaacaagaagaaagtagcgacaagcattatgaaccgaaatgtgtaaagaatagtttttgggccaaaagttgcgttaaattttaaattttcaaataattagaaaataatttttttttatatatatatgatataaattttcattaaaatttatttgctatattagtaagggttggggcgctgcattcatttaaaatatctatttgcttgtaaaatttttattattatttttttgcttttttcaatccaatattcattcattaaacgaaattattaattgattttatagttggaaatattttaaaatacatatgttattttgttta

SEQ ID NO: 11521 - DNA, 1166 bp, Heterodera glycines
  misc_feature (1103)..(1103): n is a, c, g, or t
aggcaaaaaaaagtcgtcacttggcttttaattgcaaaaattggcctttttagtgaaaatctgttaacaaatcagaaccaaattacaaaatttttcccggcggcgcctatcggcaccgccggaccctctctccttcgaccatttcacaaaagttatttggaaaaatctgccgcaaaaaattgattttttgatcccgaatgtgctaaaattcatgagttgttaattttctccccaaaattgttaaaatcgttaatgggagacgaaaaatataatatttgatacatttttgatagaataaattgtaaaaataactgatttgaagcaattttgcaaaatgtcctgactttcgaccccaaaatctggttttttgggcccgatgtcctgattttgaaaaattttcgatcgcacccctgatttaggggcccgtttgttgggtttctcctccgtttcctttgtcctttccttcctccttttcatgtttactgtttttggcatctccaaaaacggcgtcttctctccgtcttgctcttttcctccttgcgatccttccctttttcctgttcgccagcgtcggcgtcgtcgtcctactttttgagagttattgcctaaggttaggcaaggggtaatataaagggtatattcgtattcagcgaccccgaaaaccctaaaaatcctaaattagactcattttgtttttataaattttgaaaaattttggacatttcgtgggtttttactcttttggacatttcgtggcttggacactttgtgggggtgccatttactcaaattaacaattagtacaagaaaaaattcagttaactacctaacacagcaacaaagtaccgatggtagtccccctttttcaaaaaatcaaatttttgaaattttttttcgataaaaattgtgttaggggttcaagggtcggagaatccaaatctcacatcaattccgacctatgtcgaaccccggacccgaattcgagcaaaaagtagaaaattcaaattttcgaatttctcattttgcttcctgaaatggcttacatatagggaaacaaactaagaaccccggacccgaattcgagcaaaaagtagaaaatttanattttccaatttctcttttttgccaaaaaaaggtttatatgatttttattaatgaattatcga

SEQ ID NO: 11522 - DNA, 3058 bp, Heterodera glycines
  misc_feature (2902)..(2902): n is a, c, g, or t
agtgaattaaaataaattgataaaaagctcaatttcttataattttaatgtccgtttttcatcttctggacttattctgcacaaactagtcaaatttataaaaaatcattagagtttttgtgaatttatcccaaaaataaaataatttaatttataaaatgaaggattaataaatggacatatttctgtggcgggggagccaagtttaaaattccgatcactttcgctctgatcacttccattctatttattccggtgggaatacttcgggctcgggatccttcgtcattttgctgcagttaacatccggcatctgtgtcagcgtcattttgtcgccatatttgaccaaaaggtccaacacagcgccattagtccagccgaagccaagctgagaaatgaacaaattttatatttaaaagtattgcaaatttgaggcatcaaacggatagacttgctcagataatgcgatgaaatgttgttatctttttggggcgaagtttttgcttgtttcattttctctataattttgtaggaatgcgatagggaagaagttaagcaattaataccacataaagagactgactcgggaattcttgggctcaaaatattaggcataatgacagaagatccacagtcaaaaaaaccactcaaaaaatacccacagacaaaagaccacaactattttatataattcttaattaattgattttaatgccttaatttcaatttaatatgtgaaaaaatattaattgacaggagaagcaaataattgcaaagtattacgttgaagactaggaacattttatgtaaatagtatttttagattggtttgacattttcacgtaaaagtgtctttagcatttgatgcttctaagacgtgctgggtcgtttcctaaaaaccgccatgtggtaggaaaacaaaaaaatgtaagacatataaattcataacttggtccattttcaaccaaattaataattcttcgtatcattcaatagctctaggtgttttctatcagaatataattttattaaattttttacttaagtatataaaaagatatggtaaaattccacaaaaccttaagtcggaattttttgtccagaacttttttgaacctcaatgaaattttttgaaattagaaagataaatagaataaatagagtacttgaaattctaaaaagaaaatttaatctatttgcttctgaaaaaaagtgtctttagcttgatttgatgcttctaagataccttttcaatatttttctgtatttgagacttttgtccatatttatatgttttaaattttggaaaaaatgaaatgtgcaaaaaaaatgttcatgcgcaaaattaagcgtgaaaaaattaaaaaattaactaaattttgtaattatatttttcagtaagtaataaataggaggtcttaattagagatcggaccggtcgattttttcggtatttttcgattttcggtttcggtttttaaccgaaaaaaccgaccgagaaatttttgagtttttcggtttcggtttttttcgattttttaaccgaaaccgttcgaccgaaataattaaaaaaccgaaacaatcgaccgacttttttgacaaatcagttggccattttttttaacaaaattcattaaaattttcctccggcggcgcctattggcaccgctggccccccaaaaacctaaatttttcttaaaaaattagccaaaatctcaaaaaaaaatttccaggcggctcttatcagcaccaccggccctaaagttatggcttgagctcgcaattaaggcaccaaaaagcgcaaaatagcactgaaataaggcacaaaaatcccgaaaaaggcatgaaaaaaggcatttaaattttttattaatgatttttagggagcaaaatacgtaccaaaaaactaaattttgctgatttattgataattcatttttataatgtttttcaataaggaaatttttaaacctaaaattttttatcaagaaaaaaaaagaattttggcgttcaattcataaaggtatattctctgaatttttttagatcatttcttaggggtgtattttttccgatttttttgaatttttaatggaatttttcggaaaaaacgccaaaaaaggcaccaattcgccaaaactaatctggggttttttagaatcaagtttcccggcgtcgcctgtcaccgccggccttccgccccgcttgttccccaaaaagtctttgaaaaaatgtgccgcaaaaaaaatttgtaaaactctgatttttttttttgagcccgattgcataattttttttacaccaaaaatcttataaacacaagctttacaatattccattattataattgaattttgctttttatttatacaatatttctaaaatctcttttcgttattcaatttaatctattaatttatgatttcattgataagtttgaatttttcttttatctgtttttctttttatttttttattaaattatgtttattctttctaaattctcatgtacttttccttttttttcaaattctcttccaaaccaaagctttataattcccatattaatagatataaattattttttataatctctttttttgttattttatgagttgtttttataaatcattagctttacaatattccataatataatatgattttctgtattatttcgttctgtttagagtgaattaccttaatatttcgcatttgtttatttttatttttagaatttttggaatttattaattatataatgaaaatttattctttaaaattattttatttacttcaaaaatttattgccaattgaaattttaaatttcatttgtttattaaaaataataaagtttctttttatttccttaacatcccttatgaaattaaaccaatcaancgtagggttttccatgttgttctatcgcatttttccatgttgttctatcgcatcgcatttaaattaataatttgtttaattttagtaaaattagtttagtaaatatttatttatatttcatcttttttttgtcattctttaatatattttaataat

SEQ ID NO: 11523 - DNA, 1707 bp, Heterodera glycines
  misc_feature (1320)..(1320): n is a, c, g, or t
  misc_feature (1654)..(1654): n is a, c, g, or t
tttctaattaggttaatagcgaagagaaagaaaacaattttctcaaactcgttcaataaaacatagaaaaattaattcagccaacttataaatttattaaatacctgtaataaaccaaagcctacaaaaaaggaattggaagccaaaaagccgaatttttttgcatttaaaaataaagaatcaatggaaaattaattaattaatttaaaattagaaagaataaaataaaaattcgcctaatcggtcatccgaaattacgaacaaccctgatatcccaactcacaactgaagtcccagccggactcagccgcagatgcaatttcacgccaaactttcgccttttctcttggttcagttaagttttttaccaggtgcgtgtctctgcaccatgcctcaggacgcggcacctgaaaagttaattagccaattaacatcccattttatcgattttgcatttctaaattaattatcattgcttaatgctaacgttgctgtcggccctgtattggcaaagtttaatgggcttcttcttcacaacaacggtcactgatcgcttcgtctcccaaaattcgagttccttaaattgaagaagtgttaatttaaaaaagcaaatttatcggaccgtttcaatgatcggaagcatttccttgagaaattctttgtcttgggttgcctcgtaataatcgtaaaccatgctaataattatttaaaaatttattattaattatttgatgcttacgatgcgaagaagggtggttgggatcgcttgctgtagtaaattcggcctccgtttggcataaagccgaaacgtttgatcatcgaagcaatattctggcagatgttcttcacggatttcttcatccctgtgtttacagttgtttttttatttaaaaaaattaaatcagttaaattgtaatattttcgctgatcaacagcgattgaccgatcatttgtcagtaaggccatgaaaaggaggcaaattgccactccgatcacttgccggaagcgagaagtccgcgaatgatccaataggtgtcccagtagtaaaactcgcggaaacgaccacccggcaccacgaaggggttgggaacgtacaaaagcgaatgccttttgctgtctttcaactatggaaagaattttgaatataaaattggattttaggccaatggctcttttcaatgcttctcacctcatctggcatttttcttcccaattgcttccacagattgttcaaatccttggcccattccttcaaatctttgtctttgattttctcaaacgcgggcggattttccatccaatcttccgggtcatgtcttnaacaaattgcaaatttggaaaccgcatttggccaggatattagccaattaactcactgtttcagcactccctcggcttttccaaaatttttgcgcacaaatttcttcagttcgctcacttgggcctccgtcattgttttcactttaatttccgtccaatttgtcacgccaaaaatggcattgaattcctccacaattttctttgggtcgtttttcagtggacggtcagcaaattgcttcgaatcgccgttgaacagcacgccgtggtagttgaccgcctgtgattattaacggggggattccccgactcgatatccccgtcttgcgttccccgnaaactttttcccagaatcggtggattatgaatttatgaatttacattaaacat

SEQ ID NO: 11524 - DNA, 4312 bp, Heterodera glycines
  misc_feature (1466)..(1466): n is a, c, g, or t
  misc_feature (3745)..(3745): n is a, c, g, or t
atcacaatctacggattcttttgtcgacctcaaaaggtggttggaaacgaacagacaaaacaaatgaatccctccaaatgccaagtcatttttaaaatgtctctcatttgtcagccaacagcgagtgccaagaacagtcttcgcccgccgtttcctcgggcagtgtgccgttgcgtttgttcctcggctttttggccggctccgtcgcctccgttgccaacattcctttcgacgtggccaaaagtcgcattcagggtaaagttgttggccaatttcgctgtgccaattcttttcgtttgttctcttttcccctcctttcccttctttaaggccctcagcccgtctccggccgcgtttaccacaaaacttggccaaccattcgcctcatttaccaccaagtgctttttgccaggcttttccccatttggccaatttaggagggtttccgcactttgtaccgcggtttggtgcccaaagtgatgcgactgggccccggcgggggcattatgctcgtcgttttcgagacggtatacgaatttttggcaaaacacaactgaccaacagagaacagaaccagcaaattgcgagcaattaatgccaaattaacagccaattaattagcaatcctttcgaaagttctcattttaatttgactgatttttgcctcgaaaatcacaattttttatttgattttctcaatgaattgacaaaataatgttaattctcaatttaccaattgcctttcttttgttttacaatgaattgtatctttcattttatattatctcttttaaaaatgttgaaaaattcaatcaaaattaatttgaatggaacgcaacagaaaaagggacaaaaagagggaaagacaaaaaaaagaattattggcgggagggattaatgtgagaaagtgaagtgaaaagggaatgaatgataaaaaaggaggaagacatttttggattggagcatattttcataatcaattatcaaattgatgagcggttttggcaaattaatgggttaattagtcattcgggacgtgaccgggtgatcggtggccattcaatgctttgttagggtcccctccctccgtcccctctcttttttgtctctgtccctccgccaccgtttccgtcttccgcggcaccgccggcgctgctgctgttcgagtcgaaactcccatctcaaaaaacaaatgatcaattatttggcttctgtgttcgttcgtttgtcctttgccattttcacttttcacttactgactcggggccaatggtccaacaaaagtcgcaatgctttggccgcgtgttgggcgttgagcagcgaattcgcaggattggaaagggacgcttttggggagacaaaaggcaaagaaacgggcggagaatttggaggaggggaggaagagcaaaaaagctgaaaaggacggggacaattgaaacgaattcaaagggaatggcataaattgngaaattaaacacggagaattttggcataccaaagggccgaaaacgacgctcagcttttgcgctgtcagtccgttgtgcggttcggaagcgagcaaagtgcggaaatgggccatcagaaaaaccaacgaattctgcaaaacatttgggataatgccaacgaactgcttgcaaaagtgcccttctcttctcactttgttcggcgtcgccaaacagtccacaattcgcatcaccaacttttggttttcctgaaaaacgaatgattgaatgagtcggcacaatgcttttcccgtttttgcctctttgtcgatagatggcatcacagaagcggcgtccaaaagcattgagtaaatgttaaagggcaccaaaggctcgggcagttcccgcagaaagtccttgaaatgcaatcattcgacactttccctgcacttttgcgcctcattttccatggcactttctctcaattcggcccattcccccccccccccccctcctctcccctcaccttcaccaaacatgtcaaaatgttcgggtcgggcaccggccgttcgccaatgtccgtctccgcgctgttcttctccaattgcattcgcaaaggcaacttccgttcagtggccccacaaactgaatccgaaatgccctcattgtcatctgttacatcccccgaaattagttggcacttacgaaagtaaaggccggcggtgtcgacgccgcgcctctccaattcggtcgccagtcgattcagtaccacggggactaaacagagaaagtgaacaactatccatccatccaccgaccaaaaccttcaacattttcgtgctccaccaaccaattcaacgaccgaccaaaaacgccgctgcaatcggcggaagggcgacgaattcggcaaaaagagtgggccaagtcggaaaaagcgacctttgctcggaagggcaaagtcatttcatttggggactgatcagtgatcgaacggaagcaccttcaacagaagctgaccccgggactccaattggagagtgaacatccgatcggtgccgaacccttccaccagaaaagcgtccatcagacgaatgtcgcccttgtggcagaaacgatgcctaagggaacaaacaaacaaaatgccattaattaattaattagctagctaattagttaagaaaccaatgaacattatttgcaaattgcacttgtttattgttagctccaaaaaaactcaccgaagtttgggatgccaagcgtaaatgaagaaggacgcgttggttgcgttcagaatatcaatgtcaaattgttcggcccatctgaaaaaacataaaaacgattaaccaaagttaaacaaatttgggaagagcatcggttggctgtcacctgaagtgctgttcgggcgttgaaatgcccgtccgcgccctgtgctgctcgtccacctccaacacgcagtacaactgcttggagtggacgcggtccggcactttcaaattgcgaccctcgacgatcttaaagaagcgaacgaaggaaaatatttaatttatttgtcatgcagatgtcaaaagaatctgatcaaatcagattgacatttggaatgccgaaaaatgtccattttggccactgaccgtaacactgagaattccgctcaacgaattggccacgctcaatccgtccacgtcgaagccgggcccagcagtacgcaaagggacgcggcgattggtcaatggagagacgtggagacggtccaaaatgtcctaagggaaggtagataaagccgagttcggatttaatgggaaaataaaatgctgccctttcgccccaaaggcttcatcttcccccccccccaaattggccaatgtttggcactgcttggccaccttgcccatgccgtaccgccttttccgcggggctcatccgttccgcccttgaaaatgggttttgtgccgattgttcgaaattgttttgggcgtgtcccatgaaatgcttaaacatgatcagactcggttaattcttggtttttgatgtacattcacattgtccatgagaatggctttcggcgggagtgagtttgacctcgtctgtgcccccattcggcccgccgttcccgtccaccgcgtccgacgacgccctcccgcgaaatgatcgcgactgacgtcatcctcgtcctaattacccactttgaaatgattttgttccttatgtgtgctttggtccaacttcgctcgcccaatttcgatattctttggccgagaaaatgtccgccaccgttcgtcccgtgccgcccaccaccgccccgttgncacatcgaaggcacagtccgtcctatttttgtactcaaacaaatccaaaaatgattccctctcctcactttgtcgtccgacttcgatgtcggaaaaggcaccgcccgacggaagcgaaggaacgcgcggattggcgtagaaaggcagcgaagcggcgggggcattcgacggacgggcgaaggacgccgacgggacaatgtcggcacgccctgcgggaaattgaaaaagtttaacggaattggaaaaaattggggtaatattggcagaaagagggcaaaatgaagggaatatgcgcttacagcgaatgtttgcggaattaagcggagcaaatgagtcgggttggatctttctgaagagaaaggagcaaattgaagggtgagtccatgcgaatgttcttcacctcctcggcaatgaattgcttttcgattgggcccacccaaaaggcgccgtttcgttttgagccaacggaaagggccgaagcattgagagactgaacaaagagatgatcgtagtcaaaagcacaggtgatgaggggaattacggtgcattttgttgggtgaaatgcga

SEQ ID NO: 11525 - DNA, 1284 bp, Heterodera glycines
atattacaattatttccctctcttaaccaaatttaacactaccatttttttcacaaactcttcactacaattcacccaaatgttttaagaactctttgattgtatacaacagaagtcggtaatagtgtactttgtacctccccccttttttttgaaaaagaaaattttcaaaaaaaattttcgaaacaaagttgttttatgggttttcagggtcggagaatcagattctgatatctatttaaatgactttttttaaatatatgaaacgaagttaaagtcattagtagggtttgtaattatatgcacatgcatatttttttcctggaacgtgggaggtctgaaatgcacgaaaaacatgtttttagcttgttttgaagcttctaggatgactttccatatgcatatttgtgcatattttggcatttcgtgcatattttggcatttttccaaaaaacctctaatagaacggccccaaacagacaaattggcttgaattttcgactttttgttcgaattcgggtccgggattcggaattgggcaaattcgagtgatccccattctttacgattgccatttttaaaagttgttttagtatttctaaattttccagtaaccctgcagaaacccgggaaggtgttttgacgaaatcaacccactcacaacacataaagaattagtttattcatatatgtaggaaatgtacaatagtgcgtcgcaataacatacaaaatacacagagaggcaactcagggccaagtgatatatgcatatacaattatacatggaggcaacttgggccaaatgatttacaaacatcctcttttaatacaacaggcagcacagttcgttcttcggaggtgtgcacgaatcgccatcccattcgttcctcattcctgcgcgtcgcggtatctccaggcgtcggtcggcgtaccagtcccaacgcgttgaaaatggcgcggcctccactggggtctccgttgttctttgcgtcgcctgtcctcgtcccgctggtgttgctcgatgaagcgcttgactgaaaaacaaggggaaaactaattaattcataattccaaattcctccctcccctcccaccttggttcgccatttttgtgtcgttgaagtacagagcagcggtgagatgacgccacaattttcggctttcgttgttcttctggtccagcaccttgacacattcctgtggaaattagaaattggtgcattgaaattcatttttatttgggcattttctcacctttgtcacgtcgcacttcgcccgcacatt

SEQ ID NO: 11526 - DNA, 1183 bp, Heterodera glycines
gacgtaaaaggcggagatgggcggatgatggctgacttgctcgccgatgaacgtcatctgaaacgtgggaacaaatgttagatttctcaatgagtgacgaggctatcacttaaactggacctggttggttgctgagcccgggaacggtccaccggcggttcggcttgcggacaacggcacgccaggcagggtccaacggcaacggaacacttcgcctaggatcggattgtacggcttcttcgcgtcgtcggttttgcgtgcagggtagaaggagttcaagtagtatttgaggacggcaaggaatctgaaaaattgttgattcaaaagcgttgtcgtcaaccaatcgggaataaacaccgcttctcagccgtgttctcgtaggcgccggcgatcagttcatcaggatgagctgaaatgaggtaagattgaacttggaaaaatttaaaaaagctgtgttcaccgaagaagtcggcgtacatttcgaggagagagcgtcgttccagcacgaaggtgggcagcgccaaattctgcagagtctgaccggtgccgagctgaaaagagaatttctattaaaacaattcatcgaacaacgcgtcgtctacctggcccactaaatgtctgaacacgccggcctgctcgctgttccagttgtcccgttcgtccgagttgttgtagatgtagtcgtagtcggttccgttggtgtcgtagttgccccaatctggcgcttgcattttgaaatccgctgccgctaaaaattgaaggggaaaggaaatcattagaattgatttgaagactatgaacaaaaacaactaaaaaaaagaagaaaaattttaagaaaagaaattgtggaggtggagaagagaaatcaacacttttatacagaaaatccgactgaactcagtgtttctctattaacagagacaaaaaaaaatagtacgccaaaatgggagatgtatttttctctgcactctctttttattgacacatgtctcgttttttgagtcggtgtgtttatgtgattgacaaaaaaaatatttgtaagagttatgggcgaaaacggtttgccgggctaaaacgacgccctactaaaacaacttaaactgagccggtccgaaactgtacaagtaccaaagtcgtcgtttttatgactttttaatttatatttcttttagaaacaaaaaaa

SEQ ID NO: 11527 - DNA, 2002 bp, Heterodera glycines
agattttgtaaaatcactgattttatctttgatttttcatcaagtacttgatttttttcgaaaactttaaaaaaattaatcaggcgtaaaaaactcatatagaaatttgtagagctgaaaaagagctttcgaatgagctattgaatgtttggagaagttaagtttttaattttttgcgattttttaaaatttaattactggccattacgggtcatgtgagatggggtctcgggttcgagcctgcttggcagcagtttatttttttgtgagaattgatgaaaaatcatagacaaaatgatggtttttgcaaaatctgagttcatattcgtgattagaacatttttagacacaaattcttgtaaagaaaatttaaaaaattttgaaaaaaatcaagtacttgatgaaaaatcaaagataaaaatcagtgattttataaaatctgagctcagatttgtaatcagcacattttttcaccccaggagaaaccaaaagaaaatttttaagtttattttccgtcgggaccgcaattctacacctttgccggggggcgggaccccagctgcactattaacctgaactgattttacttatatcagtttaaatataatttacaacaaatttaaaggataaatatgacaaaatcggatgtgagcactggaatggttcttttaaccggcaattcacacccagagttggcccgtcttacatcagagttggctttttgatttcttaattgaaaaccacttccctttcagccgtcttggaattgctcttggtgatacaacaatttacaacaaacctaacaaaggtattagccttacaaaaagcacaaaagaattttagcaaatagtaaaggtattcagaaaaaacttaaaaattttgactttttcgcaattttcatgttgagtcgccgaagcgatacagacccatgttgattctgccatttttttttcaattttgccaaaaaaaaacctaatcttaaatttagaaacttcggtggatatcagacagagtgtgcgtggaaagcatgtgtttatcttgcagtcctctaataagttggcactttttcatttcttttcaatttaaagttcagaaatgtcaacaactgtgtcatggaaatgcttattttgatttatgcatgcaaaacttcgatggcaaagtttccctctttttaaaacatttttttttgttaaaattcagatcaattaccgtcataatgccgtatatgccctacagcaagcagtgccgaatgtttcgtcggtcgtcagtgccaatgaaacttgtcgctgatatggtctgcaaagctggtaagaatttaccaacaatttttaaaatgttttaaatttccataaactattttatcctaaggagcgtctcgaattgtttcacttgacttataccgcaaggaaattcaaggcttttttagcattcctgtggataatcttcgcgcgtctccttttttgcttcaatacatgaaatacaatgtttgttggggcctgggccaaaattttgagtattctaaacattagctgattgagagttaaaattctgggtttttgggatagagcatggcatgacgtttcgatactaagagtccattccctactcggcttctattggaaagcattttaactttttgttttcctttttattagattcccgactacaaaaatgcggtaattgttgctaaaacgcccggagtcatgaacaaagcgacatcatacagcgagagactgagaattggcatgatatgacgtcatctgttttcatttgttttttcgtttttaaaggcattgctgtaattcacggtgaggagaaaactgacgagggagtccaggaggatggacggcaaagtccgccgccatcgccgacggacaaacgaaaaggcgtttcatacgaactttttccatgtgagtttaagagactggtgaagttctgtaatattttgcttaactaaaaatttttttgcttgcccattaggttttttctgcgtttatctatt

SEQ ID NO: 11528 - DNA, 5247 bp, Heterodera glycines
atgacattaatttgggcttattaatcaactttggcgatagttataaaatgatagcttttgaattttatcaaaaaccataggggggacccttttgttttgtaaatttttttttggataaaaatcgtgaatatacattttattcaccataattgtgctgttaatacttaatattcatcattatgtgtaaaaaaaacaaaaaaaaattttgaccaaaaaaaagttgaaaaaattttcaaaatggacctctttttaagtagcgccggaattttttttgaaggtttttgccaaccaaattggataatcttggtatctttcgaaagctcttgataatgagttgttccaaatttgtttctctatcgatatgcaaaatttggtgcgtatttaatgtgcaggaaaaaagttaaacgtcacgaagtgaatgttgtttttcctaataatgaaaatagtagatagtacgccaaaaggagacaaaaaattagagaaaaaaagataatgtttttctctggcactctctatttattggtacacatctcgttttttcggacggtgtgtccataaacttaaaagtagggttcggacaaacccccgtcttcgggggcgagacatttggtcacccccgcgactctgacccccgcccccgcgaaaagtcacccccgcccacggggtccgaaccctaatttaaatgcaacagaaggcatatacacaaaacgactgaccattatttaaaataaacatcgctagtaacaacacatttttacacggagacggattctacaaaaattttcacacaaaaaaagaggcaaagaaaatcgctatttgttttttgtcattttgatcactcattccgctgatcacttctaatatcattgcgcagctttggcggcggcggccaattgctgggcttcgatatgaggcggcggaattgggaaaaactcttttgcatagtccgcatcacctgaagcagatttaggttaagttttaaaattatggtacagatagttgcgcgcgggtgcaagcgtgaacaattgttagagaaggaagtaattattgattaggtgtatgaccccacgccacttcgccatcttcaccctcccattcccctcattcagttattgtgcccaccaatttgacctctccaatttatttctgcatttttatttatttatttcttcggcaaataaacttatttaatttgttatcttcggacataacaaattttggcgcagtcagcaattaactgcacatcaccggcaaagcaacaattcaagctttatctcgtgctgatattgctcgtgttgaaaattagaaatctcgtgttgatttctaattttcgcagatcaaaaaaaaaaacaaaacttttctctccgtgtaagattaaagtctgccgtgtgcagtttttcttcaattggaccatggacgcgcaacagcttcaacaattgctaaatgctctccagcaaatggtcacaaatgccgcaccgcaaaacgccacaccagcaaatttgagcaatgccaatttggcaagctccatcgatgctcgcctttcagcgttccattacaatccggaggtcggcacaacttttgaatgctggttcaaacggtacggaaaattgatcgaggacgacggaagcactctgcctgaggcctcaaaagtgcgactccttctcggcaaacttggagaggaggagtacaacaaataccgggacacgatcagccccacacagccggaccaagtgaattggaatgacaccatttcgcacctcaaaagcctttttgctgaaacccgctcgctgttcgtccgtcgctacgagtgtttcaaaattcgacagcaacaaggacaagatgtttcatcactaattgcgcagatcaacgcatcatgtgaaaatgccgatctgagtctgacaaaggaacaactcaagtgcattattttgatcatcgcgctcaacgatgaacatcacgatttgcgacaaaaggcactgaaaatgttggaggacgctcagaaaaatggcaccaacatttcactcaagaaaattgaggaggagttaagggcaattcaacttgtcaaagagagcgcactttcgctggtcaacccgccaattgccaccaacgccattaacacaaggccgcggcaatggaccgacccagcgcaaagacaaagtggctccaatcaacggcaacatcacaatgcaaattcaaatggaaagcaaacacgtggtcgcccaacgcttccgtgtgcatcatgtggcaaatccgaccattggcgctccgattgctcattcaaggacgccatttgcctcaagtgcaacaaaaaagggcacatttcaacaatttgccgtcaaaaaaaagcaaagtcggcaccgaacaacaatcggtcattccacacagtcaaagtggacactcattgcctgcatattagcactactcaaggccgatggtggaaattaatcattttgattaatggaaggcaaacttccatgaatggcgacacctgcgctcaagccacagtcatttctttgcaaacatggcgagagttgggagaaccgaatttgactccatccgacatcgatgccaaaaactgcaatgatcagccattcgccttgcttggcaaattccaatgcaccgtccaattttccgacaaaccaccgcaaactctgatcgtctatgtgagcggagaagtcggacacaatttattgggattgccgtggatcgaagcttttgagataattccccgccaaattttatttccgaccaacaaaacggctgatcaggcgacaaaaatgatcgacaatttttcgacagtgaaaccgccaaacaaatcgatcaatgatgtggcgtcacttacagcggcacttcaaagtgatttctcggaagtttttgatcgcgttcttcaaattggcgcaattaagccaatcgatttcagtcattgggcagcgcctatcttagccgtaaaaaagaacggcaaaacgagagtctgcattgacttctcaactggcctcaacaacgcactggaattgaaccgccatccattgccaaggccggacgacatttacgcctcactgaatggcgcaaaattgttctcaaatttgaatttgcgcgatgcatagttgcaaatggatgaagaatccaagcaattgtggccatcaacacacatcgcggacttttccaatgccaacgcctgccattcggagtcaattcagcaccagcaatatttcagcatttgatggaccaaatttgtgctggtgtccctggagttttcgcgtacctcgacgatggattaatcgcgaccaaaaccctggatcaacacatcacgacactttacacaatttttggacgcataaaagaatatggtcttctcatccaactggacaaatgcatttgcagaccgaacttttgttcctttggcatattgtgtcagcaaatggcattcgtccatgcccatcgcgttcagacgcaattcggaaaatgcccgcaccaattgacaaaaacaccctccgatcgttcttgggagctttgaattatcatggaagatttgtgaaatgcatgcgcgaattgcgtgcaccgctcgacaaactcctccaaaatgacgtaatttggaattgaacgtccggccaacaaaatgcttttgaaaaagcaaagcaaatgatgatgtctgatttttgctgactcactacgtcccggcacgcacaatcgtcgtatcagcagattcgtccaaggatggcattggcgccacattaagccacacattccccgacaaaaaggaaaaagtggtggaacacgcagcgtgcactctgacagcagcgcagtaaaattacagtcaaattgaaaaagaggcattggattttggcaaattatgactttgaaattcgctcgtcaacaccacatcatttggccaagccgacgttctgtcacggcttatcgctaattatccacgtccagaggaggacatcctgatagcaaacacttgtgccgacaaagattgctatatcaattatgtttttgaaaacagaaaatggatcaactcccagtgacaacaaccttaatcactgcagcaatggtctatgatcaaccacttcaaacggttcttcaatttctaagaaacggatggcctgccaaagtcgtggattccgaaatcagtccatattttccaaaaaagggacaaaattttggaagtcgacaattgtctactgtatgaggacagagtgatcgtcccaacatcgcttcgcagtctcatcctaaaggcattgcacatcgcacacccaggcattgtgctcatgaaggcacttgctcgtcgccacgtgtattggccgggaatggactcagcgaatgaaaaagttgtgaacacatgcgaagagtggcaatcgggccagaaaaatccaacaaaagcacctctatcggcatgccaacaacggacatagttgtacataaagaatattgaaaataacaatttttaaattgatattatttcagttaataattttttaattatataaatattaaaatataaagtgcaaattctgtcttctcatatgctattgcaaaagaaaaaatgttatgagtatagcaaaaaattgaaaattaaaatagccaatattttcctaaaatttatggtcctgctcaattctaattcgaactttttattgtatacataaaactcatcaaaaaatagctaacaaaatcaaataaaaaaatatgataaattggagactgaatcaattattcaaagtccaaagtttcaagtgcctaattattttttaaaaaagcaaaataaactagcagtgaacttcaaaaaaattcaaatggtatagtaaattatattataatatagagagaaatttgaaccaaacaaagaaaagaaaattcgtagttccagaatctcactaataaaaccatttattaaaaagaataaaaattaaaaaaaaattaatacaataagaaaaaataatataatcaaaccaaactatttttgcaaataaacataataaaaaaattttatatctgaaaaagtttgaaaaatgacaaaaagtttgtgtatacaatagtacaaacgaataattgtataaggaatataattctaaaacccttactagaatttactagctaaaatggcaaaatatgcatgaaatatatgcatacaaatccaaaatatgcaaataaaagtcccgatttttatacgcaaacacaaaaaagaaagtattttcctactatttatagcatggagaagctaggaaaaaattatgcatttgcatattt

SEQ ID NO: 11529 - DNA, 1910 bp, Heterodera glycines
  misc_feature (5)..(5): n is a, c, g, or t
tcgtnggtgagtcgatcccaaaaaaaaaactcagtgattgattggtcattttccggaagccgatcacaccactttcggggcaccaaaagtgcctgatccggaatccgtaccggcccggttaagaacaattttttgttcagtatttcaagggctatatcccaggccggtccggttcttgatccattcacttggagcccttcatgggtcgggcacatatgccggaggaccctcagcctcgcccccgaccctatcggtggccaacccaagctaagcgtgccggtaccagcggcttttttgtacagctcgatgagctctacaaaatggtatcaatggcgtccggctgtgtctactacaaatggagaaaattggcgagaagtgacgtgaaaaattgaaaaattaaaaaaatttgaaaatgacttgcgtcccgccgtacattagggttaaccggacggcaccgtgattttgtgaattgaataattaatttatttatttaattttatcaatcactgagtttttttttggattgacctagcaccgcatttgtcatttaggtttaaaaacggagacgaagcaatcgcatttttcaacgtcgacgcggtgtaccttaagcatgaacaccaaagggatgcgtacgattttcgggtgattcctccattttcccctccatcccaaatattcttttcgctttccttaattaattaagcatctccaagtcggacttagccgtcgcttcagggcactaaaaatttggtttgtgtttcgtgcgattggcattcagcgaattcaacaatttttgagaatggtgcgtcaaattgggaaagtcaaatttgcaacattttgcccattaattagcaaaacgaattggccaaaatgttcgccgatcttttgctcagagacgaccgtttcgagctgttcgtcccccagcgtttgggcttagtctgctttcggatgaaggtaatctttacaaaggaatcactctaagtgatcgcaatttgctaatgccattcccaatgccattgtcgggcaaaaagtgccgtggtagtttactgtatgtctagtgataaccctgccgtggttactgtaggacccacagttttttatcgtagctttgttcattgtcccttatgttgagactagcaatgaactgaacgagtcgctttatttggccattaacgacgatcgacgcgttcatttggtcgcttcattcactcactgcacttttttcctccgtttcgtcgtttgcagttcaaagacacgcgaaacgaacatcgaaaaagcggtcgaagtgatcagagaaatggctgacaaagtgacgacggtggaaaaagcaaacgaagcgacggaaagggacaaagcggcgaaagcattggcggacgatggaacggaagaaagtggcacactccgacggacaaatgggtgacaacggcacaaatgaaatgccatgaattaaagggttgattaattggagcttcataattctgccccataaattgatcacttaattttgttgtcttgcatttgatcaaatccctttaaaatatgaaaagaattttgttgttgaaaggattgttgggaattagacaccaaaaacaaacttttaatttttacaaacttttaatttttaatctcttagttgagagagagagagagagagagagtttgtaaggcagacactcttaacattttccaaattttgtgaatattctggaatttttagtaattcttatgaacagtgaggacaaacgacaaatttacggaagattttgtcagttatgatggtgctatgtcgttagtcaaaaaccatcaaaatgggcgttagtcaaaaaaccatcaaaatgaaaaatatcgatttttgggcgttagtaaaaaaaaaccatcaaaatgggcgttagtcaaaaaaccatcaaaat

SEQ ID NO: 11530 - DNA, 1916 bp, Heterodera glycines
  misc_feature (49)..(49): n is a, c, g, or t
tctagagtccaacaaaacaaaaccaaaatatttacgcactattattacntcgactaggttttttataaagttatttaaattttatttaaattcaacaacagataatttttaaatccaacaaagttaaattgtatttaaatttttttcaattcaacaaagagaaatcctaaagttgtcttttttgacagcgtagtacagaaacatttcgatttggccggtccgcgtgtgcctcttccgagttccttcgtgatctaaaaatttttctgtactaatttagctttttttaaataacctatgaaacaaatctcatcaagatttggcattttccaaatctccccaatctttttgaagaatttttaattatttttatttaactgacatcttccatttttggttttgttttgttgatgatagtttggcattaattaataatcagtgcggcaaatattttggaagtggttggcattaattgagtgttgcatgcatataggccataatcgtatagtgtataattattttgatggttttttgactaacgcccattttgatggttttttgactaacgcccaaaaatcgatatttttcattttgatgggttttttgactaacgtcccgtcaccgtctatgatggacgacaattcacacgacagagacaagcgacataattttttgtagtaacgactattcggacacaactgccaaatttgtcgttcgtaattgtgattagcccgtgatcctgcggatttaatccggcaaaatccgcaatttccaaaaaaagcaggattgtcgagtgggatcccgcaaaatcgcgcgcgggatcccgtcctccgtcgggctctaatggaattagcattaggtattttttagaagtgaatttttgtagattgtgtatattttttgcgagacatataatttaaaactttttcagatagtttattacagtgtctttacagtaccgtttatatgcaaaactaaagccatttgtatgtaaattgataaacacaaattagacggattaattttggttaatttttcggacattcattcattttttcacaaatcttctcccagtgtgacaatttcgttgatcaaaaagtccaaatcgatctcctaaattagtttttttataattttcaatccatttattagtattaaattgatttactcgaattgccgggtttgagatgatcattcggaagaagttcggacgttgtttgtcaggttggtagccaacctaagaaaatcatgaaggattattatcacgaattcgattctttcatgaaaactaatccaaaatgaacaatgaagagtttgacattttgaaacaaaaatggacctattactagagaggatgaggctctaacaataagatgaattcttccaaagttttgaaaaagggtccggcggaacaaatttttgaaaatttttaagcattgggggctgtctgggaaaaaatttagttaattacaattttggagcaatagttgagactttgaaaattttcttaacaaaattcattaaaaatccccaaaaaaaattttcccggcggcgcctgtcggcaccttcggcccccccaaaactcttaatttcttttaaaaaatagactcataatcacaaaaattggtcattttggacaaatctgttaacaaagaagaactaaattttaaaaattttcccgacggcgcctgttgatgccgccgggccactctgttctcccaaagtaacgaatacgaaacgaaaatttaatttaaaaattttatgaatgtttcaaccgttgttgtgccacgttccatcgttcgagctttgatttttggtgccacctttaaagaaaattattaaataaaaaataaataaataatcgttttttaccttcgcgggggcgcgccgtcttttctttgttgtcaatttgtttacgt

SEQ ID NO: 11531 - DNA, 1535 bp, Heterodera glycines
  misc_feature (1524)..(1524): n is a, c, g, or t
ttacacttgaaaagactattttagtggaaatttttgacatcttctctatttttttaatatttttttgaagagacggtttccaaacctccggagcatattccaataaaggcctaatataagttttatataaggtaatccaaattttagaagatttagatttaattattctaaacaaggaacgctacataaataggcattcctcgttatttggttaaacatgatcggaaaattgtaatttattatcaatatttattcctaagtccctaattgtatccacagcatttattgtattcccatcacatttataagtttcttttgggttttttgaacccaaatataatacaaaagttttttgaattgaaacctttatttgcccattcgaataagttatgcaatgctttatgcataatttccgtttcagtttttgctttataacaaatatattttaacatcatcagcatataatttaatattcactcctgatggtatgacatcaggaaggtcgttaatatatataaggaataataaaggacccaggacagagccctgggggacaccagagcaaacttttttaacagaggataaagaatcccctattttaacgctaaaagcctgttaattaaaaatgcttttatccaatttagcaatttaccccgtataccaattttttccaacttatataaaagcaaattatgaggtaccgagtcaaatgcttttttaaagtcaatataaatacagtcaacttttttttccattaataattgcttcataccaatcttcgacaactgttattaattgattcgttgttgacctatttctaataaaaccaaattgggactctgaaattttattattttttaatagaaaattgtaaatatttttgctgaaaattctttccataactctgcatagtgagcaggttaaagaaataggcctataattttcaggattgaatttatccccttttttaaaaagaggaaagacaattgattccttccaaattatttcaaagggattgacattgtgtttttgaatgtatttaaaaatagaattttttccctttgaaatagccttatattcaattgatgccaataaatgttgtggatactttggagataagtctttttttagtaatttttttactggaatacactcattcaaggcattcaacaaagcgctattgaatgcacagtatttttcatttattattcacaattttaaaaataaaattttttttcaaaaaggggggcaaccatcagcagtattaccataagctgttgttgaggctttcagcaagtctaagaaataaataactaaagtaaatacaaattattttgtttttgctttttaattttttttttttttggcttgataggccgaaacacaatttgtgcatttattaattttggaagagccgtactgtcgagtagagcccgttctagacgggatcctgcgcgggattttgcgggatttatacatgcgggatcccgccctgcaaaatttttgagtatcaatccgcagcgngacccgcaaat

SEQ ID NO: 11532 - DNA, 3284 bp, Heterodera glycines
  misc_feature (3104)..(3104): n is a, c, g, or t
  misc_feature (3138)..(3138): n is a, c, g, or t
  misc_feature (3152)..(3152): n is a, c, g, or t
  misc_feature (3204)..(3204): n is a, c, g, or t
gtttgttattagagcccggcgcgggattttgcgggatcccagtccacaatccctcattttttgggaaatgcgggatttgcgggatttatacctgtgggatcccgtcccgcaaaattttgagttcaaatcccgcagcgggatccgcaaatctgacttttttgcgggattctgcgggatttcttgatttttaaaaattttaatgtacagaatgccaaatattttagaataaacttaataataaattcaatcaaattcaaaccatttttcatctaaagaaaatttattttaccttaatttaagctactatgagtcacccaatttttaaatcggtctttttaaacgaattcccgaaaattcggttgaatgtttgtagtgtaaagataaaaacgccagtaattttgctctaaaattatcacattggaacatcagtttattgtctctatgaatttttaaaatttacttttaaattttttcgaaatttacaaaatcccgcaatcccgcgcgggatcccgcaaattttaattgcgggatttatacatgcgggatcccgtcccgcaaaaatgttcagttccagtcccgcaacgggatccgcaaattcgaaatttccgggctctagttgggagcggtggggtcgatttagtcggatcggtttagtcctgtatttttaggtttttaaggcaaataaatactgagatgataacacaatttttaaagaagttcagaatctttttacattgtattcatagctattttttgtaaaatcaaagaaaaaaaagtttaaatccaattgcgtttattcaaagacaaattgttcttcagcatcgctttcttcgtctgtctcccgccggtctccaatttctcgttgttcttcacgttcctgaggtatgggaattttatttggaacccaattttcaccaaactgacccgcttcatttcgtcgagttttcctgtgtcgagaagccaatttgagacaaaagagagttccagcaattgacgcatttaatcttcaccaggcattgtcttccacagctgttccaaccgtctccacaccgaatgcaataatgcttcatctaaaaaaaatttacctataattttcaagtatttttatgaccctgctcgtccaaaaacgccaaaaattgatgtgtttggcgaacgacacgaaataattgaacagcaagtggacctttggcttctatgttgcggacctgctgtgaagagagatgatcgcttgttcctgctggacggacacgcacatggcgcctgatcggagtggtcgacaatggccttgggcttgaaagtggaccttaatcaaacttaccataaaaagggtgcttcataacttacgaaggccactagtcgatgatggtggtccactttcggcttcctcagtcgatgttcccggtgaatttcatcttctccaccaattttcttcactaattttcactcaaataggtaaatatgatcaacaatatatagcaattagtttttgcatggacaaaaaatttttttcgcgtggccgttttcgcgtgggccgttttcgcgtggccgttttcgcgtagccgttttaacgtggccgttttcgcgtggccgttttaacatggccgttttaacgtggccgttttcgcgtggccgttttcgcgtgggccgttttcgcgtggccgttttaacgtggccgttttcgcgtggccgttttaacgtggccgttttcgcgtggccgttttcgcgtgggccgttttcgcgtggttgcatataagagaattcttaactctgttatatttttccaaaatttgttcactctatttagcttcgggtgcttaattcaatctatatttacagtcattagccgtaggataaataatgatttatccttattatattgttttttgcaacgattgtttttcgcgttaatttaaaatattttgatgcttcatttaatttttcctttttattgttgtcttcgtgttctctcaagttttttatatattttttgtgtttttgaatcattgtaataaaactacaaaaatttggtgcttttctccgtggactgtcatccaacaacaacaaacgcccaaaggcttaattggtactgttgtttgagtttctaattgcaattcaccttattctctaattccttgccagtaaagtggtgttgaaaattaagtaaatctttccttgaccccaaaatctcaacccgaaccccagcaaatcccaaagtccctccccgaatatacgccctttctccaacgtggcgctcctgcaaaagcgacgtaaaatccaacctttcgacgccgaattgcaaaccgattttgtgcaggcgacatttgaaatttggtcaacaccaattttggaggatttttgttttgaattttttctttctccttttcatttcaaagtttagaaatgtatggagtcaaccggttttcagcaaagatataatttccgagtgcgccggccgattaattacatggaacaagaggaatcgtcgcattctcgccacagccgacgaaatggcactgaacaaaacaatggtttgaatttggcccctcaaaacattttggacaatgtgcaaaacccaaatccatttccgcgaaatttcgaaaacagtatccctcagcaagtgggagtgcaacaaaatgtcgaagaacaaatgcagctcgcaatgttccgacctcccaaccaaaatgctgcccaaagtttcggaaattcccgggctcattcaacccctcaaaatgtttcaccgcatatttcgtacaatggccaacaagaaaatttcgaacaaaaccaaaatcggaatccggatgcgaaccgatatggaaatcaccgccgccaaaatccccgaattttcgttaactcgcaaatggcgaacaaccatcagttttctgcacgaaattcccaaaattttgtaccaaatcagggaataagggcacaaccggttcggaatgctcataatcccgggtatggagaattaattggtgagcaaaatcgaaatgttcataatccaaattatggtcgagaaattgggatgaattaccccattcaaaatgtacgagattttggaaacggtccaaattttccaaattataatccggttcggaatatgaatncacaaaattatcagcaacaaccgaatccgaattntgaaaatatggcancccagcccaatcaattccaaccgttttttgcagaccgatttccgaatgctcnaaatttcgagtttgtccctcagcaaaatttccaacaaaatcaaattctgatattgtaatggaattacataaaagtactct

SEQ ID NO: 11533 - DNA, 4949 bp, Heterodera glycines
ttcacatcaatggaaaacaaatacaccgatttcgaagctaatggagatgcacatattctgtctcattagaaacatatacatgcatttgttaggtaaatttcaatatcatcataacatatagccaattatatgtcaaactagaatatatatttggtgaatttgctgtcgaaagagctaggtattttaggttagcaggcgagatattcaataggcgaaatgtccagtaggcgaagtgtcagtaggcgagatgtccagtaggcgaaacgtacgcacaccctttttgaaattttgcatgctaatagaaaacaactagagctattgaatgatataaagaagtaaaaatttggttgattttaagtaaagatattgaaaaaaattgctacaattgatggttttttgaccaacatcatagcaccgaccgaagaaacggcgagcagaaaaagggaatggcacagtgaattggaatggaacgcaacagaggagaggaggaccactaaagagaatatttttcaaaattatgaccatttgccgggcgttttaccttatccccccacccacaaatcaatcaatcaaataatcaattggacggatagagagagggaaaggatgaaaatagcattggggaaggaggagagacggaagagaaagagaggaaaaggaaaaattcgaagcaagaaggagggggagaaagaggaggaaaaggatgaaaatagcagtggggaaggaggagaaagagagagagagagaaaaaggaaaaattcgaagcaagatttttgccatttttatacgtccgatttatttaccaatttagacattattcatcaaaaaaggcatttgatcactgatgattatgaccggtcggtcattacttaattaattcatttcttcttctactgaccactgtttttgttcgtttgtccctcactcatttcgccctttgtgatgctttgtcccgcttcttcgtcttcacttgctggtggtggcggagacaaaggcctaaattaagcgcaaaattcaaattcggataaaaatcaaatgtttttaaattgctcacccgatgcaattagtgccactaaaaagccaaaagaacacattgttacaattgttgtcccaatttccgtctttccaattgaccgctgccgtctctccaattttgcagcgtttcattatccaacttttgtccaattcattttcatttgctttggccaatgtcagcttttcctttgtgcattcgttcaccaattcaaatggcaccatttccattgatggcacatgaacagaaaaatgaatttggtaactgacggaagaaatggcattggcacggagaaaatgctaaacaatttgaaaacaaaaatcagtgatttttcgagattatggccacacctccttgaaattgttgatccattcaaagttcccttgccaacaacgcaatcgcttgggttggccatcttttctcggagagtgcaaccatttggacaatgcttggccagcagaaattgttagacgcaaattgttttgctaaaaacggccaaaatatggactgaaaatgcaaaaatcgcgaaatatggatttattcccgaaaacccccaaaatatggatttatatggactaaaaactttcttcaaatcaaaaaattttaacgtagaaatgctatttttgagcccctttcttcatagcatatgcgcagaaaaaatatgcaaaagcatataatttataaccctaatgattattcatactacatttagttattttcgagatttttatgcttcaatttaacaaatttgaagaatttgtgaaaattttgcccccaatttggaaaaatttatgtgcatatttttcacttttatgcgcatagtttaagattttatgtgcatttaattaccagccctagtaatatcatgattcattttcagatttttatttaaaattttcttattttaaaaacaaagttgtgtcaaaatgtttccatcccttccatttttggcaataatttttcgtctcccattggcacattgtctaacccatcggtccattttcgtgccttttttcaatttttgatgcctattatatgtaaatagtccttttttcgcgattttttggtgcctttttagtcgtgtctacaaataactcattgaattaataatcaattcgaccagttcacgggaagcggttaaattctgaaaatggggtgtgtcctgattttaatgacaagcactgtactgttattggaactataaattgcgtatgaaaaacttcacaccctgaatttttctttttaattgatacataccagggatggcattccgaggccctaaaaattttcgaaaatcggaattccaaccccaaaaatgtcggaattccgtgccatccctggtacatacccatgggatgcatcgagaaagagagagaaaatttatattttaacggaaaacaacaacaaatcagagagtaaaaacgagcataaaaaatggtcagatcactcttattcatcaccataattcaaaatgatcgaacatttctcaaatgcattaaatcaccttcaaataattggacaccatttgcgacgtggcgacaaaggcctaaaaattcggcacaattttttaaacaaaatcaaatgcttttttgttgctcacccaatgccagcttcgacgtaataatgaaactcgacagtgctaaatccgtccaaattttgggctgcccattgaaccgccgccgtctcccaatattggcaccgtttcattacccagcggtcttcccaaacatttgcgcttgctttgatcagtgtcagcttttccttggtctgttcgttcgctaattcaaatggcacaatttgcgttgacggttgctgaacagtaaattgaatttggtagctgaccgaagaaatggcattggcacggagaaaatgctaaacaatgggaaaacggacggacattaattaaatgcaaacgaaatcagttggctaacgaaaatatggccacacctttttgagagtgttggcccattccatatttggtggctccttcaaaaagaaatgcaattgcttcggcatgccatcttttctcggactgtgcaaccattttgacaacatttggccagcagaaattgttgcatttggcccatcaaaatcatcatcaacagtcgcatcgggcaacaaatcaccggaatagattgaattcaattggtcgagatcggtgagaattgaaggcgaagtgagacgacgcaatttgtcaaaaaggatgccattgcaaacgcccaagtggcgaatgtttgccgaaaaaattggccaaatttcacgcataataacaccccaaactggctgctcatctgctgttgcaaacggaacagtcaagcgcaaattggtgactttgttccacacggcgattcaattttgggctccaagtacaattaccgtatttgctctttttatatgccagtctccattagtctgccagtctccaattatatacccccttctgagaaggttgaaaaataatataccatggtatataaaaagagcaaatacggtaagttggttttttcgtcttagtggtctgtgagttagtcaccaaaaggggggtcccaggttcaagtcctccctatgttgtgtgttaatttcaatttcttcttttaacggcataatttcgtgctgcgcaagaagacatcagtttgtcagaaaccgccgtccaactatgcagaagcggtggcaaaattcatcaattttgttgaacaaaggcgaaaggcgaagaacaattttcccggcggcatctttgcaatggacgagacggccgtttggttcgattgcccggacagccgatgtgtggacaataaaggcgcaaaggatgtaagtttttttagataaaatgaacctattctaacaaattaggtgacagttgtgaccacaggacatgacaaaatgcgggtgacggtgtgtcttacagcacggaataacggacaaaaactcaagccgtacgtgctggtcaacagaaagcgaccggtgccgcaaattgtcaaacaatttgctggaaaattagtgatcaatttcgctgggtcgatatggatgaatgatgacacaacggaggactacctgcacaaaatcatcggggcaaagctgtttgttggcgaacgcctcttggtttgggatgcgtttgggagctacaagagcgagagaacgaagaaagtggtgaagggattgggaatggaaacggtttttatccctggcggctgcaccaaattcatccaggtaacaaatcatccttctcaatgaaattcttttttcttccctaggctcccgatgtctcgtggaataagccgttcaaggagcgaattcgacacttctacagcatttggatgtccaatgaggcggaaaaggagttcacatcagcgggcaatccgaaggcacctgctcttcatgtggtacttgattggatccaccgatcatggcaggaaatctccaaagaagtgatcatcaaatcatttaagggtcagttaaaaaattaattcaggaaaaatgtctaaacttttaagtctgtgggctgactacgccattggacggaactgaagacgaaaaaattgcttgcttcaagccggaaggagcaattggaccgatagggataaaatttttgcgcaagtttaggataaatgaaacggcgaaagatggacgaaaacgatcacgaagaagacggcttatctgatgacgatgatgcagggctggatggagtcggagatgacgacgaattgttcattttttgagccccttttactgttgaatttattttaatttttttggaaaatgtgccaaataaattattaaaaaattctatttatccccccccccccgggcacataaatggagactggtatattatttttcaaccttctcagaagggggtatataattggagaccggcagggagactggcatataaaaagagtatatacggtacttgtat

SEQ ID NO: 11534 - DNA, 4637 bp, Heterodera glycines
aaaaaaaaaaaatttttttttttaatgaaaaattcgattttttcaaaaaatggcaattcgttttttcaccccccccccccccccctcgctactacatacaaaatgatgaattcttcaaaattagctgttcataattagtaacttcgctcatccctcgcgcgctgcttttaccgttaaaaattagaaccatcacgcatcgattttacacacatataaatgtattttttcggaatgttttaagccataaaaatagtgtgtaccaccatttcattattttattttttgttttatttaatattttattttttaatcctgtcgaatgtcgaactaggaattgacaaattatttggtcaatgactcacccctccctccccctaattgtttaggcctgcttgacggtgccgaactccgtctgcgcatgtccgacttggacctgcgccgggttgcccagtactgccgcaacttggccgacttggtactgatcagcgacctgttgcccaccattgccggtctgtacttcaccgcccaggtggacaccaaccggtccccgttggacctgtcccaggcgccgctgtactgctcggcgtaggcctgcagcgcaaaatggtcgaaacggtggccaacgaattggcactgtccgccagccaaacgcacgcgctgttgaacaaggcgatcagacggtgggtgagacggcggaggatcagggccaccaagatggatgaactgtgttcctgtccctacccccaaccgcatttcaattggttcctccaattcttggcaaaaaaaaatttaaaaatccaaaattctttagaaaattattcgagaattttttgccgaaattcctaattataagaaatttttaaatttaaaaaatttgcaatcctacaaaaaaaatttaaaaaaaaaatattctaaattcttaggaacaaattttatattgataaaatttccaatttaccaaatttcaagggctattattgcttttttggattctaattttgggtttttttcagtttgtccgaatatttcgactcaatttgccgtgaggcacttgaacacaacacaatgccaatgatcgccaacaacaaacagaagcagcaacagaatcagaaggaaaattggtggcaaaaacgaaaagcgacgaatgcccggcgatcaaaaaattgaaaatttcacactttgtcaaatgatacagtttttttttgttcttgttgtttttatttgttgaagggagaatttgaaaggctttgcagttcaatataattatctccaaatcaagaaatatgagataaaaaaatttagaaattttagtgtttaatgggaaaaaaatctttaaaaattcaaaaagaatttgagcattcaaaacattacattcataactatggctaaatgcacaaaaacccaaaataagcgcagcagatccgaaccgggtcaactccgtcccgccaactccgtcccgccaactccgtcccgccaactccgtcccgaccaactccgtcccagccaactccgtcccgccaactccgtcccaggccaactccgtcccgagccaactccgtcccgagccaactccgtcccgccaactccgtcccaatacaaaaaaggcccaggccaactccgtcccgagccaactccgtcccgccaactccgaaccgggccaactccgtcccgccaactccgtcccaggccaactccgtcccaggccaactccgtcccgccaactccgtcccgccaactccgtcccaagcaaaaattcaagaattttttaaaaataaatttgagtttatgaacaattcataagtagagaccggatttttatgtttttacatatttttttgcggcttagttatggcgagagaagcccaaaaatagcattatctccgaacaatttttgattttagcacataaaaatccggtctctattcataagtcttgatttcaatgaccgatttagtttttatttatgcaagttcctaatttgtgaaagaaaaacttttaaacaatgacaacttttattttcagggctcccaagtgtgcttatttctaagatttgtgcttattttgaggggccggatcttagaaacctaaaatatgcttatttctaagatttgtgcttatttcagcattacgtgcttattttgggatttgaaaataaaaaatgcaaaatttgcgtgcggacaaaatcccgccccgacaaaatcccgcctcagccaaaaacgacaaaatcccgcctccacctaaaagcgacaacacattttcgtacgagttcttgtacaagcgtcagattcaaatagaaaaacttaagaactaataaagccaaaatttatcattttttgtttcccattcataaaattttgttaaactcaaatttatttttaaaaaaattcttgaatttttgcttgggacggagttggccttttttgtattgggacggagttggcgggacggagttgcgggacggagttggctcccgacggagttggcctgggacggagttggcgggacggagttggcgggacggagttgacccgcttcgcatctgctgcgcttattttgggtttttgtgcatttagccatagttatgaatgtaatgttttgaatgctcaaattctttttgaatttttaaagatttttttcccattaaacactaaaatttctaaatttttttatctcatatttcttgatttggagataattatattgaactgcaaagcctttcaaattctcccttcaacaaataaaaacaacaagaacaaaaaaaattgtatcatttgacaaaatgtgaaattttcaattttttgatcgccgggcattcgtcgcttttcgtttttgccaccaattttccttctgattctgttgctatgtgttgttggcggtcattggcattgtgttgttgtactcggcgtgttgtcgttggtcgaaaaagcggtgcttgaggccgtcgtctcaagatgtaatacatcaagagacgggcggacctcccgttgccatccaaaaatggatgtatatacacctgaaaagagggagtaagtgatcgactataaaaagggttacacgggtccgcttgaggttccgagcaagcgataagaattaatatttttcgctgcactcaatttaaaatttttacaccgccggtgcaccataattcctttttttaaattattctaaaaccatgaaagcattaagaattgacaattggagtagagagagagagagagatgatagagagaaacaatgagtgatagatagggttagatatatgcttttgcatattttttctacgaatatgctatgaagaagggctcaaaaaaagcttttttacgttaaaattttttgatttggtgtatgtttttagtgcctataacagcatatttttgggggtttcgagaataaatgcatattttgccatttttaggtttttacagcattttcggccatttttaaaaaattgtcacaaggaaaacgcaaaaaaagcgaattaaaatttagaaaaaatttgtttatataaaaataattttgttttagcaaatagtaaaattttaaaaactcgaattgcatatatataaatttcgaaaatcaaaattttttacaattgtcaaaaaggcttcttatttgttagctgttttggtgtttttgaagataatagacaattgagaatttttacacaatttttggctttttggatggttaaaaaacattttgacgatttttagtgcaaatttgggcattttaagggttttgagggcatatttgagtgattttagtgcatatttatgcgcatatttggcattttttgtgcatattatttttacccctagtgatagatggaggaaaataaatgtagatagagaaatagcaaatgctttcaaagaaaatgagaaataacaccaaagaaaaacatagagagggagagagagaaaagaaagagaaaaagagagagacgaagaaaaggtataagagagacgttgaaggtgagaaagaaagaaagaaagcgaagaacactgggatagcgagagacagtgatataaaataatcgcagaaataggcttttcctttttttattattggaataaatgaaacttgccatcctaatatggtatttcgcagcaacaacaacagcatcagaacccggcgcctcgagctccacgttgagtcgcctgatgaactcgcgaagttcagtccacacttgcggacctacggtgcatcgtctgccagcaattgtcatcccgccgtgtcgccgaatgaagcccccggctctggggttttgcagcacaagtgcctcggagttaatttccatgagtgtctaaaacatcaatgaattgatgctgcttaggtaccaaatttaaatggaaaaatatttgattttttccatcggagaatagtcgggaaggtgacttcgttatccgttatcgaatccccccccccttggaaatttgatatgaatgatatctcattaataacatatttagtcaatgtttatttcaaaccaaccaagctagttattggaccaggttgtagtttgccaaacaccccgatatatgactcgtcttcgtcaaagtatgttgacgggtaccgagtcatattacgggcacttaggaagtctctctgaagagatgcttggaattccatgtcggaaa

SEQ ID NO: 11535 - DNA, 4039 bp, Heterodera glycines
  misc_feature (48)..(48): n is a, c, g, or t
  misc_feature (4029)..(4030): n is a, c, g, or t
cctaaagtgggcaaaaataggtctgtcttggacaaaacgaatcacatnttcggacgacacagcgcacgaaactttgttttgtttttttctgccatttaaatataaatgatcggaattgcgttttttgctaacaaaatttccgtccattttcatcaattttgcagatacgtcgatttggatgtcattgcctttctgaaccgaatccaaaggttgctccaagatggtgagatgactttgcgcgttcggatcttccaccatcagcgacgcagcttgcaaattttctgcgcccaaatttggccactcatcaacaaaaacatcgtcaccgccgttgtctacccatcgatttggctcccaccgctccagcaggacaacgcgcaacaacaaaccacgctcaacgacctgcccaatctgaaattgctggagtactgtgacgtatcgcccagccaggaggtgatcgattggctgcacaattcgagcgcggacggacggccgaaggcggtgcgctgcgggttacctcgtcaaatggtcgacgaactccgagcggtacagttttgttgaacatagccaattctgttgattttctatgcttgttgttcatttttggcaatgctgcactccttttgcaatttttttttgtcacagacccccccccccccctctaatttgattacaaatgttttttaatgtttatgttgatcggaatacagtgggcccttttttggaaaaaaatatacccaatatagacgctaactcaaattccaagtttaaaattcaaatagattttcttgaaatttaaatggaacagtcaagaaatatgacttcaaacatgtaaaaaaatcactaggtccttttttagcgatttgttgctgcatcatcgccgacaattttcattgttttggtccattgtttgcaccccattgaacgcttccaaatcgacaacgatgtgaccaatgagcgaatggaattgcaactgttggagaatgcccgccccaacaccactgaactccatcatcggcgattgttggtgcgatgtccgatcggccgaaacgaggaacagtgggcgcaattcgaggaaaatgctcaaaattggaagttggccgagcagccgttcctgttcattgagctcgacgacaggcatcttggcgaagagtaggcagaaaatggagccctgactcttctaattgttttaacacatgcattttttgtagcatcacaaatgagggaggcgaaggcacgagtaaccaatgagagcgatgtaagagaatggcggggggacgacgacttttttttttaccttttgatcaaatctctttttttcattctcgagaattcatttctatttcaaacatagcataaaaatatcttattttttgaagtaataacgttaaatacatgaaaaatatttaaatgtatgtataatgccattattttcttgtaaaacaaaaaacaagttctaagtccagcccccaaaacccgcatattaatcctgcttgatcccttacagtaaaaattttgagttccaatccgcagtggctgggactcgcgaatttgaaatttcaggactcatatatatatactagagtccggcggaggcgggagtcccgcgggggtttacgggagtcccgctcccgactcccgtacttttttgcccaactggatttttacgggagcgggagttttacgggattcccgctcccataaattttgacccaaacacgggagtaaaaatacactggtaagaattgagttttttggtaaaactattaatttttgatgaaaatctgttaatatatagccaaaatttcaagaaattttcccgccggacccttaaaagccttaattttcttaaaaaagctagctcaaatttgcaaaaattggtcatttttggacaaaatctgaacaatggtattgtcttcaaatattcaattttttttttcccggcggcgcctatcggcaccgccagccaccctcctcctccctggtccccaaaaagttttttttcaaaagataagctgcaaaaagttgtttaaattaataaaggaagtcgaaaatataaaattaataaaaaataatttgttattattttttacctgtctctaatatgtacatactaaataaagtacacttttgaccattgaaagtagtgctttatattgccattcttcaaattaaacttttgctaaaattccatggacgaatcggcgaaaaagacgctaaaacaatattccacttcttaagacaaatgcaggaccaaggtaaataaacaaaaagtttacgtatattaaagtccaaaaatgagttaggaaagtgaccgacaaatttcgtctcgagactgccaaaaaaaatttttctggttttggataggaaactcacgataatttattttattaacccaaatatctctgcaaatttttttgatattgctagagacggacccctttggcttgaacggttgaaggaggagtacaacagtttgatcgcgttcattgagcacaacaagcagggcgatgccgactggtttcgacttgagtcgagcgcggatggcactcgatggtcagtgaatttggcatgtaaattggtgatgattgttaactttgtcttcccccccctttcttacaaaaatgtttcattttttcatgaaatccttgggtttccgggatcgctgagctcgaaaacgacattgattttgtcggacggatttttcgaatttaattttggtgtgaaagcggtttatataatgctgaaagcatttttcgaccttcgtccgtttgtccgttggcactctttcccttgactaaacatttgtgtctatgcccaaaaatggtgtcaaatttagggccgcttttcaaatccgggaacaaatttttagctacctatgcgcctgtttatccttttttaaagattgaaaaaacacaaattttgaatccaattttaaacatagaaagcaaatgtcgggtggtaaatgtccatgagcggcatttttttggcattaaaatttaatttccgtatgttaattctacctattgctgagagatttttgtacggatttggagtgccccaataccatttaattttgcgggcgcgaatttgagggactttggacaaactatcgccaaatagtcacattttcggttccatgtatttttggcccacccaaaaaatctatataagattagaagtctaaaattcaagcgaatgtttataaagttagatgtaacagtcctaaaaaatgtggattagaaaagcacttttttagcgatttgttgctgcatcatcgccgacaattttcatcattgtgttccaatgtttgcaccccattgaacgcttccaaatctacaacgatgtgaccaatgagcgaatggaattgcaacagttgccggatgccgacccccgcaccactgaactccatcatcggcgattgttgatgcgatgtccggtcgaccgaaacgaggaacagtgggcgcaattcgaggaaaatgctcaaaattggaagttggccgagcacccgtgcctgttcattgagctcaacgacaggcatcttggcgatgagtaggcagaaaatagagtccttactcttctaattgttttaacacatgcattttttgtagcatcacaaatgagggcgaaggcacgattcaatgagctgttcaaaattttccacataaatgggcttcatccgatcagtctgttccgattcgtcgtcaatggctaattgcagttccggtttgtcaatgcgtaattgctgccattccattcgattgtcctccgacatgacaacatatttcattgttgctgctttcgctgcagcgactttttctggcagtcctccaacgccatgaatttttcgccgtcactcaaatccaccagcaccacagtgtcagcgaaacaaaggcggttgcttgcgagtccaaacacggcgcaaaagacggcaccggagcccgaactgccggccactaaatcagtttctggttcaattcgcaacttgactccgtaatggacaaaaaaattgtcggttgtcgccgaatcaannatgcaagac

SEQ ID NO: 11536 - DNA, 804 bp, Heterodera glycines
  misc_feature (792)..(792): n is a, c, g, or t
atgtattataaaataatgataggtaaatagaatttactttgagtcttgttccatttttgaaattctacaaaaatacgtaaaaagtgttagacattcgaactcagaaggctgtgttgggttccagccagagtttttggattttaacttttttctatgtcatccaaatcaaacatttttgtatcattcgaaagttaatgtggaaaaagattcagtcaaggtgaaaggcttcaaacagtaaatgattgaatgaaatggaaaaaagcaaagtcaaactcttaaaagactagtgattgaatggaatggaatatttaaattatttacacaaacggaattctgacgcgtgcagaaccatccaattccttaccaaaaattctatttacctatcattattttataatagattacatattttattcaatcataaaactacttttaaatgcaaccaatcaacatcagaagagaagcattcctgcaagtaatgcggataatgcattaatttcattatttttcattcttgatttaagccgtaggggttgcactcatgaatgtagtacgtaccgcaagttccgtgcccatttggtcttccatcaccgagaagctccgctaaaaatcaatcgaagaggaaccgagtatccgggcgaatgtatcagtgtgcaaaggatgctgaacgagcaggacatcccgactgaaggcaaatatattttataaacttaaaaaagtcagattcatataggagagctttacactgtgaaagcgaaagttcaaagcccgggcagtgttcacattattcgnggaaaaaattcg

SEQ ID NO: 11537 - DNA, 1044 bp, Heterodera glycines
atttttaaattcaaatttaaaattttgaattcttttgtgattgtccagtaaaactattttagatgtagatgtgaaaaataaatgaataaatgttatttgtatttgttttattaatcttttcttttatctttttattttggttacctttaattattaaataaatgtcttctgaaatcgaaaacatcgtccccaatggcgcaatagatgaccatcagaaagaaatgaacaaattttcatggacattgaacgatttcgaaattgggaagccacttggaaagggcaaattcggcactgtttatttggcgcgggagcgagaaacgaaatatttaacggcactgaaagtgctgttcaagaaggacatggacaagcacggagtgtcgcatcagatgaagcgcgagatcgaaatccaataccatttgaggttggtggctgagttttgctggctctttccgtcttcgattccctttgctctcccccagttaataattgcttttatcctctcttagacaccctaacattcttcgtctttacggctatttctacgatgaagaccgcgtttacctttcgctcgaattcgcctcgcgtggctccgtctttcaacttcttcgcaagagcaaatgcttttcggtgccttactccgcccgtttgatttatcagcttgcggacgcattaatttactgccattcgaggtaaaatttagtgaaatttggtttaaatgaaaaagtttaggaatgttattcatcgggacattaaggtttgtgtgccgggcaaatggggttaaactcacaaacaaattcaatttaagtttatcagatcaggtttttgacaataggcttttttagtaataatagttttaagagttcaaaaatttccatcgacaccgtcggtcaataatttcatttgttttccaactcttaaaatgatcaccaaaattcttaagccggaaaatctgctgattaatactaacggagacctgaaaatcgcagactttggctggtcagtgcacgcgccttcctcaaagtgtgtatttgtgatttttgctct

SEQ ID NO: 11538 - DNA, 5328 bp, Heterodera glycines
cgcatgacaaattcgtcacgcttttgtctttgtctctttttgctgtaccttggcgtttacaaattcgttttaagaattattccttcccactcaattctttcgtccttattgctaggtcgacaattggtccgtgggcgtccttctatacgaatttctctcgggcagacctccgtttgatctcgaaaaacacgtggacactttgaacaccatcagaaaggtggggaaaatgaatttgagtgaccgtactcttttaaaaacttttttttttctgattttccattgcgcaattaaatttgggcaacggtttagagatcattggtgccgataattttctttttatttcgggaatattactaggggtaatctgaagcgctgagcacgaattggccgttggtcaatttcggacccagaatccggattcaaactttttcgtcaaaccataaaacaatatctttttatacaatgtttaaatgccatgcatttacaaagaaaacaaatttgaacggcattcttaaaaagggaatctttgagggtgcttttcactaatcagaaacttcgaatgaataagtgagtgcacaacatattcaggtggcctatcaattcgcgagttcgtttcccgtcggcgccagagacattgtgagcaaagtaaggaaggaatgaattggaaggactaaaaaccacgaggagaaggaccttttccaaaccaatgccatgccaaccgaaacttcctttcccctctttagctgcttgtcctcgaccagtccactcgcatgccattggaggagctgcagaagcacccgtggattgtggagaatatgcacaagagtcagtccaatgcgccatcggccgattccgcgaatccttcggaccacaaatcgtccacttcgtcataaaattaatgttcatttgtttggtgtgttggatttgttggtgcatttatctatttatgttgtcctcattttttatttttgctttttaaatatatcattaaaatttaaccgtcccaagagggcaaaatatgcattttgtaaataaaagttgagtttttataatgaaataagggctataaagcagggttcggaccggacaaaccctttccagggacgggtataccggtttccaaggacaaggggaaaattccataaaaatcaaggacatataaaaatttaatcgtatgtaaggaaaaatgattaaattttatatatttgcgccggaatgaatttttataaatattttttgattctggtcatttcctcacttcaccgcatattcatttttttagcggtgcgctttttccaaaaaatatctaggaacaggtgggtcaggctcaaggacgaaccgaaccctgatataaaatgatacttggacgaacagccaagtacagcatttttctcttccgccgagctcttctcttccttctcccttcccaacggcgctgctggtcacatcggaatgtcttagctgctcctgctgacactgttcttttcaatcacgatgccgttcgaatgtgtccccttgccccctcctccccttttctaaggcatttgaatttaattgaaggttggaattttcttagagaatgtaaacgatcctgtctcagtatttcaggtgatccccaaaatgttcaattaacagagttaaaattgacaaaaaaaaatttctgaacaaattaatagaagaaattttgattcatggtttacggaaaataaaaaaaacgataaaaatgaaataaaccaaacaaaacttaaaactaataaaataggaaaaaggaacagaaagagaaagaaccaggaagagaaccagaaaagaaaaaaaggtggaagagaaagaggaacataaagtggaagaggaagtgaaggagaaagaggacaggaaagatgaccagaaagtggaagagaaagataaagaggacaggaaagtgaaagaggaaaagaaacaggaagaggaacagaaagaggaagagaaagtggaagaggaagtggaagagaaagaggaacagaaacaggaagaaagaaagagcaggagaaaatggaagcgagagaggaagaggaatggaaagaggaagagcaaaagtaagagattttaagtggtcttattaaaagttagagtttaaaataaataattgaattcccgtccattaaaaaacccatttgccctcttataaagttttttggcgcggagcgccctatagagactgttaaatagcgaagctatttcaatttaaaaaaataaattaattcgtctttttcagtgcccgtagggcactggttttactatatttttgaaaaatggggaccaaatggcaatagatgtaattttttggcgaaaaacggcgcaatatttagtaaaatacaccccataattcgggatttcaaaaaacgaaatacactcccctaaaaaccgaatttttgaattcagcccccccccccccccgaagccaagggtctggctacgccctttgtcaacagtgagcttcactgccgaaaccttcagaaatttttgatttgcaattacaaaaacaaccgataaaatttatgaggaataaattttttaaattaatttgcacccctaattttcaagttttttgtgcatatttggtgcatattttgcgatttttgtgcatatttggtgcatatttcacgaatttatttgcatatttatgcgcatattttggtcacttttcgtgcatattttttgcagccctgattatgacaaatcacagtaatggttttcaattgttttcagggagatacctattgttaccagtatgtcatggtaacttacgatttggaatgcgacctgacgtgctctaaaattgtcgtcgacgcccaaaatagaaactcccaaaaatatttcttcaaaaactggcgctcctatatatttttaaaatttaacacttactattctacaaataaatattaccgagtattccgctgagtttagaatataactgtctcgcagaatattcatcacgatacggcacacgagtgcagccaaaggtaatttcacaacaaattattgttaccttaacggcaaatttaacaaaaaaagaccattttttgtttgaccaattcaatcagtgatttgctataaactcattaaaaccaaaaattattagacccattgcatttgcgaatggaccaatttttgggtttcaaaaatttataatttttctcccatccaaacaatttggcatttgcatcttagacataatttagtgaagaataacaaattttccatattttaacagcatataattttatattaaaatgccgattgtttgaatgattctatgcaataccatatttgccaacttacggatacaactccgtccgagtattttgcttgccaatatatgcaagcgtgtccacattcgtgcgtcgctcgaactttgtcagagactagttgtcgtcttttttttctgaatcaaaatccttgcatagaactaataaagaacaataaatctacatctaaatttttcatgtgttttttcgtgctcaactccctctcaaaacctctttattctctctttcttgcttaggagtgcagaaagaataacgaacgagcacacaatcagaacacgaaacaaaaataaataacacagaaaagacgaatagaaaaaaataaataaaaattaggattgcttcggcagcacaaaagcaaaaaaggacgtatgagtgaatgcttcggcgaatccaaagcgtgcaaagggacagagaagaatttcagcgttccctttcattagtggctcaaaggagcgagtaagtaacacattacttcggccccgacaaatttgtagggagactcgacccttctgcgaattctacaatcgatcaggtcactttcaaaacgaatgttggtattgtcctcgggattttcctggtcccggaaaatatgcaaaagcgaagaatcatttgagaatagtgccaaagtgaatggactagagaaacccaggaattgagagagttggttgaaggtttggcttttcaatctccgaaaattgttgtgttggacgatcaaatgaaaggttgggagtgattgcagtgagcatgaaattttggtttaataaaaaagtaaatatataagaaaaatagcaaaattgtaggtatggttggaggtttaagagaggtagaaattcattatttgtcttgccaaagcttggaaatttaactttaacatttattttgtttcgcatttaatttctcgcatattatactgcccttttccgaccgatggttgatcaatcatatttcattttcacatgtgtttaatgttcgccttccattctatgtatgctcagtctcccgagaacaaagccacttagttgtgggaccagcaagtgtgggaaggcaatcctgggcttgatcatcccgtgaacccctccttcgggaatatgtggcactttccctttcccaaatcttattcgaaatccaattcccaatctttaattcaatttaagaaatttatattattattaaacaaacaaattgaaaataaattcccatcgattgggggaattgagccgatgaaaagatatggaaaaaccaggaaggcaaatcattaggccattttaagaatttccatcgctacatcaaaagaatatttaaatataatttttcaaattctttccttttacaccaaattctgtaactaatttttcactcagaccactattctcaccactgttagtgcatttaacttgtatattataacactaatgcatgaaaatgtctatttttctattttcccatagtgcaatcactttccaattaacttctagaagtaaatattgtccccgtaatgattttattcttgagatattattttggaagcgaatccaaaagtcaggtgaatatgcaaaaatgacagtcgaaatattgaataatttaacccaatttcttttctcatttacctcagctgagtttggaccacgtgaagttcgtcgtttgtagtgatcgtgatgggttgagctttgcagctgggatcaccacttaagccgcaagcgtaggaagtataatcgaccttgttcagggtggagatcttttacaagatatataatgatttttttattaatttataaaaattatcatattattacatttacattaaagccttgattacgcaaaacatattcgatgaaaattcgcttgggacgaaaacgaggcgagacgaaagtaaaaagtggcgaaaatatcgagaaaaaataatttccgtttaaacgtgattaatgctaaataataatatttgtttaaatgaaaaaattatttcggtcgatccaatcaattggatttatacgcgtatacgtgacgccgaaaagtaagaaattcg

SEQ ID NO: 11539 - DNA, 1072 bp, Heterodera glycines
gagtcaaacaggtgttaattgattgtgtgatcaacccagggcggagtacatactgatcagagggcggaattggggcactctttgatcaaggtgtaactctcattgataagacagagttattacttactaactgatcaggatgttgggatgggcccatctcgcgactcagttcagtcgaacactaaccaagacaaaatgccaatggaaattaatcaaaaatctcttaattttgatcagattacaatgggaaaaattgatctaataatcattagcaattctttgttttatagctcacaacaagaggacatgctgctcaactttttgttagacaccgatttcaaggcgggcggtggcggcgttttctctggtacgccttgaaaaaatgccaatctgttaattcgaaagaatatcccaggactcggcatcctccatgaatgccaagaacatgcttggaaaatttttccagtgttcgggttcgaacttgaggattagtctcatttgtcaggcaaaaaaatgccaggatgcgaaattccggcggcgaaaaattgctagaatgaaaaaaagctgtggattcattcttgggttcgaattcgtccttggatgccaaggacgtccttggaaaaaaaaccattgaatttattccagagttcgggttcgtacttgaggagtggtcacaggcaaaaaaaaacaatgccgaaaaacgaaaattccggtggacaaaaaaatgccgaataaaaaaagtggggattcattccagggttagaattcgtccttggatgccaatgacgtccttggaaattgggtttgatgccatttaattcttgtttcaaattggctttcatccgaaaaacaaatttgcaaattttagtttatttattattcattttgtgttatatttacactttctttttacgcatttttccaccaaatacaatggcattttgcagaatgccaaaataggcattttttttgtttgtttgtttgcacacgcgcaaatcttgaattccgcttttttttgttttcgccccaggcggtgccgtggaatttgaccccggctcaacgacgtcacccc

SEQ ID NO: 11540 - DNA, 4214 bp, Heterodera glycines
aaagaaataccgtagccatttgttcgacacataaattctatgatgattgtttattgaatgtaatgactacaataatgctaatactttcattttgcaaatattaaaataatacataaattttttgctggaatactgtttaattacgctgataccgtatccttcgtttaacaaataattgatggcatataattctgctggaaaacggtagtcccatatccatttggctacagtatccatatcatcacaaaacagatattttgtgatcccttccaaaaatgatatgttgctaatgagttgattcattcggttgagtttgtgcttttcagttttgtgccgatcagtttggccgaccagcctccgcccaccattttgcagaagcaatgcgcaaatacgtgttgatgtgtgccgactgggtgaacgcgttgttcatgctggccggcctcgacagcccgcaggaaaaggtgtgggcaaaaggccaaacattcaaatttaaaaatggggccacataaaaaagtgccaacaatgaaatcactatgcctttattgatcggctaatatattttatatcgggattgacattaacccgaaatggattaatcatggtcagaaactcaagattaaaaactcagttttttctttgtttccgctaaattttggcatttaatccgatttaagcgccattcacttcttttaagacaatttgtaaattgtctttgatgagctgaaaagatttgatcaaaaactgttcattttggtgacaaatgatcaaaatgtattcgcgtaataaaacaatcacttaactgagtttttgcagaatttattaatgtaaaatgactaattaactcagcaaatttactcattaattaattagacgtttttaaacatttaatcaaagcgtgatttatttttcttttgatctggtgataaaaaacaagtgaatcctcaaggtcgtgcatcatcattaactttgtcagatcactttccagcctacagtatcacatcgttatactgtattttaaatttaaattttaaataatttttcatttttcagttgacactgatcaagaacgcgttcgtcgccttctacacgtttgagcaggccacgtgcacagccaaagtgtgccgaaacgcggcggcaacatcaaacgctgcgagcgcggccggcggcggtgcgttgctcggtggcattccgccccaggcaatttgcttgtgcaacggcactctggtggcacgggacgtgccgcaagactgcaccaccaactgcttgctggccaacaacattgtgggcaaagtgctggacgagctggtgacgcctttgcgccggctcaacctgtccgagcaggaacgggtggcactgaccgcgctgatcctgctggacggaggtgaatgattgatggggctaatgtgttcaggggattcggaaatggcaccctgatcaacattgtgatcagggaattcgggaaacaaatcagccctcattaggggccagattaactattgacagcacaaataatcaataggtgcatttttgaaatctccgcttacattctacccatttcaaacaaaaagggacttttctagctaattactaattcatgatcaatcaggtccagtgttgtctggtcgccattttcttgacccagtgaatttgtggcatttttatgtcgtcctaattgcccgctttcccctgcctgatcagacagtcgcagttcgctgggcggtctcagcagcgactccagcgacgacggcacttccgctggcggcgattatggcgccggcgccggcctgtacctggtcaaggacaagctgcaaaacgcactgttccaacatgtgcgcgagcggtgcgaccagtcgttgaaccgggcggcgtcccgtttcgccaacattttgttgctgctcacctcggtggccaaggtggcatccgtgtactacgagaatgtgcagatggtcaaaatgtttgtgcgccaatccatggacccgttgttggccgaaatcttcgactcggaggtgtgaagccccgtccggtggtggtgatggtgggatatggaaaaagccgtgagcatttgttcaacatcaaaggatagactgactaattgggtgaaaatgccgaattttgggcgggataaattccgaaattgtcaaacccgagactattttgaccaatatccgcccattcttatgtcaatactatttcggaacagaaataattctgttcgtttgattaccatccccggattgttgatctgatttcttatattatttagtttccagaactttgatcgattttttctgatcaattttgaagtcggcacaaaaaaagcgaaaatttgcaatagcaaatctctatgatcaacatgatagaatgttttaaagtgatctgatcacttacgatttggaatcttcccttgtgggtattccgtttcgtaatttagataaattatccattttgggctaatcggtatcccgtttaatcggcttttcgttctttgggattatcagatttaatttgggtcccttgttcttttccgattgagctgactgatcaaatgattttaacaggtgtcacagccccagggcctgttgacaaacagttgcacaaactcagccggctctcccgccccgatctcggccacctccgctgccagcctacagcaattcggatctcaggtaatcaagagtgaaaactgtcttaatcctcgagaatccaaggcaagaaaatttggtcgagagtctcgaatttaaagattttttccttagggattttgcccttgtcggcacaaattatttattgctctttcctaagattgagatcataataaacatggtatctggtgtggtcaaagacgggatcattctcagcatcgagagtcttgggcaattaaaattaattagtgccggaaaattggaacgccttttaaggagtttgagccgctgttgctcggctttgacgaagtgcgacggcgtcagcagcaacaccatcaactccatcagcagcagcaacaacaacagcttgacgacatcggcgtagagcagcgcccgcggcgaatgtctgccacggaaatggaccaactgttgttggcaccgcttttcgtcaacggcggcggcggcaacttccaccaccttcaccatcagcagcatcatgagcaacaacaacaccaacaacaacaacagaaaagcaacaacaacggcacgggcagcaacgagttactgctttcgtcatcatcgccggagggcaccggtggtgccgcaacagtgacgacaactgcggcaacacaaccatcgtccgcggcggctgtcacaacgggaggcggtggcgattctgctgccggggcggcaaacatgtactttggatgccattccacaacaaatgttgacaggagtggtggtgccaacggcactgacgacggtcagtctcatagtcgagaatgggtgtcaagaatttcgcaagatccgggccagcattctctgccagggttcaattcgtgacgggtttttacgaaattaggattatttccggagcaaaatttgaaaaattctttaaaaaatattcttaaaaccagtttttggcttaacactccctgccatcacttctggacctcttagcgatgtatagtttaggcagacacaaaaatttccgaagcgcttcttgaaaattttaaaatccggaaatcggacccagaatcctcaaaaattttcggaatcggacccaatccagttaaaatccggacactgattatgatcaacccatgctcagatgggaccagcagttgtacatcgacggcgacagcgcgtgccgcactgttacttgcggcacaacaacacggcgccgtcggccaaacggcgccatggcctggcgccgccagcaacagcggcgcactgatggaccgctgcgtggcacgggtgaacagttcgccaacaatgggcgtgtcagcgatagcggcgtctgtcgctggggctgacactgttgtgccagccggcggtggttactactcggccccgctgttggcaccgcaccatcatcagcagccgttcttcttcggcaccggcattggcggcatggcattggccccgtcgtcagcgaccaacatgggtgacagcggtggcggcacagtgtcatcagtggcggctggcacgacgccgttgatgcaagccggtgccgttggtgggtcagcatctgcggccgcttcgctggcgacttcagctctagagatcccc

SEQ ID NO: 11541 - DNA, 1258 bp, Heterodera glycines
  misc_feature (1168)..(1168): n is a, c, g, or t
  misc_feature (1195)..(1195): n is a, c, g, or t
tatttccaattctcagttaaagccgtgcctataatctttggaaagggaggagggcttctgctgactgttaccgagttctcttctgatcagacactgcttgctcacgcgaaacgagtgcatttttgatctgaagtccagcagcttttcgaacaattggactatttgacgtattcgacaaaacgacggcgagttgttgaatgaattcaggctagaaaaaaacaaaaattttttttgagaccggtcagaattattttaaaataaattttcaccaaaagaaaacttacaaaattaattcgtgcggcttcatttaaggcggtaagtgccaattgctggtcggcataacctcaaaagaatcaaaccaataaataaatgtgcacaaccaacttggtgaaatcgttttctctaatatttgcacaatgtcggccatgtcacaaaatgtaaaatcgaaaaataaaaaataccgcctggggaaaaaatatttaattatggaattgttgatacataaaaaaatttgagttcgacacaaagtccgaattcgaataaaaagttcgagaattaaatttttcaaaattcacatttatggtcaaatctgataaaatgactagtgaagtcgcaatgtttgtgactaatttttgcttgttttatcgattaaaacacgtgcctgaaaaattggaaaaatagaattttcagcgctggttatacctacctaattggacattttgaattttattaaaaaccaagggccttttggtttgcaaatgtttttgaatacgtctagtaataaaattgtttctgtgattattgaagttcgggttagggctgaagaactagtcaaaatatatgttaaattcgtatcaggaatcaggacctgataatcacaaaaaaaaaacaaaacaaaaaaggtccacattaggtatagagtacgcattgtataaatcgggcactggaaatggatagaattgaaaactcatttgtcagctaacaaacaccatttttaaaataaacatggcgccaaaaattttaaagaataatttattggagggaattacagtatcttaaacggaagaaaaatgaatcgtttcatttctacttacctcactaattctattagctcaatttttccgttgggttaaatttccctttgtgttgttagtctccgtttgattanaaaagttaattaatacggtctgtatanaatgctttaaattgctttcgtcttttctcaccttttcccttgattcgcaagtttaatttgtct

SEQ ID NO: 11542 - DNA, 4526 bp, Heterodera glycines
agtgggtgccgctacaacccttcggctgtgatgcccccccagaattgaatgtgtgttccattgaaatcaagcacgccttgtgatgttttgcataagaagatttgtgatgtttttacgtttgctcagcgtttgccttcgcctggccgtcgcacattcagtcacgaatgattttttcaattgatgtgatttctctcgttattgatgaataaacggtgtgtatcacaaaagcattcattcatttatatgaggcgccttagtaagcaatttgaaaatttggcaccattttgttgccgacgcgttgtgcgcccgcgtagtgccttccgccgccacgggtgacgcaaatcgaccggttgggctagcgataaaatggtctttttatgtaaaactgttatcacaaaactaaattttcaaaattgacttaagaattgttcccctttgggcctgccgacatcccccccccaaataaaaattttccaaattcacattggttgcggtgtcaagtttgactatttcgtgcttgagttgcatacccgcccggttcaatcgttgctgaccaaacgtactacgagcgggtgatcgaagtgcgtcgtgacccaaccgaacgccgtacattgcgctggtggccggagtcaaggttcactcttttcaatggattagtgcaaatccaacctttacacaatgctttttacttcacttaaaaatttagtgctattttcgatgttctttgaactcgaacgcaaagacttggagttcgtcaaaggcgaaagccaagcagacattgagcaggtcgacgggaagagccaaaagtacaacggtttcttgatcaatctgatcgactcgcctggccacgtggacttctccagcgaagttactgctgcgttgcgcgtcactgacggtgctttggtggtggtcgactgtgtgtcaggtttgtcttgaaaactatgttttttgatttgcacaaacaaattcgcggttgcattttaatttcaagtgcactagagccactatttctacatccgctctttaggtgtttgcgtgcaaactgagacggtgttgcgtcaagcaattgccgagcgtatcaaaccggtgttgttcatgaacaagatggaccgtgcgctgctcgaacttcagcttggccaggaggaattgttccagacattccagcgcattgtggagaacatcaacgtgatcattgccacttacggagatgatgatggaccgatgggtccgatccaagtggacccgtccattggcaatgtcggctttggctctggacttcatggttgggctttcacattgaagcagtttgcggagatgtacgctgacaagtttggagtccaggtttgaacacagcttgatattttgttcaaatttgcttatttttagattgacaaattgatgaaaaatctgtggggcgatcgcttcttcaacatgaagaccaagaaatggaccaacaaccaagagcccgagaccaagcgaggcttctgccaatttgtgttggacccgatcttcaaagtgttcgacgctgtgatgaacatcaaaaaggacgaagtggcgaagttggtggagaagctgaacatcaaactgaccttggaagagaaggaacaggagggcaagccattgctgaaaacgatgatgcgcaaatggttgccagccggtgacactatgcttcaggtttgtatgggattagcccactttagtcttttttcgtcgggaatttcaaaataacagaattcggttgtaaatcctgtttttatgcagatgattgtcatgcatttgccatcgccagtcacggcgcaaagataccgcatggaaatgctatacgaagggccgcatgacgacgaggcggcggttgcaatgaaaaactgcgaccccaacgggccactgatgatgtacatctcgaagatggtgccaacctctgacaaagggcgcttctacgctttcggttttaccttttcacaaataatgaacaaacaattttatgaaaactcaggtcgcgtgtttgcgggcagagtcgccactgggatgaaagcgcgtatccaagggccaaattatgtggtcggcaaaaaggaggacctctacgagaagaccatccaacggcaagcaacaattcatttctggttttcatttacattcaatccccgttttctagcacaattctaatgatgggccgttacattgaaccgattgaggacattccggccggaaacattgccggactggtcggcgttgatcagtacctggtcaagggtgggaccatcaccacctacaaagacgcacacaacatgcgcgtgatgaaattctccgtgtcgcccgttgtccgtgtggcggtcgagccaaagaatgcgggcgatttgcccaagctggtccgacattttcatgtttcaacaaatttaatttcagatttaaggtcgaaggattgaagcgtttggccaagtcggacccgatggtccaatgcattttcgaggagtccggtgaacacatcattgccggcgcgggcgaactgcacttggagatctgcttgaaggacttggaggaggaccatgcttgcattccgctcaagaagtctgatccggtggtgtcctaccgtgagacggtcaccgaagaatccgaaattgtgtgcctgtccaaatcgcccaacaaacacaaccgtctgttctgcaaagctaggccgttgcctgatggactgccggaagccattgaacgcggcgacgtcaacccgacggacgacccgaaaaatcgtgccaaaatactcaccgagaaattcgaaatggacgcgaccgactcgcgcaaaatttggtgtttcggaccagagggcactggtgccaatttgctgattgacgtgacaaagggtgtgcagtacttgaacgaaattaaggtatgaaacgtttaaagaattcgattccttttttgctattactaattttaacggaaatttaggattcggtagtggccggcttccaatgggcaaccaaggagggcgtgctctgcgatgagaacatgcgcggtgttcgtttcgacatccacgacgtcacactgcacgccgatgccattcaccgtggcggtggtcaaatcattccgacggcgcgtcgtgttttctacgcttcggtgtgacggcaaaagtgcgtctattctccttacatatatgtattgcttccaatttttcaagtttgaaagctggtattatcgcttttttgggattgtactagattggttttttctaaaagtaaaacaaaatctatttttcatgggatgcaaatccatcctttacacaatgctttgacttcgcttaaaatttagtgctacgcaaagacttggagttcgtcaaaggcgaaagccaagctgacattgagaacagttcacacccctttttcttaatgtgcccattcagaaaacatattatttttgtatcagggactggaactccaacgctcgaaaattttcccgaattttctaaatccgatggtctgaattttttatttcagcagaattctgaccctaaaatggaaatctatttcatcgaacagcaaaatccactcttggaacaatattaaattgaatatattttatttatcaatcatttcaaaggctcgacattctgttgacctgcaatgtgttgctgattccgtccaattcgttgaccgaaccgcttcgaattgtgttcgacccggacaaggccagaattgctgcacacgccggcaaagcatccaccctgacaatgggcgtcattccaaccattgaccaggcatgaaattaattttttaacattttaaaatttccattttgtaccaaatctaacttaaaatcattcccgggcacgcggatttgaaccgccgctgtttggtggtgtggttgatctatactctgggttcctcattgttttggtgtgggttcgagttcgcgtgcctgcaaaagatttattttttgctcgttctcatgaatccaaataccggattcctaattagacaaaattaatgcgaatttgtgattgatatgttaatcctgcctaaaaaaatttccgttttaatccaaaaaagaataccccccaaagaaaatgaatatgaattttatcgtctacattcgattacagccatcccagccattttttaaatataaattttcgtccttttccacaggtggtctgtgccgaactgagtggcgacgcgtgtccgttgcccgcccatcagttgcgcggtgcgctttccgacatgtacgagcactgtttgacaattacctaattatttatttattttgttgtgtccattacatttctgtttattatttgtttgtatattatacattgaaattgcgatggacactttgtttgacgtgcgaaacaacttttatttgggcgcttttcaacagtgcatcaacgaggcacaggtttttgttttataatgggcggaaaaggccgatttatagggaccgaaaaacgaaaaaatggtgttggaatgtgcaaaaagtgggtcacaaaagatgtgttggcttgtgaccccatgttttaaattctagtaattctatatggt

SEQ ID NO: 11543 - DNA, 3538 bp, Heterodera glycines
ctctgagctatatgcattttcgaaatatcagttctaacctgtatgcagacatttgcgcctcgggcatttgcgctccaaacacttgtgcctatgtcaaaatctggatttaattttgtgtttttcaatcctggagttcatagacaacataagttaataaaacaactgtcttttggttcattaggaacaataattctgttgtttgacagataatatttttttcaaaaatttgcagacgttcaattaattgtcgaatagaatcactttctatcgcttatataaagctgttcaggccatccgggatagaaaaaattcgatttggaaccgatttttgaaatatgcgcaaatgacatgttaaccttctagccatactgatcagtagaacccgaacagaaggggaaagccactgattagaacaaacgaaccaatcaatgcatttgcttatttcaggtgaaactgatcctcacctttgacaacgacaagcaggcggtgttcaaaccgatgaggtcgaatgaaaacaaagcaacgattttattggtctttaaggttcggcagagactacgaaacggacccaaaccatttttattttggcgattttgaacgacacaatgccgagatcgcaaccttccacttggacaagtcactcactcattgtgccctttccatttgccattgcttcttcagaatcctcggctatcgccgtgccgtgccaacggtcggccgagtgatgaatatgaccagtgagctgttggaaaaggcggagaggcgtcttcgcaagactttcttcgtttccccaggcatttcgtctccctttggctttaccccccccccatttttttttttgcttatagcaaagaatcgctgtttcgtcagcaaatgcgactattattgtgacacgacacatgcaatttgcgggtcgcccgagttgaaggagggatcagtccaagtctttctgcccgacgacacgagtgtgccacggaaacacaacaaatcaccgtacagacggtacagtatgccaaccaaagtgaccgtaaccgttagattgttcaggacatattcaaagaagacacaactcgctgcctggcagcaggacatgaactattgtcagtcgaaggtgaaggggatgaagcagtacgcgcacggaaggcgactgcttgacctgatcgacttgcatttgatggattatctgatcggaaaccaggaccgccatcactacgagacgttcagcgttttcggcactgacattccatcatacgcaattcatttggacaacggacgatcgtaaaaatgggggggcgcgatgccatggactgtttcttcacagatttggccgtactgactttgacgatgacgacatccttatgcccttccgacagtgctgtctgatcagaccgaaaacattgggcacttttttcggcttttacagcggtgtcaaagggctctcagaaacactgcacgagtgagtcacctttagggcgtccgtccgtcggtcattcgtccgttcactacgtttgttcgttcagttccctctccaaagaccccgttttccccgtgatcgccttcaaacattacgccgccttggaacggcgcctctacaaaatcatggagtaccttctcgaatgtatggacaaacagaatggagacctaacccaaatggttgtcaacgaatttcacaatccgacggtggcggagcctttgccgggcgaagagtcggagacggaggaggacgaaacgaacgacgccccggcagggccaccagcggaccaacagcagaagcaacgggaagtgggagcagcaccagcggaagcgcagcaccagccggcggatgaaaatgaaaatgcgaaaaatgtgttgaaagcgccagcagtggaaccaattttaaaggaggagcaacggcaaagtgccgaagggcatgggaaattcccgaagccaccggcgatgttagcataagaaaattgccgggagagcaaaagcagcgaaagtgcgacgccattggcacgggtttttcacttcactcacttcgttgaccactcaaaccattctttttgtgatcgctttcgctctttgttgttcctccgtgcagagcttatttcagcttattgaaaattcactttcttaaattccaatagccattggcgctaataacccaaaatccgtctccaaaaccattgtgatgatcattttgttcaaaagaattgcttgtttgtaagtgtttcggtgtcggattgtcattgttcttcagtttggccttaccttcggccttcgctttcgctgctcattcattcattggtccaacccaacagttaattgaccaattaattctctccgcctttgcctttgctttctatgatttttcacttttccgtcctctctttttgtgtttgttttccccgtgttcgtcgtactcactttctttcatcgttccgctgctgtccttttattccgtccgcttttcctttccctcctccgtttatttacttgtgccccgtacattttcaatttcacttcgactgtctgtgaacattatttgcaataaatccggtgctcagccatatcccactttctaaatccttttttgttcatcaaaaatatttaacagtcgcagatttatgttttgaaatttcgtgttttttatgtatttagtttgatgctttttaaaaaacgattataaaaagacagtttattttttaaacttttttataatttaaaaattcacctaaaataatgctttttgttcccaaaagttgttttgtctgccaaaatatttttaaaataatcttcgagctttctaaaagtttaaacaacgtttgtatactcataagcgaattgtactttttaaggagaggcggaaggggtggggaggtccggatgctggcgttaacacttctaaagataaagccgcagctgtaatataagaccttacggcatgaatgactttgtaatgctacgtgactggatgggagaagggggtggccgatcatttcgtcactgagaaattattgaaaattttttgctttaaaacttttttataattgacatttgggtaatagtttagatggtaccccccttttttaaaaatttttttcaactttcaaaaaatcataaaaacatgtttctaggggttttcggggtcgctgatcacgaatccgacatccatttcgaccgattccgaacccctgacccggattcgaacaaaataaaaaattgattttttaacaaaattcacatttattgctaaaaatcgattcaaatgcacgaaaaagaaaataatcaatgttcgcatggataaaactcagagacatgcaaccaaaaattgtaaaacgcattttcacggtctccaaaacgctgacgccaaataaattctgggaaataggtgtcgtatgtttcagtcttgttcccaaattgctgtttgaaattccttttcaatttcttccacatcgattcaacattctgggtatgggcaaggcgattggctgggttcacaaagttttgtgaatggttcactgtccaatgaacatagttttgcaaaaggttaggaatt

SEQ ID NO: 11544 - DNA, 2897 bp, Heterodera glycines
  misc_feature (2827)..(2827): n is a, c, g, or t
  misc_feature (2863)..(2863): n is a, c, g, or t
  misc_feature (2867)..(2867): n is a, c, g, or t
agtcactatttaagtttagatttttattaaaaaagtttaaatctaaaaaattatttaaatgaaatcaaaaaaacagaaatttttttaaataacaaaaaatttattattaattaattaaatacaattagaggcgccgatttcgatttacaaaagaatcttataataaatgcacattcattcattctgaggatggatcttaaaaatccaggacatattaatccgttgactatccgatttaaggatttgtcacacttgtaaaaaaaataatttaaaaagaaaatttttatataaaaattaataacagtacataattaatgcaaaaattaattaaaaagcaaaaattaattaaaatatattaaatattaagttacaaaaaatggcaacattaaaaaacccaactgtttttgtaggcatagcattgggcacgcgtgccgaaatttgttggcccgaaggaattcgttcattgcactccgccactcgcgtgccacctgcgcagtgcgcgcgatcagaaacattccattgacaatgacctcaaaaagcgagtaaataattaatgagcggatttttttcgtaaaatttttcctcaaattttaataattaataaattcccaaatcgatcgggacccaaaatctcggggatgaactaaataaagcattttatggcattgatatatggatcataaatttgatcgagaatctgttcaaaattgggcagtgtttggcggtacgtttccagacaaaaaaaaacttaaaaaacgaaaatttttttttccaagaatttagctttttcccagtaaaaaattttaatttttttttttttttgaaaatgaggataattttgaaaattagtatttttggaccagaaacaattgcatttagaggagatttaggtgtatctcgagaattttataaagaatatagagcggcgataaggtagaaattatccgcagtaaaagttggcaatttaccgtcagtttatcggtcctttattggaagaaccgccgatttaaaaaaaaaacccattaacagtaaatacagaggcacacattaaaaccagagaatcccgagtctcaaatcgagactctcgaaaactgaccaggtcaagaccataggtcagccaaactgtccgctcctcaagtgtctcgcccgccaggccgcacctgccgcgctgctccaactcgtacagcacgcgcccgtctttgacagtgccggaaggccgtgcctcccacacctttgaagcgagaaaagtgatcaatcaaaactgatcagtgatcgggattgtaaaaaaaattttcaaaaattgccctgaaacctatgcaagaagcgctgaagattttcatgttccttataaaactgacacacccggccctagcatttaagatttttggagcttgacaggaatacgcttatttgttagggaaataatatgtttcagtaaatttcaaggaaaaatttaaaaaattctaactatcttttcaaaattttatggcaaaattaagtttttaaaaaattaccaaaaaatcgctgaaaatttttctgaaatttttatataaagatttactaaaaaaaggcccctcttgaaactatgtcatgacaaacattgaaattcaagagggtcgaaaattgcagattcgagagcgaaaccccaaaattcctagacattttctcgaatcaagactctcgacaccatggtgtttaagagtgatcaacagtcaaaaacctcacttggttcatgtccaaaatgccggcatctttgcccttcggctcccacaccaagtagaagccgtactcgtccagtcggaccaagcagcccgggtccaacgagtttgtctcctgttcaaaaaaacaatcaatatcaatcattctgatcaatcattatttccagcttggcattgattaaaattttgaatcgattattcccgatcaataccacttcaccgatcaatcaaatattttttagcttgcattgattaggttattaccggtcacttaatcaatcaacgtcaccatcctcatcaatcaaatatcgctcttatcaatcaatgtttccctctgatcactaatcaattatatcactacccttatcaatcgatatcgctctgaacaatcaatgtttccctctgatcacttcggcccatatgttatatatatatatatatcattttatcaattattatcaccgtcctaattaatcaatatcgctcttatcagctaatgtattttcctggtcacttgtcaattaatatcagcgccctgatcaatcaatatttcactgatcagcccttttcttcttacatcgtcataacggtcaaacacatcgccacgcagcagtgtctccggtatgttcactttgttgcgcaaagtccataactctttgttgttcatttgtctgctaatttgttcagcagctgctgattgcggcaccaatttttgatttatgttaattcaaaattttataggcaattgtatgtacagcaggaaattgttggccaaaaaatggtttgggaagaagccaattcgcacgctaattatacgccaccaattaggcacggccgatcagttaattagtctgtgcgcgaaggatcagtcgtcaagactctcgagaggagagtggtgttgttgtcgttgtcgtcgtcctctcgatgattgatttagtgccgccaattttatttgattgtctgctgacaagaaaaggggggaatgaatgatggatgggatatcagaaaaacttcaaaaattaaaaaacgggtttttattttttaaaaattgtaaaatttttatcgatgattccgatcttttaacattgtaattttattttagtgattgngtacacacacattttaagtgctgtgattgagtcggngcgngccaataaaatgtaatgtgatacccatcaa

SEQ ID NO: 11545 - DNA, 711 bp, Heterodera glycines
ccaataaaaatgtaatgtgatacccatcaaagagaattaatggttaattggcctgcccaccgcccccccccccccaaacattccgccaatgatcggtccaactgattttgatcagtaaagtgataagaggagcagcaaatattttgatggttagttagttggaatttttgatgatcaaaaaaatgttagaaaaaaaaaattaagaaaaaattggcaaaaaaatggacattaaatttgatgagtggcttataatgatagcataacaactctatcttatcggtggtcagccaaattggtttttgatcagtgataggagaaggttaaaatttttgattgaaaatttgaaacgaaaaacggttattaaaataaaaatggaaaaaatttagcattaaaatgtcatccaccaattaagaatcgagaagatttttctgatcaaaattaaaaaataaataaataaatttaggtggcaaaaaaaaccgtattaacattagtgcttaatcaacaccaaaactttttgatcagtagcgataagaacagaaaatttaatttggatggaattttaaacaaaattttttttttataaaacggtataattagtgataagtgcagcaaaaattaatgggaattggaatttttgatgaacaaaaaatttaaaaaatgcaataaaaaaaagaagggatggccaatttcataggatttttaaattttatg

SEQ ID NO: 11546 - DNA, 692 bp, Heterodera glycines
  misc_feature (46)..(46): n is a, c, g, or t
  misc_feature (96)..(96): n is a, c, g, or t
  misc_feature (105)..(106): n is a, c, g, or t
  misc_feature (113)..(113): n is a, c, g, or t
  misc_feature (117)..(117): n is a, c, g, or t
  misc_feature (121)..(122): n is a, c, g, or t
aaaaaaaattttttttgtttagaatatttttaatcccttacctagnttttcaaaataattttttattatttttacataccttttccaaaaaataanagttttttnnatgtgtncgtncgtnncattcattctcatgcccaattaattgttggacgttttgtccgtccgtaatttgtcccctccacccaattcattgttcatccaccgatgctccgacgaacaacacacgcgggcacttttgagccctgtaatttggcacttttgttcatcagaggatgaataatttttgggacggacggacggacggacggacggacggacaatccgacacccaacaaatttgcgctttttgttcacaccgccacattcgcgccgcggggtgtaccgggtgaggcggggggtaagagattatttggggtgggattaacgggatttgttggaggatatgttgaaagaaaatgtgttgaaacgggcaaaaaatttcaaaaaatgaatgccaaaaaaagcaattcaaatatttttgtttttagaaaaattaacgctaaaaaaatgtagcaaaaatttatgtcaaaaggattaaaataatttgtaaaaaggcatcaaaaattaaagagaaaaacgagatataaatatctttttaaagaatgcttataattattaattgatccaaaattttaatttaacttctcttc

SEQ ID NO: 11547 - DNA, 4015 bp, Heterodera glycines
  misc_feature (3995)..(3995): n is a, c, g, or t
gttaaatgattaaagtgtaaaatgttcaaatatatccgcaaaaaaaaaaaatcattgatatgataaagcgtttaatgatttaaattttggcaattttgaattgcatgaaacatagagttcaccaaaatattagcggttggcgtgggatttggttaaaaattcatttctttttaaatatttacagaaaaaaccagttttcatacagaatttttagcgtaagtttttgcatttgtatatttgcaaaaatcgggggggccaatggccaagcaaaagccggttctttttctgcagatggagtgtgtgctttgtctgttaggggttggttggttcatttgtcgctgcttctttgcttaatacccaatttttcgggctcccatttgggcggattaatttttaaaagaaaatatataaattaaaaaaagaaattatctttagtatttttaaggatgaaaaactaaaaagaagacaataagtgaacactgataaaataaaaatttaattgtcagaaattaattaaatatgtaaaataaaaaattattaattaataatttcatcaaatggatgaaaaattaaaaaagaaagaaaattaaaaaaagacaagaagtgaagaataataaaatgaaaattaaattgtcacaaattaataagtatttaaaataaaaaattgttaataagtatttttcatcaaatttacatttgggaggaaaataaataaatttaaaaagaaatgcgattaaaaatgtattgaatgtcagttaataaaagttataaaaaaattctaaaaatatattttaatcaaatcaaaaaaacaaaccattttttaaacaataattgaaacaattaaataaatgtaagaaataaataatcagaaaacagaaaataaatttaattttttaatataaaaataaacacttaaaagtacgaaaaaaaaagaaagtttaattttcatttgtttaattcaatcgcttgaaactgctgatgttttggtgtgggctttggcggtgaaattggatggatttcttccaatcggcccccttaatttgagttgatggtttataggagtcgggggggggggggagacaaattgttttcgcaacggaggagcaatttttaattcgatcgatctattcaattcatcacaatttatcggaaaaatttatgtggtccggtgtcgtagtacagcagatatgtacaaaaataaaacaccaccctccgcagaaaaattgaacaaaaataaatttaaaaaataatttttaaatttgttaccgtacttcttacagttttctgggggggggggggctaaattgcctgggaaagattaaataattttaatgaaaataattatttgaagaaaactgaagttatgatttatgtctgtaatgcataaaaaataaaattctggcgttggccccttcaaatttaatgaatttttgaagaatcagagaattcaaatcaaaactcgtttaaaccaaagcaaaaaatttggacatacaaattaccctcttaaaatttgataggagtatcattcagagataatttgtcattgatcaggtgatctcactaattgagagttttacgtgattaaatacattattaaatcaattaaataaaagtaatgttcatttaatttaagattaaacggcttttcgacatttttaaattatcatacatttattatgtattggaatcgaatttaaaacaggcaaatccatcaattaaatatcccaaaattggagtaaaaggaataaaaacctcccgcaaaattggcgggattttgatgaaacctattaaatcataacagtaaatttaaaccattcggagcaagagaagaatggaatcaagtggattttgagttatagttcatccagctctgcccgccatttttaatactatattaaaatattttgaaatgaaagaaagaaatgcaaaaataagcgtcaaaataattacgaaagaattgggaattgggtatgtgctgtaactcttttcaaatggaaaaaggaatttgcttcaattttgaacaatttgtgatttttgttaccatttgtgatttgtttatcaatttttatgatatttttatcaatcataatgtctcatttgtattttcttcttcatcaaaatgaaatttctgtttttcattttttcgagtttttataaaaaattttggaaaatcatcaattttttggaccccaaaatgcaggtgaaattttgaaaattcataactcacttcactgttgggcaattttaatgcaataaagctttaaaaatagagaaaaataagtattgaaattttttgttcttgaatatttaaaaaaatttgcacttttatttcagttctgcttaattttaaaaattcttgtttttatttggaaattattagaaagttttttgtatgattgcaactataccaggaaaacccaaaaattagcgacaaaataattgctaagaaaatgaaactggaaaaagaaagtcgcattaattttaaactgaaattttttaagtgcaaattttttttaattctatccctagagaatttgaatattatatttgaaatttttttttctgaaaattggcttggcattccgttccaaaatcattcagccgacgaaatggtaaaatttgcgcttcccaccagcagccgggcaccgaaactgcgggggcccaccacacaacggacaataataataaatcagtcagatcgaattagccatcaaaagccattactcacagcaggtgtcatcaacaagaaaaaataaatattagtccctcagggcatggggaaaataaaaatttaaaaaagtaaaacaatttaaaaaatgataaatgattaaagaaaaaaggaatatttttaatgaatttttgcaaaaaaaaaattgaattgtgtttatttatggttctgaataggacggaatgaacatgatttttatgatcagatgctttgatttgcattgtttcatcaatttttagccttgttggtttgtatcttaaaatatttaaaaataaattattttattttctgcaaaaaattagattaaacaaacgatgacagtaaaaaataggtcataaaatttgcttatttgatttgcttacaaatttacatgaaatgaatgtaattaattgactcaacttctgctcaatttgttggcggagatgggaacggaaaatggagatgaatgcaattataattatctttttgtcggatctttgcaaaaatggaataaagaaaattgttaatggaccgacggataaatgaatgaatgggagagcggtacaaagtcaacgataaaaaaaaaaattaattttgtgttaataacataaaaagataataattgtaaatatttattataattagtaatgaaaaaaattattttttttttgcgaaagctttcggatacggagtaactgataaatggcacacttttgggatggcattgcgcggtggtatatatcatttttttaaaataactcggccacctaaagccttttataaaccacgtcattttaatgattttttattgccccgtttgactctcgattgtctccatgagcattgaattataaaagttttgttaaattttattaaagaaattatgctaaaattttaaaccgagaactgggcccctatcttggtctgcaggaatgtccccaaaaaatgggttgcggggatattgtggagaaaggcaactaagaaaaaaattatatcggccaacaaacaaattaattactgaatcattagcaaacactaattacccaccattacgcataccttttcaaacacattaacatataaatacgaaaatcaacagtcagtcaaaagattttctcaaagatttctttcatatctgactgttggctgaagaccgtttgagcattcattcacaagtgatgggtaaacaaatgcaaattgggcgtgtgtgtgtcggtcggacaatggacgacgccgggagggacaaagtgtatttataaagtgatgggggggacagcgccggaggggngggggggggggggagagaag

SEQ ID NO: 11548 - DNA, 2830 bp, Heterodera glycines
aatttggcttctccaattaatggtctccaattgaccaccggcccgcatcacacgaacatttttgacatggggccgttacttcggaaatctcgccgaatcaacgactcatttctttcggctccgccagtttcattcgcctttcgagctctaccaggaacagcgaggatactttggttggagggctcgcacgcttcgccacttttaacggccattaattacccccttaattagatgaagtcccacccccaactcaatgggcactctctcacgcctcgtcattccgcaccgggcccacccgtggcccatttctccgtcttccgtaccctccgtccccgcatttccaccggccaatggatcgtcccgctgcgttggcatttcttccgacgattggttccctttacgggtcaatttcgggtacaaaaaatcgcagccaaaaaccaaaatgtcctcgtcaatttcaaggagtactcatcgttttgatgatacttttggttgcgctttttggttctgctctttggtcatgccgaaattacaaaaagaaatgtgaacaaatgacggaggagagagaaccgttactgatcagaaagagtaaagtgccacccgagcaaatgatggcaaactgatcagtgaagccaccaaacaaaacattgctactaaactaacagatgatcactgatcaatcacttttaagctttgtatttttatttattttataaatataaaacgaatttgtcaattatcataatgaaggtacattttgctaatgattataatttaaaataaatacaataaaatctgatgaaggacaaaagacacttaaaattgagattcctttcggcaaaatgagaaggcgccttttgccttggcaacggaagtcgctcaaagatcgtttgcacccgaagaattgaaatagggaggcggcggtgccatttgttcggccatcggtgccaccgttttacggaagccgggggcaacggaaaggaaaaagcgatgccaccggagccgattttggtggagggagtagaaacggtaaagcaaaagagcgccgagaatgtaggcgagaacgaagcaactaaaagaagaaaggggtcatgaaagcatggagagagaggagaagcagtgatcagaccgacgtaatgaaagaatgatcagacagaaaacgaagcagtgatgaaacagggaatgaagcagtgatctaatgatcagacaaaagcaacgatcatcttattgtgatcagacagaaacaatgggaatgaataaatattgagaagatatggagtgatcagagggaaaaatggaatagctatcagtgagtggatgaaaatgaccttgtggtcaagcagccgatcagaaaccacaagacgccgttgcgcacataagcactcagacaatcgaccaaaaaggaggaggaccgaccagcagcagaaaagtcaaggacaaccgaattggacaattgtcgccccgactttggcggggccaagaaaaattcggaagagaccgaccgaccgacgaaattggccgcttcacaggcgaaaaagccgctttgattggccgaaatgttgtggacgagcagagacccatttggcaacatttgcatattttgggaagcgaagtcaatgcgatcgccattctgaaggaatggaatgattgaccagtgaaaatgccaaaatgcaacgaaaactcacgaaaagccaattgatcaccggcgacggcactccgcgagtctttggacattccaaaagtgccaattggctcttctcggcactatgcaccaacttcggccgttgctcggcttcaaatggcatcagaaaggcgactttgagccgtgtgctctccccccgctgtccattggccacattttcgcaccaatattcgccttcgtcttccggcaaaatgttggtgatcaccaagaaaccaatcttcggaatcgggtccatttcgcgctgatcagccgttgggtttgactttggcgttctctcagtgcccaaaattgcattcgaatgcctaattaagaggaatatttaatggcgaagtaaatttatgacatttttgctatgttttaattatgatagagaatgccgagacaaaaccaattctctgtgccaagattgggtttaaaagccatctttgccatccatcacccacccgttcactcgtcccacttctctgccgtccttcatccatttggcctcttcttcgtcctccgattgctcctgttgattgaacaccggttcgcagatcaatgcgctggtcgaattgatcggaacgagcatttcattatgacgggactgatcagaagaagaagagggagaaaaatggccaattggagacgaattggaagaagggaaaagcggaagaaaggcacagaaacggaggaggatcgaaacggcgactgaccaaaccgaaaacggagcgaatgttcgtagtccaattggcaacattccatcaattcaatcgtccgattggcaaaaattccattagataaatacgacgacggaagtcccaaataattggcagtgcgaggagagaagcattttaagcgaaaataggagagaaatcattttgccgatgtcggcaattaacctggacggaaatgtacgcatattaaagtgagtgattcatgcaaccctcggggggagtaagcagaagcaggaaaagaactcagagttaaatgggactttgacgggagggaaatgcgccaaattggggggggggggattctaagatttaattgcactaaattctttcgcaatttcataaaaactgaactgctgcagtggaagaaatgcatttaacgggctggaaagggtcagtcatttgaaagggcact

SEQ ID NO: 11549 - DNA, 1196 bp, Heterodera glycines
agaaaaaacggaggaggagaaggatgagattgaatggcaaaagccgtgagaaggaccaacggcggaaggggggggggcaaaaggggatgaatggccattggaagaatgaccatttggtggaaaaaaggaccaatgtgatggacaaagtgccaaaagggcgaataaagtgccaaatggacaaaatgatttatggcccggcccttcctctgctgagagaacacttatttgttggctatttatgggcagtgcggtcattaatcattattacacaatatcagcagaggcggcagtggaatggcatcaaattgtgccgggtgtttcgctgtcggcagcggcaaagtgtaaataatccccgggggacaagtggacattctcagcggcgcgtcgatggagtggacacactgccatgcccactcgctaattgcattaagtgcttcgcgccaacggaggcgatgcgttcgtcgttcccttcggcacttccttccgccgatttgcaaagagtgctcgcattggcatggcaaacagaaaatttattgaaattgcttcaacgaatcctctgagaatttaaatgaaccctgggggagggacaacgaacgataaattggcgaaatgggaggaggggggggggggattaagcaaatgaaattgaggtttgtgttgttgtgctcattagcatttgtgggggcagtgaacgaaaggaattaatgggcaaaaaagtcaaagggacggaaaacaccgaggcaaaagcaattttaggaaattgcgaaccgagctcatccccattccggaaataattttaaaaaaaagtgcagtttcattttctgaatttggcatttctttcctcgcggcattttagtaattgccggacaccgaatggacggagggggaggagaggaggggatgtcatcgcgaattccgtggctaggcacacgaaattcccacagggtcggcacttttttccctttttgcgtgaattgcggtgccatcaccgcaattcaaaatttgtagaaaaaagcatgaaaagggggaggagtgactttttagattaattatattattttagaagaagagaatggaagcattcactgcatccaccgcttgtttatttggaatggccaaaggaggggcaaaacggagaaggaaaagttcggccattcatccttcagaagggggaattaaaacggcaaaggaaaatg

SEQ ID NO: 11550 - DNA, 5748 bp, Heterodera glycines
ccttatccacctctgtgatggttggggccgagatggcgccgcatcatttgctcctccaccaccgccctgagccgtctcttccgattcgccgctctgttccgctgattgcgctccttggcctcagcccgcttctgctcctcttccgcctcccttttgtgctgctcctccgccgtttgttcggccatttccgtcttttgctgctgtgccgtccgttttccgcgtgccgtccccccggcaacagacggcacagtgccgtcgcactcctccgccgttttgccaatgtccaacgcttcgtcctcgtcccatgccgcgtccgttgtgctccatcctcgtcgtttcggctccccattctctcgcttcacaactccgtcaagcacggaaggagccgttgctgaaaaaagagggaggcaaaagtcaattaaatatcacttaaaagtcgactaacgcatctatttaggacaaatgtgcaattttcgagactaaaattgcgagacgggaattctgtcgagtccgcaagccttttgcaattgtccctaccttccctctctttcttcctctccctcaccttttccgttcgtcgtcctctttttccccgctgctctcttcttctgcccctttccctcgcccgtcttcgcctcgcttttcactgccgtcactttccgtggcagttttcttccgcttttgcggctgctgaacagccactgaactggaacagcccggcaatgagtcagcagtgaactgttcggcgtcgtcgttgtcgtccccactcgccgagtcggaagaatcctccgacgatccatcggaggaggacgaagcggaggaagaggagaagtcggacgcgtcggtgtcctcctccgcgtctaagccaaccaacgaatgattctttcgctgacgccgcttttcctttctctaaaaaaagggatcattctgtcacttgtccgtctcaaatttttttaaaagtaaatcgatctccaaaaactgcgggtgttttcgtcgtcccatgccaaaatgcctcccccccacggccccatttttgcctgaatccgttggctgatcttcagcatttttttctcctccgccaattcgaaatgacacattgagtaagcgaggttgatgaactcatgttggacgatctaaacagaaaaaggaggctgaaatgggacggaaagagaaaatagtcgatgcccacgtgattatcatagagcactctgttcaccaaactgccgcaagattcgcagagaatccattggacatccttacggggaatgtgcaaacggtcgaagcgagattggacactgaaaagaggggaaatggatgaccaaacgaaaagtgaaacggcaattaaggactaatgagggacagagagagaggacaaaaaggaatcacagatttagaaccatggacaaaggaaaaggactaaagcaatgataatggaggagacatgaataggaaagaaacagataaaacggcccataatggaaaaaagagacaaaaccaaaacccacctttcaaatttggtcacgccgttcgaccgattgtcgaaaattgtgagataatcatccataacaaaactaaaagtttctcaccgtttaaatgcgcctacaattgacaaaatatcattggccacccattcacattgtaaagcattaaccaacttaaaattcaaatccgccaaaaatcttccgttaaatccaccgtatttatgtgtttaaattcttcaaacaaatgtcacaattggaattgttctgtgttcatttcaattcgtttcgccattaatttccgttctctctctgttcgttttgcatttgttcaccaccaattgggccaaatcgctgaactgtttggcaaccggcgagtcggcaaagtgttcgaaataagattgaccctcgtcaagacttttagccagccgtgggtccagcggcaattgagccaacagttcaaggctcaaatcggcacacattttcttggccccgccggtggtgttggggaacagttgggaggcggtggaacagcacggacacacaaattggcacatattctcaacgacacccaaaacgggcactttggtcttcacgcagaaattgacctgaacagggaagggattgactaaatgtaagcagaaccaagaccgtattcagaaaacttggctatgtaaagtatagggatttttttaatttgtggacggatcaagacaaatgtggtattaatcaaaagtttattcgcttctgatcaacccagacttggattctgtagtgccggcatttacagtgtcaaaagaaaagaaaaattttccgttttttcattttagggggggggggggggtgaagtgcgttccgtttcccctcttttggtatttaaaaatagacaggcgaattagtgcagtaattgtttggcacctctttgcgcacatccaacagcgaaatttcctgcggagtggtcacaatgacagcgccgtccaggcaagaagcttggagcagcatttggacgatggaaatgtgttcgtccgaagtgcctgcagcaatggcaaagcaatgaatggaaaatttgtccctttttttttgttacccggcggggtgtcaatgatcagaaagtccaactcgccccagtcgacgtcccgcaaaaactgttttatgagcgcattctttcggggcccccgccaaattatctgacaatttgtgagggatgaatgaatggttattcaatgccagttttttgggtcatcgctcagggaattagttcgcctccccccggtaaatgttgaaaaattttttctgaaaagtttccagttttttatgatttttttttaaagaaatcgggtggggaaacgatgtgacacccaccgcttcgtcgcgagtgtccaataaaaaggcaatactcatcacgaacagattgttctgcacaaaaatgggtgtccatcctggaaatgaaaagtcaacgattaagaaataacttagaagaaattgaaatttttaattaagggagtcaatggcaaatcgcattaataaagttatttgaaacaatttattttttgttgacaactgaaaacccgaacacctcacaaattttatatttttttaaagctgcagtggtaacaatttttttgacttcttttttcgacaaaatataattttgcaattagtttgtaatggtatcacatcaattgctgttaccctgatcactgttttgtacgctgttctcctcacagccgaacatccgagcttgggaaggcccgcaaatgtcgacgtccaacacggccacataaaagaaaaaagaaaattaaaaaacgcgtgaaacgacgccaaactttgaacggcttcgctccttcctgcaaattggcaattgcgtaggccaaactcgccgtcactgtgctcttcccaacgcctccctttccgctgagaataagcaactgaaaattggaaacgacggatttgccaaatccacaatgatcaattcactttgtgtttgacgcccgccaatcgttctgtgattagcgcaatgtccgggtccaccgccctttccccggttgagcaggcactttggttgggacagccggcacaggcggacgttttaccagcattggcactggcagtgcctggacaattctcattggcattctctggtacgtcagacattttaaaacaaaaatttgtaaaattaaaaacatataaaaatggcataatttaaaaaatggcaatggaattgaataaacaatccaaagaaattttgctgttttttcaatttttattcatttgttgttgctgtctttgcaatttgttctgttggattctggccaattcgctttcggcacttcgattctcagtgaatttgaacgtttcgatgaattcggccgcctcctccacggaatagcaaaggaccaaagaaacgtccattcggtagcagaacatgttcaggtcacgaagcaaaaaggaagggtcttcgacattgacgtaagccaacagaacctgaaaatgaaaatcgatgagaaatcatggggaaaaattgtcaatttaattaaatttgaaattgtgcagtcgtaaatcctcccacctttacggggtacgccctcagatcggtgaaacgagtctcaatgtacccgcagtggagtttgtggtatttcagggccaggtaaagaagcccacaattaccagaacattcaaaatcgcatcttaacggcggaaagttgctcaaaatgggacaaaaagtatgttccaattcactttacgtcggatgaccattcgtacggcacattccgaatgtatttgagcaccgggttgccctcttgtcggcgccggtttatttttaatgtggacaaaccgaacggatttccccttgggagtgccggggccaatagcgccgatgtttggggctggtcattttcagaggaagttgttgccattgaacgtaaaaaattaattaaactgagtgggaaatttgtctcgtctctctcctcgctaatttgaagaagggattcattttgggcgctctttcattggttttttgaattctccctactttttggcattttgctcattcttttattttccccgacttttctcggttgttttcgatttgtctcttctcttctttgcttttgctgtttgttattatttgtttggtgccttttccctctctcttataaattcgcttccccttctacccattccaaaactcatcaaaacaaaacagcgatttgtgctgttgtgccttttcttacacattttcttttcgtttaaaatttttttgttttttcagctttttcccatttttctcaaaatgttccgtttgcaatcttttcaaactgttggcaaacagtttcgacaggcaatgtcaatgcaacaaattgcgaaacggtaaaagcattgaccgccccttcctaccagtaatagtttctgggaatggactttttatttaccccctttgggtgtgtaccactcccgccgcctgggaccgtctccccccccccccctgtacattcttcgctcttttagctcaatttccgcttccgccgtgcgtcagtccgctttgcgtgaccctttcttccgcgaccccatcgacctttggctgtacgaccccttgcgtccaatgcgtcggatgctccgccgtgcgtccgatcccttcgcgatgctcgaccatttcttcaacgaccggtgggtccctcaggtgaataggaaaagagggagctgtgagaaaactgttgtaattcttgaaacaatttaattgaaggtccgcgacaacgcggccaaattgggcatcgatgagaagggcaatttcacgtactctgtggacacttccggatatcgcccggaagagctgaacgtcagcatcgaaggggacgaagttgtgatccaaggggagcacaaggagacggtggagggtgagttcaaacgaaaaacaattaacccctatttaagtttcactgcatttccttccgtcttaattagccactaattgttttcagatgagactgtccaccgccaattcgtccgtcgcgtccgtatccccgacggtttccaaaaggaggggctgaagtgcgcgatggacgacgcgtgccgcatgtgcgtcacggcgccgaaggcgggcgcggagccggcggccgaacgccgaagcattccgatcgaagtgaaggcgaaggcaatcgacgaaaagaaatgaaaaacgacggacaaatcgagaggaattgtttttttttccattttcacacctgggggagaaaagactcatcctttaagcttatgaaatgcattaaag

SEQ ID NO: 11551 - DNA, 5103 bp, Heterodera glycines
  misc_feature (5023)..(5024): n is a, c, g, or t
tttataaaaaatgttatatttcaaaaagttactttttgaaacattttgttcaatttctaatttattggcccatctttcaattgtcgtataatttacaccaaacatttgtttaatttctgctctaaattcttcccattcttttcgtgaatgttttccattttgcataaattcattttttattttaaaatatttttcaacagtttccgttttttcatcattaattttttgctttttcatcgaattcccatcttttaattgtttcttccatttataaatagttttgatatttgtgcccaaatgttttgctaatattttttgacatttttctctttttccatccaattttccttttaatttcgattttatttggccatatatttgatcaaaatgtcttaatatttcaagtttttcctcatccgaatatctgtttctaatattcaatccaaattcttttttccattcataaattttcttttgagttgatcccaatttttttgcaaattttctttcaattttcttccattcttttgctgaatatttgtttcccatttgcttgattttgtcttttattttatgaaatttttcaacaattcgtttattatgatcataactttgtccattgttttcatttaattgttccaattcatcacaattattggacatttcttcactatcttctttttttacttccaaaatttcatcaaaaaattgatcaaattgtcgactattttgttgaatttgattattctgatcatcaatttctccgtgaattttgtgatcaattcggcagacaatttcttctgctccatcgtcacatctttgtccaaatatttcatcaaagctttttccttgttttaatttcacttgcacggtctgcttaattgtatatagtaggatcattaatagggataataataataataatttaaatttcatttttctataatttcttataatgttaaaaataaagaaataaaattgcaaaaatgcctaaatataattatttttaattttatttgattttgccacgaatgttcaaacatattaacatgtaaaaaaatgcacacaggtgtcctggtttttcatagttgtcctgaattgaaaaaacccatgagaagaaatgaataaaatatatcccaaattttctgttttaaaattaaaaaaaaagcaaattcttgaatttcgctaattttttgaaaagttcgaaaattttctaaaatgtgtggttgacaatctttttcaaaaaaaaaaaaattttttttttggctctttcgccgcaatgttccgcactatgggcatttcgtaaaattgccaatttttacagttttttccgagaaaattcaaataattttaaaaaagttgttacataaaataatcgtaaaaattttaaaatatttcaatgggggggcgggtaagacgaagcaggacaaaacgtcgtcggccgaaacatcgtcggaagactttttgaaccataactttgttcattgtcaatcaaattaagcattgttggtgttgttcgatagctctgtgtatttattattaatagcttacaaatatcttcaaaacatccagagctttcgaatgatatcatggatgttatggttggtcaacaatgaaaaagttatggcttcttaaacttggctgggacggagttgaccgaaccctaccgaccgcccaaccgagcgggtaccggaaggacccatccaaaatcccgcgcctattgaaggtgtgttttcctttgaagatgccgccttagtattattaccgcaaaatcccgcgcctattgaaggtgtgttttcctttgaagatgccgccttagtattattaccgcaaaattccgagcctattgaaggggtgttttcctttgaagttgccgccccatcaaaaaaccaggatggggacgaaccgaaacctattggactccctatgaagttgccgcccaaccaaatccgattctccaaattggtgcgggtgttttttgcagtgccgcgccgtgcagcgccgcggaagttcatcaatcatccgtctgtcaccaaagtgacaggtggaggaaattcaattcttgaaaattaattacaaatctttttgctcgcacgcaaaccttttgggcggttttattttatgaaatcctgagattttttatcctgaaattaaactattttgaaaatttgctaaaaccgtgcggtttttttttgcatatcttcccttcgccgcgcagcgccccggaagggcccctccaaaatccgaaacctattgaaggggtattttcctttgaagttaccgcccgcttgcgggggcggtattttcttttgaaattgccgctacgtgatacttccccgcaaaatcctgagcccattgaaggggtgaaatccgttggttgatttgtgaacaggttcacagatcaaagatattgtattagtttaaccctttaaagtcgccgcccacgtaaatccgatttccaaaacattgcgggtatttttttgtctccatctccctctgcgccatgaagtcgccgcgccgcgcaccgccgcgaaaagttaatcaatcattcccctgccacaaatgtgacatgtgaaaatactttcaaccaaaattcaagttcttacacataatatcacaaatactttgtcgctgttttttgaatgctgttcattaacatttaataatacgtgtttaaatttaccatcaatataattgaaagcatcaataatttgggtaatagtccaaatgcataaattttggagcggtatgatcctgtgaagttgccggcttctttacgtcttccccgaaaatttcaaaacctattccaacaaaaaataaagttcaacaccgttcttcttacagcaaattcaaaaaaaattgtttttttgatattcatcattattttagattttggatttagggaagttaaaaataattactcttatgtctttgccacgtaattctcgttgttcttctttcatttcaaatttaattgaattcccaaactcaatggtaggggattttcatctaaagttttcccgctgagctaatttatatacaaataattttgcatttaaaaatttgaaatatttcaataaataatttaatatgaaaaggcaatccttttgagttcccgaaccttttcttttgaatatatattttaaccgttctacatttttgaatgtttaaattataatattaattttcttcccttgaaaatgctttttttgtgacataagatggtatacagcttttgaaaatgtctagataattgaaaacacttcccaacttagaccttttaaaatctccaagcttaaggcattgaaaaagatcgggacgatattaagatattgattactcatgtaaaaaccccaattaatattttagtaaaaacaaaaagctttaaaatcgcaaattttgtccaaaaattcattttaatgtaatgattttattagattacacctaataagagtatacatttcctgaattaaaatgctcgagtatctcgttttcctcattaaaccttgctcgctccattcatagattggcagagctatgacagaaaattaattaacacctgtgtagattcgaagagcctattttgccaacagccgccagcaaaatctttaacaaagattaaaactaaaaatagtatctggcaccgaatgtaattctgagcaggcttttgtgggattccaatctacaacgatatattttaggaatatttgaaaaaaaagaatgaaaattccattcatttaaaataacacttttatagctccctaaaaaattattttcgatcaaaaaagttatcaaaaaatctaggaacaaatatttttaaaggtttcaaattttcaaatagaattcgggatttttaatatcgatgaaaaaataaaatatatctttctttcgaccgactgtttattaaggggtaattagtatttacatgactttaattatttttcgtaattttgcaaatttgtttaccgttctcaaaaagtttcaggaattaaactaaaattaacctttttaaggaggttttatatttaataaaatttcaccgaaaaataatttttttaaaagacatccaattttctagttatgaaccgtgaaagggatttaaattttttcttcttttgaatattattgcattgcgtttcactaaatttttatcaatttctgcaagtttattgttacaataacagacagatgaataacattttattatgttaataatgtataaataaaaattaattgcaaaactaaatatctttaaggcacaacaattttgtaaaatgaataaagaaagaaagcctagaggaagacctccggaaaataaagaaaaatctagtgaaacatttaataaaaaagataatcctcgaatagaaaagaatttttcaaaaattttaaagcccaaagtccaaaaagaaaaatccaatgaaaattttaataaaaaagtaaatctcaaagtagaaaagaatttatcaaaaattttaaaacccaaagtcccaacttaatgggaaaagaaatagaaataaattcagaaagggacacaaatgccgttcatactaaaataaaacttcctccgatttatgtaagattatagatgacaaggctaatatttcaaatatttatgattattgttcatcaatcacttcttatcaaaaggatttttagcttttgacaaaatttgcatacgatataaaatacatggacaatggctgcttgaaaaggcagaggaaatagtatgaaaagtaaaagaaaaagcaattctaaatacaaggtgaagagaggggaaagtcaatgggatactggttaaatgtttacccgaaaagggaagagagttgtgaaactataagaaacgtctaatactattgtttcatagcgaaaagagatgaatatgcaacgaaaaccggtgaaatgagaatgaaaaggaatgatgatacaaggggatagatgaattatgtgttagtatgtggtcaaacaggcaaaggaataggtaaaattctgtgataagtcatgaaaagcaaatatatatggtgannagtgaaaaggtaaaagcatgaatgtcctgtggtaagtggtgaaaagaggtaaaaacaaattcgacaggtgaaatgtctt

SEQ ID NO: 11552 - DNA, 3781 bp, Heterodera glycines
cctgttcattttgaaattattacgcaaatttaatttcacgtaatattgacaatcatttgaaattgtaaaaatatatttcattcccgacttaatcaatcaattctctaataaattgtaattagttcattttaacgattaataagcatcgaattttcactcactgctaaagtaatgaacttttcaaatccaagccagcggctcgaagatttaaagcaacgttcgaattttttgctgaaatcctcccccctcttttgagagataattcaaaaaatttgctgagaaattgcagaaattttcatcttaatgtcaattaaattttataaatttaattgggggcaatcttaatgattataatgcatttggcaatttttggttaaaattcctcagggtgcatatcagacggtacactatttcctccttcactccgcttaccatagtatgtatgtggaagaaatagtgcactgtctgccggtctgtctgcgtttaaaaaaatttgacaaaaaagtggatacaaactcgcgtagtacctatttttgtaccagtacgcatttcgtcgttatcactagggcgagaattcttaggtttttacttattttttctgcggctttaactcgacgagaaatgcacgaaaaacacattttttgttcgaaaagctcgtaaattcgaccctaggaatccctattttggatcttcgcccttaaaaatccttatttggatgttcgcccctaaaataagtttttgcccatattttggcgtttcgcccttatttctcgatttttgggaaattcgttaacaagaatgcaataaaaacgaaaatacacccctaagaatcaacccttttatcttatttgtaactgcaatcagtgaataaaatggtttgtgttttggactctttcgcccctaaaaatcctcgccctagttatcactcaaacacaaaaatattccaaaatattctttagtaaaatagttgctaagttctaattcgaaaactgtcagagaaatacggttccatgcttctcatcaagaattatccgcaaaaaagggcgaaaacctaaaaatcctaacacaggtaatgctgagaaaaatgggacaattgggaagtggggtactgttggacccaacagtttgactcgaaccgaattcagggtttttttcacccgaaaataggcgggcccgacttttgtcttttgcccaattccgttttacattctgtgcggagttcgagtagcagatggacttcttcgacattttaattcctttggacaattttaatattaaactcattaattttaacaattactgaaacgataatttaccgttttagcgtctcatcgactttttaattagttgtttaattgctctcaatttatttctgaaaaacaactcatgtcgagaagtttggcggatcggatgaaagtgttgttgagcacagccaaaggggcggacattcaatttttggttggggagggagaggaaagagaggcgagttgaaaattaaaaaaaagcttaaaaaacattaacttttatttagctttttaaagcccataaaaccattcttatgtctgcctcggaagtgtttgagacgatgttccgttatgatacccaaaatcctgtgaagattcccgatgttgaagttggggcattcaaagtgattttaagctttatctacacggatgatttgagcggattggacggagacaacgcaatggccctactttacgcgggtgaaaatggcgggcgggggggggggggttaactccgacaattttttgcaaaacatacctgtgcaagggggtgggagggggtgggggagtcagtgaaggcggaaacaagacaaaacacagccggggaataaatttttaaaatttttttctaaattttagaaattttccaagaaaaaaagtcttagaaaaatttttcttagaaaatttgaccaaaaaagaattttcaaaaaattttccagcgattttttcaaatttacttatctatgcattactaagttttttcaaaaaaatccaaaaaaaatcgctgtaaaattttgaaattttccttcgaattttataagaaaaattattttatcaaaattttgaaatttaccttcgaattttataagaaaaattttgtcaaaattttgaaattttagtaatttatagatgattttaccttttcagcaacattcgtggaaaagtgagcctgaaaagcccggcgggaatggtgtccctaactccgggcattcttctgatcaaccccgggaatgatatcccgaccccgttgaaagatgggatagtccgtcttctgaaaaccccctgtaatccccagcagttgaaagattatctctcttcaggcttttcttatcccgatttaatttgtgttttttaatattttagccaaaaagtacgacatttctgatctaatgatcgtcctttgttcgcgaattgaaattcaaagtctgcccaatgttatcttagcctttgtccaggcccgccttctcaaaatagatgtgggaacaacatgaaaaacttgaacgagcttatctcttaacccgtaaattttagttttttgcccagcgatgtttgcgttacatttgtcaaaatgcgggccttttgttgggaacagatgactttttggaaagtgaccaggattgtctttgtgaattattcgatcgtgatcaattgctgatcagcagcgaatttcaaatttggaaatgtgtaatttgaattcaatttttaaaaatttattctgttttaatgaccattttttcgtttaggcactccgttgggccgacgaaaagtgccgtcaaaatgccatcgaatgcaccgctgagaatcgtcaaaatgccatcgaatgcaccgctgagaatcgtcaaaatgccatcgaatgctccgctgagaatcgtcgttctgtgcttggtccggcattgttcaaaattcgttttccccacatttcagctgaggagtttgataaggaaattggtagagaaagtcagatataataatgtcgagtttgtttttttaattttcagtgccctctggcgtcttgtcaaaagacgaagtgatcggcatttaccaattcaaacgcgatccgaatttcagcggtgtgcccgggctttatccactaaaatttccatacaaagcgcgcgtgtccgattggaatattcccaagggcaacagaggaacaatagcgatggaaattgagaaattgtcggaatttgcccgagccgaagaggggagtcaacgttacagcgaagccatacaaataaacggaataacgtggaaaatattggcagaaatacaaaaggaaaataacagcacagaaaaatgtttgggcttttaccttttttggtgcacctcttcagaagaaggttggaataaaatttattttgatgaatattaattttaaataaagatgaaaattggagttgcatttgttctgcaacatttcgaattgtttctcaaaagagcggcacggaggatttaattgggaaacgcaatgattttgacaagacaacacctatgaagggattctcgattttcatcgctttttctgtgagctttcattaagcctttactttaaaatgaaaaaaaaaaattaaggaattaatggacgaaaacaaaggattgtatgacaaagaggaggacaaagtgacgttggcaattgacgtttttgtcgaggaaccaaaaatggacaaattcgattcggactcaaatcaatcaaacgggaaaattgtgatggaaattggcaaattgtcggaatttaagcgagaaatttgttggagtgaacg

SEQ ID NO: 11553 - DNA, 2143 bp, Heterodera glycines
gaaattggtgttcgtcggatgtgtcgtcttcatcaatcaaaggcatgtataacggaaaaagttaaaatcccaattccgacagacattcagtaaatatgtttagtccgtcatatttttcataatattcgatgacctctttttggttcgtctcgtcctctttccttaagaagcccttcacatacactggcaataagatatgaatcgcgttttccgtttgcctcaatacagtcttcatcatcgaaaatgtagagtggattcaacaatgtcaacgaacgaatcatcatacaaccgcttacacgataatcacgatgtcttctgtatgctggaggtagtatcgtaaaacgaaagacacattctcaaggagtgctattggcgtaaagcagcctcattcacgaccatattcaactaggattggcacacatgggctgagtcggaattcagaattgaaatgttacgctcttttctctcaatagggcttctgagtgtaaaataggtaaattaaattaggaaatcgttatacagtacccactacgtggaattatcgaacctctcacagcccgacatgaagcagctttgatgattcgcaatgcattgctctggtgttaaaaatgtatatagatcacgtgcgcgaagcgcccgtcctgaggctgcgatgaatttctaaataacatcactttctagcgacgcggcgaagccgcgtcccatagcgcgatagcgctttaaaacatcacactaatgcagaattaatgttttgtatgttttaaaataacaaatgagagccatatattaccaagccacgcatgcacaccatagccaactgggcaccctagtttatatataactaaagaaacagtgagtttcattgctaaaactaaaatctcgggaaccgctggcggaaggggctcgggagtgtggcattgcttaagcaactttttgaggcgcatccaggaaaactataggcattccgttccggaggccaactgagcgccagcggcgctgaaatggctttttggggaaaaatgcatgcagtttttgggccaaaacttttttcagggaagccggagccaaaaacgtctgctgggaggcgactaagttggaatgtttgggaaatttttttcttcttgggcgaggccctaggatcaaagccctggcctgcaaaaattcgcaaaaatttttttccattttttcggtttttcggttttttgggaataactcgctgggcattgtgctgagcgtgttggcgccgctgaactttttgtacagctcggcgagctctatcttgtccattttttaaatttctgaaattttcagaaattttcgagctaggccccctcatcacttttgaggtttttgaattttagtattttttacagatttttccggggaaaacggagaccactttcaagcaaccgtttttgatgctctatcgattggtgtcattttcagaaaaaatttttaaaatttttttggaaatagaaaattttccggaaatgagggcttatttcagtttggggtctataagttgtcaggagttgattttagcaaaaaatcttctatgacaatttttgtagggaatttaaagccctatataatgtgctttatatcatctcattatcacgagtttaaaaaaagttataaaattaattgtgatttttaaattcaaaaccataggggggaccccatggttttgcatttcatgaaaattttttttgctcctaaattagccaaaatgcatttttatggcctaatttaaggtgctgaactcgaatatatactttatttttggtttcagactttttggtaggtgtttaaaattttttgaaaaatcgtcaaaatttgagccccggaaaatccagtgaaattttgaaaattcataactctcttcgtttttggtcaaatttagtggaataaagtttgaaaaatagcaaaaaattaggagaattttatgagatttatttggaatttctatcttccaaaataaaaaagttattccagaatttctggaaaaattcgatttttcagaaaaaaattcctaactcccttctgaaaaagtattttataaaaataatatactcaaaaaatccgcaattttttgctctatttcataaattttattttagctttttatcacttttttgaaaaa

SEQ ID NO: 11554 - DNA, 2285 bp, Heterodera glycines
  misc_feature (37)..(37): n is a, c, g, or t
ggggcggtacatctgtcaaagcgtacgcagggtgtcntaaggcgagctcagagaggacggaaacctctcgtagagcaaaaaggcaaatgcttacttgatcctgattttcagtacgaatacggaccgcgaaagcgtggcttatcgatccttttgaatgtgtaaagtttccagcaagaggtgtcagaaaagttaccacagggataactggcttgtggcggccaagcgtccatagcgacgtcgctttttgatccttcgatgtcggctcttcctatcattgcgaagcagaattcgccaagcgttggattgttcacccaccaatagggaacgtgagctgggtttagaccgtcgtgagacaggttagttttaccctactaaagacctgttgctatgatagtaatcctgcttagtacgagaggaaccgcaggttcagacatttggttcatgtgcttggtcgatagaccaatggtgcgaagctaccatctgagggattatgactgaacgcctctaagtcagaatcccgcctaggcaagatagcaatattcttgctccccggtgtcgggaggcactacttatgcgccgcttgcggtgcagcacaaatgccccagcatctggcccgatgtgcgtgcttaattgctcgcacattgccaaagccgtagcactcgtgtgccatggtggaacgtcggggcgcaaaatcacttgtatacgacttgactactggtcagggggttgttagcagtagagcagcttttacactgcgatctgttgagacttagcccttgatcggatgatttgtcttctttttccccctttactttttgtgccaacaacattttaggtaaaggtacatgagaagagaagggtctctcttaagggagtcaaatgcctcgttaccaccgagcccttgatcggatgatttgtcttctttttccccctttactttttgtgccaacaacattttaggtaaaggtacatgagaagagaagggtctctcttaagggagtcaaatgcctcgttaccaccgttaagtcaggtaggcaaatgcctcgtcaccattaagtcaggtagccaaatgcctcgttgccaccattaagtcaggtaggcaaatgcctcgtcaccattaagtcaggtagccaaatacctcgttgccaccgttaagtcaggtaggcaaatgcctagtcaccatttagtcaggtagccaaatgcctcgtcaccctgaaattaggtaggcaaatgcctcgtaaccatgaaattaggtaggataagttcttgactttgctttttttccatttattccaatcgactagtgctttaaggttttgtctttaactttgctttttttccatttattccaatcgactagtgctttaaggttttgtctttaactttgcttttttccatttattccaatcgactagtgctttaaggttttgtctttaactttgctttttttccatttattccaatcgaccacgttaatcattctctatacatttagtgccttatttcatgaaattatatataatttaattttaaataaagaggctaatttttacagaaaataaatagacgctgactaattagctaacatttataaagaaagtagaaatttgattaaatgcatatacaaaatattacttttttaaaatttgtataaagttcctagtcgtatgtgctttgcgttggttggttggcgtgggtgagtgtggtggttgggccgtttttgcgatattgtggctggaaaaaaaaatgcgatttcactgtggggagcgcggccgtctgggttcaagtgcttgcttgcgcttgtgctcggcattgaacggtgatggctgctgctggggtgccacctttgtcgtggcctcagtttctccagcgtttggcagctgtcgaaatgaataaaacatgcagctcgtctgtgtgttaaagaaatttggcgagttaattgacttgtgtaaatgtggcctaaggcacaaatgctgtggggaactcagcactggggatgctgaacctaaagttggtggtggtgttggtatacgagtgagtggcgtattgccatggttgacaagccctatgagttcgtggatcggaactccttgcctggggaccagtgtgcttgcattcgaaaaaacacgaggcataagcgcccgaaggcctttggcctgaggaagtgtcctaaccggaaaatccggagtgctcgtgtgagtgcctgtgcactgccctcggagctgtgtccagcggcgagatgttcttcacaagtccgggaagctcggatgcctggccagcgctgt

SEQ ID NO: 11555 - DNA, 5136 bp, Heterodera glycines
gcctgacaaaaagagaacatgcctagcaaaagtctcttctccaattgctgtcttttcttccggcgacgatggaataaaacaaaagaattcgcccagaagcaccgaagaaaaaccatcggatgagacggagggaacttctgcggcttttccttcttgggttgcagggaaagcgcagagagaatcagactatgctgggcattgaattacgtcgaggggggggggggcaaagagtctcactgtgactatcattcggaatataaattaatcctaaaaatgagtaaaacaactcaattttaatgacaaactagtgaaacatttttaatggcaactcgtacacaaatatttttattaatttaaaaatttatcaggttgaattctcctaaaactataattccaggggcctctccagctaagtttattccattggaagacctcatcagaatgagtgattgcatggggaaaatgaacattgctcacaaggtgtggtgccctttttttgttccgccattctttctttgactcttcccataaaaattcggccgatcattttttccttagatcgcaatggatcaaaactgcaaagttgaagactttgaagcagctgatccgctttacgtgtccgtgaaatccaacatgagaaaagcgtactgggatttgtttagagaagacttggcaaaagagcctccggaatttggacacgccttttcactgctgggggacctaaaacaagttcaaaaatattattatgctttgtttattttttaatcgttcaagatgcttgccgaccacttggaaggtgaccacttgaagcattcccttaacgccgtcggagagatcctcgacatgggcaaattgaagtctcttgccaaccaacggggcggcctcaatttcgaaatgggtcatatttgttcatttattgtttttcacaattttgttgtagtaattaaagatgttctcgatgtagtgggaagactgtgtgctccaattcgcgatgaaatggttgcaaatttaaagaaggaaacagacattgtcaaactgttcgagtaagcgattgtttggcaatttttgtcttaaaatttgtttcatttgcagcggcgtattttctctggtggaaatgatggaaatcgacatgaccaactttaaaatctcacaaaacagacaacttatcggctcttattctgcacaaatcgaattcgaagaatttgaaaagctaatgcaaatcgatgagagttggtcatactttgcttatttaacaactaacaatttctcaaggttcgtcgcaaaacactaaacggtggctgggcaagattctcgacgactttctttcttcacctgacattaagtcatgtgctgatggtcagaaggacggtctgacgcgagcccaagtgaatgaattaattgccaacttttacttggctttgttgacgacgaatccaaccgacagcgaccgaattccgttccccgaaacactcaaattggatgaaaaacttttggacgctttgaacgagaaatttttacaattggagttgacaatatcagcgatttttatctctgctaatttagtggggagaagcgtatgcgaaggaaatgatttcaaatcgcaattaaagcgtgatttaattgtgatcctaaacgacgtaaattggaggtgggtttgtgttcgttaaaaggatcaaaggcagattgaaaactgggatttatggtttaagcaacagtacacagaaattaaacaatgtgtacgttcactgtgagcacaaatgcagagaagcggctgctgaaaaaggatggaacgaagaacgagggaatactctccggcgacaattggacggcctttgcagaacggacgacccaatcagagtgatttcgagtgagggggacgtaacttataaaaaatattggccagaggaaaccaaaatgaccactgtaattctgccttgatttaaaaacacatttcaggaaaacgtttgtgcgattttgttggccaggccctcttacgcaggagcagccccatgcgaataccgtcaggccttagcacaattcagacggagttggcatcactcacttcgcagttttatgctattactgtgcacaattggaatggatttggtcgattttatggacaattgttggatcagttttatgaatccaaatggaaaataacctcgcctcattaaaattaaccattccttcgttttgtgcccaattgtcttcttaatattatagatgaggtcataaataaaaccgtcaaattatgctgctaaataaactcctaaatccccatttgtcgtgaattttaatttacgtagcaattcaagataccatggttcagcaagagagaagttggaatgatgacgcggaaaatttttatttttttcaaaaggggttttccactatacgccacaaatgaataagtaaacaaaatctcaaaaaccggaaaaattagtaatggaaatcaaattgtttatgagatattgtctcacgaggctttgatcgtctctagcaactgatgactcaaaaaactgatcgccatctgcacgtaaataacgtacagacaacacattttctgttccttcttttttttagtgaacaaatttaaaaatttcatgtaaagttagaaaaaaaaaatagggggctggaaaaaaattcgctcactggtcgccccactcttgccccgtcatctcatgctcactaccggcgggcactccgtacccttgttggtgatccttaatttagcatttatgctcaaaaacacatttatctcgatgagaatcatcattctcggctcttaaccccttatcttcacttacttgacttttaaccatgatatttgattatacagttaaacattgagagtgactatttagacccaatttggctatttttttcctaaaaaaatgatgaatgaaatgttatgcctaaagaatataattgaaatttctcttccaaaaaaccaaaacaattctgatggaagttgtcgatggattgatgttcttattaggcatgggataattatctataccgccggtcgagtgtacccgatacctgggcaaatatttcagtatctgatcaaaccaatgtatacgcgaccggtcggcccttttccgaatgcttgaaaatttccaatgttctacttaattatacattatatagccttaattatgcaaaaatctcaaataactttcgcgcccgtttcctcttacactcttcggaaacaaaaaagacccatcagtcgttcaactgaagagccgccacccgttcttacaaagggttcagaaaccgaatttgacaactgtgaggagccaccgccgccgttgttggaggcagaaacagcaacagacggagatggtagtttttgttttcattttttaatattaattatagtaaaacattaggatcggagcatgactttgtccagaatggttcgattaaatcagtaagagatctctccgtgattatgacatcagctgcagaaattggtagggcagcggaagacagtgccgccggctgtgaccctccagcggaaccctttattttggagagcaggttttcacattagggacattatttacttcagcctccttgattgacaggcatttgccttcatggttccgaaattgccctggatgtcatcccgatcaaaattccgaacttctgtttcgtggacgaatcgctggtgggcctcagtctggccctattgtctcaatcgaatgcgcattttgtggttcgccgatttataacagcgattgtcactgggaacggcgaccgacgagggctgaaagtgtagaaaagaagagcacaaaaggctcacaatcagcctgtgatttgactgacaacgaactcgaaccgtcgacttccgcggcggaaatcggaggaaaaacagctgataaaactcaagcgaaattgacgaccaggaaaaagaaggagattggcttcgatcaaaattattctcaccaatttgggctgagttttccggtgatgttcgaaaccgaagatggccaacggaagagccattgcgagaggatcacatttcgtggattcgtctactgtcatgttgtatgttcatgtttgttagttttcttcgaaaaattttattttataattttttcggtccgtgggtgcactacgtccccccccccccgtatcgttttcccccgtgaaattcaaaaaaaaattactaacttcgaaatttttcaagaaaatggaaacggcgggtgggggggggacgagctgctctcgggctcatagcaggggacgacgtagtgcacctgaaaatttagtccatcccccccctaaaataaggtcccccttccgaggggaattgaaaaaaaatcaatggtggttcaattttaagaaatattgtatgaaaatttaaagaaattgacagcacttgaagcgtatggtcaagctcgtaagatttgttttgaagaccaaaacggatcgggtcacagattggccattttggcaattcgtcgtcggatttgtcgacgacgtcgtcctttggcgaacaaactcgcattacttcgagccatttttcgtcgctaaattccaagatttagaaaataaaaaaaatttatatgaaataagtaaagttataaactttttgactatttattggcgcttaaaaaacgacctttcaccactaaaacatacccatcaaaaattttttcgtatcttttttcattcatatggacaagcaaatccacaaggtcaatcgtattcgatgggcctgaaaaattggcatatttaattaaatgaatttaaatattttcttttcctttttttcaaatttatttttggattttcaatttttttttctattgtactttatgctttccatctaaatttttttaatgtgcaaaatatcaaaatttggcgctaattaatctgctgcaataaatttctaatttttttttttatagtactttgcttatctggattcttcatatccagtgaataagaacaatgtcctccgtatttttctttcactacaatatctctggaaaagtcagtgcgaaaccaatgttcatttttaaatattcttgtccatccaaatgtgtagtcgtggaaaataaagtcgtgggcacagcacttaaaaaaaacttttatgtgtgaaacttaaatttattgagttatgaa

SEQ ID NO: 11556 - DNA, 5964 bp, Heterodera glycines
taagttatttttctcacttctaaaaattaacataattcatttttttttaacttttaagtagtgcatttttgaaaatttaaagataaaattctatgagtgcatttcaatttttattatatttatgttcaggaattttttttaaatcgtaaattcaaaacttaacgaaatctttttttaaacctaaaaattctcactatataaaagtgaaggaaaaagaatggaaaaaagctctcaccgatagcctgttctatgaaaacaccttttgttttggccttgatcacaattattctcttgtctttccgtccaccataaattataggcagctattaaaacaattaattagttgcgcattaattgcccgcggaaaatgacaaaaaaaaagtgatcaaagaaacacaaaacagtgatgggaagtgatcgccatcaggcacaagaagaaagtgagtgagtgtggtgagtaaacgtatcacaaagctttttgtttgatcaatgctccctaattatctttagccacaattgcctgcggccgttctcactctgtttctctcgttgcctctcccttgcacactctctttttaagcctcttcgtctctccttgtcacactgttttttgcctaactatccctttacatactatctcttcactctctctctctctctctcctctctttctcatcactcttaactctctttccctctttctttcaatctcatttctttcgctgtctctcataaatgtgtacattctctcgctgttgtccccatgaattccaatcagtcagtcaattgatttggcttttctctctctgaaaagcatagaaaaaagcagaaatgaatacacatatgtgaatgtgtattatcattaggggtgccaaaaataaacaacaaacaggtgcccatcccatggccaattaatgcccggcggctgaaatacagggaaaggcactctgattgagatatctatttttgtcagacttattggcattggcgaagattaacgaaagaagagaaagtaaacagaaaaaaactttttgccaatttcatttgcaggttttagcagtccttggcaaaataaatttcaaaaaatgttaagaccaattttacgtggaatacaactgttgcattttggattattggctagatttttaatcaaatcaattattcctgataattgagaatgtccgtgccgatgttcgcgtcttccagccgaaattcgagcaaattgtgcatctcctcctcgcgccatgcttctcgctcccattgcgcccactgctgctcattgcgcccaattggcgcccgcgtcatgcaatatttgttctgccttttcttctcaaccaggcgcagcgataagcgttcgttggtccgcaaattgtccatttcaaagtcttgcgggtcgtacccattaaaatattgttcaaaacagacgatgtaattggccggactggtggcagccaaaaagtcctcaaaagtgcattaaaatcagtcattagaagcagaaagggtcgatttttaatcattatcattaaattatgcttttgcccattttccgacatgccttcgtgtagtaaccaataatggatgtgcaaatattgcgatacaacacttttggacgcccatcgccgcgcggcgtttggagccattccctcatgtttttgcctggggcgttgccgtaccttatcaaacgatccatgcctttaaaataaattgatcgaagattggggcaattgatgaaaaaggttgaggaggtgcgcttcagtaactcgcagatgccgtgtgggctgcttaagcggagaaagtgcaaaagcagtgccaaagtcgagaagtttaactgaccattggccaatgtacattgcggtgatgttagcgatgccgaccagggggataagctgttgggcaagcagatccaaacttcgagtttgtttgaagtcaatcgtaaaatgcaaagtgattcccatttcgaaaagaggctttaagcggcgcagaaatgagagcacagcgccgttaacgtagcttaattaaagcagcaaaaaatggaaaatatagccacttttcgccaaaaaatgactacatttttgcactttttgggtttcaaatttcaaaaaattaagatgaaatggggttccggcggtgccgataagcgcgccgggaaattttgaatttttaatgcattttgttaagaaaattggttaaatttttttttcaaaattacattttttaagttttatacccggagggagggggaggcaaactgtaatatagggggttctctacagaagaaacatatacagtatatatgtattttttggacccgcgtaaagaacggagatgacattttccccgtccaatccgctcaaatcgtccgcataaatgaagcgcaacatggtcttgaacgcatcaacatcaatgtcagtgatcaaaatcggacttggcccttcttctgaaagaaaaacaagagaaattttgaagaatcccaagtttttattttcagaaaattttacacgagtttcagttattttaatttaaattgtgttcgtttcacgccattgaaattggtgccgcctattccctttttttatttaggtaaagtaaaatttaaaattttccaaaattataattactaatttatatgtgatcattttgatgttctaaatatatatatatatatatgtatattataaataaaataattattaatattttaaaatatacctaataacagttcaaaaaaagccaaaaactatttatcaaaaaaaaagccgaagactaagaaaaattaattatatgcagtacttgaaggttaggtgcaatgtcgttatataaaaaacatcaataattgcgttatataaaaaaccatgaaatgaaaaaaaaaatatgaaaattttcaaaaaaaattgcccataacttttgtctgtcaaccaaactaaacattcttgattgcattcgatagtcttaagagttactctattagctcactcgaaattcaaaaaatttcgtcatgtttgaacaaaatgatggccaaaaatacccaaggaaccaggtgctcagacatttttgtcataactttttttaaacttagccaaattttttgaaattttgcaggctactagaaaacacttaaggctaccgattgataccaagaatatttaatttgcttgatttttgacaaaatttatgggcagttttttgttgaaaattttcatttgatgattttttttcactaacgactcagcaccgagtacagacagtaccactgatacggactgaccaacaacaattttcgactggcgctttttccgagcatcccgattgaaactccaattaaatcgaatcttttttcgaccctttccgttggcgttgtgttttgttgctgcattttgggcatcaaaacgaaacattgtctcgaacacatccgaggcggccatcagaattgttttatgggctggcagaagcttaaattaaagggggtctaaatttttgattcatttcagcaaacaaaaaaaaagtaactaaaatttaatgcatggcgctgatcggcatttggccggcacagagtgccgccgatcaaggatatttttttagcacccacatggattttattattttgaaaattccgagaaattttttggttgaaataaaatctggttccggaaattctagccggcagagtaactaaccaatttcctcccattccggtgctaattaaagaaaattggtcctcccgcctcctcatttttaaaaatgcctaaagcgatttgggccgcttagaatggtaaaaaaacaactctgaaaaagcaagccaaaataggccacaaatgatggctctgttccagttaacgtgtccaatgaaaagaccatccccatttcttggccataacttttttttcttaaagcttaaactctcggggatttaggactaaacaaaaaataattcttaaatattctcgaaacaaagcttacttttgtattttctcattgtaatttttttttcttaatgacagtatttgcacttttctgcatttacaattctcgagactttaagctttcatttgataccaagaatgtatgctttagccaataaagagcaaagttatggctgaggatggtcatttattggaagcataaactggaatagagcacacaagtgagtacctaattaccctattcaagtaggacagtcaataaaaaaaattcttaatgaatttaacaataaataaaataaataagcatttttgcgcgagcctctttctgctgttgctgatctccttccccaaatgcaaattgaacatccgccccgttgccggtgctcaacaacagcttcatccggtccaccaacaaatttggttttgccatgacgtattgctagcaaaaatattaatttatttatttggatattatgttttgactgtaaaactgatttttagtgctacttttgtacgaattaaacgaatttttcagaacaaaattcataattggcacactgtattaatgggtttttatgggggattagattatttcgcattgattgttgtcccgaaaattttgagcccaaatcgcgcaatgacaccatgctaattttcccataatgctagcaattaatttgaaaacaaagaatttttctttctatcaacccatgctaaaaatgataaaaaataataatgataaagttcttagtaaatattaaagaatttatggattttcgaatgacaaaaaatggaaggttttggattttaagattgaaaaaaatggaaaatttggattttcgattgacaaaaaaatggagaacaattaatagactgtgctgaactaattatagggataagaggggcaaagaaggatgagatgagatgggatgggaacgatgctgaatacgacgaatggcaaaactgtgagcggcgacaaatggtggataacggtgatggaagtgacctcataaaatggaaaaaagagcggataaagcgaaaatgggcaaattaaaatcaattttttttttattattaaaaattataaattgttttttcttatacgctttaaaaaagcaatttaacgattaaatatacttaaataatccatgagatattttaaattattttaaagttgactcaaaaattaaaataattttttttcccaaagttgcaacaaatgaccccaaaataaacaaagtgagagcatttaattatcaatatcagctttatctccatttatctcatcccgtattgcctccatcttgcgcttattgctgtggaggatattttggttgatgtggcggaggcggcggtggtggcggagaaggcggcggtggtggcggaggcggcggcggtggaggcgggggcggggctccgtagcttgggggctgcggtggctcatagcttggcggttctggtggctcatacgctggaggcggtggtggaggcggtggtggcggaggagctggctcgggtgctggcggtgctccagacgcgtcgcgttttcctctgccgtatttgccgtatcctttagatggaggctgcggttgaggccttaaaataaatataaattttaataattatttatttttgagtgtttttactgttgtttctttccgcaatctcttggatagttgcacactttgttcgcctggtcgaacacaagccctttcgggcagttcagcttcgtggacacaccgcctgagcatgcgtagtaaacgttggacgcgcaatatttcggcgccgacagtccctctcctttgcctaaaatataattaatggctgctttaataatcaaaagaaacaatttacatttttgtggtggtgatggtgggtacggtcccggtcggggcggcggcggagctccatagcctgtagttggtcctccgtagcctggcggtggcggaggcggaggtggtggtggcggggctccgtaagttggtggaggtcctccgtaacttgacggaggcggtggtggaggcggtggtggcggaggcggtgg

SEQ ID NO: 11557 - DNA, 958 bp, Heterodera glycines
  misc_feature (21)..(21): n is a, c, g, or t
agagtgaattgaccagcaccnagtcgcccctcgtgcgccaaattctcgagccaattgctccagcgccctttgacccgctgtccacacacgaaaatccatcgtcggcccatcaacaaaagtcaattggttggtggtatcccataaattcacaacaaacaaagataaaacatacacaaaaacacataaaacaaaatcaaatgggcggaacatatttgcaatcaattaataattctcttttatcgtaccgacggcaaattaatgggagggcattaagggtaaatgagctgaacatttacatttataccatctctctcaatgaataggacgggggtatcaatttcaggactttctgacaaatgtgatttggaaaacattgaaagctcgaaatttgggcaatttataattagtgccaatagttttctccccatatcggcatcgcaaagtttggctttgtacataaatttaaatttgcggtcagagtgacgggggtatcaattacactgttagtaagaccaccttaacaacaaagccgggcacagcgtgatttcttcctgctattatttttttgttcttaactttggcccctcttctgggcaaaagaggggtcaaatgttcggcgctcagccccgagggtcaaattgactcatttggcgactgactttctccccgaggggcagtgagtgcaatgctatggatgagaaggaaagtgggggacgagggggggggggggataagtgtttatttgcatagaaacacggaagagactgttgaatggggaaaggcgagaaattgggccatttgagtcgagaattgggggggggggcgggagggtggccaaaagagaaagtgccggaggagccaagcaaatcggcaaaaatttaataagcagggcaatgaattcaaaattaaaaatgtatgaaaaattggtaggcacaaagctaatcatataaaaagcaaa

SEQ ID NO: 11558 - DNA, 2807 bp, Heterodera glycines
tacagtcagccgattaggtaattaatcgccaatgattttgggattaatcaattttagattgaccgcagaactatagtcattattgtgccgcaaagtacacaaacatacaatgagtggtgaatgagtgggtttgattttgcctaaaatattcgaagcaaatgcctagaggggcaacggaagaagaaaggatgagcgggggatgggggcgggatatgatcagtcagcgagagggatttgtgatcagtcagcagtggtgggatcagccaccggatgggggggggggacgagcgattgaagatagaccctgcggcgatgtagcagggattgtgtgcttttccgcaaattgattgagcgacggggggagtggtggcctctcatcagcagcagcagagacatgttagccccgggggacggggccacgattcgatgggatgtgctttctgctgttggcccccggggggacagcacatcgacagaccgacggacggacacagggcaataattaaagtgaaagaaatcaattgatcgcttaaacgtgacggattggggactaatgggggaacgaagttgaacggaagaaaatccaatcacagcgcaaacgcaaacaacaaacattatgtaaatgatcgaaaaaccgaacccaaaaaaaaaattaggaaaaaaacaagtattataattggtatggattatcaatgggtaatttgggtgagaaggtacattaattaataaggagaaatattgagctatgtataacacgaaataaataaaaaaagatgtgctaaagaactcaaaatatattgctaaataaagaaataaaaaatttattaaaacactcaattagatacctatgtgctaaatgcagtgaatttttttaaattataatttttcgtgatctcgtaaataaaaattggaaattatttgattgtttttatatgtctttttcttgacaattttttcgaaaaaatgttttcttgaaaaaaaatttaaatgctttattttttaaaatttcctcatgactttttgtcatgtctgaattaaaaactttttttttttacaaagagattgtaaaaataataaaaatgcgtcgccaacagcagaaggccatcacacatcatttacaaagaattggtcatcaccacagcagaaacgagcagcagaggaggatgagaaattttcaaaaaggggctaatgactttacgaccaaacgcctgccaaacactgtaaaagtgggggacaaaaaagggcttctggattaaaatttaaatgaatggtaaaaattttggtttaaaattaaaaaataaataaattattggaaaaaagtgcagcaaaaaaacagtaaagagaaaaaatatataaaataataggaagcgaaaggaataaattgtgtcctgatttggccaattatccaaacaattcatttgttttgtatagaaaaagacgaaaacatttgattcaaaattggccaaattattgaaattttttacggatgccatttttaatttaaaataaaataaagtaaataatttttattttttttttatcaattatttacttcagagttttagctgtgaaaataaccatgcaattgcttgtgtaatccatgttttttaatctgctttttggattaattcttaaccgaaaagtgcgacgattagttttttgcgaagaaagcaaagctttaaaacaaataaataaaaaacaatttattaaatgatttaatatttttgtctttaaataaattttgcaaaaaaaaagaataacataaaaataaactgctgtcggacagcacagcaagcagaaaatacgacggatgggtggacgaaaaggccattccccagggggattaatgtgccgttttccgccaatgtgttttatcggactatcgaaaacatttttacatacaataaattcaccttaaaatattggcattttattgtctaagaattttgaagtgaaagaaaattgggaaaaatttttgtctttaaaataaaaaatgttttaaaaattttatgccaaaataacaaataaaaaaaaatatgatataattttggattaaatttttaaaaaaatagaaaattaaaaggacaaaaaaaaacgtttaaaataaaatagacgaacttaattttttgctagatttccaaaaaattaaagtcttaacttaacttcactattagctaattaggctaattaggaatgccaagaaaattaaataaacatcgaccatttgtcttaatttaaatttatttctttaaaataactttggacatatgacatataagccaaatttacaaattgctgctgcttttgagcagaggctgggcgggacaacctttgaattcccatgagagtttatttttgagaccaactgaaaattggtattttcacaaaactggggaggaggagaagcattgatttttgcatgacttttgcactttaaaagcaattattaaaataaataaattattaattaacaactattatcacaatcatttttgaactggaattgaggagtttgaaaatgaacctataaatgaatctaaataaagcatcgttatacggatagacaactaatttaaggcctcgaattttttaaaattggttttaataccagaattttaatttttgtttctaatttgtgatttttgccaatgaataattttttggttcacgtgctgaggattgaactgtctaaaaaataattttaaaaaatttcaaaaatttggtgttgaattatttaaattttttcttatgtgaattttctgggataagccgaactcagtttatattttatttaaatgcctcttttt

SEQ ID NO: 11559 - DNA, 4849 bp, Heterodera glycines
tatgaattttcatcttcctagcaaatttccaaggaccaaaaaaattaaaaatattcttgaatttttaaaaaattccaaaaaatctgaaacgtaaaataaacatcatatttgtgctcaggaccctaatttaccccagaaaaatatttttcacaccctttttcgaccccaaaaaaatttttgaaaatttctagggggcctagctcgaaaatttttgaaaatttctgaaaatgaagtaaaccgttcgatagagcttaaaaagctctacaattttgctcttaggcattttttgtctaaaaccgacccctgacgagttatgggcccaggactcaaatgtcccgctcaggccaaaaattttttctatttcctggaaaaaatcgaaattttttcaaaaatatcaccaatcgatagagctcgaaaaacggttgcttgaaagtggtctccgtttttctgggaaaattcgttaaaaaatcctaaaattcaaaaacccgaaaaccgttttttaggcctagctcgaaaaattttcaaaattttcgaaattttaaaatttggaaaaatcgagctttcgaagctctacaatagtgccgctggccaccctgcgctcaggtcaaagcctaatgagttattcaacggggactgaactggacaaagttggtactgaatttttgtagaagcacacagaccagggggttagagatagaggcctggaattttttttaacttttagccaacacttcaacttagggccctcacagcgagcattttttgatttgagttttaggaaaaaagttatgggccccaaactgcgagaaaaagtaagaaatccttccctgggactcagtcgtccgcgctgaatttttttctatagttttcccggatgcgccgtgaaaagttgtaagaccgatgcacaactttcagacccctaccgatagccgttctcgagattttggttttaaggatgagttgccttgtcaatataacatatatataattaaccagaaaggtccttttttgacccagcctaatttctgcacaatattttgctttttatagtatttttaacaaattaattgaattgcaaccgggcatcatttcttatggaaatattgaaaataagcttaaaaatcaacaaaataacattttttgattcataataaatgtatttttctcaaaatttgattgctttcaaccaaaagctatctgtcactaattgccatttcatcggctaatatccccccccccccgatccatcgcagcaaattcgtgtggcgcgtgggggatgagggtgatgagcatctaaaataattgttgataatgaaggacgaagaagcaccacggatttccattggatggaaatgtgcctgattttgacacgtcatatttttgctgtgaatggggcaattttctgacatttaaaaaaatttcaaatacacccctaaaaaccaacttcttgcattttcaaaaattttttttatttattaaaaatgccgaaagcatacaaactgaattcttcattaaattctgctggaatttattcaattgacagcttccaatttcaaaaaaattatcaaaaaaaggactatttcccccgaacacctcgaaatgtatttgatttgcaattgtgcgggcgaaaataataaaaaatgagatttttctgggatttgtatgcataaatacaacggatttttccaattttgagcacatattttattacatatttcagaatttttagcatataaaaatccggtctctattcatcaagtcctgggctttatcttgaaaaattcttaaattatttaccagtgaatatttaatcggccttttcaagatgtttggaataaaatttacaggaattcttaattgatgatagcattctcatcttctactcggcattgcttcaacgaggcggaacagaaattcaaatgttaaaagaaaattcttcgttggtgctaatatggtaaaatgatctcaccacaatttctggctaattattaattacataattaacccccagggcaattctgttgcaaaagatgtgttcaaaaatggcaaaaaatggccacaaaaatggcacaatcttttggcgtggcctcaaattgcgcacagtgccaatgcaaaaggaccaaaacaatgaaaatattattatttttgagtcatcaattgcctcaaagaaatagttagtttttttattaatgttaagcaaaagtgctaaactgctgagccattcactcgcttttctttggaagaaaatggtgagaatattattattttatatattttaaattgactttctcggcttttccaaaaatgccattctcagacttcggtggccgtgccatgcaaaatgatttccttcgtttaaatggtccgtcgtttttgtcggattatgccgacctttggcttcttggacttgacatgctgccgatggcacaccaaacagaagagcaaaaagaacagctgaagatgaagctgttcagcagccgcagctccaaatgcttcattgaagcatgggtaacgatcaaaagggaaacattttttgggtatttgccaatttttctgttttctggcctccccctttgatctcagatttatgataaacttacaactcaattttgtaacaaaagtatccatttgatcaaatttaattctttaagtttgtccaaccatcgcattaccttgagccatccgatccaaaaatgcaattcgccttatagcagcatttttgttaaaaatttggacaaaactaaaatatttgaaaataattttttcaaatattttgtctttttaggcactaaaaataaaaaaactcgaaaagcatttttgttaataattttggaaaaatgccaaaataggcaaaaataagttctttcaaaatttttttaggcttttaggctccaaaaataaaagcctagaaaataggcactaataactcgaaaagtagcttaacaacaaccaaaaaacatgggtttcattcgtttcagcccactgggagctaaggaaaaaattagtaaaaaaagcactgtttaacaccaaagtggctcaaaatagcatttctgctttaaatttttttgttttagtgaaggtttttcgtggtttctggtagtttttaaggcatattttagtgcatatttgagcatttttcgggtttttaaggcatatttaggagggttttaagcaaattttatgcacatatttggaattttttttagtgcatacaacatatcacccaaataaatccattttatttaaataaatataaataaatttccaatcttttcagaatgatcagtcacacaaattttgtgtgcacacccgcaggggagattttgttaaaagaggttgggactcgaagaaggaacctacggagaaaggaattgatttgggatttgaatatttaaaggtgattcaaatggcgaattgtcagtcatttcttcaaaatttaggaaaaatttgacaacatttccatttctgttgttttgcttggagaagacaaacaatttttggcgaatttatcattcaatcggcatgtaaataattgacatattttattactaaaattaattaaaataaattccctttctttttttgtcttttgccaatgtttacgtgccgaaaccaatgccaagggctaatgatttggcttttgccgttttgtcatgcgattctttgtttatctcggcacaaacgtcaacttttgcttggtggattggctatttgatgccggacgatgcgaccattctgtataattccgatttccttccgggtcaatttttaatttcgttgaattttaaaataatgagtaattctgttttaggccttcatacacgtgaccattttttgcctgaatggattccgatcaaactgatcaatggcacaatggctctcgattatcaagcggagtgaaatggaagcgattttgaaaaattgttttaatggaagtggaaaaatgctaagaatgtgttggataggatcaaagatcacttacacctcatcactgttattgacttttcccctccccctttctctgtcttacattatttccattgtctccctctctgcctatctcctccacatttctctgaccccgcgtctttataagggtgcccattccctcactcatggctctccgctccattcattcgcattggacatttatttattattttgttctcctccgccgctgcactcctccgacctcaccattttgtgcatttatttttatttgtttattaataaattgttgatacacaacaattttggcgcagtcagcaggatcagataaattctgcacatcatcaagccaaatcaaggctaattctgcaaaatcttcaagccaaatcaaggcatattctgcacaacctccaagccaaatcaaggcataattcagcaagcctaattttggcacttcaaaagcctgggcggctttcatcggacatcgacaaaaactgatcacctgggtggtgtaagttccgctgggtgcggtttctcatagacaaaaactgatcacctgggtggtgttaagttccgctgggtgcggtttaatcaacattcaaaatggacgcacaacaacttcagcaaattttggacgcggctctaaaaaaatcagccgaaatttttgccgccgcactcaacattcaaaatcaaaacccaaacccagggtcatccacaacggcatcacttgcggcatcaatcaatgcccgcctcgaaaaattcaattataatccggaggttggacagacatacgatgcttggttgaatcgatacggaaaaatcgttcaacaagacggcgcttcgctcccagagcagtccaaagtccaacttttggtcggaaaattagacgaggaggaataca

SEQ ID NO: 11560 - DNA, 2960 bp, Heterodera glycines
ataccaccagacgaagagggggaatttgaccacatcgcttttgaatcatcgacgaatgactgcgtttcatcagaccacgaatcgtcaggggaatttgaccacatcggaacggaatcatcgacgaatgactgcgtttcaccagaccacgaatcgtcaggggaatttgaccatatcggcacgtgagcaaacgactgggaatcgcaaaattgtcaatgtacgtaattgaaagaaatacattatacgaaagcggttcatgctcagaagtacaatgtaaaagcttcagaagctcttccagtttctcgcaaaattttgtcccgggattgaaaagtaatggagaaggacataagcgcagagttgactttccgccctatgtcaaaaatttgatttgggttctagtcggttttacgcgtcccatgacatttaacgcgtcccaacagcagtttacgcgtcccatgacttttgtatcatggcggggatcaggggtggagcgcgcacagaaaagaaccgcggccgcgcatcgcacattcaaattgccgcggccgcgcaccgcggattgcccaaaaaaaaaaccgcggccgcacactgcgcatccaaattgccgcggccgcggatcgcgcattttttaaaatttttccattttttaaaccattttaaaaattttttaaattttcttatgtaaaaatttgttaaaatctcggtgtacactgtagactggaaatgtgaaaatgacaggaccggcccgggctcgggcttagacaattggccgggcgcccgccgggccagggcttttttcaaaaatttttgaattttgattaataaaatttaaaaaaatttacttttttattttagctttgaattatatcaagccatgtaaatcaaccttttttgctttttaaaaaacttttttaatggcgcattttttcaaaaaattttggggtacaaggggggggggggtccgatcgcacatcgcgcatcgcggcgcggccccagccctggcggggatggcattccgagcctcataaaattttcagaaatcgggattccgtgccatccctgtttccatggtattttagccatcctaataacaatgaggaaacctttttttgtccagtattcagtaatcttttttaaataaaaatttcgttgttaaaccttgataactcatacacaggcaactcgaacaatggcttagactaggcctaagctttaggtgtgcttagggttgcctttgcacatttcgataatcaaagtatacaatcaagaacaattagacgatttaaagtataaaattcgattgacggtttgaaaaaactgattttgtgacgagtaaatgatgggacgcgtaaaatgttatgggacgcgtaaaaccgactagaacctttgattttattataaagtacgaatttgagttacaattagcagatataaaaaatttaaaactaactacacagtgaagcacttttccttcacagggtcctaagtggtgaaggccatcctcaaggttaaagcaagcaccatctgtgagagaaaatgaaaattcatatttaatttaatcattttaccaaagtcttccaaagagtcagtcacttgtacaatggacaaattgattagaaagaaaaaagagtaaaaaagccaaaacattgtgtaagaaaagctaaactagttacctactttaggtacagtcatggtcaaatgtttatctacacagaaaaccgtgtccgaatcggttcagtaggagccgagatataaatttttgaaaatcaaaaaaacggttcaaaaccgtataggtaatagtgcaaaggggtcgactttttcgatattcaaaaatttatatatctcggcacctactgaaccgattcattcggacgcggtttttgacccatagtgtaaagggaaagagggcggaggttcgagtccgttgtgcaacattaatatttttatttattttgtccaaaatattaaaatatgacaatttttagcgccgataaatgtaatggacgaaaggaatagaagagataaagtgaagggaatgtcggaagaaattgcgaggggaaaagggacgaggcgaaggggcggaagatttctttatctcgccgaccgtcacatcccttcaatcattcattctctgttctcgaaaatatagacgcattgcgtcactttccgtcctttaacatggccttttatttatgtgtttctttatcatgtttttgcttttccccctccccctcccttcttcccctcttcatccttctctttccccactctctcttcatctctcctctgtctccctccttgtctcttctctccttttcctctctatttcaatttattttccttattccagcaagaaaagaaatggaccatcatcatcagcagcaaaaaagcgaggaagattcatgttcggcacccggagtaggacaaaaagtcgtcgaacgaatttttcgaccataacttttttctttctcaaccaaattaaacattcttggtattattcgaaagcattcgaaaaatgctattagcctgcaaattttcaaaaatttttatttatgcacaaaaaaatcagagcaaaaaaaagttcgaattactgggtttttgagttccttctggccataacttttttgaaacttaaccaaaatttttgagattttgcaaattaataataaacacatagagctatcgaacaacaccaacaattcttaatttgattgacagtgaacaaagttatggttcaaaaagtcttccgacgacgtttcggccgacgacgttttggggtgcaccgttcggcaccactggagtggaaagatccgttgcaaatgttaaatgggagagggagagagagagaagaggaatgggagagagagagagagatagaagggggatgtgagagagagagagagagagaagatgtatcgggagagagagagagagatagaagggggaatgggagagagagagagaga

SEQ ID NO: 11561 - DNA, 2074 bp, Heterodera glycines
  misc_feature (46)..(46): n is a, c, g, or t
  misc_feature (55)..(55): n is a, c, g, or t
  misc_feature (60)..(60): n is a, c, g, or t
gatggcctattccggtgatggcgacggtacttttctttaaacgcgngcgaattgngcagngccggaagaggcagcccttatgaatgaaagaaatgaactcactgcccggagggcacagtcacccgcggattggcacggcacaaaatgttcactttcagcatcaacggggacgacgaaaattgaggtggaaattcacgaaaatgccaatgatcggacaacccaagtaaaacaacagcagcaccattgcttaaatgggaaacaaaatgccaacacattgccaaattcaaaaatgcgttggcgttcgccctctccgcagcggcgaaacgtcgcgccgccactcctgcaccgttccgccagctcgtcaatggcaaactttccgctcgctgagccatcttccgcttccatttgtcggccgtttggccaaagagtgtccgtcggaggcgcacaccgccaacattttgaacggataaggcaaatggacgaaaagagaagcattggcaaatcgaatctgaacattcagagaccgatttgaggatgcggaaaagagaaacggaacggaacaaagcgcggaaatattgtggaaaaaggcggcggaggagagaaagggaaacggcgcggaaaaggggggaaaagcggagacaaagggaggggtggcgacggtgagcagagctcaaaagcatgaaatgctttgtttggcattgccaggtgtttgtgaacggtgcccatttgtgccggggacggccccaaaaagggcaaccgccgccacttccgacttcgtcgccaccggaaattcagcagaaaaggcggccattcgccgcctctccgttgccatgcccctccagggaaatcattcagctgaaaaggccaaccaacggaatcgacctgagggatttgcaggtgaaaatgaaaaacattccttcggaaatgaaaattaatgtaaattttgtataatttatttatttgggtgtttgtcgaccgatataaacgccattaattaatgagtgaccaattcttgttcagaatttggacggcgctcagctggcggtccttcggacggattttaaatttgccattgatttggacggggacgcggaggggaaaagattgatcagaattatgagacgataacggaggacggagagagagagagagagaaagagagagagagagagagagagagagagagagatgagagagagagagagagagggaatgagagagagagagagagaaggggaatgggagagagagagagagagatagaaggggaatgcgagagagagagagagaaggggaatgggggagagagagagagaaggggaatgggagagagagagagagatagaaggggaatgggagagagagagagagaaggggaatgggggtgagagagagagatagaaggggaatgggagagagagagagagaaggggaatgggtgagagagagagagaaggggaatggtttcactggtgaaatttagtcccgttttaccggcccaaatggccgggaacgggacttggaaaatggacccgtacgggacccctgggaccgggactcccggtcctggtggtttgctcaaaaaacccgggaccgggggtcccggcaaaatcccggcggggccccggtcccgtccggtctctatttaaaataagaaatacagcaaaaatttctgaggatgcgtcagattggagctggacaaatattaaattaattgattgggaatatttattaacaatttattttgagttggaagaactttttgactataataatcagggcttttacagccctgataatattttcacattgttgactacaacaattttattcacaatattatttttatttttaaaacattcaccgatttcgagagggtacaaattaagcaacagaaatatacttgttattagagaccggaaatttcaaatttgcggatcccgctgcgggattggaaatcaaaattttttgcgggacgggatcccgcgggattaatcccgcatttaaaatttgcgggatcccgcgcgggattgcgggattttggaaaattcgaaaaaatttcaattaaattcaa

SEQ ID NO: 11562 - DNA, 1644 bp, Heterodera glycines
tttttcttcgacttttctatgaaaaaatttttctaagatttttttttgaaaaatttctaagttagaaaattttttccccggtggagttatgtctcggcggagtttcggctggcggagttttggggtgcaccggttgaagcatgcgtgtgttcatccctttacataatcggaaaacccctattaattcgccaaaaaaaaacgaaaaattaggcttttactttgcgtgaaggacacaattttggctgaacaaaggcggcgccaaactgaaagtttccagcttctgcttgttttgccttgtctttattacctgattaggctgttcatttgtatttgtagctaaataatgtagatttttagaaaacaaagggtcccactttggttttaaacagtaaaagtatcgaatttgataattcaataataaaattgtcttaaaattcttatcttcagcgctcgctaaagcatgcgtttgattgctagaaagaagtgtgcgctaatgacgcctttttcaatcaaagaaagttccatgtgtcgatattccctaaaatggcactgagagaaggcgggtcttgttcttcagcggcggcaatgggtttcttagcgcttgggagggatcggctcgtgcaagacttttcataataattttgtcccattttattaaggcactcgcgcacttttcctttccatcgcttttctcactttgtgtgttttggccgtttattacgcggttaatttgaaactgaaaaacgaatccgtcaaatattcgggctttgacgcgttcgacgaagacaccgccggcggcgaaactttgggttaccgaaaaataaaagcacgccaaataaactcgtgaattttacagcccctcaaggccttccgatgcattgctttggcggcaataaggtgctaatgattacaggctaattataattaattatatatatttttaattgtcattagcttcactttggactaacttttgggatttttaaatttcatttttcgcctcgcaatttggccaatcattcttaagattgcggaggcattcaatcaaacggcagtgacaaatcagaattatggtgccattgaagagaacagcgaggaaaaacaaagggacgacgcttatgaccgatatgtgacgggacaatgaaaaagaaaaagcaatagccaaagaaggatttaagaggagaaatgatcaattaaaaaagactgacaaataaacaaatggattaaatgaaaggaaaggaatgcagggaaaatttggggacggaaaatgcgcaaattaaaaaaaagtcgagttgcggaaatgccaaaaaaccggtttttgaaccggttcaaaactcgaaacattgagaaatttcacactctaacttttttttaacgatcgggccccgacaaatttggtaccatttgaaagctcttaagagcttagtctaaaaatcaagaaatcaagtcgaaccgatgccatctgagcacttggactactgagtcccagtaaaaagttacacttcagtactaaagaaataaaggatgaacaaaaagaatttgacaagataactttcgcaaaagggagcatgcgaagacggagcaagtagtggggcgagacggcttggaaggaaaaagtctgacgagcgccacaggcggttgact

SEQ ID NO: 11563 - DNA, 2222 bp, Heterodera glycines
ttttatgggcccattaaacattgaaaaatgaaattttgagacgaaaaatagaaattaaaaaatgagatataaataattttattatttgaatattttctgaattctgagtaggaaaagtgccgaattaatgaggttactccatttttttaatttgaatttttgcacggcaaattttttgtgtcagtaaactaatgaatgaatgaatgatctgttggatttttcgatactaatagcgtattttgcaattcaattttttccatcattataattgtgttaaattctcaattccaaattaatttttcgtttttttccatgccaagaaaatattcaaaaatattaaatgagattcaaatgaacaaatttaaaaaaaggtgtgggcgcgtaaatgaagcaacaaaagacacaaattaatgaaatacatttttgggtgtccctttttcaccctcttatcaaataaataataaataaggcataaaattcgttgaattgtccatttatttttgatgttatggttggtcggcgggcgaaaaaagaattttatgttgacgattataaggaagaaatgaatagatgagtaaagagatgataagaaaaatgagaataatatgaagatgatatagcaaattggagtaaaggaaataaaaatagtctaataggcaactcgagacatattttttttgggcatcattgactttgtttgatcacaataattcacttattttgttttttataaaaaatctattttcgaatctgatagagcacgaagaagctatagaaataaattaattacagagaatttgtttaatcgttcagctagaaaatttaatattccccatttttgcctctggggcaagacttttttgggtcgctgtatttttgctttaatttttatgattcagtgattaatttaattaaaataactctcgagcaataaataaaatttgttttgtaataataaaatatcgtcccaaagtataacaataaatggcaaacgccggtaatctctgctaaaataggtcttaatcacaaccaaaggcggacgataaacaaaacgtcgtcccgaaagacttcatttttgggacaataagtttggaacttgaaaaactgtaaaatttgttctaaaggctgcgttttcatttgtaaatagtgcaatgagctgcttttacaaattagtctttgctttaaaacagggctcccattcgtccttgaatggcaaggacgtccttgaaattgggcccttccacttgaaaatttgaaagtatccttgaattcaagaagtccttgaaaatgagcatttggaaaagtttttaaaaaccccaaagaaatttgataatttttgtaattttcaacaatatttggattaaattatggcattatgtcaataaaatgcaaatttaattgcccaaaatctcaaaatttggtcattttttggacaaaatctactaacaaacagcattaaaaatacaaaattcttccggcgccgccggaccctcccctatcctcaaaattaaaaaaaaaagcgcgccgtaaaaaaaccttttttgtcaacaaaaaaaaaaagtcatcgcatggcttaaaatcgcaaaaattaggcagtttttggtgaaaatctgttaacaaattgcattcaaattttcaaaatttttccccggcggcgcctgtcggcaccgccagaccccccccccccccttttcccggaaatttttggaaaaagcgcgccgcaaaaaagcgtttttaaagcagaaaaaagtcgtcgcaaatgaggaaaatgatcagtgaaaacaaaaaaatgttggaaaaaatccattccggtgaaaaatacaagccatttgaataatattaaccatttttcactgcatataataaaaatttgaaatgtccttggatttcatgaattttccccactatgtccttgcaaatcggcatacccgtccttggaaacggagcatggacgatgggagccctggtttaacacctttcaaagggctaacgggactgagaatgtcaattttcatggccatgcaataaaaaataaaaaattttatttttgactttttttattttataattaggaccgtatttattttgcacacttatgtatttcggcctaaaaataacataccgtatatgctctaattatcccccccccccccagatggaccactttgcgacctcctcaggaagcgggggaccatactagaaacaaaattttggattttcta

SEQ ID NO: 11564 - DNA, 871 bp, Heterodera glycines
tacctctttgaatacttttgtacctcttttaatcaccctccccccacttttaatcacttttgtacctcttctaatcactgttgtatctcttttaatcactgttgtaccacttttaatcactgatgtacctctttgaatcacttttgtacctcttttaatcactgttgtaccacttttaatcacttttgtacctcttctaatcactgttgtacctcttttaatcacttttgtacgttttttaatcacttttgtaccgcttctaatcactgttgtacctcttttaatcacagttgtacctcttctgatcactcttctttttaatcacttttgtacctcttctaatcactgttgtacctcttttaatcacttttgtacgttttttaatcacttttgtaccgcttctaatcactgttgtacctcttttaatcacagttacctcttctgatcactcttctaatcactgttgcacctcttctaatcacttttgtacctcaaaatttaaataacgggcgctaagcgcccgtccaaggccgcgaagcggcctaacaagctaaaaaacgggcgcgaagcgcccatctgaggccgtgaagcggccttaatagcccaacaaatttagaaacgggcgcgaagcgcccgtctgaggccgcgaagcggccttaatagcccaacaaatttagaaacgggcgcgaagcgcccgtctgatgcctcgaagctgccttaatagcccaacaaatttagaaacgggcgcgaagcgcccgtataagcccaacaaaatttaaaaaacgggcgcgaagcgcccgtataagcccaacaaaatttaaaaaacgggcgcaaagcgcccgtccaaggccgcgaagcggcctaacaagct

SEQ ID NO: 11565 - DNA, 1211 bp, Heterodera glycines
  misc_feature (112)..(112): n is a, c, g, or t
  misc_feature (114)..(114): n is a, c, g, or t
tttccacaaagtgttatttttcgtttctgtgaattcataccaaatgattttttatcagagcattaatacatttcgatttatcatttatatacctaaaatattttaatgattnanaataatattaatttatttatagattctgcacgcgaattaacaccaattttttcaataaaccaccttttctttatccattttctatcaagatcacatgaactttttccttaatttgtatcgcgtaaatcttataaaatatttaaataatattaattttttaagattctacaccgcgtctgaaaccttcaaatctgtaagtaaaatattttccacaaagtgctaatttttccgtttctgttgaatccattatcaaatgatttttttatcagagcattaataaatttcgatttatcatttatataactaaaatattttaaatgattaaaataatattaatttatttatagattctgcacgcgaattaacaccatttttttcaataaaccacattttctttatccattttctatcaagatcacatgaactttactatttccttaatttgtatcgcgtaaatcttataaaagatttaaataatattaattttttaagattctacaccgcgtctgaaaccttcaaatctgtaagtaaaatattttccacaaagtgctaatttttccgtttctgttgaatccattatcaaatgatttttttatcagagcattaataaatttcgatttatcatttatataactaaaatatttttaatgattaaaataatattaatttatttatagattctgcacgcgaattaacaccatttttttcaataaaccaccttttctttatccattttctatcaagatcacatgaactttactatttccttaatttgtatcgcgtaaatcttataaaagatttaaataatattaattttttaagattctacaccgcgtctgaaaccttcaaatctgtaagtaaaatattttccacaaagtgctaatttttccgtttctgttgaatccattataaaatgatttttttatcagagcattaataaatttcgatttatcattcatataactaaaatatttttaatgattaaaataatattaatttatttatagattctgcacgcgaattaacaccattttttcaataaaccactcttttctttgagagatccattttctatcaagatcacatgaactttacta

SEQ ID NO: 11566 - DNA, 1442 bp, Heterodera glycines
  misc_feature (25)..(25): n is a, c, g, or t
  misc_feature (32)..(32): n is a, c, g, or t
cgttatctcttccagcagcgactcnggagcanggaggaccttcctacaaaaaacggtttattggggttgagaaaaaacagggcataatcgaccgaaaggtcggtaatcgaacctttatgagacttttccacatttgcatttcgactttgaccggataggggtgggggcaggagacctgtctttgtatttccaagaaaatgaacaaaatccaggctccccctgcgaaaaaaaaaattttaaattgttttatcgaaaagagagggggggggggccattttttgtcaaattgctttgaaacgattgaacataatttgcattatttatcgttttgtaaatttaagcccaacgaaaagaagacgccatcggtgccgggaaatatcgcttctgcttcattgggtttgtcaatttttaaagtttaaaaacatttgcatgaaaaatgcgctttctcggcgttccataaaaaaaatttttcgtgtgcacctacaaaatttattatcatttataattttagtcttataatatgtaggctggcgcttgcatcactcaaaatataaaaattttgtccaatttttgaaaaaaaaaaaaaattcagaagagccctccgaggggaagatttacatggtggagaagggtagcacagtggacactgtgctcggtgtaaggcgcgatcgtccagccgttgttgcattggtccgctacatggacgagcagtacgaattggtgccaacgtgagaaacgggggggggggggaaccgaataatatatatttttttaaattcattttctaccattttttaggcctctgttggtgaagcataacccggcaaaggtaaggcatttgcaaaaaaaattcatataaaaatcaaccaaaaattaaaaaatgttccaataaatttttttttttttgtaagttttcacaaaacatgaattaataaaacttcttttaacactgcttttttcagttgatcgaatactatgagaagcatttgcgctttttctgatgggggcgaacttcggcggtgatccaacgacttgtgttatggcacttttctgtttgttttttttgacggcatttgttggataaaatgccaatgaataattgattgattgggcgattttttttcattgctgactcatccctccgttttgaattttttaatttgtctatagatgcttctcctctgtcaccactggactgcggcagcaaaagacaatttttttaaaaatgtatattcactaccgatgaaatatttttgggacaagaagaaaatgccacttaaaatacacaccttccctcccctagagcttacatcctaaatcatattctcgagagaaatttgaaaaaacaaagtctcgggcttattcattattttaggaaaaaatgctttttgaggaaaatcaaaaattgtttatatattttttggccccatttttgattgttt

SEQ ID NO: 11567 - DNA, 3418 bp, Heterodera glycines
accgggacttaccgggaccagaaaagtcgggaccgggaccaagtttttcgaccgggaccgcgaaaaaacccgggaccggggggtccaccgcgtttcggcgctggcgtttcggcgccggcgtttcggcgctggcgttcggcgccagcatgtttttggctataacttttttctatctaatccaaatccaacattgttgatataattcgaaagcttaacatgtttagaagctttttctaagcgattgcttcgcgattagacaattaccaaaaaagttatacatgaaaatttcgaaaagtcgaaatttttgaagttttttcttaataaaattttttacaggcttgaaaatctatccgctttttgtaaggctaatagagcatgataagagctttcgaatgataccaagattgttggatttggatgccaaagaaaaaagcttaagtggaaaaacgagctggcgccgaaacgccagcgccgaaacaccggcgccgaaacgccagcgccgaaacgccagcgccgaaacgcgtgggtcccccatggacggtaaaaacaaaaaaaatgccaaaaaataattggcgtaaatacaaaacgccaacacactcaaatgaaaaacaaagtgacttaactgtgctcaaaatactaatcaagcgttaacgcccttaaatccatttcattacaattaaaacaagtatttttttaaagtttgtttgagttaaaattggtctgcaacatttattagtacttttaaggatgcattttaaaaattctctttgaaggttagagatatgaaaatagtacgccaagatgagagagaaagagaaatgcattttatgttttgttttataacttttgaaaaagtgtataaaacataaaatggctgttttacagtatgtagaatttttttctctattgatacgcaaaatctaaagaaaatctgtaaggcgggaaaaaagttctatagagctaagttaatattgttttttacattgttaaaaacgaagagatagtacataaaattgggagaaacgaagacaaaaagtaaatgtaaaagaacgccaattttcctataattattagggatgcgatttttaggtaagaaaaatcccagaataggtacttaaataggtaaaaaaacatctcaaaataggtattaaataggtacaaaaattccaaaataggtaccaaaataggtaaataaaattttttattaacgatttttagtggaaaaaagcaaacaaaaggggaaaattttggtttatttctttgtaaacgaataatttaaatatttttaatatgttcttagaaaatattgacattttaaattaaaaattttgttacataaaaaaacaaataaatttttgggaaaaattttccaattcttaggggcgtattttttgattttattgcatttttgttaaggaattttctgaaaatccttaaataggtataataggtagaaaaactccaaaataggtaaaaataggtattataaaagtcatcgtagacacccaaaaccaagtggaaaatgcttttttcgtgcttatctgtgcgtattaaatgcgcaaaattttaggtatttaactaaaaatcgcatccctaataattattcattaaaaaatattttttggtaatctttttctttttaccgtccatggcacggataaaattgagaaacttgcaaccaaaaatgataaaactctttcgtattgtcgccaaatcgctgccgccaaataaatttcggaatttgatgaaattttataaagactatagaacagggctgggcgcaatttccccccccccaaaaaaaattttttttctggctattgattcttataaatgttcaaaaaaatatataaatcctattataatgatcagattttcaaaagatttgaaccctaaaaattcaaaaagaatgaatttcttcagacacaaaattataatttccttgtaaaattgaagtcaaaaataaagaaaatgcattccgaaaatctgttttttgattttcattaattcactatttaaaaaaatttttcaaaaaattctgacaaaaattgatttttgaaaattgcggattgcggattacggaaattgcggggtttttggacccccgtaattgcggattgcggatttccgtaactgagaaaaccgccataattgcggattgcggatttccgtaattgaaaacccagttgcgcccggccctgctatagaactccctaattcccataataaattgccatttttgaataaattaataaatgaattatatattattaatacatatttaaacttgcttatatcaaaatttttaaaaatatataaatcagagggattttaaatttaaattcgtaaaatatttaatgtatgacgtcaactgaatttcgtgctaatcaataaaattgatccaatatttctttgataatatacaaatattggttagtaaaatattttttgcccattttaataatgttgttttatacagacttatgcgtcttgttaaccatagaatttttcggtaggtctttatgttactaaatatggtgaatttttttccaattttgaaaaattaatttgaattggacgaattttttccggattttgtcaaaattaaattttaattggctaattatttctccgattttttaacaaaattaatttgtatttattttttctgtattcggtgcgtctgtggaaactttggaaatgcttaacgacattataagaaaggaactttcaaatgttggttggacatgtcaaaagttttccgaacaaatcgttgcccaaatgggcgagaatggcacaaaaaaatgtatcaacaatttaatggcggaacagtcgcccatacttcggcttctcaatttgtcaattggaacggttaaaaataaattttcaaaaattatttaataaaaaaaatgtcattacattgaaaatatgcttctgatcacctcgagacaaaatttttttaaatcagttaatttataagtataaatttcaaaaaataaataaaaacaatttgcttaattaatatatttaatatttatgcataatttaattcaattttcctcgattttggctgtcatcttccgcaaaaagtgacgataactcagctatacatcaacaatcaattgaagcaatcgtaaattgtatgaaaagcgtgacgaactgggccaaatttgagcaaatgtttttgtttggccaagaaattggagggtcaacagaaatatttttggtgccaaaaattcactgggtgttggcacaacgaatccgtgaacattttggcactgaaattggcagattgaggaatttggactttgaacaagcaattggtgccggttttaccagaattagacaaaaattggccaaattaattggcatttgccaacgaaattgataaatcattgcaattgatggcatttatcaa

SEQ ID NO: 11568 - DNA, 1631 bp, Heterodera glycines
  misc_feature (60)..(60): n is a, c, g, or t
  misc_feature (76)..(76): n is a, c, g, or t
  misc_feature (100)..(100): n is a, c, g, or t
  misc_feature (109)..(109): n is a, c, g, or t
  misc_feature (1609)..(1609): n is a, c, g, or t
atttgccattcgcggtaaaatacgggatgaagaaaaaatgggaaagatgaaaaaacaatntggtgaagaaatgttngagaattgaaaacggatgattttntaagaaatntcgttgagtccctctccgatattttatttttattttgaccacatcaatttttgtattcaccgtattcttttcattctcataatttttgtattccattcaaataaaggagtaaaaaaggttagccgacatttgcggaccgactttaccaaagcatggaagtgaaacacgtaaaaattttccttggtataaaatcctgaactgacttttatgtgtattaaaatagcgaattttttcgctaatttcactacgtgtagagaagcaagaaaaaaatttccacttgttttgggacttctaagataaaataaaattctccaattgaaacagatcgccttgcatcagcttaccttcactaatttcaattttgggagtatttaatttattgaaaattaaaaaaaaaatttttttctttattttgacagttcaatcgggaaatactggtccgcaaatgtcgatccgcaatgtcgcactacggtaaaaaatgcttgtaaaatgatcatataattgctattattgctattatggccataaaactctgaaatcacgatttttaaatttaatgattataacaacttgaatatagaacgaatatgcataaagtaactaaatttaatatgttgatagcacacggtagctctaagtattctctatcaaaatatataaatttcaaaaaattttgaaaatttaaaaaagtttattatgggcataaaattcaaaaatcacgatcaggatgtgagcgggcggcaacttcaaagggctgcacccctagattttggctcttggcggcatcttcaaaaggttccacccctcacataggcacgggtttgtgcggtaaacacccgtgcgcaaccgtgcgcttttgacgctatatactactccctattctttaggatttccaagtaaatttcataaattgaaaagagaaaaattaaaaaaaaacattttgtgggaataaatttaataattaaaagaaagaagacactgttggcaccagcaggcacggcataaaaacataattttcttttttgaatcaatttccgactgagtgtttggcattttggcattttccttctactgacatccgtttgagagaatgcttgccattcaattaacataattaaaaacaattatggaaaatgcaacaattatttttttgtgcaaaaattgcggaaatacataatcaatgactaaaaaaacaatttaatgtataaaaagcattaaatttctttgcagaatattcataattacttttttaaaaaagcaatttcatttgcattcattcactgatgaattttttaattatgctgcaaaataattttctcgcgcacattcaaaaaaaaaaatttttttctttattttgacagttcaatcgggaaatactggtccgcaaatgtcgcactacggtaaaaaatgcttgtaaaatgatcatataattgtattattgctattatgggcataaaactctgaaatcacgatttttaaatttaatgatataacaacttngatatagaacgaatatgcataa

SEQ ID NO: 11569 - DNA, 3202 bp, Heterodera glycines
cttaataaaatccaaaatgattagatttcactattaacgtaacatttatttatttgtgaaatgattttaaaaaaaataaattggttttctaattaaaataaactataaaacattacaaaactcaactgatcatcaaaaataaaccaactcatttattcatttaaaaataagtatattttcaatgccttacaaagatttgcattcgaatcagaacaaatttaaaattcatgacatttttatattttcaataaatcaaattttcacataataaaatcaatggaaaaaattttgtttacttttctttatttaaaaaaacatgccaagccaaatacaatacaatgatttataaaatataagaattaaccagtttttaaaacataaataattttataagaaaatttatccatttttttcaaaaaatatttttctgttttttgttcctcaaaaatttcttctccaaatacatttcttaatcatggccaactccaattttcttcgaaatttcggcataattttggtgccattcttttcgtgttgcgcctgcaaaggtatcggacggggacccaaacaaatgacaggcatttggtgcttgaggaaatatttggaggaaaatgggaagaaaaaaggcaaataattgaaaaattctataaaataaaagagaaaataaagcaaaaaggaagaaaacacacagcaaaagaatggagtaaaattgaaagaaaaatagtgaaacaattggggacaaatcggaattacattcaaaaatggattaaacaatttgatctacaaaaattcaaattaaaattggagtaagccatggaacaattaaaaaatggaagaaacaatttggcattcgatatatgagaataacggagaaagaaaaaatgaaaatttattggcaaataaaaagagaaaatccgaaaatgagtgacaaagaaattgcaaaaattatgaaaattgatcaatcgagcgttttaaaatggagaaaaaaaattggagaggaaataaacgaaaaatgaaatagttgtaaaatttaaaaattatggccttttgttgtctaccttattttatttttattttgaccacatcaatttttgtattcaccgtattcttttcattctcataatttttgtattccattcaaataaaggagtaaaaaaggttagccgacatttgaggaccgactttaccaaagcatggaagtgaaacacgtaaaaattttccttggtataaaatcctgaactgacttttatgtgtattaaaatagcgaattttttcgctaatttcactacgtgtagagaagcaagaaaaaaatttccacttgttttgggacttctaagataaaataaaattctccaattgaaacagatcgccttgcatcagcttaccttcactaatttcaattttgggagtatttaatttattgaaaatttaaaaaaaattttttttctttattttgacagttcaatcgggaaatactggtccgcaaatgtcgcactacggtaaaaaatgcttgtaaaatgatcatataattgctattattgctattatggccataaaactctgaaatcacgatttttaaatttaatgattataacaacttgaatatagaacgaatatgcataaagtaactaaatttaatatgttggatagcacacggtagctctaagtattctctatcaaaatttataaatttcaaaaaattttgaaaatttaaaaaagtttattatgggcataaaattcaaaaatcacgatttttggatttatggataataactatacggttagaaaaacaatttaaatcatcaccctatttttattttattaataaaatatatttttaaaattgatttaaaattttttgtattttttcctctgcgattttatcgccttttttaatatttttttcctttttgcattagccaggagtagagatttaaatttataaattgatttacgattttaattatttctggggaccattttaataaaatgtgaattaatggaaaaaaacatttaaaaattaatcattattttacttattattgccaataatttgttcagtagaacaaaatttattaaaatcttaataattttttatttacattaaataatttttttatatttgtaaaagcagaagatttagatttatattatttataaaaataaaaaattaccaaatttatttttagaatttaagaagaaaatgaaactccacctattattagttttaattatatttttaatcatcgaaattgatcaaattaaaacggaaaagaaaaaattgcaacaaaaatcatttgatgaaatatttggagaaaaatgggaagaaaaagaagaagaaaggcgaaatgaactcaaaaaaagagaaataattgcaaaattttataaaataaaagaaaaaattaagcaaaaaggaagaaaatactcaacaaaagaatgggaaaaaattgaattaaaaatagcgaaaaaattggagacaaatcgcaaaaatatttataaatggatcaaggaatttggtcttcaaaaacaaatacataaaagctataaatcaaaaacggatgaagaaaaattagaaattgttaaaaaattcattggaatgaaaaatgaatataagcaaaaaagaaagttttcagaaaaagaatggaaagaaaattatgacgaaatttgtaagaaaattggagttagccattacgtaattatgaaatggaagaaacattttggaatgagtaaatttataacggagaaagaaaaaatggaaaaaataataatttattgggaaataaaaaaagaaaatccaaaaatgagtgacaaggaaattgctaaaacattgcaaattaatagaaagagcatttcaagatggaagaaactgtttggataaaagaatcattgaagattgaaaggatgattataagaaaaattggataaatttgccgaaaaaattatcagaaaaactatgacaatttctagttttttttcaaattttttgtatttgtattaaaaaaaattattttaaataccctaagttttgaaatttttcttagtgtaaataagtgaaaacagtcaattcaaggattgggagggtatcattaaaaactgaaaaatgttggaactgggctcccagtatgcctaaattttcgattttagaggccctgtaaaactccttgggcttttgctagggtgaaaaacaataaaaattaaaaaa

SEQ ID NO: 11570 - DNA, 687 bp, Heterodera glycines
attcaacaaacccaagcattagcaacatatttcttgccgccaactatttttctgagcaattccggtatagaaacgataaatttatattccgaacaattttgatcaaaattcacttttacttgcatcaggcttttcactgtttctacttcaagcaaatttctcgtatttttttcgcggtttttgagtcaattttaaaaaatagagaattctggggctccgacggtgccgataggcgccgccgggaaaatttttttaaatttaaatgcaatttttaacagattttgtcaaaaaaatatccaaatttttgcggttattttatgattttaaatgttaaaattatgcggactgggtcagtttagtctggccggtttagtctggccgttttagtctggccggtttagtcagagggtcggtttagtctggccgttttagtctggcaagccgttttcgcccataattcttacaaatgttttttgtcaattataaataaggaaaaacttaaaatatcctatgtttagctacaatataaatgaatatcccaatttagaaaataaaaacaaagcgaatccttcagtctggcacccgcctttttatagcttcaggcaaggaaacccctaattttttttccatttcacgggcttttgctggttatatcccaactgttttccgcttcatcaccccaattcg

SEQ ID NO: 11571 - DNA, 2283 bp, Heterodera glycines
cgcttgaacagagagaagaagaggacgagagggaacggaggcgggagaacgcgtacaaagcggtgctcgtgctaagcctctgtttcagccgtaataacaaacgaattgaagaccattaattcccctctcccccctttggtcagtgtgcgcgtggacatgcattttgacagtttgtccgctgctttaccaattgctcagcttcaccaccagccaatttgacggttggttccgccgttttaaaaagggtcaaatttattgggttcacaggcattctccaattctgtgaagacactgctcagactgttgccacggaatcggcagagcttatcgaagtattttcacgggagcagcaacgcgaagagcagttacgactcggaggagtcaataggacgaaaagcgtaagaagccaagggggcgggggaggggaaggcgtttaaggaacgcgaaattgcagaggaactttcgccatgttcttccgctacatttccaacatcagcaacagttgcaagatggttgccggtaatccaacaaagcaataattgatttttaacttgtaaatttcggtgccttttcagttgttcacccgaccaaggcgcacagggaacgccggggaggaagggaatgaaggggacaccgggagcaaaggcgagtgttttagtcagctgtcgtggaattaatttacttttctaaagggcgctcccggcattcctgcacggttgccgtgcgagccattgcaagacttgaaaaagtactgcccagagaaatgtccactgggactacagggaccgccgggacttcgcgtgagttaaaaacgcactttaatgtctataaaatctcacaactcagggacatatgggtgagaagggccgacgcggaccaatcggaccctctggaaagaatggcgacgatgggaagacgggcccccgggggatgcccggaccgccgggagtgccgggactgtaagaaagtgaggaaaacggagtgacgaatttattaaacagagacggcgaagacggggaatcgggcacggatgcgcagccgatgcaggtgagttggacctttgtcccccttgaaactgactcttcgcttaagtttgtgcccggcccaccgggagcgggaggagaaagcggtatttgaacataaattggaagatcaatccctatgctaattgtattccttccaaggagaccctggcccacccggaccaaggggactgcccggcatcgacggaccgcaagggccccagggcagaaaaggagcacagggaaatgcagggaaaatgggcgcaccagggacatcaggtaaaggggaacgtagcgcaaaagggacgtccattccaaaaaaggacccccgggaccgattggagaacccggcgaagacggtcataagggtgtgtgtccgacgtattgcgccatggacggcggtgtgtttttcgtggaaccgcccgaatggttcttcaaaaacagtaaaaaaaggaagtgaacattcaagcaaaaagtatcatattattttattattgagaagatcttaacattatgtattcatcgaaatgattgttcttccattgttaccctcaaaattttttaaaatattaaaaaaggaaaatcattgaaaaggccacatacatacgaaataattgacagtcatcgttattgcgcatttctcttcgtctctcaatggtggtccccatccgtccgtccgtcctccattcccaacccatcgacaatttgccgagagttgcgctgctccgtgttcccttcatccccgtcttcttctacttcatcacggtccatttcctgctcaagcattggcatcattatctgcgcttcagccaactataattccacattttgaagcatccactgaatgcctatgtgatgctcttgatgggtggccaactgctgtcatccggaaaatgaccgcacacaaatatcacataaatgaggtctatgtttccgtgcattcatatgatccgcttccttataccaaatttataacaacaaaatctaatatgcatataggaaccgggaggatatattcagaaatgacacgctcttatataccaccccgcatacaaataagctttaattaattttcaaaattgtcaaagaaaaagaataagataaagataaaaaaattttataaacgacaaatttgtgccagtcttgcatttattttcatgaaattcctcaaaattacactcgaaaatatggtaaaccctaaatttccagaatattatccagccccctaagttttaaaaaaattcaatttaatccatttttt

SEQ ID NO: 11572 - DNA, 946 bp, Heterodera glycines
cttctccaagtcataaatgagcacgcgcatgtcaaatcggctaacattttgtgcttcgatcatctttaaaaaattaaaattaatttatttttaaacgaacaaaaataatcttgaaattctacctcaatgaccactgatcgggcaccgaccgatttgacacggaaatgtgccaccgaatggatgccaccaaattggagcagacagaatgccaacagaatgcgcaacccaataatgggacacatttggaaaatgcttaattgcattaattaacgtgaaattttaaatttaataaatttgtctaaaaataggtacatagtatacaaacattttaaattacaatttggacagaacgccaagaaaaaaaacatccaaattacttgagctttgttagtgggatggggataaaatccaccgccggatggaccaacggctgctgctgatgagaatgggcggggaatttttgtggagtcggggaaagcaaaatgaatgacggagaatgagggagggcggagtctttcgggcaatgcgaggggggggggggggggggggggggtaattgtacaaaatgatgttgaaaatttaaataaaataaataatggagggtaattagtgaaatttaggcatttattacatttttatttattgttggtgaattttagtttttgtttttttcccttaaaattcagttgtataaactgtttctttaatagaaaaggattctgtcataatcagaaatttacatcgtttaatagggatgtgcgagaaatgatttttaccgataatcgagaaccgagaccgagaaatgaccccgagaacgagacgaaaatcgagaagcgaaaaacccgagaaaattctcgagtcgagaatcaaaaaaccgataactctcgccacttccccactggttacaggcaaaaataatatattttataaaattttaatttggatt

SEQ ID NO: 11573 - DNA, 1745 bp, Heterodera glycines
ccgccgggaaattttttgaaattttgctatatatttaacagattttcaatgaaaaatcattatttttaccaaaaaaatcaattcttaccagtgcatttttactcccgtttttgggtaaaaatttccgggagcgggagcgggagttcaaaattttccgggacgggagtcccgaacgggaatcccgtaaaaatcccgttcaccgaaaaaagcgggagtcgggagcgggactcccgtaaaatcccgcgggagtcccgatcccgccggactctagtatttaaattttatttaatttttttcgccattgagcacaaaaaatgtacacaattttgcaaattccataaaagcaaatttaaagaaaacccaagaattttaaatattaaattattttccaattttccagtcccaatacgaatataaaattgtgtgcattttaaattgtcatatttttctggcactttgtgcgccattttggtgctgttgatgttgtgttttgttggttggttcattagatttgcattcattcattcactttcattcttttttcattcacaccttcgcccccacggggcaatggcggggacaaatgacgctgaaatctctcgctcaattggcaccaaaaaatctaaggaaaaagcggtgacaaaactattttgaaaaaattaaacattggatttttggattataaatagttaacaattcatccttaatgagataactctgtgctaattgcctagaaaaaattttttttttctaatatattatataaacataatcgcttgaattttgtgttttttaaataaatcaaaaataaattctgaattgtgaattgtttttttttctaatatttttattaacaatacaaatgaaaaactgtcaaattgatcgttaatccaataattaaataactatttcaaataatttaaaataaaaatttaaaaaagctctccttacgataatagcatccacccacccatctcagcagcgttcgtttcatccgtaaaaatatgtgtgccgtcgttgacggcacatttgttcccaaggtccgtgtcaaacaaagcaaaaagcagggccgagggggtggtgggcggggggggggggacaacggcgacaatgatgccgctttgacgggacccacttccgtacatataagccatgccctactcctctttcaactccttttggccgatggaataataaaattggagtgccaccaccaccaccaccagcagcagctagctcctcgtggtgaaaaagacttttctttggtgccaatgttgggcttggttggtgcccaaaggggggttaggcaacaaaaattaataattcgtcccctccggcggggggcgaagggggggggtgagaaaattgttctcgttgcccttcgcccccgggggcgacaagggcgaggggggaaacaaacgcaggtggttcgaaggtgagccatgatgcctaagcaggtgttgacgtggctgacaaatggcaaccaagaaaattctggcatttaatgtttgtaatatttaaagttttcttgaaaattcatgtttttaaaaattttttatgaatttttcggaagggaggggaaatgccagtttttaagcaatgcgcacgccactattactagactaaaaagcctgtggcccgaggaacatgtaccagataatattctgtcatacaaatagaacaagcaaaaaaaaactatcatgattaaatgtaataataataataagcatgcttttacttagcta

SEQ ID NO: 11574 - DNA, 1690 bp, Heterodera glycines
atttccggtcagggtcgttttcgtaccgccgttttcgtaccggggacgttttcgtacgagttcttgtacaagcgtcagatccgattagaaaaacttaaaacctaatagaatcaaaatttatcattttttattttccattcataaaattaatgtagtgcatgcggcccggcccgtcttttgcgggccgacataaaaaaatcccgcggtcgcggattcaatttgccgcggtcgcgtcccagccctggtatatatattatatatatatatcaatttcctagcacttcgtagcgcaaattaaatttttgatcgatctgatactttccacgttttttttaaatttttaatttgattcggcttatcagaaagagcataaaaatttgcttaaattcgatggataagaattttctggggtttatgttttggttgggatcgaaaaagttgggccgctaatgtcttttatgctggtggccgcaaatgtgggaccgcacgtggcgcaagtgtctgccgcaaatgtcagggcaccactgaatttgtcgaacacagagtgcaccatcatgcaccaacttatcattatttcgttttgttttaattacttgctgctggttcattttgtagttaataaaagcttaaattttcaaacattaaaagtaattacttaaagagaaaaaattatttgaatgcaattttttttgcatatccactcgtacgaaaacggaggtacgaaaacgtcctggcccggtttatttcatggttttaggataaatccatggaaaagctgccgcttgtatgatattaattatgtgtagtaaagttgataaattattactaagttgaatatacggggcaattacgtcgccggttgcatcccatgtaattttgtgtagtaatgaaaccactttattttttttaattttctgcctgttctcgctgtttgtggtcggagggggctaaagatgagaggacaatgaagtgttgcgaccaagaccaggactatgtctgttcatttcatacagtcgaagtatgctgtttagtatttttttgcgcctataaatacaaattaaggaatgggtaagtgataagataccgccaataatttgaattgtggttgtgcttctcatggtttgtttattggtcaaaataaattttattcccaatgtagcgagtgaaacgcgcgaaagccaaacgggttggcacatgcatgagcaacgaagttgttgttgaacatattactagtaacgacaaaaaaacctgtgaacatacggaaggaacgtggttttgggtaagaatgtttcttaaagagaaatttttaaggtgtatgtttttcatcaaaaaacttagaaattgcataaaaatcaaatgatttgaaagtgcctcgtttggggtgcatcccaaaatttcgccccgaaaatttaaagtttttcaaagttcaagaaaaaatctaacaatttttttttataaaaatattccaagaaaaaagtttaaaaatttttagcgatttttttggaaaatttgagaaaactataaatcataattcaaaaaatcgctgaaacattttttcaaggaatattcttataaagaagtttcaaaaattttttcctggttttttattaaaaattttcaaagatccttttttgaaaatttctattgtttgagaaatttaaaaaaattttcggcagcgaaattttgtccc

SEQ ID NO: 11575 - DNA, 1030 bp, Heterodera glycines
aaaaaaaaatttaggaacgtcgaaccaacaactccgaaagtggttttccatcatcttctggtattcaaaaatataatttttgttgataattttctttagcattcctgatgatgctcattgaagctctgatcctggccccgatttattgaactgatcgaacaattttagaatggatggtgaaacatttattttttcaaggaattaaattttttgataaaacctatttcgaataatattagaagttaatctctatttaatatcaaaatcttgaatgtcatatctatttttcgagaaatctttaaaatatattttttgagatcaacttcttttattataccgctcatcagaaacgtatcaagtgggctaaggggcgatagtcaggatccaatttattttaattttaaaattcctcaacttacgcaacactatttttttttgctctctttttgtcaaattctccacaatatgtactgtaagtaaatataaaaatagaagagaaaaaaaactttgttgatccgaaatgttattttcttgatacggtcctgattgatgcctctaaactgtatgtaataatattttcatttaacattactttttataacatgatgtttcatatttggtataatgttaataaatttatttcatgatttgtttggattttctgtttcagaattcttttttatttccttgggagaagaaaataaagaggctattgtaagcttccgttctcggtttaatatttgtatcatggatgtcattccgaagccccaaaaatttttcagaaatataaatcggaatgacgaggtcccaatttatgctggaaatcggattttttgaaaagaaattctagaaattttcgaaatagtttaataggctaattttaagattgcgaacaaaagttgggacttttatttatatacatgtttactgtaattttagaggatttttatggaaatttttcaaaatgctcaaaataaaaatccgaaatttcacaatttttcatatatattttcatttgtttacatagaaa

SEQ ID NO: 11576 - DNA, 1304 bp, Heterodera glycines
attggagttgtcagcgagtacagcaacacgaagtgctgggtgacatcacccaaactcagcgggtgttatcgctgtgtcacgggcgcagcgctcacagcctcatgcaggacggaccacggaatggccttggcgaaggtcaaatgcgcggatggaactctgttcgcccttcactgcggtggcaacgactcgacaacgacggaggcaataccattcgaccgggcggaggtgttcacggagtgccgggtgaaatgccccgcggggatcacgacttttcggctaaaaggggagcttgcttttctccccaagcagcaacagttcggcttcaatcagcgagactcagccggcgggcgagtagaacccgggattagcctcagcttacccgactggcggatcgatcccttcccccttctccatctcttattaagcgggaaagggctattagtggcagtgggagcgacggcgattggactggcagcgcttctcatattcgtcaagttcagcccgcatttcagaatgtaccggtcattaatggcattggccataataacggcggtaatcccggtgggggggacaaattcagcgggtgaagtcacccgagccaaattcccggggacaacgaccaaagcggcaatcaatggactcagcaacggcgagctggacggggaaacgatgcggcatggtcaatcggatttgggggccttcccccaccatgcagttgctgttctcttgctcggggcagcgggcggcatacttggacgactcctcctgccccaaaggcggcggatcgtgccattttatgtcccacccccgcttacgttcacttttctgggcccgcttttgctcagcagtgcacttacggcggacagagaagcagcacaaggggagagagacatactcctttcagctacgatggacagagaaccaaagacgagctcaatcagcgaaggacagtgccggggagtacgaacgcacaacgggtgtatgacaaactggaagagacgccgacgctactccgcctctcaagggaatcacaatgggcacggtaacgaagtgattttcctgtctaagttggtgaatttgatctccgacttgggcggccacattggcctgcggatcggcttctctctgatcactgtgatggaagtggtcgagctgatcttcgagtgtttcaccttcggctgttcgaatttcactaaagccattcattcgccgattcattttttccttaggtaaaaagtgcgttttccgtcctttgcgcaaaaaggcatttgcccaccggcaccacgacgatgccgaaacggaag

SEQ ID NO: 11577 - DNA, 2738 bp, Heterodera glycines
acaagcggggagatttctctcccgagggatgcacgacggagtggcgggcgcgcactccggaggaagtgcggcaatgccgtcccgggcccagcggcacgagcgggagccggtccgggacggtcggagcgggtccgagccgacccagccgaggagaagggaacgggcgaaaagtggaagccgagggtacgaggggagcagccgagagcaagcggcgggtgtggacacccgagccggtgcgcgatgaggtcgctgaactgctcgagcagacccgggcactgaaggaggcagaagcaaaagcaaaggaggacgtccttcgctgggagcggcgagccaaggaagcgaaagagaaggcagaagaggcagaagcgatgctcaaggctgaggtgaagaagaagcgagaggaggtggagcgagcaaaggaggagcgactgaagaaattggaaagtgaggccgaagggctacgagccatggtggcagaggcgtgcttcccgcataagccggcggagaagagcggggaggaagagaagagcggggaggaagagaaggaagcgagggcaccggcaagccccccgaggacgattcgtcacgtggtcatcgacgaggactgcttgtcgatcgacagcgaggatggcccggaggaggaacggcagcgggccgcgggggggagtgtcgccaatttttccattggcaacgagagagcggaggagggaagcgggaggcgacccactcccgggcgcggtgtgggcgacctcgggttcctggtgttcaatcgggacgacggcacgccggtggagttggacgaagaagaagagaacgaatggggaggtggcgtccttgatcaccccgcagcgccgccgcggcgcgcaccggaggacgcaaaacgaaagaaatggcgccgatgagccggacggatcccacacttcaccgggagagccactcccgacagccaatttcgatccttccgccatttccttcgcaatttccccacatttattttgccatttcttaattttattcacatttattattctctctctctctctcttctcttcgcctatcgtatccaatcgtctcacttctccgatttgcaaattgtttatgcatttcttcaccattttcccaacctgccaatctcccattttgcgctggcctttggccgtcatttatccgaaaacatttcttttgtccccaattttgcacatttttcattccattcattcattcatcccccctcttctgcattaccatttgtttatctgatcggcctttggccgattcattttgccgtctttgtatttgtaattcgccaacatttgttcgggggcgtctcccccggtctcctccccctccctttgtcattgcgtaatttggccattttcattttcaaattcattcgccaattcgtaagggggctcctccccctactctcatccgtcctcattttttcatttatgcttaatcctatcgcatttttaacattcgttttccactaatcaccacgggggagttgtctccccaaatttcaatttcccccaccacaaatcgcggcattttttacccccctgccgtttgtcactgtcaccccccatgttcggtttaattacccaagtttgagctgcttaataaattgtgcttttaatcttgtgtgcttcaaagggtgggaaagggaaaaaagggagcgaattcccttcggacaaactcttcttagcccacggacgggctcgcgcatcgatcggtcacacgggactccctcacttggagtgcccagctcgccttagccctcgcacgggctcagcacgtaaaaacgggactcctgcctccggagtgcccagccgtaccaattttttctctcccttccccctccccaacgtcctctcttcccctccgagagtcggaccatcggacatcgtcagcgcaagacgggagaagctcgctcccggcagttcaacttgtgggattagccaaggagtcccggcttctccaaattctaagtcggtggtgccgttattcacatcactcggcgccctcgcctgcgccttttgctgacagtactcaagcccaagggagtcacctctccctttgccggccactgccagcttcactcgtttggcgcctctgcctgtgccgacgatcgcagcactcaagcccaagggagtcacccctccctttgccggccgctgcctttccttagggagtccaatttctccctcgccaatctttgtttgcctccccgactcctccgcctcactccccttgggaaagggacccggacggcatcgcgaatcggaacggcactttgaggagtgaggcggtgccagtggaacgggagaaactctcgaccgaacagaggacggagttttcgccacaaatccttttggaatattcaaaatttcgccgatttctccattggtgagctgtggatttacgatttttcaattcaaaatattgtttcattgtttgcattttttggtcaatggtatcagagttgcggggcgggggcgggggtttgcttttaattagctccaaaatctcacaaaaaaattaattttttgaatgatgtgtttggttccacattcctttattcgttgtatcgcctcgatttaattctttttggtataattgcacagatattgtctaaaaatgaccaaatttagggattataaattatgccagaatagtcaatttttatgggtgtttttgtctattaatccagggtttctatctcaaaattttcaaaa

SEQ ID NO: 11578 - DNA, 1308 bp, Heterodera glycines
atcattttttgaaaacttctaaaaatatcggtcacttgaaataataaattctaaaattttgtccaggaaaatccaggttttttcctgttttgcctggacctggacctggatttcctggacaaaaatccaggaaaatcaggtccaggaaaaatccaggttgtcaaaaaatgacctggacctgaatccaggaaaaatccaggcctggatccaggtccaggtcgaactctaaaggccagcttgaattcactcttgctggtgatataaaggactgctttgtttaaatcaaatatttgccatataacctataaaaatttcatttgagtataatttgcttatttgtagttaacctatcttaaaattgaaaaattgttggattaggttttgtgaaaacggattatattttcataacttgttaaagaaaagctttttaaagtactcagttttttacaattaacttatttaaaaaaattgtaatttagttaactattaatttttcggctaattaatttgcaaagtgcaattatgttataagttgtgtttgaattacatggattcaaaattaattttccaagattctttacattttttattcttttttctcatcatgtttcttaagtaaatcactcaacttcgctcgaaaacaaaatatttttctctttgagctttttagtttttttaaaattaattttttcaattagataatatttttgggttcactattatttattttataagatttttaattaaatgtgaaatacaaaaaaaaaattcagtgagaaattttattattattttctaattttacttcatgatctttttcttgtatttttaacatggtccagttcacaataatttccgcaagctagttgtcgctttttgtagctctctcccagtggtttcatttttagctaattttattgttccaatttcttatatttaaagcaatttgttaattttgatgaaaatatattttatagactcataatttatgatttattgggtaaataattttattaaataaaatttctttgttttttaggttttgattaaattgatcattttataatcttgcttcgaatcgatcaattgttcaacatattttgctatagcaaattgaattgtgtgggttttgaattttattttcaactaaatatttatttatattttgattattaaaaacaatggcatttgcattcgtaaagaaaaattttgttttttgtaattaaaaatacttgcttttaaattggcattaaatttgtaaatattaaataagtctttttacttatattgtttattcacacttatcaa

SEQ ID NO: 11579 - DNA, 6417 bp, Heterodera glycines
  misc_feature (5884)..(5884): n is a, c, g, or t
tttttctgaccttttcagcgcgcattccatattaacttctagcgatgttcattcagtttttttattttttcaatttcttctataaaaatattaccaaaaagtaatgctaatttcatgataattatttttaaaattattaattgctttatttatctgactttgaaatttaatatgataatcggtttattttccattatcatttattccgtatcgttttccatcttatcatcttttgggcattctttcgtacttagcactgatttcgctttcactaccgtaacttccggcgattattcagcttcggcggcacagcttactgtaatcctcgcttcgtcaaatgattggcccggataaagttgaacatcatcagggattcaaactaatcagaagtgctaatgatcggcttcatgttccagtattttccaggatcgactattcggaatttatttatgatttttttaattaccccactcggcactttgacttggagacttggcacaccttcttgaagatgttgttggtgaattccagcttgtaattgctgcaactttccgtgctgttggccaattccactgcgacggtcacttcatttttgcttggctttagtgaagtggtggccggccattaattggcagacaatgccaacattaaaaatgccacaaaatttttcattttaattaatttattcgtatttgttttacacaacattttcgagacagtggattaatttttatttaattccaactttaatatgaaaatcatcctgaattcccacgctgaattatgggactgtgttaacatttttgcttttattcattcaaatttcatcaaaaaaatggatggaattgacataatttagtgggtgggttcttataattgccccatgtaataatcgcttcttttaattagcttatttaaatgaatcaaattttcaaaatcgtttgcgtttttattttatttttcattttgtaaaatgtgccaaatctgttggggttttgttatttagattaagttatctcaatgtgaagcttcttcgaaataaaaatataatatttctcataaatatttagtttacgagtagaaaactatggcctcggctggatctgggtcgcgtcgttgttttattggatcctgaatcctggcttcttgaaaaaaggccgggatcagaatgccgacaaagcgattagactccattaatctcatttcgggcctgattccaatcccgttaaaatccagtgttaatagcagattctctttaaatttagtatttttataaattggtccatattttcaatttatatttatatgaagtgcaccatttttctattaaggttaatcatccttttttgaatttacgcttttgtataaattattttatttatttttccattttaacagtgaatcatccaaaaaaaagtccatcacttttcgcttggaaaacgacacgactgactttttttgcacttcataaatatttgttgttagccaaacgaacaatgaattaacatttattccaattagttaatggataaaccaatccgtccatttgtttgaataatagtaaaaaaaagaaaaataatttaataaatgagcagcaaaaactaataaattaaatattttatttattattttttaaataaataaataatacacatataatcattttagcagggctaaaatgagcattgtcaatctgcttttctttgcagtcttattcaaattgccaccgtttcttcacagcttagacaaagcatacgtcaccgaaccgtaaaatttaaaaaatttaatttatttaaaatattttaaggtttagctttctcttaacgggtggaaaaattggaaaagtttccgtgccgtactttgcgcttgaccaatgtaagccgtacaaaagcatcactcatgatccgaaggctgagtctcagaactttggtctgtattttttgatgaagcaccgaggtggacactgtgatgaggggtaaatttttgaaaaatattatttaggcctaattaaattttaattaccatttagcatattgatctgttacccgggcacactgatgcgcaatcatatgacaagcgagttcaaaaagatgtccgatttcagattgaaacggacattccaagtcggcaacaaagaagtaatggaaaatttaattaaaaaatttatttaaaatttttcaattttcgaacgatttgctttcattggagtgcgcccaaaaagccgaacaatttgttggcatttcaaacccaaaacaatggcgtggcatcaaagtgtacacgaaactgacaaactcatcaaatccgctttcggcacgagaactaattctggagacttcattgacaaatagaaggtaattaattttggtgtaattagtgttaattaacaaaaatttaagttacacctttgagccaatgactcgtcagctttcacttaattttggaaccagagtttcaatgttcacttgggtcacaactcattttggtaattaaattttaaaaaatattatttaaatatttaaatttaggacaaccgtttcatgacgaagaatttgacttggctgaacagtacgcccaacaaatgggctatggaccattcttggaacagcatgtcggactttggctgctcggcatggacatgttgccatggatggccgaagagtatgtgagcctgtacgtctaccgtggatgctcctgtaccatggacgcttgggtactgtactattatttgaaattttactgtaatttattgggatataatttaatgaagttcactcggccaaccgatgaaaatgacccaattgagccgattgtgccatcggccggctcatcacaatgcccgacgaagcaaatggacgaaacttttgaacttggccaattggacgcgcaacatttgcaggctgatcttgtgttcactgtgctgacggatgaagaatggcaaaacttcacagtggaattattacaacaagaggaagaaggtaagaggatgattaaaattggcaatattaaattttttgattaaatcaatcatatttgtatttattgaccgttgaataggagggaaataaataaacaataacgaggattgatgatccctatgggcctaattattgggatgtaaattttatgtattaaaaatattttttcaaaaaatgctgattttctaacctggtttaaacatgacgtacagatttgagatttttgcacaaaaataccttggcacgaagcctacccttctgcaacattaaaaaaatttattgtagaaatttttataaaaatcagcttgttacaatgaacattggacggacatttaaataaaaatttttgcaggtaaaaagctctctgtggtaatgaatttcacaattcgaacaatcgacgacatgaaagtgcctttttccggggtaataaattaaaaatcaaatcaaacaagtattatgtaattaatttttattaattaattaatgtagattaatacatcggtggtcaatggaactcaaatgcctaacggaattcaacaattgcgttttgacattttcctgctagagcattggcatgtcatcatggtgaacggcgagcagcttggcgaagtgttttggccaaaggaatggtggcaaggggcggcatggaaaaacatcacggcaattagggtgagtgaaaaagaaacgccataaatttattgatttgagccgattccgaaaatttgattttgaattgaacttaattgtcaaattttctgcatagattagcgaaaaagccaaaaatttacaattgggaataagaaaattaacttaaaaatgaatatttttatttaaaatattattttgataattaaaaagttttattttgtagcttaacggccaagtattattgctttatgggcctgaattggatgaatacggtattgaaaatgaaaatgtaagaaacgattaaaaagtaattaaaattaattaacattattattttagttcaacgtatctgtgccacttccattttcacagagaattgatggttttcgcgtgaattcaacattttttttccgtgttcaactgcttaatgaaacgcataatacagtgaacataacatttacaaatgggaacagcagtaagaaaagcataaataaatttaaatgattttttaaaattaaatttataataaaaataaaagtaacaaatacaaattgtcgatttaaaaaataataatttagctgatgcaactgatcagacggaaatgaacatcaaaattgaaaattttgagacaattgaaatcactgcttattatgtaatattttaattttttttttgaaattagctgattaattaagtaccttggatgggataaaatacagaaagtggaaagaagaaatatgaaaattcagccgacaaatagcaacacatttgaattgtttttcaacatcactggacctttttatgtgattatgtttaatggagaggatatttttccaaattacaccaataatatgtcaatatgtcatattaactatgttatggtaataaataataaatgaattttatacttctaattaattagtaaattaattttattttttatcgtttgttgattctttttatatcaactattaatttaggtcactggtgatgccattttattagattcgcccaaactgcatgtgccaccaccaccaaatgtagttttaaataatcttttttcttatttcatttaattttttttatatttatttttctaggtaaaaaatggaacacaaattattgtggcattgaacgattttttaaatttcggtgatctaatcctcattcgtaacgaagatcaaaagccgagaggaaaaattattgtcaaattgttgaacggctcaccgaaatgtctcaatgattgttaagtgtgtcaaatattatttaattttatattgtaagtaagtctctcacattatttctatgcatgaaattccgttttttattgggatgtcatatatttaaaaaaaatttcataatttttaaaaaatttttcaccggatgcccctgtcagcatcacgccaccaccaaaatttaagggtatttaaacaaaacaaaacaaaaattctttcgtgacaaatcgtagttatattatttatataatgggtttttcactttatttaaaaaaataaaataaaacatgaagccttattaaaaaacaaatattattattctttatttaaattaaaaatatttgtaaattttaaagatcatgttattgcacaaatggagttcaacgttgatgctggtgggcttggcaaagagtttttctgtgaacacatatacgtggagaacgcatccatagtacgataaaattttccgcactctaaaaaataatgaaaagcaaagggtccaattttagataaataaagaactgataaacgaaaataagattttcttgctcaaaaaaaggacattttgtaagaaactgttcaaattaaattaaaaatggtgatttggggttgggctgagccgattggttaatgctattaatgttcttctaggccataacttttttgaaacaataaaaaaaaaaatttttttttttgaaatttagccgttaaatattttgtaaaatgatgtagaaattaaaacaatattaaataagctaaaataatgggggaaaaaaatttatgaaaaaaagaggattacgattcgatatcccccaaataaggacaaaatctttaaaaaaaggtcaatataattaaaagcaaagggcagaatcaaagataaaataaggaattcatgggacgaaacataaggacattttgtaagaaacggttcataattaaatttatatgaaaaaagagggttacgattcgatatcctgaaaaaaagaggattacgattcgatatcccccaaataaggacaaaatctntaaaaaaaaaggtcaatataattaaaagcaaagggcagaatcgaagataaaataaggaattcatgggacgaaacataaggacattttgtaagaaacggttcataattaaatttatatgaaaaaagagggttacgattcgacacctccaaataaggacaacaacacaacccgtctttggattaacaaaaataatttacatttgaggtgacccgtcaaggacctgtccaagaaaactcattgaacatattatcaagaagagcgttatcactgaaaattctgatggcccaggacggtttctatggtcgatcatatggtgattacataaaactgtgcccatatttttggacatattggcaatactgggggatgtggccatggactattgaccatgttcaagtggtaaattaaacattttttgaaaattttttgttcgaaatatatgatttgttgtgttatctgctctcacagattgttcacaatgttatgcttactgtaaatgatattacggtaaagcaagctgatccagctgatgc

SEQ ID NO: 11580 - DNA, 4319 bp, Heterodera glycines
tcaaaaattgaaaattgcaaaaaatatttctacagcgataattagctttataaaaaacacagaaatgatgtgcataactgctggtgattctctttgggttcggggttcgaaatagggtgaaatggacgtgattcgtgttcagcgcccatcaaaacccctgaaagtttttttgtttgacttgacaaacaaaaagtttatgggcggtaaaccacataagtaccataaacaacgtctatgccaaacatcaagaaaaaaaaaatcacaaaatttcttagtgaaatccacaagtgccatgccctccgcgctggaaatttgttagtttttttatagaaaattttcattaagcaaatttattgttttttctttgatggcaccccccgttaaaaaagcgaaaaatgtttcttctgacaaccgccccctcattagtgcaaatcaacagcaatcgatgggttcgtcatttatggaatcagttggaaatcggcgaagttctcggctgaagatgaagaaaaagaaccggaaaataagctggtaatacaatactaattttcgatttttttgaattttgttatactcttggttctgggtccgaattaattaaaatggatgcctgaattggtttctccgaccccgaaaacccctaacaaatttatcccaaaaatttttttgcttgatatctccgcacagataacccacaagtaccttttttttctggaaattcagttaaattttgttttcagtagagatcgacctggatccaggcctggatttttcctggatccaggtccaggtcatttttcggcaacctggatttttcctggacattttcctggatttttgtccaggaaatccaggtccaggcttttttcaaaataccgatctctagttttcagtaacacctaggtttaaaaaaagctttaaaaacaatttttgataagttttttgcgacgacgttttggggtggcaaaaatataaatttttaaacaaattttagtgaaattctgagcagtttctttccccacttcagttggatttgcaacgacgttttgatggacattctgccgttttttggtcttcgtcaactcggcctcaaattggcactgatttccgatcgtttcgatgttttggtggacgcgcatttcgatggcaaatcagaattgacgatttggaaagctatcaggattcacaaagacgctttcacagaagtgccgaaattaagtgtgctaatcgataatgccaatcgtgtggaatttccatggcctgaccgtccgttgcacaacaaaattcgcttcaatttccttctgattgagtaattattccaaaaaaatttctgtgtaaattaatgcattttatgttgctccctttttcagttacattgatcattccgtcgtcgaatttctccgctccaatcaaccaatttgggacagaggcaccaatttgtatttgcatttttgttcatccaacaccgaaagcaatttccgcccgatttgggatgtttttgtccgtcaaatttggcccatttttacgacaataaatgtccatcatttgggccttcactttgctgatcatttggacactttgcttcgtctcacatcgccgacaattctctccgatatgaacattaattcaatccaatctgttcgtctgttcccagaagcaattgatgacgatgatgggccaacaaatacaaattctcacggacaaatgttgtcaaaatggttgcacactccgagaacagatggccgtccgaagaaattgcgttgcgataaacattttgaatcaccaaatctcgaatggatcaacagtttcaaagaggtgtgaccaaaatttccgtttttaacgactgactaattgattgcctttaattttcgtttcccattgtttagaaatttctccgtgccaccgcttcaatcagttacgaactgtattttgaattgaaaagttcaacaccaattgagccatttgaattggagaatgaacggaccaaagaaaatctgtcattggagaaaataccaccttatcctggcagttggctgttgaagcgatgtccaattaatggagaaacggcaccgattaaatgggaaaacgaaattcggctgacaaattttaacggtgtccgttttgtgcttaacattaacaaacagtgcattgggtgagtgtaacagataattgacaattcaattcaaatttcacttaattttaggccattggcgccaccagcggaagaagaaaaagcggatcaaagcatagaaaatgtcgtctaattgcgcggaagtggattaattatatttgagaaatggtcgatctcaccaattggaaacggatttgatgctcattttatgtcaaaatgctttgttgattttatttcgttcgaattcataaaaatcagggcttccaagtgtcctttttttctaatatttgtccttttttggcaagacctccttgttttgtgcttattcttggatttgaaaataaatctacaaaaattaaagatgatgtctacaaaaacctctaatcttcctcaaaaaattaactcgaaatcgcaaaaattgtcattttttggacaaaatcttagcaattggcatttaaatattataattagagaacgaaaaaaaggcaccaaaatattgcgaaaaaagcacgaaaaccccgaaaatggcataaaaaaggcatttaaattttttttttattaaggatttttagggcgcaaaacaagtaaaacataaccaaaaaacttaattttggttatttaaatgattaataaatattttataaatttttttccaataaggaaaatttttaaaccataattttttttaatcaagaaaaataaataaatttttgggaaaatttttcaattcttaggggtgtattttctgaaaaattttttgggtcattttttagggtatatttttattttttattgcatttttgttaaggatttttcggaaaaatgccaaaaaaggcattaaaggcataataaaagtcatagaagaagcttcaaacttttaggccattgtcgccaccagcggaagaaggaaaagaaaaagcggacgaatgaaagcaacgaaaattattaattatatttaagaaatggtcaacgatctcaaccaattggattcggatttgatgctctcgttttacctgagaaatgctctctcactttcatttgttgattcctttatttgaattagtgttgttactagagaccggaaatttcaaatttgcggatcccgctgcgggactggaactcaaaattttttgcgggacgggatcccgcgggattaatcccgcaaatcccgcatttaaaatttgcgggattgcgggattttggaaaattcgaaaaaatttcaattaaattcaaaaaatttccaaaaatcaaaaaatgctgaaaaataaatttttaggggctggcgggatgtattaaaaggggctgatgggtcgactaagattttcgattggatccgacggtaaaaagttgatcggaaatcaaattattaacggttcataaattgactatttttttcttttcaaacccacttttttgcggtgcaatttttcaaaaaactaggaacagagggtccggcggtccctatcagggatggcattccgaggctccaaaaattttcggaagtgtcggaaatcggatttccgaccccaaaaacgtcggaaatcggaaatttttcaaaaaatatacaatataataaaaaaatttctaaatattttaataggctaaattttttaattcttaaccaagtaaaaggtatttcacaaatgtttttagtatattcgcttgaaaaaattattcaattattttatcaaaatctttttttgtcatttttattattttagaacatttttgggaaaaaggagtgactatttacacgttttttacagcgctattttttcaaaaactttttaggaacttagaggagggtacagcggtgccgataggcgccgccgggaaatttttaaaaatttcagttcaatttattaacagaaattgtgcaaaacttactagttttttgaaaaaaaaaaattaaaaaaatttccgacttttcatcaaaaatttcggaagtcggaattccgaccccaaaaatgtcggaaatcggaagtcttttcgtgccatacctggtgcctatcgacatctgcgagaaattttatgaaatttaatgcgatttgttaacagattttgtctaaaattgaccaaatgacgcagtttttgactcaatttctacaggattattaagtaaaagcctatccggcggtgccgataggcgccgccgggaaaatttcacaaatttgaatgaaatttgcgatga

SEQ ID NO: 11581 - DNA, 1372 bp, Heterodera glycines
atcaattttccatttactcagcaaaatccccggcagggaaatgaacaaaaaaaagtgtgtgtggcagggggggcgacgagagtgtcaatggagagaaattatgtgggagagagtgcagagataaggaaaagaaatttggcaaaaattccaacaattaaatggcaaaatgtttccaggaatgggatatgtggggctaaactcaatttcgtaatccataagattggaaatttcattaaatgaacggaccaatttttcgcaaaaccaaagctgtcacatttttgaatgaattagggataattgtaattttggcccaattacaatgattaaacatttttttctctgctgccatttgctaatctgttgtgtatttactacaacaataaaaatgtttggtcttcgaccaaaaccaatgttgtcaaataaataaataaataatttattaacaaataaatatgggggacagcaggaataatataataaaaatcatgaaatggaggaatgaatgggagaatgcccagagtgggggaaagggagacatatttatggactggtcaaggggcggggcgagagacaataagagtaatcaatagggttgttcccttatccaacaaatcttcgaccgatcacttttaggcccgaatgccgataacttttaagcccaaatgccgatcaagcaccgcaccaatttttcgaaaaattcagagctgtctcatgagacccatcataaaataagtaactcgaaagtgatgcaaatttcccttttccatgaaattttgtatctaatttctcctttttgaattttatgcttattcttccgaagcatttccttctgcttttgattcctcttctgccaattcgtatttctattttggtggagagaattatgtgggagagaattaagagataaggaaaagaaatttacaaataatattcatagaatgattaacagcagtaatatggattttggtccaattagaggaagaaacaatttacagacaaaaataattatcattaagttaaattttttattttggtatcagatgaaagcgcagttcattctttaagaatttttttttgttaatttttatcttacaattttccattagaaaggaaagctgataaaaaaagtaaaattattgcttaattgtctattcaaattgcattttgattaattgtttcttcccactgccaaatcgccttctttatctgatctgacattgttacaaaattaaaaaaatatatttaaggcaattcaaatgaaaatcgttaattctaaaaaattcaaaaataattgcatcagaccaattctcttccttgagtagtgattcaaaatgattgaccaattaattattattcacttccgctgaatttc

SEQ ID NO: 11582 - DNA, 2575 bp, Heterodera glycines
aaacaaatatgtacataatgaccagcagaattgctgtggtgtcacggagaaatgcctaaacaaatgccaagttgatcaaatcaacagcaaacgccgcggatcatagggatacaaaattttcaaaaattgctcctattaaaatgaggccacctctttgaatctgttgactcaataggggaacagattttggaattgattgcttttttgtaacctttttggggctccgataggaattagaagaaattatgagatcaatgtaatgaccaattcacagctgatcaattatcaatcaataaataactcatttttaatcaaccattaataaataattttttttatcagttctttcctttttaatgaaaacctaaaattaattgggacagtaatttaacccagtcttgatgcgcatttgattatccaggaaacgcacaaattttccgctttaaatgatcagctgcgcttgatcgactttgggccaaaaaattatcggtaataaaaggcaaagccaaaaagttctcggttgaagatcagcgaatgccgacagggacaaaaaaatgttcagaatgtctatgaaaatcatccagaaatatcttacaatcatttttgctttataaaaacagaccaatcaggcaattagtattatactaaactactgtcaattgcataatttcaactgtttaatgcgatacgttgatgaaatattaatgggacatttttgcacaaaattgattttaaaatttagttttttttaattatatcattttaatgtgaatgtgtaaatttatagaagaaaattaattatttaaagctcacatccgggattacttaatcacttccgtaattgaaatgaaataaagctaatgaccgaaaatttataattaaacttagacaaaatgtgaataaatgaataaactgttttttgccttgccataattggatataaacatgtaatattgaattaatttattaaataacatttaatgaaaaatatgatgacgtaaaatttttggttcgaaattccattaaatcgcatatatttaaatcaatcattggtagtgtaaagcgcaattaagcacatccgttttatctctttcccaagcacatatccccgctctcttccattccattttccgttccataagtccaactatttaatcgggagcattctctcgataaggagtcagttgagtgggcagtaatcggcgagcgagagccgagagcaaagcgcggcggaattattattttatgtgattggccaatatttatcttatattttactccttctcgcccatcccagcacgcgtattcgatctagtgggcgcccaagggattaccaatttggggaggctactgtaacagtagaaaatcggcctaaaaagttcttggcttccgtcaacggagaagcagcatgaaaattgctaaaaacaaacaaaacacgcggtgatcacaagtcaaaaacaaggcataattttccaaaaatgcggcaaaaaaccggcaacttttgggcaaatttatggtaaaacagtaaaaaaacattcaaacatcttatttatcatcacttttatgcaaattatttattggggccgggagtcggaaaaatttttctttggaaatttgaatagattgttaacatttggccaaaaatgacaaaatttacacagcaaatcgtatccctggagaaaaatatttaattatttttataaactaaatgaaaagagttagaaaagcaaaatcaaaaaattgaaaaataaaattctgtctcgtgaatccgggctctaactatcgcaaaacaatgcaaaaataggaaaaaatgaatttataaaatattaaattagctttaattctatcaaaattagagaccggcgcgggacgggatcccgtgcgggattttgcgggatcccagtccgcaatcccgcattttttggaaatttttctaagacagaatgccaaatatttttaaataaattaaataataaatttaattaaagttaactcatttttcatcgcaaatttcattcaaaatttgtgaaattttcggcggcgcctatcagctccgccggataggcttttacttaataatcctgtagaaattgagtcaaaaactgcgtcatttggtcaattttagacaaaatctgttaacaaatcgcattaaatttcataaaatttctcgcagatgtcgataggcaccaggtatggcacggaaagacttccgatttccaatatttttggggtcggaattccgacttccgaaatttttgatgaaatgtcggaaatttttttaattttttttcaaaaaactagtaagttttgtacaatttctgttaataaattcaactgaaatttttaaaaatttcccggcggcgcctataggcactgccggaccctaaaaatccctatttttcttgcaaaatttgctcaaatcgcaaaattttgtaattttttggacaaaatctgttaataaaattttcccggcggcgcctatcggcaccgccgtaccctcctccaagttcccaaaaagtttttgaaaaaatcgcactgtaaaaaacgtgtaaatagtcactccttttccctaaaa

SEQ ID NO: 11583 - DNA, 1115 bp, Heterodera glycines
  misc_feature (1100)..(1100): n is a, c, g, or t
attaaaatatttagaaattttttttattatattgtatattttttgaaaaatttccgacgttttgggtcggaattccgacttccgaaaatttttggggcctcggaatgccatctctgatagggaccgccggacccccgttcctagttttttgaaaaattgcaccgcaaaaaagtggttttgaaaagaaaaaatagtcaaatttatgaaccgttaataatttgatttccgatcaactttttaccgtcggatccaatcgaaaaatcttagtcgacccatcagcaccttttaatgcatcccgccagcactaaaaaatttctttttcaaaatgtcaggcattttttgatttttggaaattttttgaatttaattgaaattttttcgaattttccaaaatcccgcaatcccgcacgggatcccgcaaattttaaatgcgggatttgcgggattaatcccgcgggatcccgtcccgcaaaaaattttgagttccagtcccgcagcgggatccgcaaatttgaaatttccggtctctaatcaaaatcacgcgtaattccgtttttgaaaattcttatgccaatgactgattattacgatttaattttttattttttcagagttcattcgtattgaacacatttgatctagacctaaaattgagcatgaaagccaaaaacataaaatttcaccatttttatatgtatgtgtaaaattaattaattttctatcgttaaaaaatataccactatttaaacatttttgccaccatttaaataggtaataactagggctgccaattttatgtaaatacatatttttttcctggcttctccttgctctaaatagcaggaaaacactttcttttttgtgtttgcgaacaaaaaccgggacttttatttacatatttcgggattttcttacatatttgtacatattttggattttttttcatatatattttcatttttttacatattttgaaaatttataaagaaaaaataagtttgaaaatgttgcctaaaaataccaaaaaaagtaatttttatgtcattttgtggctatttttcatattttacggggaatttctttccaaaaaataccattanaaaaaatttatttac

SEQ ID NO: 11584 - DNA, 2302 bp, Heterodera glycines
aattccttttcgatgggttaatacattttcgtttttcccatcattttttggtggcggattaaaattcgaaaaccgtccaatttgggaaagaaatatcattaaagtttcaaatttatgcttactgatttatttttttgattattttttcttaaatgaaaagattgcctttcaaaatttagcattaaatatatatttttgtttttgtttaattacatttttgagttagtccggctggattcgacgaggtatttaccggaattcctgtcctttttccggatcatttcgcactcccgttcccgactcccggtccgcattttaccggtctctagtaattaacaaaatcttaaatgttgccaataaaataattaaatcattaatgcattaatgcattaagcattcatttaggcctacgtgactttttttaatgtctattattatttatcgaacaaaccacaaggtgctacatatgcactctaacagtggcgtaaaaacaaaacataaaaaataaatagtttaaaaataaactaaatttgacgaaaaaacaattataaaaaatgtttgaccatacgaaatgaaaaatttgatacaaaaaataaaaacttgtagggaaagaaaaggggtctggcgcccatttggctggcgcccatttggttggcgcccatttggttggcgcccatttggctggcgcccatttggttggcgcccatttggttggcgcccatttggctggcgcccatttggttggcgcccatttggctggcgcccatttgattggcgcccattcggcttcgacccggtccgaaaggaccattgttttttctattgatatttttaggccattattttttgccatttatttattgcctcaagcgcggaagataaattctctctatttttatcattttaatgctcaatataaattttaatttcatcggcaaacatcttaataccaacattcttaggcaaattattcggaagatcattaataaaaataagaaaaagcaaagtgcctaacagggctggagcgcgcacagaaaaaaaccgcggccgcgcaccgcgcattcaaattgccgcggaccgcgcatcgcgcaaaaaaaaaaaccgcggccgcgcatcgcgcaaaaaaaaaaaccgcggccgcgcatcgcgcattcaaattgccgcggccgcggaccgcgcaaaaaaaaaacgccgcggatcgcgcatcgcggtcgcgctccagtcctggtgcctaagacactaccttgtggcatcccactataaatgttttttgagttagaatactgctcagagattttaactctgaatgaacggtcatttaagaaatttttaataaatttatgaatcttgccattaataccgacatttttaagcttttgtagaagtaattcaattggaacactaacaaaagcttttgaaatttcaatatatattacatcaacacaacttttattttcaatcgatttataaaaatcattaaagttgataagagttgtgttgtggtggatctttgtctaaggaatccaaactgaaaaggactaaaaaattgatttttattcaaaaatttaagtatttccagccttattactttttccattgccctgcataaagtacaagtcagtgaaatgtggcgataatttatgggattatctgtctctccttttttgaagacagggataattgtggatgttttccatatttcagggattttaaatgaatctaaaattattcgaaagagttcagttagtatgggtgccaaaggaaatgcgcattcttttaataatatgtaagggatgccatcaggcgatgtagaatttcttcgagggagttttctcaataaaattcatgtctgtgatatgattaggatttacatggctgcgaaagtcatgttattttccttgtacaaaaatgatttttgaaagacatcagccaatataatacatttttgttcattctgaaaaataatttgcccttgttcatcaataagtattggtattccggtgttatttttaagcctgtttctaacaaatttatagagagaatttcttccatttgaaatacatttagcctcattttcacaatataatttatgagtatgttttttatattccctgcataatattttgtatttaattttaagctcacgacactcagcttttccttttagcatgctatgtgttcggctttttcccggactaaggttttcatttttcatcatgtttttgcttaatagttgttttaagcaatttcatgggtacatatttataaaaaagtttttttaattcagtcgtaaatatataat

SEQ ID NO: 11585 - DNA, 2694 bp, Heterodera glycines
tcctttccccttccctttctttcttttcttcttctcttctcccatcctctttcgtctttttcttcacatcttcctacctatcttccgcctccatttctcaaattttctcctcttttccttcccttcctttgctatttttggcagtttaaaaaaatttaaaaaaaattttcctcttttgggactatctgacttatgcttctccttctcctcctccatcgttttaatgtatgcatccaacttaaacttttcaatttcacacgattcttcttcattcgtcaaagcctgctttgcaaaatacatcatatccgcctgttctggttcttgtattatctgaatgtaatcctttaggcacttctctttcttttccctggtctccttataagtcttcaatagtttctcaaactgttcatccattccattagcatcataatatttcatgtattccaccaaatccttctcctcctccatcgttttaatgtatgcatccaacttaaacttttcaatttcacacgattcttctttattcgtcaaagccttttttgcaaaatacatcatatccgccagttctggtattgagctcatctgaatgtaatcctttaggcacttctctttcttttccctgatctccttataagtcttcaatagtttctcaaactgttcatccattccattagcatcataatatttcctgtattccaccaaatccttctcctcctccatcgttttaatgtatgcatccaacttaaacttttcaatttcacacgattcttcttcattcgtcaaagcctgctttgcaaaatacatcatatccgcctgttctggttcttgtattatctgaatgtaatcctttaggcacttctctttcttttccctggtctccttataagtcttcaatagtttctcaaactgttcatccattccattagcatcataatatttcctgtattccaccaaatccttctcctcctccatcgttttaatgtatgcatccaacttaaacttttcaatttcacaccaccttttcttctctttaaaaggcttttgcttttcaaaaagcggatcatataagcttttgtgattacgttggtactccttaacagctttcttccctcctccttggaccctgacagtttcttcccttcattatacgcactcaacatagcctccaacgccaacgtcaattgcgattgaactgattccgaatcatccagcttctgttgatattccctttcactttccatctcttttttcgcattctgataattattcaacaggttttccaacttattgtctttctcatcttcataatccatgcatttattctcttttggaatgtcaaccgccgaaaaatcttgaggtcgttccaaagtaaatgcataataaatgccatcttttatggctttcacttctaaaaaggcccaaattatttttagggttggtttatttttgtgttttctgattgcaggcgcaaaaatgtcgagatagtttgattaaaaagaaatgtgaatttttcaaaattaatttatatgtaacaataataaatgcacttatcacctggctgctgaacatatccgagtttttcacaattctcaatatattccttgacatgtttaaagaccggttcaggtggataaggctcttctactatacagtaagcttgtattgtgactgtatcatttgcttcaacatttctgaatgacaaaatctcgacgagcatgatgacgagactggtgatggtgggcagcattctgaagtaatatgaacaactcttggggttttgattttgtgataattccctcgctattcaatcggcttttataatgatagcacacgcacgccaaagcgcatagcagcatttcgccagattaatgcgcatttttatgaatattccctcatatattaatcaatgtttcaccagattaatgcacatttatgatggcaagcacgcacgcctaagcatttgccagcaacgcaatgtgtatgcttaatattttttacacatcaataatttacttttatgcatatgtcagtctctgtgttgtatattatgtgttatgcttttctagcccatctctgaattttataatttattaatataattttcttttcatatgcacgcataccgtttcatgcatatgcgtttttatgaatatatcatttgaatacacacacgtttatgcacatgcccctcatatcactcctttttatgcatagcgtaaatgtgaatattttatgaatagagcaaatgaatgcactttttaggcatatgcctctcatatatgaatatttatgaatatagcaatatatacggatttgttgaatctgctttttacgatttagcatatacatgtagaaggctgacttcgtttaattgtacggttattttaattaatcgcatttttttttattttccataaaaaatttcagtggcattttcgctcgccctgcgctgtccgttgtcgcaacttttcgtcaatcgatgcgagttccttttccgactgcgcaaggccaactacgtgccgaagacgacggctgatcagtgatcacatcacgctggagcagttctgccatcccagcgatcgcttctttgattcgtttcaaattgtcattcgtttcaaattgtcattcgtttcaaattgtcattcgtttcaaattgtcattcgtttcaaattgtcattcgtttcaaattgtcat

SEQ ID NO: 11586 - DNA, 2301 bp, Heterodera glycines
cgtagatcagaattctgagaaagcaacactttgacttcccctttagttaagaaatgattttaaatacggaaaaaattacccgtttcccacaaaaaaaaagtttagtttttttcttcccaaaagtctgtttccccgctgttttatcgtttggtccttccttctcacttggtttggtcacgcaatgatcgtccaaatcggttgtgactattttcgttgccgatttcgagcacgggctctcggttgaagccgatgtggagaaggatcagacaggagccaggcaaaaggaactgcgcgaacagatcggccaggggaaggaacactttccaaaagggacggccgagccggagaaagctgatcagtgggctgaggccagcaggggatgcttttaacacattttctgacccagcgcacccacccgtccgttagcatacagcgttgggcccagaaagggcccggctccgtgtccatgcagaaactttaatttttcaaaaataaaaactattttgagttaaatttttgaaagaaaaccacctgtatagtgcggcgtcgtgctcaaagaagcgcaaaatgccgaggagaacgctaattacgatgatgaacaaaatggcacgggagaaacgctcaatcttgaaaaaaagtgaaaacgaaaaaatgaaagagtgttaccgtccgaagttttaatgtgcttcggtggtattgcgtgagaaatcttagaatttttagtgaaaattggtttcttgaatttaaggaaaaccttgcaacagcgagcaaaacctaagaaataaacttttcaaatttaaaaattatatttttatttttaatttgtagcgataaattaattatgaattgctaaataaatattttaaaattaaaataataaattaaaaccgagaaaagtgtgacgagagtgtccattgtatgagggataacctgaacaatcagggtgtgcttttcataacatcaattaacgttaattaagcacttccattgaggtgcggtacaaatggcacatggccaccgattggttcatttgacgaaggccatcgccaagcacataatactaattggaataaattatttttaggatttaatttaaaattgaatgcttaacccaaacggtaaaagggagcggcgacaacaaagagacccaagcgcagaagcacaaaagcgagatcagctggtataacgggttcggctggcagaacaaacaaaacgagcatgcaattaatgccctaattagcacaaattacaaagcgtcggtcgccctcgcgcttttcgcgtctgctcattcccaacattctgaaaaagtaattacttatgtgaaaaataatgattaattaacaaaaataattattacacggcgcttaatggagcgatcattagcaggacgagcatcggataaacgaagctgaaattggcatcaaattttgttgcaaaacatttagaaggcgacccataaacggcgacgtggggccaagcgtcgttgattctgccgaacataaaagcaacattcgcctagcaaaaattaatttttataattaaatattcgttttaataacaaccgaaacgagacacttctgttgattgaaatcgtagaaaaaccctaaaagtgccatttcaatttaattgaatttttgtgcctttgttttacccgttccgcaacaacactttgctgtcttaagcaatgcaaaatttaaatttgatttgtcaaattatgctctttttgtaccctttgttcttcagtggtgcattggtcggctggcagaatggaaatgttgtgaattgtcttaatatttttttgtcatttcactgattatcattgtttgccattttctgtttttaatttgcttttcattcgttaattgcttaattcataataatttccacccaccaaatcagcatcgccgtctatgtgcacgagttgcatttgcttcgttcatggatggtcatcagcagccgattgtgaagcaattttagcacggaataggtgtcatctcatgcgaattattatgcatttttataaacaatttaatttttcaattttataatcaccaaaataaaaataattgaatcaaaataaaaatgttttatttgtgccatatgaaagggtttctttccattgatattttccataatcccacaacaaaacagtgccaaatatcatcggtcctctcccctgggcttttctattcaacaaactatgggccactaattggcacatttattggctcaaggtgctctcgagactcgggggaatgaagcgaccgaccctcgactgggaggaattgaccgggtgaaaag

SEQ ID NO: 11587 - DNA, 949 bp, Heterodera glycines
  misc_feature (13)..(13): n is a, c, g, or t
tgtcaaataacanttttgttaatgacgctaactctaattgcccgtttaaaataaaagttctcgtcattttatatagagattcattccaatcggccggtttgaatttgcctttgatcaccgctttgactttttggcattccgtccattcattgggtttattatgcaaattacaaattggaacctttgctgccgttgttcctttttcggtttggctgaaaattcttttgcccttcttctgctggtcgactcggtgttaaattggtcgaaaaattcccagagggaatcaatcagtggcggaaatttgtacaaattgtgcgtcgggaccgttgtcaaaattttattcactctttgcattgggcaaagtgccattggtggaaggaaggaaaagggggcggagagggcacaaaaagagggggcgaaagagggagagagagaggagcgaccagcagcaggcagggggtgaaggggcggaggggagggggcaaggcggcggggggggggggggggagggttgaaggaggcggagggggacatgcacagcacaacataatacggcaacagaacggcacgcaactcgacaccatggtagggggagggggagaaaatagtaaattaggaaaggagtagagtccgatattgacagcaccatcattccaccacttcggactaagagtcggtgaattgtttttcgcgatcctccgctggaggctcaacactttccagacaatccataatggctacctatcacgtcattctatgatgtgattatgtttacttaaatattttgcatcctttttaaatccttctaatgggcggaaattactttcgaaatttattttatcttttggagggacatttattggagttataataaaaatatgcgaaatcaccctaaggtaaggcagtgcccgacgatataagataatataatttgtttcctaatttcccc

SEQ ID NO: 11588 - DNA, 1545 bp, Heterodera glycines
gggggcaagggggcggacggggacatggcagcgacattggcatgagcggaagaaatggcacggggctgggatagtgcagaatgaagaggccgcaaattattggcactaaaaaatggcaaaattgtcaaaataaaagaggggcgaacggatgaagtgaacaatcataatattgttgtgtgtttgagggccaatttattccactgtttcacatttgacccctcaaaattcttaatgatttgcttaatttgcgccttttattttccatttcaaattctgtcgttccgtcttctcagataaggtgtcctccgattttgcgatttgaatgtttttgacgcataaattcgcaatggcaccgcatccgtgccattggagccttcttccaacgtttcttttgggttttgtgatggcactttgttggtgaagaattttgtttcgccgggttgaccaagtgcaccgttagggccccgcgggccatgaaggccgggcgagcctggtggcccacgttctgaacttcattccattttgcaaagtcatctggaattagtcgacctccttggtatcccctgggcccatttggcccgcgttccccgggctgtccatcaaatccggcattgcccgggccgccccttggacctgtcagtcctttaaaaaagaaaaaggttttattgcacaattaaagataatttaccgatcggcccaatccttcctggcgatgcactaaagatggtccgtccttaatattactcacgattttgattttgctaatatcatccattatttttgcctgggtctccgatcggtccttggtggccaaatttgccaggctttccatttggcccgaccggacctctaagacccttttcgccagagcttccaggaataccaggcagaccaggcgaactaaaaagtcgaataatggaaacaattaacatggattgaattgatttatttttttatagccatttcctcccaattttatccctttttgcccgttttctatgcttatccccctcccctcccttttaccccgatgtgccgcgtgctcctttaatccccggagtcccggggggcccgcgcacatgcggtggacaaatttggcaagattcctccgccaattgctgcgcatttatgtatgctcctgcctttccatctcgtcctggcattcccgactcgcccgctctcccatttttgcccggttggcccctttttcccgagaggccgggtgggccttgcttgcaggtacagcataaagggaaattttatttggtattgttttcagtgaatttacatgagtaacggaaaagtgccgagattggctgggctttgtacccggaataagcgccgcggggcaatcgccctcttaacaaccaattttcatgttgagagtctttggtctgccgttctcggataacaagaagttcattcttaattttcatttgttttaaaatatatctttaaaattaattcccaataattattatttttactcggcacgaattgacggattgtatcataaaagagtttcggtactgaatgttaatgaaa

SEQ ID NO: 11589 - DNA, 3316 bp, Heterodera glycines
tttaaaaattacttttgttatatttcagggtacatttcaaaatattttttcactatattttcaaacatttctaaatatgtaaaataaaaatttgccgaaatttggatttattttgaggaattccaagaattttcgtaaaaaatcctcaaaatatgaaaaaataaaaatatataagaaaaaaatagtaccaaatatgtaataaaatcccgaaatatgtataaaaactccgaaatacgtaaaaatatgtaaataaaagtcccaatttttgttacaagcacaaaaaagaaagtgtttttcctcctatttagagccaaggagaaatcaggaaaaaaatatgtatttacataaaattgacaatcctattgatcagtagggataccttttttgcacaaaaatcagggaataggcacctaaaaaacgcaggaaaaaaaaccgaaaaatatttttttcgaaaatcctaaaaagtattaagagcgctgaaattttattaatcaaacaattttgagaaagatgaaagtacagaaaagaagaacgaaagaaagcgaaacagagaaagagagagaaagaaaaagaaagcggaaaaacattttaaaaagtaccgacaaagggaaacaaagcaaaaagaaatagtgattaataaacaaatctctgatcagaggaagggaaaaataaattaagcgtgcaaattgaaacgataaatcacataaatgaaaacaattgcaatggcaaccataataaaaacacaatagatatgaaaccaaattgagcgttctgagcgttccgcttctcgtgagctttccaattctaaggcacggcgcatccgacgaaggcgaaatgtgtcagtggcaaggcaatcatccaatttggcaaggagaaactgtgccaaatcacttggccagagcatttggtccttttttatttgcagaaattcgattacggcatttttataatgtccttctggcaatacttttgaacataattttgatgccaaatgagcaaatttatgacgaaatttctcattggcatttttttcgttcaacttttgaagttccttctctgttgccttcatgtgggaaagaataaatgggccattcgttgtaaacttttgaatttggcgtttcgtttcatcactgtccgtggcgatccgttccctttggcacatttcgccaatatttttcacaatttccgcaatttcattttgtccttctatgatttttttactgtccaaattttgaatgatttggcaagcattggtccatgctttttcttcttccgttggtttttctttgcttttgttcgaattgatcatttctgagaaaattaatttttttgttaatttataactttttttctttttttttaaactactaactagagttgtacgggaccgggaatttttgccaaaaccgggaccgggacttgccgggacctgagaagccgggactgggaccaaccgggaaatttcccaaaaaaaaatacaaaaaaaaattaattttttgtttggttttttattttataaaacccaaaagttaacgcaaaactaaattataatatatttaatcaatatttcaaaccaaatttatttcaattatttcaaacaataatcatttttggactaaattatcgaataatattagaaattcagatttgcttttcacatcactttttcggcgcgctctttgcaaaaaactttttgggaaataaaagcgttccggtggtgccgataggcgccgccggaggaaattttgaaaatttgagtgtgatttgttaacagattttcaacaaaaaaacactgatttttgagattgctagcttaatttgcacggattttcttttaaaatgataaaatatgtgtcaattcaaaagaaaaaaatgaggaatcatattttgtcgataggaaaaccatgagtataaggggtgtaggagaaggagatttttaccgggaaccgagaccgagaaatgaccccgagaaacgatacgagaaccgagacccacaaaacccgagaaatttctcgactcgggaatcgagaaccgaaaaatttaaatgaaattgattcaaatgcatttcttaatcaaaaacacattaaaagggggtaggtcaaccagaatttttgcgtatgagtctcaacattaaagtaacagcatttttttgcttttaaaatcgtgacctaggcattataattgactcgaaactgcatttttcagaacatattaacaaaattgtacgaaacgcttatcttagagttttccctggtttttaagagtcttaaaaaccagggaaataaagactctaacaacagcttataaaacttttgtccgacctaaattagaatacgctaccgaagtgtggaacccaaatttaaaaaaagacattgacaaaattgaacgggttcaaaaatttttcacaagaaaagcatttagaaaatgtggttttgtgtacaaaaaatataaggaaagactaaaaatcactgatttacacaaattagaagaaagaagaaaaatcaatgatttaacaacagcttttaaaattataaaagggttcaccagcctcgatgctgaaaaaagtttctttttctcggaaaggcccaggaggcctttacttttgcgagtaaagcgccacacggccaaaactcaaaataattttttcaatatccagttttagcggtgcaaattaataaggcaaaggaattcagggatttactaaaagcaatgagttctgagtaggaatattcatgtgccacatatacactatattttattaatcacctgtgaatttttaacatttgatttattttattttcatttttattacggtattcattttgtattttttatttgatcaattttatttctttgtcttacttttagcaccatgtaagagcactaatgtgccttttgtttgctcgataaataaataaataatttctttctgatttgttaacagattttcaccacaatttttgcggttttgagacaactggcggccatttttacattcaaaaggcttttttgcggcatttttcaaaaaactttcttttttaagcggggggagtccggcggtgccgataggcgacgccggaaaaaattttgtaattttaatgcgacttgtagcagattttcaccaaaaaggccaatttatttttcctcttttcccccttcgctggctatccccactccccgaaagggtcatccttaacagtgtaaaaatttctcggtttgcgagactgaaaacccgagaccgggaacggagaccggaaagcgaaaaaccagagaaatttcccgagtcgggaaccgagactctcgcacagcactagag

SEQ ID NO: 11590 - DNA, 1693 bp, Heterodera glycines
  misc_feature (108)..(108): n is a, c, g, or t
acctcgaaggactggaattcccgccccggtcccggtcccgtacaactctactactaacgaaaacagaataaaatttgttatttaaaaattctttatgccaatataaanaactttagttttttgtagctatttcaatagcatttcgcgatttttcaaatctaaaaatcccagccctattaatcagcctatattctctattttgatatcaaaatttaataaatcaccttcaaaatccgccaaacttttttgcaattttaaatcttttgtcgaaattttcaaatttttactcgtgaaaaagcaattgctaaatgaaattgaaaagaacggcaaaagaacaacagagataaatatttgtggaagcattttttgaagatttgtaaccttaaataaaaattagttaaaaatcacagccattgcctaagcaattgctactcgagaactaaaacggtttacaatcagttagctaataaaaccgagcattctttttctttcttttgaaatgcaacaccaaatgttgctgggttaaattgggtttagaaatgtaaaaattgtcataactgatataaaaaaaatgacaagaacatttgttttaagagaaatgattaaaaaattatttgttgcttgacatttattaagccttttgctcgattatgtctcatttttccaataaaatatgtgcgtcatttcctactattttttcaaatacaaaatatataaatgcttattatatttttgcaatgtattattattctatttattttatgacgtcgttttatcacattttgcgcgcgtaaaaaagtaggagaaataaatggcacagcacaaaagcaaaagagaggcgaggaattaattgtatggttaatgacaacggataattcaataaatcacatgccaattgacgtatgttgctagaatattcataatattgaaataataaataatcataaaaaataataaaataaaaacaattaaatcaatgatggaatctaaattataaaataatatttaaaaaggtaaaacaatatttgcatgtgcattaattcaaaagaaaaatgaagcaaatgcttttcgtaataaaaaaaatgcaataagctttgacgagaaaaacaaataaatttatccaaaaaaacgccccaaaaaattgtttaccaaacaattttcctttctaaaagataaaaaacaataaaaaaataattgaaaaatgctcaaagccattaaaaaatatgggataaataaaactgcgaccagcagaataatttggatataaaaaggcaataattttttagttcagatatgcttcgaaaaaccctgcaaacaacagtcacgacaacactgttcttcgaaagtaacaacaatccatccaatttttcctgtacccgtatgcataaagatcaggatcggatcctcggatcttgtcacgcaaatttgcggcccatttcttaagggccattttcggatatttgcggcctaattttttttattgaattttgcggcccaagccaaaatctgacatttgcggctcgacttttgcgggttccccaaatttcatcatcattatttttcactgtttacaatacatcaattattaccacagaaaaaattatttttcaatgatttgctcaatgtttaacgagcttacagttcacccatttatggtgcccttctgcaaggcgatactgttatgtgtttaaat

SEQ ID NO: 11591 - DNA, 4344 bp, Heterodera glycines
cgaacttaaagctattattagccgcttaactgctattgaaaaattaatttcaaccaacaacaacaacaccttggcaaccgaaatgactgcgcagttcagcgccattgcggaacgcctgggtgaaattgagcgcaaaattaacaacaatggcattggcagcgcggaggagaaagaacgaaaaaggagccttgtgctcatcggtcttccggaatcggaggaggaagtgtcatcactgcgtgcgaaggatgacgcgaaaacggtggaggaagtgttggaccggctggacgtggaagtgtgcccgcaaatggtctacaggatgggcaggaggattgacgagaagaggaaaggaccgcgcttggtgaaggtggtcctgccagcttcaaccttccaacgttttgcgctgatgcagtgggggcgtcgtcggacggagctgaagaagagacctggatgggagcgtcttctggtcaggccatccctgacgaaggaggagttggaaattgagcgggaacagcgccaaaagaagtggatggaatttggaaagaagaaaacgggggaaaacatcacgacgcgacgcggaggcaatgaaaaaaacttttgaggtcacctccttttttaaattgtttatatttcaatgcacgaagtttggcgaacaaattagacaagttaaggtttttgtttttagaaaataggtttaaaatcattgctgtatctgagagttggttgagtaacaaaatagaaaacccccaaattttggaaaatctcccctattctataataagatcagatagacttaacaaaaaaggtggcggggttgctttcataatatcgaatttaattccttttgaaattatcaaaactacaaaaaacaaaaattccgatattctttgtgttgacctattttcaccctttaaccacacaaaaatacgttttattttggtctatagacccacctcccatgaaaaacaagaagatttcgaaaaattggtcgaacaactctctgttttagtctcggcttctgaaaaatgcattagagggatataaattaagactaatggtcaactcccctacacggggaaacaatttattagatttattatttacaaacaacgaaaatctattgaataatgttatagttgaacccccatttggtaatagtgaccataatgcaattcaattcagcataaatttacaggttaatagtaatgcttcaaaaaaattttataatttcaaaaaagcaaattatttgaaaataaatgccatactctcaatggttgattggaatttatttttttctgattgcccggacatagagcttatttaccaaaaatttatgtttttcctaaataatttgataaggaattatgttcccatacaaacaacgaaaaaagttgaaaaactaccagaacatattttgaaactaatcatctatcgtaaacagctttggaaggatattcacaaagaccatataaaaataaaattcttagaagtttcgaaaaaatcgatgtagaaataaagaaattttataaaaatcgcgaaaataagtttttgcggaccttggactctaaaaaacgtttccaatttataaattctttccttaagactaaaaatactatgatacctgcatttactgataaaaatagtctgattctcttctcagataaggaaaagtcgaatgcattagcgcaacaatttttttccgtttttacagatcaaaatctagaacaatttcaatgcatagaaaatcctgaaaaaaatatcgaatattttaacataactccatatgaaatttatttttctctttccaaactttcaaattctaacaatagtaatggaattcccaatatttttttgaaaaattgtaaagaaaatttagtccgacctcttttccatatttttagtttctcattgatgactgccaaaattccagaaatatggaaaaagtcaattatttgccctgtcccaaaaattcaaaatccggtaaacccagtcgactttcgtccgatttccctgctatgttctgtttccaaaattttggaagaaaatatagcaggaaaaataaaaaattttgttgaaaaaaataatttgttaccaaattgtcaacatggttttcgtaaagcacattctgttactactcaacttcttgaagtggtggatgatttcagttttgctttagaaaatagaaaatcaattgatgtaatttattttgatttagctaaagcattcaacacggttccacataaccggctaatatctaagctccaaaacattggtataaataattccttattaaaatggattcagaattacttagaaaaccgaaagtttttcgtcaaaatcgggtctgatttctctgacgaatatccctgtctcagtggtgtgccgcaaggctcaatattgggaccactgttatttcttatttacatttacgatttaccaaaattctgcgaaactgaaaatgttaaaattaaactatttgccgatgatcttaaggcctatcatgttctttcaaatatttccttttctccactccaaaattttattaacaaatttaatcgatactgtaaattaaacggccttaaaatcgcttcaaataaatgtttaactttacatttaggacacaaaaaccaaaaaataaattattttattgatgactttccaattcctaaaaatcccggaaacgaaccagtcagagaccttggcatttattttactaatgatttgaaatgggcacaacatattgaaattatctcgaaaaaagcattacgatctgcttttgctatattaaagtcaatcaaaactggtgatacgaaaatacttgtaaatttgtttaatatttattgcagaccaattttagaatttggatctccaattttcaatccttatttaaaaaaggatattgaaaaactggagaatgtccaaaaaacttttttgagagtaatatttagacgtaacaattatgctgctgatttacctaattatgctgaattgttaaacatttatgatcaaaagtcgcttgagagtcgtaggttaaaaatagacttaaaactttttcatgaaataattttaggtaaaataaatttacaaaataatgaatccttttctttttccaaaaacattgtaaaaaatgaatacactataagaacagcttattgctcaaccaatgctagatacaattcgttctttattcgaacctctcgtctctatagacttttgcctaaagagacgagattactaaattctaatgagtttgccaaacttcttgaaagatctgatctgaatttgttgatttctttgccaccccagctccaaaagtgaccaattgtttgttttatttgatattgtttcattatttcttatttttcggcgtcacgcttatgcgtataaatgaatgaatgatgcccattttggttggagatatgagagattcatttgctcacccaactttttttgaggtcatgggaatagcctataataaaagtgcaattaaattgggaaaatacacccataagaaatgacctgaaaaattttcagaaaatacaccccctaagaattgaaaaattttctaaaaaattgatcgccaaaatttaattttttttcttgataaaaaaatctaggtttaaaaattttccttattcgaaaaacacagtgaaataattttcatgacctaaatttaagctattcggttaatgttacgtgtcttgcactataataatcctaataaaaatctgttaaaagcacttctggcatactatagtgagaatctatgcgcgggtgcctgagatactgcctctgtcttgactcttggtgctgcgttagtcggtccataacaataatttggaatggggaatctaaaagttatagctgcgaggacactccccacaactgtcctctacatgctggtattttttatttttttattagagccaccccctggcctgcacgcttggctaattgaagtgtgctcaaaatgtacacttcagtaccaggcgaataactcgccaggggttgctttgcccgaaaaattgtttctgagcaaaaatgtgtagtatttgaaaggctatccaaccaagttttaaaatttcgaaaattttgaaaatttttcgagctaggcctaaaaaaaggttttcgggtttttgaattttaggattttttaacgatttttcccagagaaacggagaccacttccacaaacatagtttttcgagctctatcgactggtatttttttcggaaaaatttcgattttttcccggaaatagaaaaaatttctggcctgagcgggacatttgagtcccgggccacaataactcgtcaggggtcggttttagccaaaaaattgccttag

SEQ ID NO: 11592 - DNA, 4488 bp, Heterodera glycines
aaagggcgggggatggcaaaacgccggcccattgatcggcttgaagggtgctaaaaaaagacccaaaaggcagtgacgggaggacgaatggcgcaaagtgttgtcgccgggaggcgtttgaagtgacgcggcattccggcacggaggtgggccaacaaaagggggggggtggggagaaatgcccatgccagaacttaaaagcaaagccgagtgcaccgtgaaaaatcatcgcatttaattaaatattaaattagccgaaatgtataaaaaacaggcaccattcaccggaaaattcgacaaacatttcgtagccgggggtaaatacacttgcgtgtgctgtggtgccgctctgttcgtgtcggagcagaagttcaactcggggtgcgggtaagaggtcaaaaattgaattgaatttccaaaatttgtgctttcgcagatggcccgccttctccaaatccattggggacgatcaaaacattgtccgactgcccgacaattcgtacggccgtcaacgaatcgaagttcgatggtaaatgtctaaaaattactaaatttccttttcatttaaatttcccataatttagtgccaaatgcgacgcacatttgggccatgtattcggtgagttttattactacgaaattgtaaactatccgttaaacatttgcaaattcatcaaaacctaacaataagatgacggaccgccggccgacggtgggcagagatactgtatcaacagtgtggccattgactttgtgtccgggcaacagaaatgaggaaattgagaattgccctttccgctgtgatccgtcattggccggtccatcatttgttacgagttcaaggggttttttctgtgcgcgggctagaatccctgagatttatttacaaattaatgaaaatgccggacagaccaattaatatttttttttatttgcttgtttggctatttatccaatccctttttcatttatttgtttgtgattttttggcttttgtatttatttttttcggttttcataataaatttctttggcattttgccgaaatgcttttggccgccttccgtcgcataatgttcagccaggacttggtcgcggaactgttgtccaaatacagcattacgaagcagcggattgtcatcgacttttcctctccgaacattgccaagacatttcacatgggccatttgaggtgagtaaggaggggggggggggagtcgaattgtttagggctttatgaatttgactgattgagaagtggaacattggcactgcttttgcttttccaggtcaacctgctacggtgattttatgcagcgcattttccgccatgccgggcacgaggtcagtgctttttgaaccaatgatagctgatctcaaacttgaacaagttggggaatgggattatgatgcccccgaatttgccatagattgtttcaattcattttctcaaaaaaatgattgtaaaagtcagtcacttacaattgacagacccagcaggatacaattttgattacactgttaaaaattattcattaatccgatataaaattacatttttgccccgtcctaaaggtggtctctctcaattatttgggcgattggggccatcagtttggactgctgacagtttattggatggaagtgatggacggcatggatgggcgaatggcacaaccaatggcggacgaatgggcggcgatgagcgcgcggaaaagggtacgaaattgggggaccaaaacggcatttgcttccagggattccctttcttttcgaattcagatttcaataaaaaaattaaggaaatttcaaaatgttaaaattaaaattttcggggaaaacatatggctgcatttgtaatggggggtgatggcacttttttacgccgaatttcaattttcaggtccaactgctcaccgacgcttatgtggcagcgaatcggctgaaactgaccaactcggcatttgaccagaaggcccgacaattacaggtcaaaaagctatatggcagcgattaagaccattttcaatctgaacgtaatattgacatttttaatagggcggacgtgtaatttaggatgagacaaaccaaaaattattttcagctgaacatggagcgccatatgatcagcaccggtgcggcgacagtagacgacgtcgatttggtcagtttatgttaaagcaaaggcaaaaatgttcattggaattattcttcgattttcaaactttttttgctatttcgaatttcattttccaaatctctctttctcttccccccccccccaattcctccgcctttaggcacaaattcaaaccgatgacaaattgcgcgaagcgtttggcctttggcgtgacttccgcgactcatcagtggcctatttggaggtggaattgccaaattcggatctctgtgtttgctcatttgtttcaggatttctatgctcgtttcggtactaaatttgaccgatgggatgctgagtcgtaccacgtggtggagggcgcccgtctgaccgacgaaatgattcagtccggtctctgccgactcacccgggacggttggcattcgaatttttctcgattaaaataatcaccggaatttctctcttagaattgtgggccgtctgtcagccggaggttggcttaggcagggaaaagatcactctgcgcaaaggcgacggactcaacctgtacatgaacaggtgggacaccgccctctgatggggtggacggagggcttcactacgaacgaagtccgacgggggacttaaccgagggggggggggggagttggacctaaaactacaaccttcaaatcccccgaaattctgcaatttttccttagatttcccgcgaatcaatggtatcttaagggccatcggaaaaaaattcacaaaattttcgatggttgcaccaccggctttttttctttgtgttttcacaatccaagttattaattgttttatcggcgtttgtttccccttttcagagatttggcttccatttatgcgcgacatcgtctttacaacgcggacaaatatttctatttggtggactatggccaggtcattcattcattggcttctaataaatgtgttttattattccttttcgtagaccaatcactttaaccaattgcgacttttgctgcgcatccgtggcgacgacgacttggcggaccgaatggaacacgtctctttcggtttttatttaaaaaaacaataaatcttttttgttttccgtcaactttacaaaattcaatattcgtctaattgtaacatttaaacggcaccttttattggtcaatatttaaatttgtatttctttccggtcgcatcatcggcctgtccacgcgcaatggcaaaaacgactcggtggactttctgattgaccagggcgcgcgcgaggcggatgcgtatgtgcacgcgtcgccgacgatgcgcgcggagccggccgaattgggcacaatttgccgacggttggccgagtcgacgctgctctttgaggtgttagcaccgttggaatatgtgggagacttttattgatatgttaacgggtggcccttcgatcgatgctaaaagttgtgtgaatggtccccaaatgttagtgaatttgcttgattgggttaattggcccaatccgtccgtgacttttggctggacaatgcgtttgagtccctccgttcgttcagattgtcttccgtcatcgaaacagtcacttcactttctcttttcgcaactcttttcgtccgggtggcaccaacgctttgctgctccatgtacgtccccccagggtctcctcgagagtctctactcgaatcatttcggggctatctccgaaagtgctatgcacactctcatggtgccgtttcaggagaagttcagtcggctctgttcgctggagcacgcccaccacgagcacatggaacgcatccgcgcattgaacgcggacggagaatggaaactgaacatggaaatgcgggagccgggacagaagttggctcggcgcatccaggagttcgacacggtggtgctgaccgcgatgaagaagatggacccgaatccggtggccatttacttggtcggtgatgacggactcgagtccaacctctgccaatgcttttccaataaaaacacgcgtcgtgccacactttcagcttaaactgtgcaacgaaattggcacagcgatggccgcccttcgggtgcaggacgaaacaattgcggtggcactgccgcgtctgatgcttttctctgctgccaaaaaagtgctaggcgaaggcatgcgtttgctcggcattgagcccatcgaaaggatgtgaaagtgaacggacagactgaggacagacaacgaggcgacgtggtgccgaaactttttgttattgtttatttttttattcacccatttcactgtggttaattttgaaaaattggaacaaaataataaaacaaatgaaaaaaccacttaatgagaagatttggggctgcgtatctgg

SEQ ID NO: 11593 - DNA, 976 bp, Heterodera glycines
  misc_feature (871)..(871): n is a, c, g, or t
ttttacaatagtgcctatttaaaaaaaatttgcgatacgctctctgttataataacataccctcaaaagtttttatttgcgtcgtttataatatttttcattttatcgtgctgaatgaatatttctgtaatcccaataataatattgacaaaaaatataaattaaataattcaaaaaaggacaattttttgtggcactaattcattcattctgttgctcaattgtccgtttgctttacgttttctgtagtgtgtaagcagatgaatttgcagattgcttgactctgcaaattgtttgccacaatgggaacacttaaaaaatgaaaattaaaatggaaattcatcgatttaaaaaaatggaaattcatctattttaaacaattttaacttttttgtatttccagatctacacaccatgaacggcttcttttcggtgtggcgacgaagatgggttgtcaaattgccagcacgtgtaaatttttggggacaataagtgcactaaattaatgtaaaagaagagaattaggtatgttaattatacagttaataggtactcatttaattaattagttttgaagttggatgatcattgcagtttctagggcaattaattgaattatttttggaaatcggctaatcatgatttagttacattcttttaatctcactttgtacggcttttcacccgtgtgaatcaaaatgtgcgttttcagttggccatcctgcgtaaaacgagcgtcacataagtgacactgactcgggagagcaattaattaattttaattagtgagtaattaattgattaattgtttatatattgccacttggtatggcttttctccggtgtgaatgcgctggtgaatgtcaatgtngtggcccgtgcaaatctttgccgcattggtcgcactgaaaaattgctgtaaaatgggattcttgattttgtctattttaaagaattgtcctttacgtaaatgctc

SEQ ID NO: 11594 - DNA, 1744 bp, Heterodera glycines
cactttaaacggctattccgccgtgtgcgttcgttcgtgtcgtattagcgctgacagccagcgaaaagcctccggacagtgcgcgcatttataccacattcgcttggcacgaccattcaattttgcagctaatgaatacttttgcgtaattgttttaggattgttggcatactgtaaaaaagaaacggtatttactcgcaatttttattgtgttcattttaaattttttaaagactaattaactgtcgttgccttgtgacaaaaaaaatagcctattaataatatatgaattcaatatttaaatacccagaaaattattatgctaaaaattttcccgtgcggcatggcaccgtcagatcacgattcccaaagatttatttcaaaattgccataaaactgacaaaccgatcgtttgagcaattaacttggactaaaactcataacttaataaaaaattctaaaaaataggtcttcaaaaattcttattctgaggaaatttgtttttttaatttccaaattctcattgtgccaaaattttgtatgtgcctgaaattgagtgccaagtgtcgattcagtgccattttccatcccgtaattgtcgtgcccttccgccattattccttcatctttcacccgttccccttcttcctcctcctcctctcttccattgttttcctcctcttgctcttcctcctcccctcttccattattttcttcccattcttcctcctcctcttcattcacttccttttcctcttgttccaattcttcctttattctctcattttcttcttcccctcccaattttctcacttcctcttgctcaacagtgacacactgaaagtgtaaaatgtattaaattaatatcctatttattaatgtcccaatattttaaatgattgctttcaattaaagcatgtcggatggaaaagggcgggcgaaatgaaaattcatttcgcaaatttcgagaatttggggtttaagcaattgaatttccttgttttcgtttttaaaaaaaaattagaaaaatttgcaaatttataaaaaaatgaaaaatttactgaaatattttacagaagagaatattttcgaccttttctttcatttcccacctcattgatcttttgcgcaaaaagcaagtgatggttgttgtcctccattgtgtgctgcataattccattttgagtttgaagtgaattctgttcaattttaaaattaaaaacaaaaacagacgagacaattaaattaaatttgcttgccgatttttacaaaaattggaaaatatcggtcatagggcccaaactcaaaagtaatggctgcccataaagatgtttaaatgcaaattagggaccgattggcatgtttaatgtttaaaaaaagaggtactgaagtgtccactttcaaacaatttttattccatggaaaaatggaaaatgcgcaattttttcatttgagctgttttaaaccaattccgccattttttgagcatttttggttttgggcatatgaccgttaaattatttaaaataagtattgattgttttttaaacttctcaaattgatagcgtaaatccaattgcctttcctgcaaattagcattaagccatttttacaaaaaatgagtgatttttcggaatttggctttttacggtgcctatcgaattgtttatttgttatttgtcgtgctatcattttatcaattaattattatttattttttatagtccattttccatttcacacc

SEQ ID NO: 11595 - DNA, 3077 bp, Heterodera glycines
aaaacgacatttgcggcgccgatatattgtggcaccccaaattaatgcttaaaaattaaatctcgaattattttgtttcctttatggtcataagaaattcttttcaaaagtagtaacgaaccactgaatgaaatctttttaaaaatatttttcagcgggggctttaagaaatcttttcaacttttcgaattcataattttttaaggctggacagcgacgggatattgtaaggaagaagttagctggaccttaaagcaagtaaagcggcggttgatacgaggcggatttgcctcagaacgcaatggcctagttgccaaaggactggatttccacccctggcttaacattttgcctatttctttattaaacagaggaaatccataaaataaaataaaacttttttggttcggggtcattaattctgcgcagcaaatgtcattttactgggcgccgcaagtgtcggcgccgcaaatgtcgttttgactgcgcgccagggctgggacgcgaccgcgatccgcgatgcgcgatccgcggcgttttttttgcgcgatccgcgatccgcgaccgcggcaatttgaatccgcgatgcgcgatccgcgaccgcgggatttttctgtgcgcggcgcgccgcgcattttttagggcaaaatttttataaagaaaatttattgaagcgattttcttttttgaatatttagatttgaaggtataaaattttgaaaacgaccaaaattccaattttctcgcgcatttaaatggaatatgcaatcagaaaatatttatacattcatcgttcattttatagacaattttcctctttgtaatttagaccaaatgaccaacgaaaaagactctatttggttttattttgacaaaattcacaattcttcttatgccaaatgtaagattgagcttaataatcgcaaaaagccaacctttttttgttgaaaatctgttaacaaattgcaccaaaatttttaaaatttcccccgccggcgcctatcggcaccgccggaccccttctttcccaaaagttttttgaaaaagcgctccgaaaaaaagtgatgtgaaaatcaaatctgaatttctattaatattcgatgatttagtccaaaaatgattaattgtttgaaataattgaagaaaatttgtttgaaaattttcattaatttaatttattaaataaaaaaccaaataattttgtattattttcacttgatataaattaaaatttgaattttttttttaatttttaaaatttttttgaatttttaaaatttcccggttggtcccggttcccggtttttcttgcggtcccggtcccgaaaaaaaatcgaggtcccggtcccggcttctcaggtcccggcaagtcccggtcccggttttggcaaaaattcccggtcccgtggcactctacttttttgtatgcaggatttattttgaatgacctccgaaaaagtctctcgcatgaaaatctcgaacggcttatttttcttcatcataatattatcctttacaattttgattattgataatatgggaattttctaattatgcttttacaaatgtgcgatccgcggcattttttgcgcgatccgcggcgttttttgcgcgatccgcgaccgcggcaaattgaatccgcgatgcgcgatccgcgaccgcgggattttttttgcgcgatccgcgaccgcggcaaattgaatccgcgatgcgcgatccgcgaccgcgggatttttctgtgcgcgccccacccctgcttcacacctcatcaatgccggcaataaatgtgccatcattgtccaacctttgctgttgttgctcataaaaatgtatcatttgactttccatctgatcgaaaaattgccatgaaaattagcttttttaaattattataaaattttaatttttccccttttcctcaccaattcgtttaatcgtccaattctttccaatgcctcgtccattttcttttgcattctctcatttgcccttttcacttgagcaatctgtgaaaattaggcatacaaataaaaaaatagagtaaaaactttgtatttagtttttggtcaattttggcaaatttcattccaaaaaattgcttaattaaatttttaaaaaagctctgatttttgctgactgttattttatactgatcagtcctttatgaacctttcctctctttatttcaaatatgaatataattatttgtttttttttctcttttagtttccaaagattgtaaaaaacttcagcagaaatttaaagggtattaaaaatgaaaaattgacgaaattttaaattttattttaatgtgattagagaggtcacttaaatgttcccataaaaataaaataataaattaaatattgagtttaaaaaagtaaaaatgaaagattccacctcattttccttttcttggattttctgcgaaaacttttcttccatttgttcaactttttgctgcagtgcgttgtgcgcacttttcaacttttggtgctccaatgcggtgacaacagttgcaaacattttacaatataattaactaattgaatttcaaaaaataaaattaaatttttattaaaaaatgaaaatgacaaacttaaagagaaagtgcataaaaagcgtcagcagaaagtgccaacacaaacaaaaatgccaaatgaaaaatggacaaatgtgtaggctgggcactgccgcatttgtcgattattatcaatttttgtgtgcatcgcttgcaaggaatggaagagaaatgaaaacagagaaagagtgagtgaaaaaaaagaatgataaaataatgaataaaatatagaaaaatagaagaaataggcagagaaaatagagaaagtaagaaagctaaggaaattaaggaaaagaaaaaaaggaaaagatcagacacagagcgcaaagacagagaagatgtatgtggtgttcaatgtgagaagaggtgagcatatgccgagctgctctagatgggtgagaaaataaagagagaaaggagaacagagaaataaatgtgaaagtgacagcgcgtaaagagtttagagaaatataaaaaaattcaaaaaaagaaagaa

SEQ ID NO: 11596 - DNA, 3217 bp, Heterodera glycines
ggcggtggcggtggcggaggaggcggcgccgctccgtaacttggtgggggtccaccgtaacttgacggaggcggtggtggaggcggcggaggcggtggcgcacctttcccgtcacttagcacgacaggggtccccacaaaaaataatgaacaaatgaccaatggagccaatgaaatcagcttcattttgactaaattcaaatataattatattttatattataattaaattaattgaatttatttaaaatatattgctgaattagtggttgcttcgttaaaagttaattggccttaaatagtctttttgtccggtcataagattaaaactcaaaaagtcataaatgggccgaattggccttaaatgcgatgattaagcaattttttgtgcatttgtattaccaattaattgaacaaattgctttttaagaattattcattgttggacagaaaattaattgacaattccaaatgatggaaaatgattaattttcaaaaatgttaaatattgggccataatgaaacaatctttggctcagacaatcagcaacagctaataatgcgtaggagctttgcacgtttaaaatgttattaaaacaatatgtcaatatttaaattttgaaattcttttttatataataattaattttttcttattttgactgatttaattatttttatagaccgcccataattggatcgaagtctgcaaagtcggggggttttcactaaaaacaattgctctcggcataggtttatttttcattaatttattaatttttatcgctgattatgtataattagtcgtaaaataaatcaaattccactaaaacgcaaaaaattctacgttattcagcttcatctatggaataaaaatatggaaaaattttaaaatgcacaaaatattttagaaaaaccaaatttttaacaaatttactctaacaaattctgaatgtgtaacaattttctgcccaacaacaatttatacgaatttagatccataaattaatgaattgtttcttgcttccagtttttattcattcattttctgtcatcatctccatggtgtcaaatgcttgcttggcaattgcatccaacacttggccaacattttcgacttgttgcaacaaatctttggcattttgtcccggttcaactttcgcaattagtttcaacaaatttctcaccgtgtcaaccgatgcaattttgttgctgtcattttgctgctttagtgtcaatttatccaaatagcctttgcccccgaaaaattcggcaattttattgttcaattccctaatatattgcttaatttcattcaaggcaccggctgcttggcgatgtttaaatgtgccattttgctcatggtccaaaattttgctcaacttttgctgataattccaatacaaaatgcctgattgttgttgttgttgttgtccatttccattgttatttgcggttaaaaaaggcggcaaattaaaggactaaagaattatttttatactttttaattgattgtaattagaattaaattaccctttgttcatataatttgaagccgcacaggcatttgaaattatcagtttttatactaaagaataaaaaaagatttaattgtgtaaaatatttttgtttttaaaaatttacctattgataatgcaatcacggtgtgacaaatgctgaaaatttgcagtattaaatgtttttacacttttataaccctagtttttttgtttcaacaattatgcataaagattatatttatcaaaaatgttttcatgtagaaataatttaaaaattttgtaaataaaattgattaaattaattattttcgatatttaatatttgcgaattttgtgataaagaaaaaattctttaaaacagaatgaatacaaaatgtaccagtagattgttaattaggccggaatttttcagaatttctttaaaagaattctaaaataattaattaattaccttttcactgctattatcattattattgctgttggaatgcatttgtactatttgtgcattttcttggaaatcctgtaaacaaatttggcaggtgttaaattcatttttttcatttttgaattcaataaatttgaatatctttaaattcattttgtttattgctccattaactttcgacaaattaacatttaaattgaaagtgccatagaacggagcctaaaaagtcaaagattcatcaattggatctcactaattatgctaattaaatttcttgcagaaaaataaaatatgtacaacttcgttaaaaggtatattttttttaactatatttttaattattttaacaattgtttttaatttttttttaataaatagaaattataattacatttgaatttccgcgtttaatttcaatttgttcagttcccaaatgaacaacttcttttgctcgtctattcggggacagatttgttttgcccaaatcgacaaaaaaagcaccaaacaaaagaacattttcaggaaccatttcgccaaaaatgacatttttttcaactttaccactagttgtcaaattgccaagatttaattccaaaactttttttaaatttggattataaacaaagagctcaaattgtcgcacaatcactggaacaaataataattaattaatttgtttaaatatatataaaaatcgaaagcaattaccctcactttcatttgttgtttttgtgtgaatttcggcttcaaactgaattttttctggccaataattgcccagaatttgaatttcttcttcaatttcaatttggcattttgtacaatttgaattgacaattttttcggctccttttatttcacgaacaattactgtatgcaaataaattttgaagtgggaaccaaacggacataaaggtctgcttctttcgaaaaattgattctcaaattcaatttaaagcaatcaattgtgttgccgatcaccacagtggcagcaaaaaaaaatgaaaatagaaaatgaaaatgaaaattcatttcggaaaaattttattctaaaatattaaatgaaagattttacatttttaatttttgttacaaaaattcttatgtataatatttcatctaaatgcaaaaaatgagaaaaaaatgaatttttataaaaaataaagcttaaataatttatgtaaacataaatgattctgatgtaataattatattttcaattagtgattttcacgtgaaaaatagtgaat

SEQ ID NO: 11597 - DNA, 1306 bp, Heterodera glycines
  misc_feature (1232)..(1232): n is a, c, g, or t
taatgacctcaaaatgagaacaattaaaagcattgcaaaatttcaaataaaaaaaacccccaggcaaatacgaagcaaattcattcacaatgctttagccaattatattaatttaaaagtgaaaattaatataaataataaagaatttacaaattaagaaaaattgttcggaaataagaaatgaaaaatgaaacaatcccgtaaaataaaacagaaggatcatctccaattcattgtgttttacacaaaatggcacttttaaaacagagggcacctgagaaagtgaaaattaacgaatttaccataaaaaaattggcgaaccgaccgatgggactgaaagtgcgtctcggagcagtagtgcttgccgcaaaagccacagatgaccaaattcgccttgagatgggcacgtaattccctttcggtgccaaactgtgccggacaagtgggacaacagcagcaaagtgcggcggtgccatttcctaaagcgaaataaaaacaattaggctttaattaccattaatgatggtatgccgtcgtcattcgtaccaattgcggcactctcttctccgtgctcttcccctgtgctcgtcattagcagtgtttcgcccgctgtgtccgcccgttcaccgtaatgggcgatgaaacagtgccaagcccagtggcactgtttcaggaattgcgcggtgcaaagatggcattggaagggcaacggcacatcagcggggggcaattgttggggtggcgaattcgctgaaaacaaattttaaattaatgccaaaaatggggaaaaattgaagacatttgtgaagggacggagaaagaaaagagaacaaaaacaggaaatacaaaactcaccattgactatacgaatgttcagctttttgtgcccaattaataatgaaaactttcgtcgctttatggattttgactgacaatttttattatcaaattcgtccatttctttgctgaacagcgaagaacaatttaatttgttgtacttgtcatacaatagatcaatgttattattaaattatatttatctcatcacaaataaatttaaaaataatcaaaaaggcggatttcataaaatctgtcactattgactttggctctgaacattaaaatttgtttatttggagacaaatggttttttcaatgcttatatgtaactgtaacaacacatcggtatgcaaaatcgaaaaatgtaacccgatcgaataatggataattanctattttgtattgtattgtgtgtcgcttcttagtagatcgtcttttgggcaatttgaaattggaaaaaacaaaa

SEQ ID NO: 11598 - DNA, 1518 bp, Heterodera glycines
ccgatcgaataatggataattaactattttgtatcccccccagggtcgcttcttttcttctcgtcttttgggcaatcttaaattggaaaaaacaaaacaaatcgtcgtcctccttcacccgcttttcattcacagcatcagcgccttgaacaaattgtacagttcgctgaccaacgcctcgtgacggaatgagacgcgaatgtcgggcacattggtgctgaaaagccaaattttgcaatttttcaaagaattgctacgattggacagtacaaatgaaactgtacagtaacgcaccgtgccacgtcgttgccgagcactccctcctccttgtagttggggcccaaccaatacactttcacccggtcctgccaaatgagcaaaaaaattgtacaaatggaagaaaatgatccacccccaggaaaagtgccaaactgacctcaaatcctgactggataacgctgaaattgatagggaaatcagtgcaattcgaaaagcgattaagcctgaactcgcccacctgttcctggccatctcgcacatgtcacacgaactcaacttccacaactgatgggcgatgctgtactcctccatcagtgcctcctggaaattgaaaaataattaataaaatgctaatcggtatttgaatccaacataatcaaatccttcgtttaagtgtattacttttgtgatgtgaaattgaagcggatcgtcggtggacaaactgatgttcagccccttcatcagaaactcgggcatcggattgcgctggtagggcaggaacaaatggttgttggacaaaggcgacattgcctagggcggggagtttaattagaagagataatgacgttaatggtagagagagagcaaagaaaggagagaggaccgagaaagaaaggagtgaaatagtatttgagagaggcatagaaagacgatcaataagtaaatggccactgacaattccaatctgtgccaaataaaagaggtactgcagcacgggcactttgcgcaacaaaaggccatgcgcaatgctttccgaggtcaagtagctgcaaaatgaaagtgggattcactttttagggacaccaaaaattccagggactcttacgacacgctcaggtggctgacagcgcccgcctcgccacagtgcggtctcaacgcgaaggtgttcagtccgcgcatccgtcggaaggcgttcagtgccgtcaaattggcatacctttggagggtagagaaaaaatgattaatgatcggagacaaaatgaacaaaatatttggcttacatgtagtacaagtaataggagtaggacggattctgaaatatgatttattttgaacgcgaattgatcattttgatcctttttacctggtcgttgtcgtaatccgccggctccggtgaatccttcgtaaatgccacattttccggcttggactcgtcgtcgactgaatcgatcccggaaacatgctgaaatttaagtgtttatggcattttgacatttcaatcacttggaggaatcggtg

SEQ ID NO: 11599 - DNA, 1042 bp, Heterodera glycines
  misc_feature (24)..(24): n is a, c, g, or t
ctttccgatcaatgggatgacacnattgtgccactggatcatttcttttttgaaaattttgttcactcacatcgtgtccaatggcccaccgtgccaatttgtcccattcgtccttcgccctcccgtaaatggacagtcttggctccttcaatttaaaaacattatactcttttggtttaattgggcaattaaatttccctcctttctcagtcttttccatcgtttgccgacgattcaatttttatgttttaataatcccaaatcccccccccccaattctccccaccatttgttggtatttgctctcctccaaatcggtgagcacttccttcataacttccgcaaaatattttcccttcacataattgtccgttttgatgaaaatttcacggagttcgttttggccaactgaaatttttgatttttttttctcaaaaaacagtacaaaaaatgttacggggattatatttagtgttgaatttgtcgaagcggtggaatctgaaaattgaaattttaaaatagacaacaaattttccgttttacgtgtgtctgtccgcgtgcacatcgagcatatccacggacagatcgtacgctcggatgccaagtttttcgaacagctgggccatggtcaccttttggccattctaaattagggagcaaatcacaaattatacggatttaaaattaaataaaatttaaaataatttataagttgccacgcatttatttgtgtaccttctcctgcacaacttcatcagcatcggtgcgcattttctttttgatgaaccgcaacaaatgccttaagggataagggatcaaagaacggaaaatccggcaaatcaaagccaaaaagtcacttgtggttcattgaactggcggctaaaaagagaatttcaaaattttatccatttttaaaatctattttaatgattaaaaattattttgaataattattcaatttaattgttgaaatgaccatcactcaccgtggatgtgcgtgtccaccttgcgaatgttgtaaaagtcgcggtgcggaacactg

SEQ ID NO: 11600 - DNA, 1985 bp, Heterodera glycines
  misc_feature (1795)..(1795): n is a, c, g, or t
  misc_feature (1903)..(1903): n is a, c, g, or t
  misc_feature (1949)..(1949): n is a, c, g, or t
cgagctgcgttggagttcgtcgatggacttccttggtctttctctgtttggcgttgctaaaattgacaaaaaatgaatgatcaatttttgagaaaattaattgggaaaagagaaggcatcgaaatttcactcacttttgctggtggttggtgtcgccgttggtggtgccgcacattgctccagctgacgacgcagatcactgatcagcgcttctcggtttcggacctgctcgcgcagaaattgaatggtgtcatcccggtccttcagttgcttttccagttgttcgatgcgctctgatcgctcgtcaatggccagcggtggcggggtcgtctctccggtgtccattggcgcagttggtgttgacggaaacggcaccaaatcgccaattggtgtggcaggtgtcgacggcggcgggtcgtcgaattccaaaatttcctcgtccatttctggcgttggccctggtcctggagttggtggcggcggttccatcgcttcttcggcggatgcagcagatgttgacggtcctgcttcgtcttgctgtggcgtttcggcattgggattcggctgtagagcggctaaaattaaaaaaaaaaaattatttttgagttaaaaattggtggaaaactcacttttctttgcggatttggcttttctcgccctctccaacttctcttgtcgctcctctcgcttattctcccatttagtccaacgcttttgggccccttttttgctttgtagtttccttattacacttttcttagccataaaatctaaataaaagaatagttttttaattataaaatttataacttttgagtttgaccatagacaaaaatgaattcactatagacagatgcagtatttttttctctatctataagcaaaatatgaagaaattctgtaaggcggaaaaaaagttctatagagcgaagtgaatgttgttattcctaataatagaaatattagatagtacgccaaaaggagacaaaaaattagagaaaaaaagataatgtttttctctggcactctctatttattggtacacatctcgttttttgaaacggtgtgtacaagagcctgaaggttcgcatcttggcactcaaatccggcatttgttagcatgttttcatactcgattcgagaatcttatcaaaaaatttgttgtatttttgactacaccccagctggaaattattttttcagctgtttttggatttttgcttgtgaacaaaaaacttgttatgaaaaatgtaaataaaaatataaaaatgcagcctttagaatcgacttcaaaagtttttccgacttttcaaaaagcaaaaaatcctggccatgatttggcggacaatcaacatcttttaacgcctgctgtgttgcaaccgaaatggataatgaatggaaatttcaaatttcatacatttatttacatatttttccaatttttagaaactatttttgcagttttttagcaactatttaggtacctatttcttcagaatttttagcacctaaaaatctcatttctatcaaaatttgaacaacataattaattattgttcaattttttcagttaaataaattgaaaatcataaataattatattaaattgtttttaacaaaatgaattcaattttcattaaatgaggtcacaattaacgccagacgattctttttatgcaaaaatatttaaattttatgagaataaaacttgaattaacactaggaatcggtgtgcagagtcagtcggttttttggtaaaaaaaagaagaaaaacgattttttcaaaattttttanaaattgaatgcttatacggaagggttatcgcgcttaaatatccattaatattttcaataatcttataattttgtccatcaataattcactgtaaaacgccgaaattgngcagaaattcataaaaagggaggcacaaagaaaattgaaatcattntttactattaaaaatgaatcaatttttcactactat

SEQ ID NO: 11601 - DNA, 1845 bp, Heterodera glycines
aataaatatttgtgtgtttgtccatctcctttggacagaggaaaattgcccttccctttgggcaatcaccaaatatcggagtcgggactcatcccggcaggcaattgggaggttcactcactccttaactgagtggtggtgccgttacatcacccccattttgtcagccctccccattctcctttctcggccccccttaggcattcaattcggaaaggggtcgacaaagccgagaaggagggcaaaggaaaccggcgatcacccctccattgatcgccagctttttcgacaataaatgcatcaatttttaactttatataaaaatgggcctcagtgaaatgaaaaggataattattaattttacgatttgttaatagattttgtccaaaaaatgacaaattttgcgattttgtgcaatttttttaagaaaataagaatttttagtgttcggaggtacagataggcgccgccgggtgaaaatttgagaattttggccatctttttaggagttttttcatcaaaaaattcccaaatttgtggatttggatttttaaaaaatttagcaaattttttggaaattttgagtgaggtaggtcttggaggggtgtactaacaagaagaatctaaaattcttatcaaaaatactattttttccttaaaaattttaagaaaaatgcgaaacacctaaaaaaatcctgaaatatgtacaaaaatcccaaaatatgttccaaaaatgaaatatatatttttaaaattgtgtataataatgttggcacggcgaaaaaattatacccagaaaatctgggaaatcggggaataaaaagtttcacccttttcacgttactgtgcattttgcgggattcccgcgcgcaactcccgttgtccaaaatttcggtctatgctcccgcacccgtacgtaatctacggccggtctccagcagtcgataccgtagaattcattaaaaaaatttgcgacattcccattttttcgagttgtgaatttcaatatgtaagcaaaagttaccccaccccacattggcggcccgggcatttgcgcctatgtccaaaataggggtaaaacttaagtttttttcaatccctaattgcttaaacagcattttataagtgatagaaagggatttatttgtctgataatttgatagttagtaaatttttgaaaaattatcaattagtcaaacagcacaatctatgcttctaataaactagaagactgtgttttcttaattttaatgttctcaggattgaaaaatctattagtttgaatccgattgggtataggcgcaaatgtctgggcacgtaagcaaatttagaaaattcacgaacatcatcattaattagcgtttaaattttgtcagtaaataaattaatatcattattattaaattatttcaattaaacaaacataaaatgaatccaattaaatgattgatcacaaccaacggggtcggggtcactttggcgcgggccattttggcgccgcgaactttaaactgttataacttttttcttatccaaccaaataaaataattttgataccattaaataggcctaagtgttctttattagcctgcaaaatattagaaaaaataaattctgtttgacaaaagatatagcgtgcggcgccaaaatggccagaaaaagtcagttttttgaggttttttggccataacttttttgtgtttcaattaaattttttgaaattttgcaggctattagggactatcaagcgctttaaaatgatatcaagcttatttaatttgaatgagaaaatgttatagcgtttggagccaaaatggctggcgccaaagtggccggttccccaa

SEQ ID NO: 11602 - DNA, 655 bp, Heterodera glycines
atttttcagcactggtaagaatgggggcggggaagggggttaagagaaaatattttttgaaaattggaagaaaatgaaaatttttgagaagaattcttcttcggtccacaaagagaagaaaattattttcatttattttaaaaatatttaattcaattttttcaaatatagacggaaattcaaaaaaaattttttaaattttcttttacgtgtaaaacctgttataaatttgtaacaaaatttccgaaatttcccggccgcacctgtaggcaccgccagacccaaaaattcccaattttaaaattggctcaaaattgcaaatttgctaaaattttactgacaaaatctgttaacaaaatgcattaatttttgtgccttttttgtcctttttgttcattttttatgtcttttcttacctttttcgtcctattttaggtgcttaccgtaaatccgctatttgaatgcccctctctggtagaatgcgccctccaattaaatgcccttttttggaggggttgaacaatacaatgcccctctctggtagaatgcccctctccaataaaatgcccccctccaggagggatcaagtatatccgcagggattctggggctttgtcgatgccgaaagcgaaatctgattacagattcgttatca

SEQ ID NO: 11603 - DNA, 1210 bp, Heterodera glycines
cgccgttgtttttggcgaagtgtgcgctcgactgatgctcgccttctttttcccccaattagaccttgtgaatgccattttaaacaatgccactggcgaaccatgctgcggatgagcgaacggactgcctttttgaactccttcatttaagtggaatccatttcctatctctttttgccagttaaacctttcataatgagggaaagggctgtgaataagcggcgaaatcactgcgcggcagttttttggagcgcccgtttccgtttgatacaaaaatagccgctttctttagaaaccggaaagctaattagcggtttagtttatgatatttacggccccccgaaatcggtttccaattattttcataagcagctttaagtatacattccaaaactgtaatactgcagaattgtggtcccgcttgaaaatttagttaaaaattttactagttaaacgaaaatcattaacaaaattttttgttgggtccaaaattcggcatttgaacaatcactattttgaaattatctgttacgagtacaatactaattagcctttccctctttttggaggtttaggtaattaacacaaacctatgagtgaggaattaacttttggaaccgatgaattctcattttattttcactttgcctttaagttcttttttacaaatattacaattaaattaaatgaattgtggttaaaatttaagcataaatgtatcataccattcctctaacaaattaatgtccattattccttccttttccaaatgattcgtttaaatgtggtgtcggtcccgactccctttttccaattccgtctgcagggcacggccgaggtccgggctgacctttgtgaattcgttcactgcacgcccttggacttcatcggaagtcgacttcaacgaggcactcaaattggctataagccttttgcgatggtcttcgtcgagaacctaaagcagcaaataaatgcacaggtcttggcatttatggccaaccttctcccaaaacagcgcaggctgtgaataattgtcgtcgtcttccgtgttgtatcggtcgacatcgccggaaacggaaaacacactctcccgtgccgtcgccgattctttcggacctccgtaagaattaggatggtacaccggagcgccatctgataaaacccgaaaatatcatgacaaaaaatttaaaatgaaaaattggtagttatt

SEQ ID NO: 11604 - DNA, 1844 bp, Heterodera glycines
atttaaaatgaaaaattggtagttatttcgattgaactatagtcaagtttaagttttttaaaagaaacaatgttaaaatgctgaacaaaaaaggtaagcactaaatttttataaattccgggatcggtatattttagtgttctcccgtataccccaccacctctgttgtcatcaaagcatgcccacccatcaatttgcgtgttgcggactcgagttctatacggacagttgatcggcaacttcatgaagttcgggccgagtcggtggaattgtgtgtcaggataagagaataggcgccctgaatgaagatacagacatgcttttcgaacacgtgctcaccttgtaacattttatcgggcgaaaattcgattcctggcacaattcgggcgggggcaaacgccgattgttctacctcagcgaagtaattctgcggattccgattgagcacaattcgaccaactaaatcaaagcacattaagtttggtttgggacatattttaacgaaccgggaagcaatgggaagtcacggtgaggccaaactttggtcaaatcgaacggattccaacgaaaacgcgacgcttcttcaaaggtcataacctcaaaagagagatggagtaacaaaaaaggaatgtatggtaagacttggatgaagaagtcccattggggaaagtctccgctggcgatggcattgtaaaggtcgcgaattgcgtaatccttgagcaaacccatcccaattacactgaataaccattcgtaattcttacggggtcttcggctgccaattgaagggccttctcagcagttaaattcttaatgccttggcgagtcttaacaggacgaagtgcgttcgagtggatgattaaaggattttacttttatgtgaaatttgcaataaacggcgctgccggcattgtcgacgagtttgaacgtatgactaccgtagcctaaacaaaggtgacgcaacttacataacaggccattcccattgtgtgtggctaaacaaattcacacattcgacagaccgttcatgtggcggaatccgtccggagtcccacggtcggagaacagaaacatcacttggtgcagtgcttcgggtcgaagtgtccaaaaatcccacatctgaagttcttcctgctttatgtgtatgttactgccaataacaattgaccatctccgggtccttaagatgcgtcactgggttccgtttttgcgtatggatgaaattcggaaagagaaacggatcgcgaatgaagaaaatcttcagaaaacattttgatttgacacagaattgaaaggccaaagaatcccacgggtgtgttgttgccaaccaaatcccaattgccctcttcggtgtagaatttgatggcgaaaccgcgcgggtcccgagcagtgtccgcgcttccggcttctccacctaaagcggggaaaaaaaactaaattttcgcagagtcgaggcattttgtaaaaagtatacagtacaaactcgcggatgccgataattatgcaagaaattgaggaaaaatattattttttaaaagaaaaagaaaaatttgccgaagataaaaagatagaaccaaaagggagaaacaatatctgaaactaatattttctggtaatcatgaagaatgtgggtatcattttctaatttaacaaaaaaaaagcaccgaccaacactcgaaaagcgaatgaaaagtggagtccgctttccgacttcgctaaacatggcagtcttgctgtacttggcgatgtccttgttggtcacttcaaaatagccatgcgctcctccgcctttggcatggacgacgcgctccggaatgcgctcacgggcaaagtgtgccatttcg

SEQ ID NO: 11605 - DNA, 1441 bp, Heterodera glycines
acatcttgcattagcaacggaccacgcggaccaacagtcaaaaccgcatttttgttgtggatgggagcaccgttggacatcgtaagcacatccaattcctaatgaaagaaaccgctaaaattctaatcgactaagaaacaccttctttgaacttttgtactcattcatttgctgagaagcacgatccaccgtaggagccattttagaaattcgatgaatattaaagaataaaataattatttaaaaaaggtaatattacagtatgttccaaaaataataattttttctggtttaacaacttactgtaaaaaactgagctgaaattttattgcagccttttaaaaaaaaattgcacgatgctgatttttttgctgctgcttctgatcattacaaatggaataaaatttaactgattgactaaattacccagtccataaaaggcaaattcccattgcgtctattaatgatggagtcacatgttttaaaagaaatttacaaacaaataaaaaaccacacgcgcaatgtcacatttggtgggtgtgttgggtaaacatttatgtaccaccttttattgtatacaattttatggatactggttgttttgttgtgctggtggtgtacagtgtacatcttgttgactaatactttgtgaagaaaaaaaaataaatattaatgagaaaaatataattgatagagctaccaattagaataagcataactttaggcttaagcctaggcttaggcttgcttgggcaggcaaatttgaatttcaacgaaataatatttaaccacaaaaattgtccctaaactgagatttaaaaattccaaggtaaaatagaagattacatattttttaatgtttttcaaattatgaaaaaaaagccaggacccgtcggacgcccggtccaaaattttggtgcgtgcccgggctgtccggttaaacggggtttttgaactgggggggggggattatatgtaaatcaaaacaaaggaattatttcttctgaataaggaaatttatccatttaaatgaccaaattcttcgtgaacgtaataaaattgatggggcaagcgcgtttaattgctgtaaatcgatacataatattgtaaaaaagcaataaatattgagcaaagagcaaaggcaattttctgaaaaatgataatcgaagaaagattatgtatactctgtattagagaccggaaatttcaaatttgtggatcccgctgcgggactggaactcaaaattttttgcgggacgggatcccgcgggattaatcccgcatttaaaatttgcgggatcccgtgcgggattgcgggattttggaaaattcgaaaaaatttcaattaaattcaaaaaatttccaaaaatcaaaaaatgctgaaaaataaatttttaagggctggcgggatgctttaaaaggggctgatgggtcgactaag

SEQ ID NO: 11606 - DNA, 2222 bp, Heterodera glycines
aaaatatgcaccaaaaatggcaaaatatgcacataaaaagtgaaaaatatgcacataaaattttcaaattgatggtgtaattctcaaaatttctttaaattcgctaaatgcaaagtaaaacttacaaaaatggctaaaatatggtattaaaaatcattttagaagaaaaaacacgatgcagcataaaattttactcattttagcgaaaaatcaacctgaaaagcaaaatttcgcttttttgcttattttggacataaaacgatcaattaaaacctcaaaaattgactttttcttggctttttcggcgccacgtggcataacttttttatttttgaatcattcatttctatttttacatgtaaatatagagcacacatagagctttcaaatgatgccagattggctaaagctaactgacaaataaaaaagttatagcatttcaaaatttgcggcgccgaaatggtccgcgccgaagtgaccccgaccctttattttatcgttattttcattaattatatatatacagagcattttttatttttttaaaaacttttttcataatcttgtaattattagggatgcgatttttaggcaaatgcctaaaatttttgcgcacttaatacgcacagataagcacgaaaaaagccctttccgcatggtttggggtgtctacgatgacttttataatgcctaactttgcctatttcggggtttttgtgcctaaagtgcctattttagggtttttgaaaaaatccttaacaaaaatgcaataaaaacaaaaaatacacccctaagaaatgtaaaatttttcaaaaaaattatccctaaatataatatttttttcttaataattggtttaaaaatttgttcatattcgaaaaaaaaactttaaaacatttaataatttcatttacaattgaaatatttaaagttttaacgtgtttcgctacctaaaaagcgttaataaaaaattttatttgcctatttttgtgcctattcgggcttttttgtgcttatttaatgcctatttcgcgattttttgtgcctaaaaatcgcatccctagtaattatagtcgcatgcaaaatgttgttttttctttatgaaaatttttagattaatatttctattttaaattaatattaatgatacggccgttgccgtcgctgctgttccccccccccccccccccgtcgattccccaaattcggcactttatttttattattttgtttcttttgatcaccaatattgtttcaagcgaaattatatgcacatgcgaaaaaaaccagcgatgagcaaaaaaaaaaaggtcgtcaaaaattttggaccccgtcgtaaggaaaatcgcatatgaccaccccccctggcccgatcgtacgtcgtatgacccttggaagtgaccaccccttgtacacgtatgattcaaaacctctttttttgcagcgcttttttaaacattttttgggggacaggggggttcggggaatttttttttattttagtgctatttgttggcagatttttaaaaatgaccaaattttgagattttgggctaatttttttgccaaaaaagaccaaaaatgctcaaaacccctaaaaatgtcggatatttattctcgaaaaccccaaaatatgcatttataatactcacctgaccaacgttcgatacgtgtccaacacttcacgcatagaaagggcgtcgatggcccgcaaacattgcgctaatttctcccgattgaatttgacttttgttttgaccaattcgtcctcgaaatttttgtccgtttcctccagcaacgcattgagcaattcggcagcagtgacgcgtccctcccaattcgaactttgcgagtattggacgaccaatgcgaaaagttggacaattgtctaaaagttggaattatttaatcgttaataattcaatgaataaaaattcaattgaatgcctcgcgatccgaagttggcgacccgacaatttgtgataaagcagcgacagcctctgctcgaatggaacagttgcgcgactcgagcagagtgcccaatttggagagacgaaagcgagaaaaatctgctgctggcattacatacccgaaaaacaaaaaaaaaaagaataaaataaaggaaaagagtaataaattgacagtggtgagtagagaccggaaatgccaattttgcggatcacccctgtaggagtagaactcagaatttttgcgggacggga

SEQ ID NO: 11607 - DNA, 1986 bp, Heterodera glycines
aaaattttcattatccttcaaacaaaaaaaaactaaatttttaaaagaaaatcgcataaaaccaagtggttgacaaaaattcaactatttcaaaccacccaaaaaactccgcccaattagtggacagaaaagttttggaaatcaaaaattggtcgaaaacggatttgaagcattcctgtatcgaagtctgtgtcccatccgctgaggcattaaatttaaaaaaaattgcgaaaaaaacgcacttccaagcacttgaccagccgtcgttgcatgtatccggtctccgccgttttcaccgccgtgtccacgaggccctcccttccgcccattgtgtggaagaagaactcggtgggcgtcaggccggagcgattctgtggcgaagtaacaaaattccattaattaaatgtgcgataatgggagtaaaattttggtgatggcatcgcacaccgtcgtaataaatcatgggtttgcatttagcatcataaatcattttttacctttttaaaaaggttatttttacggaatttttttagagttatatgattggtgtgagcagctcgtttccccccataccagtccccccccccgagaaatgtttttaaaaaagattttttagcttataaaattttaaaaaaatcttaaaacgttgttttacgagaaactccgcgaaaaaataattgcgaaaatctttacagcaattttttggaaatttttttgttgaaaaatcttaacaactcaccaaaattttcaacaaaaaaaattcgttgaattttcagtttgattaatggcgattattttaaaaaattaattaagattccgaacttgggaaggactcaaaaaactttttttttaaattagtatgaggtgataatgatttaatttgcactcccacaatttgtgtcaatccaattgaacaaccgaaaaccgacctcaaatccgtcggacggccgcttgccggagatggactgttggccaaccagggcgatcatttgcgcaatgttaatgaaagaccctttggaaacgcactgggccatcgtcagcggcgcattctttcgactaaaaaaattgcataaaatttggccaattttagacggactttttcagaaaattaaatgcgattttaatttaaaaattttttaaattatattttgaatgaatattgacaaaaatgtcatttttccaattttaatttaccatttttagtcactttcaaaaaaaatggaaaaagtgtccggtgcggtggtaccgatagggcagcccagccgataaaatttttaaaattttaatgaaacatgtatgttaggaaaattgattaaattttcaaaaaaaaccatttcttttcgggaggagagggggggggggggggaattccacccctggctacgggcagatggataacttcgggtttgtcagtcaattattgtactttacaaactcactcctgttcggtcagatttcccccaagggtgccgaggctgcgtcgaatcggtccaccactgggctgaaaatgatttatttgagatgtggaaaaattttaaaaaataaaagaggagggggcatttgggtgttcacaatatttttgtcataaagggtcattttttgtttgaatttttaaaaagaaaaaattgtatcagaaaaggagctgattgttttgtccctcgcatgtttacttttatcattaaatacaataaaaatagatatgtttagaacgtagcagtgaattttacatttgtttaaacaaagtttcgggggtgagggaaacgatgtggaggagaaacggtggatgggatgggaatgaagcactcgtttaagaaaatttcatttttctaatctaaattactcataaaaaatggaaaatcgactcacaaatggcaccatcagatggtcgtcgctgagcatacggtactccatgcgcatcaccccgccaaggctgaagaagttgtgtgcacacggcggtgccaaggcttccgtcgctgcaaacggtga

SEQ ID NO: 11608 - DNA, 3840 bp, Heterodera glycines
  misc_feature (2289)..(2289): n is a, c, g, or t
ttggctaccggaggaccgaactcttagggatgctggctgttggtgggccgagctcatagaggctttgactgtcgaagggccgaactcttggggattttcacagattctaaggcgtaattttatctggccaatcaaaaatttcaatgttaaaatttagacccactcacagtggcgcagagtgatgcgcattaacaaaaagaaaggagtgaaggatggacgagccaacgcacatccgacaacaattttcaatgttttataattttttcgacaaattttcaatgttttatatatttttttttgtttaccaacaataacaacatttcttatctcccattcaaatctttagggatagtggatcaaaataacaaaagaaaagaaggaaagggggtttgggaggggggtccaaaacagatccacgctcattcattcattattcacatttattaaaaaaatggaaccaacaaatacaacttggaccattgagcaaaattgttcttgcaacaatgatttgcttcagtgcgtccggcccctgtactacaaatcacccgtattgtgtgtgcccattgaatttggcaccaattttgtgcaccatttgacccaattttcaaaaacccgtccctcaatgtcccacttgttgttatggtcttactgattctgctccaggtataaaccccctacaaattatttatgtttgtatgtgcaattaatattttacagttgtgtcaaatcatcctcactttgttctatggttatcgccgtcgaccacgtgtccgttttcctaccaatgtaagacccttcacaaattttggcaaaatttttttcaatttttaaaggacactccgctctcgccattgcgccgctttcctccaccaccgccgccctcaattgcaattcgggcaacaacacagaaagtgtgtttaattttgtttctgtttgaacaatttgtattagcatttaacattttcaacaggatcagcaccacacggatgagcgcaaaaatgaacagttcaaaaagagggaggaaccgaagggggcggaggacggacggcacaatttgcacaactcatcggtggttaaaaagaaaaccattgttatatttctaataaaattaaagaagcccaggacgtttccgttcaacaacaaagcagtgatggatgggttgccaaacaacaagcgcaacaagcacaagccgttatacggtatttgtttttgttaaaaattaaaaaacatcacaatattattattattattcagctttggcaagcatcccggaggaggaggagacaaaaaagaatggacgtgaaaagccggcgctcgtgaaggatgacaaatatggggacaattattttgaggactgctattaccagtccacttgggtctaggcaataattttttcatatgcatattttttttgctaaattcaataaacatattgtttaattgtgccttcccagatttatttaaaaaataatcccatcaccatcaaaataattcccatcatcaataccgattcacaagcagtccttctcaatttgacgaacagttctttcgagctgctccttgactattccataaaggtgcgccgcttgcgggtcgggtagtccgttagagcgctcttcgatttttgtgattgtgaaaatcagattcgtcatctgtttgtcgatatcttctttcagaaatgcacatcctaaaattattaaaaattacagtaagaactgaaaatgcatatcaaaaattgttctaccgaaggactttggtccatttattggtccaccaggcagggggtcttgccgattccgacatttccatactctgaaatgccacgcacatttcattgaaatggttttgttggtgccgctgctggcgatgtttttgacgcttcacaatatgaagccatttatattcggaattttttttctgggggcgagatttaaaacgacggcatggggacatttttgtggatttgggaatataattgaaatgagcagtttatgcggaatggcgtgaccaatggaagaggaggcgcgcgatcatgaaccctcccactccccacatctgcttctgcacttcaaatttaaaaatgtttattggtagtcaaaattatccaaataatgcgaaaaatttgatgaattatttggtggtttttggctttttcttttgatcagcaatcatgtcactgacacagcaattgattcgggcacatttttcacacatatcgagtccaatcgccactcgcccatcttccagccgacgtgccttgtctttgttgagaagagcgccaaccgcttncttaactatgttgtttaaatatctattttgctttgggtttagcttcggcaattaagcctactaacagtacccgcgtcgggaacgcaccaaagcattgggtaccaagagctgttgagggtttaaatgatagtcagagggatcatttacaccccgccctaccatacgctgtaccaccctctttaatacagctattaacttaccgtagacagctcttttattccaaaagtaattttaacgaccttttctttttttgtcgaagcttaatagttatttcattaggtttttgaaagttacatatatgttcatataaaaattcttgttataaaatttctttccaaactatatttttaataagagcatttgggttgtcagaaggtaattttactttaatttgttttggtatgttgccacttgtccttttataaaagtcgcagcgaaagctaatctaactggaaactgatgcctttttaatggaacaggaaattcgctttctgttattaaagaaattctatgtatataaatttctgaaccatttttatcacctccaagaattatgcaccgtaatagattttcttttaattctataacttgcaacattgttccattacagagttcttgttcaatattaatattacgtaacaaaataatcttacaattttgttttaatttcaattcatgttaaaatgggtgcgcgcgtgaatccgttgggccctgggccaatgccaggggcattggcccaaagcgcggattccccaattgaaagctccgattaattcaacaatcggtttatttagcgatgagtatatgtgtaaaagcaaaaaggaaaagttggcaacaagccgatcaaagtccccgatcacactgatcaatccgaactctcccccaaatttttatattggcaacaggtgggcgggtcgaacgccccgtggaagaaaaggccaaaaggaagggaaattgggatgactagcgacagggaaaaagaaattgtgtgagacaacaggggaaagggagtcaagataggtggtcagacataacattcccccgcacctgggaaagccgtgccctcacggcttaagctggccccgggcagaaggaaggggtgcgaaggagaacatagattagagagaagatgagatagagagagaaagaaaaagattatttgaatatgagaggaagagagacgatgagagtgagcagtgaaaagagtgttgtcgctgcttttgtgtaccgttttgctgctgctgttgccgttctttgttggatgggaagacggggggggggagggtttttgttgatggcggacgatggaagagcagaagggtcatttgcattcgtcattttttcctttaatttttcgttgttgtccaatcgatgtcgtttttatcccttaatttttagagatttattttgttgtttttttttgtcgtcgccgattgttcatcttcaacgttgtgccgtttcgtcgtcgccgagctgttcgtcctccaattcgtcccattgcgtcgtccgtgccgaaatccaaatggtgaacaaatcgtcgaaatgtggtcg

SEQ ID NO: 11609 - DNA, 5258 bp, Heterodera glycines
caaaatttaaaattaaatgttgcgcctatttctttttcgaccgatttgcccattctcatcactattggttaaacacttcccgttgctctttgatctttgccacatttgctttgtctttttcagtaagtattcccacctggtcggtctcattgcttctaaatacaaaatgccaattttcctctgcctgatttgacattcgttcaaataattccattgccaaagcgatgtaaaaggcccggaaaaacattttgtatgcttccaatctttttgttaatggatgtttctgaatttttatctgcatttccattattttttgatcacattcgtctttgtcctgatcctcttctatgcattctttcagtgtttttcggacttgtccgatcttctcatttccttaaatatatttatatcttcaaatgcaaaattaatattaatttaaaaattgttatttactctaagaaattttatttattttacctaaatcctttacaggaccatcctctttccgatctatcttcgtcttttggtttttaggagtgcccaatgactcactaagcttgtttattgtcagtaccactgcttcttgtccctttttatacgtgtcacttatcccataatcttccaacatttgtcccacaaattcgcgtccaattcggtattggtcccgtatcggatgcgtaagtgtacccaacgaatttgtcaagcgccatttctcatatccttgcccaatttttttgcctatttcaagcagcagccatttgttgtccattttgtccagacgtagcttgccgtacttttcgttcaatgacaccaaattttccttttcttcgcgcaatgttattttctcataattcaggcgatgtgccaaattctgatttagtgacagcaataactcactgaaaaaccagagaaataaacatttttgtcatcattttcaatgaaattggtacgtaaagcgaacatcagtaagatacgaataacccgtagaaataaacattaatagacttggctttaaaaatagcaggaagaaagccattttatctagagcccggagcagcaatcccctttttggaaatccggattttccgaggttttgaggattaatccttcggaatcctgtcccgaaaaatttggaattccaatcccgcagcaagatccgcaaatttaaattaattttgagtttcaatctcgcagcgatatccgtaaatttgaaattttcattctctaatttgatcctccattttaaaataccgcataattaagcatttgtccttggtgttttgtccattattcaattgtattccattcatagacgatggaaatttcattgccgtgtccaattgcatcgtatgttgattaacaaataatttatagtcgaattgatctctacgaacagcctcaaaaaattggctagcacattgaaacagatggtcatcaaagcttttgtccattaattcacctgaaaagcaaatttaaaggaatttatgcggatctaaacatagggctgttgttctaaactgattcgagtcgaaaaagataaaaaaaagtcctatgggtgcctatcaccacgccagactctaatatgtaaatttgtcacctaacatgaattttaatgtatttgattttgaatattatctttcaccctctctattcattaaagtgtctgcttcaacgtggtcctccacaacattggcacaatcattaaacgggtcttcccatgtttcttcttcattttcatcttcgtcctccccctttttagcagttgatgccgacggttcattctccccatttagccatttgtccatattttccagtccctcggagttataaactgattccattcgctttcgcgttttttgcctcaaattcttataaatgtctttcaattctttgttgtaagaattttcaccatttatatcttcaatttttttgatcagattctctgaaaatgcatacatgtaatggtaaatgcaagtggcaaaatcggagtttaattcatccagcctttttgtgtaattttctgtcatgagatcctttctttcttcctcttcctccgtcagattttgctcatttttactatcaatgtcttttttctttttatctttctgatttttgttttcctgttgcaatttttttgcttttgtttccttaactttttgtttatttttgttactaacgaatttgtaatgcgattttatcagttgctggcactttgtgcccgccgtgttcaccaacacttggacccgtacgcgcatggatggctctgccaatttccaatttttggcattattttttgctttttgttcgttttctccttccaaatcctggaagctcttcctttgttcggttctcaacaaattgaaaaaatttgtagcaattaattctgatctttttgccaaatttttttcaaattctggctcaaaaacaattttgtagaaatgattgacaaatacttccgcattttcaacattaatcgcactacatttcaattctgaaatttgttaaaataaaaatatgaagaattaaaccaataggaaaaaagtaattaatttttgtaaaacgaaaaataattaatttgttttgaatgcttacgagtttcgccttcgatgataacacaaagtccaaattttttgttaactcgctcggttattttatataaatctgccaaattatctccgtattcctccaccatttgcttccatgcaaacatttttttgtcagtataagttttcaagaatgaatttttctcctcattttcgccaaaattcacgccaaatttgctttcaagacgccacatgagtttttgtatatggtgataaagcaaatactgcacacaattgaggtgtgtcgcattgctgttattgcttaaaaaagcaaatgaatgaaaaatatagctttaaactagagttgagcgggaccgggaattttgggcaaaaccgggaccgggcgggaccttttcaggttgaaaaaccgggacttatctcgaagtcaaaaaatttttccttaaatttaaattttacgactggaaatcggcaccgtcgcagcctccatgaaaataaatttggaaaaaggccgttagtcaaaaaaccatcaaaataaaaaattttttgctaaaactttgctcaaaaacaaccatattttaaagttttatgtcattcgatagccctacctgttttttattagcatgcaaaatttcaaaagtttcgttaagtttgaagaaagttatgatcaaaaatgttcaagaaaacttgctttcattgagtttctcaagtcatgacttttttaaacgacgaattttttgaaattttggagtataacataaaacacttaagctatctctaataatatcaagattttaaaatttgattcattttatgcgcatttgtgaagaattttctgtcaaaaatttttatttgatggttttttgagtaacgcccattttgatgggttttgagtaacgcgacccggcaccgtgcaccgatccctcgcgctgatctctaatattaattcagactttttatttatattaattaattaaatattatataagaatcatacctcttcacgcgatagcgagcatcgagttgcaagtgtgatcatttttctggcattgttcacaattgtgtccggatcaccaattatgtcttcgagtttcttcggttgatcagttgccgcctttttactctccgaaattttttgtttgattgattcaacaaaattttgcacaattttgtctttgccttttccttctatgggtatttgatggaaattttcggcagcaaattgggcacttttcacggaaaagttacggcaatttattgctaaatttttgaatatttaaataattttatttcaattattttttccaaattaacacttaccttcagaaaaattgttcatgaagacaaatagcagaagcgtcagaagaaacagttgcatgtaattagttagcattcttatctaaattttttaaattaaattatatttttataaagtaaagatataaatctttgataataaaattaaaaagaaattcttattctaaaaatgaaatgtataataatgtgaatggttaggtctatgaatattttatgacgactatgtgaataagaatgtgattctttctttttttatttccatcgattttatttgagaaattattttattttttttttaaatttaaaataagcaaaagcattgtaagttaaatttttattactgacacttttacaatttataataataatataatatatatttatccaaaaaattatctaaagtttgcataataggaatttaaaaatttgcattaagcttatgcttagggcactctttgaagcgataaaagtaaaaataattttaaaacatagcgaaattggttaacagatttttatttaattatatttaatttattaattaaagcaaatccctttgttaagatttcgcgattgataaccccaaatgatgagcaacaacaaagtgccttaggcaacaaaaaaaacacataaatataaaaaagctttttttaaggccaagtttttattttttatttttgccttttttgtgaagtgcccaaatttgcactttttgtgaagtggccaaccgcatttgagacatatatgcatagagagagagaaaagagaaaaaagagagagagagagaaagaaacacaaagagacaggtccaagttaggcacgaaaaacttcaaaaaattaaaatttattagcctgggtccgggtataggtttttcctggacatgaattttctagcaatttttccaaaaaatacaggtctatgctttttcaaaatcataattcttctttttttcctgcttttcttacaaaataattttcgaataagatacgtttaaaaataggctaattagttttggccatttttcttgcttccccaaatgcccggcatttccaaccccagcaaattttagagtgccgtggcattttcaaatcctaaattaaagcaaaaaatttctctttaataaattttttttacaaatttctcattccatgcttactagattaaaacttaaatcggctttaagcttgtaattttttcatttatattatttccaacttaaaaaaatttacattttattcgatgttgccaaatgtccttattttttaaatatgtaaatgaatttcataaatccaatttaagagcttagctttgctggcattttgccagcattatgcaatgaaatcacattgttttatgaaaaattaatgtaaaaatttcccatt

SEQ ID NO: 11610 - DNA, 677 bp, Heterodera glycines
atgtgatggtgcggtttcggagatcgggcgtcttcttaacgggtgtcacttcgtccccccccccccccgagaaattaattttgattaaactacaaaatctaaacttttaaagaaatttcgtaggaaggggggggggtgtaaaactgtcaaaacccccaattttgcgaaactaaaagaaatatcgcaaatctttcaattcccaaaaaaaacttggtttcatcatcgaacggcacattttatatgcacattttacaccattaattatttttcgagtgtggcacctttttatgcttcaaggattccgctgatttccagaaaatgttactgcttatttttctattttttaccattgtttgacctcattaggattttcttcttattgacagactaatacaaaaacgaaaagaatcccttcccataggcactggctgaacacattgccaaagtgcacttgcagcaaaagccattccctggcggcgttcacgtgcgtctgttgccgaacagcaaaaacaatggacgaccactgattcagtcggccaacatcagcagcaccaatggagaacaacagaagaatctgatcgccgtcgtcgagcagcacttggagcagtacaccaaggacctcgttaaggaagtaagtgactggggcatggcatggttttggtttggggggggggggg

SEQ ID NO: 11611 - DNA, 2043 bp, Heterodera glycines
tttaagaagcaacgtaaaaactgagaataacaaaagcaattttattggcttttaatgttgaggaacgaccacagaagagctgctatttgagaataatctgaacagaaatgaaaattccttctgaaaagctgcgcgatattcggaactgaaaagcaattagcggaacagaataattaacattttatcgatgtcacggcagttcgtacaaaggcttagactaggtataagccttcggtttaagcctaagcttaagctttttttgtaaaaattttattgtacgaattgccattgacccattttgaccttgtcaaatagagaattaggccacttgacgaagcactgatgtggcacaaaatgccaacaatctgtgaagaatgccacaaaacaatcgcattactttcattaatgttcaataatttgtatattaaagcaacggaacaagcaaagagataaccgccaaaattggcgaaaataattgcgaaaagcgaccggaaaatacgattattaaattgggtcgaattggagtttgaaggcactgaaatgacaaataattggcaaatacataattttgcatatttttaactgaaaaacctttacggcactgaacagcaacagcaattaatgcgtaaagaatgaccgaaaagaatacgcaaaaagtgccttccaactgaacattggttgcccagtggctctttaattaataaatgttaattaatattataattagggcttctttttttgatgcaaatacatatttttcctggattctctatgctctgaaatagtaggaaaaccctttcttttttgtgtttacgaacaaaagtttggacttttatttacatatttcgtgattgttctacatatttcatacatgttttcattttttttacatattttgagaatttatagaagaaataataaaaatttatttttgaaaatgtaccccaagaaaatgggttttttcaaaaaaagagatatgaaaaaaaaaattttaatactaaaaggtgatcaaaaaatttttaacatattttattatatatttttgggtttttatagctattccatacatattttatcatttttatacatattttatttacataattcgcgatttttcttacataaaaaagaagtcctaattataattttagagattagtaaaaattttattattaaatgaaactaactgatttgaaaatgcgaccgataattaaaaaataattgtcaattgtttcaagcgaattcatttgcgagtcgtaaccgtttaaataaatgagtgacgatgcaatgatttgcaccatattaaccatcagaacaatggcaaaaatatatgttttcttcaactttcttattaaataaaataattttgaaaacatttattttattttgatataaaaatattgtttttaattattattttttacatattttacttgagcggaaaaagcacagcgaacaatcgttcaatgccggtaaaaaccattaaattcactgcgcatccactgcttgttaaaggaataaccacaaaataaacggctgttttaaatgacacaaaatattggccagaaaatgcggagaatattgtcagaaaattgccacacaaatttacaatttcgcataatgaataaaatgccaacaaaatattgacggagccacggagtgcccttgggggaagaaaatgtttttttttgaaaaaaatattaaactttaattattattaattgacaaaatgattgacactttgtccgaaatgtgatgaaaatgacggaaaaattgaaaaacatcccaaacattgtcacaacgccaaaactaatggcataaatgggcattgtcccagcaaaaatctttattttaaaaattgacaaaaaatacaatttaattcatacctccggtgttaattcgtcgatttcttttttcatttgcgtttctttcattttaatgtttattcagaaaaaaaaaaattttttttctcataaaatgtttgacgaatgaattcggagataaattaataaaattttacgagagaaattttgctgacttcat

SEQ ID NO: 11612 - DNA, 752 bp, Heterodera glycines
ccccgttccaaggggtggagcgcgggacagaaaaaatccccgcggaatcgtgcaaaacaaaaaaaattttcgcacgtcgcaggtcgccggctccaaccccttgccccccgtcaaacttttttacaccttaaaataggtctaaaattattaattttcaaacataattaatttaatttgtctctctgtagtccaaataagatcgcaaaaaacaattattcttgctaattattcgacatgaagcgaaccaacgcatcaaacatcactccgcctcgcgcaaaacgttcaatggcacctgcacaggacctggacccaaacgctatcgcactcgcggagcaagaacgacaacgcaccctggtcttcattggcctcccggaaagcaatgccattcgcccatcggaacgtgttcaggaagacagggaagccgccacaaaaatcctggaccatcttgaagttgaggcccaaccaaccgccgtctttcgactcggacgtacgcgcgcttcatattcttccttgagttgttctttggtcagcgctgggcggacgaacaggcggttcaggttttgtagagaacggagtcgagcacgctcgcgcttccatcctccgagtgccatgtgttggtgtgtggttgttggcatgaccaccttgagcgggcgtggtgttgttcgctgcgggtcgtaacgtcggctctaggaaaatccgaaactggaaaatccgacaccggaaattccgacactggaaaatccaacacaagc

SEQ ID NO: 11613 - DNA, 928 bp, Heterodera glycines
cccccccccgccgtttccctcctccatatcaaaaataacttctttttttgtcaaactttgagattttagaaaaaatatttaaagaaattttcaaggaaaatggaatttttttctaaattttttttgtattttaatatgaataattacattttcaaaaaaaaatagttgaaattctagtctaggtattgactaacgtaatcagccaaaatatatcaccgtgtgcccagcagcagcgaattctttgccctgcttttttcgtccttttcccagagagttggattcgttcgaactctgaaaagttgacatattaaaagaagcagttcattcaaaaaaaggggggggggtaggccaaattttatgagggacaaaatatacaaaaattttcggtaccgccaaagaaactttcatttttcaaagttgcaggccaaaacgtcgccacaagtttttttattttagaaaattcaagaaaaaatatcaaaaattaattgttacctagcttagattgaaaaaaagtttatgaaaaattcgacggaccataaaatcttcaatatttttccgaaactcagcaaactttgtttcactaatcgtctccatctttttgaaattttaaacgactacagaaatcaaccaaaatatatcaccgtgagcccagcagcagcgatttctctgccctgctttgtttgtcccttttccgtgctttctttgcggtcggacgccgtctcgaacggttcgaaactcttcaacaattttacatttaaaatttgcatgacaaattttgtcacaatttattgcctttgctggctgtcgttgcggtgccctctgctgggcattggcatcggtgtcacgcggcaattgcccgcgcaactcagaggccaaatgttgaagaccgccggaaagaggcgtgaacagatttgctgaatggggggtt

SEQ ID NO: 11614 - DNA, 2951 bp, Heterodera glycines
ccccccccccccgccttcttggtatggagtgcaaaatccggttttcccttcgcgtccctgccggttacttacccaattgtggaaaccttcgacacattttcagccttctcatgaatgtgcaaggcccacttagacaaagtttgaacaatttcttttaatttggcaacttcttcagcgtcaattgatgagcgaaggccgttcatgacagagttcatctcgtccaaagaagacatgaatcgcgcttcaaagtcggaaatagctaaatggcacttttattatggtatggcactaaaaaatttgccaaaacacgaaattcttattttaaaatttagtttttctaaaagaaaaactaaatttttttaatggtttgattttgaaaaaactgagtatcttactgatgaaaactctaaatgtaagaaaaaaaaatttaatttttgatggaaattgaagaggggctgaaagggatgagagaggacggagaacgagctgccccgggcatgacaaacgaaccaatgttgatcgacgttctgtcagtgcattcgttgcgcagtttgcgaggaaaatcatgcagcagagattgaagagactcggcatgttcgtaaaaaagtgctttgtctgacttctcacaatttgacttgatggcgctgtcgacaccgggattgtccagtcgcccttggcgaatcgcagtcgaaagcgaaacctgaggcgtaaattgatgtgatttaacaaaaggacagcagattgaaatgaaagaggtgctcctccagccctagttgacaaatgaggacaaccacaaccaaccactaagggcgtatccaggggatttgagggagctaaaacacccccccccccccctccgaagcgaaaaagtaaaaaatttcagcattttgaaatttaagtaatttttcttaacaaattgctttatttatttttcccggcggggactcatattttagcatattttgaaaaatagggaccaaatggcgaaaatagtaatttttggcgaaaatcggctaaaaattttgcaaatagacctcttttgattttttttttgaaaaactgaatatgagacaaggagagtgggggacgacccaattaagcctaagtcgtagtgaattaagccagcgaccaagtatatactttgtcgtttgggcagatcggcgacgtcgttgacggtacacagcctcaaaattatttactttcgcactgaattcgccgccgcgtgcggccgatgtggcggcagacggagcagcggcggtcagttgaccgccgccgaacgttccttcagcggtcatggctgaatcagtgtcctaaagtttatacaatgcgccaacaagtttagtattttctcaggattagctttttccctcaaatgtggagaaacccgtttttccaaccactcggtgttaaggaccaaaattttttacagttcgcaaattttatagcaaaaatgttgccaaaattaatgatgttttatgtcaacgagtcagcgctcggcccaaagaaaatgttccattgggtgaaacccaatttttcaaccatgaatgtacagaaccaacattttgccagttgagtattttgcatttttgttggaaatttattttgatagtgacatgcttttcttctcgttttacaaaacagtgaacttaaaacctgtccgcactgttgtttgcgccttttgaaggccgacacactggtggtgatgttaagtgccagtaagtccatcgtttgggctgtgtgtcgacaaaagtgggcaatttccttgttgccgtcttcgatacgctcaacaatcgtgtcgagcaattcaaatgtgtcctcgcgaaattgttcaaactttgtggtgagtcttttttccatttcctcgaactttcggtccatttcttctgtatttcgttgcatttcctcaaaaataaaatcgttatgtttgagaaccgccaaacgccacacatatggtggaacaaaggctgaactctatcatttatgataaaatcagacaaaaccgatcaactgtgaacgaattttttataagttttaataattctaataatttggtttttattaaaattttaataaattttaagatatggtttagcaaaatcttagaaaaggctgggcaaataaacatgtagctttcgaagtattccaaggtttattttgattaattgactagaaaaaaattctttctatctttaaacaacaagagaaatgaaaaaagagtaaaatctgacccacgagtttattttgaatttaaaattttcattaatcttctcaaaataaaaaattggcatttcgtcaatttacggctcaattcattcttttttttggtgaaaactacggatggatcgtccggtagattgtttattaacttgttcccggaggatttggagtccctgatcacgaatctgcatctattttgaccaatttctcaaacccaactcgaacaaaggtcaaaaattcaaatttttcgatttatgttttttattaataagttaggaagccggacttggtctaaatatatcagatattcgtgatcagcgaccctaaaaaccattagaataagtttccactagttgaaagattttgaagttctcgacttttggttcgatttcgggcccgggttcataattagtcaaaatgaatgttattagattaatgatcaactgccctgaaaagcccataaacatattttcacgactttgtaaaataaataaataaattttcttccaaaaaagggcggaccattgacagaattaccctttcaatttaaaagtttaaatcaaattccttggcccaaaaatggcacggcatacctctttccatttgtcaacacgtggaagcaaaaaattgtgaagcagccgacaggataaaacacattcggaagagtttcctcgacagggaataaaggcacaagttcgaacaaaagttcgggcggaaggcattttggggccatt

SEQ ID NO: 11615 - DNA, 1028 bp, Heterodera glycines
  misc_feature (58)..(58): n is a, c, g, or t
  misc_feature (72)..(72): n is a, c, g, or t
  misc_feature (90)..(90): n is a, c, g, or t
  misc_feature (103)..(103): n is a, c, g, or t
  misc_feature (109)..(109): n is a, c, g, or t
  misc_feature (1012)..(1013): n is a, c, g, or t
ttagtcaatgggcagagaacagaatagccaaagcaatgtatggctgtatgggagaagncaaattttttatanccttaaaaaagacatttntgcttaagctttnaaaatntaattggcattgccagttaggagggcttgtgattatcaacgctttctgatgaatgacccgcagcagccacagtcaccgatttacaatcgtacaatggcacagggaaaaggggggaggagggcatttacactgaaaatggcattcattttcacgacaattgtacagttctcatttcatttatatactctgatagcaaataatccctaagattgatcaactgctgattagccctgtgaaaagattaaattttacattatgcattaattactccgaatgtccatccatgcgcgtctttgactttgccgcctcgccaaaaagccgacaaaaagaaatttcacattcccaaattatgtcattgcttttgggcatttaacctaattatttatttgcaaagataattttataataaagattcaaattttttagaaaaaattgttagtagagggtgaaacaggcataattttccataaaaatgcctaaataggcttaaaagcacattttaatacttaaaaaataattttttatatctctttttttgaaaacagccgattttgtcgaaaaaaatgtgtaattttggatttttggggcactcaaaactcaaagtttgccgcatataatacataatgtattatttatttagttaattgcttttcatttattccataatttttgaatacagtcatggtcataagtgttgtcccatcatgctttgaaaaaaataattgcgtataaaattgtcattttccaatttcaacagataagtagcataccattggatagcattttttatgggctttccaatgataccatatttgcatttgtgacataaacatttatttgatttattttaccatattcacaattgatcaaaatataggtggtcaaaaagtgttgtcccgaccnntgcaggcccatgcaa

SEQ ID NO: 11616 - DNA, 590 bp, Heterodera glycines
agggagggggcaaagcacagtattaccgaaacttttaggctgtttttgtgtgtttttgaccttcaattgctgaagttcttctgcgtcctctcgttgattttccaattgatttttcaatgacaaaagtttcagtctttcgcggtcagtcaaacgtccgatctgtaagagttttcgaggttactaagaaaaataaaggacagattttagtaaaattatatatagatattctacaaaaatattttactatttgtcatttatttattatttgtaacagtctaaaattttcggcaatcctgcagaatgggtgtccctaatttttaactttttttttttaatttgggctcaaaatcagtttcaggggatttcgagggtactgattacgaatctaaactcggatttgcctaattccgaacctcagacctgaattcgaacgaagttaaaagaatttttttcaagaatggattttttggggtaaaagcttctaattcatttaacacaatttattttgatgtaaaactatgctacaattgttaattggattaaaatgcgcaatttgcgtcaaaatttaattcggtttaaacatatttttt

SEQ ID NO: 11617 - DNA, 2423 bp, Heterodera glycines
ccaacgccaaagacaccgaagagaaacagagcagaagggaagcccaggcacggccaatgtacgaaatgcgctggtttccacgcttaattatgatgaattttaatcctattttccaatggagtgaaaggggaaaacccgatcacttagaaatgtagttaaagtcaaattaaagacacctttactgatctgaataaaataacgttcactgtcagcatttcacctcatagaaaaagcactgaacgcccgttatgatgcatgccaacaaagcatgggaagcgaacacaacgtcattgataaggactgggatcagactgcgctgtccatgccgttcaatgtaaattctctgtttttgagattaaaacataaaacgccaaagatttgacaaaacctgaacattcggatcgaaataaagcaacacattataaacagtgtaacaggaaaaaccaatgacattcagcagcaaaaaatcgaagttaagaccaatgacactgaaaaataaataaagaaattcaaaaaaccgaaacaaacaccacctctttcgctggaagttgagaataatctgcggatagaaggaaatactccacctgaagagaagcggacaattggccaaagggaaagggactcacgcaacgaaataaatccatccggagagaatgaccaaaacggagatcgttttacttctgaccacggtgacggggataaagaaatcaagtggactgaaagaaattgacatcattaggaaaagaatgaatgctaatgttaatgataaactcactcaaaagggcaaatgtcagcaaatgacccattgtcaaaaaccaatgaacaattttggagttcaatataagttcggctggacagggacagaccggtgacattcacttgcacttgagagtccttttcttttttcagagtaattcgttcgggtgtcagttttagcacggtccaacttgtgttcagaaccaagttcaaattgtactcaaatcttttcctgaaaaatataaattcaaaacaatggaattgttcaaattaaaagatagacaaacttggatgataagacgagtgaaacttcatggcctatcgaaacagacaattcctttggacattcgaccggcaagtctttactgatctttaaatggtcatggaggatggattccgtccgatagatacccataagaaaaattgaaagaacaatcggccagcgcatagagagagagagacacggaattgttgcttatctgctggttcgaatgagcagtggtcgagaagaaatatgaccaaagtggtaaagcacgcacgacatgaagtggaaaggaaacaggctaaatgggcgagaagacaataaaaaaactccccattacattagataaaaattaggtaaacactggcctgttaatcaattaatggagacagttaatcaattaattattcatgaggatttaaaaaaaatcaaatgatgcaataataattaaaattaactcattttcatgttttcatttttacttaaatcgttagaaattgaatctgaaacgaagtgaacaaaagaaaaattactgaaaattcaacttttttttaaacaaatttctttaaattcttaaaaaatttccctggcaacgcctatcagcatcgcagaaccacaaaaacttaattttcattaaaaaatgctcaaaatcgcaaaaatcggaaaaaaaaactcgtcgattctggcaggaccccgttcgtaagtttgtcgtcccccccccctccctatgaccccccagcacgaaaattgttacttgggtccggatccgtccaaccatattatctatatatagtatgtttgtttaaaaagaaagtttttctcaacttgcagaatttgaaattctctttgcttggatagtgatggaatctccaaaattactgagcataaattttggtcccttggttcgaatttttcgtttcaacagtgctcttgctgatgttaaacgtgttccttttgcaattcctaaaccaattcaagttttgtttatttatttttttgattctattttttaatttaagcgttcgccaactgacttgctaaaagcacttgcaggcactgttaaggaagatgaaacctcagttcactttggactagtcgatgatccgataatgattccaactggttttagagacaaacgactctatctgatgtcaaaggcatatttattttagatattcaaattaattacaaacgatgctttcaaatttgaggagcttggtcgccggactgctcgcaaaattgttgaggaatggccaacattatttatgctcgaccgtgatgttcccgaattgaaggctttcagaccgcagaaaccattggatcccactttggtacaaccgaacgaggaaaatttacaaaaaatgataatggaccgacgagtgtctgatgctataaagctttatca

SEQ ID NO: 11618 - DNA, 1542 bp, Heterodera glycines
  misc_feature (88)..(88): n is a, c, g, or t
  misc_feature (97)..(97): n is a, c, g, or t
taaatgtgcgctttgcctacaatgttttggctcaacttaccgatgtcaagccaagagtatgtctatcagtgaaaaattaaacacaaanttggacatntagttgtttaatttgcctgatggggaaaattacatggaattgtgcaagaaaatcgttgacgttattgaacaattggaccgtcagaagcttgaaagagaattgaataagaatagcaaatgaaatgctttgttataataatttcctttcattgaaaacatttttatttattccaaattattttaatttatcgttcattcgactttatttttattgtgcatattcttttctggttatataagtttgtgtttctgtctttaagcagctttctttttcaaatggctttttgcactcgtccgatttctccgattttaactgaaagtaaaaaccgacaaaaggaattgattctggaccgtgataaggttgttgaagggattgccgtgtcatttcactttttcttcctttttgcagatccatcgcattgcgctgaacactccggcgatttgcgttctttcgcacgtcgcctcggcaaattgcatttggttcaaactctttaatcacatcactggtcaacttcaacttggcaggtgaaattgtgatgtttattccatcatttgttgtttctgtgatgtttagagaacaattaaagaaattggaccgtactaaaacagtcgaaagtgagtttttgttgatattccgtggttaaattcaaaaatagacctagcctaataattagggctgctaattttatgtaaaacatgtttttttcctggcttctccatgctctaaatggtaggaaaacaatttcttttttgtgtttgcgaacaaaagttgggacttttatttgtttgttttacctttgtttcctcatcaattgacccattagcaattgcatttccattttctaattgtgatcagcatctggcaaagattaccaatacgtgatggcccctctgaatgagaatgtatacgccaggggacgcgtgttgtgccgctgtgactcgaattggcaaattgtttacgtccatttcattgatgaggggtacggcgcttggatgtacgaagtacgtttttagtgacaaaaattagtgtattttaagatcatgatttccaaaatccctcctctataatatttcccattcattaggattgtttggctcagatggatcgctttttcttctcccatccttggcaagcatttccgatagcgttgttcaaaacatcgaaaatggccgagccaagcaggtttttgaccgtcttgttcaatacgatgaatgtgataattgttactatagggaggagttggtccgcattttgaagcagttcccgcgttttaacgtaatccccgccatgggcaatcagcgcattgcttcgagccaacaattattatgcccacgtcagggtaacaaattcagtcattcactaaaatggaagctgattgcttacaggcggatgtttttggcttaaaatcttcggaaggccaaacgaacgaaagaaatgatcggtct

SEQ ID NO: 11619 - DNA, 2654 bp, Heterodera glycines
  misc_feature (1637)..(1637): n is a, c, g, or t
  misc_feature (2642)..(2644): n is a, c, g, or t
atataccgtatatgctctaattatagcccagtctctattaataccgcagtctccaattatcccccccccctttctgaggagtttaaaaaataatcacccagtctccatttatcccccatgacggataaatagaattttgagaacattgtttggcactaattttttctgaaaaacaaaacaattttccagcaaattggttgataatttgcggcaccggtcgctttctgttgaccaacacatagggcttgagcttatgtccattgctgcgggcttttgcagtagagaccggacaactggggtcggagggatcccgagtcgggatcccgaccgaatcccgatcccgatgaatcccgaagatttttttcgggatcccgcgggattatcgggatttgctaaaacccaattttttttaaatggctttttaatttttagttttgtgctaagttttgttcaagtgcttatctaatatttataattgattaattcgattgtgaaaaatagggatggtaattatattaggtttttatagattttttccaaaattagaatatctagggtcaaaaattagaacatttaacaacatagcttgaaatatttttacaatttaatcaattaatgtcaatttctgtattttcgcctcctattatcattttaaacaattttaaggaaattagaaaatcgtaaactgcatagggatcaaaaatcaagaattttttcgcagtgaattttttcaaaaactttaggggaacagggggagggccggcggtgccgataggcgccgccgggaaaattttgaatttgaaatgtaatttgttaacagaatttatcaaatgacaatattttttaatttaaaattcaagatcttaattaaaaaatggagatttttcgaaaaattatcgtgacttcagtcccgcgggatcccgcgggattggtaaaatggtcaggagggatcccgattcgggatcctgatgaaatccttatcccgatcaattccgatgaatttaaaaaatcgctcgggatggatcccgaatttaatcccgcgggatcccgatcccgtccggtctctattttgcagacggaacagctgtggcttcctccataaattgcgttacaaacacagcaaaaagactccattgctaaatatatggaatttttcaaatttttcatgaacagattttctgtattttacatgaaaatttgaaaaattccataggtactaggtcgatcctaaaaaagtatcaatgataatgaataattatatttaataattcttaataaaaatattttaaaatttatataaatattttattttttaattaattttagaccaattttcaatttcattaatacaattgaaaagtatcatcataatatttaaaattattattccatttaaattaaatgaaaattattttttgatcaaactacagaaaatattttaaccattcggtaaattttttgcaaaaaatttaattccattaaaaataacgtcactttttgagtccgtaataagagatgaaaacgcgagaaaaaagaaatgctaaaaatggatggaaacaaacataatgctatgcccatggcatttgaggagataaaagccgccaagaaccggcatggattttttacgaatctttcanatccggatttgtggccttccaaataatcaagtaagagcaagagaaaataaagttaataaaaaatattttcattttttatgtcaatatatgacaagaatgattttaacactgaagggggacgatattttataaattgaaaatttttattattatggcaaataatattgacagcattgattatcgtttccgatgtaaaataatatttcatcttaaaaataatttttattatctgcttaaatattatccatgaatttataattaatctaattattcattatcattgatacttttttagggatcgcccccatgtatacttttttaggatcgactcagcactcaaaaatgcattaaaaataattattttttgccgagctgacatttttggcgacatgttcaaaaaaaattcaaaaatttttcactaaacaaatcagtcgaaaaataatcccacagtctctattaatcacgcagtctctaattatcccctgtattctgaggaggttgaaaaataatcccccatgggctataattagagcatatacggtatgtaattgtatacaataaaataaaaacctgaacatagaataaatattgattgaataaaaaaaattacgaataaagcttttgagtaaaaatcgatcaaataaataaaagaaaaaaaattgtatttagggattccatttttaggaaaatgtcaaaaatttttgctcatttgatacgcaaagcacgaaaaaagaattttccgattggttaaaggtgtttaagatgacttttataatgcctattttggattttttgtgcttaatgtctaggggaatattttgtgccgatatctgaatttcggaaaaatcatataaacgtaataagcaaaaaaaacacttaagaatgataatttttcccaaaaattgataaagggggaaatactaggtatttcgaaaccatatctccgccttttaaaggtattcttttttaaaattttaaattccctagccccttatgacctgcagnnnccatgcaagc

SEQ ID NO: 11620 - DNA, 1640 bp, Heterodera glycines
tgaaatgcatgtcaattatttaatcataatttttttttaatagctcaaaatgttaatttccaatgtcactatttatctatttcgctagcaaattacaaaccaaattgatttcaagtaattcttcatggagctttaaaatacaaattcgcttaaaacacactttgatttttaagctttaggcttctataagaataatttcgaccctattaataatagtgacaagcttaatgaaaggagcaagaattgactgataaaagttgtaattttcgatatcacagtatttgataataaattgaaaattttttatatagcgaaccaaaaatatgacttaataatatttcaaaaaagagattaaattcaatttaattttactcaactaaattaagttgttaaactaataaaggtttttgaaaaataaaaaaacatacatacaatacataaattgcaaaaatttagtaaaattctaaattaaaaataaaaattttattatttaattcaagtgaacataaattaattaacgaaaactcatgcgttttacacgtgtaatcaatgcaaggcatgaaaaaatttcaaaagttgttaataaggaacaaatgatttaggaaaaattaaaagatcataatttaataataaaaatataaattaattttttatgaaacaagaaatttttatcagaaaatcaaatcaatatattttcaaaatcatattcaaaagtaaaaatataaaaaataaatgcaatcagatttgtgttaagacatcgttgaggcctcactgctccgtataaaaaaggtaattccgcaaaaaaaaatggaggttagctgtacaaagcaaaggtttaacatgtgaaaaataaatctataaatcaaaattctaaatataaaaaacaaaattgtcaaaaataaatatttaaattaattactgaattatatgaatatagtaaaattaattatgaaaattaaaaaaaatatatataaaaaagaaaattattattatataaaataaatttgaaatattcaacatatataaatagggataacatttttaggcaaatgcctatattttcctgagctccccgtggcctgaaacgcacgaaaaacatgttttttttgggctgttgttaagctacttttcgagttattagtgcctattttctaggcttttatttttagcgcttaaaaagcctaaaaaattttgaaagagcctatttttgcctattttggcgttttgcccaaaatttgtttaaaaaaatgcaataaaaacgaaaaatacacccctaagaatcgacctaaatttttttcaaaaaatacacccctaagaatcggctcgaaaattttctaaaacacaccccctaagaaatgaaaaatttttcaaaaatacacccctataaatcgacccgaaaattttcaaaaatacacccctgagaaatgaaaattttctcaaaaattcatctaacaaaatttctttaattattttcttaacgagaatttttgattttgaaaattatgtatatcctttatgatttggcaaaatatttttgctttttgaagaaaattttcgattttacacccctaaaatggaggtttttcgtgcctattttccattttttagtgcctattttgggggttttttagagcctaaag

SEQ ID NO: 11621 - DNA, 1067 bp, Heterodera glycines
ccccagtcctcacctgggacagtccctgcaaaaacgtcaaattttcttaaagaatttgctcaaaatcgcaaaattcgagcattttttgataaaatcttttaacaaatgcactcaaatttcagcaccatcggaccctctcggtttgttcatcaaaaatttttttttaagttttgaactaagcactaatcttctaagatttaatgcccatatttaaatttgagcccctttttgcaatatgatgacaacctggggaaattggacaaacttacgggaaacagtattcacaacgttgggaatctcctgcttgacttgcattatcgtgtactgcttcaccacttcacaaacagacattccttttttgacttcaattggattcgctttttcgccaatgccaaaaatgtcggtgattgttttggcgaccttttctaatttcgggcatgctgccaatgctgtcaaaagcttttcgaccaaaaatccgagcaaaactttgccgtagtgtacgcatttttcacccagccatttgccccaacagaaggcctgcgacactttatctgtcagcgcttcatatgccattgtgatgctcagtttcaggtcatcccatcccctgaaaaacaaaggcattttgtaataagtatttaaaaattgggcgggccaaggaacaagcagaggttgtcaacaaaagaaagtatactataccgtacggcgagactcaatattttgagttcttatggctatagcggatcgggatttgcagttattaattaaagtttttgcgttaattccaagcaaataagattttaaaaacaaaaaaaatttggaaaaatcccagttggatccttattattaaactaatgaccaatcctaggcaatacccaaacacagcggcaaaccctgattccggactcgctcagttcggccccagccaagttttaaatctataacttttttctttgtcaaccaaatccaacaatcttggtatcattcgagagctctttacatacttactctatcagccttacaaaaagcaaaacgattttcaagcctagaaaaaatttattaagaaaaaa

SEQ ID NO: 11622 - DNA, 981 bp, Heterodera glycines
cagagtaattaagtagaaatcgatttaaaaaaagaaagaaaaacttgacaaaatttacagaaattgcaaaactgaaaagccacgctcaaaaatatttgaacaaattttaatgataataaatcaaattttcgaaaatgtgaaaaccaaaactcgagtataaaaaataaaatcaccaaattgttttaaaactcacttcaccgatttgccttctttttgtgtctccgcaatttttttgtcaatttcgtaggcaattttgttgttccaaaaggcccaggcttcgagaatttgaataaatgcgtacaaacacttatcgcccgctttttcacacatggcacggatttcagggattcttcggcacattcgctggtagagagcgcctggaaggagagagatagagaaggcatgaacacgtgggcatcaaataataaattaatccccgcgataagaaatatttttacataaacggagcccaacagtccgatccgatcagtgtgtgcacagattaccattttaatgaccataccaaacacactaattaatgcaccgctcccacccccccccccccccccacatttggaacttgggtctttcactacacaccgtgaagcattattggcgggatgcgattgaggcggaataactcgagctgtgcggcaaccatttcatcgcgcttatcgcgccaatttgaccattcttcgtccgtccattgttcatctcctgcgacgccaagcagcgtccgcacgtgcgacttgcggacgatcagacagccggagcccggctgacccttgcgcgccacgcggccggccgcctgctcctcgacgcgttggttgcatggggaaaaagcggtgatgtgggccaaaccgccatgggccaaaacctattgtaaatagattttaattattcattggaaaccctttttttaatttgaatgtcgcctccctaatttttaggcctgctagaatttcaatcctggtgagtgta

SEQ ID NO: 11623 - DNA, 2340 bp, Heterodera glycines
aatgtgaatggacgatactgctgctgcagagtgagcaagcacggaattccgacaataaattttagagattggatttcaacaaatttacaaaaatttcctcccgcttttcgtgcccgaaattgttgcaaccctagtgggggaaatacgaaatacggtattatcacaaaagggtgccgccccttacatccggcgaagggttttggtccacgccgcgcgcgatgagtaacgtgccgatcagaatgtggccagtgcacatgtcctcccgcaacattttgcgttcctcttcagtaccctgaataataagggcagaaaaaccattattaataatgtgttttaaaaaatggccaaaaacccatgtggtttcgggatcgcttatcaaaaatggcataaaaattatttggaaaaatacaaaataaattaaaggcgtaaaaaataagatggcatttccctgtaccttagtgaacatccgaattttcctcgtttcggcaatctttgggtccgctttgatttcggcctcaatctcttcggcatctttgatggattcggtgattatcaaaaccgcccgcttttcagaatattccattgccttaagtggaatgctcgtttaaaactgtattttaatatcaacgatcagggggtatccctttttccaattcttatttaagcgcatttgccatattttggtacccaataggcggcgagtcccaccgatggacaacccatttattcacttagtctaagaaaacctataattagcctttcttggtcaaaatccataaacatgattcaatttgaaaatttccctccacctgagttccaaatttttaatgcgatgaattcggtgggttgtgatgcttcttctaccttttctctgatgcttttcaaccactcttcatcgctttcacacagtttgtcatcgtctttcgtgtattttcgttctttgaagcgtggcaaagtgatgttcattatattgaaagtgttgccggaaaagtcttgctcatcagtgtttccggtagttccggtgatcgacgttatgtcggcctttttgctcagaaagaagccgaggttatttttgtgggaaatgtgcagggacggcggggtgagctccacgtcctgcaatgactgaacacactgctgcagtccgttgctgtactgcgagttcttctcaatgatgccgctgttcatgttgtccaccggcactattctcatcggtgccgccatttgtaacattttgccgatgccgccgctgccgttgttggcattctgttcgtgggataaatggatgagcaattcggcttttgactaattcgtgtttctgatcatacataacaataagggtgggggtgggggggtcgaccacggtgggggtcgattgggcgccgaccagttgggcgccagcctgctttttgaggcacaactcctttcatagttgacagaactgaatgaatttaatatcattcaataggcctaaatattctcgattagcctgctaaatttcaaaaaatttggttaaatttcaaaaaagtcatgtacaaaaatattcagaaaaccgatttttttttaagttttttgtccataatatttttgaaacttaaccaaatttttcgaaattttctaggctaacagagaactcttaggtctattgaatgatattaaattcattcagttcagccaactatgaaaggagttgtgcctcaaaaagcaggctggcgcccaactggtcggcgcccaatcgacccggtccgcagaatcgagcccccccccctctgctgataagaaaatattttaatttgtacacatacatacataaattatgggcttaaaaaatcgagaccggatgtgctcatagcggggacggtcccccagcattttggcttggaggaggtagctttttttaattgaaaatttgggtgagggaaatcttggaaggggtattttaagtgtttctcagcgaaacaaaaggtgcagaaaaaagatttcaaaaataataaaataaatccgctccctttaattaataccaatttaattaaaattgccggtttgatcaaagcatcgaaatttatcagagtgaaaaataaaataaaaaatccgatcaaaaagcttcaaactgctgattgattcttctttccgctgtgttccgattgatcaacaacacatcgttcttctttttcggtccgctgttcacttttccccgatcatttcattgttttgacaaacgcccccccccccgccacttttcatcagtttcgacggggtggcgaacaaatccaaaccaaataaataatatgaccgatatttcacaatttaacaaaatttccaacccccatcgccatcgattag

SEQ ID NO: 11624 - DNA, 1129 bp, Heterodera glycines
tctagagtccgattagaaattattagaaaaaaaaattaggaatcaaaaaatgtaaatattgcgcttttacgcgtcccattaatggccatcctcagtttcttaggtcataacttttttcatgcttgtaatatttcgcgtaatatttcgcactaaaaattttctgttatctcaattcctctgtttttctctgctctcatctctatgcgattcactatttctctgtgagattgttctagggccactgatcattctttatctgatcacttgctttgttcagtcgtcgcttctccgtcaacattttcttcagcatttcccgctgttcattgcgcaaccaatccgagtcttggcttgaattcgacgtctataggttagaaattatcatttttaaaagagttgattgaatttttcaaaaaattcgtgattttgttggcattagcactttcttttccgtgccgagagtctcgaggagtgtcataatttataaaaactccaaccctaatttgctgttgttgttgctgctgttgcggttgtggcagttgtgccgcgaattgcactgaagttgctgttggcggtgccatcaatggcgctgcgactgttgtggcaccggcggcggcggtcgatgccaccgccgccgcagcgacggcagccaatggcgccgtgggcgctggcggcgacattttttcgccggtgggcgacggaatgtgagcagtgggcagaaagaatgccgccgtggcaggaggagccggccctggcattggacccatggatacggtacggcagcatactgtagaaacgatggagagagttgctgtacaaatctcggcactgtttatccccctcctcaccatttgccgatgttcgtacacaacagggcgattgagcgagtgggtcggctgctgctaccgacggttgctgtacaacggaagatggtagaaggggggagacggcatacggtagcgacggtgccatgaaaccgttgccattcatggcaccgcccgcatttgttgcggcggaaccaccaccattcgtgctgctcagctcggaggacggacgtaccgaattgacctggaaaaaaagtcagaatttgcatggaaatttacaaatccgagagtttcagaacataatttca

SEQ ID NO: 11625 - DNA, 1790 bp, Heterodera glycines
  misc_feature (108)..(108): n is a, c, g, or t
  misc_feature (1771)..(1771): n is a, c, g, or t
tgtttagaaaatgaatttaaataaaataaaataaatataaaaacaaatttaaaagtgtttaaataggatgagagtgtcacttaaatgagttcccaagacttttttatntagaaattttcctgccattttttctcgattttttatgaaatttactccccgaccaaggtgttttttgttcgccaacatttttttttttggtttgaaccaaccatccccgacaaattttgttgccgtgggatttcctcctctattcccaacttttctttacccgaaggtcggggagaaacccctatcaatttcaaataattattttctttatttaattttaatttgtccaactaattattttttttttcaaaatttttgcctgaatttttggtccgtcccatttggtcgtctgacaaaaatgaagtccaatgagtagcccagtgaaacttcttccagcgaacttccgtcctattcaaatttgaatgttggcatttttttttttttctgtttggcaaaacgttcacagactttgcaagggaataattcttcgccatatccctcgcactgttggatttcgacaatgtacaaaagcgcggcataagctggctgcatggtgtgcaattttccataggcctatcatttttagaaaaattttttaaaacttctcttaaatttgaaattttcttttcttttacgacgccctcatgaaaaaactcaccgttaaaattcttgcatatgtctcgtcgttgttgatcttcggattccgacacatttcctatttttaaaacaaattttaatttaaaacaaaataaaaatgaaaattttttaaaaaatattttactaattattaattagtgttaattagtccacctgcggtaaaagtgacagcattttcaagtgttgtaatgttggcgaatttaaattgggaaattcaatttggagctgataggcggctgaaaaaaatatttcagaaaatatatatttatttaaatttaattaaaaattataattaaatattcaaattacccaaattaatgcatttgtccaattccaacgtggcaaatttgttgctctgaagcacatccaattttagcaaagtgtaataaatgctgcgcgaaacagtgtcatgcagcgtaaacacctgaaaaatatttgaaaataacattataaatttgtttatagtattagaaaattaaatatttttataaaccgtattccctaaaatagagcccccggggggctttattttccaaccctctcaaaaaggaggggggggggactttatttcagaggctctatttttcaaatcccatcaaaagggtggctttatttcaggggggtgggctttaaattgggggggggggctgtattttttgaaaaattttaaaattattgcattgtaaaatattttaaattaaatttaaaataattcccctcacatttgcgcacgcgtgcaaaatggccaaattgacggcccatttttggccccgtcggcatgcccaccgttccaattggcgtctgatcggcttgtccggctccacccatcgcatcattcgcttctccgtatcagtggcctttaattaaaaaattcttaattcagtctaaaaccaaaacaaaaaataataaaataatattaattggtcccaaaatttaaaaatgaaaaattcttggcccaattttgtaagacatttgttaaaagagagagaataaaattgaattttgtcaccttcatttggtactgtaagccgaacagttcgggctaaatgcaaaaaatgtaatttanaattaattaaaataaaata

SEQ ID NO: 11626 - DNA, 1171 bp, Heterodera glycines
  misc_feature (799)..(799): n is a, c, g, or t
  misc_feature (1076)..(1076): n is a, c, g, or t
  misc_feature (1138)..(1138): n is a, c, g, or t
attcattcattcattttgaaaatccggttccaccccccccccccccacccctctcgggagccctttccccacatttttgagcagaccactctcgcggtggtgcctgccctctgctggggtcgtccccaccgctcattagcgggggcgcggacggacggacagacacttttgccctttaaggcaaaaaaagaaaaatgcggtaaaatgcgacggaaaggtgaaaaacgaaagaaatttctaatttaattagccgaaaaaatgagaaaagaatttctctctctttggaaattcaaaaatgggggcattttaaattggcgtgacaatttgcaattcaaatcaggtttcaattagattgattattcgccaacaaaaatttaataataattagagtcgatttcgcaattcaaaatttcattttgttagaaaattgttagaactcagtttaataaaacaatacaaataagaatatttttttctaaaaaaataccgggatcggcattattgatggcaagatcctgtgtcaggatgggacccttttttaatccggatccgcgagatctcgattttggattaaaacccaccatgctgcaataagcattggtattttgggagcccggccgccgccgccttgggcataatttaattgaagcggaagggtcgcacgcgcattaaacacaacgccaaaaccaaaacagcaacaacaacacaacaacaatcaacaactttcatcgcgccaaatcaccgcctattatcaccatcatcatcaaatcatcatcaaatcaacatcaaaatcatcgtncttggttgttgtcccccgcccccctccctaatttgctcccaccagttttaatgagcgccccgtcccgctcattagactaatgatgatgataatgatgacgaagatgatgttgcaccgcagcaataaggcaaaacaaagaaagcaatcaccataagcggaacaccaagcagccaaaattggacgagcaattcgttaattaattaattacccctaccctcggggcatgaagtgatcaaaactcaaaagcgatttcaatacttgctgatgagcaagtggntgatcactctcactgtcactgatcagtcaaagggggtagaaagagcaccacccccaaatganaacagcaaattaccgttttaactaatgataaaa

SEQ ID NO: 11627 - DNA, 1648 bp, Heterodera glycines
ttatttaaaaaaccatcaaataaaaaattttggcttataacttgctcaaaagcaacaaaatttttaattcttgatatcattcgatagcccttagtgttctctataagtctacaaaatttcaaaaaatattattgtttaaaaaaatttatggccaaaaatgttcgaaaatcaaggttttttgagttcctcgagctataacttttttgaaacttcacgaaattttttgaaattttgcagactgctatcaaatgatatcaagaattaaaaatttcgttgctttcgagcaaagttataaataattttcgacaaaaattttcatatcacttcacctggccgttggatccggatcccgaccctaccccctcccttccccgcgccgaattgtcctttaaatttgtgcattaaaaattttttttgtgggtatttaattaaattttcgaattactcccgctcccgcccgggactcccgttaaaaatggacgggagtttaacgggagcgggagttttacgggattcccgctcccgctcccggaaattttttttaccgggctctaaaaaacagacataggtacgcacaaacaaaatgccaataaattaatataaattaaatcatataacgcacctgttgcaaatctaagtgcaacagatgaggtttttaactggtgcaaaatgataatttttgcattaaataaaatggtgttaaatattatgattagggctgctaattttatgtaagaaaatttgcgaattatgtaaataaaatatgcataaaaaatgctaaaatatatatgaaatatgtacaaaaacccccaaatatgtactaaaatatgtaaataaaaatttttaaatggtcttttttttggaaaaaattcttcgtaaaaagtctaatcacaaaatgccataaaaatgatcaaaataggcttagaatcacattttattttagtgctttaaattttattaatttttggtatctgttttttttgaaaaaatcgattttttagggataaattttcaaaaaaatttaattcttcacaaaaaatttctataaattctcaaaatatggaaaaaaataaaaatgtgtacgcaaaaattttaaaatttttgattttttggggaatctaaaaaattttcgttaaaaaatcctcaaaaattgcgaaatatgtagaaaaaaaaaatgcgaaaaagtccaaaatatgtataaaaatatgtgcatatcaggggtgtgacttgtctcagaaaagacgagagcgagagtttggcgagaggcgagagtccccaaaaagacgagagcgagagtttggcgagaggcgagagtccccaaaaacacgagagttggcgagaggcgagaggacgagaggcgagagtttttcaatttttttctgtagccttattttttaatttaaaaaacttcaaaatcgtatattaattaggggtacgggcctgggtatttgggcaaataccgggtcagggtattgccgggtacagaaagccgggtcagagtcctagtttttaaaccgagtccaagtcatgaaaaatccaaacaaaaatctttaaaattttttcatgaaaattaaaaaatattttcatgaaatatatttattttagaaacaaactttattatttgtcccattttttccactcttttttt

SEQ ID NO: 11628 - DNA, 1747 bp, Heterodera glycines
tttaccctcataaaattgtcagaaaaaatgtttttctattttatgattaacaaacttttcataaagaaaagaaaaatgcattataaatgggatgaagaagtaggcagcaattggcgtgcaaatagcgcagttggtactagcgcagccacaggacccaatcgaacgcgggttcagtcccgttagcacgcaatattttttaacaaatttaataaataaacactatagcatcatttaaatcatatttattatttaatttattactgaatattttttaattaatacataggatgataatttttttaaatgaaaattttttttcaaggaatttctttctcaacgcaaaataggtgaagcgaaaatgtcgtcgacaaactacttttgttcattatgccaattatttataatcacaaaaataaagaatttccgagcattataattagggcttatatttgtaggctcttaaattgccaaaataggcctaaaaatagaaaaggctttaaaaaacctcaaatttaggtgtgtaaatgacaaaattttagtcaaaagcaagaaaattaagccaaatcaatattgagaaacaaaaattcttgccaaaaaataaacaaatttattttagagatgagtttatgacaattttcatttcttagtgagtgtatttttgaaaattttgtcgtttcctaggggggtgggttttcttttcattgcatttttgttaataaattttggccataaggcagggcttcgatcgaaaatttttcaaaataagaacatcaaggccaaacaaaaaaatttgaaggtcaaaactaagaacaatcgcaaaattgctcaaatcacttatttgtacaatttatttatctcattgaatagtaaagccggcggacaaacaaagaaaaaagcggcatttttcggcttccgaccatccgtctccgatcaccgctgcccctggtgctcgcgttcggcttcctgatcggttttctgattccctattatgcacttctgtttgatgccgtcgggcgacaacgttgctgctgccgatcagtgccaattgtgtcaccgctgccgacaatgcgctgttcccaatgctccgcattttgcacatcgatgccatcgccagcaaaattccctaataattactaaatctaaaattgctttttctctggttggaaaacattcatttcgccttacgtttcgcctattaacccaaaatcggagtttcaccgactaacctaaaatagatggtttgacaaagaatttcacctaaatttgtttatattattagctatatttataatgataatgaaatttaacctaaaagtaaactggaaaaaatatatttataaaattccagagaaattcttgtcattgttggggcttgggacacactcatggacggtaaaaaagaaaaaaaagcgacaataaatctttttatggataattatgggaaaaaattggcgttctgtcacatttactttttatctttatttctctcacttttatgtactatctcttcattgttaataatgtaaagaacaacatttacttcgctctatagaacttttttttcgccttacagaatttcttcatattttgcatatcgatagagaaaaaaatataggatttttcaatcgcttttttaaagaaaacaatcgcttttatttaactttaatttttattttaaggcaaatttaattatatggaaaaaaggaaaattgtgtgcaagcttaatgcaattaaatcggcacaaaaa

SEQ ID NO: 11629 - DNA, 5101 bp, Heterodera glycines
  misc_feature (33)..(33): n is a, c, g, or t
  misc_feature (36)..(36): n is a, c, g, or t
  misc_feature (102)..(102): n is a, c, g, or t
  misc_feature (148)..(148): n is a, c, g, or t
aattttttatccaaaaatcatgaaaatatgttntgnaacattttagtcggatcatgcatatagtattatcatattcatgatcaacgaaactaaaaacatcanagtcaataaaaacaaaaattgtcaaaagtgtcttcgccctttgctntaatacctaaagggcaatctcgaatatagcatcggttttctgttcatttcacgcaacattttgtctttcttttatttttactgttgcattaataaatatattttttaatattaactgggttaaatggttaaatacacaaagttataaacaaaagaaaaaattacaattgttcatgcatacaaatatgaaaataacaaatgtaattagaactgcgaaatgcccagtgataagcccgaacaaaattagtgaaattttaatcaggcccgacaaaaaaaataacatttctttgctacttaatttatcttcctaatcaaaaaaacaattaataaaataaaaaaaaatttccgtcctgggacacgtgttggccacgcctttgtccacaattggcgccttcccaatctccgcatagtgatgtacatgctgttgttgttggggctgcaacagaagacggcgacggggaaataaatgcacagagtgtttgactttccgaaaatgattaatgatttttactattatgaaaattttgattaataattaattattcaaataaagccaatttttttgctgaacgaatgaaaatcacttcaatctctacactatgacccagccgcaaattgattttttttttttttgctttgtaaaattttattccaaaaccatgagtagaaatattattttaagtggaataattttttgctaatatttaaaaaaaaatttaattttcaatgattaaaaaatcaaatgttaaaaattcaaaattaatttttacattgtactcctgccagggggccacctcaatttactggttttcaagagtattaaatttttgtgacatgtttattcaattagataatatattttgtttttattcctaaaattgttcatttattattaccgaaaacgatagttaaaaaaacttaggacggatttaatgccggaaaatgccatgtcattctgtcaaaattataatttttctctataattcgagtaaatcattaatggcttcaaccgactaattaacatttttatatttttttaaatttaaattttccattttgtgccgtgaaattaaatttaacaattatttatttattttgtaaacaatgaaaatttccataatgcagtccacattgaattaccaggaaaaatttggtcttttgaccgagtcttggcttgatatttttcagccccgttttgttcatcgtccattaaaatattcgtcattttttccttcatttctcgctttttggcattttttttgatgtccaaagcaattcaatttattataaatgtaaatccaattttaactttgaaaataaattattttcttggcattcattgctaattttcttggctcaattaaagcataagtgttataatacgattatttgatgtactttggtatcgactatgtgcgatatggtcatctagtatgtcgtccgtttggctccgaaattggtttacgctttttctctatgtgtctatgcttattcaatgaacactttctctctctctctctctcttctctctgtctctccccctctctctctctcgctttctctctctttcgctctctctctccccctctctctcgctctctctgtttatagtgtgctctttcttttttaatttgtctcattcttctatttttatgctgaacgaataaatctttttccatttccccgtcattttcaaaattgctttatcctgacttttctgtattaaggcaaattttcagtgcaagaattggctcttttgcccccccccccacccccgagttttttcctcgcaattttggcaaaattccgtctggtcgaaggccaagcacacgctcgagacaaggcctaaaaattgaaaggaaattaattataggttctcgagcgtatcggtttgcagctctatgagcttcggtcttttcaaaccgacaccaatggaagaattaataaaaaaataataattattaattggcgagaatctgagttaaataatttgaaaaaataatgcccgcctatttgtccaccttttgggtcaataaaactttcggggggaaagaatgaaacaaaagaaaacaaaggggtctaacaaaagcttaaaaaaggaactaaacacaaattttgacggaaggcaacgcatttttcacatttaaaaataaattaaatatatgagtaagtttgtttttttatcttttaaaaatatttaacgataaaattaattgaaaagctttatatagatcgatagaggagacttttctcaattaataaatcttatttgggatttttatattgtttggctgatttttggccgatttttaaaagttggtggttacgcctgcaaccatgggtaggggcagggttggcgttttaccatggttacatggttaggtatttaaccataaccaccttcttttactacggccccagggggcaaccggaggcaaaatagtgcagcagtcgggacccgcacaatgcattttctggcgcgtgcgggtgactgatggccaccaaaattgcattaattgagagcgaatgcgctggtcaatatgcaagtgatgcgtcgcgtgattggagctcgtccaaccgctacaacacttgcgcatcaaaacattccatgagcaattcctgccaaaattgatcaaggctaattagagtaattaaaattttcaatttatttttttcaattcaattaggaaagaaaacttctaatctatttttcaaaattttttatttaaacattaaaaacaattaattgaatcacgttcttaagaaaaaggacaaatggcctaccaaattaaaattcaaaaagaatttaaaaattcagactaagtcttgagtaggcaaaataggacgaaatattatatactatcattcgacgtctcttagtctataaagtaagaatcaaagggttttatgactcttattccctaatgagtcacagacgcgggactgaactgtccaaaaaaaaagaagaatttcttgacagaaaacacattttttacgcgttcaaccactttttttcattaaatttggtctgtatttttttaaagattttgctttccaaaaatgacaatttttgtgggtttttatgctgaaatttaaggaattttaacagaatagagagaatgcgctatcgggaaaatttttttttttttggattttcttgaattgttaacaaattttgtccaaaaaataatcagcatttcaacaaaaaaaacctgctttaactcgttaaaagcatcaaagtatttttattttatgataaattttagacttttttaaattaaaattttaaaagactcttcttatcattcaatttttagtctttttacgattcaattcgttcaaattagtaaagcagaaatgcaaaaattttagtgataaaatgtttggctgataatttttgctaatgaccatcattaaacccaccatcgcgacccaattacatttgggctactgcttttctctatttgtaaatgttttaattgtagaacagtacaacccaaaagtaacaataataataattattatttattttaacgaaaattaaggagtattttaaaaatatataattatatttattattcgattttgctgatcaagatcctttagccccgggacctaaatgtttcttaaatattaattttcaaaaatttttataaattataatttgaatataggccaaaataggttttgccactgcgcatttggccttatattgtttgcattcggattatccacaattctcatctgtccacccaacacagggggtcactttatcttcgtcacatctgaggtggggggggggggcaaaatggatttttgtgccgctcccccgtccgaagcatccaaacagaaggcctttcgaatttaccattttttggattttgttcaacaaattaaaaaaaaagttatggttgctctaacttggtcggtacggaattgaccccaaccgacccattctaccagttgtgccgccggttttttggcacgaccattccggggggaagagcaatgcaaaattagacattcatgccctcgttaattcagtcaaagatttctgttaaaaaacaaacaaacaacttggcatttaatgattatattatttattcatcatttttcccggagatcttaagatcaaatattggcacaggaaaactaaaaaaattcaaattttcaaaaaattttgtttatttatttactcaaactgtctttgggactcagttgacccccccccccactaaaatcgtgcgcccaatttttcaatttattggccttatgcatgaataatttgtgtgaggtgcaagtggtgatggttgtgactggtggtgacccaacttccgcactgtccatgtcccaccttttctcccctcggtgacacttccgtcctccgtttcctcactcacttccccccccccatttgcgctaaatttcccctctaattaaaggctttgtgtgcacccgtcgaaggcaaaatggaggagatattaccccctccccccggggcacctttacgcttatagcacacacatatcgcaaaggtcaaatgtcaaaaggtcatcggcccgtctccgctggcggcgcgtcccattcggcgcccaactgcttaatggacatggaacgaaacgcaatttctatctatgcttgattttttaaaaattttttttagcatttcccggggtattgcagggagtcgagaaattcttaaacatttaaaaactagccttaccaatgtttttaggaatttttaaacttgcgcttatcagcaagaaaaagcgtatttccctttaggaaacattttttcatacagcaaagtatttcaggtcgtttctataaaaaatcattcccaagggcgatgtatttttggaaataaggacaattttacggtttataagccactctcctaaccaattatgtccttaccattcaaggacggctaatatgcattcagcagcagaaa

SEQ ID NO: 11630 - DNA, 1950 bp, Heterodera glycines
  misc_feature (59)..(59): n is a, c, g, or t
  misc_feature (1865)..(1865): n is a, c, g, or t
  misc_feature (1916)..(1916): n is a, c, g, or t
  misc_feature (1920)..(1920): n is a, c, g, or t
ttttgactacattccagctggagatatttgtatagaaaaagtgaaagcgataaattttntggcgaaaaaatcatacaaatcttattttttattacttacttcaattataaattttgtatatgcaaattgtatattaatattaacatgtgtacaataaatcacgcagaaaattaattaaaaatcactgtcgaaaacacctggtacgcccaaaacaaatccattcctgaaaaatgaaattaactatatttgtagccaaattaatgtttgaagcaattttcgaacagccaacgtgggaatgcgttgaagcgatcatcgccccttctgcgatcggtcagtcagtcccccgggcggagattgtttcgacggaatgcccttctcgcccccgggtccacccattccataccctcactaatttatcattattccattttttatcattccgccgctcttttttatgcgtctccgacactcataaattttacatttccctttcacttgccaattccattctccgcgggaatgataaagtgtcaacctaaacaaacacaaatcaaagccgtacattttatggaagaaatttgtcggacgacggtcattcatttgttgaactggttaaagaaaaaaaagtggggggaggcaacaataaaaacccattctcattaactggagacgagtcacccccaactcatccatacccaactcatccataacgctgcgagtcatcgtcgtggcatggcattttctgcttatgtggtcgtggcatggcattttctgcttatgtggtcttgaccgtggacatttttgattatgccggtcttgaccgtggcattttttggttgtacggtgttagtcgtggcattaaatgccacggcgacgactcgtatcgtgctatggatgagttgggcatggatgagttgggtatggatgagttgggtttggatgagttgggtttaccccgttttattgcatttttgttaaggaattttccaaaaaatgtcgaaatagtgaaaaaatagtgacaaaacgccaaaatagtgaattttcactattttattgacgaagctccaaataaaagcctagaaaataggcactaataactcgaaaagtagcttaacaacagcccaaaaaaacatgtttttagtgcgtttcaggccacgggagctcaggaaaaaataggcttttgtctaaaaatattagccctatttattagctttaaaaagctgttatcggaataaattagttctcttactgtattttttaaacctaatcaattacttcccatgggcaaaccgaactgaaatttttgcaaaacatatcccccctcataaatattaagaacttaacaaataatcggaaaacttgaaaaatttgaggaaattcatgcgagtacaacttttggtgctgataaaaatgtcaattgcaaaacatgatcagataacgttttaagggtgaactgaaaaccaaaaatggctttaattcaggaaatttttggaaaaaaattccaaggggtggaaaaattgttcgcagaaaacgaatacgatgtacagaaagagaacaaaacttgctacaaatcgccttttgttggtgtgtctatgattcatatccgttgaattcggtaagattaaaaaaccgtcaaaatggtcaattccccttggaattcaactgatttgcttagtctaccagcgaaaaacagtctttgttgatccatcggaatgccttcaatgcgatcgactatggctttgatttctaaggtggtgccgcttggaagaacattactgagagtcagtgttttgccggtcaacaatcttacaaagatttgaattccgtgccgtttctgtgcatggaaaaaggaaaatgccatttanaaaatggcacaaaagataacacaccgcagaatttgaatcttcactaattanaatnttactggtattttctggccaattctttttc

SEQ ID NO: 11631 - DNA, 2317 bp, Heterodera glycines
acccccggaattccgatttccgaaaatttttgggacctcggaatgccatccctggagcaatcctgtctttacgtcagttttctgacgtgcttgcagagaagcaaaataagaagtaggtaaatgataagaaagttaagttaggaatctgactccattacgccagaaaagtttcaaaaatttaaatttttttgtcgctgctccgcatagacagacagtgcaatatttcctccttccctccgctaacaaataagggaacgcggaaatagtgcacagtctgcctttctgagaatttgatgaataaataaaaaacatcatttaataaattaacttgatttaaatggggtaaaaagagatacatataacaaggatgtcatcgaaaaatctttgaattcagaacttcgggctcaaaaaatcaggtttttgggttaaaaacagtgttattttataatttgttgttaataaaaaaatagcaattttaacaaaaaataaaatacattaaaaacatattgttgaaatatttttagaaaatattcaaaaataagataatatgtacattatatattttagaattttaacacatataaatcccatcccgttctttcggagaaatgtataatatctatttaaaaagttccatctttatgagtgaatttaaaaccgaaaaaccaatccccccggttttcggtttttggcgcaaaaagccggttttcgttttcggttcgcttatagaccgtgcccaacccttattacaactgtatacaatatagtttatttttaaagatattttctatttttcgttttatttttaactaagcttatagaattaaatatcgaatttttttaaaattatttccttaaaaatattaaatcaaaaaacttttcctattaaattttttattttattttctgtaaatcatcttttattttcttctcgttctcagagagatgagtgttatgttattgcttctgcagcactgcttaatttaataaatcaatgccagggaattttagagatattatgtatattatagatattatttttttgcaaatcatagattgatcaattggatagtgacagtaataaattatttaacagaaaactttttcaatggtattttatttatgatacagacgataaaattattcttttcattaatttaaaataaataaaaatcaatatgaaaatgataacaaagtgttttccttatttaaaatttagaggttaagctcattgaatgttttgatgctgcacatcttcagacttgcggtgtatgtgttgtcaaaatacgcatcgccataaactcggacgcggaaggcgaattgtttgatcgcaacgaatgggatttccaatgttttgatcaaattatcgatggcactgatcagacacttttgcagcattttattggatgcgcgatcattaatccaaatctgaaatttaagtcacatttagtggattaccagcaaaagtcattttatacagtttttagcataaatattggggttgtctgcgactagagaaaggccaaacgtttaatatattttttgcgctgaatcttattaaaattggtgtttaggtatttgacaaaccccatttcaaatttgcgggatcccgtgcaaaaatgcggtaattatggaaatttcgaaaaaatttaaattaaataaaaaagttatcaacaaactaaatataaacaccataaattttttgtgggatggcggcatacatgaaaagggagtggtgggtcaacagatttttcgaaagggtccgggggtttgagagagatgatggtcaaattgttaatgggagcattccataaaatttgatggtttatgttgcttttcacatcacttttttaaccgggaggacaaccgatttgcggtgattatgactccccaaatggctattatggatctttaagaaccaaaacattttcaaaatgtgcaaaaatatgcaaaatccatatgaatcgaccccctaataatcaaaaaagtgagtcacaaattcgtgatcagagctccttttgaccgggttccctttcccgggccatccatcacaaactcccgcccgattcttggtccgatggtaaagctcggccaaatgtgcttccctggtctaaccacgatccgattcgttttctggtgctttcctcctatcgcattgtgcccacctccaactttccaaagatcggtaagtcgatcacatcccacggcttctcctcttccttctcctcctcccacttcgccccctcctccgcttccgcatccaattccttcctccacattgttttgccattggccgtgtcgatttgccacctgagga

SEQ ID NO: 11632 - DNA, 1767 bp, Heterodera glycines
cgtgcgaattgcccacaaaactttgcccctttcgcaaataattctcccaccgatctttgccttcgaagacagcatttttgaaaaggatacgaaatttgcacaataccaactgaaattggactatgaaattgcatatttattttctttctcttacacaaaatgggcactgttctttggcatttatgtgcacgggaaagtcgccacattcgtagccccacaaagtccatttgccaagtgccaattggggagaaggacactttggcacggaaaggggcggcagaaggcttaaggaaaacaaatgattgggattggattgcttaaaaacacacaattggtatcagtttcctacaataatcctttttatgttttgctaaaaagctcgacttatttgagttgcagtttattacattttcatttttgaattatatgaaggtattaaattgtttttaattattttttaaataattattttttttgtttatttcggcacattttcatttatttgctcacccttttctcttttccatttcgttgttctccttttgcgtgtatttgtcaacaatttccttggtactttttgccatgatcaaacggagtcttaaatttgtccagagaatgttaaaattgctttttgcttcttccattacctcgtcccattgtaattgcttttggtgtatttggcaacgatttgctcggaattcatggcacttttttggtcaaaggcaataaaatgtaatttttaataatttgtcccggaataattaaacctaagagagggtttttattaaataatcaaaaacggacctttctaacaaataaaaaataaataaatggattccattaattgcaaaaattattaatcttcagtttcaatttaaagaaaggataagtaaatcttcgcagaatgaagaaatgagatggaaaatgctgattaaacttccaattctgtgaatgtttggcataataaaatatggaaaaaagaatggtcgccaatcgttggccattccatcggcgaagaaacacaaatgaagaaaaaaggacgaaagaaaggatggaccgaccaattgatgaagacgattcagcaaaaccaatggttaaattaaactgtgttcgatttgtttggatgaaaaacgaatttgaaagatttatccttaaatccaaaaagcaaaacttaataggagcataaaatcgaggggtttccagactgaaaatagtgctttgtcataaaaatagagccgaactaataacttgagattttttggaaaggggctcaaaaataggatttctacgtaaaacatttgcaactgcttctgaccggctgatcaacggccgggaattttttgcgaatttttccgaaagtcgaagttgccaatccgggaatgccctccatcatcgcagttgccgttttgcgaatttccgaacacataaaattggcaatatggaatgttctcccataaaataattggatcgaaattcttgtaggtgtttaaataggagtcacaggaaaattgacaaaataattcaaaagaatgatagtccaactattattattattcataacgaatgtgttaattttaatgccattaattatgacgtaagtgaagacaaatgccaacaaaaggtaagtgatgagaaaagtatgaggggcgggggtaataggattagtaaggaccaattatggattatgccaattgtctggctataaatactttaatcaattgccatttgaagcagtccatgagagcagcaaaatttttaaaaggtatc

SEQ ID NO: 11633 - DNA, 1323 bp, Heterodera glycines
ttcaactatttcaattcatgtgtttaaagatatttgtttttataatattttttgctcttcaagccaaaaattttttcttacagaagagtagccattttgaatgtctaacttagccatttggggtcaatattccaaaaaatataaggtaaatgggtctcctgcggtgccgcttacaattagaagattttttgggaattttaatgcgctttttgagaaaattggttaaaattttcgaaaaaagttatgtgccatcaggaaaaaaccattttagggtgttttatgctaatatataatatttttgttaggttaaagacgcgtgttgcgagaacgttgtcggctttgtgccgttgcccaccggtgtcgctggtccgctgtattttgacggaacttttgtccacctgccgttggccaccacggaaggcgcgctggtggccagtgtcagccggggatgtctcagcattaatgtatgagattttttaaggcaaattggggccattttttggattttttgattcggttaaatcctcgcccgaacttttttttgaacgtccactacccgagtcccggagaaaccctgacatttttccccgtcccgaatttgggagtcccgaggccgacatcgacaattttttcaacctacggaaaaaatattttgatttgaggaaattgtattgattattgaaattgcatccctaaaaaattcgaaatttcacccccccccccctcaaaaaacggacactaaattttttttataaataatgctaatatgtgccaggaagccatttccatgttgggcaacaacgcgttcagcgtgcacgtgttccgtgacggaatgagcagggcaccaatcatcgagtttccatgtgtgcgcgattccatgtatgtttcattttgtttaattttccaaaatggtatccaattgtggatttttggaaaaatttagcgtaattttttggtaaatttggatgactaattgtgagatcttggagaggaaaaatcgaaaattttagcaaaaaaacccaatttttcatttttctcgattatttccccccccctttttttacagtgaatgtttgcgctgggtccaacagaatcggacatttgtgcagcttaaacaaatttttgaggagaccagcaagtaaaaaaaaattttattaattttttcaaaaattttccaattagttacgcctgtctgcaacgcattgacgcccatttggagggcacctatttgtatttgcgctttgtcgcctcaaccggcgatgcgatgggcaaaaagatggtgaaccttttttgtcaatttttcttcgaaagttgggacctgca

SEQ ID NO: 11634 - DNA, 1607 bp, Heterodera glycines
tagcaatttgttcgtgaaaaacttaaaaaatcgcccggcgcagaataccctctccaagcgacatttctgggaaagtccctgtgttacacccccgacggtgttttccactcatgtaaatagatcaccttatttttttggggggggggggagggggtcccatttgtgtgggctttatcttttccctaatcggtcccgtttgatggcaaaaaaaaaaattttataattttttcaaacgttgttcagttaaaactttcgaacttattttgttataaattgttggtcttaacatttccttggtggctcagttggttaaaagcaatgcaacttacgcttttcttgtgtaagttcgagcacccgctgctgcgtgtgtgtgtcttaaatttgttgttgcaacgggggaaatgacgaaactgaatccattcgttgagaacggcgttcaaagattaaacagcgattcatgcaatcccgaagttaacgaccgatcccctcgagcaaaaaacattttttcttttttcaagtctttttgactaaaaaaacaatttaattttttggagaatcgcttcgcttaacttttgacaccgaattttttaaacttagaaatttctccaaaaggttcttaaaaaacttttttaaaaaaagatttcatgaaatcttttaaaagttcgaaaaaattgctagaaatttttcaaaatttgtatgccattagatgttgggctgtcgtcgtgccggactgaggccgggacagaatgcggagcgttttgcgcgtttggtgtgcggggcagtgctggccggtgagctgtcattgttggcctcacagtgcacggagggcgacctggagaagagccatctgaggttgaacaggtcagagtttataactgtgtctatttgaaaaatcttccgaaagtatggcctaaaatcgcttaatttttttaaaaatcactcaaaatcgcaaattttggtaatttttaaattttttcttgaaatttcattaaaaattattggaatgggggaaatatggtggacctgtactatatgggtacaccccaaaatctcgccgccgaaatttgaaattttttttcaaacagaaattttttcatggaaaaaagtttagaaaattttttataagaaaatttcaagaaaaaaaaattatttgttgagtttttttgaacattttttgaaaaaactaatttacttttgtactacttggtcatttggcatccttatttttttgcagatcaagcagaagtttggcgttaaacttggccagtggttctggccgaagcaacggcaactcgccacagcacagtggcggtggtggtggtactgctgctggtactgctccgctaccgtacgccccctcctcaccgtaccgttgttgttcatcctcatcatcaccacatcactcttccaccacaacaaataatcatcactaccatcatcatcaccattattgctgcactgccggaggtggcagtggcagtcccgatgcgcgacattccggaacacttaccactgttgccttcttccccacaagtatgcaagagggaacacaccggcggaagcaggacctcccccccctcccctccccccacgtaataatatttttg

SEQ ID NO: 11635 - DNA, 1506 bp, Heterodera glycines
  misc_feature (75)..(75): n is a, c, g, or t
ttgctgttgcaaatgagtaggacttggatttttaaagggcaaaaaacccaaaaataggcacctaaaaaatatttntagattaaaaattcttgccaagaatctgaatttttgagaaaaattttttcatttcttaggagtgtatttttgaaaatttttgcgtcgatttttagggggtgtgtttcccgtttttattgcatttttattgggaaatttttcaaaaaatgtcaaaatagtgacaaaacgccaaagtagtgaattttcactattttagttacaaagcgccaaaatagtgatttctagtgaccgatagtgagatccaaatcgaaaaatttcaacgcaaaaatgcgttttttgagctcctttcttcaaaacaaattgagcaaaaaaattagttaaatcactaaaaatcgcagccctactcattacaaagtcatttcgctcaacaaaaattagcgtcatcagcttctccaatgccaaaccccaactaattaatggagcattggcaaaacattgcccccctccgggcgttttttcatatgaaaacaggtgtgccaccttttatggcattttggtgccaccgcttggcacacagggtgcctatttacgagaatggcaccattatggacgaatttttcgacttatttaaatcacaagacctaacacaaaaataaatatgccaacaaaatggcttctatatatattttttgtactctcgaataaattggttggcatttaaatgggtgagggagggaaggcattttgaatgtcgattttggcctcaggccggattttggctcccggaaaatgcgtaaatgttctctatttgcttgttagatttcgaaaaattttgcttagtttaaaaaaagttatggccaacaaaaaaaaaataataatcaaaaactggttcttccgatttttttgaaattcaatgaaattttttgaaatttagcaggcaaatactcagggctatggaatgatatttagttcattcagttcagtcaactaaggaatgagttatgttactcccgggttttgctaccttcacctcacaaaattttaaaaattcattagggctaggactaggcttgctttgtgacctgggctctctgatcagtgagtgaccttgaaaccccaaaatatgaattttttaaatctttcggggggggggtggcaaaacccggaagtaccggagttatacccaaaaactggaaacttcgaaaatctaatttggcattaaaattcctaatcatgaaaccctcagtttttaatgcatcaaaaaatatgcaagaaaattcagcggaccctcaaaaacatttttttagacttattaaagtaataattgtgccaacaaaatggcttctatatatttttttttgcctttttgaactcattatgtaagtgcccaaaaatttttagttcactaatcgccattctgtgattacggtggattaatgtttcatggccgttaaagggcagattttttttaattttgtttttagacctgca

SEQ ID NO: 11636 - DNA, 2704 bp, Heterodera glycines
agtgaggggaggaaaagtggggacagtgaaagagaagggagggcaaaaaggagcagccgaagcagtagcagaacggagcgacaccgacgacgacggtcatccgccgggtcgtcgaggcggagacggtcacgcgaccgaagtcgagagacaacgacgacgacggacaagggcaaagaggaggagagcagagcgcgtaaaaacgtgggttaccatcagcaaaatacctattttgttggacctgttattgaccgggttctatttttgtttcgtttttttaaataggaaaattctggaatgacaatcaaaaaaaaaatccataaagtacgcaattttttcaattgtaatgcaaccgcggtgttcatttgagatcaattcgtttctcaccccctcgacccaaaaaatcagaattttcattttattttgtagggttccgctagttccgccacccaatcgcaagcggcgccaccgaagaagctgactgctgaagagttggaggaacggcgacgcgccatgttgacaaatgcctcatggcgagacgatatgcgtgagcggaatctgcgcgatgcggccgacaaattgagaaaggaacaggacgagatggccaataaccgaggtggcgccggatttatgcggttggttgaccggcacactgactatataccagggaatgggagataatcgccaaaaaagtcgcaaatgattcgtgatgttgcccgccgatgttcaatcctaatttaattgtatagttaaaaaaatattgtaaatctatacaatttggagcatttccagattttttgtcgggaaatttttgcgttacaattttataaattgcatctggcaaaaaaaatatttagtgaatatgtattcattttgtttattaagtccaatgatgaacaccgcaactgaagacgcgtccattgagaaacgcttacaaagcaatcggatgaacattcaacgccaacatgatcacatggacaagtcattcgtcagaaaatgatatgattgccattgccgatttcgacacacttgtttttatttttaatgaatttttttacccatttctttctcctctttttgaaaattactgaaagttttaaattcacaattataaatgttttttcttgtttattgttcttctgtaaaattgttttttgctttgttttgtcgcgtcagaccacatcagttgcttatccgaaatggacgaagtaagtaatttattttttcgcaaaactatttagcgaatttatatgagaaattaatagaattttgcgtcgtacgtactttgacaaccccctcatcaaaaaattgctctaaaatgaaaggaatgacgtatccataatttgcgccccctaaaatccctggacatggcattttacacgacacttaaaaatcattttatcgtttgaaaaactgcgaggagataaagcacagtattaccaaattttgtttcaggaatcttctacaccaccactggaaacagataatggacagtgcgaaatgtgtgcaaattatgaagtgtgtactgcttcatctgcgccttcaatgaataacatttttttggttgctttttaggtgtctcttcaaacattgcaaaccgcgcaagacacactccgggtaaacaaattagtgttttgtcaattctcatgagataaacttttatttagaactaacaattgatatcatgaatatgaatggggtttttagtggcaaaaaattacaaataattaacaaaaatttgaagaatttctaagtgattatgtaattttacgtttttttcaggaacaattggcagcagcaaaaggtttttgctattcgtttaatagttccccttttcaaatgtttctaaatttccccccccccccccgtagaattgtacgaaaaatatgggaaggaattgtcggaagagcggctctatcgtaaagaattggaaggccgttttgctgcacttaacgatgaaattgaacagaaaattcaggcaaacttgtgctttttaaaaaatatttttatttgttgttttttttgtcacagatttttatggacagtgtgaatcggtcagaagaacgggttgcattgttggccaagaaacaggagaccgacttggccgacatgggccacgaattggacgtggccaaggagcagcaaacagcactgcagacggagttgaagacgctctacgaaaagtgggacaaaaattttaaaaaatgcggacaaaatttgtgtcataaaaaacccactcttttaggtatcaacgaatgttgcacaaaaatgcacaaaaggcggacgaaatgcgtgaacagtgcattgatttgccccaaactgttgacgaactgacactgttggcactgcaattgcgcgaagatttggtgagtgagtgagtgtatgtcagtataggatgcactatgcttccccccctgccttttgaaacaattttaaatgttttatggaaaaattttaaaaaaatctttaaaaattccaacaattttttgtaatttctaaatttattgaaaattttctaaaaattctcattctatgcatgcccttcagatcagcgagaaagcgagtcgagaacacgagtgccaagagttgcgtgacgagttgaccgttgcccgtgaacaaatgcttgaaagtgaacagcagttgctcatctacgcccagcatgcacaacagcaacaagaccacatggagcagttgctgcaccaacacc

SEQ ID NO: 11637 - DNA, 1347 bp, Heterodera glycines
aagaatgggaaggccgtttgctgcactaagcgatgaaatgaccagaaaatccaggcaaaattgtgcccttttaaaatattttatatttgttgttgttttttttgtcccagatttttatggacaatgtgaatcggtcagaagaacgggttgcattgttggccaagaaacaggagaccgacttggccgacatgggccacgaattggacgtggccatggagcagcaaacagcactgcagaccgagttgaagacgctctacgaaaagtgggacaaaaatttttaaaaatgcggacaaaatttgtgtcataaaaaacccactcttttaggtatcaacgaatgttgcacaaaaatgcacaaaaggcggacgaaatgcgtgaacagtgcattgatttgccccaaactgttgacgaactgacactgttggcactgcaattgcgcgaagatttggtgagtgagtgtatgtattaaaaattctcattctatgcatgcccttcagatcagcgagaaagcgagtcgagaacacgagtgccaagagttgcgtgacgagttgaccgttgcccgtgaacaaatgcttgaaagtgaacagcagttgctcatctacgcccagcatgcacaacagcagcaagaccacatggagcagttgctgcaccaacaccgaatcagcgtgggcgaggagggcggcggcgccgccggtggtgaaactggtggaaacagtggtggcagccgaagacaacgagcaggaggacaaccggacatggtcatcatttcttttggacaaaagactgacattgggcacatttttaaccaaccatgcaactcaagcccctctttcgagaatgggcaaattccctcttttgaggccctttaaacaaaatttcgagaaaatttctaaatttaaaattctaattttgtttagcatccatcaaacgctgttgtccgttctccgcgagagcagcgacgacagcaacaacaacaaactccaacagttgtggaagttggcgatgccgactgctgttgtccggatgcgaaatgccacgaacagactgttgagcttgaacgtcgactgcaccggtcgatgaatgaacgggcgcaactgcaggaactgttgattgaacagcggaacaaatgcagccaaatgcagtccgagttggacacttcggaagcagtacagaaaggtaggtactgtttgtggtggtgcactttcccatctgatagttgggcacaaaaaatggtctattttttgtacagattttgtgcgcctcagccaaaacttgcaaatggaattggagaaaattcgacaatccgaatgtgaggtctgccaacgtttgaccgtaaaattgccacaaaaa

SEQ ID NO: 11638 - DNA, 5611 bp, Heterodera glycines
atttgcgcaaccatcggacaaagcaggagaagaatttggacgaaattgacaaactgaaggtgtgttgcgttgttttgtggacatttttaggggagttaaaaaaatctttttgtaaattgtaatttaaattataatttagaggagagaaatgcgttgccaatatttttttataaccatttaattttttagaatccttaatattggcacagggaagggcggcttgtatgttcagattagcaacaatttaaaaaaaatgattttatttttcccactctttgggcggggggggggggggggggtcgaacgcagaaaaattgcaaatttaacagtttgattcgctgtcatgacgaaccaccacccctctgacccctctaagattttacctggagaaaatcctgcaaatgctagcaatttgttgagaaaaattaatacaattcaacaaaaatgctccaaatttttcattagcataggcttgcttgggcctaggtaaattttcgtttaaatatttaatatggagagagaaatgcatgcggatattttatttaacgagtcatttaattgtttcatttgttgagaaattttgtataaattcaaaaaatgcttcagcaatacctgaagatggcggatttacgcacttgaaaaatcacagaaaaaacgcattttaaattttggggctttctcctttcaataaaattgctccatattttatttcatccatttttttgtttcagcaaaaaattgacagcggcgagttggccaagccggaacagacgcagttggacaaattggcacgacggggcgagttggagcgtgacattgagcagctgaacgaacagttggccaaattatgacgacgacgacaaaaaaaaaacaaaataaaaaatatcactaaaattggatattttgttgtttttcgctgtttttacggaaggcctttctttttccaatttttggaaaaatttgtataatgtaaaaattttcaatttgaaaacctctcattttaagtatatgccaaaaggagaaatgttacagtttttaatgcgatttgtaacagattatcctaaaatgaaccaaacttttgaaattttgagccaattttttaaaagtaggcgcaacggggaaggaatttgggtttttaatgatttgatttagctaaattttttagaaattttcctcttcaccggcaccccctccccactgtttatcttcttctacctctctctgctgttcttttccattcgtttttcatcaataccaaaaagacaacacaatttcttattttttgaaaaattagaaattcgttgaaaaattttattttacaaaacccaaatttacttgggtgaaaaattccccccccccccccccctcgtccattctttttcttttacgccgtcaatgagcagaattgttgtctaaaaatgactatggcatttgtatttttatctgctatttttcattgtttttattttgtacaataaaaacaaattaaataatttgcaaattattgaaaattatttaataaaaaaagtaattttttcttaaataaagaaaaaaatatttaaaattagatttttgtcgtggaaatgcagaattcaaaatgttaataattaaacattaatgatttttaaaaaaagatggaaagggagggagagaaaaagagagtgagagtggctgatagagaaaaagcggagaacatgagaagataagagaaaaagagagagaaaatgggcaacagagaaaggggagtggcgagagagagagagagaaaaaaggtctatcagggggcaaaggaaaagatagagagagagaaagacaagttataaaagaataaaggggtagcagaaagagaaggaaatagtgtgaaggaataagaggagacaaaaatagagagacaccagaaatggttaaagagtggagtgaagcggatggttagagagagaaaatgaagggattaacgagggagggggagagaaaaaaggcattgtgactcattgccattcgctcattcacttcaccacaattttcactcgcctctgaccgaccgcagtagatgaacatcctttcaaaagcacaccaattctctcctttcttaaatatttacccattttccactctcaatacatttgatggcacttttatgtataactacatacatatattatgcttcttattctttaaatggcatttttaaaaccaaagctcttacatttttttgatgataccattacacccttaagaaaatgaaatttttgtttataattcatagagctttaaagagaattgaatgggcttcaaaatgagtataaaaagattaaaatcggttttctggtttatgagatattagaaattttaaactggtgcaagacttatttgtcaccctgtatttgaatttttttaaaacttttccaaatgctcatttccaaggacgtccttggcatccaaggacgaatgggagcctgcagtatttttgacgaaaattttcaattttacttattgatatcccctccaaaactcccctcacccaatttcccaaaaaattctttacattttccaaaaacagttgaaaattgttaaaaaatggtaaaatttcaaaaatttccccagcagcgcctgtcggcaccgccggaatcctcctgctccccaaaaattaacaaaaaaaagcgtgtcgcagaaaaggagtgaaaagcaaaaaaaaaaaaaaggtcgtccgtcaccagtggcggtgccccctcgaagccctaggccgaaattccctgggcggtcagtagggctgggaatttaagtcaaataatttttttttgttgcctttaaatgaccttaaaatgactcaaaagtgttctacactttgtttgaagcttcttcattttttggtgactttttttttgacttttttaaactttttgggttttttatgattgaagaaaattccgaaaaatgagtctatcttcgggaagttactgaaatttcttataccattaggattcaaataaagggattgaaaaataaaataaaaatctggcggtgtaacaattttgaaatatttttatttcgctaaaactaattggttttaaattacttttttgtgttactttttggctatttttccatttgtgccatccctttttccctccaattgttcccattgtgtcgtctctatttttccccttcggggggtttaattacccaagtttgagcctaatgataaattggattatttctgcgcactgctccttgggtctttatttcaacaacttgctctgaatactctgatatcctctcgccccgacccccaacaaaaaaccatttagtaataggtaaaatctttcctaaactgttaagcttttaaatgatataatatgcgaaaaaaatacctatatttatttttacaattttagcaaaaaaaattctctaaaatggctaatttcttcatcattccccgtcgaaaaacaattcaacttttattgtttattattttatttaaaataacgcttcaacaaggtgatttaattttttgtttttggcattatcatttttatcatatgacattctgtaaaattctttacaaataaaacaccaaattttttgcttaaactttgacgaaatttttaaaaataattttattgaaaataaaaaaaatccaaagaaaactaaagaaaaaaataaaatggtttttttaaagacaaattttcttttatttcaaaagtttatttgatttctattttagactcgctcattgaaactaaacaattggttgaccaagcaaaaagtttgtttaaccaagtaaacgagggaaaatttgatgccgattcgtccattgaatggatacagaaaaatgcgattggcattttgtctaatagcgaatttgaatcaaaaatggatgaaagtttgaaaaaattgcaaaatgaattctgtgattcattggaaaatggcaattatcaaaaaatgatgaaaatatttcaaacgacaaaaattgagaaaaaaacatttgacaaaaggcaaatggacaaagccatagcaaaagatcaaattaacaagggcaaaaacaagcaaatgtttaaacaactatttaacaattctagcaagattcttgaaattcatgaagatttaattgaaggtaaataataattaaaattttaaatataaaaaaaatccaatttatcgtactcaattgtttcgtaaatcaaaattcgttgaatatttggcacaaagtgtcaattataagttaaaattgaaaaattcaaatattacgcttaggtaaaatggctaaaaaattcaaagatgttcaaattttttgttttcagcagaaaggcttgccgtgcgccaacaacaaatgccaaacggttttatgggcagaagaaaaaagcgtgcccgcgacagtgcaattaagggctgtgtcactgcagtgcttttaacattaatctctgctccatatttgggttattattctaacaaatatgccaacgagggcaatgtcatggttcaagtcaatagatgtaaaaagaggtttaatgtccgacattgttaccaagtccagcagtcggttgtcacgcagatttttgagtggacaattctattagccattggactaatctgtgcactgatattttgttcttgtgtccgttgatcatctaattattgtatgattacaattacggtacatatgactttggcaattggtttttgttttttttttgctaaatttttatggctataagtttttttacaaaaattttaaacatcaaaaagatatgatcaaaattatatttagacttttcattttcagattttttttcatagcgaaaaacaaaagtttatataatttacaaaatttcattttccgaattgaaacatttgtttaaggatttctctattctgtgcttcttctttatcaatctccatttatcacaggcttttatcttttccctcttttatctgaaatcctttttattttcattaaaaaattcggtggttactcgtcaataatagggttgctccccgacccctctgggggcaaaatgtcgggggccgggaaccttcggggggcacaagtcgggggtcggggacctcgatcgagtagtgatcaacaaaattttttaacgaaaaaactaatttttctttttaaatgctcgtaaatcttcccttttttctctttaattttctgattcaaattcattcgttcgcgccattaaaagtgcgtccgatttggcattttataataaggcatcctaggcaggggtgggcgaagctcggcttagtactcgaagccgaagctcgaatcgaagcccaacttttttcgaagcacgaagctcgaagttcgaagcccaaaaaacgcgaagttttcgaagctctaagcacgaagtttttgaaaaaatgattttaccctaacaaaactttttttcaaaaaattttcgtgttcactaaaaattaattaaactataatttaaaaaattataatttatgcttttcctaataatttttcattttttgattttgattatggctaccaactgaaaattttcaaaatcatcatttggccggtaaaaaatcagcattttggtaaattttattccaggtttaaaaactcaataaaacgtttttgcggcgcgctttt

SEQ ID NO: 11639 - DNA, 1970 bp, Heterodera glycines
  misc_feature (45)..(45): n is a, c, g, or t
  misc_feature (52)..(52): n is a, c, g, or t
atctcaatgttatcactataatacgttggtatgaaatgaccaaantacgggntaaggaaacgtgtaaaggaaatggtggtaaggaaacggttggtaaggaaacgtttggtaaggaaacggtggtaaggaaacggtggtaaggaaacggtggtaaggaaatgagtcgatcccttcaaaaagggttttagaacggtacacctcagttgggccccggcacccataacttttttctttgtcagtcaaatctaacaattttggtatcattcgagagccctcagatgctctattaacctgcaaaaatccaaaaaatttcgtcaattttgaacaaatttattgccaaaaaagttggaaaatctggttttttgaattcttttggccataaccggtccttatggatgcatttttattgcatttttggtaggaaattttttgaaaaatgccgtaataggggcggaattccaaagtgccaaaatagggattcctagggacagatagggctttaaagggaagaattttcgcgctaaatatgtattattcgtttttttctcattgaattaagccgaagaaaaaataaataaaacctaagaatacgtttcctaatgatgatgacctttaattttcaaaataaaaatgggaaaaattttttgaaaaaatataccaattctaaaaaatttatcaaaaatttcaaaattagactcaaaaatcgcaacttttaaaaatttgttaaaagtcggccataaattcgataatttttccggtgcgcttaaccctacccttccgaaaattttggaaaatcctggcgaaaaaagaagagactgaagagcaaaaaataaaaaggtcttcgcacctttgttcgatttaggtttgagaccgaagtctgagactcttttgagggataaaccatcatgacattattattatctttcaaaaatgataaatataatctttttacaaaattacgatacaaaaataaatatatatatttttttggtatttttaatgcattttggcattgatcaaattctttgccatctttctttacatcataatcaatcttctttctcattcttccttctccagccatgctcagaaaatagctaaaattttgtttttaatattttgaattatttagaatatatatatatatattttggaaaataaatgcttaaaagcatggaacatgaacaaaagtaaaaaaagcaaataattttgcttaaaatgttttagttccgaaatttttagaattaagggaaattttaaaattttcaagttaatgaggccatcccccactgaatttcgcataattgccatgtttttcgcggcattcttttaccggcattgtggtggccccgcattgtcagcagcagcacagcgttgccaatgatgacaatgatcagtttggcactggcggtgccaatggccgtcatcggcatggcgccggtggcaccattgatcggcatgctctcgatgtgaatgttcaacgtggtagggctcttctccaacttcttcaattcagtgttgctgttgcagctgtcacgatcattgcattttttgcattcccatctgctgcctgttttgtccgcgcaaatccccttgaattcatcaatgcagtcgtttgccttattacgacatccggtgatacggaaccgatcggcaccatccgctgtgattaatgcaaaattaatttttagttttatttatttttgaaattttctaccgtattttttacaatagaagaggcctgtggcctcctctgctgcctaccccaactacccagccgtccaaaaaaaattgtgaaattttcccaagaaaaaaaggtgctaggtcgtttcgtaaaaaaactgcctccgtcataattcgtaaacacaaccaaattaaataatcttgatatcatacgatagcttttggcttgtcctgtaatgcataaaaatttcagaaattttcattttagttttctgaaagttctgacc

SEQ ID NO: 11640 - DNA, 2357 bp, Heterodera glycines
aattaccgtacgacagatggacaaccgtgccaaggatgagcagttggagaacgattgaggcgacagtggtggccattgatgagatcggatgagtgggacggaagggattgaggaggattagaagaatgaacaagagaattagctaaatatttttaaatggaacatgaacacatcagttggatgattgggcccaattatgaccgtaatttgccaaattacggtagtcctacaaaaaacatttgaaggaacatctcagaaatgtatttttaaaaaaccgtttatttcgaatataatttatttcaaaaattttctgttttccaaaaagtctttttagatttactcaagagttagtgttgggactgggccgggaactccaggcgctacgaaaaatccaagcccagtctcggcttttctggtcataattttactaaatgtcgagtagtttatggtacgtggtctgcaaaatgattgcttggaactgatttctgggggcccatcaacggctatttatgcggccattttgggggcggagttttcgctgctaacgccgacaatccgtccgcccatcgttcgttcgtccgtccgttagccgaaggtccgccccaattgcccagcagcagaaattggctttagcattgtgccaaaagtggtgaatcattcattcattttgcccattttgtccatttttccaccaatttttgtacacttccgcccattcgctgctcattttgttagcatcgtttttctgttttcacagtttttctgctgttaatgatgattcattcatcatccaaccacataatttgtccatcaaaagcagtgaaaacgtaaaaaattaactgttctttcccaacgataaacggaaatggcagcaaaaaatgaaaaagaaaaagcgaataaattaacaaaacgaatttataaaaataatttaaataaatgatgatttatggtaatgggtataaaattgtgaaataattttaaccaattggacattaaaaaacgaattttgtatgtaaaaacaatgttaaacaaataaatattttaaatataatccagacataccgtaaatccgctatttgaatgcccctctctggtagaatgccccctccaattaaatgccctatttcggaaatccaacaatacaatgcccctctctggtagaatgcccctctccaataaaatgcccccctccaggagggatcgagtatatccgcagggattctggggctttgtcgatgccgaaagcgaaatctgattacagattcgttatcaacaccctaaaatacctctaaaaagtatttttcagctaaatttgggtgaaaaaatttttcccactcagaaaccatgtggtcccccctttggtcccaaattcccaaatcaattttatttttctaatcttttccaaaaaaatagtagaaatatgaaataaatacagttctatagagcaaaaaattgcgggttttttgagtatattaattttcgaaaacatcctttaagaaccgagttctgattttttgtctgaaaattcgaatttttccagaatttctggaaaaaatttttcattttgatgatagaaatttaaaataaattcataaaattctccttatttttctctatttttaaagctttattgtacttaaattgatccactttgaaatgagttatgaattttcaaatacgagtccaaattcccgagggccaaaatgaaaaattttcgaaattttttaaaaattcaaaaatttgtaaaacgtaaaataatactcatattcatgctctgcactataaaaccggttagaaaaatggttttcacccctttttgactcgcaaaaaaaatttccgagatttgaggggttgaacaatacagtgcccctctctggtaaaataccccatccaaggtaaatgccataattataacaagttgaacaaaagaatgccaagacattttaaagccccaggaattcctaaaaaataattttaaaaattagaattcacttcctttcgattaagacttgaaaaaggccgctcatacgtggttcggaggggtgatttttcttaagtgtaatttatccctgatgagatgatatgattaatttgaacatgcatatgacaatatatgtgataaatcatatgccgcagattatcatacgatttaattgcacagtgcctacaactaaaccataattttattttaatgataagtgttttgattaagtttttacgtgttttccacttaaaatgcgttcataaaaatttttttaattgcctatttaatgcaggtgcgatttttttcttcctttttaagtgcctatttcgtgtaaggttgtgcctaaaaacgcatccctaaaacagcttttcca

SEQ ID NO: 11641 - DNA, 1687 bp, Heterodera glycines
  misc_feature (1662)..(1662): n is a, c, g, or t
cagtgctgggtccaggcggtccgggcgtttcagtgctgggtccaggcggtccgggtgtttcagtgctgggtccaggcggtccgggtgtttcagtgctgggtccaggcggtccgggcgtttcagtgctgggtccaggcggtccgggcgtttcagtgctgggtccaggcggtccgggtgtttcagtgctgggtccaggcggtccgggtgtttcagtgctgggtccaggcggtccgggtgtttcagtgctgggtcctggcggtccgggcgtttcagtgctgggtcctggcggtccgggcgtttcagtgctgggtccaggcggtccgggtgtttcagtgctgggttcaggcggtccaggtgtttcagtgctgggtccaggcggtccgggcgtttcagtgctcggagttcctggtccctcagatggtgttgatgtgcttgattcgggtccgggtgtttcagtgctgggtccaggcggtccgggcgtttcagtgctgggtccaggcggtccgggcgtttcactgctcggagtttctggctcctcagatggtgttgatgtgcttgattccggtcctggcgtcgatgttgatcctgttcctggcacttcatatggtgttgtcgtgtaacattctttgcatccacatggacaagttaccggaggacatgctaaattttcttttacattttatctttctgataaatttttaacccgttgttgttggcggaggataatagcctgttactattccaatgatggcaatacaaagaaaaagagacactaacttccaacccatcttcgatggaactaaaaaaaataattaattttatttttattaaataatttttaattcaaattatgattttttcttctctccgtcctgtttttatatacaaaattttatccttttaaatccgtctcccttctcccatttaccactgattaatcattgaaataaatggaattgaaaaagagttggcaaattcacgaaaaattcaagtgataatacatatgtccaaatggcaccactttgatgattaacgattgtcccttgggcgtcgcaaacattcgttttaaaatgtcagacgctaagccacgacaaattaaattgccattcttgagaagtttgagcattttgttatgacaaaggtttgtttggctattgcccccccccccccccctcaaaaacgctctgattcaaatgctttgggagtgtttaataacattttgtttttggctgaaggagacaatgtttctttctgtcactgtttgtaattggtagaagttgaatgtttgtcttaaaatgcacaaaaacaaaatgtctaaatataaaagatttttaaaattcctctctgaattctgtcattcgcgcagaaatttgactaaataaaaatattttgatttctatttagttttttacttttaaaagagcacaaaaaattaataatttttgtttttgtcaatttgaacagctaagctacagattagcataaaaaaatacaaagagatttttttgaaaaaagtcaaataaaaatttaaaatatatactatttgtgccatttttagagcccggtaaaaataatttgcgggagtccgaagtcttacgggagcgagaatcccgtaaaactgccgtcccgtaaaaattcctttatttatagcggggagtcccngggcgggagcgggagtaattcgaaa

SEQ ID NO: 11642 - DNA, 1260 bp, Heterodera glycines
cttttttatcgtttggaagttcttcacagcactgtcatcgcaatcagtggtaatatcccttcacaatagcgaccaaaccatcctggaaaatcaatgttttcgcttcatgaaatcgctttttcttacaattataaattgggttaaataaatatcatttgcataatgtcaaaatacgacgattttttaaatgtagctttttattgtataacaaacattacatattctcttataatcaaaaattgaaagaggggctgtccagcggattctcccatccccggaatttttctcgcgatgggccttaccttataagcgccagagcagtcgctagcgatggcattttccagtgaagtgccgtacatattttgatatgcctggcgaatgtcggccaagtcgacttcggagcgggtgacgacgaggcgaatctgtgaaaggtgcaaaaagctagcattttatataatttgtataaatttggagcattcgcttatccgttcgtccatttccttaccaaatcggtgtcgcgggtgccaatgccctaacaatgaaaaattaaagtaacaattgaaaattaataagtgccttcatcgaattgtggagaagctcagcgaaatatgaggcacggttgcgaatactcttcaccaaagccaaattggcatcacgaatgtcaccgcttaaaaaggaaaataaaatttaccaaaataaaatcccaaaaaactcgtagatgataacaagtgaaccgctcaatttgaactcacctaaactcgttgctaattgcctgttcaatggaatggccatgctgtcgttggtattcgtcaaagaccttcaaaacaacgggcgtcaaaaacaaaccaagacaaaaaacaccatgcgaagctgcgcaaagttctgcaccgccaaaatagagttgaaggcgatttcgtcggtgccgaggcgtgcctcaccggcgcgccacaatcgctgggcatcctaagaagggaagcaaagttcagtgaagggtcagtcagtcaacaaattgaaaaccaatttcttctaatttattaaaagccggcactttgtacttgataaggcatatttttattgcgataaagaaaagtttcggtacaattggaaaaatttgaattttggccagaagaaaagcattaaaataaaacgatgtttcgtaaaattactaggctattgaggcgaattgagaaacgaccaaaaatggaaaatcgaattataaaagcaaaaatttaaaaaaattcataaattaattactaagtg

SEQ ID NO: 11643 - DNA, 2761 bp, Heterodera glycines
gggagggggcttttccttccgccaaactccccccacccccgaggcaaaaaatagtttccatttgttttgttcgtgctctgccccaaccgatcggtgcctgcggcggacggacgacggatcaatggacgggcggccaacgccgccgagagaaatggccgacgcccgccgccgttgggcgggggctccgtgagttgcgtcaacaaaaaaaaattggcttcaaacaacggctcaaaaaccaaaacataaataaaaatgtggctcaaaggcattaaatattccgccggcaattcgaaatttatttgcccatttcattttcaaatgccgacatctgcctgcacttcaaatttctgaccatttggagaatggatttgcttttcttttatggatcttttctgactttttaatcacaattcttccatttgcggatgaatttatttgtttggcacttatttcagtttgggattagtagggcgccaatcccggattttattttttgggagcggatggagaatcccggaccagagcttttggccagtgtcctggcccaagatatttgccaaaacttttactgattttgtggaatttgctacctttggcatttaaacgggaattataaaatagatttttgattaagctcattaattaatttgtacagaataataacactgattaacaatcactccgtctgatcactgccaaactcagcgccgtcgttcatcgtcagatcgccgcgtgtgaatcgctgctacactgccatctgactttgtcccgcctcaacattttggcaattggcacccccaattaatcactttgtgccaacggatggtgccgccccgtcctcccttttggtggtgccattccgctctccttttcctccttctgctccatttttcttcatcgttcaccaaaacgcatgggaacaatggcattgtgccaacaacagaaggcgatgatggcattggcattttggagttgcatcatttgctggacattggccaaccgttgggcatcgttttggccacttggccaaatcagtcgttatctcgcgcgccgactgacattggcatgcaggcggcgatgcgcagcctaaggcgcatggaaagggaaacactgctgctgatcagtagtggcataggcggaatggcaccgatcggaagcggcagaaggcggagaaaggtcaaaagtgagtagagggggagagaaagagagggagaaagagtgcgcgagagagagagagaggtatagagagaaacagagagagagagagaaataaagaaatagagagagagagagatgagaggagggaatgaccagcagaaaaatgagaaaagcatcaatggcaaagtagtgtgtttgttatcaacggagccaatcagacaatgagagagtgcccttttgccagaattgagggccgccgcccctcaggggcggaacattatggtgctggaggcgacaagcccaaacgccaccaacgggggccgctgcatcatcagcgcggaccaagcggtgcacttctgcggatttgaggaggaaggttgggaacagagtgttctttgctctttgttcgtgccgtgccgtgacttgcgctttttttaaattttgttgtgccatcgaccaacacatcactgatccttttgttttggtgtctttggtgtcattattgatcagttaggctttttcttcccgatgactcatcaacgaaaatctcgagcagtaattagcaaaatgaatgagaaatatatgatggaagtaagcaaaacagctatggtattcgggacataaaatttttattaataagtttgacattgcactttcctaatttggccttttccatcgagtggtaattaattagcagttaattgtccttcccacaatccgtgataattttcaatatatgtttggatgtttttgctgtgaattttaatcacattgacattaaacagaagcaggatcaaattgtgcctaatttcagttaatgagccgccaattccgccgcctttcgacggaatttgcatgcaaagtgcgcgaagcgggcgagtgatctgttacccgaaatacgaagttggtggccttgatcagacaaactgatcagtgtattgccttgggcatatcctttatcattgatctcatctgactcggtctaaaaatttaatcaaatttcgggacttggacaccacttgtacggacgcagcttcgatcaacgaacgctcgggacttgtggcaccgccggtgattgcgcatgccaagtgatcggaagagaaatattttttgatcgcattgatcatcactttcagtgttcgaacgatggcatttgtgccgcccgataatttgcagagattgattcgacattactaccgaagatacggaaaaaaagcgtacccaaaaaacgagacggacaaaatcgccatgtaataataattaattcaattaatcgagactattcaaaaagcattctatttttgtcctaacaaaattttgagtagttgactcaaaattctacggtattccattttcggaaattatcaacttaattaatcaccagaaaataattttgaatcgaacttctcggtgaagaacacggccctttctgttcgtgaagtacggctgcgacgcgggctacgaaatggtggacgaggcggacacaatgttttgccgcaagggccaatgggtgcaaacggcacccatctgccggggccaaggcctttgcgaaatggacaacggcggctgctcccactcgtgcatttcattctcacacaatgca

SEQ ID NO: 11644 - DNA, 1388 bp, Heterodera glycines
  misc_feature (78)..(78): n is a, c, g, or t
  misc_feature (83)..(83): n is a, c, g, or t
  misc_feature (111)..(111): n is a, c, g, or t
  misc_feature (131)..(134): n is a, c, g, or t
  misc_feature (187)..(187): n is a, c, g, or t
  misc_feature (218)..(218): n is a, c, g, or t
  misc_feature (221)..(221): n is a, c, g, or t
  misc_feature (225)..(227): n is a, c, g, or t
  misc_feature (230)..(230): n is a, c, g, or t
  misc_feature (233)..(233): n is a, c, g, or t
  misc_feature (249)..(249): n is a, c, g, or t
  misc_feature (265)..(267): n is a, c, g, or t
  misc_feature (276)..(276): n is a, c, g, or t
  misc_feature (304)..(306): n is a, c, g, or t
  misc_feature (308)..(309): n is a, c, g, or t
  misc_feature (312)..(312): n is a, c, g, or t
  misc_feature (316)..(316): n is a, c, g, or t
  misc_feature (318)..(318): n is a, c, g, or t
  misc_feature (322)..(322): n is a, c, g, or t
  misc_feature (325)..(325): n is a, c, g, or t
  misc_feature (342)..(343): n is a, c, g, or t
  misc_feature (347)..(347): n is a, c, g, or t
  misc_feature (354)..(355): n is a, c, g, or t
  misc_feature (358)..(358): n is a, c, g, or t
  misc_feature (361)..(361): n is a, c, g, or t
  misc_feature (367)..(367): n is a, c, g, or t
  misc_feature (373)..(375): n is a, c, g, or t
  misc_feature (378)..(378): n is a, c, g, or t
  misc_feature (383)..(383): n is a, c, g, or t
  misc_feature (386)..(386): n is a, c, g, or t
  misc_feature (391)..(391): n is a, c, g, or t
  misc_feature (399)..(400): n is a, c, g, or t
  misc_feature (405)..(405): n is a, c, g, or t
  misc_feature (408)..(410): n is a, c, g, or t
  misc_feature (415)..(415): n is a, c, g, or t
  misc_feature (418)..(418): n is a, c, g, or t
  misc_feature (420)..(420): n is a, c, g, or t
  misc_feature (422)..(422): n is a, c, g, or t
  misc_feature (430)..(430): n is a, c, g, or t
  misc_feature (435)..(435): n is a, c, g, or t
  misc_feature (447)..(448): n is a, c, g, or t
  misc_feature (453)..(453): n is a, c, g, or t
  misc_feature (459)..(460): n is a, c, g, or t
ctctagagtccttaattaatcaccagaaaataattttgaatcgaactccttaatgaagaaacggccctttctggtcgngaagnacggccttgacgcgggcaacgaaagggnggacgaggcggacacaaggnnnngccgcaagggccaaggggagcaaacggcacccagcagccggggccaaggccanggcgaaaaggacaacggcggcggcacccacncgngcannncanacncacacaaggcaacggncagaacaaaggcaaannngggcggcancagaagaagccggcaaaaacacgccaannngnngancganangcancgnccaaaaccacgcgcaannaagncacaaannaancangcaaangaagcnnnaancagcnaanaacgngaaccaannaggcnaannnccaanaanangncaccaaanacggncgggacaagagnnaaggngcgaannagcaaaaagcaaaaccgaaggagcaacagcagaagaagcatttattacgggtgttttaaggtggagtgccgttgccccaaggggatggtattggagccggaccggaaaacgtgcttgaagccagtgccgaagaatctgtgccgaaaagtttgtaacaatcaaagggatcaatggcgatcaatttagctattaatttgattggggattgggactgatcacactgccccccccccattggttcggcatttgtcctcatcaatttcagctcgccggctgcacatgcgcatccattgatgatcatcaatattcttgcgcgtgtccctctccgactgatcgctgtcttttgatgcggggccaacccaaaatttacttgtcccctccgccggactatcaggtcaaaaacaagtgccattctactgacattggtccaagaaatttaaatagcataaaaaaccgaaaagcagaaaattaaatggtcgaaatggggggggggggggggaacggccccaaccgaagattgcggcctaaatagtcaattaaagtcactaattggactaggtggagcctggcggcaacttgaacatcagctgtgccgcggtagccttcccatttccgcaaatcttttgggagaagggcgccgacgcgccgcagacaaacggcgcaaatggcggcgccggcgccggattggtcaaaagtgagcaggtgctgatcatcaaagaggtgagcaacatttctgatcaccgatcaggcagaatgatcggtcgttctaatttcttgcagattggaagccatccattgcctgccggttctcggcacagcaaagcactaatagggtgtttgactcacttcaaaaaataattcattacccaaaagttttttacaaccacttattgccaatctaatgtcttgcagatttaaagccatccat

SEQ ID NO: 11645 - DNA, 1470 bp, Heterodera glycines
atcaaaagtgagccaccacaatgaaattagttaattgtgatgggataaaagatcaggtgatactgaaccgagaaagtctcaaattttcaggagtagggacagaatttggaatttcgaggattcgggatttttcgtttgacgatcagaggcggaaaaaagcctaaaaacgatgggaaattggcgacgaattcaagaagttttatttcaaagtgtacaaactcaatgatcaggctggccccacgagaatgtcagtgagccgcatcggctgcacacactgcgcggtctgtcccccgacacaacttacaccgtccgaatccgtgcccacgactcgatgggtcccggcaaactgtccaacccggtgtccgtccatacgcttccgcccgccaaacggccgcttctcgcaattccggaaggcaatgagttgcgcgtgccgccaaaagtgccatttgccatcaactgcaacctgagcaggggtgacccaatcccacaggtgggaatttgtggaggcgaggagggaaagaaataagaggcacataggacaaaagacacaaaatattgggggggggggacaaagtatcaaactgaaaaagacaaatgactcaaataatgtgtcacttgtccagatgcattgggagtccaacggacggccaattcgacctgcgcaagacagcaaacacattgcattgcaacacattgggctgttggtgagtagggcagccaatatgcaaaagcggacaattgatcaaataatggacaattgatcaaataatggaaaattgatcaactaatgacaattggactgaaattaactggcaaattgacgattccctttttagtcattttgattttttgtgtttagatgacaacagagtttcaatgtgtggcagagaatgaggcgggacgaacggtgcaaaaagtgttggttacggtcagtgagttactgtattgtatttgtgtaccatacgtaatatttgcgtttatttgaccaatgagtgcacagaaaatgtgtcatttttgtgcaggtgacaggcccatcccaacctgagcaaattcgttaccacgtggacggaataacggtcattttgcaatgggacgagccaaagtaagagcaaaaaaaaaaaatcccgaggtttggggtggggtcgagacgactcgagactctaattctcgaccgatctcggggaaaattttgtcgaaaaccgcaagattgccattaataaaggggctattgtcgggattttgactatactcggggcttcgagctaagagaggttacaaataagctgttatcttcctagtccataagaagtggtgatctgttcaatcactctcgagtgttttctccgcgtgatctcgaccaacccttttcccactccgtgtgctgattagcagcttttcgtatttgcacttaacgttttgttaaggatcaccaacggtccgatggccgactacgaagtgttttacactgat

SEQ ID NO: 11646 - DNA, 2237 bp, Heterodera glycines
  misc_feature (26)..(26): n is a, c, g, or t
  misc_feature (38)..(38): n is a, c, g, or t
  misc_feature (66)..(66): n is a, c, g, or t
  misc_feature (84)..(84): n is a, c, g, or t
  misc_feature (2167)..(2167): n is a, c, g, or t
  misc_feature (2223)..(2223): n is a, c, g, or t
aaagtaattgaagacggcttgacccncagtgtcctatntacactgttgttaatgtttgttgttatnttgtctattacatcgacncatcgtagagtgtctttctttgtaaaatatctgtacaaacgctcctttattgtccgatttgccctttcaacgactccggcgtgaagatcggggctatacatcacatttttgataataaatttttcctcaaaatattttttcatttttcctgcttggaattcaagcccactgtcactatatatcttcatcgggataattttcgacttttcgaaaacccgatcaaaagcctcgatcatgtcctcactcttctttgacttggctggtgcactaaagatcattcgactcagcacgtcgatgcagaccaataaatacttgtaaccgtcgttatgttttttcaattgatcaaatatgcataaatcacactgccaatcggtgtggaagccactcggtattgtctttagtctagggaaaaattctgtaaggcggaaaaaaagttctatagagcgaagtgaatgttgttattcctaataatagaaatattagatagtacgccaaaaggagacaaaaaattagagaaaaaaagataatgtttttctctggcactctctatttattggtacacatctcgttttttcggacggtgtgtataaatgcgaattttggatgaatttctgtttttgtgttctttttgctttctcattatttccaactctctctttttaagttacataacaacagagttttgcattgccttttgtgacacaccaatcaattggaaaaatggcaaattgagccacaaaaatgaatcgacggtaaggaattttttttaaattacaaaattttcatttacccatacatttttttacgaatctcagttggctttgtaacgacgtgtggatggacattctcccatcttttaaccgtcctcaactcggcctcaaaatggcattgctttccgaccgtttcgatgttttggttgacacgcattttgatggaaaaacggaattgacaatttggagacgtatcagaattgaaaaggacaaaggaccaaaagcgaaactgtctgttctgatcgatggcaaatttgtggattttccgatggcggaccattcgctgcccaacaaaatccgctttaaggaccttcggattgggtaaatcaaaaattatacagaaaccaattacttaatatggttggtcatcttcttcattatttcactttatcagttacattgaccattctgtactcacatttatccgttcaaacaagccaatttgggacagaatgaacaccaatttggagttgtctatatggtcaaacaaaactgaggatgatcagcgaatttgggatgttttggcctgtcaaatttggccaatttttgcgaaaagcattcgtcattttggctttcacgatggcgattatttggacaaattgcgtcgccgcatttcaccgacacttctcactgatcttgatcaattgatttcaatcgattctggacttctattacccgatggaattgctgatgataggccaaatgcaactgctggccaagcgttgtccaaatggttgcacactccgagcaaaaatggccaaccgaagcaattgcatcgcaataattattttggtccaccaaagctggaatgggtcaacaacttcaaagaggtgtgtctcgccagaatttccgtcaaattatttttgtgtttaccaattttttatttagacatttcgccatgccaccacttctgtcacttacaaaatttgttttggtgttttcttgtcgctaatcgagccatttgaattggtgaacgaacggaccaaagagaagctgacactgacgaagggtggagatggcactggtgaattcaattggctgttggagagatgcccaattattggggagacggcggcggcggttcagaaacagcagcagaagaaggacggaaattcggatgccaatttgaacaaagtgttcttccgtctttacgatgacattgggtgagcagaaaggaggcctttttgtataaaacacggatagggaacggtatcccatgtacagtactttcccagaatcttggcagggccatgggttctgttaagacagaacttcagtccttgttttgtcttttttgctctggtccatcccgnaaaactcctgctggtccgggtttttgcaataattacgggctgtactttcgaaaaangttatccgattcaa

SEQ ID NO: 11647 - DNA, 2134 bp, Heterodera glycines
tatttgtgggaatcacggataaatttgtgggcttttctttgccggaccgtccgctgcccaacaaaatccgctttgctgacattcggattaagtaattcaacacattttgtaacatttctgcctctatcgcattttgttattcctttttcaggtacattgatcactctgtgctcgcatttctccgttccaacaagcaaatttgggacagaattggcactaatttggaattgtttatatgggcaaacaaaacggaggatgatcacccaatttgggatgtttttgcccatgaaattttgccaatttttgcgaccaacattcgccagttgggctttaccagtggcgatgctttggacaatttgtgtcgccgcacttcaccgacaattctcactgatcttgatcaattgcattcgatcgatttcgctcttatgtgctccggcacgattgacaatcaaattctgtccaaatggttgcacacgccgagcaaagatggacaaccaaagcgattgcgtttccgtgcttatgtgggcccaccaaatctcgaatggctcaacaatttccgagaggtgatcactgatcagccatattttcattaaacgacgactaattgatttaattgtccttgattttgacgagcagacaacggaaaatccacaaaattgccaccaatcgatacattgccatcgattagtaaagacattttctgttctggtccattatcgtttgcttttggtacttcgtccttgccaattctgatcatcctccaaattaccaaattggatttgtatgtgcctttatatatgaccgaaacttgggatgtttttgcccgtcacatttggccaatttttgcgacaagcattcgccatttgagctttgccgatggcgatgatttggataatttgcgtcgtttggtttcccctacaattgcacactccgacaactgatggtcaaccgaagagattgtttgcagtgattatttgtatccaccaaaaattgattggatcaacaacttcaaagagtgtctcgccatttttctcaattgtttttgtttttcccaattttgttttgacatttctccgtgccacctcttcggccagttacactgttcgaattatttttcgtgtgaaaccaatgccaattgcgccatttgaattgatgaacgaagtgacaaatgagaagctgacactgattaagggtggagctttctgtgggaggcctgaaacgcacgaaaaacatgtttttagcttggtatgaagcttctaggaaggatttctatatccatatttttccatatttcgcgatttatgtccatatttccatattttggcatttggtccatattttatgtccatattttgcgaaaggatggagcttttcgttggctgttgaaacggtgcccaattgttggggagacggcggcggcggttcagaaacagcagaagaaatacgaaaaattggaccgtttgaacggagtctacttctgtctttacgatgccattttctcgactcccgggcacattgatcagcggaagaagaaaaagtgatcatttgagaaatcgccgaccattaatgatttttgataattgggttgattgatgctaattgtttgctctgaactcatatcacttttgtggtggacttttcaatgttactataactgaatttctagacaatcgtttctattgatactaaagaaatttcccaaccaaaaaaatcaacaatggtttatataattgaaacaaaagaattaacaaaagcatttctgagagaaaataagcacaacaaattgagatcgatcatttctcaaatagaattattcaattattcatttccgtacacttaatcagcagacgacatttccgttgcttttatccgctttatcttcttcttctttttcttctttcgttggtggcgacaatggcctaaaaatgtgtccacaagaaaaaacagttgaattgtgtaactgaccgaagtggtggcacggcgaaatgtctaaagaaaattggtaaaataaaaacgaaaatatggcggtccacctctttgaagttgtggagccattcgagatttggtggaaccacataagcacggaaacgtaattgcttcggttgaccattttttgtcggagtgtgcagccatt

SEQ ID NO: 11648 - DNA, 2006 bp, Heterodera glycines
accatcataaaagccgattcgacaggaatgggtcgttttcattggaaaccgtggcaatttgctcccatcaacggctttgccaacgacctgtgaagttcgcaccgcattggaatgccaaattgtgaattgtaaagttgctaatcaggcactggcacttagcaatttcactaatttgatgttggaaccgccggtgatgccattcgaaggggcagagagtgaaaaatggctgcaaatatttggtcaggctccctggattctagagaccatccgggccaagatcgtgcaccgtttgccgatgttggagacgccgcgggtcataatcggtgactttacggcccaacaacttaactccgaaatgacggacacagcgctggtgacttccgtggaggatggcctggcaggaattgtgcgccaatttgcaagcgtcattttgtcctcaaaagtgcgcgccgttctcgttgtgcttggccgtgacgcactgctctcaggggagacgatggacacaatcaccgaatatgtcaaacgcatcaaaggactgtgccttcgttaccaagacattcaaattgtatgggccatcccgccatatgtccacacccaaaaagtggcatatgatcagtttttggaggcacttttgacattgactgaaaattgtcccattcaaatggcctttgtgacgcgaaaaggacgttcattggccgaaattttccgttacggcggtactcacaatggataatacgtaaatcaaaccgggattttgactgacgcgggaatcaaggctgtccttatctggttgtataatgtggcaaatttcccgggagagcgagagatgggacgaaggcgttcagtgatcgggaatgtgccttcggggtctcataaccgtctaggcgacggtagtgggcgagaaaatgccgaaaatgaggtgcctgggcgttctgagtcgcgccctgggagttcaaccggccgccgttctttcatggccaatcatcaccgccgtaatgatgctgggtgcaaccgccacgaccggattccgatccgcgatcgagtttcggcgtctaggcgacgcccggaattcggaaattcgcgttcgaatatcgccgttagcactcaccgccaccgatacctgacgggtcagccgaatcgcagctttatgtgacttttaagcgtcggggcgccgctttctttgaggggcgggatgtgataattaatgttttattatttaaattttgacttgattctggcattctgtttatttttgtctttccccaaattttgtttcccatcttctaaaattttatgaattttggaatctctctcttctgataattttaattgtaattgtgcttttatttaaattggtcgtctcgtaaattgttggatttgatcaaaagtgtgaattggacgtgtttcccaaatttgaagcggtctttggattctctccagtttccatttttgaaaatcatactattatctattatcaaaagttttgcctttttattaaaatgcaatatataggaaagttcttccctaagaattgaaaactttctctaaatttcatttcctacatttatttattactgtctcaacaattataacatataattttttataatgagactttaattaaatcaaaatcttataattacgaatgaattctcctgaaatttcccgcgcaatgcttggttttacatctatctatctccaatacattctcatcaatacattaggtttttgtaattatgattgatactttactgatttgccttttcagcgattgacatgccgaatattaccgagagacccatcgatttgtttctgctggaatttgcgaccagttattcatgcaaccaatagttttcaacattttaactgagaaagcagcgcctatgatagactggcaaaaaatggtttgttgttttcctatggttttcaaaataatttcgatatacttaagtggaaataatgtagattgacccctcttactgtttcttatacccaagatgttgagg

SEQ ID NO: 11649 - DNA, 3298 bp, Heterodera glycines
cggggccaccccactgctgctcacttcgcaggtcgcctgtctgatcatgcaacaaaaatacgaggaggcagagaaattgctcttggtactacaacaacaacaacaacaaaaaaaacactgaattttaactcaaacttgtcgagaaatttcgcaaatttttagataagcccacaaaattagcaattttaaatttgttctaggaattttctaattaatagacaattgaaatttttccaacacgacagagtgcccaggagcgtgatccgaacaacgctgatgtgcttgtcggtctattcgtggttgcacaatttcttggcaaaccgatggaggtgagttgaacccaccttctaggaagggtgatcagaaaaaccaaagggctaatttaataaaggggtcaggcggaagttggtggatgggagagcaagcagttcaagcatttcatcaatatttcaataagcgatcgtttttttttttttgaaaaaactgtgataattaatgttttattatttaaattttgacttgattctggcattctgtttatttttgtctttccccaaattttgtttcccatcttctcagattttatgaattttggaatctctctcttctgctaattttaattgtaattgtgcttttatttaaattggtcgtctcataaattgttggatttgatcaaaagtgtgaattggacgtgtttcccaaatttgaagcggttttgaatccaagcaatttcccaaattgcctttctctccaatcccacaccgcaaatttattttgacatggcgctccctgaagctggtgagtgctagcggtttctttgggtttacttcgggtaaaagcaagttttgcgtgcaattgagctgcttatatttgggtttggaaaaattttaaaacaggtacagttcaatatctaggcgatattgttctgatttggtggcaaataaatatctaggcgatattattttgcattttgaactcacctcgacgcacatgcaacaaaacctactgccacatcggaattatttgactcgtagaagagcacaaacactgagagacgagggaaacatgctgaatttgtcagagatgagaaatctgctcgagccaatgccgcaaacgaccaaatcggcattcaacaaaacgcagaacggcgtgaaaattctcagtcgagacatgaaaataccggggatagagctgcacgcggggaacaacaaaaccgtggaaggaaccgagaacagcccaattttacagaaagaatggagtacgacgaaagcattgtcgacgacggagcggtgtcactcgtcggtgaagctgacgaaaacgaattgttgggcgtcagcgacgcacaccatgagcagaatgagcgggatttggcaggtttttaccattttccacggaacacaaatatgcaacagagcctagtcaggcagaaaagaactgtgggagacgaaaatagtggtcggcatgttaaccgcatgccaattttggaaaatttggaagcattcggtggccatgattttgagtactcttttcaacgccaccatagagaacaacagtccagacagagaccgaattttgaaggggactcaagggcttacccccctcctcctccttggtatgggtcctacccatggatgccaccgccatggttcaacgctgaaaaagcaccacccaaccaatgccaaaaccaaagggaagccaccgaaatgcaacaaagcgcttcccattcgacttataatcgactcgaagcaattcttatcttggataagctgcccgacatcaacggaagagagggctcggaccgaattcgagcattctttcgaaaattcgaaattggcaccgaaggctggaccaacgcagaaaaattaaaagcgttacaactaaaagtcacgggaaaggcggaaaggtctttgaatgccgcagtcgattttgagcgcactgcgtccaaaatagggatgcgtgaagtgaaattcgacctgattaaaaaggaaatgctacaaacgctggacgagttggatgcgcgcgagacctcagcttttgatgagctattcactggactgcaaagaaggtcgaacgagtcaattgaccaattggccgaccgcgttgggcgaacagttcaaagagcctatccaaatttgaactcaagagacatcgacgaattgtcgattaaacactttacgggccttagacagccatgagttggcattaacattggaagtgtctcgcagtccgtcgatgagctatgaccaatttgtgactttggcatcgcgagccgagtcaacaaaacgagcagtgcaaaaatcgatatcaaggcagcgccagtatgacaatcagaatgtgaaccgtagttcggttagcgcccattttccgcaaagtcgagcatctgttacgtgtttcaattgtgggaaagccggccacatttcaacattctgtactgaaccgagacagaataatcctttttcacgcgatgcgcgtaatcgagaccattttaatgcaggaatgcagacaaattcaaggacagcaaatgaaaaccgtgacagttggcaaaaccgtcagaattttccaccgagaacgggtggaaaccaacagccattaatgcatcaaactttcaaacgttcaccgaatcaatttggtggtaccaatgcagcaaattgcattcaaattgaggaaattccggcggagaataaatttactatcggaacaattggaacgaaagaggatgttcaaaactggctggaagagctgattttgctgaataaggaagagaagggggcgcaaaaaattgggaagctggtcgtgttggagctgttcatcaatggtgcaaagacttcggcaatgttagacggcggcgcgcaactttgccttatttctgccaattcgctttataagctcgtccgtgaagggactattcatctacataaagggaactataatagaacccttaaaacggcatacgactttaatggaaaaaagattaacaccttcggtgttgtcactctttcagtaaatcgagataaattagaaccggttgaaatcgagtttttcatcacatctgcatctttcggatttgatttgttaatcgggacgaatgcactcggtattttgggtttaaaattgtacgacgagaagaccgattcgataatagaattcgaatgcatacccgagaaagaaaagactgcgaagaatgaaatccgagtcgcatgtacaactgtactcgctccgagatcgatcacattagtgccgctcgaaatcaacaaagacattaaaaatgattttgttgtgacacccaatggacgaattg

SEQ ID NO: 11650 - DNA, 2770 bp, Heterodera glycines
  misc_feature (2763)..(2764): n is a, c, g, or t
tctctatctctgtctgtctctctctctctctctctgcctcccctctttctctccctctctatcaattcactctctccgtccctctctgtctcttacccacccaataaatcgcttccatcagcgaatgcgctcctttgaaagtgaatgtgtttgccaatttcttttttaaatatatgtctcattcggtttacctcagttcggccgtcacggttcggcccaagcgtgtttttccactataactttctataacttttttctttggcaaccaaatccaacatttttggtatcattcgaaagcttaacatgtttagaagctttttctaagctattgcttcgcgattagacaattaccaaaaaagttatacaagaaaattgcgaaaagccgaaattttttaagttttttcttaataaaattttttccaggcttgaaaaaattttcgctttttgtaaggctaatagagcatgttaagagctttcgaatgataccaagattattggatttggattacaaataaaaaagctatagtgaaaaaacacgttggggccgaacagtgagggccgaactgagcgagtccggtctcattacctccatttgtgatcaacaaacgcgtccgatgatgcgcttaattaaagggaaatggtgacggggtgtactgtatgaacgcaccaagcaattcgttttgtgggaaaaagctggtgatgttcaggtgaggcatgcgttcagaaagtccatcaatttgagaaggggaaaggccggggagcgaaagtttgggagaaatgcgccaaaaaattcggtagtcactgagaagtgcgaaagtgtccaacagagaacggataaactgaaccaagtaactccaatcacacactttctgtttcgcttggcttggccacctctgttggcattgtgccggtgtccatttgagtgccaaaagagcaaaggatgacgccctttccattggcttccattgagaaattccacggctttaaattgattggcttatttgaatgtgcccctaaattcagtttcatactgaaaaaagaggtcgaatggaatcgatgtgaactccgccgacgggcaacaaattattgggaaatgccgaagacggagcttcaaggaaagggtcagagttgacaaggaaaagacgtgccatccttctgagcttaaataaagaaacatcctttattgtggtcatttaattctgcacctcggcaactttgggaaatttgccacggaatttgcgattaatttcaaaatctgaagcgaacaaagcatcaattggggcatccaaatgacgaaatctcttcgataaaagttgggccagccacgggacggcactttgggcgaaagactcggagagcagagaaagagaacgagacagacgcagagtaaaggccttatttgttaggcaaatttcgaaaataaaccaatgataaaaccccgaaaatgctgaaggcattgccttccaaggccaactcgggcaaattccaaggcgcctttacaaattttccatgggaaatattgcgaaagtgttgaaaatgacgaacccccgaggcgaccaaagtctcttcggtgattccctcgaggtcgaacagcacaaaaggaatgcccacggagtgcaccaagcccatcttaacacatcgtcaaatatagccatttacagcctttatatggcctcaaaccaaacacgggtttcccgcgtagagaatggccaagtcgaagtcaccccgggccatcacttccatgagattgctgttcagcatctacataatgtggacttggctttccccacttttgccttcttccgtgcgcaccttcccacatgaatgattgtgtgccgcccaatacggcaccctcagggcattttccgcgtccgtttcttcgccccagggcacattttgtccgacatgcgccaggggttcggagagacgccttttgataagggaacagtgattaattagcacgtgtttttatgctctctgctgagtgtatggtgttgcttcagcggctcctttggtggttactgtatcattagtcattggacattttgcaattcttttttccctttgtccgtttttcaattcgattttccaatttattcacctcggcaacacatctttgagtactttctcattgaccatgtgcagaatgggctttacctaacaaaaaaaaaccgaaaatttaataattttcagggaaagggagggaaccaaatggcaaatgttcgctgtttttccccatttatcaaattggtcggagatttaaccattgaatttttaaatcccccgggcatttgtccggtgtttcatttcttccctttcctctgcttttttgtaccaatcgcggttcctccggcaccaaaatgggcttcaccgtcatcactttgtgagcccttcgcgcaaattcctgtgccataaactcaaaagtgtgacgttcgaactgattggtgccgatgagaaaaaagagaaaactgagcccatccgccgaaaaagagaaagacaaaagccaaaaaagggcaacggaaacaccgccggaggaaaacatgggaaaatggagggaaaaccaaattaaacaatttatatggacgaactttgggtgcgcataatccaacttacaaaagaagcccaaccccacccaatctcgggggaaaatcggacggaccaacccatccatcgggagcaaacaaaaaattcgttgaggggccaaaactcgcgaaaaaggtcgatcagcgagaattaaattttactacaccaagcgattgaccnntgcagg

SEQ ID NO: 11651 - DNA, 2320 bp, Heterodera glycines
  misc_feature (43)..(43): n is a, c, g, or t
  misc_feature (49)..(49): n is a, c, g, or t
  misc_feature (1555)..(1555): n is a, c, g, or t
tcctctaaaacaattgaccgtcaaagcaatgattatctcaganataganaagattgccatgcggaaccatcagacgagcggcaagcgttgaacagaagtacacgttgcgcagcccaacctcgttgatgtcatcccaaaactccggttcgcattcccaaaactttttcccggcattttcaatcagactcttgaacgggagagggatttaatgactgtgcgggcaaatttagtgtcgaagaaactgacaggcactccggaataggcattgttcaccaaaatgtgcagtcggccgttctgttcctcctcaacgcgcttaaacaaacggcgaacgtcgtcagagttcgcgtggtcacaatacacaggatgagcttctcctccacgacttttgatttctaatttgacataaaacaccacaaaattcaatcagtgactcgcccttcgctgtttgttccaaagatggaagtcccttctcaatcagagagtacgaagcggcaggagctcgtccagtgacataaaccgtagcaccagcttgaccaagttgaagcgcaatccctcgtccaataccacgagaagcaccagtcacaactgcaattttaccttccaaagctctcactgctgaagccattaggtattattttaaatctgagtattttgagcagcaatttaaaaattaccttgggccttagttgtatgtctgggaccccgaactcaggtaatcctgaagaatgggtgtccctaaattttatattttttttaattttgggctcaaacccagtttttagtggttatcgagggtgctgattctgaatcttaactaaaatttgcccaattccgaaccccggaccctaattcgaacaaaaaaattgaatttttttttcaagaatggattttttagggtaaaagcttctaattcatttaacaactatttagtttgatgtaaaacaatgcttaaattgttaattggacaaaaatgcgcaatttgcgtcctaaatttgaccgattttaacgaatactttgcaaattttgccccgccccgactccaaaattgtacaaagttatactcgattgctgacaatccctgttattttttccactcttacacagggacaaaaccattgtttatgcgttaatttgtgtttttgtttgtgcggtttaattattggcgttttaatctattttgaatttattaaaatattttaaaaatcggaaaaatttgtaaaccaaattccaaaccaaagcaaaaaattttattcatcaaattttcttctattacaatattttatccttcacaatggcagatttaagaatggaggtaaaaataaatgatttcctttcatttattcctttcatcttaaggccggcaatgatgtgatcgttcccgtcaatgttgcaattcgcatattcggttttgttagtagagatgatttggaaaattgcaaactcacctgcaaatcatggaaagacgtgtaaggcattgaattttgttttttgcaataaaaccattggcaaataaaaccgattattttaagaattgattacgcagacaaccgaaagnaactcggagttgcaactgaggcacattgacgccatttgtctctcaactaattctgaattttctatcaaaatttactacaaccaaactattcgcgagttttactacaaaaaatatttcgctgatatgttaggcctttttttaaataaaatagaaacattttatcttcagggaaattgatgaaattgaagtgaaaaaagtcaggcatttaacgagtcaatttgacgagaaaaaatacgttttcccatgtggagagcatttgccaattcggcaaagtcattcctttgtttttccagcggttgatatttttcaccaacacaggtgtaaaagtaggtaatctttgggttaacggcagttcgtacaattttttaattttcattaaaaccgaattttttatcaaatgatttttttaaatttttgcgacacttttgctgtttaattttttgggtggtttcgagtctctgaattctaaagaactgcgatgacatcaattcttttgattaatttgtaagctaaaaataatttcaattttttcagtggtgaggccaaccgtttaccaggaccatgtcaattacacgcgaaaactcttcacacctccgctcagtttttatgaacgccttcaacaaatgctcaaaaaatgtaaaattcgtctggtgattttccacgcgttcactttcactgatttctttgttgaaaaaatgcgtgaatttgcgtccgatgcgtttacgagggtcgtttttctttcccttcactgtaagtcccaatttt

SEQ ID NO: 11652 - DNA, 1072 bp, Heterodera glycines
  misc_feature (1040)..(1041): n is a, c, g, or t
ttaactctaaaacaggcaaagaatgaattgcttgcccaactttctctcttcgaccaaattctccttcccaaaacttttctcgttggcgagcgtttgtcccttgcggacatttccgttgcgattgatcttctgccggttctttatttttttggttgattttaatttaaaatcgcatcaggcttatcaatacgttttgggagaagaagctcgcaaaggccttgtgaatgttaaccgatggtttcaaacggtggtcagtcaaccaggaatcagagaagtgctcggggagttcagcttcatcaaggatcccttgaccttcgatggtaaggctcactttggacctttttgtttggtttcagcttaatgctcatttcagaaaaagagtacaacaaactcttgaatgctgctggtcaacctgcgaagaaggaacaaaagccggaaaagcagaaaggtgccaaagaggaaaagccaaaaagcgctaaagaggaaaagccgaagaaaaaagccaaggaagaagccgacgaggaaatggacgctgctgacgaggctattgccgctcagccaaaattcagcgacccattggctgcgttgcccccgggctcatttgtgatggacagcttcaagcgcgtttattcgaatgaagacaccgcaaccaaagcaattccttatttttgggaaaatttcgaccccacaaattacaggtatttaaaaagtatttgtttattaatttatttcttcccatttattagcatttggttttctgaatacaaataccccgaggaacttaaagtatgtattgagtgcatttggtagttttttgcctttagcaacatttattttagttagtctacatgtcttgcaatttgattggcggtaattaaatattggtatttccatgggctaattaattgaatttaattcgttaaggaatgtttcaacgactcgagaaaatgaagaagcatgcgttcgcctctgtttgtttgttcggtccgttcttcttaaattcttattgtttttttaatttatgacttttaggaactganncacactcgacaaatctcgggaatttggatct

SEQ ID NO: 11653 - DNA, 3219 bp, Heterodera glycines
  misc_feature (3137)..(3137): n is a, c, g, or t
ggaggtattgtagcatttttatcgtcaccaaaactaaagtccacttttccagggtgactttggtggtaagaagttcaaccagggaaaaatcttcaagtgattctgatcatgtcgtaatcacagttttgttgcctacaactgttattttttgttgacgaatttttatactttattcaagtgattaaaggtggatcatttataatcttaaacataataacagggtcgaccaataggatgagtatcggtgagaagttacaatatcaaattaatttaaaacactcaaaaatcagcgtcaagacggaattcacgctgctcttctgttgaaataactcccatcttttggtactccgacactcgcttctcaaaaaaattggtcttgccctgtatcgacagattctccatgaagtcgaacggattgaggacattgtatttctaaaaatggggaccaattgtaagtgattatatatacaggtaaaggctaatcctgtattttattggtcccataaaaaagagattaaaaatcttttatttatgggaccaataaactacaggattacccagtaaagtaaggaatgccttgtcatagcctagttcaaccagcaaatggtcagcgacgaactcaatgtattgacacatccttaacaataaaaaatattccaaattaaaacgtttaattacaaatcggaattcatgccgatcatatagacaggaagtgcgtcggttaggtattcctgcaaaaaacggcgatttattgtctagcaaaggcccaattacctgttcaatttttaccgcgtccgagatgatttcgtagatgcgttctttgggtggcgtgtttttgaggtgggtgtagagaagacaggcaaagtcacggtgtaagcccttggaaatgcggtttttgatatttaaaaaaaaccaaagcaagtcaaacttcgtcacgcgaaattaattcgttgctgtgcgtcagaccgggcaaaaggcctcgttttttaagccaaaaaattgcagcaaaactccccgagaagaaaatcccctcaaccgcagcaaatgcaacgagtctctccgcaaaagaagcgtcggaacttgcgatccaacgaagggcccagtcggccttctttttgataaattcgaactcgaaaatggcattaaaaagcttagcactaaaaggacaaataggagggattaatgtatgaaaataataccgttcatccgaatccttaacgtaagagttaatcaacagcgaatacatttcagaatgaatgttttcaatggctatttggaaaccataaaaacagcgagcctctggaacttgaacttcttgagcaaagcgctccacctagcaaaattaaaattctaaataaacaaacgaattttactaaattttcgttgacaatcccatcagaagctgcgaagaatgcaagtactcgagaaataaaaaatcgttcattatcagttaagcttttccaatcggaaatatcctttgacaaatcaacctaaaagcaaaattaaaatttcattcgttttattcaaacatttcacgcaaatacctcctcaactgtccaaaatgaagcaactgccttcttgtaaaattgccatatgtcatggtatttgatggggaaaatgacaaaacgatttgggttttcctgcagaagcggctcgtccattcttttcaattggaattgggcagtgacaatctgtgataatgttttgctggttattcttttttcctaaaagcgatgctattttgaattcgtttctgggcgcgctattttaactaagttttcagtttctttagtaaacgaattgaataacgaatggaggttaatcctgccgatttgaatttccctaaagcagtgatcgctcgtataatcaaagaagcgttgccagatggagttacagtttcgaaggtattttttacacactttcatgtaataaggaggttattttttaaattttgttttggatgctggacgtaattagctgattagattaaaattttgagattaatttcaggaagcaaaaaatgcgattgctagaagtgctgctatatttattcttcacgcaacttcactagctaatgacaatgcacaatcaaaaaagagaaaaaatctgatcgccgatgacgttttatatgcaattaatcaattggaatgcgatgagcttgagaacccggtcagttttgtgcaaatcgaattgtaagaatgaattatcgcacttgcatagtgtcaatttggaaaattagtaaaaatacaaaaagggaactttatccttggtttccaacgccataaattttctttcttggtcaatgcctgcatttttgtattcaaacgaaagctcagtttctcaataatttataaatgcaaaaagaaaacacgaaatttagcttttttcgggtggtaaaaataattttttgtctattatattatcccataatatagttaaaccaaaaatgctgtagacttaaaaatagacaattaccaagtaagataaaagttatggcctaagaaactgacaaatgagatggtcattgatttggacgcataaactgaattagaaccaattgggcttcaaactgactctgttttaccaaataaaacccctgacaggtaaaggaagcactcactctttacacgcaaaagaagaatcagcgacaacaacaccgaagagagagaagggcaaaacaaagagaggaaaaacggtttgaaaccaaaggaaaaggggagacagaagaaaaaggacagcaagaggatggacaaagcgactgcgaacagggaatggagaacggtgacgacgatggagaggaggaggaggagatggaagacgaagtggggcaatagtgcgcatttatttagactttaaactgcatttttgcataaattctttttactacctattttaaacggccgttttccgttcaaaaggctttattatacttctaattgtaaaaaggaatctgttttttgaatggtattagcttgtatggcgacgcatgattctgaaagttgttcagcagaacaggtggataaacacggatcaaagcactaaagttttggaataaataattatttcctccctataaaaggcttctactgccgatgaggttgagtcgtccagtaggaggtccagcacagataacttgngaggtgattccgactacggcgatgactcggtgtctgacacagattcggatgacgaaatgaaaagagcaaaagttcgacgctg

SEQ ID NO: 11654 - DNA, 1604 bp, Heterodera glycines
gaaagctcagtttctcaataatttataaatgcaaaaaggaaaacacgaaatttagcttttttcgggtggtaaaaataattttttgtctattataatatccccataatatagttaaaccaaaaaatgctgtagacttaaaaatagacaattaccaagtaagataaaagttatggcctaagaaactgacaaatgagatggtcattgatttggacgcataaactgaattagaaccaattgggcttcaaactgactctgttttgccaaataaaacccctgacaggtaaaggaagcactcactctttacacgcaaaagaagaatcagcgacaacaacaccgaagagagagaagggcaaaacagagagaggaaaaacggtttgaaaccaaaggaaaaggggagacagaagaaaaaggacagcaagaggatggacaaagcgactgcgaacagggaatggagaacggtgacgacgatggagaggaggaggaggagatggaagacgaagtggaatagtgcgcatttatttagactttaaactgcatttttgcataaattctttttactacctattttaaacggccattttccgttcaaaaggctttattatacttctaattgtaaaaaggaatctgttttttcaatggtattagcttgtatggcgacgcatgattctgaaagttgttcagcagaacaggtggataaacacggatcaaagcactaaagttttggaataaataattatttcctccctataaaaggcttctactgccgatgaggttgagtcgtccagtaggaggtccagcacagataacttgggaggtgattccgactacggcgatgactcggtgtctgacacagattcggatgacgaaaatgaaaagagcaaaagttcgacgctgagagaacgcatgaaatatacggactcgaaaatacacgacggaaaaacaagtaataaacgttaattgtcaaatgggagagacacttcctatttgtgctcagatacacaaagtgacactgagacgaaaaatttgctggatgacatgggcgaggaaatggacgacgatttgtcgatattgcacgagatgaattgtcgtagtaaacagaatgggtcgtcagagttaggtatgtttggatgtaaaaatatcaattccccatttctattagactcaaaactctttgagctctccgatgaacagttgaattattacaccaattgctttctttttcttatgcagaaatcgcaggttggctttaactccctttttcatcttctaaacttaattttgaggggttcttttctctgcaaggggcgctccaaggtcgtattcttttccgagtccgaatttctgcttttttaaggcaatgacagaacaattcttgacttcttccgcaaaagttccctcgacgattcaattctttccaaaatttggtctctcagcgatgtgaacgaggacggatttttgaatttggcggagtttattttggccatgcatttggtcgttttgcacaccaaagtgaaacttcctcatgcccatattctctctctcatttctcttcttatttagggttctgttcctatcccaagtaggctcccttcctccgtccttcc

SEQ ID NO: 11655 - DNA, 1904 bp, Heterodera glycines
tttttctaccgtatcccctttgctttttgccctcattgatggtacgtcgggtactgtagccccaacaaatttcgctgcaagcaatgactgtaccgtatcctgatcagcagcagatttcgctaccattggtgatgcttgtactgtatcccgaatagatttctcttccatcactgctgctggtgatgaagactgtttgtgtttttcttccgccgtcggccctttgtccattactgtctctaccgtatccttttctgctgttggccaattgtccgttattgtctctaccgtacccaatgcttctttttctccttctttttccttttctttttccccttctctgtttttttccttaatatttttctgctttttcattttcgactttttgcttttgaatttaatttcgtttcctttttcaattttttcgccaatttttttcaattggccaattaacgcagaatgatctattttaattgagttcaatatattcaaacatttttctgctccaacagatccatcgttaaattgttggagtttattgagttgagaacaatcaaacactgaatgaattcattatttattttccccttttttggcttttccttcccctcaccaaattgcaattgctctttgaactgtccatccttggccattaattcgttaattgtctccacgtgcttttccatcattagtccctcaaagtgtttgtactgtcccatttggctgtatttcacaattttcagttcggccgtcactttaagcagctcataaatttgttcggtcttctcaatgatttttcttaatccattttccatggctttttcacttttggcattttttgcactcaataaactgtccaaaaataaataaaattcattcaataaatttgtttggcaaatttcaaatgttggcatttcgtcgctgtgctcgtcaaacaatcggtcgtagagaatggcaagcagaaatttgttgcgtgcccaaaagttggcgcaacggagcgcatttttttgctctttttgttgcaaaattttggcatccatccaacggacgaaaacgaataaatccaactgaaaatgccatcaaaattagcaaaaattaattggctaaattaattttaattgatcggattgctttttaccttcaatttgagattaagccaactgctgacagcattttttctgaccaatgtggaaagaagctcagaatattgggcagacagcaaaggatcattgtaaaacactttaaaatgggagaaaatgggaaaaataaaattattttatttaaaattaaaataaaaataaaaacaaaaacttttttattaaacaatttatggtaattttacattcatcggccatatttccatccatccaaagccatttaatcagcggtttgttctgatcgttgtcccaaatatttggcaaaaatgccattgtcatttttgcgttcaaatatttcaaaagccgcgttttggcacccaaaattaatgacaatttttcgaaaaacgcatcaacttctttttctcctttagttaatgtctcgccgagatgaagcttgtacattatttgattgtatttaatggcactttaatttacaccaaatttaaaaaaaacagaaaaataataaagaaataaagtacgatttttgtttaccgtaacctttccataccatttcaattctcattttaacagtccccaaccccataatgatgtgtcatacccagggcccggatttttaggttttcacatatgttttttttgcggataacatatggtgagataaacgcaaaaaacacttcgatttagagcgactttttagcaactttttttcaactattttcgcttatgaaactttttaacaactatttttactttaaacactatttttttcaacttatttttgctcgtaaa

SEQ ID NO: 11656 - DNA, 2534 bp, Heterodera glycines
  misc_feature (65)..(65): n is a, c, g, or t
  misc_feature (72)..(72): n is a, c, g, or t
ttttcctttctctctcaatttctcttttcccctctttgtttccctttttcctatcttctcctctncctcttncctctccctctttctcctcctctttctcctcctcctcttcactgctttcctttgttcccctccaccgtattcctcttcttcttcttcttcttcttcttcctcatcgttacagaaatccgctaatgactttaatgactttgaattgctcatataatgcctaattatattttccggttcatcagtttttattataaagttattattccccagaaagtggcgcaatgcgtcggtaattttcttttcgtcggtgaaatacaaaactttaaatttaaaataaaattttaattttacataaatttatggaagacggatttaataaaaataataatatttgaaaaattgcatcaattttaaataatttaaatattattctgaaaattggataatgaaattgattgtttttcaatttaactaattttccaacccataaaagcagcatttttgttctgatcactttccaaaatgcttctcaattccgcgttgtgcaattgccaaatccatggcccaatttggccaatttcctcctccgttggcttcatctctcctccatcaaattgcttcttcccatttctgatcacttttgtcccccttttttctccactcttttcgcttcctttttcccccaaattttcttcagcatattttttcgtttcaacgattaatttccgtctcaaaaagtgctctcttactgtcagttgcatttggtccaagtcgaaaatttcttcataaaattcgtccacaaactcaaaaaatttgggcagcagacgccggtctctcccggcggcgctcagttggcgttggacccatcggacgaacaccgccaaatcggcactgattttgtgcgctttggccgccaatgtgtcgggcttttgcaatgcgcaaaaataatgatcccacaaagaatcgtcgcttgtaaacgctggaaaatgataattaattaatgaattaattgaattcgttaattaattatttaattaggaattgttaaaacggttagagaaatgtttagtaaaaaaaaaatatataaacgattgaactgaattaaaacaaaaagcgcaaaaaaattcaaatttcttttaaaaattgaagaaattttttgatttttgtttataaatcgtaaaaaatgcttctttaatgctttaattaaaatgataattttttctgtatttattttacataatttgacaatccttcaccgttttccgcaaaaagtgccgtcaaattgaaccgttttgcaaatgctttaaaccgttccggggtgccgattagtcgcgcaaagcgcctctttgtccccgagcatttgatcagtgatcggaaccgggcgggtgacgccttgaccattcccgcgatggcaaattcgatcagttcgcccaattccgtaccgctgctcccctcaattagcttttctcgcgctttccgttcgtcgcattcgtccgtcctcaatttgagcagcgttttctctttctttgccaccagtgtctgtttgatgcgtgttccgaaaagtatcaatttgagcatcacgcaaaagtgccgggccgagccaaagtgccgaaaagcgtcccgccgaacgtcggcaatttttgtggccaaagtggcaatgcccggcggcattttgggccaatcattcctcaaatggttgccaaattttatcatgtagtcaatgagaagggccgtgccgaactgcaaaaaattgtcgttgtcggccagcggagcatcgcttcggcgcaacaaaaagcgacgaacgcgcacaaaggcactttcgttggtcattaattctggaaattaaattttgcaattttctttctttaaaatgaggtttccaagatttttgtgcgtatgaaattctcgttttttaatgaaatttcacagccattcccgacaaatttggtaggatttttgcccccgatccccggcatttaatctctccccgatggtcgaaaaactacactaattatattatataaataaaattgcttcaatattaattttaatttattattataaactttcttattttgtttctatttttaaataaattttgatgatttaatttaataaatttatttcatttttttaattttcttaagcttaccaacgcgtaaaatctcggggaatttgttctccaaattgacaaaacattcacttttgaccatcccattcaaaaatattttcactttgataaagtttttttcttcttttatttcgtgacacaaaaaatgccgaaaattttctcttttttctaaaatttccggtaaaattttcccatttattagcagcaacattttgttggtcgtcaattcatttaataatttaacaacctcagagaggttcatgcaattcaccgaattcgcatgctaaatgtataaataagtaagtaaataattaattactaatgcaaatatttttttaaaaactttcattttttgtaattaaaaacaaagaaaagaaatttcatcatttta

SEQ ID NO: 11657 - DNA, 2196 bp, Heterodera glycines
  misc_feature (10)..(10): n is a, c, g, or t
tttatatatnttcgggatttttcaaatgtaatttctaaaacctatttaaggcctatgtttccgagttcgccgaaggagtggcagatttagttgaaatgttgcaaatgacggcaaatgaagaatgaaaattttttttctttttctcctaagagaggcatttttcaaattggaaattaccattttacattttgtcattttacaaaatattacatattatcaaatcctgattttttttgttatattctatgaaataaattttccataaaaatgtaaaaaaaatgaaaaaaaagattcatgggttagcgagtgtccttgttcttttccggcaccgagcagggtcaaaattcgatcatcccatcaataacatatttttaaatgttattttagctttgtatttatgagctctatagaattcagtttgcctgtgttttgttcgccaactcagttaaattttgtgattggaaagcgagatttatgcgagagcaaaccgatacaaatgtaagctaaaatagccttaattattaaataaataaaagttttggctgggttggtcggaacattcgtgaagaatatgcaataattgtttcttttagattcaacccttacaatcatttactgcgctttaaattcttttgtaagttttttttggatttatttttccattttctgataaaaattactttgggatgcaaatgtggtggggttaaggggccatttcggcatcgaaattgttaaactattttttcgttgtctaaccaatttcctaaataagagatatcaaccaaatttctactcttctcaaaaattccttcctcccctttttagcaaatgcgcctgagcgttggcgcgtggaaaatgctcagggcggcatccgggccaacaattacgtcacgacgacagtccaactgcgcgagccgcacacaatccgacagccgaccagcgactgtctccgcgtggaaattttcagggacggcgaaagcgttgcggtcggaagaaaaggtttttttgacgtttagtttataacttcagcgcttttaggctgccctgactaaaaaacttaaaattgaacccgattttgacttattattaggcgcaattactcggcgtattccccctccccgggaccaactcttttattttgaaggccaccccaggacaacgtttttgtattcgtttttgaattttttttgcgcatttttttacatgttcaaaattaaaaaacgattatacgaaggaacggtggtaccgatatgcatcgctgaagatttttaaaaattctcttcctttttttaacttacccaaaaagttttattgacaaagttttgtaaaaattcgtcttcgccacattctttttgatttattgcacagctctgctgtttgactacatttttcatatttttttatttctcatttttcagacattttgctcaacattttgacggttgagccgccctcttcgtccgtcgatggcgcaaattttgtcgaattttctgacggcaccgacgcggcattaaacagcacggcacagcgcggcgaggccaaattgcggacgaattccatccacaatttgacgggcgaaaatggccaacaacggcgacaccagcaaacggtcattagtgatatttatgaaataggcatgacagatagaagtttgtcagtttaaacttttccgagcctttggccgtatctcgatgttttgccatctttaaaattttgaatcattgtcgtaagggaaaatattttttgtttttgcaaaattaacgcaaaatttggaattttgttttactcatattttttgttttccattcaattaattttatggttcattttctatttgcttttaattttgtcctatttttcctttcagaggccctccccctggcaattgtccactttctattggctcgccttggccggtctcttcgcctgccttttctgccttttgctgccccccacggcgccccctccggtgaccgacccccaccgccatggcattgccctttccgtgccgcattggctgcgcccctcgcacacacaacactgtgtggccgcttacattttgggtacggcttttttggtgcttttccctccactcggccaagggcataacccaaagcattggcttaatttttcggagccccgaacatttgcacttatgtccaaatcggattcaaagtgattttttttcaatccctg

SEQ ID NO: 11658 - DNA, 1661 bp, Heterodera glycines
tctaaaaaattggctgacaaatttctcaaaaaattttttttcttgaaattttcgtactaagaaaattcctaagaattttttttatgaaaaatttctaggtttgaaaattttttttaaaaaaatttttcgggggggaaacgacgtgggggggaaacgacacgggggggaaacgacgggggggaaccggcgggggggaaacgacctgctccccttatttaatgctgtttaggcaattagggatggaaaaacttaattttgaagccaattttggacaaaggcgcaagtgtcggtacagcgaatttttctcagttctaatggcaattttgggtccaaatctaaaatgttaatagaatctcgtaaactaattcatcttcaataccaataaaatttggagagaagtttttttaatttatccacggataaaaaaattccaaacaaaaagtccaaccatcgagtcgaacgagggcgtagccagacccttggcttcgaagggaaggggactgaagtcaaaaattcgatttttaggggtgtatttttcattttcattcgatttttagagtgtgtatatttctttgaactcccaagttagggggtgtatttacaaattttttacccgttttcgccaaaaaattttggtctccatttttcaaaatttgatttttgttttttagggctactgacgatgtatttcttcttgcagatgaattgaaggaagattttcattgcatttggacaaaacaatcttttacttaatttcaaaaaagaatgaaataaaacgggtaccgcttgacaatttctttgtgtccatttttgtggaaatcgccaacatttgtcacctttttgtacaaattgcagacattttgtgttatgtacttattggggaaaaaacattgctttacttcgtttgccttttaaaaataaagatggagttgagtcaatttttaattaccttttagttgaacttttaaaattaaactcaaaaactataaaagcgtggatttgaaatatgagaattgtgtgcaaaatgttttttataaataaaagaaaagtttttaattgacaggaaattgttcgtaataaattgaaattttttgttaaattttgggtaaagttacattaatttcaggcattttgaaagtcttgatctttgctctttcattatgcatttcagtctaaatgtggtggcttcatcaccatttctttacgcattttttccggtttcatttccctcctccccaaatttgatcaccggcagatgcattctatgcgcataatcggcgttaattgttgttccattttcgacttggcccaacagccaaaaggtctccatgacgcctttgccctaaagcacaaaaagggcaaaaaaataatcgaatcattgtcgttaattaggcagcggaattaattagttaattgccccaagtgggtgacctttatgatcacttcgcctctgctctccgtgtgataagagccgttgaaatttttgtgcagcaattcgagcgtttcactggacatgtgaattttgtttgctaaaagtgaattcagaaaaacccaatgacaaaattcaaagtgaaacaagcgtacggcttgaagaactttccatgcgcgaggcggtgtttaccgtatccccaaacaaacagtaacggggcatggccaaccct

SEQ ID NO: 11659 - DNA, 2526 bp, Heterodera glycines
  misc_feature (2403)..(2403): n is a, c, g, or t
tgcatgcatgattttaataaaattaataattggttttattttactagctgtgcaccaacaagttttggtatgtattgagaataataaaaattttaattctttataagtttataagacctttcattttaatgtaaataagtgatacattattttctcagcaaataattggcccaaagacaataatagtcatatttttgatccgaaaaatgattaatatcataaatataaaattatttcaagaaattctggttgctaaattcggaaacaaaataaataaaagtaataggcaattttactttataaatgtaacattatttaaaactgctaatattgtcgggaccaaacagaggcaaattcggcccggcaaaaattttggcaaaatagaaattgggacaaacagtagacaagcaggggaatgatgttttattccgactgaaccgatttcaataacaattccacgacttaaatagggtgtcattcgctgaataatacatttttgtgtgagaaatgaataagaattgaatgtaaacaaacaaatattttttgaatagaacgacgaagagggggaacatttccaattaaattaaggttttcccatttttaatgaaattgcatcatgctttaaaatttatcttttccattttatttctcgtgacgtgagtcgcgacactccccacagcaaagttgtcggggggttcagttgctgcaagtctgcctgtatgttgttgttttatttcttatgcctcattccgggttgtctgtgctgagaaaggcgggcggttgattttggttaatcgtaaaatctgtgaggtgatcagttgcccaggctgatcccttgttgcttgtgaagatccgctccgcggcggtggacagcgatcagttgaccagactgactcctctccgtcctgtcgcccttgtaccagcgtctgccacccgctgatcacaagcattcatcagtgcataggttcccggccgttgcaccacttgtcgggaccaaacagaggcaaattcggcccggcaaaaattttggcaaaatagaaattgggacaaacagtagacaagcaggggaatgatgttttattccgactgaaccgatttcaataacaattccacgacttaaatagggtgtcattcgctgattaatacatttttgtgtgagaaatgaataagaattgaatgtaaacaaacaaatattttttgaatagaacgacgaagagggggaacatttccaattaaattaaggttttcccatttttaatgaaattgcatcatgctttaaaatttatcttttccattttatttctcgtgacgtgagtcgcgacaaatatcgcaagaatagatacgaatattagcttttttcgtgtgcggaatattaaaattgcattttaattcaagttttaacgcgttttgcatgcatgattttaataaaattaataattggttttattttactagctgtgcaccaacaagttttggtatgtattgagaataataaaaattttaattctttataagtttataagacctttcattttaatgtaaataagtgatacattattttctcagcaaataattggaccaaagacaataatagtcatatttttgatccgaaaaatgattaatatcataaatataaaattatttcaagaaattctggttgctaaattcggaaacaaaataaataaaagtaataagcaattttactttataaatgtaacattatttaaaactgctaaaatcggaagaatagatacgaatattagcttttttcgtgtgcggaatattaaaattgcattttaattcaagttttaacgcgttttgcatgcatgattttaataaaattaataattggttttattttactagctgtgcaccaacaagttttggtatgtattgagaataataaaaattttaattctttataagtttataagacctttcattttaatgtaaataagtgatacattattttctcagcaaataattggaccaaagacaataatagtcatatttttgatccgaaaaatgattaatatcataaatataaaattatttcaagaaattctggttgctaaattcggaaacaaaataaataaaagtaataggcaattttactttataaatgtaacattatttaaaactgctaaaatcgcaagaatagatacgaatattagcttttttcgtgggcggaatataaaaattgcattttaagtcaagtttaacgcgttttgcatgcatgattttaataaaattaataattggttttattttactagctgtgcaccaacaagttttggtatgtattgagaataataaaaattttaattctttataagtttataagacctttcatttgaatgtaaataagtgatacattattttctcagcaaataattggaccanagacaataatagtcatatttttgatccgaaaaatgattaatatcataaatataaaattattcaagaaaatctgggtgctaaattcggaaaaaaataaataaaagtaataagccattttacttt

SEQ ID NO: 11660 - DNA, 1737 bp, Heterodera glycines
tccttgaatttcaatgacgccatctttttgccttgctcgactccgtcctggaaaacctccggatattggaccacttatgcttccaattcctttttgttttcaacggcacgaattgtcggaattccgaaagctcggttcagatcgattttcagtcccatgatcaaatcgcggccgcacaaattttgtgcttaccacttatgacatgaatattggactcaatcgttcttccttcgtgcgtcagtttcacttttgcctttcctaaaattccagcaatggattttccgccataggcaaccaatccttgggatggttccaattttggctttccaatgcgtttccagtcgatctcgtcaatcactgtgacgtccgcaccgctgtccaactcaaactccaactttccattgtgaatgttgagttgaatgaaaccaggatcggcagaaattcccttgatttcatgaatgacgctgacatttgaacattcaatgttcttgatttgtcgtccgttggtccttggcttttgaccaaattgttgaccaaaattggcattaccgtctctgtttttgcttttgcaaccaacggcccaatgcccaatttttccgcattttctgcatgtcgaattctgattcgggcacacatttgcaaaatgtcccggttttccgcaccgaaagcaacttctcgtgcttttcgtcggcgttcttggtcctctttgctgattgccaactttcgcgacctcaggcattgcatttgagccaattgcttgggcatccaaattggactgctccaacaaaacggctgattcaactgcgtccttgaattttaggtccttgtcgccctttttgatcaattcaacccgaattgcatcattagagatgccattgataaacaatgcgcaaagacacatgtcaatgctgtcgcggctccattctatagagcgagagataaatggcttttcatgaataaacggtgctaggtcgttcgcaagtcattttcaaattttttaatttttcaatttttggcatcacttctcgccaattttctacatttgtagtaaacacaacctgacgccattgataccgttttgtagagctcatcgagctgtacaaaaaagccgctggtaccggcaagcttagctttggttggccatcgacagggtcgggggcgaggctgagggtcctccggcagatttgcccgaaccatgacgggctccaagtgaatggataaagaaccggacccggcctgggagatagcccttgaaaaactgaacaaaaaatttttcttaaccgggccggtccgggttgcggatcaggcacttttggtgcccgaaagtggtgcgataggcttccggaaaatgaccaatcaatcactgagttttttgtggaacgactcaccacggaataaactgatagagaaaaaggaagaggctgcgagtcataggtgcatcaagggggggggggggcaatttcgtaaatatccggcatttcaccgtgggttgttgccgttgtcggcgtcgtcatcattggcatttccattgtttccggcgtcatcattggcattggctgtgttggcattctgttgatgggtgtcgccgccgtcgtttgttgctgagtggctaatagcgcgagaagcagcgactgctccagcaactgttgctgcaggttgttgttgtccacccttctgaacagattttgagccaaaattgaaggatttttgaactataaaaaggattttcccgaattt

SEQ ID NO: 11661 - DNA, 2213 bp, Heterodera glycines
gcaggtcaaaaaaaatccgaaatccttgaaaatggacgacagagaactgtgaagcgacgcgccatttgaatttgtggtcacataaggcaaagtcaatagcaacatttcgggtcaagattcttctagggaaaatctctttaatcattcttggctcttgatcttcaattttgctgcacatttgtattttttaggcatgaaaatttccgataacttttctagttcggtatggttctgggtctcatcaaaaaagcatcaaatgccaaatttttggcagaaaattgttcataatcttgctcaagtgaaaccaaattcttaattcttgatatcattccataattttaaaaactttatttcaaaaaatttatggccaatggaactcaaaaacccactgtttttgaacatttttggttaacgaattttttgaaataggataacagagaatatttagctattaaatgagaaattttgggaatgattgactcggattcgaaaaggatcaaaatggatgccagaatcggattctccgaccctgaaaccccataaaaataaaaaaaatttcgaaaagggtggctaccatcagaatattaccaaaaaatgaaatcgaaaataataagcccattcgttttttgttttgttcaagtatttcaggagtttagcggtttatgcgaacggagggcgtagccaaaccttggcttcgggggcggcggttgactaacccaccccagaagagcgacgaattgaccgtttgcccttcgtccacttatgtttcgccacaattttaagtaatttttgaatggtagggggtgaattttggccgcgttcaacaattttcttttcataaaaatagagcgaacatgagcaaaaaaaaaattttttttttttttttgcccgacagaccgaggcccaatccaaaggtatttaaatggcgaacaaaattaatatttgacgtatttgtttatttttggaatcaaattacatgataaagtcaagcaaaagtgtttgattccaatcatacaaaaactgcttttgtgagaataaattaaatgagtcggcagcggcaaagtccctgagattcgtagaggcctcaacgacgagacatctgagaagacacggcacggcactcaacctaaacattggcataaaacacacaaaatcaaccaatgtttgagtaatccttcggaattgcgacccaacggaaaagagaaaaaaagatttttttttcatcactttttctagggtaaaaatgcgacgcgctttttttgtcatgaacaagttcaaagaaaagttttttccatcgggaccaaaattccgagaacgattaaaagaatggcacaaactacggaaggaggcggccggtgacgcgggggagggtgcacagttcctccccgcgcgcatcaatcgcgataattttaaatttgtattcttcgttggaaggcgctccgacttgaaacgtcaaactgtaaggctccatggagctgcgctaaacaaaattgtgtttattccgatggcataagggaaggagggagggggggaggggtcggagcagtgaaaaaactacgaattgtcagccgaaagtgttgtagaatgggttcaatttgctaatgatttttaattttacattgctaagtgaaaatcagcgaggttcagaacattgaaaatcggaatttcaagtattacttatttaccgccgcccattttccgagaattttttatcttccaagtcatgaaaacatgtttccagtggttttcggggtcgctgacctcgacgtcacccatttcgaccaattccgaatcccggacccgaattggaataaaaagttaaaaaacaaagttttcgctgatttttgcgtatttttcacttctttgtatccaaaagcaccactttcatacccaactcaatccttcccatggctggctctacgcctttgaagcttagaattttgaaacttacaacaggaagacttccaattcgtgcccaatcgtccaccccggacagttgcttaacaaatgcctcataacggtcaattcttcggtcctccattccgttccagttgatgcgaaagtaacgcgggtatttttcgagccaaacgatattttcagcgtgcatttttatctaaaatcagaatatgatatcagatttgcaaaaatcattgattctatcattgattttgaaatcatagattttctaaattgtgtcaatattgtcaaatgtt

SEQ ID NO: 11662 - DNA, 5621 bp, Heterodera glycines
aaacgggcgtcagtccgcgccccacccatccgccctccgtcactggcaaacacacgcaatcggtgatcgggtcggcactggaaaagtgcttaaaaccaaaattattaaaatacaatttgctgtccgttcttcggtcgggtgactcacacttttctccacacagtcgtggaaatggtaaagggaattggtgcccccgatgaacatgtccacgccgtagacgaacaacgagcgaatgtcctccgtcaaattactctcaaaggtcagaaactgtttgcccttgcggctgtagccccggacctgtgccaattcaaaatggcatttggaagaatagtacaactccctcatcagaggatgggggggaccaacctcagtgccacaggcgacgaatgctttgtcctggacggagccgagcgcaccgcccaaataaatgcgcgaaatgggagagcctggaggggttttgaagagaacctgggaattattctcagtgaaattagcccataaaaggcgcagccttcgctttccctcacatttgtgtcgttatttcgcctttccatgcacagcaaaacgccgttctgtcctccgatgaccacctttcaatgtcatggccaaataaggaggattataagtcagcttattgtgaaagtttgccaaaaggcccccggcggttcgatgatggtcggtcccccccccccccaaacacttcaaaaccactttaaatttgaacccaaattttgtcccttttgttccataggcatttgtcccatctttcccctcactttgtcttccgctgcaattgccattccctttcggctcccccgccgtcccctccttcccaatttctccgccttttctcccccatcctccgccaaagtaatcggctgatcttcggcacgtccgactggcgactgattttgaattacacacaaacagccttttcagtgggaaatggggaggggaaatagtgagaaaaatttggtggaaattgaaaagtaaaattcggcacaattgtgccgccaattcgaccgatggaccaatgtttggatccgatctttgcttcactttgtccattgttttaagccttcattccctttcgccaacctttcgaagtcgtcccaacgtgggcatagtccacccgactgagcacaacttccattttcgggtgggggggggggaagaatctttggattcaaaaaaggtactttcctgttttggggtcacatgtcaaaaactaaaatttaaaaatgcgcaaattcacagtcgcgtacagtattgtttgggtgcataaatacaataattgttcctaacaataaggctcccgtaaaatgccagtgaaaatttaaatgtcaaaaaacaagttccttttcggacttcagaacgatgttcttatagaattttccctttatacagtacctacaataatatttaatactgcagaactttattttaaaatatttgtatcactgacgcattttccggtcatggttgctaaattctcgtcaaatggatcagcttgagaataggatttgtgagaattctgtcatttttgttgttttttaaaattttggtgtgtgacccaaaaacataaagaacccaaaaaggaaaggttgccatggaaatgccggcgcggggaggggacggtaatcgaaatttacagtaatactaataaaaataaataaagcgcaaaaaattgcaaaattttgaccacttttactcgttgaacacaccacattcatttcacatttaattaggattttttagcaaacgtaaagctcttgagtttagaaagtgatacataattgaaaagctcataacaacacaaaaaggcagtgatcagtacttttgaattaacgcaatatttatatatatatttctttttgaaatgataaaaaatgtaaggttattcgaaaatgaaaatttgattggtccaaaaactcaaattgatacactagtttttttgttggaaccacttttgccattcacaatcgacatgctaggaaagatgagcgaattatctgtcctttatttaaatttaatttgaattcaattttagagagatggagacactttccatttctttacaacaagggcaagaggtgcagcaaaacgaaaccaattcagtttccacgtcttccacagattccaatgatatcgatatccaagcattggttcggccatcggctcggcggcagggcgatgtgatttcgtaatcacgcagatttttaatgccatttaatttgttctcgtctattttaggcctcatcgtgcggttttgactctctccaaaagcatgttcaatgccggatgcttctcattgccttacgcttggatgctcggcggaaaatgggtgtgtgtctggtggcttccgattccctttctgtttatccgttcttcaggtgtcattggctctcacttttgtcattgccggctttaattggtacggcaaccacattctcgtccgttcgtctcaacatttggctaaaaagttaacctctttccaatttcttcacatttcaacaatttcaggtccggtgttgcctctctcgattatggacattttgcgaaaagagtgtgcgactacagcgaattgccatttttgcgacgtcacagcaagcgaataatgtgccgaattaaactgacattgttatgctttctcacattttcaggtacgtcgtcaacatcaccatcctcttctaccaacttggtccgttcccatgtccatctttctcatttactttctttaggaatgtgtgccgttgccattcttttcattgctgacaatatggtgcacatgcttggctcctggcttggcaattccaccactcttatggccaccattgccattgttttcattatctttacgaacatgtaaatccgttttcgtacttgcgtttgaaattgcttcattttctgtcttaaaaggttcaccgaaatgcgcgtgatcagtgtttttgccgccgtttcttccgttttctttttgcttggtgccggagtgattatgcaatttacgctgactcagcccagcaaatgggacgaattgccggcctacacaaatttcaccgatacggcatgccaatgtgccatttctccgatattaaatcctatattttcaggtgattttcattggaatgtcaatgtacgcgttcgaaggacagacaatgattttgcctattgaaaacaaattggcaacccctgaagattttcttgacaattttggtgttcttccaacgacgatgtgcctttgcacggtgaaaacaaaaacaattttgcgcaaataatgttccctatctttcccatcagttttttatgatagcgattggattctttgggtacaacggtttcgggacgaatgtcagagagacgatcactgtaaatgtgccgcacacggggttagtatgccgaaagataaatttaaatgaaaaatggttgaaggtaatcgaatgaatgcaaattccaagcctatttattaatgggtttttgtaattatgctagtaactcttgctgattcagtctctattccgccgtcaatggctttctgtgcattcagtccatgcttggccattccattgcgatgtacgtcgtgttcgacatgttctacaagggattccgcagaaagttcactgctcgttttccgaatgtcccttcccttgtgcgttttcctttgttaacagtttcattttatccaattgttcaggttgtcgacaaagggtttcgcgtcggttgggtttttctcacttatctgatggccattctcatcccccgtttggctgtgatgattcccttggttggtcgattttttaaaatcatttttgcatttgcttttaggtcggtgtcacttcgggtactttgtgcgctttagtttatccaccattttttcaaattgtcactttttggagcgattggaaagtaattatttaatatattattattattattttattttttgctctattccaatttacgagttcaatcagtgaccatccttaatttattggccacaactttttatttcttccttggtcaatgtctatatttttggtatccaacgaaagtttaagtctctggaattgattagcaaatgctgacattaagaaactgagtatggtcactgattgaatgcgtaaacattgattgactccttgtgaatgtatggagccaaaaattggtttttcgggtgaagccccgattccccagtattgccaatattactgctaattatgtttaatgtctctaattcagttgaatatgagtcccgttcgacgtgcctttctcattggacgtaattgtttcgtcatcgttctcggcttctttgcaattggtgccggcgttgcagcaaatgttctccaaattcttaacccgccgccttcttagcctgtggctttttactccttacaattagtcgtctttcatcttatttactgtaaaattccccttcccctccccccgggcatttcagtccctttccttcgcttctttcccagctattttttcactgtcatttccatttttgtgacctatgcatttccttccagtttcatatcttttcattgttctattctttgttatatttacataagaattaaagtatttattgttcgtttttaagtgcaattagctctgaataaataatttttaattacttctacattctaataaaatttgacgtttaaattgaacacattaaaatactcatttttatttgtgaattttgcaaattttagaaaaaaaaattgttttaaaaatatcaaatgccaaagaaaaaacctgcgaggctgttgaattttgaagaggaggaagatgaggaaatggagcccgaattggaccatgagctattcggaaaattgacggaagaattggacgaggccatcgaaaagtctatggaaaggacgtacagcgacacattgaacacattcaatgaaattctgagaaatccaagcaaatgttagttgagagatccctttttgccatcttcgggtaacatatgatcgaccattttttggactgaatttaaaattgatttaaaaccgatgggaaggagaatcactgcctattttcagataattgaattgaattaaggaaacccttttaacctgcacgaattaagtttaagcatctgaacatcgcatcccgactttgttcctttgcggccattgtttggattggaattggctttttaatcgccttcggaaatgccacaagaatttgacaatcaaaaacaaagaatttgccgaagtgtcagaggaattgacgacggacagcaaaaacgaaagtggcgaccatttaaaggcaaagggaaaatgggagggaatttaaaacgaaagattttcagaaaggcgggaaaaaagtgattttgtttttccaagacaattccttttccaagagagaagtgtttgagcgaatactttcactgttcggaaaaaagtgagtttaaatatttttattgggatttggaatatctcacaaaatgctggaggtttatttccggaagattccatgagaatgctaccgatgctagtactcttttttgaaaaaaagttcaattttatcgagataatctttttcccagtgtgttcgtccttagcaggcgtccaccactccccatttcattttcattcatcgatgaa

SEQ ID NO: 11663 - DNA, 4108 bp, Heterodera glycines
ctaggaaggcaaaacagttgtgccgttcgttgacccttctgctggagagttacatggacaaaattgcgccccaactgtccaacatcagcgagttcatgctgctgcgcacgcaagacaacaacgaggagacggcgctggaggcgtgcgaattttggctggcatttgcggaaaatccggacgtgtgccgccaagtgttgcggcccattctggcccaactgttgccggtgctggtccggtgcatgaagtacaccgagacggacatcattttgttgaaggtatggccggcaaaacgcgtgtcctcccaacgcgtccatttctccctcccattaaaaaaacgtacgaatcttttcataagaaaattcaagtaaaagttttcaatgattttatgaaaatttatgatgaactactaacaataggttattttcaaaatttttctttgtaagatcttttttttgaaaaatttcgactgaatatctcgtttttataactttttcacaagttttcatattttattaaaacggtgagaggtggacaaacaaaaattcacgggttaaatcaagaatgagctaaattagaaaaaaattttatggtttttaaatttatattcccattttcccctccacagggcgacgttgaggacgattcgaatgtgccggaccgagtgcaggacatcaaaccgcgcttccaccgggccaaaacccaagggttggccggctcttcttcgtccgcgcccgcgctgcccgtcgatttggccacgggactgccggagcaacaaccgccacagcagaacaacagcgagggggatgaggacgacgaggaggagggcaccgacgacgaatccgccaccgagtggaatttacgtaagtgttgttagcctccacgtctggcatttgttgattgttgaaagtccgggacattctaacaattttttattttcttttttttgagaactttggaaaattaaattatccttttaaaattaaaaaaatggaatgtaattcaggcaaatgtgccgccgcttcgatggacgttttgtccggcattttcaccgacgaattcctcgtccatttgctgcccattctcaaccaatcgctgtcttcggaccaatgggaggttgtcccattccccccaatcttgaaataataattgaatttttaatttaccaattgtaatcaaactttcattcaggtgaaggaaagtggaattttgacgcttggtgctattgctgagggatgtgtcagtggaatggtgggtgaacttttttaaaaatatgacccaaatttttttattttgacaggtgatttttttcagaaagaatcttatttgttagggagtttttcctaagctttcaattaaaagaattttttcttcaacgataattttacgatgattttttcaaaacttttcaaaaaaaagtcacatttttttttgcttgaattttttataggaaaaaattcctaggatcttttaaaattgcaccctaaacaatgactttcccccgtcagactccgcatttgccctggctcgtcccctttctgatcgactctctccaacatccgcgttcgctggtccgctccatcacttgctggacactgtctcgctactgtcactttgtggtccaacaaccgcaaagcgaactgttcgccaaactggtcaaggaggtgagctaaaaaaaggggaggatgtgcatatggtcgaaccggctgacaatgagcattccaaccacaattcatttccaattgaaaatggtctaactgataataatgagacacaccgagcacatctcgagagaaagtgcagatatatgaaattttgaaggataaattgtcgaaaaattatgatttgttcaagaaaaatggtttacttgtgaatcaagcgtaaatttaatgtcatggagcttaacggtaatgatgggattgattcctgacatttattgggccattggaaaaggcaaaagtgaaatttgaaaagttaaaaaagtttcacgctttctattccccaatattgggaggcaacaaatgcttaaatttttttgatattaatcacttacttttctgcacagctgttggctcgtgtgttggacaagaacaaacgcgttcaggcatgtgatgagtaattttgatggccagtaaaattgtacaaaagttgggttaaaatgatggcggatgactcaatcatgtgttgtggcatggctcgtgtaaaattcactgtttgactcgagtcaaaacattgctaaaagagtcaggggaaccggtgcaaaaaggcagaaaaagcaagaaacgatgcttaaaactcccgagcacaaaaaagacaaatataaaaaaacatttaaatttcataattatttaatttattttaagtttgttcatttattggagaggaatttctcttttttcaggaagcggcttgttcagcctttgctacattcgaagaggaggcgtgtaagtcgtcttttgtagttctttgatgttctcaatccttttaaattatatgtgtttttaggccatgaattagtgccttatatgcccgagatactcggcactcttgtggaggcgttcaaaagatatcaggtgaccattttgtggaaaggggtcacgcatgaaaaacggggtggggtcaacaataattttgtcagtcttattttgaggcaaaattttcgggccagaactttttgtttctaaatagggcaaaatataacaaacttgatttatttgaaagctatttgaatttatttattgtagaagtgattgtttatcaagttcgtatcgatccaaattcaattagaaaacaaaggggacggacccttaaatttaatgtaaattatttccggttttaaatatttctttctcaaaatggaattattttgaaatacaatatttattgtcccttcccacacttttttaggccaaaaatttgctgattttgtacgacgcggtgggcacattggcggacagtgtgggcggcaacctggcagagccaccatatgccgaaatgatcatggacccgttgatgtccaaatgggcccagttgcgcgacgacgacaaggagctgttcccgctgttggagtgcatttcgtcggtggccaccgcactgcacaccgccttctacccctactgcgagccggtcagaacagccttattgcataaattgggaaaaaacagggatagagtataattttatttggttctaatatcgggagcagttcgtcctccccgtatcgtcccgccccggaaaattcaatttttcaagaaaaaaaaaattagaaaatcttgtgtaagttatgaattttatttttatcgcgtttttctagaaactttgaacagtaatcggttcaaaaacaaatttaaatagaacttatacgacatttatgaatagagcccggattttgaggcatatgccttcttttttgctaacttgctatggcctaatacgcacgaaaaacgagtttttaacttggttagaagcttctagtttaaacttttttgtgccttttttgcaattttggtgccttatggcgggcacgtaattttggtgcccttttcatgccttttttagtattttatgcaaaaaatggaaaataagtgcctatttgagaaattttcatgcctaaaagtccgggctctatttatgaaacacactacaattaatttacttaaaatacaatcacacacacaaaaaaaaaattaagcaaataacagatattagccaagaaaaattttaaatttatcagttttatttttctacaggttttccaccgctgtgtgcgtctcatttcccacacactcgcaatcagcgaggcggcgcatgaatttagtaaatcgaatttacaaaaattttctttccattctcggagaccaattattcctttttaaaagaccgagaagctcaacacgatcagccggagaaggactttctgatcgttgcgctcgacctgctctcggagttggccgaagcgttgcgcgattacattgacccgttggtggcccaaagcaacatcatccagctggtgtacatttgtgcacaggtggtgaaaggggccggaagactaaatacaaatggcaaacaacgacaaaacgcactctaaactgcttaagattgtgcaaaaatg

SEQ ID NO: 11664 - DNA, 4961 bp, Heterodera glycines
aaaaaattttttggaattaaaaaaaatttggaaaaaacttcggcttcggctttggaaactttcggggttttgggcttcgagcttcggacttcggctttcgaataaaattgggcttcgctttcggcttcggcttcgagtgcaaagccgagcttcgcccagccctgatctaaacccctcttttctttctttctcccctttttctctctcccactctccttaataatcgcaaaaaccaacctttttttgttgaaaatctgttaacaaattgcacccaaatttttaaaatttcccccggcggcgcctatcggcaccgtccggacccctttttcccaaaagttttttgaaaaagcgctccgaaaaaagtgatgtgaaaatcaaatctgaatttctattaatattcgatgatttagtccaaaaatgattaattgtttgaaataattgaagaaaatttgtttgaaaattttcattaatttaatttattaaataaaaaaccaaataattttgtattattttcacttgatataaattaaaatttgaatttttttttaaatttttaaaatttttttgaatttttaaaatttccccctgcggcgcctatcggcaccgccggaccccttctttcccaaaagttttttgaaaaagcgcttcgaaaaaagtgatgtgaaaatcaaatctgaatttctattaatattcgatgatttagtccaaaaatgattaattgtttgaaataattgaagaaaatttgtttgaaaattttcattaatttaatttattaaataaaaaaccaaataattttgtattattttcacttgatataaattaaaatttgaatttttttttaaatttttaaaatttttttgaatttttaaaatttcccggttggtcccggttcccggtcccgaaaaaaaatcgaggtcccggtcccggcttctcaggtcccggtcccggttttgcccaaaattcccggtcccgctctactctaataaaaatgccataatatggacaaatatggaaatatggacataaatcgcgaaatatggaaaaatatggaactccatcctagaagcttcaaaccaagctaaaaacatgtttttcgtgcatctcaggccccccacagtccaggaattccccgccctacttataaccctaattattaggtatagtccattttgcttaatagtattttttttgcagaaatttaatgattgcagaaaaaattaaattataaattaagagaataattgcaagtttttagaaagaagtaccagtccattcattacttaaaaaatcaaaataaaaattggatttttttggggtaaaagctctaattcatgcaacaactattattttttgataaaataatgcttcaaattgttattgggtaaaaatgcgcggtttacgccagaatttgaccgatttgaacgtatatttttgaaaaaaaatttcaactttttgttcgaattcgggcccgggattgggaatttggcaaatccgagttcagattcgtgatcagcaccctcgaaaacccctgtatacctatttttagctcaaaataaaaaagttaaattagggacccccattcttcaggattccttattttcatataaaaacaacaatttaaaataattatacccctaaatatggaactttttcgaccttattttcgcccttatttacggccttattttggacttttcgtccttaaaaatcccagccctaataataactagggcttatattttaggcaaatgcctaaaatttttgcgcacttgatacgcacaattaagcacgaaaaacccgttttccgcttgggggtgtctacaatggcttttataatgcctatttttgcctaatttcgtggtttttgtgcttaatgcctaaatgcatatttttgggcctatttagccatttttgacgcctttttcaggattttgggaaaaatccttggatcgctgatcacaaatccggtatccatttagactaattccggacccaggaccctaattcgaaagttcaaattttggtctaaaacggcttaaacaaacacacgaacggaaacatgctgaaagccaatcagcagggggacaaactacagtattattaaacaaaacaatatatagatgaacaatacaatacaattatttcatttcccaacatcctcctcccctttttcagtcttatcctcagcattatcatcatcattatcatcatctttggcattgttttgcgcttggcactcctccgtgtttgattgatcacttccatcagcaccatcaccaccattattattggcatttttgttgccatcgccgagaccgctgctcatcaacatctgcaggagacgtgccgccgcattggtcaccgtccgtgccgggcttggcgagcgcgacgtctgcgtgtgctggtcccgatgggtacgcgtgccgtacgtttggaacagacggcgccggtgctccgcatggccaacccgtcgcagcagagtgcacaaccgttccacatagtcttggtgcttgtatatgtactccttgaaaaatgcgggcagtgataagaaccaatgaatagagttccggggcatggacagacacatgcctttcccagaatgggagcggctttaattaattttctaatttttttttaatgcattgtttgaaaaaaatttcattttttataaagaaaaaacatagatttttgtttaacttttgaaagaaaaattttttgtaaaaaatttaacctttttatttgaaaaaacctccatgaaatttatgggggggggggggtgtcatggtaattttctgctttgtggtccggattttttgatttttccaaaaaattgctgaaaattgttccactttcgcttgaaattttcttaaaaaaatgcattaaagatgaaaaaaaatcatgccccctattgttgtgtttttaattcaaatttccggtgccgttcaaacccgaaaagtgccaatgccataccaaaatgcaataaaaataattaattaataatttgtctgcccaatttttgaaaatcccaaaaaatgttcccaccatacaatcccacatcattcgcgcaatgtccgcgtcatttttctcgtccattgaaatgttgcggaacagcggcgcactgaggcgaaagaacggcgcccgttgttggatgcaaaaagcgccggcccgcagcaccggcaccccttcggtggcagcaaccttttgaggggaaaatggggggaaaatgtcaactttttagagagaaaaaatctaattttccatttttaaatagggaaatttttaatagcaaaaacagaaaaaaacaatgaaaaatttaatttattttccatttttaaattggccaaaaaattgtggaaaaaggtaattaatttgtagggagaaaatcgatgaaacatttttacttttcatttttatatttggaaaaagacactaataaattaaaaaaaaaattttttttttgaaaaatttaagttttcctttaaaaacatttttttgtattgatacaatacagtacctggtcaaccagaatttcaccgatggtccaaaaggcgtttattgaggtgagcggttgggcgatccagttttgcgaaacttcgatataagtgggctggaaattgcattcgaattaatgacactttgtttttaaaaaaaccttcaatggagtgggcggaatgacaccggtgccaatgctgagaaagcatccaacgttcacggcattgggaaaattctgaaaaaacgaaaaaaaaatttaaaaaatttattttgctgttgttattggtgttttaccttgtacttgttgaagctgttccaaaattggatttcctggagcagttccaatgacgggttgttcgcaataatgcctgacaaaaatgagtgagggttatggacagaaaaaacacatattctaatgggatggaatttcatttaaatttcgaaaaaccgcttttttcttgtcaccaaatgcattttgattgcccaccgattaatacaacaacaacaacaacaacaatcaaagcaccactgttcacccacctccatcaatgtatttgttgtccacactggcaaagtaggtaggggcttaaaatttttttgtaaattaaaaaaaaaatttttttttacccgccgatgaacgccttaacactttccacagcaacaaatcgtcgggcgtccggtagccgagctcctcattctcctcgtcatttgtcggcagtttgtagttgcgcatcagctccagctgaaccgggaagaactcggcccgcgtggtggtgaacataagtctggaaattttttttttaaatgaggaaataatttcaattttcaaattttatcttcccatataaatatttttcggcaacgtccccgaaattttaaaaaaaagaagatattttcaagaaattttacaaaaaatttttttgctttcaacgacacaaatttttcaaaaaaaaaattccaagggtttttttccgagatttttttcggcgatgctatgtccctgacacattttgggaacaccgaagcaaccttggccatttgaggtcgctgaacattgtctcggcccccatctcctggcgaatgaacttctcgagcacctgcgtgttgtgcggcctacggttgtcgaacaccatgtctttgaagcgcaagtacagctgcaaatgcatgcacacaaaaatcagtaaaataaaaaaaattatctaatttttttgagtttttttcaattccaaattttcagcgtaaaaaataataataagaagtgtttaaaaaacccaaaaaaaaaaaattttttttttcatgtaagatggacagacaaaattctctgcttggataaataaatttagattttgaattattgcaaaaacatgttgaattgtcaatgcgataaaaatggaaataataaaaaataaataaaataaaacccgctgaatttggtgcagtgtttggcccattgcgagcccggcagagac

SEQ ID NO: 11665 - DNA, 1089 bp, Heterodera glycines
cacccactcactcacctgaatgatgaccagcccacggatgccaccgccatccaacgaaaggacattgatgaaattgtggtcgggcggactgtcttcgtctgaggacacttcgggcaacttttccaacacctcgtcatatatgtccttaacaacatattgtcgcaaaattgaaaattctccatttatttctggccatttaaatggcaaaaattttccaaaaatcgctgaaaaatgttttaaaaaattttttcttgcaatttcctaatacaaaattttttttttttttggaaaacttctagggttgaaaattttatacaaaaaatttttcggggaaatgaggtgcacccccatgtcaggtcccggttttttttcttcaaaatatcgagctctacaaacaatgaactccgcgaactccgtcccccccctcccaaaaccaccaaaaaagaagaagaaaagaggacttaacaaactctttacattgtgctgaatgtccaacagtttgttgaagcggaaatgttccttgtcaaatgcccggttttcaaaatcctccaccgtcaccgacgtgtagctggccggctttggtgccgttgttgatgctcctgctgctggttgtgaggaggttgctggttgagctggtggtgccgtagcagcagcagctgcggtggccgacgccgctgccgatgttgttgaactgcttgacgacgatgacgatgccgtcgaagatgttgaagtggtgttgccggtggcggatgatggcattgaactggtggacgtcctcttcagctcgtgcaactgcttctcgttgacacaaccggacacacagccaacctaaaatacggggaaaaaaagaattttttaaacacaaaaatgcgtatttgtggattcacaaaacgtgagagatggatgtgtttacccaatttgaaaccatgaaaaaatttttggaaggcaaagaaaaaattttttttatatatatatatagcaaaatctgtgcttgttaccttggtgagtggacaacgccgagcatcgcatatgatcagacttttcagcaaatcaaccctgaaaaattttgacatatttaagaggacaaaa

SEQ ID NO: 11666 - DNA, 1869 bp, Heterodera glycines
  misc_feature (125)..(125): n is a, c, g, or t
tgcataaattataagaaaatattttatatataaatagagagagcattcgtgttgctcgagagtcaaagtttttcgggagtcgagacaagatgaggaaggagtgtccccattttcacttttttatnttttcatgtttcgtttagtgtttttaatttttttttctatcattatccgtttcggcagaccgaaatttggacgaaaacccgaaaatttacactcccctaacagccacattttggtgaaaaattaaggtgctaggtcgatccaaaaaaaaaaactcagtgattgattggtcattttccgaaagcctcggggtaccaaaagtgcctgatccggaacccggaccggcccggttaagaacaattttttgttcagtttttccagggctatctcccaggccgggtaaggttcttgatccgttcgcttggagcccgtcaggggtcgggcattctgccgggggaaccggccactttggcgccagccattttggcgccaaacaatataacatttttatttctcatttaaattaaataagcttgatatgattttaaagcgcttgatagtccctaatagcctgcaaaatttcaaaaaaattaattgatacacaaaaagttatggccaaaaaacctcaaaaaactgactttttctggccattttggcgccgcacgctatttcttttgttaaaccgaatatatttttctaatattttgcaggctaattaagaacatttagacctatttgatggtatcaagattattttatttgattgggtaagaaaaaagttatgacactttaaagtccgcggcgccaaaatggcccgcgccaaagtgaccccgacccgctgtgaatagcattggctatcctcagcgtatcattctgattttgcatgtaatgaatagggccgcaacttttagtgacgaaaaataccgaaatagttaactaaaatagtgagtaaaaatcccaatagtgaagaaacagtgacaaaaagtccgaaatagtgacgaatagtgacataattttcagccaaaaattgagcaaaaataatttttattcactgattgcagtttcaaatgagtaggactgggatttttaagaacaaaaaacccaaaatagttacctaaaaatttttgccaagtaaatttttgagaaaattttttttcatttcatagtagttttgaaaaattttagctcgattcttaggggtgtatttttttgaaatttttttatgtcgattcttaggggtgtattttttggttttattgcatttttgttaaggaattttccaaaaaatgtcgaaatagtgaaaaaatagtgataaaacgccaaaatagtgatttttaactattttagtgacgaagtcgccaaaatagtgatttctagtgacgaaaagtgacgtccaaatgaaaaaattttaattagagcatatacggtaagtaccaagtagctgcgatccacacagatttattgctctaccccattttgagtgtaaccaaatttaatggaagctaatcttaaaaaagtcaacattgtcacgcattcatttaaatctttaactcaaaaattttcaatgattttttgccaaaaatatctcatgaaaaaaacatttggccaaatgcgtgtcttttcctaatcagctaatcacactgtaaggccgcgaaggaaagactggttcgtgagatcgtttttcaactttttaaaatgagaactcccctgccccagctttttgggttggagaatccgattcctactcccatccgaatttaaagtgacaaaaattgtcacttacaatgtttattcgcacacacataacatatacatacatacatatatatccacacacgcaattgaatgacaacagtttttttgggg

SEQ ID NO: 11667 - DNA, 3492 bp, Heterodera glycines
tcgtacaccgcgcccatggagtatcggttgttgcgctccgtgtcccagatgtgctgcatgacgaactcgacgaacttcggaggcgcgtcgtggggaaattccagccggtatccgtttgtcacctgcaaaaagggggaagcgattaaaaatggaaaattttttgggttttcactcaccgctgccgcgacctcgcttccgctcaactgcgcgaacggcgtctcgccattgttgaagacttcccagcacagcacgccgaaggcccacgtgtcgctcttctgggtgaagctgcggtccctcagagcatccggcgacatccatttgacgggcagttttgcgcctctctcgatttgctttgaaagtgccttgatcgccatgccgaagtccgagattttcacctgtggggaaaatgaacaaatttagacgtttcatgacaaaaaaaatttttttggtgctttttcacccaccacgccgtccgtgtagaggcagttcctggcagcgacgtcgcaatggatgatgcccttcgagtggatgtggtccagtccgccagctgcgccgaggcacatgtagagtttgacccgcgcgctccgccgctgctgcttcaagtagttggtgaggctgccgtccgtcgccagctccatgacgatcatcaggggctcctggccaaccgcgacgccgtagaactggatgacattggggtgtcggagctgccgcatgactcgcgcctcattcatgaactccttgatctgaaaattaataaatgcggacgcagacttccaaccccccccccccctttcctcacttgctctttggtgctcgtctgagacacctctttgatggccaccgccgctcgagtcccctgctgatccacgtagacgccactcttgacgaccccgaacgtgccgcggccaagttcattgcccaggatgattgaagtgtgcgacagctcccagtgcgcgcggggcacggccctgatgagagcgacgtattgttgctgaaaagggaaaatgaaaaaaaaagatttcaagctgtttgacttacagtggtgacggaaactccggtgcgcagataattgtcgacgaatcgttcgattgttcggaagcccttgtcggagttgaggtccacggtgaacattcccttgtgtcggcggaaagatgacgtggttcaggaagccgccgacgttcaccgacagtgcatacacacgctccgtgcccgaaatttcttctgtcatgcgcaccaggaagtccccatcgttcggcagcagctccactacgtcctcgcgcggcaactaaacaaagttgaaaagacattgaaatgtggaaagtgggggggggggggggggtgggcggtgactgctcctcaccagtccgtggtagtagggcagtttccacatgtcaacgtccattgtgcttggagccggtgcgcacgcgtcggtggtgtaataaaattgaaatacgagaaataatgggagagggaagtgacaaaagagtgaaatcgcatcccttttatgtaaccacaaaacacctcaaacccagcaattcgaaaaagtgattgtaaatgaaaattttttttatataaaagcattctttttcctgaacgtccttcatttgggctcggtcggttattaaatgcctacattcttcgtatcgtcaaaatgcatctctcattttggcctactatttcttttgagtgttaatagacaaaaattgaatttaattcatgacgtttataactcgatatgtaaattagaacagagccaaaatgcctaacagaaaataatttttaaaggacaaacatcaaacatcggggcatctaaacagtgaaagtgccaaaaaaaatttcaaggagagtaaaacgggattctcgtatttttccctttcccgtaatgtcatcgttattcattttactattctttccagatgaagagcattagcgatctttgcaatgaaataaattacgtttaacgatcaacaatgggctgatgaatgctgggtggaaaatgatggagaatgccgtcatttatttgtggagtaattaaatactttaataggaagatgttttctaattacattggacgtcgttcagattgccaaatggacttttcacacttgaaaagatattgcaatcggaacacgaggcaaccatcggattattggctctgaaatcaacaaacttttgaagacgaacgctgttgaagtggtcgctgaaacaggtctattgctttttcaccgcaaatccgaaagtttccactcatcattttcccccatttcagtccaatcgaacagtttcaattcaaatgctcatcagaaattgctgcagcgtttgcgtcatgcgattgaggacaccaacgcggaggctgaccgtctggagaacgactacttcttgttgcaggaacaaatagcagcaatgagacaccaattggttgtgcatttacgccgtcaactggagcagcagaagaagataaagaagcacataaagaaggaacaacagggaggagggaaaagagtgggagaaagcgaaagaggaggggaagacggacaagagcaaagggaagcggatgaagagaaagatggaggagggggagagaaggaagaacggcagagaggaggggcagaaaaggaaggcgatctatcacatctattagattcatgctttcttatgtgctttttaatgtcagaaatgtgtaaatattgtctgaaaaagagtaaaaacaacaccaagtttgaaaaaaaagatggatgaaaattttgattttaggtcatttgaaaaacaaatttttcttgaattttgaatgcaattagagaatcttacgggctattgaatgatacaaagtttaaataggtcgcctttaacaaaagttgagccttgtcgaaaaagacagtacgttggctttgttcatgtaatttactgttctatcaatttgctaaatctgagctcagcatttcaaaattttattttccgacgggagaacttaaggcagagttttgatggatttatcgttccgtggtcattgaaatacatttcatgatgatgaataaaacggaacacaataatacaggacagtctcaagatacggatatggatcgatacagatcactcatttcttccgttcgtcgttctagttctttccaccacgaaggcgcaagacgagatgaagagttgattccttctggatgttgtagtcggccagagtgcgtccgtcctcgagctgtttccctgaaaataagggttatgtataaaattgaatgttgcaacggcttgaaagttgatgtaccagcgaagatgaggcgctgctggtccggcgggatgccctccttgtcctggatcttcgctttcacgttctcgatggtgtcactcgcctcgacttcaagagtgatggtcttcccggtgagcgtcttgacgaagatctgcatccctccacgaaggcgcaggacgaggtgaagagtggactccgggaagatgttgtagtcggcccaaggtgcgtccgtcctcgag

SEQ ID NO: 11668 - DNA, 1190 bp, Heterodera glycines
aaataatctacaaactaacactagaacgttacagttaatattgctgtgactctatcacacatacaagataaataaaatcgtttataatctacagataaaattcatcttttttataaaattcataattgtaaaaaataatcattagatataagtttatatcaaaagaacataataaatatgatttaacaacaagaaaatattttaaattccgatccaaaactattaaaaaatgaattcaaattgaattaatcatcattaagaaattattcattcaacaaaatattagttatacaatctattaagtgcgaatgctaaatacaaagtcatataaaaaataaaaatcttaaaactattctatacaaataaatgtcttaaatcagcggagtataatcacaaaataaaaagataaaataattattaaaagggacacaatcactgatgaaaaacggccatcgtgtaagcctccaaaagtgaagtacgaaacaacccggttttaacaagataaataaaaaatatataaaccttcctttattttaaaattttgaaaaatttgaaagtgatgaacttaaataataaacgtgaatttaagctattgatttaaattacttaaatattaaattaggatttagttgcaaaaattatcgagaagaatgtaaaaatcatttgcaatactttaaattaaaatttattcaaaactatctcacatgtcagcttcaaaaaattcaattcaaaataaaaatttgttcatctctcagtaaataagtcagcagcatattcattctaaaaatcttcaataatattttattctgtcaatattttttttattaacgatataccattctaagtaatgaatcatcatgcttttcagttaaatttattattaaaaaattatctaaataagtaatcaaatggttgcttaataaatattatgattttcattaaattcttattatttgtgatattttacagtgttttaatttaattttatgtcatgaatttattaaagtgtattcagttagttgcttttgtttagttgtttttttaattatacttttatttttgcattatttttgcctcaatttaaattttgcaatgtttttcgttatttttcgtttaggtattttttttaagtaaataatcatgtacttacctaaccaatttaaaaatgttttaaaatcattatatttatt

SEQ ID NO: 11669 - DNA, 3566 bp, Heterodera glycines
gtgctcaccttacactgccgcatgcacgttttccacgtgttcatgtacttttgggtgcagggctgtattttggagcacaggcactgcttcaccttttgtgcatttgccacggagacaaacgccgccgaaatgagggcgaccaacagagtacagcaggaggaagaagaaagcatttttataattataataattaccgttattctacaattaagggggaagaggttcaagttcaaacagtacgcgctcaacaaattagctctgatttgacagttggcttgtaaaaattgtggggtacttgtaggtttgctacccccccccccccataaaaatggctctaggaaaatccggctctaggaaaatccgacaccggaaaatccgacactggaaaatccgacacaagcagaaaatccgacaccggtggaaaatccgacacaagcagtaaatccgacattggaaaaaccgaccccaactttaaatttaaaaaatatttttgattgtttgagttaatatctggctaagtttatcaagttttcgatttggatttaaaaaaattaattgattctgccattcgatgggatattgatggcaaataataaaagggttgtcgattgttgcgagtcgcataaatctctgtgagattcatgtcttgcaccaagtacattcttatgcttcatgccctttcatctgattccatttgccggattgttacaattttttgagatgatcaaaaagaacattgaaataatatgattattatatacctacctttaatctattttatagcaataaaatatttattttaaataacttaagtatttaacttttattatatgtattttaaatatttactaactcaaacaatcaaaaattatttttaaaatttaaagttggggttggtttttccaatgtcggattttctgcttgtgtcggattttccagtgtcggattttccgcccccccccccctcccccctttttttttgcatctcagtaaaaggcgatgcgatggaacagcgatgaaatggccattaaattggccaatacattatcgattaggctcaaaagatgtgttcaattttgttattaaattaaaatattattattcgaattcggctttttatttaaatacttggtatttttttaaaataattattgtctattttttttattctttattcgccaatttctttagccattgcattttttacaattgataattccataattaattccaacaacaaaattgactttttctaacttttttgataaattaattaaaaagtgaaataattaatcaaatttaaggaagcttttaaaattcaaacaaaaaatatcgccaaataaaataaagaagattaacatgaaataatttgaaattatggtttaaaatgcatgcataagtgaatatatctaaaatttataaggtacattgtttaatacctacaaattcgcacacacaataagtatcatcacataataaatatatataaaacaattgaaaatatccttaggctataaattacatatactgattatttcaacaattaatggcataatttgatattttgtttagaaaaataaaaatcagaataaattgaattgtataatatatctattaatgattttattaattctttgtatttgtttataaaaaacaaataaaaaatataaaaaagcaattccaattccgggagtatatatgctataatacgaacttattattattattattattattatttttaagcttttacaaatatataaataaaaattaaagtttattataaaaacaatattttattgtaaaatacttaaaattatttaatcattgatttaataatattcaaatttaaaaatttacgtaaaaatataaaaattataaaattttggtaagcctgagcaacatcaaagacaaaatgactggtttagaagccatttgataaaaattatatgaatttgaggagcttttatttttatttactcaaattaccaaatgagaaaagtaaaaatcttaaataaacttgttctaagaatctaaaactttaaaaatatatttatcaattttacattatcaactaatatttgaaaaataagcgaaattaatataaaaaataaagcattataaattacaataaaaagtgtcagtaataatacataatggagtaaacatgtagctttattgtaatctttgaaatgagtaaaaaaataacccgagaagcttcttgcattaagaaagaaaattcagaggaaatagaagaaccggaaatatcaattgagaatgttaatgatagcaaaattttgacatatgaagatagtttggttttaatgaattaatatattatgaaattgttctaagaataaataatcaatgtcattatagtaattctgcactggttttttattaaaaaaactatttaaaattttattgatttataatattttattaaatatgtttatgcgattttatattttatatttatttgtctcttatgagcaatgcagagttaataatttctgtgtcaagttaattttttgttaataattattttatttatactatttaaaatttttcatgtcaaacatttatttttatgatgaaaatttttttctttgcaattaattcaaatttatttgttattattcctattaaattccaatttattataacattgcccatcctttattaattaattttttataattcatttttaatttttttaaattaaatatcgatataaaatttttattttattaaaaactccttcaactatctgaaaaattgagtttttagttttttaaaattttgaaagcttcatttaaattaaaaacaaaaaattaataatcagaatgaaaataaaatgtgaaactgtgaatgcaaattttcttacagaaaatcgggtatgttaaaaaattttaataaataattgtttaaaaaaattatttaacgaaagtattttattgatctacatattatattataaaaataaaattcataaataaaaagacaattaaattgttacgcttactcataacttacaaaatcaatttattaaattagaaaaatttgaataataatatgaatgtataatttaaactataaagcaaattcatcatcttattgacaaaatttttttgactcggtaaggcgctttgacaaagacggctttcgttttgcaattagtcggtcaacattcggaaattggtctcgaattttttcggcaattacgtgcaatcattttaaaagaaaaaaaacataaaagctaaaatttattaatttttttagcgcaaaatcaacaacaaaagcgaaattttcgcttttttgcttattttgacataatttattaatttttaagaaaatttaaatttattcaatattctcgagaaattttggcgaaaaaatgattttttgaaaaattttcggtttttgggctcaaaaaggctaatttagctgatgggggccgttctaatagaggtttttttgaaaaatgccaaaatatggacataaaatatggaccaaaatgccaaaatatggaaaaatatgaaatatggacataaatcgcgaaatat

SEQ ID NO: 11670 - DNA, 2518 bp, Heterodera glycines
tcttttagtaatcaaaagtatttggaattaattattctgagcagtaatggttggttggatgattcacattcaatcagttgtcatcacaaaaaatggctaacattaggcaaaaaatccaaaaaaaaagtaatgtgttgaattatacaattagaagaaaaaataatttatcgattttattaataattattttttaattaaatgatggagctgaaagaaaaaataatttatcgattttattaataattattttttaattaaatgatggagctgattgtgagttattttttgaggttttttgaaaaaattttttatgtaagcttcgtcggcggcataacaaaactcaaaaaatttaaattttcattatgtgaagcaaaggaaaattatataaaataaattaaattgaatgaccacaaattaataatttcattttgctattttatgaaagcgagaaatcaaatgcatttgtctcctctgaataatcaaaacgaattatgcatttgcgaaaagcaaaaataatttccataaattccattagagcaatgcgttagagaggagttttaagcaaataaatattctgattttcaatcacaaattctcttcacttggaaaatttttataaaaagaattattttgtataattaacataatttataataaaaaattatacgcattttaaataattaaaattcacagttacagtaaccaaccaaccaaccaccgtgtgcgcaatgttcaaacttttgactgcattcacttttgtgctcgttttgagcattgcatggtgtagccaatggaagagaccgtaaattttcattgaaaattgaaaaaaaaattttgactcaaattttttcttttcctttttttgatcatttttcagttatcagtcagagctcgacattttgaaaaaaacctttacctggacctgtattccatgtggacctggacttcctggacaaaaagccaggaaaaatccaggctcttcaagacctggatccaggcctggacctggattttttgattgttttaaaaagcaaacaaatgtttgaaaaaaacaaataattgctgaggaacatctaaatattcatttttcagttatcgatttaatgaaatggccatttaagcaaaatttttgttttcaaggacgactaattgtgagaacaaattctaggaattctgaaaacaatttatgtgtataatttcaggcaatttatatttttttatttttgaaaaatttttagcttctctaaaggcacttacataatccttttatggaaaatagccacttctcaaaatgccttaaagtttttttattagcttgcaaaattgcacaatgccatagaattttaattttaacgactttttcggcattttttaacttgtcacattcaatttttagcccagtttgctgtgacccgtgctccaaaaagtactgggactgcaaaacaaagtgcgaaacggacgacccggacaacatggcgtgcgagccgaactgcacttttgcgctggacaaatgtgcgaaagcgcactgcaacaacaaattatgcccacgcccgaggggcaaatattgggaaatcgatggatgatgggccaaggaaaagcgcaaattgtggaaaaaagggaattaaaaagtgtgataatgtgttaaaattcactcacactaattaaatggatggatttgaataaatgtggtaattaaatacgaaaagatttgctagtgaatttccaaaataaaatatttggtacttttccactgtgctcgctcctcccccgcccccccccccaaaaaatgtcattatcccgacaaatcaaggcacttttctaggtagtttttttagacgcctgatcaagaaataaatttcacatcattgatcaatcgaatcctctcccgagagggaaacgatagggaatcgattggtacaagtttcagggctgtcccaaaaagtttttggaaaaagcgcgccgcaaaaacatttttatgaatttttgatttggaataaaattttaaaaatgatgattttcaatcccaaatgtgactttttgtttgcaaaatgatgatattgaaaaatcccggttatagtacaacaaattttgtgttgggatgatgcggaccatttttcaaaaaccaattacaggatttatggcttacaatttgtttccgtgtgtttaaaccaattttgatcaaaaatacgaaattcaaaatgtggacttagactttttattctaattcaggtcaatggtttaatttggaaaaaataaatcaattaaaatcaaaacataagaaatgttgcacaatttaatagtttttatttgagaaaaagagacaattttttgtctgggatcccaaaaaaaaataattccataaataccacaaattcatttttaataacatgaaaatatttgtataaaaaattcaaaaaaatcgctcaattttcttattttattggtattaatgtaaaaatcgataatgccgtgattttttcgaaatgaaaaatgtttattttaattaactataatcagt

SEQ ID NO: 11671 - DNA, 1345 bp, Heterodera glycines
tcgtgaaaacatttttatggggcttttggggtctgagaaccagaatccaacattcattttgacgaatttcgaattccgggtcccgtatttgatcataaaatcgagaattctagattttcaacattctctcgtttgttcctaaattgaccaaaacaagttaaatttagtcaaacccatcgaaacatcaaaaatggtcattctgtacaggtatgaacataaaagtgaattttgaaaatttgaatgttcaactttttagaaaaaaaaaaattttcttccgaaaagggggaccttccatctatagtattacccatgactgtatgcgattccgtattttttgacgccaggggcttatttcaatttcagtcatatcagtgagtgatatgatgacggaaattgaaatatgccccagaacgacccgcgactcaccggtcccaccccttataagccattaatgtgggttggtttaaaatctaactgtacctcttttcactaagactttgatcccgatgccacacaaaagcgctaatgcaacggctaagagtggcccaaaaatgattgtaaggacaaaaactggaaaaagaaaatattatttaacaatttaatatatggtatttcatttcatttaaataataataataatggtttttatttatatgcataaatttagaatattattttaataaagttttcagcaaatttgtttgataaggaatttaaagaccaaaaagtttcatttgcgcaaaattaaattttattagctccgttcatttatcagggcatacaaaaaaatttaagttttcaaagtgtcaattgaagatttttttgcatatcacagcaaaaatcaaatgcaattttaaaattaagaaaattttcaagaaaatattataaaaatttaaaaacagcgaatatgcatataacccggcccctaaaaataaatccatcttttatcagttcgaatttaaatgtcccgacttttctactcccggcaagtcccggtcccggtttttgtcaaatttcccggtcccgctcaactctacttttgcgtgattgtgttcacacgaccaaagcgaacttcaccgtcagcactcggcttgtgaaaaatgtatgaatgaccgttgtgttgaagctttgtacggttcttttctgttagaattgcctgcattttctaatctataacttaaacaaaaaaattattgtcttataatttacgagaaacatcaaaatgttgaaaaccccctttctgtttttgaaattttgccgaaaaatttcgaaaatttttggtatgaaaatggcccaaatgccttagtagggaactggcggcagggaatcgggcggtaaggaattg

SEQ ID NO: 11672 - DNA, 2211 bp, Heterodera glycines
gcggaaattgtgaattaattctcagaaaaatggctatctctttttagggcaattttttatcttgtaaccccgatgctaatccgttccgcagagcctcttcaaaattttttccattgccgcaagagttgcggaaattgtgaattaattctcagaaaaatggctatctctttttaggacaattttctatctcgtaaccccgatgctaatccgttccacagagactcttcaaaatttttccattaccgcaagagctgcggaaattgtgaattaattctcagaaaaatggctatctctttttaggacaattttctatctcgtaaccccgatgctaatccgttccgcagagcctcttcaaaattttttccattaccgcaagagttgcggaaattgtgaattaattctcagaaaaatggctatctctttttaggacaattttctatctcgtaaccttgatgataataaggtccgcagaatctaataataatagatacaatgagacttgaacttttgtaaagaaaattataaatgaaaataatcaacaattaattaattaggtaataaaatcttttttggaaatagcttaaacgctgcgatttatatatctattttggcttctttagtctttgtgctttcgaatgacaccaaaaagacaggttttgttcaaacatgaacaaagttattgtataaaaagcaggtattgtcaattgattggactcataaaatacctttggactcataaagtgcaatatagcaaaattaagtgccttttaattattataaattaatttgattttgtgcgcttttcagcaaattgccattacaacaaaagaatcattgcgagaatttaaacatctgctgacccaactgtacggcgagcaaatatttgagtgccgtgggacgttgtcccttatgttggatctcgtcgaaattttggtgagaaaaccgtttttggtcgattcctaaagtgcaaaaatcaaaaaaacgattttttctatgatttttttcaatttttaattataaataagtaaaatttacttaaattgtacaagtttttttagatctcgaataaaaataattaaaatttacctaatattaaaaaaaatcattaaccaaattactttgaattttgaaatattttaaagttcattacaaatggattaaaattaaaaaatgaactcaaattataatccgcttcaactataaaatttataggaattgaaactttaaaatatttaacaaattcaaagtaatctggttaatgatttttagggatgcaatttttaggctctaaaaactgcaaaaataggtaggctttaggctctaaaaaaccccaaaaataggcactaaaaaatgaaaaataggcactaaaaatcctcaaatttaggggtgtaaaatgacaaaatgtattcaaaaaaataaaaaaattaggccaaatcagtattgagataaataatttttaaatcacaaattcttgtcaataaaataaataaataaattttggagatgaatttttgaaaaaaattttcatttcttagggatgtatttttgaaaattttcgggtcggttgttaggggatattttttgaaaaaaattttacgttgattcttaggggtgtatttttcgtttttattgcatttttgttaacaaattttgggcaaaacgccaaaataggcaaaaataggctctttaaaaaatttttaggctttttaggcgctaaaaataaaagcctagaaaataggcactaataactcgaaaagtagcttaacaacagtcgaaaaaaacatgtttttcgtgcgtttcaagccacggggagctcaggaaaaaaataggcttttgcctaaaaattgcatccctacttattaatgtatttagaaaaaacgaatagagggaaaaacagcaaatgatgaacaccagcaatgacaactcgagaatgaaatgctttatttttactacacacatatatcaattttcattaagcatagtgatttttttaaataaaaatgactttttgggccagtttgaccctgaggcagtttgcttcgggcaaactgtggattccggcttgttcatgtgaatacataataataataaaataataatttaattctctgtcgaaatctgccactgtcgaaatcagtcactatcgaaatcagccactgtcgggaatgtcggaaaactgtaaaataaatgaaaatagttcactgtcgaaat

SEQ ID NO: 11673 - DNA, 3352 bp, Heterodera glycines
aaaccaatgcccaaattgtgatggtaattgcaattttttcaatactgtacaaaaatttttttaaaattttagatgatgaagttgacactgacccttcacccgaagaagttgagaaatggacgccgaaacaagtgattaagtgggaccagcgttgctacgagaaaatgccagctgaagaagagctttggcaagaattcctcgacaaaggagaggcaaatgtcagtaaataaaaattttgatccattttttaaattatttaagccgcaaccaggcactagcgcaccagccccaagcacagggctgagcactagcaccgtgtccaaccgttcgccgcaaagtgtcaggccggaggccacaagccgcgaccaggcactagcacaccaaccccaagcacggggttgggcactagcaccgtatccaaccttcgtcttaatgcgtcaggccggaggccacaagccgcgaccaggcactagcacaccaaccccaagcacggggttgggcactagcgccgtgtccaaccgttcgccgcaaagcgtcaggccggaggccacaagccgcgaccaggcactagcgcaccagccccaagcacggggttgagcactagcgctgtgtccaaccgttcgccgcaaagcgtcaggccggaggccacaagccgcgaccaggcactagcgcaccagccccaagcacggggttgagcactagcgccgtgtccaaccgttcgccgcaaagtgtcaggccggaggccacaagccgcgaccaggcactagcgcaccagccccaagcacggggttgagcactagcgccgtgtccaaccgttcgccgcaaagcgtcaggccggaggctacaagccgcgaccaggcactagcacgccaaccccaagcacggggttgagcactagcgctgtgtccaaccgttcgccgcaaagcgtcaggccgaaggccacaagccgcgaccaggcactagcgcaccagccccaagcacggggttgagcactagcgccgtgtccaaccgttcgccgtcaagcttcaggccggaggccacaagccgcgaccaggcactagcgcaccacgccaatatcaaaacaaaaaacataaaaatgaatgaatgatgaaaaatatttagacaaaattcaattcagtaaatattaatgcatgagaaaggtcagagaattgctggacgggcaaaagaaagagggggaggagagaacggggggttaattatctcaaaattcagttctgtacgatttttatttaaatatttttttataaataattttaaaaaactttttagatttttaaaaaaaaaatgttgtgcaaatgcggcgaatgcttcgagtgcgaagatgaaaagcgccgcctcaagcgcaatcgggagctcaatacccgcaaagagcaaattaagaactgcacaggcaatcatctagcaccggctatgatggacctcaaacgccggaatatggaactgtttaaaaaggcttataggccggtgaagggcgtcatcaataaaataaccgggggtgagtttaaaaaagaaattgaaaaaaaaaaaacaaaaaaaattttttaggcccttggaatgtagaatgtgaggtctgccatgagaccttcacatacttcatggtggagtgggaaaactcccggaccgacttctcgtggggtcccgggaggaccatggtcgaagcggataacatagtaaaaatttttgaaatttttttccagttaaaaaataattttagaatcagaaagaaattttggctcactatgtaggccaaaatgatctactccagaatgaggtggactattatcagaatcttggtaataatcctccgttgaatgtgtccccaatgggggaggatgctataattttgaccagggacgatggtatgccgattggtgcagaggtaaaatattaaaaaaaaaacaaaaaaaaacaaaacaaaaaattaaaggcaaatgatggggcacggtcggtggccggggaaagcatcgttagcaaaagagggggagggcagagaaagagagagagagagagaaagaagagggcggaagaagcgaagaaagcacaaagagatggagcggaagaagaagaagatgatgactttttcttctttgcgagaaatgggggagagaaacgaggggaaatggacatggaaagcatggtagtgaaaatgaaatataaatttaaaaattaaaattattaaacaaaggaggggtcagtcgccagcaccacaatgagcaagagcacgaatcgcaccaatcggagcagtggaaaaagaaagcgagagaaagcgagagaggcgaagaagcttagagggttggaggaggaggagagggaaaaaatgcaggagacgccaaaaacaagccgaccgaggcgcgggcgtgatggacagggaacgagcatggggacgggagggtgaagggggaagaattgcattttttgaaaagggggaattttcaaaaaaatgtttttgaaatcgatcaaaaatcatctgttaatttttttatttatgttgagtaaaaatttcaaaaattaaagtgcaaaaaaaaagagattaaaaaataagctatgaaaggattacataaaaatataaatcggctgggaattgaaaagaatttaaaatattattaagctgggaatgtaaaagttttttaaaaacggctggtaattgaaaagaattaaaataaattaaaaaaggggttgttgggaaatacgttagtaaagtttaattacaaaaaaatcaatttgagacgctaaaaattgttgttgagttttttggctgtatgagtccactctacggcacattgcgctgtgtgcgatagagaatgaaaaggaagagaaaaaagatagagaaagagagagaagaagagagaacatcataagtgtgggggagagaaaaagagaaaaaatgaccccccacacacaccgtccactcaataatattgagcgcaaaaaaaaatgccccccccccttcactaatccccccgcccgccaacgttcactgaccagcagcagccaacgacgccacactttatcgaattacaatttatgtaatatcgatgccgtcgaaatgtataaatttttattacaaaattacagtttaaataggaaaaaattttattaaaattacagtataatgaggaaaaaatgtggtaaaattccacccccacacacaccgcgtttaaaaaaattttttttaaatacagtaccccgaaaaaaaaatgcggtaaaattttgcgcgaaaatgggccccggacacctgccggtaacagattttttcacaccctcaaaggtgtgaaaacacatgttttcacaccaccccaatccctcagacggggcccgggccataactact

SEQ ID NO: 11674 - DNA, 866 bp, Heterodera glycines
ccccaagcacggggttgggcattggcacggtatccacccttcgtcttaatgcgtcaggccggaggccacaagccgcgcccaggcactagcgcaccagccccaagcacggggttgagcactagcgccgtgtccaaccgttcgccgcaaagcgtcaggccggaggccacaagccgcgaccaggcactagcacgccaaccccaagcacggggttgggcactagcaccgtgtccaaccgttcgccgcaaagcgtcaggccggaggccacaagccgcgaccaggcactagcacgccaaccccaagcacggggttgggcactagcaccgtgtccaaccgttcgccgcaaagtgtcaggccggaggccacaagccgcgaccaggcactagcgcaccagccccaagcacggggttgagcactagcgccgtgtccaaccgttcgccgcaaagcgtcaggccggaggccacaagccgcgaccaggcactagcgcaccagccccaagcacggggttgagcactagcgccgtgtccaaccgttcgccgcaaagcgtcaggccggaggccacaagccgcgaccaggcactagcacgccaaccccaagcacggggttgggcactagcaccgtgtccaaccgttcgccgcaaagtgtcaggccggaggccacaagccgcgaccaggcactagcacaccaaccccaagcacggggttgggcactagcaccgtatccaaccttcgtcttaatgcgtcaggccggaggccacaagccgcgaccaggcactagcacgccaaccccaagcacggggttgggcactagcgccgtgtccaaccgttcgccgcaaagcgtcaggccggaggccacaagccgcgaccagg

SEQ ID NO: 11675 - DNA, 2435 bp, Heterodera glycines
tttttcatcaaattaccaaatcttgtggatttgtggccattcttgtaagaaaaaataggagtttcgggggcgcggcggtcccgataggcgccgccggggaaaaaattggaaatttcgatcatttataaacaggttttcactgaaaattagccaatttataggtaaaattttgaaagattttatgggaatttaatccaattcttaggggtgtaaaagtcgcgtttcgcgccaaaaagcgaaatgcgaaatgcgaaacgccaaaaaatgcgaataatgcgaaaggcgaaatgcgaaaagcgaaacctaggcacatccctggtaggtaccagggctgttgcaaaaggaaaaataaaaagcgaaaaggcgaaagcgaaatgcccaaaaaaagcgaaaaggcgaaattttttttccaaaaatagatgaatttgaaagtctcaaaaaattcaccttttaaaatgcttaactgttctgaagattgactgctctttggttttcataaattctttatgcaaagattaataaaaaagaagacgtgaatcggcatcgaactcatgagagagagtaatgtcaatgctaatgcactaaccactacaccacaatagacatttacgtagcaaagcaaatttactttatttaataaaaattttagtaaaatggttaaaaaattcaaaattttgtgtactttttctcccacgaaaattccattgtttattttaaaaatccatctttaggggtgtactttttttcgtttttctgcaaaaagcgaaaggcgaaaagcgaaagcaaaatgcccaaaaaaagcgaaacgcgaaaagcgaaacttgcaacagccctggtaagtacgtatgtgtacggtatgcgtgccgttcgcagatttaaaaaatggacgcacagttgttacacatttataaatcaactttcttatcccaaaatttttattctggcgcatattttttagcgcatatttcagcacttcttggtacgtattttattacatatttcaggatttttagcatataaaatcccatttctctaattaggcatttttagagaaaaaaaaattccgtaatgaattatttggtccaaaaaatgacaaaaaaaaattttagccaagaaacccttaattgcgaaactcaagtggaaacattttttcagacccaaacaaaaccaacggcacgtttattttgaaaattgaaaaactttccgaatttgcgcaagagaaaaacggcaccaagcgtagcagtgaaattatgttcatcagaggaataccgtggcaaataatggcaattaaagaagaagatgctttatacttttacgtccaatgctccgatgataaaacaggtggctaattagggggaaaattttgaatgtattaattacctaattaagactccaaatggaaatgcccttattcggtaacatatcaaattgatgcacaaaataaaggaaacgagcactttgtcttcggaactggcgggcacattggcaccaattttgaatgccgatcttgccgtaacagacgcggattccaggtcattaataaatgccaaatttggtcaattaatgtgattagcggcattgtgactgggatcattaaaaagtcatatttagtatctgatgagcgagtacaacgattggtacaacagagcggaggacacgttgactttgcgtgccgatgtgcttattggcgaaccatataaagacactaaaaattaaaaaaaaacaatttgttgggttcgtggctgtcattcttggggtttgaaaaattcggggacacagacccgaaaaatgttcttatttgttaggggattcaggctaaactaaccacaaaacttttcgagagcgggggggggggaacccgacaatggggaagaatgagagacttattaacaaatagggctcagaaaagatgacacctgcgaaaattcgttaagtgtaggcaaattttaggaaagaagaaaatgcaaaacctgcattaaaattttaaaaaatatttttaaactgaaataaatagttttttggaattaaaatattatatggtaataattatattaaaattttttattattttggaatgatttcgggcctgacttcagggcgcgaaatgtattatataatctaatgctaatttttcaatattaattgttgcataaatctttaaaatttgtgtttgatgaaaaataaaatcaacaacaacgctttggcttacacttgaaaaggtttagaaaaaaaacacataaaaaatagacaaatttaattaagcgacaattttctaaaaaccaagaattatttttaatgatttgcattatttttttcttaaatcatggttaccatttgttttttgtatttcattattatattttatcaaaattaaaaagtccatttgtttaaattaaattacaatttatgaaaataataaataaagtttatttcgt

SEQ ID NO: 11676 - DNA, 529 bp, Heterodera glycines
tttttttataaattttcactacttttttttcatcattcccataaagcttcaaaaattcaatacacaaagtgtttgagaatttttacatttttggacttaaagaaaattttcaaaaaaatttcttttttaacatttctccgacggtaaagacaatctcattcatccccagcataaaaaaatagtttgaaaaagtcaccacataaaaaaatgtattaaaaaattaattttggtaaaaaatacaaaacatttaaataaaacccattttttattgaatttgataaaaaattgaagattactttgctttaaaaaaattctaattactttgaaatcgaaatcaaaacaatttcttagccaatttggatacggtatcgaattttcacccttttgtaaaaaattttctcaaggtgttgcacattccagtttgcattttctggaataaaaaatagtttttggccaaccaaatgacagattttcaagttttatgccaaatttgaaaaaatctgagtaatttaaggaaggggtggggggg

SEQ ID NO: 11677 - DNA, 1597 bp, Heterodera glycines
  misc_feature (27)..(27): n is a, c, g, or t
  misc_feature (1560)..(1560): n is a, c, g, or t
  misc_feature (1567)..(1567): n is a, c, g, or t
  misc_feature (1590)..(1590): n is a, c, g, or t
tttcatgtgaaaaaataaaatcaacancaaagcgtggcatttcattttaaaagtttataaaaattaaaattttcaaatttttgggcacagacaatttatggaatctgggcaaccttgaaaatatggcaaaaaataaaatttacatacatctgaaaccgggtttttgtcagaagtttttgtggtataatgaattgttaatcagattttttgaaaaatgtgagttggtagaaagatgaattgtgaaattttgagcgtgaattaatgggaacaaactttacaacaaaaattgaatatttacttaaatgttattttaaaaatataaaaaattaattattaattaagcgacaattttcctaagtcgagaattatttttgatgatttgcaaattttttgaaaaattatgactacattatttttggtattttttcattatattttatcaaaattagaatagtccatttgaatacattacaaatttatgaagaaaataaataaagtttaatcaaattaagttttaagattgaaatttatcaaatttattctgcaaattcttccttttgtgtttagccgcccgccatctttcaattcaaattggaatgaaaaaaagagccaaaatggctaaaaaaatatttattaaatttcaaatattatttttataatatttgcattaattagaactatcgttcgtatgtctgtctcttaataaagcccgggagtttttttttttgaataattgggatcagtcagaactaaatcgcttatccttggtcggtcccccgattcctatctgcactattttttgctcaaaaataatcattttttatgtgccattgttgtcataatgtaccaaatgcaatcgacacggtcggaatgttggcacaaatggaaacgttttctggaacattaaaagagcaattattatgaacaatttttgctaattatggcatggacatttcggttcggtcagcgttttaatctcggcttttttattgctcctccgccccaataaaatgattaattgaacaaaaaactttgggggtgaaacggccgggactcagttttaccgtcaaccgttgtttcggacatttcatccgaaatgtcggtcaccaaattcgcagagggcgtcgaaatcgtcttggaagccgtggatgtagtagtcgtagaaaccgtcgtcgtcgtcgtcgtagtggtggtgccctccggcagcggtgccaaaaccgtcgagcttacaatgcctttggtcacacgcgttgcattttttttcaaaaatgtcggaatcatgaagttcatattcgagtgtttctcgtcctttttgcctagtttgcaaaaatggcacaatttgccaacttttgagcaatagtcattggacggctgacagccccaagtgtcgatcacaccactggctgcaacaaaatgaacagcattaattaaatgaacagcaattaaataatgaatttaattttaccaaagaattcatcaataaataaaagccaaaaaaaccctataaaaattggcacaatttgtataccaaaaattataggatagataaaaaattcattncaataantgtcctaaattttatcatgcatncatctgt

SEQ ID NO: 11678 - DNA, 2892 bp, Heterodera glycines
  misc_feature (2840)..(2840): n is a, c, g, or t
  misc_feature (2878)..(2878): n is a, c, g, or t
ctgacccaaaatccttactcaaatcctgacgcagccccttcacttcgtcctggatttgagcaagcgcatttggcgaaagctgcccctcccattcctcatcccacgcgccttgctgctgctgttgttgttgttgctggtggtggtagtgttgctgctgctgcgggtgttgttccacatgtgcaacttgggcccattgtggtgtcggctggtagggaaccagttcccacgcatccgggagctgtggcccaatttccaattgctgtgcaggcattggtgggtccagttcccacggctgctgctgctgctgctcatgctgtagaccttgtccatggtccatgcccatcagctgtccctcatgcggcgcctgttcaatcaagattaaaattcaaaaaaagcaaaaacagcataaaaaataaagaaaacttacctcgttgatcaatccatcggcctgataattgctgatcagcccttggaccacaaagtcgacctcgtcgacaagtaagtttaaccttgcacggagttgggcacgttctgcctggcgctgctgggaattcatttttggtttgcagggtaaatgaatggtgaaaaaaagagggcgactttcccatgggcccttttgtatgaggcgggatcgtggccatctgtgtagcgaaggtccgacgcttcggtgaccgatgcgaacggggtcaaattcaaataacaatgggatgtgcggcatttctgcatcggcacaaaagagaaactaatgcatcatgccgctaccggcgatgcgcttgtcacatttacgggtgtattcaaacaccaaaggggattaaagaaatttataatgattaatatttaaatttattatgaaatgatgattcaaatacatgaactattttgcaaaattgattaaagtttgtgatcaatccatccttccggcattgttgaacatttgcccactttcattagcattgttgtatgggttgctttggttattcccagcatcaaagttcgtgcaattgtttccgaaattgccaaaagttgaaccattattattagtgaagctgcttctaaagcgattgttgttgttgtaatcgttgtttttatttgcacagttcatgtcgctcagtctcatattaagtgaaacacatcccctgcacatgtgaaattgcacttttacccctcctaagggatcgaactcaaaagcataattaccgccgctgttgttttttgtcgaattgaacaatgtttgtgagcagcaatgacaaagattgaaagttagaatatatttttttcgtaaaagtttccataattgagcgttagcattgtcgctgtggttgttgctggtgttgttgttgttgttgttttgctctgctggcgcattttgttgattattaaaagtattcatttttattttacaaaaaattcttgtgattaaaatgaagttttgcatcatatttgcgcgcttttatatagcgaaaaggtacagtgctgcgtgctacgtgaaagacgaagttacagtgctcctacgcacatataaaagtgcttaaaattagcacaaaatctcacttgcgcgcaatgcatttgcttatctcattctcgcgcattttggactgttccactgacgaagtgggcgcgcgaatttgtgctagtgttgcggatcgagaaaaatagttgaaggaatttgcacacagtaagctcatcactacatactccgaccgtaatggcttcacccacacgctcttctttgctgggctcacggaagaaggcgccgactaagtgcttgcttatggtaacctgaggcgcccctacaatgtttgcgttgcggcccattattactcgcggcaccgtattatgctaaagtacccgcaattcccatgtgtaattgagaagtgttttggtcaaagggatgatggacccttgcacaaatattacccgcttgaactggtaaaagtcatcgatgactgctttccacctgtgtacgcgagtttactgtctcaaaagcgtgacgactcaacgtcatcgtcatcatcctcgtcatcattgccgcgaaatttcctatcgtcttcttccgatgatgctgattatgacgaccatggtctctggtttggctcgatgcccacacaaaacagtgttgcggaaacaccacctcctccgtcttgcgtttatgtgaagggaataatatggattgaaaaagagcaaatcaaaaatattctcagtcaagcagttaaacatgactaattgtgcatttttctacctaaaaacagcaactctgtaactcagatgatgatgaatctttttaatatttccaaaactgctacttctcttactaaattatgtatttttctacctaaaatttgcaacttcgaacgcttcattattttaaattttaatcttctatttgttaattatgcatttttaaaaagcacaattccgtataaattacggctttataaaaccaaaatcatgtacaatagcattcatccccacaacccccttagttacaatagggcgatagcgtttcgacagcttaacagaaataaccgtcccgtccttaatgttgggcctcaggaaattggggtactcaatcagaattgaacaaatgtcatcatcatcatcatcatcatcatcatcatttgaatggctcattgcgtagcgtaggacactcctcttgaatgtgtcaaagtggagaagctgacaggcatcggcgctcagtgttatgccccgtactttgagcaccgttttctcctccccgctttggcggtgccgcatccgcagggcgtactgcttgcacccaccggaaacaaattccacgagttcgtggtccggccattcatccgaaaggtcacctaggtggngtcccgtctccagagggcacccgtccgcctcacgatgngcgaaacacacact

SEQ ID NO: 11679 - DNA, 4984 bp, Heterodera glycines
cctcttcttcctcttcccattcttcatcttccatttgttcttcttccccctcttcttcctcctcccattcttcatcttccatttgttcttcctcttcctcttcccattcttcatcttcctcttgttcttccttcactattgtttgctcctcctcctcttctatttttatttttctttccatttcatcaatattttcctcttttttgatcattttttcctcttttaccattttcaatcgcttctgatcacccatcataatttgttcttctccaaatgataattgttcttctttaattattgctgcttctttttttatcggaaaattttcattatcaaaacttttctttttttcaaatttaatttccattttttgtttattttttgacccattgaatttgttttgctcacccaattggtccaaaatgttagcgttttgttcacttttggtaccagcaattctcaaaatttggcaaaaaaaggcaaatgaaaataaaaatgttgtaaaaaggtaataataatttaaatttttcatatttgtaaaaatgtaaataataataatataaaataatttttttcttttggctttgttcgtttaaatgctaattcttttatccttcataataaatcaattattgaatttcattaaaacatttttaattgcaagaaaaaaaggcgcaacattttattacaaagatttgcaagaaacatatgtaaaaaagataaacaaatgcagctttattagatatgcaaaaaaacatttccggatttttaagatatgagaggattgtttttaaattgaatgggttaatttgtaagcgtactgtgccccccccccttgtcaaataaatattaatgggtttttcattttttttttaatttttagaaatcgagatttacattaaatgactttacctgtatttaacaaattttcaaaatgtaactattgctttgttcatgtattctgtttaaaacgctaggctgcttcaactttcgatgagagaggtcgcaatttgagtatggagaccgtttgagtgtgactcattaaatacatgcatttgataaattcatttttaattagagcaactctccaatggcattggtcattttttggtcaaaattcataaaaaatttgtatggaaacattaaatcgttggcggaaagttaataaagatttgcagaataatttttcaatttgtccttctttttaatttattttaagtgagacaaaatgaatgaaattattttatttaaaaaataaatgaaaaatctaagcgaaaatttaaaaaagaaaatataattattgaaaattctgctcaaaatcttttcgcatttaaaattttaatgcgatgaatcagcaaaaaaaaatggaaaaaattggagcatttgcacaaacaaaagaaaagccaaagcgcgtcgattaagcattggtattttggtctatttgcgatgattttttgaaaattggaccattatttgcataacagcaaaaataatccgccgttatttgggcgagattaaaaatatgaaatcattcgcctaaattttgtgtcagcgcattcattgcataaaataaaagaagaaatgcgggagaatttgcatttcatttccaaaaatcattttaaaaatatcattttttgtgcatttccgttgaattaccctttaaattttttccatcggttcgatttgtttgaagtgcgcggccaaagagtggcggcgcacttaaaaatggcaattatcgatttgcggaacgaatttaatggaattaaatatttcattttaaaaacaaaataatttttggtttttaaaaaacaatttaccagaatgattgacaggtggcaaaagaatgaataatgagaggaaaaaaggtacaagaaataataaatatattttaaaattaattacatttcaaatttaaaatcagttttaattgtgtccgtcgctgtcgtctcaatggcctcgcttttgctttgtctgcttttaattctctgtttttccattttcaaaactgctgaacagcaacagcaacccgacgaaaaggaccatcgacaattgctttttgttcaggcaatttggcggcatggcgacagagtaattaaataattaattagataattcattaacaatttaaaatattaatcgactttttttggtaattctcaggcgcctggcaaattgccttaccccggggaccaatacgacgaaaaatattggccacgtggttggggtcaattgacaaatgtacaattgagcatttgtcgagtttgtgtgtttatgttttagcttggcatgacgcaaatgcgcgagttgggccaatttttaagacaacgttatgtgaccgaactgaactttctcgacccggcttatcatcgcgaggacgtaattgggggcttaagcaaagttcatagaaatttgcacttggataaaggtttttgtccaatcctccggctccgaccgggcattggtttccgcgcaggcactgctccaagggatgtacccaccggtggcggagttggagcagttcgaccccacactcaattggcagcccatccccgtgcactcgactgggccaaaccatgaagtgcacttttaaggggacggataaaacaataaattttaatgggaaattcaaaattgaaatagatacctcttgaaaattggatcaaattatgaataattttgagtttttcactttcatgacaatttaagctgctcaaaccgaccagctttggctgcccagtttatgacgaaatgaaaaaggaagtgaagcagcagttggaacaaaacttgaccaacacgtacccggaattgttcacattcatccagcagaatgtgtacaaaagcgcacaaccaatctcactgcatcaggcggctaaactgagcaacatcaaaagggaggtgggaggagcaaaatgggaaaagcaaaatgaaaaacgcttattaattattccaatttaaaaaatcagcataatttaatgggttttcaaaactacttttccaaattctgattgaaatgatgagaaaatgggggagaaacaatctcacttcatttggaaaagacgagaaattgaaaacccaactgaacatacaattttatttaaattctgaacataatgccataatttgtccatttcagtccctctcatcgtccgtcccttcccttcccttcttttccttccccctttttttgttaggtgcttcacaatttgtcccagcccgagtgggtaaatcgccgttgggaccaatacggtgggcagacaacgcttgatttggtgacggaactgcgccgcttggaacgcagcgcggagtttgcccgttccgagctggccattctgaagggcggccttttgctcggcgattgggtccaacgggcagagacggttattaactaattggtttaaataattacgtaatttgaacggggttagatttcatttgtttaattaaggtgttgcaacgacaaacgccgaaagaggcaaacaaagccgtcctttattcagctcatgacggcacccttcaggcactaaaagcatttatttgcccaattagggatgattaattacgctaatgaaggccctgctttatgcgctcggagtcggcgatggccaaatggtcccttactccgcttgtgttatgatggaattgtacaacgcaacgggcggtgtcattcatttggatgtgagaagtttatttttgcttttcaaaattaaataatattttcaaagatttattatcgacacaacggaattttggacaaattaaaattggcggattgtggcgattcgttttgtgaagcggacaaaacactcaattcgtttgagaaaaatgcaattaatgggctgcaacaactttatgatgtttaaatttaattatcaaattttaaattgttgaaataatcctttttagcaatgcaaaaaagacggattttgcgaaatacccattgaaaagggtaaagaagatgattaattaccactcattcgttaattaaatttccacattcttattgtattttgatatttaaaataataaatgttgtaaattttaaaataaatatattttggattttacgtcattttttattaataaaagaaaactaattatatgttccagccaattcactgaatcataacaaattcttggtgttagattgaatgttatttatgatatgtacggaatttacaaattattcattattgccatttgaatgaagtcgcagacgcaaccgaagtggctcataaattattataattattttttttaaaagcgatacggtattttgaaaaaaagtttcgtcatttggagtctcgttatcatgaatttcgaaaacagaccgttgctttaattttttattcaaacggggttagagtatcaggcgaaccaacaaagaattcactattttcgaagcttatgaataattttgaaaaaaatacaggaattttttttgtcaaatttgaatattgcttatagtttcgccctaatcctttcttgttttcggcgaacaatttaaataatggaaaattttcaaaatgattagtgcatatcttcacaacaattcaatttattaaatagtaaaattatcaattagaaaaatggcaacaattggattgaaagataattaaaattggttttaaaatataagaatatacgattgaaaaattttgaaaaaaaccgtgagcctaggaaaattctcggactcgagcattactgtcacaaatttctgaaaaaaaattggtgaatctctttttttttgcataaaccatgataaatttccttattaagtgagaattttaatatctaatagatgccaatttgtacaataatttagataattaattaggcattcaatcaagcgatggttttcaaatggatactgtgctttgtgagtacggcccatttctcaacgggtgattcggcggattgtcgcgcgaacaaaagtttgaatcgttttgctaaaaaaacaaatttattatcaatttaaatataatat

SEQ ID NO: 11680 - DNA, 2422 bp, Heterodera glycines
cggttttgttcgccactttcggcacgttttgctgaccctgagattctcgctccgatttcgaaaaataattttttttcttggctctcgaatctcgacgcatttctgccgatatttgcttaatttaatggcactttcatttgacgattctctgccgaacattggcatttgtaaaaagtactcccatttggttttctttatttgatggcgatttattgataaaataaattgggatatataaatttttaacattttgatggacatttacttactgaatgcattttatgatgcaatttctcaacattggtcccaattaccgagttcaaaacacacttttcttttctttctttccctcccatttaattgccttttgcccccccccccgggcgttttttccccccaaagaatgcccaaatttgttgccatatgatgggctgtgtgtccttggtccgttctgctgatgtcccctccccccttctcatatgaccctctccctccctcactttttgtccattttcgccgcgggggttgaagttttcgtagaaattgaaaaattacatttaaaaaatattatttcatttatttattattttattttaaataaaaaactatgtttattttattcttaaaaataatatgtttttctgctgattcgttctcattttccaattgaaacgtttcgttaaaaaaggcggaagttttttgcctttcgcccccaaaaaattgtcagtttttgcgtcaaattttttaaattgtaaaccattaaattttagcaaatttcgcatttcattcccccaatgttttccatcgcaattcatccaatttttctcgtcgccgttttgctcacttttttctccctctttttgtcctccaccgacggggccatcgcgcgacgccaacacaacacgcagaaaaaaggtggcacatataaatgggaaaattaataattggctgatcagaaggaaggattaggcgtaggtaaacggctaattaggaagcaattaggcgggtaatttgtcaaaatttgctgggagtcaatcagattcattgtccccaaattcggcacttaattatcacgttttcagcaactgatccaaacagcagtgacgagtacgattatcgtgtggacgatgattacagtatcggcgtttttgttgacgcggtgccaatcgccaaaaatggggacgaaagtgccaaaacaccacagacaaatgaggacggaaaggcgtacaaacggacgaataggtgaggaaaaagagaatgttggcaaagcgacggtcgaattttcgattttttaaaaaaggggggaaaattggcaaaatgacagtccaattttcaaaattttaaggtacccgacgaaaaagctgcgcagattttttgacgaatcaaaagcgcggagggaatggtacgaatcactgttcagcagaacggcggagagacggcgaagataaaagagagagagacgggggacggagcagagactgtaattagcgcaaaagcagtagccaatcaatgaccgtaaaatgcaatcaaccgatttactactggttgattacggtagccaagcgagggttcaattactcggctgaccagcagcaagagaccgatcagaggacgattcaaatggttctgattagtttaatgaatccatagttctcaaacggattgccataattctccctcaatcgattcgcccactttgatctctgtttataatttatccacctttttaatgaactctcccaaatgtacaaattaccgtagtgcttcgctaatgcccagttttgccatactgtacctttctttccttttgctcatcacttctttgtctctctttcataattctttcattacagtacacctctgacttcaattccatcatttttggcttcgattacgataaatgtttatagtttcttcacaatttcttcctttttccttcgcttttcgtttttcctctttttttaaaatttattttagcaaaatgttgccaaacaatcggtggaggaattcgcgcaatgttttattattcattcattccgtcgaatcaccgaattttgtgattaatcgtcgcgcaaaacgaaaaggcaaagaaaacgacgcccgagggaacataaagtattaaggaaaatgctaaatcaattatgaaattgggcgaataattaggaaagcaaattagttaattaactacaataggcagtgttaattactccaattagaaaaaaagaaggagattttttgattttagcggtgcgatacgattgagaagtaattaaaggcaaaatactgtaaaaaataatattttatataaatgacaactcaaaacgatcagctgagcaaaaacggaattgttgctgacttttttcaattttgatcaaaacggagagcagcaaaagcattcagcgagatgttgtagagtgaaaat

SEQ ID NO: 11681 - DNA, 6236 bp, Heterodera glycines
ttaattttttcaataaaaatgttttacttaaaattattccttctttggttcttgttggtcggaacggaaagttgttgcctttcaaaagaagaaaaagagcaatttaccagtgcccgaagaacggtagaaggcgtatttagagacataattaggttagataacgaagcaaaagaattttctttttctgcacataataccatggttgaagcccaaaatattaaaaataaaaaccctgataaacctggtgtgaatttttggcatagcaaattattagatggagttttaaaaattcatgccctatatgacaaaataaaaaaagaagaaaagaatatgaaaaatataaaaaaaggtatggaaaaatgccttgacagaaaagatgtggaaatgtgccaagaactagcagaagaggcaaaacaatcaatagaattagcaaaaaattatagaaaggaaattggacaaacttatcggaccgcttactcgcagcccgatttaggcattggagacttggccaataaattaaaagaaacaatgcgagaaaaccaaatacggtttgaaaggctaagacctcaggaagaatttagggatgaatttattgcttataaaatttaagaaaaaaaaattcgagaaaatgaaactgcatgagaattaaaggttgtgggacataaaccaaaaacaggtgaaaaaggaaacaggtgaaaataggtgaaaaggaaacaggtgaaaacaggtgaaaataggtgaaatttcacctaaaaatattataggggtgtgcatttaatggggcatattagagaatgtctcaactagtatcaataaaaagtgccaaaggaaaattttgtgatggttatcgctattacaaacataaaacgaccaagttaaaactttggtgtaaatgtgaacttaattcacatgggtgccagggctgggattttgaaaaggaagggttttttacaatgacgcgccgacacaatcatcatccagacactatattgattgaaatcgaagaggaaataaaatatcataatttttctgcgggggcaaaatgttttttgggtgacaacaagaaatagttgatgatgctaagaaaaatccgagactccaaactgaatttagagatgaatttattgtttgtaaactataaataggatcaagaaaaaaataccaattaaataaaaatgaattctgaaaaatcagaaaaagctaattccatattattggaagctgcaaaaaaagagacagaaagagcatggcgggatgtagctacgctaacggatgaagtaagcgattttgccaaatcttctcgcgaaacacttaatcgtgcaataaaatctagagaaaaggctccttacgctaatggtattcgagaattatatcttaaaatgtccgattcaatttgggaaatcttcacaatcctggacaaaatcaatttggagtcagaaaaagccgaatctacgtggcgtgatttcgagagatgcaaaacttttgaccaggcaacaaagctcgaggaacaatcgcaaaattcattaatggaagcccgaagattacatttcgagtcccggagggtgcagagccaaatgttaaattatgaaaataggctccaaacaattgtttgggagcatatgggtatataagagcaaaaaataatgatataacaaaatggaaaattgtgctataattgagacatattgtcataaagacttaaaatttggctttaaaaaacacaaaaccaagttttattttgtcaatcctttttttgttaatgctgagcaaaattttaaactaatactcgcatcaataatcgaaaaaatttataaaaatgaacaaggaaaattcaaaagcattctgaagctttcctttggttttgaatcattttattgccctcttagataccctagcgaaaacacagccgaggttttgttccaacatgtcctattaaaagaagaattatattcgcttttctatcctttggatgatgtcataacactagaagtaactataatcccagatgtcgacaatagaccaagaaattaattttataaaaaacaaaattacgagaaattggaaaatttctggaaaaatacttaaacgatcaaataatctcgaaatttttgcaaataaactttttaaacgggtgaaaattttctacatagcggcatttagtgcccctgaaatcgaaaatttatatttttcattcttagaaatgctcgataaaattcaaaaattaccaaattttattatgtatgaatatagaaaacagtctttagctatgcaaaaattagaaattggtatcaaagaacgaaatatatttaaatgtcaagatgcagagattatatccgataccaatttttcggagataaaaagttatcaaaaaaagatagggaattataaatttaatatcaaaatgttgtacaatgaaattagagtaaccgcagtaagtcatttgtttaggcctgaaaaagaaatattttttagtccatttcttacagaaagaaatagagaaattttttattcattatttcggcatatctaataaaatcgcaacttttttttgcaaaaaacaaaacattttcgttactaatagaatcgcatgatttttagtgtaatatttgagccttactgcacaaaagaccaaaaagttttgcaagtttgaaggtcatttactaatttcgtttgctgaatttgaactaaattagggttgcgtcagcattacaatgcaaaaagcgactatttaagaactctaaattttcattaccgatatataattttgccttcaaacattagtttatgctatttatttttgatttaacattttttttcccattaagaaatgtcgatgcaacaaaatcaagggtccgatgatgttttgccaatgtgggcggtaccggattttgatgaaatggaccaaatgccgcagcggcaaaaacaaaaaaaaatcccaacgttgaaggagtttcggcaccaatggaaggaacgaagacttctgtgggagagggagcaagcagaaaaaaaagacccaaaaacatggaagaagaggaccgatgagatgaagaaaatctgtgaggagagattggagcaatcaaaaggtgcaggcggcagcaacaaacgacaggagccggacacatacacttggaactgggacgaactactgcgccaagaaagagaatatttggacgggggtctatggggaaaatgatgagatacccccccccccccctccagctcccctccccctcccgcttctaaatatgttgttgtttttaaataaaaatatgaaaaatttttaaacattaatttgattttttactttggctactataccgagaacttttattttttgtacgtttttcttaacttttttttgacgatttttgattttttggctattttaaggaattttttcatagtcttcataaatcaccaataaaattttgcactttgaagtcataaatgtagtgaaaaatggatgagctaattaattgataaacaatataaacaataaatttaaaaataataaaagtcacacacataaaaacaacctaacgacataaatttgaaaatatggaagttttggtagcagttttacacaaaaatggccgttgtcgatgattttttccaaaaatccgtataaatcatcaaatttctcaaaaatcagcaaatcatcatctcaaaaaaatcattattgaccccttgaaatcatcaaacaaccccgatttaatcggttaccgttggctatattttgtaaaatttaaggtttttaatcctttttttgtcttatttatcggcttgtttgcacttttctgagttttatggttgatgtatttttatttaactagaattttttgttgttgcgtatttttgatcaatattcaaattttttcacgaatttaatgaaaaatatttaattggcaacaatgcagattttcaaaattccaacaattaatgcgacattaaaatgaatttgatcagctcatttcataaattcatcaacaaaggcatcgatgcatttggatgcctgaatttacatttgtaaaaagtgaagaaatcatagaggctcacctccgttttaatcgcccttggcacccttggcatccacagaataccatcattcgtgtgctgagtagcggagagcgcaagttttttgtgcactgaattaattaattaaagaaacataattttttgttgctaaaaactgcctaaatagttaatacgtaaaagttggtgccaaattgataaatagttgttcaacctttaatccaacaagaataattaatccaaatcaaaatgagataaattattaaaggagcaattttgaaaaattttgagtgcgattcttaggtgtgtgtttttcgtatttattgtcttaaacgccaaaataattgaaaatagtttttcaaaaattttttctaacaactcataaactagctcaacgcagaaaaacacgatttccggatgtttcagtacacgcggagctcaaaaatagttacaaaacaaaatatcatagccatcgtcggcacttcctgcctcgttttcattattacgttttttaaatttttggttgctttccataagtgcgcggtgttccgctggcactggtttgccgctcaaaacatcgagagtcgcttctgtcgcggcttgtctggtgaaatccacacataactcaagaccgtaacagtcttcgctcaatatccactgtcgctctgcataatctacaaataaacaaaaattttgaccgtggtaaaattggactcaagaaaaagacacgctaataaaactgtaaagaccaatttttctggtaaagaaaagtaatcaaataaatttctgtatctccaaataggtgaactttgtttgaaatcgggaggaaaatggtgggatgagccacgatccaacccgtcccaagggaagttctgcagtccgaagaccgtgaacttggccttgaaatcgggaggaaatggtgggatgggccatgatccaccccgtcccaagggaagatctgcagtccgaagaccgtgaacttggccttgaaatcgggaggaaatggtgggatgggccatgatccaccccgtcccaagggaagatctgcagtccgaagaccgtgaacttggccttgaaatcgggaggaaatggtgggatgggggactcatcccgcccatggaagccaaaagcattttatttttataaccaacttagccacgagacatagtaggacttgcggtgtgtggtcggatgtgtgaagcaggcgaaaatctctttcagctcaaatttctcctcttcaattccgtgtgtgccatctgtttggtccaaaaggtgcgattcttggaacccagcattttgttgctgctgctgctgctgttggtgctgatcatcatccgcttttaatgtattttgaatagatatattgcgttggaatttaaatttaaaaaaaattttttcgacggcatatagcggaaatgttgtaccctatcatccattttttgaattgaaaaaaggcaaaaaatgttcatttttggcaataagtaaccagtgaagttttatgggtctaaaataagaacattttgaaaaattaatttaaatcaaacaattaattttataagaaagtgggtggttggtttctaaaaagttcataaacataatagtaagaaaaacaaaaataaaaattcctagaagaaaatgggtttacaccatttgtgctaaaaatttaaccctgatcatgagcaaaaaaaacttacttttttgggttgttttttcctcattgatttgttcttgcgcttctgcttctgccggagggtttttttgcttggaccactctgctcctgttatttcaaattattttaaatatttatgaaacattaaaactaccggagtaatttttttgtagggcgcaataacaattttagccattttaaataaatctgaaaataaaatttcttaattttattttgttaacaactaaaattaaatggggaatgcatggtgaattcgttctcgcacatcaatcgatgcgaagaaaacaattttgatttggtgcaaaaatgggcgttgttttttcaaggtcgttttggcggggaaaactttggtcgtaaaatatttggaagagaatgaaaaggaagtgaggcgggggagggcggctggcaggtggaaggaatggagggaagatggtgataaagaagggatgggtgatgagggggaagggaaggggggttgaatgaaagaagggggttagggccacatttgggggt

SEQ ID NO: 11682 - DNA, 1931 bp, Heterodera glycines
cgcgtgtcatgtcgcgccaggtgaccgcgctgagcgctgtccggatcagcaaaacgaacgccgggcgtgaaggcggcgcattgcacgtgcacccaaccggcacagccgccaccttttttaattgaaaatgattaatgaatggcattagttggagaatggcgcgggcgctgtttttcgacttttctgttcgaaaatttattcgaaaaaaatcaaccgaagaattttttaattttttgtatcaaaatctttaaaaaagcaattataaatataacccgatgatatgtataatagacacacacaaaaaaaaaaaatttaaatacaaaaaaattttttttaagcgtctttcgactttttaccgaaaaacgcgaccgacccttaagcgcaagatttgtcagaaaaacaaattgggaatgaaatttggaaatttgaaaaatgtcaaccaaataactcgaccatggactaattgagtcaattttcccgtttattcgtaatggcaatttattcggtgccgaaaattggcccccgggattggcttttgcaaaatcagttttttgtactgtttgacacaatttttcgggcaccgcctcaccggcagcagcagcagcgcgcttgaaggcgccgtaacggctcgggcacagctcgcagtggggcacctcgcgcacgccgaacaggcacggctcgcaaaaccacggctcagtggaggcggaggaggaggcgacgctttgcgtgtccggcgcggcggcggaagtcggcgccgaagaagtcgcggcagccgtggcgatcaccggcactggcggagaagagaccaacaacgacgggccgccatcaacagcagcgacagttgtgcacgactttttgctggggtcaacggaagcggatgagcaattttgctgaagagggaaattgtgatataaacataaagcttttcctgttgaaccctgcccattctctaagtcctacctcacccgactttcccaaaaaatttcgcaaaattttgcggaaaattcaaaaaataacaaagcctcaatttttttttgaaaaaatctgttacataattcactctaattttaaaaagttttcttggcggcgtctatcggcaatttatgaaatcttttaaaagctgaaaaaatcagtcaaaaattaccgattaatttatgtctctgttttaacaatttttgagaattttactacattacaattggatagaaaaattaatttttataattttctacattttttcgcaaaaacggcttgagttgttccgaaattttggtttcccttgcaccgccctgtcctacctcctgcccatgttgttggccatcgtcgccgccgccgccttcgtccggtgccatcggtcgctggccgtcctcgcctttgtcctccggagcaaccgcaacaactgcagctgcaccagcatcagcagcaacaacgccatagcacagctcatggacaaaaattgcacaactgaaaagaaaagcgtaaaaaaataaattttttaattttttttatgcgtagcctccaggcctaaaatggggtgggagtggagttttttctggcgatgctgcataatgaaacgcgaaatttaataatgtaaatatgccaacagaatttgtcttaaacaccataaattgcaaggttttattcattttaaagaaaaaattagcacacagttttgagaccactgatgccaaatttatgaaaataaactaaaaatttgttgaaaattattcaaatttcattcaatttccattcctcgctcgttttatatgtaccggttgtccccccccccacccccgccattagtaaatcaagtgtaagacgaaggataatagataaacagtagaaaatcgggtcgacccttttcgatacgaacaaagtccagagaggggtcgtaggatggacatttgcgactcgcggattttggccgaaaa

SEQ ID NO: 11683 - DNA, 2182 bp, Heterodera glycines
  misc_feature (70)..(70): n is a, c, g, or t
catttccgggcactcgtctaaaaaatgaagtaaatttggtaagcaaaatgcgctcaaaactattaaatgnagagtcgggggatgccttaggagcgtgtgcatcggttggaaaagcgtttttgctagaaattttcacaaatgtttgtcagttttccattatttcgggacggtttagtggcacttggccaaatattctgtttttccatctgtttgacccccaccgagttttattaagccccccggtgatatgtaagcttatttttgttttcgaaagttgtaaaagaaaaaagttcactgagatcgctgatcgcaaatccatccacccaattctacaaaattctgaaccctggacaaacagacatttaagtactgcaataactgctcgataaaccatttttgaaaaaattcgaaaataatttttcgacttcgttcggttcatccggggggagggctacgaactagtcgaatatggatgtaaaattcgtgatcaacaacctcaaaggacgcccccccccttcccactttaaaggccccctttttccatcattttacaaagtgccgctttttgccatcatttccccattttgttccgaacctgggcagcatttggcgccgctcctttttgccttttgcttttccatggcttcccctgctgctgttgctgctcctcctccccgtcgccgctgtcctcgtcatccgacgaattgccccccgtttcgtcgtcctcgccattgtcgttggtcgaggactgctcgccctcctcgtcaccctcctccttttgctgttcgttgtcggaggaactgcgcgacacattgggcgctgaacaattcattctttttgtacaaaatcgaataaaaaatgccatgatgatttaattacggccctccaatagggccatagttgaaaaactcttcgccaatacatttagaaaattttacgaacctcaccctttcttaaaactaatgttttgtttaaaaaaaaaagacaaatttcaaaaaaaaactttttgcgcttttcaaactgtacttttaaatgtgaaatttgattaaatgttcgctgttttctgaagtttcgaaataaaacccgctgagccatcgattttgatgccaattttaattattcaaattacaaatgaaaagagcaagacggatgataaatcattatgcgccagattccattaatcatggccttagttgtgccaatttttttaccaaccctcgcccaattccaattttggcaaaaagttcgcgcgattgtttgcgaaacagacacgaatcattcgtacaaaacttttgaaaaaattgcgaaaatgcgcacctatgaataccgcatatccaattaatgtgcggagattaattacctaactatcaaaattcaatgggtttagaaaatgcgttattttaaaaaatgccattttttgcctaacatggaaaaatgacgtcatcgtcctcttcgtcgtcatccgcgccgtccgccgcgatcagttgcaactggtcaaaaaatgccgcatttggcttaaactgccgcttgccgggctcacgcgcagctgaaagaaaaatgtttaatcattttattaaaaattactaaaataagtgcaattaattgataaaaaaaagtaggaatttaaaattgaattgagatattttatgtgttggaaaagcggataaaaatgagataaatatgaaatggaatgattttaattaaaatgttcttcaaattgagaaagcaaatttctgttttgaatctcaaaaatgcagatttaaaagtcgggatattttttgatttttccatgatacataataacagtaataaaaacaataatgatgaaaatccatttcagtgaggagggatggcccagtgatgccgaaaatgtctggaaaatcagggcatggaaaactccatctttttaagtaaaatgttttccagtaaatttgtacatctctattattaattaaatttcaaaaattgcacaacacctgcgccaaatagaaaattgtgtcgttctttgtccatttaaaccgtcgtattctttttttaattttaaacctgaaaagtgcaaatttacatacaataaaatgattaataaaataggtatttaaaaagaaaattaaatataaatgtgaaaaatggaaaattaaaattatatatcattttggcgctttattgaattttaaaaatcaca

SEQ ID NO: 11684 - DNA, 2700 bp, Heterodera glycines
acatcattcagccggaggggtgaccatctttcgaatcggctaagacagacggcgagaactttgtgccgtttgatgcaattggtaagctgcaggtgtatgtcagagtttgactcttttcttaagtggactttgccgatcgtgcgaaatttcgcattagggcccggaacaaggtgttcacgctgccgctgcgacacccggaggtgcacgccgccggcccaagcttggaagacggtgtaaaagaacaaaaggaaatgactcagatggcataaacacttgtccatttttctttctattgttgatattctgatggactacccaagaataaatgaaagtgaactcgcttttcccatcccttcggggattattgtcagcggtccgtcctcatcgggcaagacccagctggtccttcgcctgttacggcatgccaacgtgatgtttgacccgccgcccaaggcaataggtatgtgcaaagggggtttctgtgcagtgggctgttgctatttagtatgggcatacggtgagtactcgacgcagattcccgatctggagcggcagggagttctcccccacgcaggtgccccgtctgacgagatgctgaaaaagctgccaaagccttgtctgattgtttacgatgacttgatgggtgacattgaggccaagaaattggccgatctgtacaccaaaaagtcacaccataacaatttttccgtgattttccttacgcaaaacctgttcgataaatcaatgcgggtgccaaggtccaacgcccagtacatcttcctgatgcgggctcccaacgacatgcttagcattcgtaatttggccagccaaatgttccctcgcgagcagggattcctgatggatgcctaccgacaggcatgtgccctaccgtacggctacctgttggtgactctccacgcgaacagagacaacattatacgcctaaggacaaacattttcccagacgacgaggagagaatcatttttgcccccaaaaatggttaagcgggaacagaagatcggtgagcgggttgtgcacaactacgactatttgaagaagttgggaaagacaacgtcggagaagaagcgccgtcatttgttgaacagtgccggttgtgaggaactgttaacgcttgtcgagatttgtctcaacgttttgaacgggagtttttgtctgagcaggaaacaaaagcagagacttgcgccatttgcaaaagacatcagacagttggcacgtgtgcgaagcgagagggggtgcgcgaaaactagtgcagcagtcaggcggatcactttttgcccctttgttggcccccattctgattgaggctgcccgatacctgctttcgcgcagcaataatggccaataaacttattctgctgccgtacgagcactacaaggggctggttgcagcgagggagacaaagaatgacgacgacgacgacattgctgagcggacaaacttgggctttgtcaaacgacaggtgaccgctgcagtacagaagcggaagggaaacgtcagcgaacggaacgcaatgtacaaccagcacctgcgccggtacctgaagatgcgcaaggaacataaggagcggcccgtccgggtacagctcagcaacggcgttcaactgctaaataaaacagtggagacgggtgtgcaggtacggcctggtccggacgaaccgaaggacaagtccgtgatggttaccgacgaagatgaagaggaagaagaaattgaagtgccaaaatttttaaccccaacaagccagacgcagggaagcagccgatcacccaggaccaataagaaagcagcaaaacagcaaaaattgatcgagaagaaggaccacctgttggccatcattatgtctgatccgcagagattcggcgcaactgaccgtgggaaaatcattaacccaaagacgggccgagagttcatcgactcggacctggcctggtcaattgaacgcctggtggaccctcgcccggagaatgccccttcgccacgcggaaccaaagagttgaagaggaaactcgcacagaatccgctcgccagtagcctactcaatcgactgtttgttgggtctgggttcgtcggacaagtcaaacaaacgagaggatttgttccctcaaaatggacaagaaaataaacaaaatatacaccgacccggccaatccgggcgggtatgcgggggcgagtgctctgtacgcggcggtgaaggagaagcacccgaagttgaagcgtgccgagtttgaggactttttgcaaaggaacaccacctacacgctgttcaagccaaagagagacaagttccgacgcctacgcactgtgcctgcgggtttcatgaccggtaagttgtactggggcttattgcgcacaattcagggttcagatgttcaggcggacttggcagatttccaggcactttcgcgcaagaacagcggctaccgttacttgctgttggcggtggatgttctatcgaggcgaatgttcggcgcgcccgtaaagagtaagcgccctgtggacatgaaaagggcttttgaggagctatttgagcaaatgccaagggtgccagacacaatgtacaccgatcgagggctggagtttgtggcaaaaccgttgaaggagttttacgcggagaagggcattcaaaagtttgagaccagttcaaagaagaaggccgccgtggcggagcgtgccatccgca

SEQ ID NO: 11685 - DNA, 3528 bp, Heterodera glycines
ccttagaaacaattaaaatttttattgatctccacagtcgttagttcaagacccaattcgatcctaaataattaatagagcctggacatgatcggaatctcgcggggttatttcccggtaccgacaaaattgggatttgatttcaatcctatcattgcccggtctgatactaatcggaatcccgactttttcaaagttcctagctctaataattagcagggtgcggatttttagctacttaagttggactttttttgaaatatttattaacaaaatgcaataaaccaaaaaatttatacctactgtttgtttttgccagtttttcgaccacaattatgtacttagctacacacatatttgggattttcttaatttaaaaatcccggcaacggcaccctaatgagactaattagcaatagtaattttgtttgtttttggcacacactttcgcgggattggccgctgcacgccgccctccatccacaggaacagtcggtaccacaccgtcttcgtcaggtggtttcggccctgcaattcgttgcgcaacgcgggcaaatcggccaaagtgtggtaaatccaaaacagccgagtggccacccaataggcaatgatcacgtcgatggaatagtgaccacgggagaacagcagggacagaacgccaaccgaggcgagacaaagtgcgcccaaatggagcagacgccaacggcgcggactgtctgaaaaaatggaaatgcatggaattgggggcggaatttaaaattttaatataaaattatttttctaggaaattttttaattgaataaaaaaatgaaaaatagaaattcctagaaattgttaaaaccaagaaacttattgaaaatatgcgaaatcattttttcgggtttgcaattttctttccaaaacctttctaagttttttttgcgtaggtagaaaaaatttgtaggcattttttgtgaaaaatcttaggttttggtaattatttttttaatttctcaagatgaaacaatgtgggggggggggggaggcgcgaggagggaagggaattgtccccatgtcgagaagcagcgccgtcgggaaaatttttataacttttgcgaagggtgcgttttcccacaccccatcctctgagggtgccaacaaaacgggtaatttgcggttcaaaattttggcacccaaaaaaataaacgcacattcgcggatgaacaggcagcaggtgacgtgcacaattgtgtgcccgctgtaaatgtagtcaccgcacagcgtgtgccgtccgttgattttcaacccgaggccaacaacgacggacagtgcacgggccaaaatgttccaaaaggtgcgctgttcgggcttcaaccgtggcgagcagtaatagttggtgtccgcaacgggtacttgggtgacaaacatggtcacacaacggccaaggtaaagcagcgagccgatcaggaaaatgcgtctggggagggacacaatgaatgatgattagtgattagagagtgaagtgatcagagataaaagtgaccaagacaagggagggtgaaaaaggaaatgcgtcttagtgagtgatcagccgagaaagttgatgagtgattagaggatgtgaagtgatcaaagacaatagtgccccgatcaaaatttaaagttctagtgatcaacaaatgggaaagagatcggatagagatctacgaattaacttttaagtcaatgatcatgatcagatcgattataggaatttatcatgggtgtcgtcgacatatttacaaacggtaaaaaattgcaccttaacaccacccaacgatgtttgtgcagaactgcaatgagcatcatgataaagaacatgctgaaaacacataaaattactgctttaaatacaaagtcaaaattttaacgattttggcaaaaaaaaaaaaaaaaattaaaattcgaggttttttggcagcgattttggcgaaaaagtgcaaataccctattttattattgactaacgaaatttgtaccgtaatgccgaaaaccgtagtgccgtggaaacaacaacaaactcacgtaatcatcaggcactccgacacgaccaatgcccagggccaatatgggagataagtgaacgcaatgtccggcaaaggtgcgtttccgggaccactcgtgatgtaggacagcacaatgtcgttgagtgtgccgcaaaaaacgagcatgaggaaggcgtactgaacgggcattatccgttatcaatcatcaacaaacactattttctggcacaacactttggtattttttgcgttttgatgaattgccatttttttgttgtaaattttaccgttttttctcttacatttattttttcattttgttttgggaaaaaattgtgtttttttttattttaaccgaattttagaactaaggttgttggaagcccgaaaaaatgccataaacaaacaaaaaaatttaaaaaatgatttagatttcacgtttctgagggtttttcatgttttaacgccgaaccaactactaagctaactgaagcgaggccataagaccctgtcgaatcctccaaatttttcatggaatccctgcacttaaaattctaattttcggaatcccaagccccctaaattgtgggtagaacagcggacggaccccggcttttcgtcgctcgcgtggaatgcgtcgccgcccttttggtgaagcggcggcgtcggcagctgctgccgcatccgcgactgccgtgccgcctgcgacgccttcgtgcccggcggttctgtcatcggcggacggcgccgcccattcgtcgtcgtcgtcggccagcggcgagcggggcgatcgcctcaataacggggcacgtccctcttctgaaaagagaagggatgaatgagagagcgagagagagagaaaaattaaaatttattaaaactaaaagttttactcattccgcagccgtaaaaaatatttttagaaatctttgaaattttctttaaaaaatttcataacaatatattcatcatgaaaaaatcgctagaaaaattattcaaacatttttttcttgaaaaatctatattctttttgaagattttctgttttaaaattaaaaaaaaaaatcagggaacgatatggtggggggaactgaccccagagggcatagtacagctaatagaaagataagctgatttttagcagcagaatctcaagcttggaccggatcccacccagctgaatggatgagggatatgtgagatcccgactgaaacaactgtttcacggtcccgtcgcaaaaagcggtgtcttttattgaccaaaaatcctatgcccccgctccccatcgcgcaccccacgaatcgggcacactctcttcagactcctcggatgtgcatgatgttgctgatactgctcgcgcttggtgctggtggaggtgtttttgatgttgtgccgccgtcgtcgttgttgatgactgttgttgcggcggttcaattgtgatcgctgttgatgatggcggcaacgctgccaccggtgcggtcattgtcgtcggcggcaccctt

SEQ ID NO: 11686 - DNA, 869 bp, Heterodera glycines
agccgaggaatccgctgttaatacaacaacattttttactgctggctgccgatgaagaaccgccgggataaaggcatatgctaaatattgaaaacaaaataattcaatatttaaacaatgttttatataatggaaaattattttatccgagtgtggggatctggggattgaaccatggaaaaagcaaaatagactgcactcttagccaataggccattcaaattattaaaatcttttcgatcgattttttcggtacaaaagatggtgaaaagaccgatatcgatgaaaagatcagatcgataagtgaaaatttcttcgaacagttttttttaatataaattgaaaaaaggaccgaaagaaatcgaaaaagaacgattaaaagatcgatcatgccggactcactcatttcagagatcaaaagacaaaaaccgggcaaaattcaacaataaaaaatctccaaaaccaggcaggaacctccatgccaggctagagacacacacaaaaaacattggccagtaaccccaaaagagagcaatgtctgctttcttgtttgtatagtaaaattcgcatcctcagcagaggtcggtgaggcatctcaattttaacaattacatttaaattgcatgaaaaaaattttttggtggtagggggggcggagggaagggaaattcattgaataatctacaatacggagaaaacagccccataaatttaatgcaattaatttaaaaattttaaaatttaagacaaactgtaattaatgatattgttttaattactaattattatatattacataaaaatgtaaggcaaaaggaatgagttctttttgtgctgatttgtcagaaagataaactgataacatgaaa

SEQ ID NO: 11687 - DNA, 2825 bp, Heterodera glycines
gaaatatgatttcattcatgcagtcggttttaaccaataatattgaaaataagaatgtcaaatttttatagacatcaaatgtttttgtaagccaaacagaaatatgcaagagaaaatgggataaatgtgcttttttacgaaaactaatgaccatttaaccggatcgttaaatcctattcctatgaaagccatttatacaccaatttttgcaataaaaaagtaaatgaagttctcgagtgtgccagaatatgcaatggattattttaaaagatttttaatttgcttattttagaatttatttatttttcaatttgaataaaaataattgcatgtttaaatattttaaataaattcatgaaattattcctttcagcttacaaaaagcttgaccacataaaaaagaaacgcatgtcaagaagttgataatgattagattaattaaaaattatagaagaaaaattctgatgattaatcgcataaaagtttgatcatttttcaatcggaaaatgaaataaatagaacgcatataaaaattttaaaaaattagcttatagttagttcagcaaggtttaatatagtgataataaagttaaataaatagacaaacaaataaaataaataaaaaaagaaaaaactaataaaatgaaaaaaattaaaaaataattacatcaattaagcctaagcaactcaacaatctttttgcattgacattcttttatgaaccagtggtacattttaaagagaaataaccaataaatttttatgaatttaatcatattttaaacatttaaaaaacaaataaaaaaaatagtttaaatgcttaataatctttctcctgcccgaatgtccggaatatcttgcaatatagaatgaaaggtgaaatatattactaaacataaattaaactatcggtattattgggttaaaaaaagaaggtacaaaataatacagatcaacaacgggcaaacaggtcaacaaagcctcaatccgggtgctattgaaacacaatgagcaactacacaaagaaattcggattgacgaactatgatgctcgattatttttacgaagtatttaaataaaattggtagagattccgctttttaatctgtaaccgaaatgccatttttagattgaactaaaaaagcaataaattaaataatgaattcaaaaagtttctgaatatatattataagcaagtactaaaagtaaaaccatattgcaatagatgataaatttaaatatataaaaaataagataactttaatcatggaagaattggagaacctcagccatggcccgttggttccacttttaatataatcttcacagaaaacaaaaacaaaaatcaatttgagatttattgcataaggaaaagtttaattgtaatacaaaaaatttattttaaatttcggtcaaaacaaaaaagaataaattgtatactttaaaaatagaaacataaattgatcatagcagccattcccgaggaggaggcgctgatggagaatgagaggaatacgaaaacgaggacattgggggcgattacaggactgttattaccagtcgacaaaattaatttttttctatttggtgtcttataaatataattaataaattaaagatattgtagaaagggttccatctcgaaaagtccacttgggatcctatggaacacttgaaggagccaaagtgcttttagagaaggtaactaaaaaatagtgaaataaaataaaataatttattagaaaaaaaccaaaacaccttcaagactacaaaaataataataaaacgaaataataaaaaaccaataatgaaaaaataaataataattattaataaaaaatacatttataaataaatttacacacaaaggatcaaagattcagcaaaattaaatttaataatggcaatgggtccatcaaaattatccaaaaagtggaacaaataaaagatttaaaaaaattaattaatagattaagtgtcaaatcagcaaaaaaaaatggaacaaaaaaaaaattaagatattaaattataactaaaaaataaacaatttatatttaaaggacaaaaccgaaaagcatgcgcgtaaggaaaaagtgacgaaagaaggcatggttaaaaataaaaatataataaagttaaatttacaaatatattttaaatttgaaggccattgtgcttcgcaatctacataggattatgtgcaagattcttatggcaatgcgaaaaattgatcaatttttaacgataatttaacctaatcacgtgaccggattttcatattataaatattagaaaatgacggtaggggagggttcattgccatcgggttcattgctagcccagttttcgatctataacttttttcattgtggaccaaatctaacactctttgtatcattcgaaagctttacgtgtttagaagctattgtttcacgattagacaatttccaaaaagttataacatgaaaattgcgaacaagtccaaattctgagtttttttaaataacctttttacaagctaaaatcttaattaatgaatgggtttttgaaaagtttaaaattggaatatttctcaatgatatattattttttgtatgaattaatataaagaaaggatatggtcaatattcggccactatatttttttagagtactgtataaaaattgtaaatatgcatagtaattggctcacgctttttttgagtcgctcgaagaaatagttataattaaaacccgtacacgggaccgggaccccgccgggatccctggtcccggttttttggacaaaccaccaggaaccgggggtcccggaaaaacgggagac

SEQ ID NO: 11688 - DNA, 1826 bp, Heterodera glycines
gacattttgcgaaaatacggataaatatcagtactacgtacttgacatcgatacggattaagtatttacggactaaaaatacggaaaatccgttgtacgtaaaaatacgtatccagattcagagggcctgtatttccgtggggtccaggctcaggaggcctatacctggaccaggactcggaatttagggtccagtgtccgagattcgagaccgcaaaaacctgcaacttttcacgagtcgagactgagcctccctctctcgcgcattactttttcatacatgtaacctggacctgactggtcccaagcatctcgttgagtggacctgctggattttcctggctttttgtccaagaaaagccaggtcaaacacatggaatccaagtccagcaggcttcatttcagaatgtcaagctctaatgtgtaccagggatggcattccgagtccccaaaaattttcagaaatcggaattccgggtgtcaaaaatgttcggaaatggaagtcggaaatcggaattccgtgccatccctgatgtgtacgttttcgcgacgcaaaaaaaaatttttttttccaatttcaaaaagtgtccctttttttgcttatgttcacaacagaccactgcttctccggctcgaaaagctatgccccgcctcaattgtctggtcgacaaaatttgcgcaaagttcgaattgtttattttttcgcattaaaataaaattgttaaattattatttgttttaaatagggttggtcgggaccgagaattttgggcaaaaccgggaccgggacttttcgagttgaaaaaacccgggactttttggcgctgggaaaccgggaatttcccggtctcggtcaaaaccgggacttcggtactcagttgtccgtgttttggtccgaccaatcctagttttaaataaacaattctgaaaatgcattcatttctcggaatttctaggattttttgttggtccttaatccggcacttatttcgacaaattttaaaaaaaccggattacaattccaacaaaaagtcaaaagaaagatatataacatgtttaaatacgtaaaaattacttaaaaacatcataataaaataataatttatatttttggacataaaaaattaattaattaaatttatgtttttgctcgaatttcggatatggattgttcggaactcatcgagatttaatcccttaattccgggaaaagtaataaaaaaaatttttgcaaattttcagaaaggatgagaaaggattattggtgcataagctgaagcgacgctttgcactgtttgccaaaatggatttgcaagaaatggaatgttgggaattgcacgaacgcttggccaagctaaaagtggccaaaaagaagaagaagccgaacaagttcgagcggtttgacgccgacttcggcaaggccatgatgaccgaaggcccagtgtttgtggaggatttcatcaaagcgatcctcctctgctgatcacttgctaatgaggggctaattaattgaggggggaggggacgaggaggcgataaaacgtacataaaataaattgaaaatttcaaaaaatgaaaagtcgcggaaaatttaaaaaaaacggtctacaataaaaattaaacaaaaattttattagaaaattttaaaaattcgaaattttttaaattttaaggaaaaataatagatttttcgtttttttaattaaaattgtacgttttgcaaattccgcattctttttgtcttctctgcaaacaatttttcacatgaaaacttgttttcatcagctgtataccaaccaaccaaccaattccctcaaaaaatgact

SEQ ID NO: 11689 - DNA, 2818 bp, Heterodera glycines
  misc_feature (2744)..(2744): n is a, c, g, or t
  misc_feature (2782)..(2782): n is a, c, g, or t
tatattttaggaaagttggctggttctattatggtttgtcgcccataaattttttgaaaaaattacaattttaaaacagtcgggaaaacattccttaggttttcgggatcgctgattacgaatttggcatccatttcgacccatttctaaccctgaacccgaattcgaataaaaagtgaaaaattaaatactcaacgaaattcacatttatgtattgcacaaaaccgattcattccatgaaatggccgttcgttggccgtgcccgactctccaatcccaaaatctgctggctttttttccgttgcccagcactttgtccaataaatgtaaatttgtttaaaattaaattttgactttttgttcgaattcgggttcagggttcgaaatggatgcaggatattttaaaatcttgatattttcgatagccctaagtgttttatattatcatgcaaaatttcatgaaaattcattaaatttaaaaaaagttatcacctgagaaactcaaaaatccaaacatttttagtcataacttacttgaaaataatgaaattttgcaggataatagaaaacacttaagtctatcgaaagatatcaagaataaaaatttttgttgcttttgagaaaagttataccaaaaaataccatcaaaaattatattaaaaaatgaaaaaataaaaaaaaaatggaaaaagtcacttttaatttttttttatttaatgaataaattttttttgttagtttttgactaacttcacagcaccaacagcgaccctgaaaaggtaaggaaaggtgttctacccgactgtttaaaaattgtaatttaaattgctgtacttatttcctagcatgtacttggaaataggcattttacccataaatgggatgggttaattgaagttttgtgtttgccaatgtggcatttaattatgatgacctgaccatgttttaatttaatttatcgtcagaccgtctcaagttggccttgctggaaacaatgaaggagcttgaggtggagacaatgaagcagttggacgactttttggatcagatcactttcatgttctgatcaatgctttttcgtatttctgtatttaattattcatatttttgctctatttattccgatcattggttcctttatggttttattgtattcttttttcatttatataaaatggaagccaactacaaaaaaccccggaatgcaaaataacatttctttactaattcaaattcaaattctttaattgtcattagtaggattataagttgtgtaacatattctaattatcacccatatttaatccgacatgataaagagccacacgaacgattggaccctttggacttcttggggattgggcccgattcctaagattaagacctttcagtcctgggacaatccgtctcctcccatcccactctggcatggatcctcacgtcttactgttgtatgattttgtatattttttctgtacatatgctatgaagaaaggggctcaaaaacagcatttctgcgttaaaattttttgatttcgtgaagattttataaatttggaaattcagtatttttgcaattgtctaaaaattgctcattagcccttttttggtattttaaaagtcaattcataatttacacaaaatttttggcatttttgagggttaaaacacatctttggcagtttttaaggcatattttagtgcatgtttgggcatttttcgagtttttaggacatatttgggagatttttagtgcatattttatgtgcatatttggcattttttagtgcatacaacttataaccctagtcatcagaaagtacaaaacttagttgtttcttacccttttccaaatttaacttttattttaacatggaaccatagataatttaattttagaaactaggtttaggcttgcttgagcctaggcctaggcgttggcctaagcaagcactgtttgctgtggatgcatttctctattatttttttacattttttctctaatttaattcattttttaattttagtccatttggaattgaaattttaataatattttaaaactcaaattaaattagcaaatgcttttatttaatattaagtgaattttaattattatttattcgaaatagaaaactctcgtctttgtaggggtctcgttctcgtgtctcgttttaggacgagacacgaaatatgggggatagggcggagttgagagaaatatttccgaaaattgtgagaaaatgaaaaattttaaaccccctgctggttgggtagtaaattttcacaaaaagtcaaaaaagaaaacaaaattagcctttttcgactctctctccccattcggatttttttaatttccaaaatgaattttaaaaaaataatttttttcttattaatgtatttttttaataaaaattactaaatttcaaacataaacttaaaaaaccattttttgctgtaaagctccgaatttcgctcgcgtatcggagtgacgtgcaaaaatctgactatgctgcgcgcgcattctcttcaatgttccgggtcagtgtttttatggatgcaaaaaaaccaacaaaattttaattaatcagataagcgtcccccaaaaaggcactaaaaagtctcaaatttatggggtgtaaaatgacaaatttattcaaaaaattagaaaaaaaaccaaatcaatgttacgctaaataattttaaaatcaaaaattcttgtcaagaaattaaataaataattntggagacgaatttttggaaaaattttttcatttcttangggaatattttctgaaattttggtcgatttttaggg

SEQ ID NO: 11690 - DNA, 1461 bp, Heterodera glycines
  misc_feature (32)..(32): n is a, c, g, or t
ggatcagccggattcataagcagtgaaatttnaacttttgttaattggcacaatattaattccaaaaattagtcccgaattgtgattcttaatgtttcaaaaaattttagtttcttcccattttcttccctttgatgttttgccgcttccccctccccctttccttcgcctcctcccttttaattctgctactttcttcgaatttggtgcttcttgttgggggtaagtaagctgcttacaaattaacaaatgaattggcattggcattgaaccgtttcaaaatgtttgtgcttttttaggtgtttttaaactgttggatggaaatgctaaactcgtgagcaaccctttggagaatgtggtgtatctgttccaattcccgagaacgtcgaccacgccgagccaagcgccatacaatctgatggtggagacatggctgcattggaagcacatcccattccatgtaccatattatctctaattatcccccggggtgattattgttcaacttcctcagaaagggggggattattaaatacgggggagaccgggggattattgttcaacctcctcagaaaggggggggggataattggatgcgggggataatggataattagagataatacggtatatctttcattcgaatgtgaaacagtctcgctaatcccacatttgagcaaaaattttgatcataattctgccaatcactttttccgttctcccatcccttcacagcggatcaacaaccaattgttcctcggctctcattcaaagggcacagcaccgtatgcatatttcaatggccaatacattgacggatcgaaggaaatcatcaaaacagttggccaacattttaagcaatatcagccggttgaaggtgaagaggagctgatgggcacgctcctcgacatgtttaagtgggttgggttgcgtaacatttttttgttgataaggctaattatgctaattaatttggtttacacaattacagtattcttatggtcgatcgtgaggccggcttagaatggatgactaaagatgaggcccttgtggagatcattgtgccgcaaaccttcaccgatcgaccgcttactgtgcagcttggagaggacggtaacttcaatgtgagcgtgaaccaacagttttgggagcagtactttgacgcgtacaacgccaaaggacaaactgagaaagtggcatttgtgaatgcttttctgaagcctttaaatgggactgatcagaaagaggtgaccaaaaattgatcagcatttggcgaagctatcgcatttgtcggtttcaggaaaatggatcaactttgacggacggaaggctatgggtcgacttcagtgcgtggcttcgccagaatgtgatcaaacgcacaatggaaacggtactaatggtgacggtgaacggacagccgaatactgcgaatccagggaacagtcaagcgaaggtaaaagg

SEQ ID NO: 11691 - DNA, 2185 bp, Heterodera glycines
  misc_feature (13)..(13): n is a, c, g, or t
  misc_feature (1167)..(1167): n is a, c, g, or t
  misc_feature (2149)..(2149): n is a, c, g, or t
  misc_feature (2178)..(2178): n is a, c, g, or t
tttatttttttancattttggccaaatcatcacaaattcttttcatcgacaaattttccaccacttttttgcatcggacaatttggcgtaaaatatgaatgaatgcataattaattttatttattatagaattaataaatattatacgtatttgtgattataaaacgaaatgataaaatttattaatgctgtgataggataaagcatagaaaaagtgggtcttcttcatttgcgcaagcgccgccgccggcgtactttcaaaaatattttggatttggtataaatagacacaaattggactgatcagacttgtgcttgtcttaaaaaatgatcaagctacaattatccgtgccattgttgtcctcgtccaacaccgccatgttctgctgggccggcacgtcccccagcaaaatgttctcgttgttttggatggagaattgaacacgctttttgatcggcttgtgatggatggaacagcttattgcaaattattattctaatcatttaaaattactcgtaaattccttctaataaagccccccccccctcaccatattaaaactgggcaaataatgcaaattttacataaacacacactgagtctcttctaaaataaggggtccatttaagaagagttagcgaccattggttactctcactaagtttttttctcttcaacttttccaaaaaatttgttgaaaatttttcaattttttctatactcttttctattagcctacaaaattttaaaaaattatttcgtttagtttcaaaaatctatgacaaaaaatgtttgaaaacctggtttcaggtgtatacttttggccataactttgttcaaacttgacgaaattttttgaaaatttgcagcctaatagagttaattgttagggctatcgaatgatttcaagaattaaaaatttagttggctttgagcaaaattaggggtagttttttgttgaaaattttcatttgatggcttttttataacggctcagcacccggcggaggctgcctttgatgccgtcgttgctcattttgttgttgcccttctggcgaccgcacaatgccattgccgtatgtgtgggaccaggaggacgaagtggacgacatgtaccacattttgaagacggtcaaagaataggacacgaaaattcggggtaattntagaatattaaattttgcatatttttttatatcccctaacaaataaaaacatatttttccggaaattttctcaaacattccaatttttttcattgctaattaaaaaagaaccctttgatcagtctgcttctcatttatactgatcaatttaaaaatgtggcattactcaaaagctttgcatgtttatttaatttttaaaattgaacagcaattaaattaaacaacacaaaaaaaagtgaatttccaaacactcccaaaaatgaaaaattattatatattttcttttgttcttttaatttgattttatttgaaatttttgtacgtaaattttttattgaacttttttgttttgaagggtttggcacggattttacaaagaacaaaataataaataattaaatgaatacaaataattggtgtatcatgaaataaatacaaatattccaattggaaatattaaacagaaagacatctccataggcattaattaaatttttaattatttttattaattttttcgacgtatataaatcaaattttgtcaaatttttctctttttttttgtctatttatgagaggatatttatgcactttttgtcaaaaattattgcccacgctggtggataatgtgttaaaatgcatatagtatttaatagaaatggattcaaaaaatgacaccccaaaaaattcaaaaataaaataaaaaatttgctgattggaaattggccaactgatcagctgcagaagacagatcatcatcactgatctgccccttttctctcatggatggccaacaaatggcacgaacacatggataagggatgaagcattgctcgccaagaatggacttggactcaatttcatcggcgcctgttcttcgacttgcaaacttttgaaccgttttggcactccagcagcttcattagtcaaacagtgaatttcgtccacccgtatgatttcgtttgtctccggcttactgtangccccaaagcttacggtacctccttcggncttctgt

SEQ ID NO: 11692 - DNA, 4082 bp, Heterodera glycines
  misc_feature (2163)..(2163): n is a, c, g, or t
  misc_feature (2189)..(2189): n is a, c, g, or t
taagtgatgaagcattgtccaataatgtacttggattcctccctagcgacagctgttcttcgacttgcaaactcttgaaccgtttctgtgacggtggtgttactccagcagcttcaaaagtcaaacagtggacttcgtccacccgaatgatttctttggtattcggcttactgtagccccaaaagcttacagtacctccttcggccttctgtaaaattagtcaattaaaaagggtttgagaaattaggaagccccaactcacataacaattaacctcaatccgagtccaatcgtatcgataatctatttggatttgaattccattgaccttgaatttacaaattaataaatagatggcattttttttcatttatgttctcatttgtccttatttccgcttttttgatacaaaaatggtaatttttacagccaaaaaaattaaattgccaaaatattatatgaaatgtgtctgtggcggtgtcttttggcattaattaataattaattaattaattgcctttattatttggcaaagaaatgcgtcgtgtgtccatttttcttcagcgaggcatttcttatcaccgtgacaggagcagtcataaaattggtgtttgacctcgtcataacacgtgaaacctctgtggccgggattccttttctcggcaaacaaattatcggtatttacgcatttgctcgaatttatgagtttggcgttgccttaacagatttttagaacaattttccattagatatgtaaagcattataaaatacaaatttaaaatttttttttaatttaaaaaacaaataaaatttattttacaatttttccttgcctgattcaaatgtcagttcgaatacggtagatggtacggtccattttggtgaaaggtgcgcggaaatgacaatgtccatgtccggcttttccgccgcaatccaatttttgtattcattaccgttcagatcagtaagtgcacggggacagcaaagtttggcaccttaatgagcgatcgttctgctaagtaataattaattagttcattaatttttttgccttgtgcccttttgtcggtacggtatttgatctcgacgttacggtggtgtgcatgggtgtgagcagatgatcgaattgttcaagcttttgaattgaatttgcacttttttgccagacatgggctaaaatccttttcactcattttatattgttaattattaacactataattatctttttacaacaaaataaaaattgccgtaattcgccaatggcaacggcattctttgccggcagaagtgcacccgatcaccggtttcaacactttggcggtctgatcagatttcaattccctcgactcatcgcccaaaatctcgcagttctcatctaataaatgggaggaacatttttgggatattttatctgccacttaatcgatttaataaaaccatttttctaacaattcaattcttcaattttgtaaaatttaatataattttaaattttttactcactctcttcgagttctttacagtatttgccaccgtattcgtccggacaatggcattttgtgcaatcattcggattcaaatagcccccgttttggcacttgtcctcatggcctttgcatgagtctgaacaaatggaaaatctactcaaattatatttcaatttatttgcctttgcaataaatttggttaattatcgccgcgtctttgaaagatattctgccgcgttggccaatcgtttgctggtaaaaccgtggcagagtgatcagagagtactgatcgctgcaatcaaacaataattaataacaattattaaaagtagtctcattatttagcaggagccgaaaacttaagcatttttgtgttattttcgaaaatttttcattggtgaacattctgggttagagctagagttgcacgggaccgggaccgggtcgggaaatcccggtttttcaggtcccggtcccgatttttggaaaaacagaaatcccggtcccggttttgccagtcccggtcccgggtttttgtcaaaattccccggtcccgtgcaactctagttagagcaaaggacatttcgacagaaatattataaaaaatgatgccaaatcagtattgagataaatagttttttttaaatcatgaatgacctagtaataatgatntagcaatacatattagtatgttaatntaaaagaaatttagtaaaactgacaagcaatataatttattttaataagatttatttgtttttatgtttaatgtcgaaaagtccattatttttgtatgtcctgtcgaaaagtccgggagcctagaaatcccggttccggattctattcgtattttctaaaaatgattattacttttcttcgtcataatgtccaccgtaatggagcaccgagccaaaatcgtaaccaaagccaaaattttctgcgtcgtggcttatatccgattgctattaaaattttgaaaaatttaatttttgtataatttttaatttaaattatttttacgctgttttggtgcctcaaaatgacaaagcttcgcgcatcgctcctgctttgctcgtgcaaattgccaagtgcgtgcaacagttcatgacaagcaacccccgacatgtttggttgtaactgcaaattaatatcatcactaatagttgtcagacaataccgtaccaacatagcattgattgaattacagtatagttagccagtggaaatattaaattgatatttttaaacttttcttgacacttcaaattcatcaacaacaaacattaattgccatgccaataccgtacccattattattcatttacagtatcagcgtcaatggcaatttttttaaatttaatattattaaaaaaattctttttttttaattgaaaactcacatgtggacaagtgtgttccatcgcaagcttaagttcttgccaaccaccaacttttccagccttcgattctccaaagactaaatttttgattatctcaaatagggttgctccccggtccccgacccccgacaattgagctcctccccgccccgacccccgacatgtcgccccccgaggtccccggcattttaccccccgaggggtcggggagcaaccctaatctcaaaagatatttgaactaaaaaaaaactctgcaattcgcgcggattttcaaaaaaaaatcgctatttttcaagagtttaagaattttttccaaaattttcaatttttttattctgatttatttaaaaatcatttcttaaaacttacggcaagtctttaaaactttgtgagcttcggcaaactcaatttctctaattaaaatgccttcgctgtaattgtccttttcttcaacattaacaattttgaattgaacgcatgtgtgttgcctgttttgaaaattaaaaaggataaacaaattttaaattagaaattcaaaaaacggcacaaattattaagcgaaacaaaatgccctgaaaatttttacacaacaaatttgacgtcaaaaattctttgttagcgcaaaatgctccttcaatcacggcaaaaaaagcacaaatttatgacaaagattttttaaaaaattaggcgtttttataaagagacttttgaattttttttaacgaaagaattttgagagaaaattaggatttacaaaagaaaaaattttagaatcttacttattcataaaggaaaacctttaaagaaaaaattgaatattttttttcaatgattggaaaatttcaaaaaatatttttataaaatttctcttaaaatttaaactttcttaaaatttaaaaaattattcaccaaatttaatatttttccattttgatcacctacattatcatgtcggttccgacttttatcgccgctttccatgctcggtaatcttttggcactgaaaccattttgaaaacaatttattgtataaatggctttcaattttaaaggcaacttacgtttatcttccaaaaaactgatcacgatcggaaacgaatcccatttgcccaattgtggtccaaaaaacggacgaaattgccttttccgccgacggctgatcagattttcaggctcgagcccacatccttt

SEQ ID NO: 11693 - DNA, 2523 bp, Heterodera glycines
cattatcatccatcaataggaaataggggtaaaatgaaaatgaaaacaatatttataaatttattcacagttaacgacatttatttcattaaaccaatcacttgaacagctaaaaattaatgaattaattaccataattaataattagtgtagctaactgtttaccattattcctattgatgaaacgatgttaccaatgcaagcaattctttattaaacagatgacgatattcagtacttaaacaataaaattctaatgcataaaaattatttaaaaaataataaatgacctgctaaaataaagcacaattgcatttgatcctgccgctaaattcaacagaatgccaagaaagcattcattttgccaaattcgaattaaagacctataaaatatattatttgaaaatttggaatattttttattacccaaaaatagagctaattatgtctataaatcggtacagggccagcgtgatcaaataaccgccaatgttaatcaacaaaatgatgctcagagaccgtaacatcgcgtggacgtctgttgggttactgtaaaaattgttttcacttttggcattttatggcaaaaaaaacgccaaaaaatttaccgccttttttgcatcgaattatcaaaaaaatgggccaaatagcagaaaatggctacagctgagaatgaatgcgctattgaagaaaaagcgccacacattgccctgaagagtttcggccacgaagccggaggatttattaaaatatgaaaaggatttatttatttaaaatttaaataataatcgaaatgtttgaattatgagtagggttgggaatttaagtcatggaaaatacccaaaaattcaacaaaaaaagtcatagaaaatggtgccaaacactgaaagaatcggacaaaatggggcgattgtttcaattcacggggaattctcaacaattaggaaaaatttttgccgcatttaaattgcccttttcaccactggaactttattttaggcattttcattgctgaatttcaaatttgccataaaaattgaagaaaaaaagtcacgaaaaaagtaataaaagtgcaaaaatgttaaataaaaatgcatttagaagcttcgaaaaaagtgtaaaacacttttaataaaacaaattttaagtcattttaaagccatttagaatcatgaaaaaaagctcatttgacttaaattcccggccctaattatgaaatttaattaacataaaggcatttaaatgagtttccatattttggcccttttctttcttaggcctataaatcaagtaaataattttttatcttgctttaaagcttcatgggttggtaaaattttactttccataaaactgataaattaaagtttaaaatatttaatttttaattttattttccaagaattaaaagattttcacttttttgtaaaaatttaattatcatagtaaagatttttcgaaaatttgtaaaccatgtttttgtccgaatttcttattttggaacttaattatcaatttaattgtttatttttttttaatgcgccatacattccgcattttcgatagcaaattcaagcacataatcactgcataaattccataaattacagaaataaacaaataaacgaccaaatacgaatattattttaccagaacttttttaaaagctcgatgaaattttttgaaattttaaagttaaataaagaattcttaggactatagaatatataaattcattttgacttatttgttcattttaatgacttaaaaattttaaatgtttataaaatatttgcatgaccacggcacaaaaacctagcctgttcaatgccatataagtttttttcagaagcattagattaaattttattttttagaatttcaagtgctctatttaatctatttatttttaaaattacaaaaaatttcattgagttttaaaaaagtttaggacaaaaattccgacataagattttgtggaatttaataaccaaaactttttttatactatttaaaaaaatttgaaaataatattctgataggaatgataccatgaaatattaatttggttgatattaaaccaagttatgaatttatatgttttacattttttattttcctaccccttggcggtttttagaaaacgacctagcaccaaattaccatagaaaatataattttaaaaaaaattcagggggtgacaaaatggataagaacccataatagagcataaattgaaatttcagaggttggttgaattttaattgaaaatatttctacttaaaaaaatgcaaaaaaaaagcaaaacatttttaggcgattttcatttttcaaaattgatcaatcaccgtaaaatttataagtaaaataaaataattttatgtcttttggccaacaaatgtcaacaaattgcttcaatcattctcatttttcgctgatcagttccggtgctcgggcttgcacctaaataaatgaaaaattaaaatatttaaaaatatattttccaccaatacctccagcatt

SEQ ID NO: 11694 - DNA, 1336 bp, Heterodera glycines
attttgtgtgactgatgagactcaaccataattaaatgaattttaaacagaattaaaattaaaatagtaattgttgttttaattaacaactttttattgatattgaatcaaaaattgaggcaattaattattgtgatttaattatagtagtcgattttatgttctcaaaatttcaaatgggtggcaagaaaatcgagaactttgtagtttctttttttaaactaaaaagagttggcataaatcgaaattttatagtttcttttttactaaagggagacaaaaaataattggatttttgaaatttaaatttgtaatttaagtcaaatattgcaattaaattttaaaaatgattatttaaaaaaaaaaaattaataattatcattatggaacaattagacaaaaatattgacaaacaaacatataaaaatggttaaaaattggggaaaatcgttgaatttcttcgtccattttcatcaatcatcaaattccgttgttgttcattttcttgacaccagcatggcgtactgcacacatttgtcccagtggcgctcatcggacgggtcgtaaatgcgcaaaaagagtcccaacggcagcgcactggggtccaaccggccaagcacgaacatctgattgtgagatgacaaaaatggcatttaatttactgaaaatttgccggtcatttaatttactaattggggcaattagggtttgatctggtattaattatttatgttgtcctattctgtactgtgtttacgcactcagaggagttcgtaagtgtgcttattttagggttcgtgtctttttgagggccggaaaatcaaaaatttttctggaaacctttaaatgacttataattaatttttgaaagatttttaaaatgatttaattttttcaagaaatgaccaaattatgcaaaatttattttttcccgatttgtttttaggaaaaggttcctgaacaatttaatttttggcatgtggatttactaattggggcaattagggcttttgatctggtactaattatttgggttgtctattctgtactgtttttaagggcttacaaattatatgagttcgtaggtgtggttattttgaggaattgcgccttttttgagggccggaaatacaattttttttttctggaaagctttaaaaattatttcttgattcttttcgctggctgactgactgactgaccagctcgatgggcatcatgtcgaccaactgtcgccagtacggagtgcggggcgcttgggcaagttcgtgcaagaagaaaatgatgaaagtgaccggcgggcgcaacgtgcagtcgcgcacaatgcgattgaagc

SEQ ID NO: 11695 - DNA, 5743 bp, Heterodera glycines
ttttggcttgggccacaaaatacaacaaaaaattgggccgcaaatgtccgggacgcaaatgtcgggccgcaaaagtcgcgccgcaaatgtccgattttggctggggccgcaaatgtccgggccgcaaatgtggggtaaccggtattttggcctgctatgtgttaatatcacaattaatgtcgataaaccgggcacaaagtcagaattgaatccacaatttgggtgtggtccttttcttgacaatttccgtctgcttctctgtgcccggcctttgaagcaatctttcggggaatgttctatgagatcgttctgtctgtctttttctctgccgctctctctttctctcgtcagtctctgtcttctctgttccctgtgtattttttgcattttgccggtctgaccacaaatcggacgcaacggcacaatgggaagacacatttggtcaggaggaggacagcgagcagtagcagaacgagacacagcaccaattccacgagacatgtgaacagctctgcgggcgaattcagcccgtccagccattggcgcgggtccaaactgctcagaaaagactcaactgaggtggaaaatgaaacaattgcaagtcgtcgtcgtttttttaagtaacctccgcgttcgttgcaccctaaagccattcattatattttcagatttgaaatgttggcaaagtgttcggccattaccttggcactccgagcgttgcctttgccaatgatcagtcattggaggtttctcctcaaaaagaaaaattctaaacccattatatctatacttttgtttgtacctggaggggttggcgaacaaagtccagccgatggcactttcgcttttcgatgcttcccatgggataaaaacagaccaaacgcggggaccgtacggaagtggccaccgctcgttgggctttgctttgcgtggatttgctgatgtcaatgctgaagatgctctccatcaccgagagtgagtcttgactgctgaatatctgtccgatgagtgtcccccgcgcattctgtgccgaaatgtttcccattttccgacaaatgccaaaccaacaaagaaagtgaggttcagaaacaggttggactctctgtccaagacaatttgagccggagaagtcgctcagttcggacgaatggtggacaatccgaggccatgactcagtccgaagagtcagctgaaagtgcgttggtacgtcggagcgattgccggcactcactgtcagtgccactccctcggcatgttccagcacaacttccctttcgctcgtccgcactgcccccgcccacggctcctcctccaccaaattgcccaggtcgaagttgcccatctcttccgccgttccctcggcttcttcctccccatttgctccctttggagtcggcatttcttcggccggggagtgccgtcgcagcacaaattgttccgcgttgaaagtggcgcggtaccgctgcgatttgcagtcctccacgctgatgtgctgaataaggcgcgagttttttcttgccgtgcccttttcgcattgcctgcgcttgcgttatcttctcgagtcccttgcgcaccgcccatccgtggcccttttcccaccgaaaccatcccaatttttccaaattgctttcgcccggccaattcaacggaacgccgtcacgaagacgatgtttcgagtcggtatccgcttccgggtcctcaattttgtagaagtacatgcccggctccatcttccgttggggtgtgccgccgactggcaatggttggtggaacttttatccgatttggccactaattaccttacccgcactaatctccacccgatgttcgcttctgtcgtccgccgttttgtcccttgcgtttagttcgaattttgtcgaccctttgttcagcggaatggcaattcgttcgtcgaccctttgctcccattggccctcccctttcgcttcattggcactccgttcaaagattcgataacggagaatgaatacgatggacggttgtttgagttggaccgattggaaggtccattttttgtatggctggcaaaaagtcataaagaaatcaaacatccgcgcgtacctttagctccacctgagaaaaaggttatcaacaattggatgataaggcacccatttaccacaattgcttaattaattgctcacctggcagcaaatttcggcttttcccgagctgagacaccccccgttgggctgacttcctttgtgtgtacggtaacaaacgccgtcggaaactgagcaattcctgccaatgccaacacagcaaaaattaacccacagtgccattcttctacctgtactggtacttctcgacgctgcaaatcgtttctccgcctgcgcagtcacatttgcacctcggggtgatcgacggaattgcgaatttgtacgtacttttgatggcgtagtgtaactcgagaccgactgatttatgagaaatgaatgagtggataattatgaatcatcagtgattgttccgtcgttctccgataaaaatggtccgatatggtaccgtaagacactgaacaatgacagcactgaccgtattccacgatatgaagcagcgaaaagtgttgctgctgttcgtcgtgtgcttccgcttctctgccttgctcatttgccgaattgttccccttaattgcccttttgctctttccccgtcctcccctcccggctaacactgattagcatgcaatgcgtttctcccaaagtgattgtggtcaactgcacaaatgagctgatgttcactcgttttatatcttcatttgtcaataagtccatctcagttcggacttcggaattcaaaaccaaattattggtgcactgcggcaaaaaatcgaagcgcgaaaaacccgcgggggaattttcagaggaaggcatcgccgggggatgaagcggacgacggacggacaaagaaagtggggacaaagaggaaaaatgtatcgaagagagcggcaagaaaatccgaatcaaagtgaagcggaaggggcacatttgaaggatgagaggaggagagagggaggggacaaaagaggaaaagcacctgaaatttaacgaaaatggctattgaaacgacgaaggacaatggacaactgaatgaaatatgaagcaaactgaatagccaactgaacggaattgaaagggggggggaaagggagagagagagagaggagagaaagagagagagagggagagagaggagagaaagagagagagaggggagagaaagagggagagagaggagagaaagagagagagagggacacatgtgtaggagggggggggggggcaaatgtgtgaaaatggacaaggcatttgataatggacgaaaattagctgcgatcgggaaatgttttcggtgtggaccaactatgctcccataaacacatcccttcaaaagccccgccttttattagcttactcattccccctccccttcacccaatttccttttccaaacaatgttttgctgacgcatcacgcgaatccattagtcacatgaacaccattccattaattaactgaacacatccagaaagtgatggcagtgatcaaaaagcgtggaaatggtttcaaggtcgcaaaactttaagcggatgggggggggatggagtggtaagagtgggtgccaagacggaaggaaaatgagcagaaattgtcccaacggaaaggaatttaaaaatgaaactgagttaattggatattgttaaatgatggatgaatgtgcaaatcttcgggggataattgtttggggataaggacaaccttttctcatcccccgccggtcgcctaactttcctttttgcggcacggattagcaacggtaaatggggggaatttgaggggagaggggaattgtccaaggtcaaagaaaggcgcagaagaaagttctctctttttaattgtaattgggataagcggaagcatcgcaaaattgggaagggtcggataaaaaagggattaattttggggaaagggggaaaaggggggagggattggcaaaacatagcgattggaatggaaaagcaaaatgatcgagccgttagcttcgcctgtcacccctttggtgctgagtgagtgaatgaatgggttgtctcttttcacatttttggactgttgaaaagcaaaaaatgaacaaaacgaacgaatggccgtcgatttgcatttgaacgggcgaaaggcgcaacatttcgcgcagccgacggagatttgtgaaggaacgacggatcttgaaggattattattcgtcgcttcatttcttcgggaaatttgacaggcgagcgaaggatcagccactgagccctccgtccgaatttgtccttttgccaacatttgcccaaccgtcgccgtcccttctctccatttcaccccccccccccgctcaagtggcaattcttgaacgcgcattggcaatccatgggtaagcaaatgcatcatgtcgaaggacactgacaagagactccaaatgggtgagcagtggaattgttgagtttgatgaatgcttgcggaacattgcgatcggattggactcataaaattgggggacgatttggggggggggtaattatggacgcgggaaaaatccaatggtcagctaagggaatgaacaacagccaacccaccgtccatatcagttagttgtctgttgcgcgactctgttctaaatttggatcacccctgcccctttttcatctattgcccttcccctccctctctttccatgcttttccctctccctcccctccactctctcccatttcgtcccccgtccctccgctctctcatcagtcacccgtgtccacgttatccctcctcccccatttgttgactcaatgccgacaacaacagcaaaactcgttgtgtggtcggaaacgaacggtcggaagttgagattagcactttatgaaagctttgcccgattgaaaagccaatgaaccatttccatgacgaaatgttcctccaattcataaattaaccataattaacacctttcgagtcagtttatcatctaatgccttttgtgatttgctattgggttcagttttcctaccgaaacttggtatgtttccgaacaacaaaaagtgtcagaaataaaatcaacgacaacagagaatgaaaaatatgatcatatggcctaagacatggaaaaacaggacccagagccgaaaatggccacaatatatatagctctcgatctgcagtagacgaatccgaaagaattttttcgcggcaagcgtcaaccaatccatgaagagttacagacccgggaatgaaatggccaaatatagagctaatattttttggttttagcctaattttttcctgagctcccagtggcatttacccacaaaaatttcagaaattacactcctaagaaataaaaagttttctcaaaattcatctcttaaattttttggtaagacttcaattcaaggggtaaaccaaaaacacgtttaatggttctaaaatggcgtataattaataggatcatcattttttggcgtaaaaccgacgatttcttggcgaaatgcaatttttttttaatgaaaaaatgaacaaaatggggcactcctaaccttataaaacggtcaaacccagacaaatttggtatcatcgaaagctcttgatcagctaagtctaaaaaacaaggtataaattcgaatcgacaccatctaagcaccgggacaactgagtcccagtgaaatggacacttcagtaccaaaaaa

SEQ ID NO: 11696 - DNA, 1354 bp, Heterodera glycines
  misc_feature (32)..(32): n is a, c, g, or t
ttattccgatcaattaaataaataaaaatttntgtcgaccatcaaaatcacagcaaatttttgtcatcgctcatttttctgaagcacttcaatattgtttgttgttgtgcttttcttattctgattggaggaagtgattgttgtgaacgggttggggcgcaaggagcagcagcgacggagttgggcatctgctgggcttccgattacattgcgggaaatgacaaggagtcttgaatgaaaaaaaataacatttaaatttatttaaaaataaaaatgaatttaaaaaactctatatttttaaaacaaaaattgaaaaaaatattttatatttatttaaaaataaaacttttaaaattagtgtgaaaaaacctcaaaagaaatcaatcaattatttgatagagttaggaaatgaaaaagagaattttaaggaaaccatgtaatttctgaattaattttaattaagaattttgataaaattttaaaattttttgacagccataggaattcgaattttcaagacttggagggatgtacccgttagagaaaatgtatttgtcaattttttgttttttttcttatgaaattaaatcatcctaaaattgaacgaaataacaaagcggagcaaaatgaatacaaacgaatttccagtatgttgttgatcagcgcaaacaaaggtgctaaaccccccagggcttctaattttaggaacatgaaaacatgtaatttttttaggtaaatttttgtgactgatccatcaacttatagaattattttgttcactcaacaggaaaatgtccttgaaatcgttgtgcttcttcaaacaaaaattgttggtaaaccaaattcaatgaatagtcctgtcctaaataattaagaaaaaaattgattaaattatatataaaaaaaataaaataatttaatagttttattaaaaaatttgaaaattctcgtacatcacccaccgctcatataagctgacttttgtgttcggactgatacatttgattgtttgacgccgttctttgctaattcgttcgcattttggtttctttatctcaggaattttgaaacgccatcgtcgaacccaataggaaagcattctttaaaataaaaaaaaattaaattggacgttcaatattaaaaatataatctgaaaagtttggttttacggaatgtataatagaaaatattccctaaattccattgggctggtagagaagggtaaaaaatgaattgagcaaataacaaggttgccacgggtcgagaaaattacaaaaaaaagtttagtcgagacttccaaaaaaaaattcggtaaaggaatgatgtgtcgggattcgggtcgggacgtagaaaa

SEQ ID NO: 11697 - DNA, 3393 bp, Heterodera glycines
  misc_feature (3134)..(3134): n is a, c, g, or t
  misc_feature (3244)..(3244): n is a, c, g, or t
  misc_feature (3250)..(3250): n is a, c, g, or t
tgcgctcgataccaattttcatagcagaaactcgagcactggcattgagaagaggtggtcatccgcgtggttgaattggcagcactgacagccgacggcacagaaaatggaatagggagggacacagaaagtcaaagggctgaaaaggaaaatggcgacaattagcaaaaatccctaattaccctttgataattacaaaattccgcccaccgttgtctcaaaccattccaactgcattttcatttagatttaatttggttccattctcttttcccattgcatttctttccatggatttgtggcaccacttcctccaccatttgttgccggcaaaccgaaagcaccggtcgccgtacaatgtgtagccggaaaagagcaacaacagcaccaacagggcgtagaacagccatttgccaatgtgttgttgctgtgcatcatttctgaataaaaggaattaaaattagtattaaaaaaagtctgtggctcccaattccatttgaaaatttcttacaaaactggtcaattaatcgctttttcgggaataaatcaatttatcgcaataaaagccgaaaattggcaatagctaatcgtcccgcctcaaaaaatttgcattttttgcgtagtgaagggggaagaaaggaaatttcggttaattaaatgcattaaacttaaatagaaacaaagaaaaaataaaattttatttggaattgaaatcagcaaatattacgataaataaatatcaattattaattatgctttttcaaaaatacattactacttaaaatatcaacaaaaaataaataaaattttattttattttgaagcaaataaatttttaaaatcagggtcaaaaataaaatcttcgatttttttaaaatgtatgtgaaacttaaacaattttttgatcgccttcttttctttcttctccttgacggtgttgtcaaagagcttcacagccaaatagctcatccaaaaacagttcgtttggggccaaaaacgagcccaattttggctaaaaaatatttgtgtgaaaaaaaaaacttttctctctacccgactttctcctgcatcatcctgtatatgttgaattggtagtcgccattttcgcagctgacgccgttgcctgtgaaaagatccggatccttggataggtcgtcgaagaacaaatgtccatcttgtttgaacacacaaaattactgtcaaaaatttaaggccttaccgattcgaaaatgcgacaacgaaaaatcaatgatcgtcacacgcaccccttttgaggccacatcaaattgctgatttccgtacaagaaactaaaattacataagttttgaaaatttggcaatcgtaaataattgcaatccctaatttcaacttcttttttttgtgctgaaaccagttttaaggaggtttcaagggtgctgattatgaaattgaactcggatttactcaattctgtcaactgggcccgaattcgaacaagagttggaacttttttccaagtgatgtatttttctggagaaaagcttagaattcgtttaacaactatttattttggtgtaaaataatgcttcaattgtgcagaaaattgtggatcctaggaacaacaatttaaatgattttttcttcaggtttctccctcccaaaatttgtttagctaggagcctattttcagcttaccgaatgttctcattgtcccgacagtgctccacaagtacgtttccggtatggagatctcgatgttcaaaatcatattttttttcagcaaccgccagggcaaaggcgatttgaaggaaaatggagtaccgttgttcatttttggtcttctaaaaatgaaaaattttatatataccatttttgctgtattttgaatttgatcattttttgatcagtttaggggcaagacaaaaaataaaaaaattacaatagcaaatcgactatgctctacacaatatggtctaaatcacctttcatgttgagaataggtgaaacttttattgtgtagagcatagccgatttgtgattgggtttttttttttgcattttggtcctgactcccaaaactgataaaaaaaagtgatcagttttgaaaaaaaaatatttaaaaattatcaacgaaaatttatttgatcactaagcgggacaaaaaacctcaccccctttgaaggaccgaaaattttctgcttatttataaaaaatggccttttgtgccagaaaagtccaagcatggtcaatttttacctcctttttgaggtaagactcgagggtgtcgccactggcaaccattcccatgagcgcaaattttgcggcgtcgttgtcaagtggcgggagattttgcgcgctctcgtttaaatacttgaacttgttgaattgctccaacagtgggccagggaactttcctaatgaaaaattccaatttaaaagtggctacaaatttggcgtcctgtttctttatctctgttaagagaaaaattgaattcactttctttctttaaattttgcatatcgatagagaaaaatataatgcattcaataatccagccattttttgggagttaaaagaaaaatgtttgtttgaacgctcatatctagggtgtaaaattaaatggactaaaaatcgcgaaatatggacataaaattgcaaaaaatatggacataaattttacgatatgaggggtataatttctcaaagtttcttcaaattcgctaaattacataaattaaccaattttagcaaaagaattaaatttaatcattattttcgacaaaattttgcttaaaaatgttttttgaaaattttttcggtctttagtggtcaaaaaaagcaaaattagttgatggggaccgttctaataagggttttttggaaaaaggccaaaataaggaaataaaatatgggaatttaataaatacctaccacagacgactttcgccatgactagcttgatgaacgtaggaatgctttttcctagttccgaagtgatgaacagctcgttgaagacctgtttcgccgacacgaccatgggctcgtcaggctcttccggtgtggcagcgagtcggatcaccttgcaaaaaattatttgaattcggtaaataagcaattaaaaacagggattgaaccgggggaagagacgtgacncgggttttgggggacctaaagaatattcaaatttcggcattttttgctctacccccaaatttatcagcaaaagtgacgaacatgtcaaaaaaaatgggaaatccatcggngaattnggtgtcccgatagaaaagagatagaaattttctttgagctttttcaggggtaaaaaaggcactgatacgactccaagctcggatttgcaaaatcgttgattttgtctatgatttttctcatcaagtactttgatttttttttt

SEQ ID NO: 11698 - DNA, 3257 bp, Heterodera glycines
  misc_feature (118)..(118): n is a, c, g, or t
caagcaggtgaagagtgcgacgtagattttcaccacgtcattgctttgtttgaccttgagtggacgaaagtagtccactccccgtttttgtcgatggtcgtgcttcgctgactcttcncccttggcaaatccgatgcctcaggatatgtgtacggcttgactcgttctcgacgacattcaagacatccgtgttgcggggagttgagcagttgctgaactgttttgcgtccgcgtggtatccagactttctctcttaatgttgacaggagtattctcggaccgcaatgtttgagctgtttgtcataatgccggatgatgagcttggttatccatgcgtgtggcggcagaaagattgggtgtttactgtcgtatggcagatccggtgcttcctcgagtcgtccaccgcatctccaaattccttcttgtcggaagagttgcaattctcggatttggtcgttggatggtggatgaagccgctgtgcttctctcaagatccaattttcggcctgttgcagttgtgccatggtcagtggtttgttgttttgatgcggttcactaattgtgccgttttcgattgtgcgaagctttttgatgaagcgcatagcgtgtgctgcggtggctttcagcctgttccaattcgaaaatcgttcgaagtggattgatggtttgaactgttcttcgacatgaacaggtgttgttgtcagttcgatgattggtggctcttctacttctttgaattcatctccgggccggtagatgacgtttgattttggccatttgtctgctttcgaaagccaaacggggccaaagcgccaaagcagtgatgatcgaaggcattgaggatccgctcctcttgatgccatgtccgctggatttgagtcggttctgacgtgtcggacttggaagttcgcttctcggattttttgtaatcgatttgccacaaatcgatcttggcgcttgttttctcgaagtcgttcgactgagcattgactgtctgtccacatgatgacttgatgatcggcaaatttgatttgcgcttggatgaatttgactgccttgactccgagagtcagtgcttgaagttccagctttggaattgtgccgtcgtgtgcggctactttgattggtttgacaaggctttttgcgtagatgaggttgcattcatccttcataatcgtcgtttttgccttttggtacacggcaattcccatgccgtatttgctggcgtcgcagaagcagtggaattccactgagtcgatggcttggatgtgccgtggaaattcaattgtgattgcttcgcctctgtcgagccactgtgccatcaatttgagccagtctttgctgatgttcgctggcaattcgtcgtcccattttggattcatgttttgcacttcttgaagaatgagcttggctggcagtaggaccggtgacatgagtccgagcgggtcgtagactttggcaatttgcgataggattgtccgctttgtgattttgccttcgaagatcggcaacttgaagatgagccgattttgctttggtttccatcgaatgccgagcaccttgttgtcttcgaggtcctttgccaagtcgtctggttgcagcttttttagctcttcgatgttgcttccgtagaattctcggagtttcatgcccgctgcttcgaagatagtcttggcttgcgtcaccaaatcttgaagcttttccgttggcttggcgtcgaacatgatgttgtcgacgtacagattctcttcgatccgccttgctaggtcggagtcgaatagcgcaaggtgctcccgtagtgtggcattgagtagaaatggagacaccgtcaggccgaaactgacacggcagaatcggtagatgcgcagttcggagtggtcgattggattgagctcagctgtctcggggttgttgagccaaatgaatctgcaggcatctctgtccacgtatcggatgccaagttgcagaaatgccttttcgatgtctgccaggattacatgttccatgcgtcggaagcgcaggaggatgccggtgagatccttcagcagttgtggtccggtgtgcaagcagtcgttcaaggatggtgctgatgggcaattctttggttttgctgacgcatccatgacgattcggatcttggttgttgctttatccgctctgatgactgctctgtgtggcaaaaaatgcagtggccatgcacttgatggtgactcaggtgggccgatgtattcgatgaccgactgtcgaacttgctcgtccaaaattgtctgatattcgtcaatcaggttgaggctgcgcagctttttgatcaatgaaacgagtctggccttggcttgatgtatgttgcttggaagagcatcgactctgtcgttccaaggcaaggcgacttggtatcggttgttgacgaatgtgaggttctttttgaagtagaccatcacttgatcttgatcagttggtgttgatgtgtcatccatgccgatcaggtttaatccgaagaagttgttgagctgctcgtcctttttgacatcatcttcggatgtgaagacttccttatcttctttggttgattcgaacgtgacggattgattggcttcttcttgttcagtgccgtggactgacaggacaaatgtgacgtttgatgcttggtgcatttcgatgcgtcctgatccactgaggattttgccgattttggaacggcacagtgtgaagccgcttggcagcttttcgattggttgaacctgcagttcgtgccagacatcaattccgagcatgatgtctggttgacgttgctcatgtggaggattgagcttttgttgtctcaattctgtcttgtccaactctgacagttgaatcattggcatgtcgttgaccaagaatttcatggcgttgaggttgaagatgagcttttccccgcttgtgcagagaaatccgagcttgaccagatcgctgatgtatctcttcggttcgcgttctccgaagctggtcaaatggcattcttcggtgtggaccaccgggaggtccagtagctgtgctgcctttgccgaaatgaatgatctgtggctgcctggatcgatgaaaattgccgcagtcatgctgagatgcggctgtgctggattgaagaccgttgacgttgcggtcatcagcagtgcgcgagtgtcgcttccgtttacggcattgcacatttgtgatgttgatgctgcgggttcgttgctttccgcttggcttgtacttggcacgttttgttgtggttgaccaaa

SEQ ID NO: 11699 - DNA, 3054 bp, Heterodera glycines
  misc_feature (1887)..(1887): n is a, c, g, or t
  misc_feature (2018)..(2018): n is a, c, g, or t
  misc_feature (2030)..(2030): n is a, c, g, or t
tgaggagacagcgatgaacaccgaagacggacgaattgcccattgtgcgtcttctgatcgcatcggacatccatgccgggttcgcggagaacaaagagcatatcagcaacgattcattcgaaacattccgcgaagtgctcaagattggggtcgactcgaaggtggactttgtccttttgggtatgttttgctcacatgatcaccattttctgttgagcagaaaattgttaggcggaaatggacgatcataaaaagaaattggaaaatcattggttttggaattggtcggtgtttgagtgaataatctccggttcttgaccggtattaattagccattaaatgtgtcagaattcagggggtgaccttttccatgagaatcacccgagccgtgaaacgcaactgaaggtggtccgtctgctacgaaaacactgtttccgcgagggtcgacttggcttggaattcgtttccgatccgaccgtcaatttccaacacagcaatttcccggtcgccaattatttggacgtgaatcttcacgtgaacatgcccattttcacaatccacggaaaccatgacgatttgtccggaaaagtgagtgaactcactgattatgcaaattttcatgttccaacttttcttttcagggtctttctgcgcttgacgtgctccacgaggccgggctcatcaacttgttcggcaagttttgtgatgtcgaccaaattgaagtcactccgattctgttgacgcggggcaacacaaaaattgctttgtacggcatcggaagtcagcgagacgaccgattggcacgatcatttgcaagtgggacaacgatggaacttgaacaacaattaacgattaattgtgttgggttttgcagagggtcgagtgaagttcaatcgccccgacggggatgacccggactcgtggttctccattttggtactccaccaaaatcgaccgccgcgaagcaaattgaggagcaccaaatcccatctctccttcaagcacatccctctcttttttgacttgggttagtcattgcaaatccctgccatttttatggttccaatttttcagtgatttggggccatgagcacgaatgtttgataggtatggaaaacagtttgtaattttgacttgtttcagtgattttcagagcccgatttcaaatacatggaccccaacgattcaaccaaaggcttttacataattcagcccgggagtacggtggcaaccgcactgagtgttgaggaggccaaaaagaagcagattgggattttgtgaggaatttaatcaaatttatctgatcgattgtctgccattctcaaggtccatcaaagggaaggaattcaaactcaaaaaggtccctctccaaacgacgcgtcaaattttcgtcgacgaattgacactcgaaggagcgcaaccgaccgcaccgaaaatcgcaaagtcatcggttcgcctgaagaaaatgccggtaactaaaaacttcttcgaacttccttcacatcttttccatcgcttaggatgagccgttgatcaccgaacgaatcaacgaaattctagaaagtgccgaagcaacgcgaggaccccaacagccgtggccgccgcgggtgcgtttgaaagtgatttactcgggacgatggctggacattccggtaattggggtgggtggtggactgaattcacgtaaatttgacatccatttaagccaattaacggaagaaaatgggggccaaatcattttgccggcaaagtggcgaacgcagcggaaatgggtattaaatcactgtataaattcctcatttgtgattgaaaacaacagatcgttgtccgtgctgttcacccggagaagaaggcgaagaatgtgaacgacgaacagctccaaaactntttggggaagtcgtacggacgacatttgcagcgtggacgaaatggtcggtcaaattgtgaatgttggcgagtgaatgttttgtgaaagcgttgttacaggtgggcaagtactacacccaatgtgacttcanagcccgtctggngtgttctgtcgaaataacgatgggaaaacagctgcaggtgatttattgctacattttgcatgtgaatggaaaattctcgagtttcttgtcgaaatttgtccatttaaaggaatattccaacaccgaggcgaccactcaattcaaattcacggcagcggacaaagcactgagcgacagcatccgaacacaaatcgacgcgatgacagccaaagtgaagggaatgttgcagaacagaatggcgatgaacgcggaggtatggcgaagagagagggggcggggaacactgactgaccttagaacatgtaatccggcatttttacagatcgacgacattccgcttgatcagcaaattgcggaaggaatggcgttggcgaagaagaacccgcgtggtgtaagcggccgaagaagttgacctgaacgtgtccatcgccgcgtcgttcttcgaacacgggttcgaacccatgcgcctcgtcacttccacgccacggcccagccaacagcgggaggagacaccgcaggaaggtgaatcaattcaatgagaatacattttgtgatttgacatggtggaattggtcttttcagcaagaagcatcgaagacgtgacggaagcagactttgacagtccgtgaatgtgttttgtgccgaaaatgaacatttttatttgattagtaaagcgtttttcttagattcgttatctttggtgttatttttatgaatctttgacttttgttcaaattcgggtccaggttttaaattggttaaaatggacatcatattcgtgatcagcgacccgaaaccccataataaaaaagttatggcctatgaaactgaggatggtcattaatgggacgcataaaccggctagtaaccttttttccgaaaaagggggagacaaataacagattaccagggattaatgaaatgtgtgcctcagaaaacaagaaatttatttaggctcaaattcatttgcaatgcgcattttcgcatgggaaatagaggagattttatgaagcttaatgttaac

SEQ ID NO: 11700 - DNA, 695 bp, Heterodera glycines
aggatacgcaggaaaattgaaggactatgaaaatacggaagattcgatgaatgccccttagaatttgtttgatttatgttttttcaattatgttatgttatttgctcaattaataaagtattttattaattcattaactagggatcggatttttaggctctaaaaaatgccaaaataagcactaaccttttaaaaaagaatttaatttggggacgaaacgactcattttggcttaggggacgaaacgacgcaggacgaaacgacgcaggacgaaacgacgcgggacgaaacgacgcgggacgaaacgacgcgggacgaaacgacgcgggacgaaacgacgcgggacgaaatgacgggcagcggtaacctacacaccgtttcaaaaacgagaaatgaaccaataaatagagagtgcagagaaaaaaacatctctcattttggcgtactattttttttatctctgttaatagagaaaaactgaattcacttcgaacaccgaaaatttttttcgactggcgagattttctttaaattttgcgtaccgatagagaaaaattttctgcattaatttctatgattgttattcgaaaaacgaagttttcgaacgcttgatatctaatttccgtgtaaatttcttaaggctgccgaccggaacgggacgaatcgaaggagagtcggagcgcgttttgtctgcg

SEQ ID NO: 11701 - DNA, 4614 bp, Heterodera glycines
cataaatattttacttataaaaactcaaaatatgtttttttcatatttatgaatattgacattaaggggttttttcaaacaaaaaattaatttttataataattttgtttttttttattttaaattaaaatttgtactcaaaactgaccactttcttcatttttttttgttgtaatccataaaaatttcgtccataaattgagcaaatttgagcacattttttgatggattggacaaatcccattggcagtttggtgaaggaatggaaaatacgagcaaatttagaaaaatatttaaaagaaataaaattttcaatagcatatttcttaaaaaaaaaattcgttaatgtttgttttaaaaaaagagtctataaaaataattgcacagaaaaatgaataaaattgatgtaaatcatttaaaaaattgtatttttttgggctaaattattaagaaatcggcatttccattttccccggcgcggcacttttcggcacgccgaatacagatgaatagtgcttataaaaatttataaattttttgatttttactttgaaaacaggttaaaaggttcccgcgtttttgaaaaattaaaatttgtcgcttttttatcacttttttaggcgagttagacgccgccgggaaaattttgtaaatttatttctgatttgttaacatatttttgttcaaaaaataaccaaattcggtgatttttagtcaatttatttacagagtttataccaaaaatgttcaatttttaaggaaataaaagattaaattcgttaaaatttcttatgggatattgtaaaaaaatatgatttttttaaacttatgtgttaaaagagtaaaattatttttattaaaaaaattttgagcattttttaacttaatgataaaataaaagttttcaacaaaaatctttaaaaaatgtttaaagagattgctatgagacagcattgaaccagtgaaagaaagaagcgaatccaaaagattaaccactacgccacaggtgcacttgatagtcccgtttttaaataaatattaatcgcattttttaaaatttttttttaccaaatttgcttaacaatttgacccagacccattcttaccagtgtacttttggacccggacctaccgggtcgggtaccgggtattggattttcaaaaaaccgggtccgggtcttgaaaaaaccgggtatccggatctgaaacccggtcgggtcccggacccggccaaccctatttgaaatcacgccaacttttgattaaaaatacgaagaataccccctaaaatgaactatttcagaaaaaaacaacctttaaagtcagggttccagaataccgaggtttttttaatttcttttaaattaagattagacaaagtcacaaaaattcgaagaaaatttgtcttattaaatcatttaacaaaatttgattaccttcctattcaactaataatttggaattcatgtgaattttataatctatgttgggtttgaataatattttttgtcaaatcacacactgccttataaatggacaaattttggctgatgtttttggtttgtgggcgtttaagatgcatgagagcaaatatgtagggggtgctttgtttttatgaaatcattaaatcaattagcttgctttttatttaatcgatgcttaaccggaacatacatgacaatgtgtaataatatccatttttattataggagctgtaatattacaaaataatattcatttttgtttgtttgttcattatcggactctaatttgtttactttcattcaggcccgtagccagaggtgggggaatggggagggaattcccccgcccccgaaacgaaaaatgaaaattttaataaattaaaaattgaaaattttttaaatgtttaaatataatatcaattgaggcaaatttaataataattgaggcaaatggcaataaaagtaatggcattttatagaggtgcgccgtgcctgaaaaaacccgtgaaccgtgaccgttatccaaaaaactcgtgaaattcacggttttcgtgaccgtgaccgtgaattttttgaattaatttttctctgtcggcgaattttatttgagttcatttatgcacagattttgtacgtaaaatgagccaatttcgcaacattaatcaatttaaaaaggcaaaaaacgatgaaaaaatttgcaaattagtatatcgattccgacctttttaaaatggttttgtgagacatatgtaattacccaatttttaaagaaaaataggcgttttagtggaaaatttttgaaaatgtgatttgttaactgattctgcctaaaataattttattttgagcgaatttttaaaaaaaatttaatgagttttttatttaaatggggtcatccttgaaactgtgctatttgtttttgcacaatattggtagttggctttgctcaaaaaagtttcaggaatagggaagggggccggcggtgcagataggcgccgctggggaaatttttgaaaattttgctctgtttcttagcaaactttgcccaaaaactgaccaaatttctctagaaaaataatatgtaattcgtaaattttcaattttatccagtttaaatttttcacggaattaaccgtattggtaccgtgaatcgtgaccgtgacgttgcgcttttcgtactttattttctcatcaaacgaccgtaaaaaaatatttgattgtcctgaatcaattatgaaataaatttgaaattccacagaattaaattgtttatttggtcgctttttttatcaagcaattacttctttttattccatgttttaccatttttgaattacattttttgttcgattcaaaccacaaatatgtttatatattcaagaaaaaaagtcaaaaaattgttttgtcaaaaatttattttccaccccctaagtgtcaaaataaatatttgattaactatggtaattagttgtttcattcccgtccgtgaacttgaacgggtcatcctctgctgatcagcagaagaattaaggggggtggcaccgccaacaactggtgttactgtaattacgcttttgtagatgtgtgtctctcatttatgaattgatctttttttatcgtgttcttgttgatttaacggtttaattctgctattcatcaatcattctctgcggttgttgacaatggtaaagtggtctcacagtctgcccattcagcttcttcgcactgatttttgtagtgcatgaaaatttgctgatcagcagcggtcacagtgttggcacgactgcgctgctgatcagcacaagtgatcgacgcctgcccaacgccgttaggctttccggatcgatgcgctgtattttggcagttgttttgagcaaaacacagctgatcatcgtggtaatagaaagcatcggattgcgaccgattcagaccagtaaatttaaggttttgttgatcattcatcgcatcaagttgaccaaggctgaggtccaaaatatccggcgttgtattctggtcctcaatctcgccattttggcactgatcaaaatccttttgctgatcaatgtcatgttgttgccgatccgctgataatggcttcccttgttgttgtcgagcatgttccgtcgccgttaatgttggctagaaatatttcaaaaagatgccttaatcagcagagggggaaaaaaatcctcaaccgtagaaacccgaaataaaaccaaaaatttccgaaatatgcaatccacaattaaaaactctagagcgaaatttatgccaaatttgtcggttcaaacggaggttaaatttttttgtttatttttgctttactaatcaatggtgacaacaaaattttaacatttgtgatcacaacaaattgttcgggttttgtcacaaataaatgaatttttgaaaaaaacaaaattgcgtagtaaatattagagtgccacgggaccgggacctggtagcggacaactgagtaccaaggtcccggttttgaccgggaccgggactagtcccggctttttcccggttttcccagccaaaaattcccgatttttcaacccgaaaaggtcccggtcccgggtttgcccaaaattcccggtcccgtggcactctagtttaaactgacaagagttggatttgtgtacagcaattgaaacacaaaattaaaaatgaatggcattttgattcggtaaaacgtgtccttgagttttcggaatttctgatcacgatctgagaccataatcgtgatcaacgacttcaaaacccccggagggaacacttgccgaatagaaataactcaaccaaaaaggtacttttacgtggtgtgcgaatcgtttaattatgtacattctgttgaacaacctaaaaaaatgtttcaattatttatctacactattctgattaccataaccaaaaactttatgctggatatttgtatattctttgtttaattttatattttccattaagtctcacatactttcaatcaatttgctggttttcaccagagtgaaggccaattaccatcaactcgctttcgaatttcttcgatttcatatgacttacatattgatatgatcaaaaacctttgactggcaataaccttgtattttagcacctacattaacac

SEQ ID NO: 11702 - DNA, 2494 bp, Heterodera glycines
tcgtcccctcgctgtgactcatttttgtcacggaatttgggatttgcacaataattaattcgtatctaattaattaaatgatttgtaaataataattaattttcaaaaaatatttgctgagtttggtataaaagtaataaaccatttcaaaagtgtgatccaattgttggccatttgagtgcaattttatgacatttgacagaacagacgaaatagcgcaacattttgtttttttagtataaataattgtccattttcaacacaaaacataaaacatcagagggcttggatctgctcacggagcgcttctttggtcatccgttcaaagccgtcctttgtgcacacgaccaactcaacattgtcctcagtcatggcaacgctacaaataatgggaattcgtagtaaaccgaatttgaaagcaaaagttcctggaatttttcgcataattctgaaaaagaaaagccaggtggaatgatgaaggtaacaggattttggcttaccgttttgaggaggcggcataaaaatggaccgagtttttaatcgtttttttgtgataattataagagattttagacagtttggaaaagatgggcccccaaaaaatggcgaattagagactccaacaaaaatggtgtaattccgtgactcccaaatggtggtttccgagtccataaaaatggcgaaattccgtaccaaatggtacactaaacaagctatggttctgtactttttgagtcaggggtacaagaaatcaggaatttttggtcatccgggccaagatctgcggcgcatttacttataccgtcaagttacactcactcgtaagtctcgcgcattgcaagcagagccatgtgtatcgcgtccaccttctcaatgtcttcattgtaccgcttctccaacaatttcttggccaattggtcgtttttgccgatcgccgtgcttttccacccaaaataggaaccctgtggaatgaaggggaaaatattgcaaaattttaaattttcatgaaaaatgggaaagaaaataaatgcctaggaatttcggggtaatttttttttcattttgggcatttatttattatagaaaagacacttaacatgtaattttttaacgggggatacaaacagaaagtttcttttgaaaaattaccgccggatcggcttgaaaaagaagcgcccccttttcactgtcccatccgccaatgagcaatgaaacgccaaacggacgaacaccactaaaaaaatttaaattcctttttttaagttttttacaaatagaaatattttcaaattgtaggttagtttttctgaaaaatttctgttttatttttttttaaattcggggaaaaatgatacgagggggtggggtaaacgagcagcccccataaaaacagaactttaccccgactgtgtgtattcctgcatgaccgcagccacccgggaaacgagttgaggcacgggaatttcatagccgtacagcacttggtaatccatcgcaattttccgcgctttcttcacgagaagtctgtcgaggtgcaagaaatggattaattataacaattaatgattctttttttatgctcttgtgtagaattgttttaaattcaaacacccaaaaaaatttctatactttttatttattttttgaaaatcgaacccctgacgaaaaaatgacagacccattaacaaaaaactgtcatcaaccaggccatggaaatttttccttttttttttggtttcaatttctgaaaaaattgatgtaaattataggctagcggtgccaaaatatgcgcccttgagaacattttttgcttttcttggcaattatcaaattttaaaaaaccccagataattcctcccgtttaccccctctaaataattgagaagaaaataaacaggctggacggattaatgataaatccggatccaaattggcttttagaattaaaaaaaaaccaaaacgcactgtgcatccgggcccatcccactgtacacgcatgcaatatggtcggacaacttggagattttgctgacgggctgtgtgaggacggagtgtttgttttcggtggcgaacacaacgcaatcttttgctgcaaaaatgaaagaatttgttgggttaaaaatatgctgttttcaggagtatcgaagtcattgaacaggaaaatggcatcacttttcggcaaaactcttgaacccgaactcaatttggaaccaaaagttgtgttgaaaactcaacccgcgacataaaaaggaggtaaaattgaaaaaaatcatcatttgttttccggatgtcagataaacaattgtatattccaccagttgcggtttatgtttatttttgaaaaaagggatttgaaacttcaaaattggccgatttaaataaagcgccatatttttagagcgttagatttattttatgttatattcaagccgaaataggacaaaacagacgccatattcgtggtcagagacctcaaaatgtcctgaatttcttt

SEQ ID NO: 11703 - DNA, 1726 bp, Heterodera glycines
taaaaccgactagaaaccttttttgaccaaaatagtgatggtggtacaaattttgaataaccaattgaaacataatttcattttaggtaagaaattttgtgtaattatagtaatgaaaaaaaacctcgggtgccaacagatggcgcactgcccttgacggcattcaacgcatactcaatttgcatcaacttccccgagggactgtgggagagagggaaaaaattaatatgctgtttgaaaaaagcagctaatttagccatagtccaaaaccgtccgaaaatcggttttttctatttcggaaattatttacattaagagttctacattttcagttataaaggaacaatctgaccaatagaattgattatgcattaaacaaaacctgaaggtggtgagagagaaggaatagcgttccgtgctcatttcggcaacaaaaaaaaatgtattttgtgaataaattggcttaaaattgatacattaaactgcaaaataataagcaaaaaacaaatgaatgttatgtgaaacggttcggcgaaaattgaatccaattaatgaaagtacagataaatacaaagtttggtcccccgtaagacagtcatacttccaaaatccatcatttttcagaaaataacatgctctataatgtcaaagattaaaaaaccccaagcgatcctggaaatggcctgtgtttgtgaaaacccatcaatgcccaaagcgaaaagcaaaaaaaaaacaaaagaaaaattgaatcatcaaaatttaaatttagccctgaaagacaaaatgccaaaaatattcagctgctttttttcaaaccaaagaaaatctaaagcccagaattttggaaaactcgggatcgcgattcgagattggaatcacagttttgctggcattcgaatcctgaactcaatatccaaatccgattttgtattctgttttgtatttgatgaaaaattttgcgaaaattttctgctatttgaagataaacagaatttccacactgaaattgttccgaaaaaggatgcacaaacgaaaaattggtacgacgagggccgaaattgaaattgaagattgcaatgtgcccattcccgaacttgttcaaagtcatctgaaacttattcgacaaatacgcgagaatgtggtcgcccccgtggacacaattggctgccatgcgttggccgacaaatgcgcagacccaaaaacgtatcgtttccagattttggtggcacttatgctctccagtcaaaccaaagaccaagtgacggcagaggcgatggaggcaagtaaagtgccagctaataaatcgtataaaaatgaaaataaagacatttttgacaaaaaatttacacatttttcagttttttcctggaaaaattcggtgccaaaaaggatttttggtttcaaatccaaaggagatatgttgccaacaattcttgacattttcatgaattcctttagaattaggtctaggacgggctcgaatttaacccgaattgaagttatttttgtgtgacccctcgcctcgaaattcaggaaacgctcgaaaaaatgtcaaaaattgtagaaacaactagaactgaatttctaatcagctgagccaggctagttttcggaagcaactggtttccgggcccctgtctctccaaaactgggtttttccaaaaaatcgcccaggcctgacccggtacaaaacgggcattcgttatttgaaatgtatgcatttgaa

SEQ ID NO: 11704 - DNA, 4235 bp, Heterodera glycines
ataacacgtaaaattaattaattaaatccataaaaaattttaaaaaatatttttaaatttacaaaatttttattagaagctcctccacctccgccacgaactcaagtgttccatactccacatcaagatcacggtcagtacggattaattaccaactctgttaattaggcaaattaatgagcgaacttactgtaatttataatgtaagggtaaaatatactgtaggaaaatagaatgtaatgaaataaaagttttgttcatttcagaaccgacaagctacaatttatgtggaccaaattggaacaaatttggccaccattgctatttggtttgaatttatttttttattattacaattttaaacttaaataattattatttttttatagaatttagaaataaaagaatttttaattattacatttttaaacttaaatagaataattatttttattattattataatttgaaaggaaaatattttttttaattatttacaagcttaaaatttcatttatcattttttaaattaaaattttcaaacataattaaacaacataatgtgctaaaatttaaaaaaacttggcaaattttttttgagaaaactaaaaatttacagggccaacaaaaataaatagttttttagcttattttctcgtaaaggtttccagctttaaaaattttagaattttccaaatgttaacccctcgccccttttattgtcacactctttaagttaagaattttatttaaattttaagaaattttccaattttcttccgcgtttcctgtaaattattccatttcagaaaagtgaaaattcaaaaacctaaaaatatgtattaaaattcttccgacaatttggaaattttaatttatttaaaatttggaattttctatttttcacttcaccccttccctccgtctacttttaattaatcccatggcaaatactaaaaagttaaaaattcactaaaatttttacacaagccgaaatttagtttatttaaaatttaagaaattttccaatttaagcccccctccacccattttaaggttagtacaaatccatcaggcaaaccaatcagttttgaggaggcaaacaaagagtgccaacaacataatccaaatgccaaacttgcatcaattcacagtccgatggaagaagattttgtggccggtgagtggtcaatttttgctgattttttcccattttatgtgccccaattagcagaaattgtttacaaatagcgccaatttcggattaaattttttgaaatgccaaaaattaataaaatttaaaatccggaaaattcataaaaaatttttaaaagcaataaatgaagaagtcaaataaaagccgaaaaatcaaaacaaaattaaagcaaaaaaaaaaaattataaaaatttatctgtgtttttttatgtttttattttaaacttactgtacaataataattcataaaaattttttttgacttgttgaacacttacaaaatcgtaagtgatacagtacattttttgaaaacgagatacggtagtaaggccatctgaattattgcaattttttttgaatatttttaatttattttaaataaaattcacagtttttatgtaatgatatactcatagaaagagtgaattagggaggttttttgtaatttattttaataatttaaaattaattagcataattaaaaattaattgctttttagcttttaccaaaaatcgtcctttccgtagccaaaaacaaggacaatcattgtattggctggcacaaatcaaaagtgccgtggaacacgtaagcaaaacaatactgtagtcattcattatcatacaataattacaataattaatataataaaaatgaaaaagaaataattttaatattttcaaatttaaaatattaattataccaaaattaaatcttctttttttatttgtgaaaatttttttgtcaaaaaaccccacaaccgaacgaaacaatacagtcattcattatcatacaataattacaatttaatataataatgaaaaggaaaattgaacaaaaaatgatttaaaagaggtcaattaatgattttaacatttaaatatattaaaactctttaatttgcacattttcgatatttaaaattatatcactcaaattttaaagatttttttgtaacagttttgtcaaaaaaatgccataattaatttttttaatattttttatttctgaaataagggcaaaacttcaaaaatgaaatgctataatgtttgtaagttcttttctagaatttgcatttcttcttaaaaatatgaatttaaaaaaaaattgctacagttatgaatacagtatgttttacattacagccaaacaacgatatggatgggaactacgataatgagggtggcagcaacagcaacggaccttttgtatggtctgacggtactaatgtcggctacggtaatcccactgacaagaagtcgggcaaaaactttccatggtacacaaaaccaagcacaaaatatttggaaaaacatccgggtgtggtgatgtacggtaaaaaaaaggatggggaaaacaatccatggatggacgagaaacataccggcacgtggtcggccatctcaacacagagcgccacgcatggcgaatcggtgccagatgtgcatggctatgtgtgcaaaatgccgaccatgaaagcgacgaatacggtagggaatgcgaaaaaaaacgaaaatggacggtaattgtttacgatagttgttgcaattagtcatcatctgttttgtagctaagtattgtggtaaattttgtaagaattaaaaaaaattagggaaatttttgggtttgtatttaaaattatgaaaattttccaacaaatttaataaaaattttctcccattgaactcattggcgcttatctttgctattgtgccattaattcatttttacattgtttattgttcaaattttgccaaaaccattcaaatttggttatttttagtccaaatctgtaacaaaaaggcaaatttctttggagacacaaaaaatactttttattataaaataagaaaaaatttctgtatgaaaaataaaattagcaacaaaaaacttaatttaagaatattagcggagttcgatttgttcatttcttcatcaagaatgttaaaattgataagaagaggcaaaaacataatattgatatatttttgattgcataaattataaaataacaccagtaaaacgtctgtattttgacccaaaaaaactgattttttttttggcatttattttccggtttttgaaaaatttttttgataaaaaccctggattaggcgggagaaaatgtcacaaaaaacaacatttagaaagaaatcatttttgtattcgaagaaaatattcacaaaaacattaatattatgttgtttttgtttaaattttaatttaaacaaaaattctaattttagcaccatttgaacccccgggcgccacccaatgccgacgaacagcaacaattctcaacaaaaatggcacaaaatttcaattcgcccaaccccacggaaaacattgatgaaaaggatgaagagccacacttcagcagaaacaacggaaaccaatatggtcttgggtcggatgatgagcacagaagaagatggccataattgactgatggcaaatgatggaatggcacaaaaaaatggatattatttttttgcgatggatttttatggtttttttcgggcattttctatgggattttcacattttctgttttcttttattttcatttggggacgctattttgagagttttggttttttaaaatttttatttgtttagaaatggttagtataaagtattttcacacaattcattcatcgtttgctcaattaataaatgaaaaacaataataagcaaatcggaccgaaatcaaagatcaaaaaaaaataataaaaaaaagaaaaatttaaaaaaaaagattcacttcatcaataagaaaaaaatttaacaaaatattatcatgctggtttgttttgtaaaatatgccaccttcggcgtttcttaaattccgccattttatgaagaaaatatttagagacggcaaatggccgggcatcataaagaatagaaaaaaattagaaaaaaaatccctttctcggccacttcccgaacccggacccaagcaagcctggtatcggtgatagttagtttcgttaaatacgccattttaacgatttttcg

SEQ ID NO: 11705 - DNA, 2290 bp, Heterodera glycines
  misc_feature (2282)..(2283): n is a, c, g, or t
attacgtaaaaaaacaggctaaatccgtaacccttaatccgtcattcgggaattcagaaaataaaaattccgtaatcagtcatcactagggctgggaatttaagtcacggaaaatttccaaaaagtcacgaaaaatgcaaaaaaattataaaaaaaaatagccaaaaagtcacaaaaaagtcaaaaaaagaccaatgaaatggaaaaaagtcctcaaaaattaggcaaaagtgacaaaaattttatttttaataatttgtgaataatttatttaaatagagattggatttttaaccggattataattcgaaaatttctacattaaaattcaaattttgccataaaaagtgtaaaaagttatgaaaaaaagtcacaaaaatacaaaaaagtcataaaaattacaaaaaaatagaaaaaagtaaaaaaaaaagtcacaaaaaatgcatgtaaataagtgaaattaaaagcatatttaacgccgaaaagctaattgaaaatgactaataaccagccgaatgatgcaaatgagtaaattgtataatttttgttttttcccttttaaatatttcctcaattttagtctcgattttgtaattttaaaaagtgcgcaaacttacgttttgctaaaatgtcccacattaaaacagacaaaacgacgaaatgatacaatgctaaaattctctaaaataaacatgccgaaatgatagttgaaaatttcattggtatgtgccagaaatagtttttctggtgaaatgtaaaggattgtcgttcattttagcacgagtaattatataattcgtcagaatgatgtgttcgcttgggataaactttctgatcaaaatattaattgacgaaaatttgatataatgaatatgcaattttaattgcttttatattttaagtaaaaaaagtttttaaagacttattttgaaaaaaacttttgtattatatttgggttcaaaaaacccaaaagaaacttataaatttgatgggaatacaataaatgctgtggatacaattagggacttaggaataaatattgataataaattacaattttccgatcatgttaaccaaataacaaggaatgcctatttacgtatgcgttccttgtttagaataattaaatctaaatcttctaaaatctggattacattatataaaacttatattaggcctttattggaatatgctccggaggtttggaatccgtctcttaaaaaaaatattaaaaaaatagagaaatgtcaaaaatatttcactaaaatagtgcttttcaagtgtaaccttccaccaattccatacctgaagcgattagaatacctacaactaccaacacttgagaataggcgaaagctatttgatctgttcatggcgcataaaattgtttatggccgaacagatagatctagatttatttaaaattttcaaaccttctaaacgctttaatgtccccttttataggtttaacacaaaatataaattaggcaaaaaatttattccctttgcggggagggctacaaaattgtggaatcaacttgataaagaaatcattaaaataaattctttaaatcaatttaaaactaaaattaaactccttaacgaataaatgacctgaaaagtgaattgtctcttttgattaattaattaaagctatttataattttatatgtgatttggttttattgatcgattgacctcattcttttatttaattttgttgtgattccttaattttgtttaattgttgatccatattactcgaggacgacttaatctatgacatgtccgcagagtaagtggattactcccttttgtggaattttttctcttttgcataaataaataaactccaaaaaaacaataaaacctataattttctctcctttaactaaacccaataatatttaatatacatagaggaaaaatgattcatttttctttaaatcccccattaatttttgactcttacccccattcatgctagaaactttttttaattccgatcagttttttttttagaaattggttttgattgatttcatatttttaattatgcatttgtcatttatggctttctaatgtgaaaacgtttttttccttcaacggacttcctgtttacaaaatttaaaatttccacgtatttccggcaaaaatatttaatggaaaagttgcatataaaaacggcaaaaattttcataaaactcatcatcaaaaattcattcaaccatagaatttattcatttcctaatataagtttttttgtacaaaatgagcaactnnttatatt

SEQ ID NO: 11706 - DNA, 5132 bp, Heterodera glycines
  misc_feature (23)..(23): n is a, c, g, or t
  misc_feature (5076)..(5077): n is a, c, g, or t
  misc_feature (5088)..(5088): n is a, c, g, or t
ttttgaagcatatttaccatggnaaattggtgtcggtgacgttttcttatttgctctaataatttcaacatttgcctacaaaatattaaatttccgcaatttttcttctttttcatcgcagttgttgctgcatggattttgtaaatattaaattgcatttaatatatttaatataatatttatttttaatataaaaaaaatttcacagttttcaatatcaccaaaaaaagcattggcaccgtttggacgtgccagggccaaatgtgaacattttctttggcaacacaataaagcaaattcgcaatggcagcattgatgtgcgaagcattaataagaaaatggaaatattattatttatttaaaatttttttttttaatttgcaggttgaccgagaaaatttctcaaaatatggaaattcatttgggtaaaattttgttattaattaatataaaatatttgtttaagttcttttttgtttgatcgtcgcgaattttgcaccaaagacccggatatgatccgacaaattttcatcaaagaatttgcgcacttccaaaatcgctttgtgagttttttcggggattgacttaattaatggatatgtgagtaattgttgtttcgagactcaaactcgatagccaaaaggcgagaaatcagtaataatttgggagagaattttgatttgaattttattttgatagaccataccttttctgaaaaacaattaaatatttaattaattaattaattatccaaaaggatttcatccccgggcgaaaagaggacgcgcccaaatcattgacgcgtaacatgatcaacatgttgcgcgacgatgattggaagcgggtgcgcaaccgcgtaacgcccgcattcaccacgggaaaactgaagaaagtgagtcatccagagcgcaacggcgagtgacacataaatagggaaaacaaatattttgatttttttttaaattaattttcaaaaaaaccataaaaaggtggaaggaatacacaaaacaaagacgaatcattaaagggattttagccagtggctaattagttaattaattattttgccattcgaatttagctcattccaattttatgcgaatgcactgaaagactttgcaaggtatttgaagatgaatatgcgtcgaaaaagaaggaaattctcttaaaagagtgagttaattattttttttattgagtaattaaagtcagcattaacggcgcaaaaaataattaaaaaattaaatgccaaaataaaattaataaatcaaaaagaaaagcataaagaaatgtatttattttttaattgcccagtctttacggccgatttctgttggatgtgatcggtcgctgtggattttcgttggatttgaacacttatgaggaggaaaatgtttttttagaacaatcaagattagtgttcaattttggccgtaaagcgcaacgcatcagaacgatactttgcggtaaatgtcgtgaaaaatggcacaatattaaaaaaaactgctcaaagggattgattatataaaaatcaaaaaatatttttcttctttaattacgaattacaaaaatatattagtaagtcactttatatggtttaatcaaaattttaatttgccccctaatggatttataattaaaattatatttttttaaaacttacagtaaaaaaaattaattaaagcagaacaaattttaaaaacagtacatctgttgaacctataattttgcatcaaatcgcaaataaaagcacaattttttcgtttattttttccactcactatgtttaaagaaaagagaaaatcatttaataaattttaatttccaatttcgcaatgtttaagtgttttttccacttactgctaagctaattgagaattttacgggcaaatcgctcgcttttgccgtggatgaacaatttttcaaggaaatgatgggggaattgtacgagaaacgccgcgccgacccggcggcaaaagaagtgcgattaattaattttaattgcttataaataatgagaaaaagggaacacgtcacaaattagtcaattgtaaaatttaaaccaaattattattgaaatttgtttgccagaagtactcggacatctttcaacttttgatgaatgccgttgaagaagacgacgaagaaattgtggctgaaaacagtgccatctcagcggaggatgcccaaataattcacagcgaaatgcgaagcgacgaaaagcagcaaaagcagggaaagcatttgaccaaaattgaactgttcgcgcagggattcatcattttggtggccgggtaattcttggcaaaattatttttaagagggatttcaggatttttgtgttttgtttaaatggatttgggataagatggaaagtagaagcaaagccaaaattaaaaaagaaaaaattaccgaatcttcaaaaagtgtacgatatgatttatttttgtaataatctgttcaaattattagctgattattgccatcaattttttgttgttatatagccaacgtaaagcaatttgtaactaacctttaaaattcacattttaacacaaaatgccttaaaattcaaatttatatcctagtcaaaaatatgatgacaaatataattttggctttcaaaatttgtaaattatcgtccctattttttaataaatataaaaacaattacaattgttcaattttgattttgattttgattttatggaaaaataattcacttaaattttcttaaatattcccgatttgacaccaccggcacgacattgaccttcgccacttatatgctggcaattgagtcagaagttcaagaaaaattacgaaaagaagtaaatgaagtgttaggggagaaagtaagtgaaaatggacaaatttaataaattaaagtttaattggcaaattaaaattttattttattattattattattaatttttaaatcatttactttaattatttaaggaagtgattacttacgaacatttgaaacaaatgcattatctttgtgctgttgttcaagaaacactgcgaatgttcccagtggcaccaaagtgaataatttgaaattattaagaaaatgaatcagtttaaaaaattggatttactttttggataaaggataaggatgctgcttaaatcatttcataaaatgcaaaaattgtccaatggctgcattttttcatattttatatgggatttgccattatttttgaaatggcaaaaataatttttgtacatttgcctcccgatttaccggtcggtttccagatctttgtttttttgtgcatgcgttttcctgtattttgttcagaaaaagtctaacagatcaattcgaaaaaacatagctgtaaggttccaatcactaactatattttgagctcccagtcactcactggttttatgcaatttttaaaatatggcaaatcccataatgataaaatggcattttgtttatttattattaatttttataattaagaaaattaaatgagctaattaaaaagcaaaataaaactcattatattaaattaaggaccaaccgcgaatgtaacactgactgcgttattaacggagttccgttccaaaagggcgacttggtcactctaccaatttatgtcattcagcatgatgaagcatattattcaaatccggacgcatttgacccggaaaggcattttaaaaccaaattattacatttcgcttcttttttaaagatttatgccagagcaaaaggcggcacttgacccattggcatttttgacttttggcattggtccccgaaattgcattggaatgcgttttgccgaatttcagatgtatgtgacattggcactgcttgtgcgacgcttccgcttctgtgccagctcaaacactccggtaaaacccaaaataaattcaaattagaaaaataagtttacgaatccgggcatcataggaaggaaattcgcaaaattgtgcttcattgagattgggctggaattttatatttcgaaatttttaaattttgcttacttaaaaattttagcctattaaattcataatttttaacattaaaaatttcggacttagaaaaactattggcacaaatttttatgggtttcatcaaataattttccaccaatttttaattattaccgcaaatttttaaagacgaatgattttttttattataacttttaattcatttaattaaaattggattgaaatatacgcacattaagtcagcacattttgaaatttccaaaaaattctacttttatatatttcctggcaaaattttgtcaaaaaaaatcttggccttgcaacaaattctgtgtcttttgatttttcagaaattcccgcccaaattgctctcttccgaatttcttcgcactgccgaaccaattgttgtgatagcagaaaaaatatgaaattgaagaattgaaagaagcgcaaagttcacatattttgaaaaaaaaaatcattttttctaatttaaaaacattaatttattatatattttcaataatattttcttgtattgccgacgacctttcagttccggcgccgtctatttctataacctactcattttgcatggatatgtgtaaagaattcttagcaaaaacatttttattttcttctaaaaacaataaaatttcggaataccgtcggatgttgtcagaaaaaagtctagtatttaaatcatcaaagtttggatggataaattaatacataacttttattggcttttattggaatgtgcgctccaccggaggtttagaagcagtctcttaagcaaaaaataatcaaaaattgagaagtgccaaaaataattttacttaaagaataaattatttgccatgtttaaatttcgcattaagtctataaaagggaaatgttcagatggtttattctttttcatgagaactttttttttgaaattgaatttttcgtctaaaattgaaagaaaattttttttttcgttttagtgtttttgctctcaaaaaaatcgttaataaaaataatttatttaccaattttgatacctattatttgctgcgtaattagcttatattttattttaattttaanntcatgaaattnaactctcacgaacgatttttttgaataaaaatttattttttgca

SEQ ID NO: 11707 - DNA, 1321 bp, Heterodera glycines
atcttcaaagcataaccgatcattgttttatttttgatcatttttctattggttatccgatgattcagtgatcaatgaaaatgatcactcatcactgaatttccaattcattcgattctttatttgttcaggtggtggtcgagcggatgtccgactgtggtcgcgactccgtggtgatggtctccgaggagttctacgacaaacgcgtgctgatccgatccgggtcaccggttcggcactcaactataatggaagagatggaaagcagtgacgaaggtgcgaagaaaacggaaaactggcgggtgacgaagaatgataatttgctaactccaatttgaatatccacgaacggcttaatgagagaggaagagagagagagagagagagactaattgccaaaatcaaaaagctttaattgctgtgattattttttaaaaagttatattttttataagcaaaaaaaaaacagaaaaattcgcccatttattattggatttcgcagatccttccaacgtttcccctgctcctttatttgtattgccgttgtgcttctttctcattttgtgttgtgcatttttaattttgtgtataaatattaatttttttaagccgcacaattcgcacttttagcactgctttaaaataataatttaaaatcagaacggaatttaattgataaaagcattatattaaaataagtattgatgcattaatggccgctatgcttcctagattaagcgatattaaaaccaaatcgtgcttaaggacggccatcggattcttccccggggacaatggtcgacgcacacacaaaaatggcggtttcaatcagtgcgcggagtgaccgcgactcggtgcacgtttttctggaagagatcccatgcggacagattggggcccaagtgaaggtggcggcagataattgaacacattaataggataaagatatgtgttaaggccccctccgcttctccgtgcccttcgatggcttcgactcatttccatgccaatggcgcggaaatggcgggacgcaaaagtgcccaaagcgttgggatggcaaactcagcggaatggagggactgcgtgttcagagaagcacggagaacaagcagatttagatgaaaatggcaaaacaatgaatgcttaagatcagagtcagtggtggcgccgatttggtggaaagttcgtcgcggtcactccgttcctcgcggcgaccctcgcaaaagtcacttttggtggtcagtgagggggcggacgaaacggaggacatcccggcatatgtcatcaaggcaaaacaaaaataatagaagcttaatttatg

SEQ ID NO: 11708 - DNA, 1552 bp, Heterodera glycines
tttccggtcacaaaacaaaaattcagaggttatgacgagagggaagtgcagtgtcgtcgcggagactgacgacgaggaactcggcgattatttgtgccttttggtccaccgcaacgattgcatgcgaagtgagcaatttgatcactaatttggcataattaacacttcatttcaacatttagcttgaaaatgtcagttttggctataaattgcattggcaacgcaaccacagagtaattaaatattccatttaacttaatttaaataattttcaatttttttcattttgaggatttggactatgaaatttcatcaggcgatggtaaattcgaacatgtggtgaacagggcaaaacactatctgatcattcacaacgcacagccggaagactcaggtcattcctttgaaatgaattgaaatattattttattatttcttttttaataaaaatctaaggaaattaggggtccgcggagaatttaaatgcaaaaataattaattaataaaaataatgttcatttattaaatttcaaaagtagaagaaaaatgcattgaaaaattattaattcttggggattaaactatttgtgatgcaagaaaagtcaaagtgcttttccatcaggctcgtaacaagaaaacaatcgaatggggttaatcggtttttgccaaattctgaaaaaatctaaggcaattagggacaagtggaggaaatttatatgaaaaataattaatttgaaaaaaaatatttaattaaattgtaaaacataaagaattaaaaatagaattaaatattacatgtgataaaaatttgcaggcgtttattcggtgcgaattggagacacaatgttcaaagtggcacagatcagcatcggcactgagttgggccagcagaatttgtccggaagccgaattcgacgcatttcgagccaatcgctgaaccaatcgaatgaaagagacgcacgacagaatgccaaacgaaaggaaaaaacactgccaaaatgaaaaacaaagcgaaattaacaacaacagaaaatgtgatggaatgaagcaaaacaaatgaaaattgaatttattatatttacaaatgaaaatgaagttttttcattggttaattattttttaagaaaattattaattattttatcataaatttttgcactgaatattttaaatatatatttaatgtcaaatattttaatctttgtacaaaatcggaaatgccattcgcttcctgccaaattgaaaaacattttgccgaatgttttccaacattaaatattttgaggaaagcctttaaaagcaccaccaaatttgagaggcaaagcttatttttatccatttttgggcaatgattttaccctctccaattttctttttgccaatttttttgctatgttttgccgttccttcggataaagtcaaaaattccgagcaaaaatcggaagaaaattcggtggatcgcataaataattttgttgaatcatttgagcaatttgatcaaaaaaacgacgaatttaatgcaaatgatggacaaattttagaaaaagaaaaa

SEQ ID NO: 11709 - DNA, 2609 bp, Heterodera glycines
attattgggacgaagtgcgcgaaaaaattattttaataaactttcattaatattccaattttaaataagtaaatctttttttaattttaggatcaattgaattcacaaaataaagagaagacaaaaattggaattgcaaaagaaaaagaaagcacaaataatctcgacgaaaaaagttacaaatttaaaaataaattataaaaatttaaaggcatgacgaaaccgccaataaaattgaaaataattgaaatattaaagctaattaattaattagttaatcaattgttgtgggtataattaattaattgctttttcagtaaaaatggtgaaggaacaatggcaaaacgatgcggacgcattaattgatttcgaactttttttcagaaaatacggcgtgacaaaaagcgaagaaaaatgtaataattaaattggttaattttaaataatttttgggaattatgaaaattcagtgagtttgctgcaagaagtttcacagcgcgcaattggggcgaaaagtcattgtgatgagcaaatttatttgagggattatggcaccgttgaaaagattgggcactcatttttcagtgttgaccgaagcataattatagaagaaaaaaacataaaggtgtgaataaataaatacaaattaaataaaaaataaataattaattaatggaaaaacaaataaaatatttgttaatatgaaatacaaggttcccggtgatttcgtcagtggaaattaattcataaaaaatcgtacacttagccaaattttacaaaaaattcatggagtcgtaagaataggcttgtaaatattctaacgagtcacgatttgcaaaatcctctgcaagtattctcaaattgttgccctgcagaacccattatgatttgtgcttttcatgtgccccttcttcggtcagcggggctgcgcgaaaattagttacttgtacacactcgaaaaggtgaacgccacttccaacgtgatcggctgacgcctacgattcgatttgcagacagaaaacgaactaagagcatcaacatactcaaagtgcagacattcaaaattattagtaaaaaacaggggtggaacgctgacagaaagatcccgcggttgcggatcacgcattcaaattgccgggttgcggatcgcggtcacgctccacccctggtaagaaatttaaaagctaaattccgacattaaagcagaatgaatggctaccaaccatctagaaatgaacacaccggagatgaaagtagtaaaaaaacgaggcacaatacaaattattttagatatgtaagtgaccggccaaatttaggttgacaatcgagcaaataattttattttgaatttaaatatcgaacgaattaaatttaagaaacattaaaacgttttttcgtaaaaaatgattattatcactgacgaaatcacatattaccaaatacaaaatgacaaattaaggcatttgttaaagtttcactttttaaatgacagatttataacggaaactccgaacagtttggcttatgtgtcgcaattacggagtttaatacagaaaatatgccaaattacataacggaaaaactgaaaaacgaattcaaaatttacagaaaattgtcaaaagacagcaagcacatgcttaaagtgtttgaaaggtcattgaaaccaaaaagattcttttttaacttcataatttaaataaaaatttgaaaattttgattttttttttgtcaaaattaacgaaatgaatttttagcgagaaaaatggaaaaatatttaaattggtaagcgaagtcgtaaagtacgacttttgggaactttttcaatatggcgcaaaaaatatcaacgaaactcgcaacattttatacaacgaaatgttgaaggcattggaagaatttcataaaagtaaaaaaaataataattaaattaattaatgaattaattaattaggaaatattctatttaccaattaattaaggtggaatgcatttgagcataaatttaaccaaattttatttggtggagaaaaacaatggaaatgcaaaaagttatgataaaaatgatgatgacaatgacaacaatgagatggaaattgaaggcgaaaaatggaaaatgaacacaaaattggccgattttggggcggcaattttattcaatgaaaagccaccaaaaataaatgtaaatggatgagcatttaaaacagggcttctatcgaaaagttttcaaatcagcacacaaagggattaaaaaagtggttcaaatcagttatttatacaatttattcgtaccaaaaaatatcaaaattatttttttttacctcccattaaggatttgaacaattttgaggagtaaattatattgtccaaattttgtgtattaagccaattttgaagaatataaaggattttaatggtcaggtggtgccgataggcgccgtcaaaaatttttttttttgaaatttgactattttttaacagctttttgtctaaaaatgaccaaattttgcgcaaactttaaaatttctaaataaaatatttgcattatgccataaaaagctgaaaattatgagtaagtttaagaaatcagaaagaaatgggtcacaaccagggct

SEQ ID NO: 11710 - DNA, 3063 bp, Heterodera glycines
aagaggtacaaaagtgatttgaagaggtacaaaagtgattagaagaggtacaacagtgaaaaagtgatacaaaagtgattagaagaggtacaactgtgattaaaagaggtacaacagtgatcagaagaggtacaacagagattagaagaggtacaaatttgatgaagtggtacaaaagtgataaaagaacaaaagtgataaaagaggtacaaaagtgattagaagaggtacaaaagtgatcagaagaagtacaacagagattagaagaggtacaacagtgattagatgaggtgcaacatggtttaaaattaaatattggggtgttcggaaagttctttcatagcggtcgttttatgtaaattagaatttttttcgcacccaaccgcaacctttggccaaattctttctgttctatgggaaggagcagattttgctgcatatgttacgagccatttcattttcctttctttgtaaattgattttttaaaattatcccaatggagcaccctaaatcccaaatccgatcacttttattgtacgggtcaaaactttgctttgatcagttggaaatttattaaaagcagtttttgtggccaaatcaagtccggagaatccaaatctggcctcagatttgatctctgaattttctctggcattgtactgctccatgtcgttgacaagaagttgaagcagtacagggtcatagaacagcaactgactaaatctgaggcgatattcggattctccgggtttggtttgcccatgaaaacatcaatttcattttattaggtcctttcagaacaatgttgtacaaagagggtgctgaatcttggcacttttgagcacccattttcagacaggacaatttaaagaaataactcgtcggtcttggtgactctttttcagttgtcagatagtcccaactttgctctacaaaaccataatttgttttgtgcctttagccttttcttggccaagaaatcagtggttgaatttggcgacttttttaagtagaccgatctgtttatttgagtttaactatcttgaatttaatcgacagatcatttttaaattctcaaaaatgggagaagattgtggagaataattgggcattttttgattaaaattggttcattagttaatttgttacgatttttttaatgaaatttttggtcgctatgaaagaactttccgaacaccccaataaataaggaaaagtttttataaaaatcgaatgcattttaatttaaaaatttttttataataaaatactctttttattcattaaatataattttgaaaattaataattgaatatttattttgaaatgaaattcattttttataaattcataaaaataaataatgaaattaaataaattaattaaataattttataacaaatcttaaaattaattaaaatcattaaaaataacgtaaaaatgcacagaaaaataatgttacaccgtccggattcgaacctgccgcccccccccccagaagatgactcagaatccccaatcacacagggattctgagggcttaacgatgtaataattgaaatctgatcacgtattcgtgatcagcggcccaaataaccactaaagaatttgattaaaagtggtacaacagtgattagtaaattcattaaattaaaatgaaaatattttttaacaaatttaattaaaaaaatacatgaaattctatcaattaaaaaaataattaatttaaacttataaaatttatttatcaaaaaaaaattaaattaaatataattttttatttattaactcaacaaaatattttaaattaattaaaatcattgaaaataactcaaaaataaatagaaaaataatgttaaaaacatttaaataaccataaatataacgaaaataatttacaccgtccggatccgaacctgccccctcccccctcaaaatgatgcctcagaatccccaatcacacagggattctgaggtctaaacgatgtcaaaagtaaaatctgatcatgtattcgtgatcagcagcctcaaatagccctaatgacatgtttttgaaagatttttgtgagaaaaatttttccactcaaaaatcctggtcacccccctttggtcccgaatcccaaaatcacttttatttttatatctttttttaaaaatgtgataaaaatgtaaaataaaatttatattatagaggaaaaaattgcggatttttgtagtattttacttttacagtatgacctttcagaaccgagttatgaatttttttctgaaaaatcgaaaatttccagaaattctggaataactttttttcttttgtacattatacaaccaaataaatctcataaaattctcccgattttttgctatttttaaagctttaattcacttaaattgagcagtctttcattgagttatgaattttcatattttaacccaaatttccaaggaccaaaaaaattaaaaatattttcgaatttttaaaaaattccaaaaattctgaaacgtaaaacaaacatcatattcgtgctcaggacctcaaaataccctagaaaaaaaattttcacccccattttcaaccaaaaaaaaatttccgaaaatttctagggggcctagctcgaaaaattttgaaattttccaaacatgtattacaccattcgatagagtttcgaaagctctacaattttgctctaaggcattttttgcctaaaaccgacccctgacgagttatgggcccgggactcaaatgtcccgctcaggccaaaaattttttctatttccgggaaaaaatcgaaatttttccgaaaaaaataccagtcgatagagctcgaaaaactatgttttggaagtggtctccgtttctctgggaaaaatcgttaaaaaatcctaaaattcaaaaacccgaaaaccgttttttaggcctaactcgaaaaattttgaaaattttcgaaattttaaaacttgttttgatagcctttcaaatactacacatttttgctcagaaacaatttttcggtcaaagcaacacgtggcgagttattcgcctggtactgaagtgtacttt

SEQ ID NO: 11711 - DNA, 1563 bp, Heterodera glycines
gtcgatgtagctggggctgagaaatatttttttatagcttagtcaaaagaggccatttcaattcgtttgcgccagaccaataagaaattggatcttcattgatatttatttttttggctcggagatattcattgacttcaacctgtataaaaaatagtttattatttaatttctggtttatttagttcgcctctgattttgtcgggcgtttgtcattaatgactaaaaaaacttttggctcgcaacgcttctgcaatgctttgtctaggacgtttttccgagaaaatggtctgaacttcgtcgtcttcaaaagtagtgtcactattttctttcgctgctgaacatgaaggaacggaagccgaaaacattcctcaatgtttagaaattcttataaataattagggcttagatttatatgtaagaaaaatcgcaaaatatgtacataaatatgtattaaaaaatgccaaaatatgtaagaaatatgtacaaaaatcttcaaatatgtaccaaaatatgttaaaaaaaaatgccaaaataacatcaaacaagtacaaaaataagcataaaaaatttttatcaacgattttagggcagtaaaaatggtcatttctttttatgcgtgttacaaatcagaaatttttcgagattttccggagtaaagctcatccgattgtctgccagaatatttttgtatgctgaaaaggaacgctccacttcacacgactgaatgggcgcttatttgaacattgcaataacgtccggcggcaaatgcgtttgaacgtgttcgccgcgcaaaaccataccaatttcctagaaaaaatatgagtttaaaactttttctaaatccaaccaaaattctgtcaaatcccggattgtttcgcaaaaccgtgttaaacttttcttgaaccaatttgcccacattgcccggtaccaattgcaattcatttccaacatcgctcactaagtccaaacctagaaaatttgcatagaaaaatatcgagttttcacaaactttcaatgagtgtgagattgcgtgattctaatttttcaattgctccaggtaaaatgtcaaaatgtgattttataaaggccaaatctccacgaatgcctgaacagtcaaaggcaatttgtgattggcgaatagcatcagaatcggatgggttgaagtcccgaataatcgcaccaatttggttaagattttgacagtaataatccgctgcattgagccaagtcccccaacgtgtgatgattgggcgcggtgggagagggagatcacaacgttcgcggaatttggccaagcgggatggcgcttttgaaaaagttttcagttacttttatgataaatttttgaaaaaacctggaaatatgtacgaaaaagtgcgaaatatgtaagaaaatatgtacatatgtaatatgtagaaaaaccccgaaatatgtaaaaatatgtattttaaaccaggctctagaagcttcaaatcaagctaaaaacatgtttttcatgcgtttcaggcctcccacagtccaggaaaaaaatatgtatttacatataaatctaagccctag

SEQ ID NO: 11712 - DNA, 2317 bp, Heterodera glycines
tataataattttttgctttttgtagtttctcccaccaattaaaacaaataaatttcaaaaataaatattctactagcgtctgtcggcacagtcagtcgcctcattcacattagtttacaataaaaaaaatggaaaatattgaagcttcaatattatttttgcccattttatcattatcgaaagccaagcttttctttctcgagtagggaccaatattctcgaaaagcggtataagttattctctgatttattttatttttcaaattttagatgattaatttcaaattaaatttaaaatagcaaaatttttttaaattaaataatagatggtcattggccggggctcccctttttgggcttggattttccccccttcctttgtgtcagctcctcccatcactttttgtccctcaattgaccaactgcccctcccctttctgccaccctcaattcccttggcttttccgttctttcattctgttaattatccaactttgttcgcttggcttggtttttactcaacaaataaagaggacatcgaacagcgaatttggggatttggtgttttgggccaatttggccagcccggggctgcgacgaggggccccattttgggtgtccccgagtcccaacagaccccagagtatagggcattgtcatggcgctcctgtgtggatgcgaacatttcgcttccctaatttttctcccaatttgttccccttaaaatcccattttcttcgcccattatttcattatttttttatgatttgtaataattagcgttttaatttttcacattttgcgctgccattatttctccgttcgtttattaattttgcgcaaatgatttcccatttatttttgcctaattttctcccttaaaatttaaattctttccctaaattcccttcaattcttggccaccttggctttgggtgatcgtgaggatgaagtgaaggaagaaaatgcaaaacggattcagcaattccgatcggaaatcgcgcgcgactttttcagagcgaatatcagaagacaaaataggattttagaaataataaggaaaaatttttaaaccctttgcccagatttttaaaattataaatgttattaaataattttcaattatttatttattgagttaatctatgtatttgatttaatttaaattatttttatttaattataagggaatgggagtaggccaggcttggctcggctgaagtgtcaaatgaagcactaaatgaaatgaacactgcattcagttcgtccacacgaccactgatcgttccgcctcttttcgtgcttttgcctcttttcgctcctccctctcattagtcttcctgtcatcctaccaaaatctcatctcgttggcttttggcccttcttttcgcttcgttccgttccgttcatcaatctctgctttttcccttctttttgtgctttatttttggtgtatttgtttgttacacaattgtttgttacaccatttggtgccgttgttccctgcttttggtccccaaaatgtttttggcctttaattaattattcgaatccaatccctgtccagtctgggcccgctgggggaaggactggggaagcaggacaactgattaattgtgtgcatcgccggcgatgcgatttgcattgagaattgggaaaatgttacagcaaaattgggagtgaactgagggcgatgggctgatggatgtaaggagagagagagagagagagggaaccaatgagcgattggaaagcggggtgttaggacttaggactacggtagccagcacggcagtgaaatggatgatcagagattgggggaatggtattagggattttggcttacacagcacacttaaacacacacacacacacacacttaagatttaatgcgttttgaaccggtggaatgcgggacgctgaactgctcggcgatgtgttttgcgcccgagggatgggaggagcccaaaatttgtgcttccgtcgcacccgtttgtggcgtgccaaaaacacccaaaatcgacttgtctttgctcaccgacattgtttcggttctcatgctgctcatcaacattttcttcagtgtttggctgctctgccgcgtcaagcgcttgccgaaggaagcacctccaaaggacccggcttattgtgatcagtgccatcgtctcctgcttccgcgggtccttcctcatcgtcgcgtcagcgtttttgaggacatctcgctgatttccgccgtttaaaagcacaatcaaaatcacttcaaacacacgtgcatatgatttttgttaattaattttatttgaataaataagcactt

SEQ ID NO: 11713 - DNA, 3639 bp, Heterodera glycines
  misc_feature (3460)..(3460): n is a, c, g, or t
gccaagatgaatactggatatacccgtcgaatctcaccccaacgatgtttcttttttcgcttcaaaaaaatccgaatcatgttttgcttctaaaatttaaaaaatatattttaaaatgaaaaaagtgctgagaaagacctatgttcatttttgttgggaaaaaatttctatgaggagttgataaacgccttctatcatataacgcatccataaagcgtagataaaaacggcagattggtgtttgagtaatttcaaaatttatatttgaaagggatttggaacgtggccgcatcattaaaataagagcaaattaaattttaagggtgaagtaaggaaatttagaatatatttattaattcttttatgcatttatttgaggaaaaagacatccttaaataccattttaaatgctcttttataaatgatcaaagaccaatttgatctaactaaaattaaatttagaaatttacttttttttaattgggttcaaagattaaaaattttgaaatttaaagaaaatccaaatttaggctttctaaatatatttttaattcgacgaatcaaacatcagatttgtgcccttctattatcaggctaaattgggccggcttaaatttttatgatcgttcgttgatctgtcttttgcgcacaaaatttcgtccaaaaattttttatggccttggaaggatccccgggcccgccagtttaccaaaaaaaaagcatttttatgagttaaagtccgcgcggcaaagagcgcggcagagggcagactaatttgtgtatttaaagtagcgcgaagcacagcaaaaatttcattcacgaaattgatacttaaaaaatgtttccttttcgccaaatccctccaccctttgatccgcgcatattcgttccacagattcttttaaacattgtaattaaatgaatatattataaaacttataaaaattttaagcgccctcatgttgaacagcttgtcaactatcgtgtaaatgtgcatttagcgcaaaatttagtaattgggtccaaaaaaaattaaatgtaaaaataattaaaggctccaattgttgatcaatttgttgatgccagaattgggcatcacatacgcgaggcgatggaaaaattgcaaccacttttgcaaacaatgcttcagggtgggcttttgatattcgacggagtttcgcttccatcgaatttcggcaatcccccccccctccgtttttggcacggaattccgatttccttcgctttttcaatcgaattttccccttttttttgctggagtgccagcagctgatcatggagcagctgaagtgccaccgacggacgccggtaggcgctcgggaggggacccggaattcacgatttgctaccattttcccctcagtttttggcacggaattccgatttcctacgctttttcaatcgaattttccccttttttgctggagtgccaacagctgggcatggagcagctgaagtgccaccgacggacgccggtaggcgctcgggaggggacccggaattcacgatttgcgaccattttcccctcagtttttggcacggaattccgatttcctacgctttttcaatcgaattttccccccttttttgctggagtgccaacagctgggcatggagcggtcgaagtgccagcagctgatcatggagcagctgaagtgccgccgacgggcgccggtaggcgctcgggaggggatccggaattcccgatttgcgaccattttcccctccgtttttggcacggaattccgatttcctacgctttttcaatcgaattttccccccttttttgctgaagtgccaacagctgggcatggagcggtcgaagtgccagcagctgatcatggagcagctgaagtgcagccgacgggtgccggtaggcgctcgggaggggatccggaattcccgatttgcgaccattttcccctcagtttttggcacggaattccgatttcctccgctttttcaatcgaatttttccccttttttttgctgaagtgccagcagctgtgcctgggaatgaacgagcagcagctgatcatggagcagctgaagtgccgccgacgggcgccggtaggcgctcgggaggggatccggaattcccgatctgcgaccattctcccctctgtttttggcacggattccgatttcctccgctttttcaatcgaatttttcccctttttttgctaaagtgccagcagctgagcctggggatgaacgagcagcagctgagcctgggacagtcgaagtgccaccgacgggcgcgggtatgcgttcgggaagggtacaaatccccgatttaaagaattattgtgttttaatttaaaaggttgtcccgtgtgtggcagacattttgccagccgacacaacatgctcaagcaccaaattgtccacaccggtaaaaacaatttcataactttaatatgggtataatttacaggagttaaaaaatacgaatgtcgtttatgtaaaagacgttttggctgggccgggaaccttacagtaattttcaaaattttgggtccatgacaaaaagtttttttcgcagaaacatttcaaaacgaaatatcgtgccaaagggttcaccttcctctgtccacactgtcaccgtggattagaccttattgtaatatctgcttattatttaattctttcctaattttgaatttgaatttagagtgaagtgcgcaaacacaattttgtcgtacaccaccaatgaataatgaccagcaactgggcacaatgaatttaatttcctattttcatcaatattcacaattcataattcttcgaaatagctatttaaaaaaaagtattataaccaagtgaacatttaaccgcgtaaaaaatctcaaatgtcattaaaatcctgctttttttgtgcattaaaaaccacaagacaatctttaaattactttgaataattgattatttagcataatgcttttaattttctttagctggattgatatgtgattaatttttcctttgtttatttaaagctaaatttattttaaacttttacaaatttattgaatctattaataacccagcaattcattgaccgtcattcgccttcaaaactcgcaaaaaaaaataaaaattaaaaagcggagcaagtcaagttttattaaactccgcattttggttttagtttcggttgataggcaattctgttttcctttcgtctatttaggtataattttattaaatttaaagttttaatttatcgaatttatgaatacgccatccttcggccgtcgttagtcattacaattaaaacattttcaagcctttccatcattcgttttttatgaacaccactgatccaatagtcgatgctgctgttcattcgctcttgtttgtttcagtagacagagagttgattctcggttttatccaatgctgttaacaaatgcattacaatttcccctagtcacnttttatgagtccaatcgacttttatgagtccaaccaattgacaatacctgatttttatacaatatctttgttcatgtatgatcaacccagggttcggagatgaaaattttaaaaagcctcatttggcaggcaaaaaaagcctcattttgcgtcaaaagcctcatttttacaaaatttat

SEQ ID NO: 11714 - DNA, 1983 bp, Heterodera glycines
ggggggaaaattaagaattttgaccatatttttagcatattttcattaaaaaaattctttaaattgccaaacattatgccaatttatcaaaatttaaaagattctgagcattttccccaaaagcctcaaaaagccacaaaatttctcaaaaaagcctcaaagcctcattttgaaaatttagcctcattgacctatcaaaaaaccacaaaatgaggctaaagcctcagatctgcgaaccctggatcaacccctatttttggtatcattcgaaagcacagtctcaagaagctaaaaaaataaaatctcagcgtttaggcaatttccaaaaaaagatttcattaattaaataatgattgataatttttgtttgtaacttctttaaatgtttagattttcttgttttctcgtattattacattattcagactatattcttttgaatgatgccaaaaagataagatttgttcgaatatgaacaaagttattgtacagaaagcaggtattgtcaattggttggactcataaaagtcgattggactcataaagtgcctagagccattcggcttttctgggagaatgaaataattttaaattgactatatttcaaattgcaattctcggaaactgaattatttttagctcaaaattttgaatcgcatttgtaggcaccagcaccataaaatcatcaatttactcaatgagcgagttcccatttgtattcatatttctattttgttaaagcttttttgcatatcattttattcgcaggtatcttggcctatagcagtgaaactactccaaacttggagaatttaatagttttggcgaatgtctgtaattcaaactgccagcccctaaaaattgacacaaagcgcaaaactttgtcatttttggtaaaatctgttaacaaatcacactcaattttcaaattttccatggcgatgcctatcggatccgctgtgccctcggcgccgtcataccgtccttttcccccaaaaattatgccgtaaaaaaaagtgtcttgaaaagcaaaaaaaaaggccgagttacatggccgcccaggcaaaattttggatttgggcccaggccgaccgataaataagctttttttgtcgtgccgcccgtgcccatccattatcaaagccggactgcgggccggtgttttcaaaattccagtcccaagttgattatttaaatttagtaatatgtttatcaaaattacctaattttagatttcgccgtggccctctatatttaaatctgtttcatcaattattgtactgctctttaaactttcagcgattattaattattttcttttaccattttatttaaatgcttaattttattcttaaaatataatttctacagtacatcaatattataactgatctttgaacttttcaacgattaattattttttaccattttatttaaatgcctaatctttttcttaaaatttcgctgattatttttgcttttcttttaattacttttttattgttacacagtattttgagtacaagggtctctcccttgaaatttgacatttataggttttaaaaaattaattatgtaccacccaagtttagatataacttttattaaaaatttttcatcgaaaaatgagcggcctctcccgatttcaactctccactgctactgctggccagcaaaagcgtaaaagcgatggcgccccagcaaaaacgaaaactctgaaggaagtgttggacttcaaaagcgccggagtttttcacgtcacggcaaaagtcgtgaatttgcaatataaaatttataaggttgagttttgtgtttttagcgcttttttttattttgaattttcaaggcctgccccctaaaaaataggggcttcttctgccgaaaaaagttggatgacgaaatgagatgcacttcctgcgatcacattgtgaaatcgcccatgaaaagcgtgttcctgcgcgtcgaaatcgccgatcggttcag

SEQ ID NO: 11715 - DNA, 1028 bp, Heterodera glycines
gatcatgatcaaggttatgcaaaaaaaaaacattcttttagctttcaaaatccaaaaaaaaagctaaaattcccggtttatgtgacaaaatcacaaacctggttgggtttttaatgaaaaatgtaattgtggcccagcatgaaccatttttaattcccgacgacaaatttagttacagtgagatatggctgattagtgaaaaaatctggaaaatattaacccctctttatcagatagttgtttcatttaaaagtgaactcgattttatcgatccaaataacaaatttgatcattcccaatcgatcggatgatgctttttttggtgcttgttctggaatggaatgtgtgcggagacaaaatgatgcgcattaattgctttatttaagcgaggtgacagtgtgcgctgctgtgcaatgcttgaacatcgcgcgcattacgtaccagcagccatagaaagcatgtgctgttgctgtacacatacattctcaactgctgatgaatgcgcggcgttgtgtttatttatggtgctacttgggttttggtcctcgataatttacctaattagtcgaattttgttcgttttttgatcggatcagttcatctaattattcggcttctgttgtgttttgggtctgtttgactgaccgtattaatcgatctgtgattgggtcggttcacttgttcacttaattattttctttctttgatcggaccggatcacctacctaattattgttagaattttggattgatctgattgacagaattattcggcttttatggtcctcttagtctgatcgatttaccgaattatttggttttggttgattaacaactcatcgatttgagattgtatgagaaattactcttctgatatctgtcactatttggaaaaggcgagaagaattacaaaaaaaaaccgtcaaaggagaaaaatcgagtttttttgtgcatgaaacaggctggcggcgcccttcagcatcagcaaagaagtgggttgtcttctctgttacacacagtttttggga

SEQ ID NO: 11716 - DNA, 3929 bp, Heterodera glycines
  misc_feature (1961)..(1961): n is a, c, g, or t
  misc_feature (3901)..(3901): n is a, c, g, or t
taattcgattggatatggaaaactttaaaaaaaaagcaacaatataaattaatctgtgtattttcggataaaaataattaacgaattgaccctcgtgtatcaaataataaaaaataaataaataatgaaaaagtgaatttataaatttacttgtcgtactctaattcggccaataaaagtattgtcaaccgttacatgatttaaattgtgagagaaatagcagcacaatttaattccgtctttgccgttgactgggcaaaatgccatgtttgttagattgggcaaatatggaaaaagttatgaagttttctcccatgactgagatggtccaatggtccatcaaacttttggacagacaaatctctctctattccttttatgttagtttccatttactcagctaaatgtgtagaacagacaggtcactataattgaatcaacacaattcaactacaactaccaccagccaccagctccaccgataatcaattatcatcatcattaagggccggccatgacggattagtcccggcctctcctcaatgtgcacatattgtcttcccgatcaccactcactattcaccaataggtaggatcgggtagaccaagtaattaataaacgattaaagttgaagttggacagagtaagaaaaatgtgataagtgagttgcatcacacacgacacgtagcacacacacaattactctccgtttttacgcaaattcattaaaaaaataaatgaacaaataaaatctgatattaggaatcaaaagaataaatgtgccataaaaattttgaaaaaaaatgaaagagaaacaaacattcattcctctgtaagtgtatttggcctaaaaagattaatgattttctcagttttgcccacccccccccctcttaatttttgggtgatcatagctttaatgtccctataagaggtaaggtattagcaactcgaagctatttaaacctgaaaaacattctcgccaaactatgttatgactggaacactccaaaaaacgaaaatcgggaaatttttcaaaaaaaaatacatttaatcatttttttcattgaaaaacttgttttgatctatttgtttaaataattaacacggcaaacacagcataattctctgttttggaaaaaatttttccccaattttccgggaataaaatgcattttatagcgcagcatagcaatcagtcagaagagagtgctcattgtaattcaagagcaataacaaacaaataattctacccaattatatataaatttttttgtaatgatcaccaaatatgtttatatgtttagtgaatgatgagtgaatttcttaaaaaaactttcaaatacactgttttttaattagaataaaaaaattcaaatttttaaattcttcctaaaagttgcaaaaaataaataaacaatttgtttttaaaatttttacagtagcaaaattaaaaaagtatttacttttcgtttcctccaaatgtttgtgagcttttgtttatcagaatttataaatttgaaaaaatgaaaaaactgcaagaatttatttttgcttttatctttatcaattccaatgcatttaatttattccacatttttcgagttatccagatcacttaaattctcagtttgtgccatcattgtgtctcgggtttttctgcaaacgaaccatcattgaagcgagatttgtgggagatctctgaatgttttgatttttttttaaattactatattgccatatatggtactcactttaaaagtgataaacagaggttccgccagctgagtacgtgatcgatgcaaagaatggaagccgggccgaaaatttccacggccactaacctataagacatttgaatctatttttttaataaaaacagattcatggtataccgtatatgctctttttatcccccatggggaattatttttcaacctcctcagaaaggggggggggnggtaattggagactgggggattaagataaagggattattttcaaactcctcattagattgggtgataattggagattgggggataattaaagaatgtacggtattacgattcattcaaaacacattgatttactgttggcgatatgatgaaaaatatagcataaaatttaccaatgatccgccgcccgatggcaaattaatccatttggcatttcgtctaaagaattgctgagtgccgcgcatggccaacccaaccacatcttcgttggccacaactgtggctggacttatcaacagaacaagggcagcaaacaaaagcatggagtacatcaaaattgacagcatgtttaaagacggtgaagcaaattgcaaaagattgtctctgctgctaattgtattcataatggctattataagtgataaatattaaaaaaaaaaaacttggttcggctagctgaccgggttaatgacttacataattccgccaaataatcagaaaatggaaaaataattcattattttaattaaaaggtcaactgccgaattttatttattttatatttttattcatttagcgctatttataatatgagtgtagaaatttacaatacaaacgcgccaacacgaagttgacttgtcaaaaaatctattgtcaaacatggcgcctaatgattaaaagcggattagcaaagacggacagagctttcttctgatggcataaccggcacagataaagcctgcccgttagttatggcatttgagaagttcagttaagtgtcatttttcgaataaacaaaaaaagaaattctccaatgcttcaccagcgtggtcaatgtcactttgtgcgcaatgatgacgaattttttttcaaaattaagttttttgtcccaatcaattcaaaattttgtacacatcattagtaagaaaagcttgtcggactttttaagtatattatattatatattaattataattatgattttaattttagttataaaaatacaaaatttgacgggatggcttacgattttgaaacgctgttaattgaatgctgaaattgaaataatttatataatcattttatctgctattttttcggaaatattgaaagccattttagtaaatgtgctcaaaacttttttttcacaccaaccactgaacccaaattcaatcatcataaaatttgtggaattgaatccctagacaaaattacgttttttattgatggaaaattaattaaaaacaaaattggcatagtggaaaaaaaaattttttttttatgggttaaaacatttattcaggatttttttgcaagaccttagtttataaaatcgaaaaggatatttttattgttcagaaaattggtaaaataaaaaaaataataattttttttatttcttaatggattgaatttgtttaaattgatgataatgaatatgcgtgaaagcattcaaaaaagcaagatgaaactttctcacaatcagcggcagcaaaggaacaagaagaagccttgtttaaaagctattttaaaaattaaattaaatattatgataataataattaaattaaaacaaatgcatataacatttctgttttttttttgtaagtaatttttttcaagaaacattcaatttactatatattaaagcagaattcagaaaatgcctatttattttgaaataaaaattattttttattattaaattttaaatttccacatttcaatttgagcattttttaaaagaaaaatcctttcaatatgtaatccattcctttctttgcagaatttttccatgcttctcaatagcgcctcagaatgattatgtcgaggaaatagtaacataatccttttagtagatccgtgctaaaaagcttagggttccgaatctcgtcgaagatgggagcggtggagggataataaacctcagcgtggtcgacgngatgtcccgtccaaaaaggcaaccgcca

SEQ ID NO: 11717 - DNA, 1774 bp, Heterodera glycines
aagtctcaatttatttgtagaaaatggatgggttttggtggatatgcgccgcatggcttcttgttgctgtagtttcactttatgtgttcttctacaggcgttctgctggaccaaaagtgccgacaataaaaattgatgacgaaaatggattttcgttggaaacacaacaaaagttcaagaaaaatataatattgcaacaaattaattttaatttttaaagttttgcaaatgatttgctgaattggctactttggggaaattctggcacaaatttgggaacggaacaacaattagtattgtctccactacttgcaaaatttgtgctcaattcgctaaatgaagctgcccaacgagttgggaaaaaggttggcaaaattaaagaaaaaatttaattcaaaaaataattgtgccatttatagacagcgacaattgatttgaaatttgacaatttatcagcacaaactggggactctcaaagcattcaaatttgttccaaacaatcattgtttcacaacattcgtgtacatccaaatgaggcatcaggaaattatttggcaagttaaatgaagcatcggacaatccatcaatggacaatccgtcagttaaaaacaccaaatttatatataaagttagaattgtattttaaaaattaaattaaatatgaaagaataagaattttactgatccattttatgttgacggagtgtccacttacaaattgtccggacaccccatcaacacaatctatttcagtcaatccataccaaattgtcatacactaaaaaaagtacggacgatggcataaggctggacatttccgtgtcaactgatgaacaaaatcaaccaagaactgcacgtcaaaatggaattcaaatgcgaaaaattcctgtcgtaatgggtccgtcattagagcactacacagtgataattgaccaaatcaatggcgatgtaatggcagcaattaacaaagcaattagggacaaaaaaaatttcaatgcacaagttcaggtggaaactcggttggtcttcattgccggggaactgttcgtgatttcatgttttcgagatcgaccaactatccagctcagaatggttggcaccaattctaaagcagacgaaattctctcttacagtatgcctaattgtcaaaaaaagggaaattttgaaattttctctcccaacctacacagtaaaacggtgtatcatttcggctgtgctcaactttagcatcggcgagttactgtatccagacaatgaatctatagaacgcgcttccaaggcacggctgagtgccgagtatcgtaatctaagctttgtcaacgaaatgtatccgacgtcacaaacgcccattctacagaaaacaccaccaagatcgatggtaaaagctggaattcgatcagagtcgggctcagtacatggttttacatggcctggcaattcagcactgtgatttttgaaaaaaggggtttgacaggattgggactgccggacccggaaggcagtttcaaaaacgtcaagccctgcatatttcagaatctcgttctctagtaaaagcattgcattgagcctcaatcggttcgaatcctaattacaacagactccattgcagtataattggttttattatattctagccgtctaactcccaatattttttttcttagttgagaaaaacaatatttttttcgtattctcttagtatagtagccaacaatatgtaaaaaaatcaagtcagaacatcataatcaaattatggggcatttcagttaataaa

SEQ ID NO: 11718 - DNA, 2077 bp, Heterodera glycines
tatattgtttcacttctgctctcacctggccacgttggccaagaaagcgctttttcttcccattttgatgctaaatgagcattctgcagcaatcaataaatctcgtctttgttgccgattctcatccgtgccgccgtcgtcgtcttcgtcaacatccgttccaattggcgcctgaacgcacacaaccgacccgattgaagggctctaaagaaaggaagattttacaaaaaaattcgcgtaaatttttaaatttttctctggtggtggtgtgtttcagtcttttgacaacgccaagtaaaagttttgaatgtgaaaaaattaccattggaagaccccggggaatttccacctcccatccatagccggtcaaatttgaaaaaaaccgataaaaaatttccctttcccggaaaatctcccattttccgatcactaattatttgtaaaacatttataaccaataaattaacatgcaaaacacacttctccactgtccgcaaacatcaacagttggtgcacattgctgctgctcctgttcacttcgtccattgcttttgttgggttggcatttgatttcattgtgcactgatgccacaaatggtccgccaaagcagtcaactccactcggaacacgtcccgttgaccaaccaccaaatatgcgcaatggtcgcaaaattctgtaaaaaaaagaaaatgtttttttaaacgaatattgcaattaaaattaatgggttacaccaccaaaagttcgccgccgaaattttctttatagaaacttagaaaatttccaagaaaaaaaaattcaaaaattaacagcgatttttttgtgttaatggcaactcgtagtacacaagcaactcttacaataaaaaatttcaaaaagcctaaatttaagcctaaggctaagcaagttttcaaaaaattttttttcatcgaaatttaaaaattgtgcccatttttttgcagtcggctcgatggccttcagcatcgattgttgttgatttttgaatcacgcggcgtattgacgacaaattgtttttgccaatggtccacacaatcaatcgcaaaaagttcaaatggcaggcgacaaaatatttggcatttacagcacttcgtccatccaatggacaaagtgtcgaaggatgacagctgaacaaaattttaatgatgttggaaaatcttacaatttgaatttcctttttaaattaataattcatataaaatcttgaaaaaatcgctaaaaaatgggtgccgaaaccgaaaaatgccaacttctaaccatgggaagtatgaaatgggtcaacagtccgtcctccgatgccatagcccacaacgaaaagtgttgaacaccgaacggatgacgaatgtgcagcaaatcgagcgcagaacagagcaaacggtgctgagacgaagccggaaatccaaacaaagacagtgggccctttggaggtgcacagggccttaaatttaaaaattttttaatttaaaaaaataaatttccaacccaatcccatcaaaggggaaaagtgtggcgtaaagttggccattcgaatccaacgcgagaagagagccgagcactgtccgattgccatccaccgattgagggggtccaaagtcaaaagaaactgaaaaatgaattaattaatttgaggtaaaaatttactaaaaatcacaaaaaaaattttcatgaaattttttttgaaaattaaaaaaaaatttcagggggctctaattgagagaaatctgggaatatggcaaattatttgatcagaaatgtacccagttgagtgatgaaaccaagcgtggaatgggcacgtcctcgtccaaattcgtctccactcgcctcactgtcgtcaggcgttcggtctggcaacaacgcattgaaatcaaattgaatcaacggactgtcgaccgccgatgacacgtcgtaaagcctttaagacggaggatcgtttaataaaagatttaaaaatgcaaaaaatgtaataaaacaggcccatatccaggggaaagcgaaggaggcacgtgcccccccccctagattttttttttgtaaaaatttgtcattttttggtgcaag

SEQ ID NO: 11719 - DNA, 1279 bp, Heterodera glycines
aatttgcggacaaaaaggcccacatggagcaaatcgcatctgaatgacagagttggaaatgtatgagaaaaataaacaaaaataaactttgcataatattcgggtctcaaatggtccacacagtccggaccatcaaatgggggacgatgccaaaagtcggtgtccaattcgaccacaaaaatcatttaagtgccaaccaatgtggcaccactgccgctggcattgaccaacaaattggtgaactgcgcattttcgggcaattttggtgacaagacaagtctaaaaagaatgaaaaaaacaaattttttatctgaaacatcccaaacatcaaaaagtgtcaaatgtttctcgggatttttaagagtgtttttttttaatttcacttttcctttctgtatcccctccaagatttcattcatccaaattttccaaaaaatttcgctaaatttttccaaaaaaccacaaattagcagttttagtgaaaatcggatccgatatcccctaaatgtataacaaaaactcaaaatatttactgttattcgtttgaagagtacacaagttttcacgggttgcgatgaattcgatgatttttccaatgtttttgctgttgatggtggaccagcagatgcgctaatgaccaagtgcaatttgttcggttcaccatttgaataacacagaagacccaaatttctgtaagcgctgaagagcaacgattgtgatggcgcaatttgtgactgttcatttgttgccgacaaagttgaagatgacgaagatggaaaaaggcgcaagaaatccataattaatttaatttcaaactctggaagagaaaaaagtattcgaaattattcaatgcaaaaaaaacgtgttcggtctttgaaccgacaaattaaaatgtacgaaatcggaataaatattgaggagcacaaacatgcaatggacaaacaaatcaataatgtcttattacaaaactaatttgtaagagacacaacaattagagagtgtggaaaaagaagaggaaaagaaaatacaaatgcaaagtttgtatattcattggtttcctatctacaaaatatgatccacatacctttagagttttaaaaatctaagctttacgagaaaaacgaaaattttttatttatatatttttcggtactgtaccgtccgaggggggggtgtgatggggaagcgagtgagaaattgagaaacggcgagagaatgtggaaaaataagagaaacgtccagttagagaccaacgagggatcgcctcacggttcggacc

SEQ ID NO: 11720 - DNA, 1906 bp, Heterodera glycines
tgcaaaggggcgtcaagtattattcaaatggttggcgattttttacgtaacctttatgtttaaatgattaatcgttaaatatatttgacaagaatttttctttacttagggagtaaatgcatcacattttggtggaatcgccatgattgatgctatttgccaaaaaattgacactaaaacggcaccgatcagtcgggaggaatgtgcaaaatttgacaacaatctgttttcttccgctattcatatggttcttcaattgacaggagaggaagtcatgtgcaaactgattgctggaccttggttaattttcttttattcgattcggcttgattattgatatgaatttttttactagaactattcccatattaataatagttttttttctcaattgattccaaccttaaaacgtggaaaatttggttgtctcatcaaatagtatcttataaatttttattgaaggcaccaattaacaaacttatagaatcgaagggaaacaaagtttattcatatccattgtatattgattaatactttaaatatcttgtttagcaattcaacgaattcctcagcatcagccgggccagtgaaatgcgacttttgtctgctgttacacaaaaagtcggaaaacgtaaacccgatttatttttataaaaatcaaaaatagcaaattttaattaatttttcataaatattaaaacttttatcagataatcaacaatttcatcacactttttgaaagcttcaatatgatgtgcgaccgtttaagttctggagttgatgtgtgcaaaaaatatgttaaagccatgatgaatggcatatcgaacattgttggtattcacctcgaacagacccacgctcaatttttctgtaagaatattttcaaatgcacgtaatatcttcttgtacaattgaccatattttaataaatatatgtacaaatataatcaaaatattccgtttatattttcatccatgcggtttttcattttgtttgcataaacttttaacctttgagtttgtataaaaagccgaatatgtaaaaagatgtaaataaaagtcccgatttttgttcaccaacacagaaaagaagtgtttttcctactatttagagcatggtgaatccaggaaaatttttgtatttacataaaattgacatccctaataatcatgtgcaaattaatgtaaatcactaaaaaagtgaattaaagaatacctaaatgaacatgaacatatatttgcgaggtatgtggtgatagaataaattgtatcttgatgaattatgatcgatcatttaactattcattgatttcttgtaatgatcatgtgatctcgtgttgtggttttgtgcgtcactcattgtcagaatgatgggttctttggtgggatgtctttgtcgacgctttttcttcttgtgttggtggtggcggagacagtggggaattaagcgcaattgaattattttactattgtaggtttttattctcatacagtgcgagtaatgctgtcagtataaagacaaagttcatcaatgtttaaatggtgcagtttttctctattcgactgtattgaattgttaggggtatccccaattggtcgtcgaataggttaattatatcttgttcgttagttttgtgcaatgtcagcgtttcgtaggtttgttcgattaccaattcaaatggctcaattaatgtggatgtttgatctagggacagtatttcgtagctggaggagagtgatggctaggggggagacgaagcattggtaataaatgatctataattcagtctctagtaaagagagcagcagttctctggataagaaattgggtaattcaatcggtattaagataagatcgaatatactgtttcgggtcagtccataatttgattaaattcgcagatat

SEQ ID NO: 11721 - DNA, 1505 bp, Heterodera glycines
aaaattatgaaacgaaaaacaaaggtcatattcgtaatcagcatttcaaaataccacagaaaaaaatttttcacccccattttcaacccaaaaaaaattttcaaaaatttctagggggcctagctcgaaaatttttgaaaattttcgaacatgtagtacaccattcgatagcattttaaaagctctacaattttgctctaaggcaatttttggctagaaccaacccccgacgagttatgggcccgggactcaaatgtcccgcttaggccaaaaaatttttctatttcctggaaaaaatcgaaaattttctaaaaacatcactaatcgatagagctcgaaaaacgatgttttggaagtggtcttcgttttccctggaaaaatcgttaaaaaatcataaaattcaaaaaccgaaaaaccgaattttaggcctaactcgaaaaattttgaaaattttcgaaattttaaaatttggaaaaatcaagctcattgagctctacaataagtctgctggcaccccctcgctcagttcaaacccttacgagctattcgcctggtactgaagtgtccaaaaaaagtgattcttacgttgcctaacctacaggtcaggcctttgatctgatcaaaaattttttgctggcaaagttgtaggccatagttggggcatttcgcttttggggtccgctaagctctgaaagcaaaagcaaaaaatttcgtaacactgagactggcggcaaagtcagtttccgagccgctgggactcagttggccaccggaccaaaaaatccgtatttttcccggatgcgccgtctcgagttacccctgtgtgcaaaatttcagccccccagctattcccgttcttctcaaattagtttttgaaacgaaactccttatcattctaacgtatatataactagcgtgtggcacagtaattgctcggtgtagacagtatacttttggtatatatgggcgggcgctgacatgagcgcttcgcgcaaaggacttcgttgctagtgcatgctcggcttcaaaattttaataggttatgtttttttcaaaattttaaaggcgacatttacagcttcgcggcctcaggacgggagcttcgcgcccgttctttaattttgttgagaacattcggccgcttcgcggcctcaggacgggcgcttcgcgcccgttttttaattgtgtgggaaacattcggccgcttcgcggcctcaggacgggcgcttcgcgcccgttttttaattttgtggggaacattcggcagcttttaattttttaagggacattcgaccgcttcgcggcctcaggacgggcgcttcgcgcccgttttcaaactttgtagggaagttaggacgcttcgcggcctcaggacgggcgcttcgcgcccgttttttaattttttggggggacattcggccgcttcgcggcctcaggacggacgcttcgcgcccgttttttaattttttgcaggacatttggccgcttcgcggcctcaggacggg

SEQ ID NO: 11722 - DNA, 2340 bp, Heterodera glycines
cgaattttttgtcgaggatagggatccgaatttcaaataccatggcaggaagggcacctgaatgacaaattagcaaaggtaaagcggaacaagcgaagcaccgatcacagcgaagaacgtcgtattggtggagcagtcggagacgacggacgatctcacgctggagaaggggcgcggacggcgcccgctgcatgtaagcgtaagagccgaacagttcgtccgccccttcgcctggaaaagcgatgaagcgaactttgggagagttaagcgtacctgagagaagcactttcacttcactgctggcggcgatgtgcttacagagcagaaaatgggcaactccacagcgcacgacgaccgcatggaatgtctctaaggaaaatttgttattttattctgaagcattgggataaatcgcaccgtcagaacggccgcgtcgcgctagtcttttaactttctgggggccattcgccccctccgcgtcctcaggacgggcgcgtcgcgcacgttttttaattttttgggggacattcggccgcttcgcggcctcaggacgggcgcgtcgcgcacgttttttaattttttgggggacattcggccgcttcgcggcctcaggacgggcgcttcgcgcccgtttttttaaattttgtggggaacattcggccgctcgcggccgaagaacgggcgcttcgcgcccgtttttagactttgtggggccagacgggcgcttcgcgcccgtttctaaattttgttgggcttagacgggcgcttcacacccgttttttaatttgttgggaattttcggcagcttcgtggccttgggacgggcgcttcgcgcccgttttttaattttgtggggaacattcggccgcttcgcggccgaagaacgggcgcttcgcgcccgtttttagactttttggggccagacgggcgcttcgcgcccgtttctaaattttgttgggcttagacgggcgcttcgcacccatttaaattttgttggggccaaacgggcgcttcgcgcccgttttttaaaatctattcatcaaaaaataatttatataaatacacgaaattctttatttaaaaaatagtaattaatttttaaattaaacttttattcatcaaaaaataatttataatttacaaaaggtttttcatttaattaaaaacatttaaaataagccaaaaataaatataaaaataatgtgttaccgtccgggttcgaacttgccctatttaaaaaattctgaattttggcccaaaaacaacagcgatttgaagaggtacaacaaatggtagaagaggtacaaaaatgctttaataattttttaaaattgtaaaataaatgcctatttttattattaaaaaaaactttgaagcttataataatttaaatttatttagattgaaattaaattaatttctgaaaaactcaaataaaaaaatatatatgaaattatttaattaaaaaaataattaattttaataaaatttttcataaaaaaataatttaatttaaattaaaaaatttattttttattataaaacaaacactcttttaaatgaaataaaaacattaaaaataaccataaatataacgaaaataatttacaccgtccggatccgaacctgccccctcccccctcaaaatgatgctcagaatccccaatcacacagggattctgaggtcttatcgatgttaaaagtaaaatctgattacgtaatcatgatcagcggcccaaataacacctaaatacatatttttggaagatttttgtgagaaaaatttttccactcaaaaatcctgtccaccccctttggtcccgaatcacaaaatcacttttatttttataaaaattcttaaaaaagtgataaaaatgccaaataaaatttatataatagagcaaaaaactgcggatttttgtagtattttatttttccagaatatcttttcagaaccgagttatgaatttttttctgaaaattcgaatttttccagaaattctggaataagttttttcattttacagatagaaattccaaataaagtccataaaattctcctgatttttctctatttttaaggctttattcctgtaaaattgatcaacccttcgatttgttatgaattttcaaatattaggccaaaatcccgagggccaaaaaattgccaaaaaataaagaatttttaaaatattccaaaaaatctgaaacttaaaataaacatcatatttgtgctcaggaccctaatttaccccagaaaaatatttttcaccctctttttcaccccaaaaaaatttttgaaatttctagggggcctagctcgaaaatttttgaaaattt

SEQ ID NO: 11723 - DNA, 2944 bp, Heterodera glycines
aaattagggttgggctcccgacgtcggggttggaaaattcggggttcggcgttgtcggggttggaagcgtcggggttcggggtcggggttgccaaatcgttcggggtcggggttcggggtttttcaatttttaccttatgcctaatagtcaaaaattttttaatattttttcggaaataatatttattaatttccataataatatttgtattgcttttatatttttttatttcttttttatgagaaattttgtatagaaataatttttttttcttgaaattttaaaatttttattactttttttgttttccaaaccatcttttttcacggcgctcttttctaaagacttttagggagaaagggtacggcgtcctgcggtgccgataggcgccgccgggaaaattttgaaaatttggttagatctgttaacagattttgtccaaaatatgctaaatttttgcgattttgagccaattttttaataaggtttatgaatttttgggccggtgataccgataggcagcgccaggcaaattttggaattaagctctattttctaggatttttcaccaaaaaaatttatgaatttcggtaaattttgtttttttcgatatgtatttgtcaaaatatgccaagattggtcgatttctatgagtatttaaaaaaatcattttgtcacaaagaaaataattaaagaaaaaaacgtcaaacggtattgaactcacgacagaaagtaatgtcagtgtgatgcactaacctctacaccacattccaaatgtccgaaattgagcaaatcttctttatttaataaaaatttggcaaaatggttaaaacattcaaatttcgtctaagttttttgcattttctcccacgaaaatgccattcttaggggtgtatatttaaccccgaccccgatcggggttaagggtcggggttcggggttgtcggggtatgaagagtcgggttttccccgaaaatgaccaaaaatgtcggggttcgggggcgggctcaggggcccaaccctaataaaaatgaagaaaacacagatttttttggtcgttttcgagagtgagaaatagggcgtcggaaattgtttgttttcgtttttgtttttgttttcgttttgtttttttttcttcactatcggcagtaattatatagctgtaagtttttcgtaagttcggcattcgacaaaaaaacgaagggtcaaaatcgattcatttctaattgattcccagtgtacactggaaatggcgcaaatgacgcgtttggcgacggaatggacattgggcactgcccaaactactcgtggctttgtaatgtgtgcagtaagtgaatttttctgttttgcattcaatttcgttcaaacatttcttttaagtctgtgcctaatttatttaatttactatcaaaaaccacaaaacggtcaaatttttctctattttttctgttatcaatttaatcaatgtttttgggctgatattccactaattaattcaatttactaccaaacaacaaaataatggtcaaaattttttttcttctcctctattttttcgtcaaaaaaacattgccgccaaaagttcaattctctatcgaaactaatacagtacaacaatgtgcggtgcggaaaacattgcactaatgggaaaagcgtcgctattaacaatctccattttcactaaaaagcatttcccactcattcatcaattcattcttcatccaaagcacatagtgctctcatctcaatcgtcaaacgctccgcaattcagagccttaagcttaagcaagcaaccgcgcgaaccctatcgcctattccctcatttgtttccaaatttaattgttacatctaattattctaattttatttccccgtttcattttgcttattatttgcctcatatttgaattttttaactcgcgctctcatttcaatcaatagaatagtcgtaagactaagagcaaaccaaaatttttttcttttcaaattgtccaccccaattttaaattgaactatcctttggatagtaagtcctgtcgaagttttactcaatatttttttccatcgaatgataggtcagaaataaataataatcagattttcggcattttatgtcttgtttgaattcgttaagttgagatcgactttatataataagttcatttgatttaatcaattgattttttctaaaattgaattcatttttaaaatatttatcttccatttccttatgttttattagtttatgaaaatattttaaaaaacgctttttaattatgtatacctttaaaaataattatttcgccattataatattattttcagagcatttaaattcactggaggaaaaagttttgtttctaggttattagttataacaattaaatttttagagaatttttttttgaattcgcagtgcttcgccctttttcaaccatccttataggtccatttaactttctatttttccgcattccttctttttttgcacaccattgttgactatatccactttttttatcgttttcctgttctgcataatgccacgaatttcagttggcaatgcaccatcactggcattcgctgtgttgggtccttgcgaggatatttctaaattatatagttttatatctttttaattgataacttatcaaccatcatttgtgttaccctatatcaattcactttgccagtttaaattaatcgaattttaaacattaaaaaaaattttggctttttaatgcccttctcttatttaaatatttattatattttcactcatattcttccagttaaataaatatttatcagaatcagttccaaacttgacttaaacattattgaatgaagagtttttttacttttgaattatattaatttcatgtatataattcaaaattatttattgtcatgaagaattttgattaaactttttttaaattg

SEQ ID NO: 11724 - DNA, 2489 bp, Heterodera glycines
  misc_feature (46)..(46): n is a, c, g, or t
agtaatcgttcataaatatatattaagatgttgttttgaaaatcgntacagattaatatgtacattatttcattaaattttcttgttaatttcgttttattatttgtttaataaatttcttcaagttaaatttatttttaaatacacagataaataattatttaaaaaaaataattataaacttttgcttttcatttcaaaaaaagacaacaaaaatttgaatcaattaaaaatttgctaatttcttctccaatttttaaaaataaatatgcattttttgtagctaattggccaaatattttattgaactctgaatcgaatctgtattcggagaagaaccgcttaagagaatttttaatatttaaattttcaataattaccgaggaaggaggggggagggcgcgaatttttgttgctttttaaattcatttttattttttattaaaaaaatttatgcgaaaatcatttttgaaaatgccgattttcttaacagaatcgcagtgggacatttgcggactgacatttgcagacaattttggaaaaaaaaattttttgaaaaaattaaaaaaattctgaaaaaatgaatggaaacattagagcaagaactataatgattagtagtaattccatgtcctttttcgcattttttataaaagaatcgtttcgttttaaatttatatattatgatttttttaatcaaataatttattgtttgcctgtgctggcacatttttggttgagtggattcaaaacgaaaattttttttgttttcatattacaattatatattactcttactgtaataattttttttgttaccattataaaacattccagtttttattaaagattaaaaattttacattccatctagtttcatagtattgttttttctttaaagcatcttcttgtcgaaaagtgcactgtgttcttcccccagtcctaaagcaatcagcacaaagtgccttatgatttattttctttttgcaataagaataaatttttcattttcatataatcgtttatttattttttatttttttgaattattcaaagtatgtattataattataattttcattatctttctcatttttttctaacactaatattatttttccttttttattagcccgattttcttatgtataactttttttttagttaatgtgtctgattttattctgttcctattttttcaaattgtaaattgtctagcacgacctatttgtccccataaaatacattatatgctggttatcgaaaaatttttaatcattaaatttgttattaatatttttccttgcgctccaaccggtatgaatttaataaggtaacacttcgcgattttacttttggttttatttatttatttatgattttttttcatttatacaaagttaggataaaagtatgtttcttttccaaaagtttgtgtttttataatttttaaggcaactaaatgagggaggggtggagcgcgaccgcgattcgtggcatttccgcgacctcggcttttattgaaaaattttgaaataatttactgaagttttattttttaaatgaatttcagtaattgtttttctcaacaaattctttaaagttcatattttaccgtcggctcttacttacgtcgaccgaccctaaaataccaccaaaattttcaaaattcttaaaaaatgactcaaaatcacaaaattttattagtcagatagtcagactctacttaagatttgcctctcttaataaattatttttaaactatttaataaagcagttttccatcacatccactttatttaatttattaggtcaaagaaactcaagttatagctgttaattaaaacataatattaattttttgactataattttttgattttttcacttatgtgtataagtatttggtaatttgtggtaatccatatgtacatccatcaaaaataatcataaattttcttatatgtattacattcataattttattgtttatattgtatatatttcatttgtttgtcatttttgttgttttttgatacattcacaagcatagaacgaacgatttatcgttacctagctttggtgtgatgcctttagaaaatccttatgacatttttaaaatacatattttcatggtttgacttgcaatcaaagaaattaatattaattatatgtaatgtaatgtaattatttaatttttcagccctatttttatgcctgatgatgaaatttattttaaatttaaagttcattttaaaaatatttaagattatccttaatatattttgggataaattggagttctcaaataaatgggaccaagtgcaatgtctcgcagttagaatccaatgttcttgaacttttttcttttatatctgctaatttgtaaatgaatttgttttttattatgttttctttggatttttgattgtcatttggtacattttcgttgtccttttttagctcggtatatgctcttattagaaaaa

SEQ ID NO: 11725 - DNA, 2593 bp, Heterodera glycines
ctttgaaaaggtaacaaattttttgaactttgaatctttcctataatttaataaaaaagatgaataaatttagaaataactctttttagtttttaaattttcggaagggggggggggggttagttgttgaaaaattaatgaaacttgttaaggaattagtgtaaaattttgaaaatttcctaatttctcacaattttatggggatgaggcgcaggtggggttccatttatagtgatgctctctgcgcgggatcggtgtctcaacataatcaatactgatctgataaactgataaaaaatgattgcagaacgaatgtaaaaagcggcatttggcggtgtctggctcaaagcagcagctgatggaccggttgaagccgtacgaggacgaaattgtggatggacgaacttgtgccgaaatcattgcgggccgtgaaaacgcgaacggcaccagtcaaagcaggacaaacgccgccggggacggatggtcagttgtgatcaaccaatactgatcagaaattgatcaggatgatgatactttagggatgttcaaaaattactgggtgtgtgggaataggaattagtttgatgataaagaatgaagaaaggatcaatgatcattgatcaggccttatgatataaattttgatcgggcgcgcgaaaaacccaaatgttgacagagggatcaatcaatcaattttaagtgcttcctcttccactccgatcacgtccggctcttcatccgtcattgatgcggtgatcgacgcagtgatcgatgcatcgtcgtcaaattcagcaaatgcccaaggaacgacagtcacgaagctaagcacagcgaagcgtggaagccgtgccaagctgaccattgtgggcaaagaaactggtgctgatcagccgaagaagccgccggcatcgacaacaaagcgatcggagccaaaagaggaggtgggaaatggaaaagaaaagagagaaagattggcatcgagaattggaatctgatatccggggaaaagccaaatgatccgagggactgaagttggggaaaaagctcaaaaatgttgaataatgggaatttcggccgggaaagtggcacaatattttgtggattagtgattttcttgacgcacaactttatcttgggcccaaaactgtcggaggattggagggggttggaatatgtttttacatcagagagtcaaggtcggaaaatccctaaaaaccggaaaatcccctaaagatcggatattgggatttcttgggaatggatggctagagtgaaaatgctgacaatttactgtgggaaccctaggtgaaattcttgttttgtcagattgtgtcggacaacaacagttcgttgagccgacgactagtcagcaacagaattggcaataatgccaattttggctacaatttttttgccggtaaggatttgttgttggcaccgccgggcacggcagcagcagcagcagtgccggcaccattggcattgtcatgctgcacatgctcagcaggcaacaaaaagcagcaaccacagttgaggtggaaaataggggataattccggatcatccagtcagcttaatcctgttctaatcccaataattatctgactgatcggatggaaaatggtttttcggaataattcaagattatatacatatcggagtggacaaaaaatgttttggaaagccattcccggcaaattttaaacaaattactcaggccggaggggaaaatcttttggaattccaaattccctacaacttaaaccaattgatcagctgatcaggggagacaaaaatgtgccaaattccgttaattcttgtcttattgttaatccagcaaaatctaagtccattcgatgattgggattaatcggacatttcatacgcttaagagaaaatattcgtaaaacaaaaaacaagggtccttaaaatccgagaaactcttaaaatgatatggaaatggaaaattagcaaggcctaggccttgcccagaaaaattgcgtaaatttttccacaaatttccaccaccaggcaaatgcgctcgccgtcagcagaaaggggccgtcaacccaatgaagaaaaatttccgtcgccaccggcggggggcccaaaaaattttgcacctctaaatgccattgcttcatgttctgcttccacttccacctctgctgctgctgatcagctgctcacttccgcaatgacattcagcttctcgcaaatgggctccgggggaaaggtaaaaaaaagaaaaagcgaattgcaaaaaaagggggagagaaatgcgcaaaaattaatgggctaattaggcaattttatattcggtaattaatctcccaattaattgattagtggaaagtaggtaagtgtaataggtcaaaattgataattatattttaattcgtgcagttgctcaaatggtcaaaattaggaaattatctcagtaattctctattaaatgatttcaatttactcaattttaatggttaaaattgaccattaccgcttaattggcagacaattattttttaaatgaatttgggcaatttataaatggcgaactttgggattttctcacttgattgatgattgagaa

SEQ ID NO: 11726 - DNA, 1475 bp, Heterodera glycines
  misc_feature (16)..(17): n is a, c, g, or t
  misc_feature (24)..(25): n is a, c, g, or t
  misc_feature (38)..(40): n is a, c, g, or t
tttataaatgcgactnntgggatnntctcactgatgtnnntatgagaaagaacagggtttaattaattcctgtgttttgataaaataaatcggaatgacaaaaaaaatcccaatggtaaatttaaatatttatacaatattatatttaactggggtgattgaacattacgaatgacaccaataaaaccaattaagattagttatcaactataattaagggaagtaaaatagaccattaattatttgaattggctgctggacttttcattaattaatcagcagaaggaaaaactgaaataattaggacggaatgtagtgagtgatcagtagggcgtcaaattatatggatataaaatcacgaaatatggccataaaatatggacaacaaatcgcaaaatatggacataaaattgaaaaatatggacataaatttttccaaatttagggtataatttctaaaaatttcttcaaatttattggttgaaattgcatataagatacatttccaaattttgagctgaaaaactcattcagtcggcaaatttaaatttattcaatatttttcgtgaaaattttgctaaaaaattattttttggaaaattttccggtttttgaggtcaaaaggccaatttgcctgttgggggccgttctattagaggttttttgaaaaaatgccaaatatggacataaatgccaaaatatggacaaatatggaaatatggatataaatcgcaaaatatggaaaaatatggaaaatatgggtatagaaatacgtcctagaagcttcaaaacaagctaaaaatatgtttttcgtacgtttcaggcctcccacagtccaggaaaaaaatatggatttccatataatttgacgccctagtgatcagtataaaagaccaatcaatacacttacttggtcagcttaattaattgaccagtggcaaatcatagacagaataattagtgcactattatgcaattagtgaaatgaattctggcaaatcccaatgaaatcgtataaaaaaagtaaatatgttcgtaattaaaatgggaaatcccaaacacgacaaaatccactcttgtcgaattcattttatttttatctgctttttatatacaaataataaaaaaaacaaaaagaaattaattattttctaagccaataaagttttagatttttgttgaatatacatattatttttataggtaaatccaaaatatacataaattctgaatgaatattttgaaattcttggtttatttattaaattaagaattatgggtagtaaatgggtaaatttacacaacccacagctgtaattttggtgaaacggaaagaaaatttgttttttgcttctcattgtaatagaagagagttcttcttagaaaataaatatgtaactcacatccatggcctggtggcgcaatggataacgcgtcagcctacggagctgaagattgaaggttcgatccctgcc

SEQ ID NO: 11727 - DNA, 1841 bp, Heterodera glycines
attcttatttgtgcgacatttctaatcattctgaagccgatgctgttttttttttggagttctcgagagtctcaaagtacgagaacatggttcagtctcgagattccgcgaaaaaatttgtcggggaggaaatttaccgaggaacaaacaccccgatttaaaacagttcgtctcattttctaaaatatgagtctcggtcacatttccgatctcgactaccgaaaattctccaactctcgagacattccttctatcagaaattccaccttttatttggttgcgcaacagttgctctctgctgctgctgctggacgttgtttggtggtggtcagcaccagcgggtgccatgcgtaacagttgcgcaacaacacggacaagcgcagctgctgccatgcaatgccgagttgtgcgcaactcgttcagtagaaggcacaaagtgtgggaccaatcgatggcatcctttcaaattggcgccattttattggcaattattggcataatgtttgatgtggttggtgcccagtgcccagggatggtattcattccgaggccccaaaaatctgaattatgtggcccaaaaatcggaattcctaacgaaattccgactccaaaaatattgtaaatcggaatttccgtgccatccctgttgccttccacaactcacctgccaacacaaaagttgctcaacaacagcaaattgtccactgtcaaacgcttttaatagcaaattgctgaccatttgcatcaaatttgggcctacaaattgattttatttttattttttttggcaaaatgatattttgccaatttaaaattagtaaaaaaaaactgaccgaaaacaaatggttgctgctgctggtggtgatggtggttgtggtcatcgtcaatgattacgtccaaggaaggtgaattttccatgggtgacgaagaagcggtggaatccgcgcattgggcaaccatttgtgccaaatttggaggcttaccaaagtgagtgatcggaattttccgacaaatttcttaaggtgatcagagaaagtgatcaattggaaattgttctaagtattaaaaatgattgttggaataatttaggtgaaataatggggaaaaatgtcattcaacaatttgagctttcagtttttgtgttcgtttttcgggttttggaattatgaaaatgaatgccatattcatgcgatctgattggcatttaataaccctggaataataatatttaaatgaatttttaaaattaaatttccgaaggatagtggtggaaattaattaattttatttattgcatatatttttatttggaagctgttccttactaattcgtcagattaattcttctaaattgaactagaacactgatcaattaattaattattcataacataagcgaagcattcaaaaattaattcccccccccccccccgcccaagggaggggacattagcaattgtgggggaatggcgtgagtttctctcacccccgagcaggcgaaatggaaaatgaagaatcacttttccattctcctccatctttaatctccaataagaatttttatttttaaaaaattattttttaggcgtttttaggtctttggcgagaaacaaaaatttcaaaaaatttagtgcaaaacgaaaatatttcttaaatcgcgaatttttaggctgggcacggaaaattcctacggaaattccataaaagaattttcccattttttttaatggaagaataaattaaattcccccaagggtttgtcaagcgccggaagtttacatatgggaatagcagcagttccagctgacaaatgagcaaaaaaattcagctggctaaactct

SEQ ID NO: 11728 - DNA, 895 bp, Heterodera glycines
gcggcggcggggggcataaaatttgaaaaatattccgacggaaatccgatcaaaaattgggttcgtttgtggtttattaaaaagttcaaccaacgcaagcaaattcactcttctctccattttctctcgttcctgtgtttttaaaaggtgtccgtccggaggatgatggaaatccccgccccaatcgttcatcattttttattggtccgccatttcccacaacacagtgaacaccgagccgccgatgacaccctttcccccccccctccctacgccgtcccatcgttacgccataaaaacgggtgaaatgcaaaattcaaattgatgaagatcggatcgggggacggacggcggcggatgatggcaggggcattagtgggtggtggttgttcatcatcttcattcctccctccaccgtttttccccttcttcccatccccatcaatcatcatcaataaatgatgatgattgattgggttgtcacctcaacaacaacaaacagcaggtcggagttggaaaatgtgtgtcggtgatttgtttcggggttatgatatgtacagttgtcagtcggggggtctaatttttggtggagtttattaattgcacgactaattggcacacttggacggaatgtggggattcaaatttaaaaaaaataaattgcggcacattaaatggtcaattgaccgggtccactgcgtttcggcgctggcgtttcggcgccagcatgtttttggctataacttttttctatctaatccaaatccaacattgttgatataattcgaaagcttaacatgtttagaagctttttctaagcgattgcttcgcgattagacaattaccaaaaaagttatacatgaaaatttccaaaagtcgaaatttttgaagtttt

SEQ ID NO: 11729 - DNA, 1315 bp, Heterodera glycines
  misc_feature (1293)..(1293): n is a, c, g, or t
tagtcagcttgatgccgaggctcgggattagggagggggggggggattgtacggtttaaacccagaagttggaagccaagccgaggctttcctcgtacatacgccaccagcagctgggaattattgcatcaaccaaataatatcccaagagccgagaccaacaaaacataaaagacgccgagccgagagtctcgagacgagaccggtggcagtgcgattttgagaaagcaacgaatgaatgaggggaggggcccccggggggcgggaggggtccatcgaaattggcggtgggtcactccctcactcactcattcattctcaaaggcgcggcgggtggcagccgagcgtcgccagcagaaagcagcgataaaatcgtcaaatcatcgtcatcaccacccacttttgcttttgggggttggctggcatcattttactggaatttttgccgctttggtcccctccctttcccctctatgccacacaaattcattcaattcgcccctccgtcactaagcggaggcggggaaaggcgcagttaaagatgcttatcatcataattcatccgcttcatctgctgcgctcgttttaggcggcagcgggtgccctccccgccgccactctctcgggacgcggaggagcgaaatttgccacccgacgcctcaacaagttcagcacttatatattcattttgtttatcatgtgtgtataattgtgtgatgttattagctattatgtatacatcattatgtttaaaaatgcattatgggcgtccacaaatgtgcgatggatgatgattagcgatcggctcgggcaggacagtgaaaaaaatgttgaaatatatctatttattgaaatagaacctctgaggcatctatttttcaatccccctagaaggggggggggttctatttgagtaaacacgatattctgaaaatctgtctcagtccaggagcgtgatctctaatcatcattactcattgagcatttctgatcaatcgatcgatcatttcgcaaattgtcctcccggggctgaggagtttgattgattatgatcgttcacattcattgtttgttcccctgctgttgctgttgttgttgcagcatttgttgcatgtccttctccgactcgttcagccagttcattatggctacaattgaggcgagcacggccggcgtgccgaacccgtgggtcacctgcgcaaagattcatttagctaggtgaataattaataaaaatttggatagcgttggcattttttcaagaaaatatgtggtctaatttggcgcttccanataaaattgattaaattttcaa

SEQ ID NO: 11730 - DNA, 1769 bp, Heterodera glycines
  misc_feature (621)..(621): n is a, c, g, or t
ttcaaagtgcttactattgtacaattaaaaagtacaaaattttattgaaatccggtcgaactcataaatttgaattgtaaaaaaaatatttaaaattttattttcagatttctgaaaaattttccgggaataaaaggacacactaacacattgattttcgaggtttccaccaaaaaatccactgactattggcacaattttttttaaaaggcaaacgatttggagagcagtttgtttcactttcaaagaaatttaaaaaaaaactgaaattttttagttttctaaatttcctgggaatttttgatgtaaaaacataaaaaatttttatgttttgaaaaatttgattagactttttaaatttacctatttcaatcaacaaaatacacgtagacaaaaaaaaacccacaaaaattagcagtaaatatacaataatttcaaccatattcattcattccaactcgtttaaaaaaactcacttcatccctttgtttccaaatgttttttccgcatttgaagtgtccgcgaagaaaaatgtcatcgcttccctggggcattggagcaccgtcggatcgccgacaaaagtgcctaaaaattaatttaatttttaaatgccgttggganaatttaataaatttgctgtgccaattattataaaaaccttttgccgttttgcactccaaactgagcgtccaaaacagggacaaatcggccagcgaaaatttgggcaattccaagttggcactgtccaatgcgaggtgcaaatattccggatgaaggcatcgcttccgataatcggcagtgccatcggcaggggatgagacggaggaagatgggttggcaattggaattctgaaaaattaatctattagcatgaaaaattccggaaatttttttattgaatttacaaaaaaaaaaaattgtaatttaaaatgttcaaaaatattgccatattctgaaaactgaatgaaattttctggcatttttcatgctaacaatgatcaaatagctattgtatgatacgaaaattattaaattaggttccatttaataagtttttgaacagtttttctcgtaaaattggcagttttcaaaccgcccatgttggcagtttttacaaaataacccagacaccctttttcattgaaattgataatttttgggtcaaaattttgaaaatttaagggtactgatggtgccgatcgcaggaaaataaatttcaataaattcagaattacgctaaaacttctaataattattatacattttccccacacaacccaaacacattggctctccccaaatcacacctcaagttcagcaacaatttgttgaagtagcacttggcatggaatgtttttggcattggctgctcaccgccctgaccgcagcaaccgcctccacccatttcaaagtcgtccttcagtccgccgacaaacaccgactcggaggaggacagaaacagcgccggcgggggcgacaatttgttttggacggcatttttggtggtgaaaaagggctgtacacagagcaaagggctgagccggtccatcaagctgaaatccacgtccattctgcactgctccatgccgatggttagcttgtaatcctgaaattattccggtggaaaaatatacgaaaaaaaaacttttagaaaaatgagaattgggaaaacaaacaagatattggaaagcattcctaaaagaatttgaaaactcaaaaatgaaagaaaaaaaaattgtgaaattttgcttattgttaggcttgtaaaa

SEQ ID NO: 11731 - DNA, 2372 bp, Heterodera glycines
aacagcaattttaaaaatgtgggtggttcttaggttagtaaatgttttcttatttttgtggatatttaaaaaaaatttttgttccttaacacaaacattttgtttctcgaatgaattgttgatttggaaggtcaaaatgtcatttttgagcaccgtccgtcgttcgtcgggcgcagcaatgttcaaaatgtcaatgcattggggtggcatctgaaaaaattgcataaaaataatataaatcttggtaaattataaaccaatttcaattaggtaatacaaatttatttttgggtgttttattttgggagcaggacaaaactcagccgagacataatgcagccgtgaataaattttttaaaaattttcaaacctataaatttttcaagaaaaaaatcttagaaaattttttcttagaaaattctatgagaaaaaaaattttaaagaattttccgcgatttttttgaaaattttttgaaatttcttagaattagtcattaaattttgaaaaatcgcctgaatttttttttcgtagaattttctaagaattttttcttgaaaaatttctaggtttgaaaattttttaaaaatttattcacggctgaattatgtctcggctgagtttcggcggctgagttatgtcctgctccggttttattttaccccgttttgtgccgactgtaagcactcgatgaagtcacactctttcaggtgactcttcgactcgaacaacacacgctgcaaatcggtcgtaaaagtgaaggatgtgaagaaatcgttggccacgaaactgaaaaatgctgacttaaattagaaaagcaaagataaaccaagaaaaatggaggaaattctggagaagtccgtcccatggcaatttgtatgaaaattgtgttccaattgttgattattttacccacaccgagaccatagggcatatgcccgtatccagaaaaaaatttcggggagggcatttttttttgctcttcggaccaaaaatttttttttgtactagtgttattttcaaaatcttcagcgcggattttgcgccgaaaaatcataattttccattttgggctcaaattttcaaaaaataatggtctacttggggcccggcgatgccgataggcgccgccgggaaaaatttttggaaaattaaatgcaatatgataagaaaatgtgcaaaattttcagaaaatttgcccatttttgcttgaaaattttttgatttttcattttgttaaaatttgctaaattttccacacggaacaaataaatgcatttaaattgtccaaaaattttgacataataatgctcaaaagaaagtatgtaaagaaaatgctgggcacgaaatagaaaataacaatttgtattaaaattttacaaaattttccccaatggggcctatcgggaaagttccattagttttttcgaaaattaacaaaaaaatgttcataattggtcattttttgttggaaaaacagccgaaaatactattttttggcctgtttttgtctattgccgtttggaaattttttctgccacatttttcatggcaacaataaaaaagcaaatggacggacggaccgcaaacagtcgccgtcgcacagctcgccaaactgttctcgctgctcctccagccgtcgctgtttgccaattttaatgcatttggcggcggcaaagaatttctgcgcccgctcattcatttgttggacaacggaagcgacgagcaatggggacggatgaggaggatgaggcgacaacaccgacgacgaggaggacgaaaaggacagtctctcctcgtcaccgttgatttgttgttgttgaaggatggcatcggcactcaacgggtcgtcatgagtgatgacggcgaccaacgcgggcgcacggacggagacggcgaaaatgtcgggacgacgttcgacaagcgttgcaattgaagtgcctgtgcatttagttgaataattgggtttatgatgatgattgaataacgaaaaatttaattgaaaatgagtgggcaaatggaaaaatattttaaaaaattttaacccaaccccctcgtaaatttgtatgaaaaaattttaaaattttcatattttacaattaagagaaaaaaaatttgttgaaatttatgtgagaaatggaaaaacatgccaagagttgacccccccccctcgaaaatttgtataaaaattacccctttttgttttatattgcgttttgcccataggtggacaaggggggggggggggtcaattgaaaaggcactggtaaagatgggaaaattttacgaaattgaatttcgtttttctctttcgtaaatttttttttatgaaatatacttttttggtgaaaatctgttaataaatcatgaaaat

SEQ ID NO: 11732 - DNA, 1797 bp, Heterodera glycines
cagtgtcctttacgctgttgctgatggttatgatgatgcccatgaccaccgccgccgccaccaagttcgccaagttcagacaggtcgtagaagcgttgctcagtgccaccactccatgagccagggccgccaagcccaaatgtcggtggtgccgtcatcgtcgtcgacgatgccgtcggttgatgatggtgatgaatgtagtgatgattgacggatgatggtggttgatggtgttgttgtagccgttcaccaccaccgtacaccgcacccttttgcatttgttcaatcagtttggcgtactgttgaggtcccatcggcacaccaccgccgcctgtggcattttgttgactgtaagcgccaccgccactgctcccagcagtagtagtagtataaaattcagtggcacaaccaccattttcgctcgtcgtcgtcgtgccgaaagtgtccggcggcactttttcatccgcccgaggggccaacagcgtgaaaagcttttgcaacaacaccaattggctgggcgtgagcagcaaatagagcggtgcccggaagaacaggtccacatcaatgcgcttgttgtaaaaggaattctccgcgtaggacagcgcggaattgttccggacacggatgcgcagcgtgtgcttgtcatcaaacagttgggcaatgagtgtcgggtttggcggaatgctaaacacaggggggggggcattgaataaaggaaaaataaaaaggggtatgcatgcattttacaaggccacacaaattgggaaatttgggtgcccgaggcggcattccgattgtaggacagggaatgattggatcaaaaatggttggctcggttggtgaaatttgcgtttttgggattttgtaaaataaacaggaacaggacaaaatttcgccgcccaaatttcaaaattttttttttttaaattttcaataaaatttttgaaaaattagtaattcatcataaaattccaaaaacgcttgaattattctattttttcccttaacttactttttaaaaatatttaaatgattttttcttaaaaaatttccaagttttaaattttttttttaaattttggcagcgtaattttggggtgcacccaaataaacaggcgaaggttttacgaagaaaaattttcccagtttcttatttcaaaaaatccttaaaaacattgggaaagtgtcgtgatggacaaaaaaattttaaaaaaacgcacatatcctgtgacttttgctgcgaaaaattgtttgaatttgatcgcgagctgaagtgggagtagcaggactgaaagttcatcgacgaggcggccatgtccgcgccaccgccgccgcctccgtccgattcagtcgcgtcgcttgtcctcgaggcgcacattcgctggaggatgagagaacaaaaattaacatgctattttggaacccaaaaaaaattgtagaatttcaaggaaaaatttaaaaaaatttttgatttttttttctggcacaaatttttcattttgaaaaaacagggattatattgtaagaaatcgaccaaaaagtttccaaattgattagcattgcggcactttcttttgactgtttaattatttgtacatattaaatttgtgttacattgtcacggattggtgaccaaatgtctgtgtacagtcgaacattttggacatgcaacagcttgttgaggtcggtcacctgaaatatatggcactgtgaataaggggggggggggggggaatcccaaaatttatttattttttattttttttgctttttgtgacaaaaattattacccatttt

SEQ ID NO: 11733 - DNA, 1231 bp, Heterodera glycines
agtgaaatttatttgtttgtatttttatgtgtaaactaatgctatcataaagtgtttttttttgttgggtcagttttacattgcctatacagtctggctttctctttgatggaggccaataaatgcgttggatatttaggggtcaaatcttttttggtaatttttttccttggaatacactcgtttaaggtttctagcaatgtattattaaaggcgttgtatttttcgttcacactaaaatgctcgttagataaagcgctaattctagaagaaaccataatattaaaaagagaaacattcgacggaaaaaaccgtcgattgtaaaagaagtttgttttttgtagtgtttttgtaatagtcaatgtgaaaatttgcgctaagtgatccgatgaaaaaacaccaccttcaatagtacattgctttacaatttgatcattcgccggcaaaactaagtctaaccacgaatttcccctggtgggtccactcgtggcattgaaaaaagaaagcttactaaaaaagtggcaaaaaatttcaccaaatttactcatagaaatgggctgcccttccttccataccaggtctttattcgggaaattaaaatcacccaacacaacacaattatggctatagaatgtttctaaaaattttaaaagttccttggtttgtctatatgttgtcttggttggtcggtaaacaagcacaaatctaattgattttagtttttgtaattgaaaaaccaagatttcgcaattatattttgtttcagaaaatttaacaaaaaactcaatttctttcttaattaaaacaccgcaaccacccccacgtgttaatttttgagattttctatgacaaaaaataaagttataattttcgattatccatggactaaagaggattgggttttcctcctttgtccatgtttcagttaacagaaaaatgtctatgtttttatttaccaaatttaaagctatttcatcaattttgttgtaaagtgatctaatattaactaagcatgctttaacttcccctattttggttttggggttattgggcttaacatacttaagaccggaaaagtgcgaatttataaaatgttttatgagtgtgattttggtaaaacagcaagtcaattggtgttatttttaaatgccgcaatggttgacctcagcatcaacttttgtcccccgtacaccacccaatcgccgccatctttcctttctttttcctgcta

SEQ ID NO: 11734 - DNA, 4003 bp, Heterodera glycines
  misc_feature (76)..(76): n is a, c, g, or t
  misc_feature (3908)..(3908): n is a, c, g, or t
ttggttaatatgatcggaaaattgtaatttgttatcaatgtttactcctaaatccctaattgtatccacagcattnattgtatttccatcaaatttatatgtttcttttggggtttttgaacccaaatataatacaaaagttttttgcattgaaacttttatttgccatttatttgcccattcgaataaattatgcaatgctttatgcataatctctgtgtcggttcttgctttataacaaatatataatttatcatcatcagcatataattttattttcactcctgatggcaaagcatcaggaagatcgttaatataaatcaaaaataataaagggcccaggacagagccctgggggacgccagaggtaacttttttacttgaggataaagaatccccaattttaactcgaaaagtcctattactcaaaaagccctttatccacattaaaagtttgccctttataccaattttttccaatttgtataaaagtaaattatggggcactgagtcaaatgctttttgaaaatcaatataaatacagtctcaacatcagaattgttaaacgaatttgcaaataagttggtaaataattcacatttttcatcaccattatgatagcatttgttttcaaagactaaatttggtatttcaaaaggattaacatcgtatttttgtaggtatttaaaaatggaatttcttccctttgaaatagcctttttctcaatttgcgagtgaaatttatttgtttgtatttttatgtgtaaactaatgctatcataaagtgctttttttgttgggtcagttttacattgcctatacagtctggctttctctttgatggaggtcaataaatgcgttggatatttaggggtcaaattttttttggtaatttttttcattggaatacactcgtttaaggtttctagcaatgtattattaaaggcgttgtatttttcgttcacactaaaatgctcgttagataaagcgctaattctagaagaaaccataatattaaaaagagaaacattcgacggaaaaaaccgtcgattgtaaaagaagtttgttttttgtagtgtttttggaatagtcaatgtgaaaatttgcgctaaatgatccgatgaaaaaacaccaccttcaatagtacattgctttacaatttgatcatttgccggcaaaactaagtctaaccacgaatttcccctggtgggtccactcgtggcattgaaaaaagaaagcttactaaaaaagtggcaaaaaatttcaccaaatttactcatagaaatgggctgcccttccttccataccaggtctttattcggaaaattaaaatcacccaacacaattatggctatagaatgtttctaaaaatttaaaaagttccttggtttgtctatatgttgtcttgggtggtcgataaacaagcacaaatctaattgattttagtttttgtaattgaaaaaccaagatttcgcaattatattttgtttcagaaaatttaacaaaaaactcaatttctttcttaattaaaacaccgcaaccacccccacgtgttaatttttgagattttctatgacaaaaaacaaagttataattttcgattatccatggactaaagaggattgggtttccctcctttgtccacgtttcagttaacagacaaatttctatgttattatttactaaatttaaagatatttcatcaattttgttgtaaagtgatctaatattaactaagcatgctttaacttcccctattttggttttggggttattgggcttaacatgcttaagaccggaaaagtgcgaatttataaatgttttgtgagtgtgatttggtaaaacagcaagtcaattggtgttatttttaaatgccgcaatgtctgacctcagcatcactttgtccgcgtacaccacccactcgccgccatcttcctttcttttcctgctacactcttcttgcagcacacgtcgggccttgagttcctcttggctgagtgaagggcgaattcggatgttgctcatccccaatttctgattgatttgcgcgcgccctttgttccactgtgccaaggtttgtttctgatgtttggagcacccgaaaattactttcatcaacctcgggcggttttgacctgtctttgcttggtctggggaacccattctgtacacagtgattgggctctcgatgccaagctcatcgagaacgcctgagatggcagttcggtcctcagcgactcgctcggacggcttttgtttctgcgattcagggagacccattacgacgacgcttcgccgacgctcatggtcttgaatggcttcttccatcattttctgttgtttgagatgttggagttgaaggtcttgttcggagatgacggcctgttgttgctggacctgctgtaaaagttcgacacaaattttcaaaagttgtttggtgatggggtcgacactgttgttgtccatttgttgggaaattgccgcaagttgatcactaagagcggtgtatgggtagtcagaggtggacttttttgatgcgttgtctgagagaggagaaagatgggaagaaggacgctttccaaacatgacaaatttgaattaatgacaaacatttttgtttaagccaaacgcatagattagtgccgttgaaagtgcaaccttttgacacttttgtccaactttttccagcaatttctgttcaaattaactgattaaataattaatgatgaaaaatgataaaatatcatttatattgctaattattggtcttaccaaatgagcagctcgcctcgacacaagaatcaggaccccagcaaaaatccagctttctagggtcatatgggtataaatcttcgtaataggagagagtgtcatggctagggatgctaattttatgtaaatacatatttttttcctagattctccatagcctaattagtaggaaaaacactttcttttttgtgtttgcgaacaaaagttgggacttttatttacatatttttacatattttgggatttttctacatattacatatgtacatatttttatacatattttggactttttcgtacatatttcgcaatttttcgtacatatttttcatttttttacatattttgaggatttttgagaatttataaaattttttgtaaaaaatttaaaaaattttttttgaaaatgtatccctaaaaaatcgattttttcaaaaaatgatatatcaaaaattaatttgtaaaatattcaaatgtgattctaagcctattttggtcatttttatggcattttgtgcctatttcactttttacgaagaattttttccaaaaaataaccattaaaaaaattttatttacatattttagtacatatttgggggtttttgtacatatttcatacatattttagcattttttatacatattttatttacatatttcgcaaaatttgttacataaaattagcatccctactgattaattaaaataaatataacataaatatgtatgaaagaaatccaaaatatgtgagcatcaaaattggatggttaaatttttccgaaaactgttatttagaggcgggacgtgcccgggcgctcggcgggctttaccgttccattttttcgacaaaccaacgggaccgtgccgctcagaaaaaaaaaccccaggagccccgtgttgaacataaaaaataactcgccagctgggactctaacccacgaccccagcaatccgtgccgtgctctaaccgactgagataatacattaattaggtgatttttgtataagtccctttttgtgtcttttatataacgttatagaacagcaccaaatcggaagtaaaaccgtaaattcgcaaatcataaaataccatcaaaattgtaacctgtttacctattttaaacaatcactanatttggaatttcaagccttttttgatattttgtgccaatctgtcgataattgtttgtctgacattgatggccccacggccattggcattatgact

SEQ ID NO: 11735 - DNA, 1366 bp, Heterodera glycines
cgttttgccgaagttgagttggaaccgtgctgacaaaaggttggattgttgtttttggaaaacagagaatattcgctccacatccctttgtttaaggttttcgtataatttttgtttcaatcaaaagcttcaactcatagacattttcaacagacaaaacaaagttcgaaaaactcagttttcatacttttacgggttaggaattcaaaattgggcaaaatgggtatggtattcgtgatcagcgacccctaaaacaactgaaaacaaattttcaagttttttggtcaaaaaaattattatttttttttttgcaaaaagagggttcccctttgattttgaaaaaactcaaaaaatgcaactttttcttttctccattggggtattccagggttttttttctacaaattgctgatttcgggctttcccgtgattggctctggaggcgttcatttttaatttacttcttttagcaaagcctccggcggtggctgacattgacgtttgtttgttggttgttttttgccgctcaatgtgatctcctccgacttttggacttcaaaatttttgccccgttttgtgggaaattggattatttacattgttttttctttgttgctttgccagtgactttttttgtttgatgcgcaaacgaccacattattttgcacaattacttcttataaatgtatttcttttactatatgtagaacataaaaatgaaagacatacctatttatgtatttattatactataaataataattataaaatcttaacaaaaatatatatgatgatttccatgcacaatttttgacatttttcagctgtccaaaatgatgagtgccaaattttttacgcatttgattaattcggcatcggtacgacccatctccacctcatgctgcagaaaggagttgcgtgaattgtggaaattggacaaacggaacccttttcaagaaattcccgaggcatgggtcacttctctggatgatgttgagcagaaaaattgtggactcattcaactccatccaggcatggcctcaatttggagcgaaaatggcaccatgataggacattggcaaaaaatttattccaaacacttcttaaatgttcataagcaacacaaacattgcctgatttctgtggatgagaagcgctaaattttctctaataaatttctctgaaatttaagttacaaaaaaatttaattgcgaaaatttcaaaaaaattcctaattctgaaaacttaattttaactgtctttagagttcggcctggatccaggccacttggtttttaatgaatttttgtccaaaaaattcaggtgcatgctttttttttcagtgtcgaacttcgtttttttttta

SEQ ID NO: 11736 - DNA, 2309 bp, Heterodera glycines
aaggaaattttgtgaagatttttttagcgattttttcaaaatttatgattaattactttttttccaaaaaaatttccataaaaatcgctgaaaaaaggtcgaatttttctttaaattttcttatacaaaaattaaagattttttcttggaaattttttaaaaaatgcttcaagtggaactgacaagtggggggggggaagagctgctccgcccaaattccattcctccgaaaggaaccaaaagcgcggccactataaacatatgtaaaaaaaatatggcactgacatcctaaaaaagtggcaaatgctgtgttttaagggcaaaataaccgccctatcccccgggggaggggtccccgtgtcacggcattatatactcgaaaaagcacacactttgctcagcgaggtgggctgaattcgcatgggcgaaacggtggggtcaaaaaagcgccgcacagtcagcggagcatcgaccattttgaaacggagcacaatgctgcagagcaccaacagcaaatccctgccgaaaacgatggcagtcacagggactgaaaaaagcggaaccatttatttatatctatcgcacaaaaattatttttaaaaaatcaaaataaaattaaaaattccaagaaaatgtatgagaaatgttcctaaatttttttttcaaaagcaatgaattctccgtgtcccgacatttgcggcccgacatttgcgcctttgtccaaaatctggttcaaaactaagttttttcaatcactgatcgcataaatagctttaaataagcgattaaaagtgattgtacatgatcatttgatcttcaaaaaaatgttgaaaaattaataaaattttcaaacaaaaaattattgatcataatgaaccataaaaccgtgttttcttaattttaatgcttattaggctatcaggggttgaaaaaattcaactttgagtccgattttggacataggcgcaaatgtctgggccgcaaatgtcggggctccaattttctcgatggtctaggcaactaaaattttttggttgtatattttttttgcatttaaaaaaatcggctgctcctattacaattagagccatggggaaaatgccatttttacagatttttggcaaatatatgagtaatttctggcaaattttgaacaatccaatggcttggcgaacatcggataaagtttaaaaaaaaaatttttttttttatcaaattccctcagaatcgttcaaaaaaaaaatatatttttttaatattagcgatggcatttccccaatttttgatgcaaccaaattcctatgcacgctgtttttaagcattcgttcaccgcatttcattcgcggcggttttgcgcacggcgttcgcggcccgtgcacccaattttacatgctgcccaacactgtccgaattcacgggctccgcaccgcgttgaccctcaaacatgcgcaggacgacttggtcattgtggacagctacgacacgctgaacagcgcggacccacaagttggaggagggtggaaaaaaaaatttttttttttttactagtttttgaacgatttggccgacgcacgcaattggggctattccgtgctgtttgttgatctgtgagtttttttttgtgcattaaacggttggtccattcttcgcttttgcgatgcgcgtaaaccccaaataaattatgattgatttggcttacaaattatggtcctgaatttttttaaaattgtcaggcctctggcaaaactcgaattgaatcaaattgcaaaggcatcatttccccacgggcgcctcggcaccaccgacacacctaaatttgttgatcaaaaattaccaaatatttcgtttttttttcaaaaaaaaattaaaaaaccaattcccagcggcttctatcggtaccctgcaacttttttgttccaattcgatttaaacaatatgtcattaaaatggcaaaaaaagagggggggggggagggtgaggtccacaaatttgtctatttactatttccccatggtgcagccttcgcacatgttttctttaattttcatggtgtgcacccatttacggaccgggtcgattgggcgccgaccagttgggcgccagcctgctttttgaggcacaacttctttcatagtttttttagcagattttcttaaaaatataatggattttttgaaaaatttaacgaaattttttagaaaatttaggtgatgctaggtatgagggggggggggggtaccagcaaggaaaatctataaatttcagcaaaaatactattctttccttaaaaaatttcaggtgcggggggg

SEQ ID NO: 11737 - DNA, 4362 bp, Heterodera glycines
tttcgccggtaataatttcgccgaggaaattttttcccccatttggaaaatttcaagaaaaacacttagaaaattttttatatggaaattccaaggaaaaatttttgaaattttttagcgattttttggaaaaattttcgaaaaacttactaatttatcataaatttcaaaaaaaaaatcgctgaagaatttttctaatttattttttcttgaaattttcttaaaaaatttctaacaataagtttaatttttcggcgaaatttcggcctgcaaaattatgtcccgttaccttttttaaaaattaatggcattgcatcttttggttagttgttgtcgatgagccaatccgtcgtggcaattgccaatttgtggagattgttgccgcgtacaccgtccatttgttccctcccattcacttcatcaacacattgccaatgccagtacaaatttcagtgcccgtccaatgcgaattggcaggcggtgatgggctggatattatgaatttggtcgctggattcccactcattttcacggtaaatgaaatttaattcagctgctaatggaagaaccccaaaatatcgacgcagaaattaaaatttttgaaacagtaatttaccataaaatttcaaaaatatagctgattgtgcgatttttcagatttgtttgctttaaatctcagtttcaaaatttttagaaaaaattctgcgtcgagattatgtctcggcgagatttttccgataatttgaacccatttgtttccctacaggtttatatcggggctgtagtatacgagttgcattacatagtgccaagcgttaaaaatccattggaaaccatccgaatgaaaggcaaaacgaacgccaatttggaattggttggacatacacctttataatttaacaataagtataaattgaaataaattttttttaagtgccttggtttgaattggagcaccgaattattacgtacaaatttgatgctttacgcgccgtattggatggtcaacgagactggcaaacaactcgcttattatgtgagacatggcaaacaaaaaatacattcatttagatttaaatttcctcaagttttaattcgagagtttttttatagtaataagctggttagcatttctgataataatcagtctttttccccgtcattcatttgtttcccccttctcttttagagtcttccgtcagtgaaatgtctttgttgttctgattgtttgtcatgtaaagctcaggtcagggacgtttttatgtaatatttggcggggatgaatgatacgaaagaacggagtgtcctatttatgtcaatcgctttgtatttatttataaaacaacggatttcgtgataaaaataagtttaacccggaaacccggttttggccattttaattcaaatcggttcaagaatatttttcttgtcttttgaaagttgctaaaaaaattttgatgccattgtgtagaggaaagaccagacttttaaaaagacctaaagcagcctttttctcatgccaagttttatagaatttttccaatttatccaaaaacgacaatgttttgcgacaacccaattgcctaatttcttttgcttgggcttgtgttggtctttgtctttgtgtgtgtttgcgtgtccttaattatatttaaacaccgacaacattaccctcaacttttttaccattttcagagcaaatccgtccaaatttcgcaccctcccggcaccaatccgatgattctgccgttgaaggaaagtgaatttatgtcggagaaaaaggcaaaggtgaaaatcgtggacgagtccaattggtctgccgaattccctttggacatggccggcagcagtgagcgtgtcacttgcaaaggcatcgccaaaaagaagcgcgcatttgaggcattgaaattaaaaacatttatttgttttactataaatgcctttctccgttcagatgactgtcgatgtccaattgggtcagtccggcctcacaaaagtggtgaccattttgcccttctttttgctccaaaatgacagcaaagttgacatcgaagtgcgcgagccgcacttgacgaaatggattgtggtgccggcggaatcagtcagtgactttttgaagaaagaaaaacctatttcaaccatttgcaggtaattggtttttggccagcggagaaaaagaaacacaaaaaattagtggcacgttatgccaagacgaaagaggaatcggtgcaattcccaatcacagaggcattcgaaggcttttgtcaaatccggaataatgtatatgtcttcgtcattccagtttcatttgtccctacttttagctgatcggcctttacgtgatcgtatctctgctggatgaatcgtccgtcattcacatggagatttttgtgcccggaatggtgccggcgattctgatgaacgacaccaaatacccaattcgctaccgacagacgggccacagacagtggcaaattgtcaagcccaaccaaatggcaccatttgcgtggaccgactcgctgaatggtgctgtttctgtcctttaaatggctttttatttttcatataatcctttagccctttttcagattgtaaattggaatgggagtcgggcgatgctgaaaattcggatgaattgttgcgcaaccgcgacatttcttatctgccagccaacaatgatggttaccattattgtgtgtcctttttggacgggcgccagcgcgttttgctcgtaatcatttttaatatttacgataattccttatttctttttgtttagttcactgctgacaaaaaagtttctttcattgctcaccaagcgtatgaagtgagtggacagaggggcagaaccatttatcttgttttcacattccatcggtttttcaatcattaaaatttcacagatggaacagccggacatcgaattggagctgcacttgcacgggttgggcatctccctggtcaacaacttgaaaagcattgaagtcctttatatggtcattgagattcaatttgcctgtttttaaatatgaaccactatttaggccatttctccaggaaaacagaagaaaagtgacgaaaagtcgcttaaaatggccaccggtttctggtgtcaatatcgtcagaccactcatcagcagacgcttcacgtgaaattgcacaatttccaaatggacaaccaattgccagcgtccaccttcccctcattactcgccatggtaccacagccgaaatatatggttaaaaatggttgtttatttaaaagtttttggcataaatgttacaagttttttatttcagatccaaagccattcctggagtgtgcatttgtgatgagtcaatcggaacatacgaacattgtccaaatcaaactgctggaggcgttggtgcaagaatttgcgattcgcattgaccgaacattgctcaacgaactattggacataataccgaaagggatcattcagacgggatacactgtgaacaaagatgactgaattaatattatcgtttgccgttgtttagcgcgaatccttccaaatggacatggaattaaccgagaaagcgctgaataaaagggcaattcaaacgcgggagacacaggccaaggcgtattaccagcgaatgcacatttccccgttgttggtcggtcattttcgaccacattttatacattgttctgaaggttcctttccacattttcagatccatttgagcttttcccaggggcatgttgagaagggcaaagagggcgctgctatccaatttatgaatttgcttttgaagagtgttggcgttacactcaccgaaatccaggacgtcattttcaagtacttactgtttgatgtccttttcattgctttgcaattttcggcttgccttcttccaacgcgaggccaccttctacagtcgtgcccaattgcagtccgaagttatttcccattacacccgccaattcatcaaacagctttacgtcctcgtgttgggtaatcaatcaactgtggtttttcgcttcacttgggaaccctttcttttttaaggccttgacattctcggcaatccgtttggccttttccgcaacttgcgcaccggcgctgtcgacttgttctaccaacccgtccttggcatttttactgcggccgaatttggagagggcgtttatattggactgactagcgcgttcaggtggaattcttttggctattgcttattgctcttactcatgtccccctcccactttttagtcacaccgtcggcggcgttctcggcttggcttctcgcatcactggcacaatgggaaaaggggtggcggcactgactttggacgaggactacccaacgacggcgaatacaagccctgcagca

SEQ ID NO: 11738 - DNA, 2783 bp, Heterodera glycines
atttgtaatggctgatcgaaaatagctatgggagctgaaaatgctgtgggagcaaaagcaacaggggccaaaatgaaggaaagatggccccaaaacaacagtcatccctccagtggtggatgtggtctagtggctaagacaacggatccacgtaaggggccccgagcggcggttcaaatccggccttccactccaatttttcgcctaaataataacatcccatcccatctttgaattctgaccaatttgttataatcggactcaacagattgggctgggattggattcattgtcagaacagccccttcccccctcgggcgttggatcaaagaccaccgcccgcccatccgccgccgatcttcacccttttcaccccgaagggattggcggattaaaggtggctttttgcaccgaacgaaaaaaaaatgcattcgccgtccgtacgcaacactttcgcggataaaatattgggaaaattatgtttagcacatacataatttgttactattatataaatatggagaactgaaaagaaagttttaggaaataaacacaaacaaaaattgtgattttgtagacagaataaaagaataattgttttaaaaatgtttttttcttgcaaattgtgcaaaacgtaagactaatttaaacatttcaatgaaagaacctttgataggctcaaaacccgaaaattgaagaaaacttttgcaatttttgatcgctcactgcatcaaattgctcaaggacattgagatttaacggagtgattacgcgccgtgtattccgcgtactccgcgggtgggtgaagggaagaagacaaacaagaacacaaaggaaaaaatcgatctgatcactctgtgatcgatgatcggactgtaaattcaaaggtaatggatttgggagtgtcaaagggattgagttgactccgctgatcagtgatttgaaatgtaagagaattgctcaatgaatgactcatttttattacaaatttatatttttctcacttttttgacgaaattaccattaaatcccaaaaatattttaattgtttgcacaagaatagaggagcaactccccctgtaaaaaccactgctgctgatgtttgttccctcctcagttccaattttgtatcaatcgaaatcattttggtatcattagcgcgctattagtggtttaactgctgcttttatggcatagtttcgcgcataaatagcgactatgcgtccccctcccgcgtctgagcttgctatttatacagcgaccggcgcggcagtgccattctgtgcactgcgcgggcattggcgccgccttgcgccgccggcatcgaccgccccgccccatcgccgcgaggcgttttttgcacacagtttacacagtttattccacacaacagtgcgccatttttgtgtactttggcgaaatgttgcgatacgacggctgtctccgttcgtcgtccgcggcggggattggtgggaaagcaaatattgcggcgatgcttcatcacacacacatattttttagtaaatggcaaccgacaaatgaacggagagggacggaaagaaaacccaggcatatggcaaaaaatggggaaggaatgtgaaaagtaagccaaaattataccaaaaaagttcagaaaagcatcccaaatgtcaagtgattatcacagattgaatgtttcttttatatataaaaatgcacacatttaaactcagaaatattaactcgaatttttgataatgcgattagcaaaaataaaaatgcaaatcctttgtgaataatttgttcaatgtatttattaattataattgaatgatgggaaattttatgaattgagatgacttattggtgacgatgggttggtgctgcacccgccgcccccgggctttagcagatccctccgtcctccccccaccccgctgggggtgacggagttttttgagtggcagggggggcgtcgtaccagccgaccccctaaagatgggtcaggccagacaaacgacctttgtgctgcgcttttgcggaggcggggctggtgggaatgagaaaggtaggaagggccaagcacaaaaagaactttcattgtggaaaattttaaaatagcgccggggggggggggtaaagccgacgaaaagcggtagatcagtggcaagaagcggagatggtcacctatttcacgagatgtggtttttatgtttaacagcgctggaaatccatttggaagaaattgcccaaaaatgtcgtccgtccgtcccctcaaaataccgaaataattggcacatcgttttgcttacccccccccccccgcccgcttcactgaaaccgatctttggcccatcactgccgggcgtatgagatgatgggctgagcacattccaacgcctccacacaaccacaaaagcgtcgtcgtttctttgttgggcccgattttatttattgcttcccattgccttttttttctttgtgtgcggacggagagggaaatgtgtacgaagggggggggggggagaggaaccagcggcagcagcaaaagggggacgaagacgctgcagtcattgcattgggacacgcgggaaaatggcaataaattggggaattttgtgaaattaaaaggaaattaaaatgttggaataggcactaaataaagcaatagcagtattaaaagctttgttccatgcccaaattggagcagaatgtcctcctccagccgcgactgacaaaagcaaacacattatttcccaactgaagacaacccagctaattaaatgatcatcttggccatttat

SEQ ID NO: 11739 - DNA, 1311 bp, Heterodera glycines
  misc_feature (1297)..(1297): n is a, c, g, or t
tccattcctcattcacatctaccacacctgccccgctaaaagagcacagctgtgaatcaacgacggcaatatgatgataacagcacagcaaataataacaaaagacgacgacgagatttgccacaaactgaattgtgttcgattgctcacaaaataataaataataataagatgagatgagagagatggcattatgggcaacggcggaaatgtggccaaaaggcgaagaacaaaggcaaaatgagagggaggctaaaagagagacaatgggacgggaagagagcggacagagaaagagagggttggacattaaaatgacaaaataaatattaataaaaatggaaatggcatttttcaattcccttttacccattaaataccgtggagtttccccgcttattgttagtgcactgtttcaaacataatggtcgcagattattacgagtggataaattggcaaaaaagagagatcccaacacaaaaacgcacaccacacccactcaaaaagaaagcattgatcgatgcttttgatcagtgatcgccgtcccctcccccttctctcaaaatatgtgaaggttccttcccgaattttgtgacgtaaaaatgaatcttttgctaaacttatatgaatttagaggcttaattcttttcactggggctaatttatgaaaaataaaataagtaaaaaaagaataaattcctttttgggagttaaaacgaaaaaaaaactcagtaaaaaagtcagcgttaagttttccgcacttttcatggatttacatctcataaattttgtttcctgaaaatgaatctgcaaacaaaaaagagcgacgagcaaaatgggcgaatccaacagaaaaggcgaaaatgtgacaatcaatttttatggattggggaaaatcgaaaaaaaaacttacgaggctcgaatcgggtccattttccaatttctgtcttcggttctccaaaacgggcagcgacggtttggtggagatgttgaaagccttaaaagctcaatgatcggatatatttttgaaatgcaatcaaattaatgcttttaaaaaatcgctgcaaatttcgtatattttccttacaagggaaccacccgaactgtaagtcggaaaatgcatatgtgttatataccattggatagagcaatgtcgacttctattgtgaaattttaatattacgcccatatagcaagaaaccaaaaagttatggggcctcaaaaatctaaagtttggctgtgtttccacttaaaattggtggctcagtagattaaattcgtgattttgaagctcgnggttcaaatccaac

SEQ ID NO: 11740 - DNA, 3370 bp, Heterodera glycines
gtcactccaattaattaattattcctcccttttttgtgttttgcttttctttttctcaatttttccatttggcccaacattttttcatttgcttttcatttcgaaactggagcccccaaaagacgaacgcaactccccgccggacttttctgctgctgacggcgttgaacagccaaaaaacgaatcggtcgacggatttcgactttctccgccgccgaccaccgcaacggcgacgatgccaacgctggtcactcccgctgatggcgggcaaataaaaaagcaaaaaccgaaaagtttgtctccgccggctatcgctttgttcggcgccgtcgctttgattctcgcttttggcattctcggtgtgtgaatgaatggtgcaaaagagaacaaaaaaaacatggagtaattatttaagaacttcgaaagactgattagtcaaaatatgaagtaattatgaaggatggtgtttgctaattaacgctaattataaatgtacaaagtggtaaattattgttcaaaaagtgtgccacggtaagcattgtttatgacttaaggtgtgagcatcgccacgctaatcagaacattccaaaatgggcaaaacaatgaaatgccagggacaacgacggcatcgccgccaacagtcactccaacgccttcagcgagcacaaaacctagtaaataaaagaataatttaaattattagataataattaatgaattggtttagccacgacttcggccgccccgacgactttaagccctttggaagaacttcacattcccgagcccgccaaaatgcaaaaggacgaaaattcggaggaataccaagtgacttttgacttatgacatttgcccttttgttttttgtcacttttcaatttttactcaatccaattaaggcgtattcgaatttcactgaacgattgaccaaatctctgaatcttagccaaagtccgtgcgacaatttctatgaatacgcatgcggcaacttcaaagggccgatcagtttcgaccaattgacagtgcaaaacgtaaaaacatttgtgggattggtcgaagatgaacgttacagtaaaaacccaaaggtaattaacccaaagagataaatatttaaattcgctaagttttagttgccactgcccgtcaaacagtcgattcaattctatcaaaaatgcgtcggagcaatgagcgattggagtgccgaagttggcgatgggagccgactgagaaagaaaatgataatgttggagaatctgttggatggagtgccattccccgcggtgtcggccaaaacccaactgaacgtgagcactgattgaagtgattggtccaattaattgagctgatcgcttaagatgatggaacggccatccgtcgacactttgtccatcgctttgggctatttgagcaacgacgaaggcgttaatacgtttgtgtctgttggagtgtccaccaattggcttgagccgcacggagagcatccgtacacgctgcactttgaccaagtactgcttggaaagtgacagcaccgtctgggccaatccgtccttttcacaggctcgccttctgttgcccaccaattattatttaaaagcgtgggaaaatgttcgcgcaatgcttcacgcaaatttggtctcctcgctgaaggcttataccaaatttgcgggtgccaatgtgacaaatgagcaaatcgacgcggacgcgagggaagtgatggacatggagctgaccatcgccacaaatttgctgaaagcaccggacgaaagacgcaaattcgccccccaaagcaacagttatcccaagggggggggaagtggccaatgggcaaaaaagaaacaattctaatgcccgttgaagcgtacacattcgagaaagcggacaaagagatgggcgagtatttggactttggactgttcgccttttgggctttgaaagtgccggagggcgtcgacccggcgcacattgagcctttttacatccacgagcccaaagtgatcaaaagcacaatgcaatttttggacacggcaagcattgatcactttttgtgaattatccattgttccatagatttccccgcgcactttgtacaattatttgtacatccgtttgctgtccgctaacctcaattatttgcccgtgtcccatcgacttggcaaaatcccgggccttctcagtgcccgtgggattggaattcccactctcgacgacggtggcattatcgaaaacccgtggccatatgaccaggatggcatcaattttggtggccccgaggggcgaaatcgcgcaatgtgtgcgtcgattaatgcccaatattttacgtatgcaaacgcacggatatttttggatgcgcagttacccgagaaggaacagcgaacgaagctgagggaaaatttgcggacgatggtggcgggggtggtcgactcgtttagggtaaatggacaaaagacggaaaaaagcaacaaaagaatgaatagagccaaatgatggcctaattaagccaaatgatggttaatcgtttctctagggaatggtggcacagttggattggatgagcagcgaggcaaaaagggcgtctttcctgaaaatggacaatttggtgaccaacttggcatggcccgacttcgtcgaagacgacgccgcactttcggaattttattcgctgttggcattcagagaagaggacacattcacgcaaatggtgaaatagcgagttaagcaatacaaaagttgcgaaatgacttcagaaagacaaactgcgcgacttttggacgaattcgcaggccgaaaggcttttctttgccaacgacaccgaccgattggactttggcattccgtccattgtcaatgcgtggtattcggtacgtttttaaccccctctcctttctccgatcagggctctgtttaagtcttcgcgcaattcgatcactttccccctgggcattctctccaagcccttctacgacccaaactttcccgcctccgtcaattacggcgccctcggcgtcatcgctggccatgagctgtcccatggctttggtttgctctttttttgtccgtccgttttccgatgctcccatcaattacaaaatagcttctgctgatcctttcattccatctttcatgctcatttctcatcagatgacgaaggtatccaatgggatggcacgggaactctccgcggatggatggacgccgcttcggaggcaaatttcgagcagatggcccaatgcgttgtggatgaatatgcccagttcgagcctttgtccggcatgcacatcgacgggacgatgacccaaggcgaaaatattgccgacaatggaggtcatcggtgggtaaaaacgagcaaatttcgcaaaattttcccgtttta

SEQ ID NO: 11741 - DNA, 3022 bp, Heterodera glycines
  misc_feature (12)..(13): n is a, c, g, or t
caagaaattcannttttttgaaaaaattttaaatgaaccattgagtggattagaagatttttttgtaccaaaaaagttgctttgcggaaattttgttaattcaaaaaagacaatcggaatacattttttgtataataatagttattttggggcatccaataacttttaaattgttttttaaatttattttcaatagatgttttgctgtccttgccatcgtctcctcagcgcattaacatccttttgacggggcaacagcaacgctcctctccaagtcggccaggcactccttcgcctgcgcatactttggtggccgcgtcttcgccaaccccattttcaagccaacaacaagcggcggatgaccccacattaatggtgcatctccattttgcccccccacccccccccccccctcttcgaaattattttttgtaaaaaatattttcccaggattatgatgccattgatgcgttttggcgccttgacattgagcaggagaagagcggtgcattgcatgaacactttcactatgagcagccatcatcatatgtgcagcaacaacaacagccaaaccaacaaccatcggcagcggttgttgaaccagcaacaacatgggccgaccacaaccaccaatatgaacgcgacgtgcaccttttgaccgagaaaagtctgctctccgttccacggttggcgccgccgacaattcgcagcaacaaaaatgagaccatcgagcatgaaggtgattggttgaacgatttactgcttgaggatgatgaaacggatgtcaccgcatcgggttggaccgaacgctggtggaagacggttgaggatttttccgccgtctctgttgaacaggatgaggccgggcaacgacaacaaaaggggctcaaacgatccaaccttcagcttgatcaatgtacgtttgagtcctctcgaggaatgatttaaaaaaaggaatcgagtttagatggacaacatcaattctcgaacattaggccaaagaatgagccgccagaaaattttgttgacgaggcagaacatcgtgaaccattttaccaagatgaagtgccacagcagtcccctttctcaccggtggacagtctgatgaagaacacgggagaagaaggtggggtagctattttgaaactttttccaaatttgtcatggttttttaattaagcccatgacaatctgctggagtttgactgttcatcatcaatgttctccaactttgattcgtcgcctttttgtcatcaattcgagagcaacgacgattttttggactatgatgaggaagaggtgaagacgggggacgaaaacagtgcaactgaaggtcatttctggcaacgaaaaatgcgtataaatgttcattaatatctttttttttagcaattttacgtgacatgacagcaacaattcctctgatccaaaatttggatttttacagcaattcagagtgggaaaagcggaacccggatgttttggaaaatcgtaaatttcgatttaaaaatgtgccaatttttattgtattacttactgcagttccttgtacttcaaatacctgcactgattttggtacatccacttcttcgtcatcgacccaccatgaccataatcaacaaatttgttgttcatcatcgtccttacgttgctcttcaacatccagcgggtaggcacttgaattgcaaggaatctcattcaacccatgatattacgataaaagacgacactttgtttttttacagttttggctcattcatcgatgacttggatgacttgccgttaagcccggcaaatagttcatgcactttgttggcctgcgacgacgaatacaaaaataataccgatgctgatgaccatctgaattttgccgacaaagcatcatcatccgctgcaagggatgagacggcttccacaacttcgactgtttcacattcgtacagaatggaaaaattagtgccaatgccatcatcgtcggcaacagcggcgagcagttcaaaacgaagacgaaaaatggtgcacagcaacagtcaacggcagcagaaaaagaaacagaatttgacgaagcaacaaatgtcaaagatcaacaagaaggatacgaaatcttccaagttggactacgagttggagttgaagagacgccaagaggaggaagaagaactaattgccatcaggtattaaaaatggtgtaaattttttgaaaaaaataaatcgttttcaacaaatcaatttttttttcttttttagttccatttctggccccaccaccagcagtcaccagcatcaacaatttgattttacgaaagtcaaaggcaaacgtggacgtaaatccaaggacaattgtaagtcaaaatttcaatttattacctttgaattagacataaaatatgatttttgaattagctcttctcaacgagcacgagctgccttactccgcggaatggttgactgcaatgccctacagtgtgtactccgaactgatgaatgactttcggttgagcgcgcagcaaaaagcactgatcaaaaaaatccggcgaagaggtggaatatgttttttttaaaattttacgcgggaagaggagccgcgggggggggggggtttgcctcccgctggttacggacctgacctgaaaagacacaaatctgattatgcagcacaatttttgtctcgtctaacttgttttgctccaaccaacacaggtcgtaataaacttgctgcacaaaaatgccgcgagagacgggttaaccagaagcaggagtgggagagcgagggatggtccgtcgaagcggacgaggatgaaatattcttcatgaaagaggaggacgatgacgatgaactcggagaaggcattcacacatttgacgacgttagcacacaacaaacggcagcagaagataagcatttacactaccatccaaactattacgcattttgcaacaattaaatgtttaacttttttacgacagttgctggaccctgcaaagatgtcgctttatccgacatcgtcacaaattgatgatg

SEQ ID NO: 11742 - DNA, 2756 bp, Heterodera glycines
  misc_feature (34)..(34): n is a, c, g, or t
tttggaacaaaaaaaaaaatattaaaaaataatntggagaatgttcaagatcctgtccaaattccgaaaaagtgttctttgttgccattttgcgtaatatatatttgcttcattttgtatgcattaccatctctccgcttattcaatatttttgtgttatgtaaacatgaacccggtattaaatgaatggtgtctagagacaatgggtggtcttgaataataatcactttcccattattcgaaagaaaaaaaaataacaacaaaatcattttacttttttcccctgttgacgtagcaaatatgccctcagcgatttctgtcggtctcggaaggatcgctggcggtttcgtccccgcactttttggcggatcatttggaccggtttccgcttggctaactcgcggttggtacggccaacatgcggtccctttgggaaaaagatttgataggtatgtcctctctgtcgaaaaacattgagcctaccctattcggccttccatatgcctctttgccgggccgcccctctttcacttggtccatccgttcctcctttgtttgacgccgaaacttgccataaaaatgttcaatgtcgctaagccggggaaggccaccatgtccatgctgctcattgtcgcttctttgaacaaaataaaattgtggcaccgccaacttctccccccgcccattccaactcattctcatcagccgaagattcttcgccattggacgacgcttttcccgcttcagacaattcgtcatcatcattatccacgtccatttcattgttttcgtcagtagctttttcaggcctccctcggtctttgtgatgcaacagtttcggattgatggtacggaacagcatgatcagtgcatgggcagccaacgacacatttttgttgtgcgtttttttgtactatacgcaaaaaaaagaaattgtaataaataaagatagaagatttactgggaaaactttaccgccgctaaatcccgaaccatctcttcagtggctgcctcagggcaacccttgtaaatttcacgaattgtattcaggccgacagtgattgcctccggtgtgttgcggtcggaaacaaaattttgtgcaaccactcgaatctgaaagtttttgaaaacccattaaaaaaattaaagtaaaaaataagactaatcttccggtttttagataaaagataaaacccattttagttgacaaattgaatttttttagcctgcaaaattccaaaaaaatatcgttatgttcagaattatattaaattcattcaattcggacaactatgaagagttctaccaaaaagaaaattgggttgtcgctcagttgtcttccctttccggcacccttttcaccaaaatcacacttgaaggaaagatgttaccaattgttcaatgacatccgacggcaccaatgggtggcacgcctgcgcggcgtatagcaaaatgcgtgtcacctccttctgttttggtcgtatatagcgatgcaaatatgagtaaaaaccaagcgtttgtagttgatgaacaccaatcactcgagcacacagtgcaatttggagaagtctaaaaactggtaaaaaaatgaaaaaattgagtgccgttagcaggggtcgaacctgcgaccttgggcttattagacccacgctctaaccgactgagctataacggcgatgcaagaaaatttttttaattgttttaaattaaaattattcgatgtaattatctggagacattatattcaacctaatcgcgtatttctcgttccgctgacgaccctccagccgtcgtgaagagacggtccacaaaacttctgagggtcgtagatggcattgatggcttccatgttgcattgcttcatgtctttgggcagtcgcttctcttccttcttgcgctgtgcagtgacaatgaccttcttggcctggtccaaatttttcttgcgtttacgcgtttttttggcatgacgaaacttttgcagcacctctttaagggatctaaaatggtaaaatgaagataaaatacgtttaaaaatgtttaaatgattagaaatgacttggtctctttacggctgccttcctctcctccttccatttcatcgtcagacgaattttgtccatcctcatttggcttttcgtcgcgttgagagccgaggaaaaagcgcattgcacttatcttaaacaataaataaagaacaaggagagtggataaaatgaaatatcctcgccataaattttaattaattagccaaaatgatttcaatacctgaattcgttgcacacgatggaaaacacattcggctaatgcatttgcgatgtttgcatttcgccagtaatggcgccgatacgcgcagataagtgccaactgagaaactcgagcacagacctgaaaaaggggtatcctttttgggaacaggacaaaatcacgccgccgaaatcacgccggccgaaatcacgccgggacaaaatcacgccgctagaaatttttaaaaaattttcaaacctagaattttctctaaaaaaattcttagaacattttttataagaaaacttaaagaaaaaaaaatttgaaaaattttcagcgatttttttttgaattttatgataaattacggttttttgaaattttccaaaaaaattttttttttctttgaaattttcttataaaaaaattttctaagaattttttctagaaaaaattctaggttcgaaaaattttttgaaatttctagcggcgtgatttcggtggcgtgattt

SEQ ID NO: 11743 - DNA, 3727 bp, Heterodera glycines
acaattataattattttgtccatttccaaactaaatttttgtctttttattataatttatgaatttttttagtgacccgcgaacttatgcaaatttaagataattatttgattataatgtcaccattttatgaacagttttattaattacttcgattttgttcctgtgatttcatttaaaaaataaatactataattaaatttaatttctttcaaatgttcactatggtctgttgtacgttactaaattgtactgcaaattcgccgtgccgaaaatgaccccgtcgtggttgagtccctccttctgaaattgttttcctttcggtgtttttttatttcgggtttctacttgaaatgccgcattctctccgtcaatggcactggcaattcgtccgcacgtttggtagccgactttttcgtctcccgtcgaataaattgtgtaaatgaattcgccttcgtatcgcttccttaatttgggcatttcccgcctaatttgccaatgtgaaagctcagactttgaattgatgtccttcaaaaaacgcgagccgcaggacattccgttgagcaaattgcaactgccaaagggcaacacacagagaaaggagccccaattggcacccgccacgccgacgaaagcgcgcaccaaattggtcaatgggggaccaacgtccttaaataaggacggcggaatgggaggccaacgcacacaaaggcacggcacagtttgtgctgttttgccctccctcaccgtacttcgtttgtgtcaacgcacattccgcccaaaatggcctaagagtggcaaaatgtcctcagtaaatgactcccccccccccgctttttataccttccgagcaaccggcgaacccatggaaaaggcgacgatgttcactttgttgtcggtgtacgcggacactgccacaataatcattcgaatctattgaggggaaagtgttcacagtgtgccattggttagcaataaaaggctttctggcatgccaattatgccctacggaaatgagcgattgatttctatttggcactcaaaattggagggtttcagctgggcgtcaaacaccgccattttgaaaatggatatttttcccattggcaatgtgccctctctgtcaactgaccactttcacgtagtggcacgacatcgtaacaaatgccttaacatttggtgaaccattgaacaacaatttccacacggtccctcacaacgtttgttcgtcccgagtcaccgtatgtggtaccgtacacttcttcgtcaccgtacccgttgttctgtgtgcagcaattttttcatgatacatttgcatcacttgccaggaaaaagtgctgtattgagccgaaagtgcccgcattatttgtgatgccgtggacgaaaatcaccggccgacgccttcagccgaatgaatggcattgttttgaattcactttctttcaattaggactaacttcgtctgttgtcccttttgatgagtgccgcccccgaaacttccgccgccgccaacgtcttctcgggaaagttctttgtccaccgcgtcaccgtaacgttcacggagaaattgccgaaaggtcacggaaaaagtggcactaattgaagacggaaaaaggagcaaaaaacagagcgaaagaggaaaaagcaaagggaaggaaagaagccgaaggaaaagcatctgatgatggcatgggaaggagaaaaattgggggaaaagggacaaaagaaaaactgggaaaattgcgattgcatttataaatatgggaaaccgccgtgttaatgatgtcgtcaatggttgtgtccccgcagagaaattggaccgattggagcagcaaaagcattcatttgggcttttccccgccggtgaaaggatattcggggagagaaagggaagaaaacccgttgtttagaaaggaagacgggttgaagacaaagggaagcgaaagggacgtggcccaaacgattggctaatggaagtgatttttcctatctaaggggcgccgcttacccccgccgcggctaatgtttaattttaattagcaaattctacggttgatttgaaattccatccgctgttcttttttttgtttacaattgacaaaatgtcattcaaatttgaacattttaaaccatttgaatagggcaagcttttcagctggtgattacttatgctgttcttcgacttcgttcttcgtccttttgttcagtcctcgtcgctatcgctcgacttgaaaaagcggcgcactttcacataattcttaaaaggcaattattattaaattattatggccaaatccacagcctcacccacccctctcattttccaattgctaatcactttgcccccccccctcgtcggtcagttgttcctctaaaatgccatttcttttcaaatcctaatttccagctaaagctgccgtgccctccccccccccgcccgctttgccctcgttttgccttcggcgttgtggtcattcgatgtgcgatgcccttagggatgatgagtaagtcgccatactcactgacacatttcaaattagtcaattgaccgattgaatttgctaatgctcaccaaaagatgcgtatccaaactccgtcctaaatttgggcattcaataaagctaaatccatgtgtaaatcactttggcttcgacgtcgtaatacgccgacccttccaaaaccatccgtgcttgatcctcgtcactttccgtctcttcgaaaagttctgcgatcttcaaacagagtgccatttgaatgcttttcttcccatttccaaaatgggctttgccttttccttaaaatcgttcgttgtctgtgcgtccaatgtgtacgtgtcctccttggtgaagttgcgctccaatttcataattgcaattcgttttgataatgccacttggtcttccaaatccaactgacgaaggcaaaattaaaggcacagatttaagacccatctgatcagtgatcgaacaatcaaaaaaaaaaaaccgatcaacagacggacaacaattaccttataatagagggcgcccgtccgtttggtcaattcgtccggattcaccaattttggtgggaaacagtggtgcggactgagcggggaaagggaggggggcgggggcaccgattgattgatggcaccgaatgatcagaaaaagacggcacttacagacgcggatcaccacacgggtaggtctccatgcaccacatttggaccattgttaggaagaaaaagttgtcgaaaggcagaggaaatttaatctcaatgaaaggaaatttggcgaagttttgcggtccgtcccacgccctcaggaatttttagaaaagaacgcaccccatctgatattcccatttttctgtttcacaactggccaacggcgactgtgctcattgacacgtagttgtccaattaaggtacttggactttccacagtaaaatgtggtgccaattttggaactgtcccgcctcacggcggggcttaaaagcatttgtagcgcaataaaaaagattattgttttgaatttttcacaatttatttaaaaaagccaaaaaatccggatcccattttaaaaacgaaaaatagtgcacaaaaagaagccgcctcacggcggggcttaaaagcattgtacatcataattaaaagcgaaaataatttttcgtatattttttcacaatttatttcaaaagacaacaaaaaattgatacaatgttgaaacgaaatagtgcacaaaa

SEQ ID NO: 11744 - DNA, 903 bp, Heterodera glycines
ctcgcccaccatctcctacaaaaaatctcacgcaactctcacaaccattgaactcctctacctccttgcgtgtcaaaccggttcaattcgtcccctccccctcaattaacccattaattttgtcgtccaaaatttaattcccctccttctctttccttactttcttccttttcgtcttatacatatttgccggtatttttgatggtgttctctccgcgcgctctctctctctctctctccctctctctctctcactttcctttctctctgtctctctctccctctctctctctcactttcctttctctctgtctctctctccctctctctctctcactttcctttctctctgtctctctctttctcctctctctctcactttcctttctctctgtctctgtctctctctttctcctctctctctcactttcctttctctctgtctctctctctctttctcctctctctctttctcctctctctctctctttctctctgtctctctctttctcctctctctctctctttctctctgtctctctctttctctctctctctctctctccgttctccccttctctaattaaacaatattcaacaaatcacattatttaccgtttgctattatcacaataaacagcaattgcggagtaagtgctttaggctaatattttctacgaaaacgaaaattagaataaaagtttgaatttaaactttccaaattttactggtcacacaattaaatgttattgtgtgttaaaatatgtaaaagtgagaaattgtaaaaacgggtgttttaggatttttttccatgcaaaaaatgtcattgcaatcagatcactcttctgatcagttcctttttctgaaggtatcgtctgctgatcagtatcccggcgctgtcct

SEQ ID NO: 11745 - DNA, 4800 bp, Heterodera glycines
gtatggggtgaattccattctagccaactccgtttcagcaaagttcataaattgttttcttttttgataaaactcagcaaactcgaaagctttaaatgtttagaagattcgacattctcaataatacaaagtttttgatcagacggagttggtccgttccgttttatcggtaccaccggaacccaaaaacttatacttttttcatgaaaattggcttttttgggtaaaatctgttactaaatcgcacaaaaaattcaattttttaccttaaaaacaaaaatgtggacacttttagacaagatctgttaacaaatcacactcaaatttccaaaaatttccccggatccttccgcaaaagttataaagaaaaagcgcaccgcaaaaaagcggttttggaaagcaaaaaagttcgtaaaattcggtgttggaatcccatcgaaaaattggccgctgacccctccccccccccccgctcaagactccttcgcaaaaattttggttgacctaccccctttttaatgtgttttgattaagaaaaataaatttgaatcaatttaatttaaatttctcggttctcgattcccgagtcgagaaatttctcggttttttgggtctcggttctcgtatcgtttcctggggtcatttatcggtatcgtttctcggttcccggtaaaaaatcacttctcgcacagccctacatgttggacctggacctggatttactggacaaaaatccaggaaaatccaggtccagaaaaaatccaggctcctcgagacctggatccaggactggacctggattttttataatttgttttaaaaagcaaaccaatgtttgaaaaaatcaattaattgcttaggaacgtcttctaatttataataataatgtttttataaccaatttatcatttttgaaaacacgaaaaataacagacatattgtatctcatattgcggtaaagtagggttaagccccgagccctcggggggcaaaaagtcgggggccggggacctcggggggcgacaaatcgggggccggggcggggaggagctcaattgtcgggggtcggggaccccgatcggggaatgaccaaattttattttaacccaaaaaaacaaatttttctttttaaatgctcgtaaatgttcatttttttcactttaatcatatgatttcgttagcgccaataagagtgagtccaagctggcctttaatccagggcttccatttgttcttatttataagaatgttccgattttggggtagcgacgaaaattattctgatttcttaaatagacttaaaaaatgtcactattttatcaaaaaatttaaagttctgacgcaaatttttttgatcttttgatccctaatgtactgaaatttacaagtttgcattttcctccccaaaaattgttaaaattgataatgtgagactaaaaatataaaatttgatacatttttgatcgaataaattgtaaaagtaactgatttgaaaaaatgttgtaaaattttcttatttttgagcctaaataattgtggaagccctggtttaaaatacttggaaagggggagggggtttaaccgaaatttttgcgacccttctgaacatcgaatttgaccaccattttttgcggcactcattttcaaaaaaaaaactttgggcaacagcagaacggggatgggcggcgatgctattaggagccgcgaggaaattttttttttgaaaatttgcaatttgttaacagatttttcctaaaaatacctatttttgcaattttgggacaattttttgcaaaaaaattggacttttggggggccggcggtgccgataggcgccgccgaaaagtttttcggaatttttaattaattttattaagaaatttggtcaaaatttcataaatttcaacctttccccccttcgttgttgaattaactttttaaatttttacaatgctcggagtccccaattccccgaattagtgtcggggagtcggggggttataaatgccgggggtcggggcggggaataggcccaaaaatgtcggggatcggggtcggggagctcggggtcagggctgaaccctactttcaagcgaacagtgaacgcgtttttgaattcgtttttcaaagcatttggcctctgcttaaagacaacatttgtgggctgcaaattagacttttcggcaattcgtccattctctccgattgtccgtctcttcgtttcgtcttttcctgtgacaatgtttttcccgaattttcggaagatgaaatgccaatgaatcagatgaacaagcaacggccaaatggcctttttcgtctcgtccggacgatgtgccaaaagtgctgaaatgctatttcggtttttatgaggatgaatggccatcacaattagaaggactgaagacggtgatcaattatttgctgatcgttgtccaatttcatgagatgaaaacaaatggacaaaatgggagaaggaagcgattgaatggcggcacttcactaaacaatggaacaaaattaccattgaaatttatgaagatgaactcaaatcacctaattaatgtaattatttgtttctgatttttctttaaaatccgtccattttcatttttgttgaatgtataataaatttgttaagtaatcatagtttattcaaatagtgcacaaaaagtttgtacaaaagtaagacctaaaaacggtaaatttaaattccccccaccttttttcaaattttagtcatttcgggatcgctgatcacgaattcggcttccatttcggccaattccgaacccgggactaacaagaaaacaaaatgaaagcgtcaatcccacaatgaaagaccatttaagctgtttttagaaggaaaacaaaaaaatgcgaaatttgggcgttggaccttttgttcgaattagggtccggaaggagttcgaaatggatgtacacctaatatttgtgaccagagaacccgaaaagcctataaaacatattttatggatttataaataatttttttttcgaattaccctgaaacctagggtacttttcccgggggaccggtaaattggacaccggaaaattggacaccagaaaattggacaccaagcggaaaaatggacaccgccggaattttggacactaaaggaaaattggacaccagaaaattggacaccaagcggaaaaatggacaccgccggaattttggacactaaaggaaaattggacaccggaaattggacactaagatttccttttttaaaaaaatcaagaattaggtgaaaataaatttgagtagaataaatgggttaaatgagggatgattgatcaatgtgccaaacaatgaaccaaaaatgggtgacgattgatcaatgtgccacaaaatgaaccaaaaatgggtgacgattgatcaatgtgccacaaaatgaaccaaaaatgggtgacgattgatcaatgggccaaaaaatgaaccaaaaatgggtgacgattgatcaatgggccaaaaaatgaaccaaaaatgggtgacgattgatcaataggccaaaaaatccaccagaaatgagtaataaaacttatttctttatgaatgatattatgtttttcttctcctgaagttacaaaaataataacaaattcatttccatattatttacgcttataaacaacatatggcagattaagataaagattggaagcagaggggaagaggaggggatggaagaagaggggaagaggataggacggaagaagaggaggggattgggaggggggagtcaatgaatgctataatttagcaaatggaggcgggggggaagggaaatgtgtacgacgatcaaagagtgtgaaactgtccaatcacttaccctcccctttccccccgatacaattttgggcggaggggaggggaggcaaaattgtgacgataattaccccagcgagtgaaaaatggtaaggaggggggggggggtggcagaggacaagtaaattttgggattgtgaggaggggtttttttgtgccgtaattactataggaagggcacatattttttaaagtttttgatttttggacaggagggggggcaatattttttaccgataattacctatagccaacgatgaaagtggtagggagggagagggcggaaaggaaaatttcaagattgtgggaagggattttgcgtgccagggagtgccatttgtgtaaattgtcaattctcgactgcgggatggggtgggggtggaagatttgaacaatgggagggcggaaaggaaaatttcaggattgtgggaagggattttgcgtgccaaagagtgccatttgtgtaaattgtcaattctcgactgcgggatggggtgggagtggaagatttgaacaaaatttgtgggcatgctgtaataaccattacagcacggcgtcaatattgccgtatataaagcgccaccaaatcattcactatatcactccatccagctaatctctcaacaaatcttccactccgccccccatgaacatttacatagcctcttccatttcgtaggcctaatcaaatttatttttaaaattcattaaattatttcaaattttattcccccaattaaaaatatttcatgttttaattctcaaattaattagttatttcaaattttatttcccaaatcagtagtaatatgtagtatatggacaaaaattatttttaaattttatttcccaatttaaattcctttttaaattaatttaaataatttcaaatttattttcaaaaataaattaattatattatttaaacttatttattaaaatatttt

SEQ ID NO: 11746 - DNA, 1996 bp, Heterodera glycines
aatggctggtattaccatgtgagtgggggagagaaggccaaaaaacattaaattttataaataaaattaataaattaatgtgtaaaattaaacaaattcaaaaaatttgagacggaaaatgtttttattctttttttccatggttcaatttgtgccgatttccttttttattggtcataatcaggctaccattgaatttttcagaaatcggcatttggccaacaaaaaatcaacattttgaaaaattttatgaattgaaagattttctcaaaaattcattcctccaaaaaagaattatttttgcttaattggctgaaaattatgtcactatccgtcattatttcagactttttgtcactcttttggcattgttcctcactgttttagttaactatttcgagatttttcgtaacttaaagtagcattcccaacagggctgggcaactgagtttttaaattacggaaaccgttaatccgtaataacggcaattttctcaattacggaattccgtaatgacgggtgaaaaatgccgtaatttcccgtaattcgtaattacaggatccaaaaaggccgtaattttcgtaattacgcccagccctgatccctaatcatcattgaccccttgaaaagcaacaaaatgatgataaatcagcagagttgggagccatggtcataattaatgaattaatgttgaaaacataggacggaaaagtgacggattatggcaaaacgcggacgctgaccggcgcagaacgtgccaaactgaagaagttcatcgacgaaatgcagcagatgagcgtaaagttcgcgcaggaaatgcaacggatgttcagcgcgacttttccgttcggtccgcccgcggcgccgccgccgcaatttcatttaccaccgcaagtgcgtcgcataaatcagcagaggaaaagcaattggaaagagtgccgtttgttagcctaagcttaagaatacgaagtgccgatcattctcggcacggactctgaaaagatttctcacagatggtcctcccattatgcttaacacaacccaaaattctcctcttcttttaatcatttgtgggttgggattgacacattggccattgcactgaaaacatggaattaaaagccaaaaataaagtttaactcttctgcctgtctcctccttcgattaagaaaaacacggatatttttcttattttttcatagatttggcacccaaaaagtctatcaaatgggaatttttaaaccggcttaatccggcgctaaaagtcgaatgatatcaactgagatttggattacattgtttttttatataaaaatcattttggttaattaaatactggcaaaattatgccaactctcttttgtaaaaattttttaggccgttttaagctcttttcgtttaggtgccgtgcttctgctcatcgtcgtcgtgttcaaagtttagagaaaaggcaaatcggatgaaataaatgatggaggaaaatgaatgtgatttggcataataaaactggctactgtagatgggctttaccatatagccacatgtcctaatgatactgtagcttttatttattaggaaggatttatgtgtagaaaaaatgaataaaaaacaaacagaatatttattcaattttggcactttcaaaacttgttcaaattttgtgtcgtttctacgcagccaacaacacaaaagtacgtatgtacatattatgacttatgaaattactcaaaaaccatcaaattaaaaaaaattttcatataattttgctgaaaaacattcaaaatttttaattctatataacattcgatagccctaagttttttctattatcatgtaaaatttcaaaaagattcgttaagtttcaagaaagttatgaccaaaaatattcaaaaaacttttctcttttcttgtgttcgtctgctgaatattttgaatattaactaattgttttcaaattttaaaggctaatatatgtatatctataggatctatcgg

SEQ ID NO: 11747 - DNA, 2869 bp, Heterodera glycines
cctccaaatctttctctaaattttaattttaaaacgaaaaattcaaattttatttaataataattaatttgcatttcaatttattttaaaaaatttttcctcccattttatttgtggccgaccaaatttttgcgacatttcttcatctttttcttccatttttatctttttcctgttattttcctgaatattttcacttttcgtctcttttttgacaaaatttccaatgtttttgccaattattttttgttcaatttttaattttgcttcttccccatattcaatgggattcttttcctacatttttggttcaacattcattttttttacttctaatttcggccaattttgagtgccgttccctttttccaaaagtccgccatttttccaaagatcaccaaaaagatcctcagaaacggcacttactgttagattgaaaagaacagaaaaacaaaaacaataaaatatgtagacaattgacgacatatttggaataaaataaacgaggcattaagaagacaattaacacaaacaattaaattctttaaaaatttaaaagtattttaatttcctaaagctatgatttattttatgcacaaaaatggcaaatagcgcaaagaaaataacaataaaagtaaaaatttatatgaattcaatccatttaatcttcttttcgttagtgagaatagatcctttttctcaaatttaatcagttaaaatattacatttttgacaaaataaatttgtaaatgaatgacaaaggctagcatttgtaattttgcaaatttggattaactgaaaacgtcattattttacagagcactggaaagaatggaaatccgaataattgaaaatttgaacaaaatcgttgaattataaaattttgtccaaaaatttggacctcagaaaattatcgatttttctgataccagctgaaaatgttggtaccggtgccggtttttgcagtgtcggtcagtaccggccggtaccgatgaaagcgaaatttaccgatacctttctactctcatttaaataattgaaattttaaaattattaaggggattcatttttctaaattttctatttttcatttaattttctcctgacttactaaaagcacggaaaaagaagcaaatttgtataatttttaaaccactaaaatattcatttattcattcattaatttttgattatatcacaatttattcaaatatttgttatgcaattatttcttatttcaatgtaatcatttccaaataaacctttatacgaaatgtgaaagaaaatcccataaaatattttgaaagatatcaaataaattttgggaaatataaaatgagaaaatttccacaaaaataaatcacatataaaaacacaaacattctttaaaaaatgcgtttttattattcttgcatttttgtggttgttcttttgatggcattcgtcgacaaaggaattttggaaaaagttttaaattaaagaataaatattaaaaaataaaacaaaaaacattatatttgcgataaataaattttacaaataaaaattcaatttaaatggtgaataaaagaaatttgctgttcagagtctcaatgaaagcgatgcttcaaacgacacaaagacagaacaaaatgcgcaagaccgtggtaagaacaaatgaataaataaaaacatagttgataatttaaaaatatttaatttttatattaaaatttcttttttattttcagcagttttttcgctacaaaaaaaatctgaggacgaatttaccattagagctgccttttcctgaaaatgacgtgacgaaaaacgaaagatgaacgatcgaacgactgatggatcacagtgatcaacacattcttaagaaaattattggtgactttgaggaaactgataaaaatgttaataaaaaacgcaaaaatattttccaagtcctgtaaatcagattctgaaatttaaaaaaatgttttgaattttcaaaaagagtaatttaccctttaagaacaaaaaaaaacaaaattgagaatttgccgaactttgtcccttgttttttaaatttttatttacttattttcaacgcatttactaattgatgataacaattgtcgtcattacgggatgaatattatgcaatttgttgggacagtgtcacttcaatggtccctcttttcgcttcattttgttgccaatgaattgaaaatggacgggaatacattgatgaattggaagaaagcaatgaaaatttttaaaaaataaacaatcataaattggggaggagctgataataacatttttcaatgtaaaatttaatgcaaataaaataaatgtagcaaattaatggacaattatttaactcgccttaattcaaaatgttattatttttaattgtctttaattaacccaatttatttatatgatttcacaagaaatcaacaattactttatagatttattaataaggatttaaattgaaaatttttatgtttttggataccaaaagtttccggtgattggtgaatgttatttttagttttgctgcttgacttattgccccaaaaaaagatacccacgaacaaatttatgatcagcaagtgactaaaatattatgatcaaaatattaaaaaaatataaagaaacatacccataattaaaaatgctaattaaaattaattaaaaattgtattgaaaagagaattaaatgttatggaaaaaaattaatattatgttttatgtgtataattcgaatatgcatcaaaaaacaaattttcgtgattttttgattatttttgctacccactaataatcgttaaattatttggtcttacatcttttcgcattgctaattttcctttttaatttccaaaatttg

SEQ ID NO: 11748 - DNA, 2616 bp, Heterodera glycines
  misc_feature (1151)..(1152): n is a, c, g, or t
atttagtgcatgtgaatcgattttggtcaatacctatgaataatggtgaaaaattaattttcgacttttgttcgaattcgggttgggggttagaaataggtcgaaatggatgtcatattcgtgatcagcgcccccgaaaacccccgagtactattcagaatcacataaaaccctttatttattttatttttttagggaccaataaagtacatgattaccaaaggagcggtccggtggtgccggtaagcgccgccgggaaaatttttgaaaattacttctgatttgtgaacagatttgattaagaaaatgaccaaattttgtgattttagccaatatatttacagaatttctaccaaaaatgttcaaattttcaagaaattcgggttaaattttcaaaatttcttatgggaatattgtaaaaaattaagaaatttcttgtaaaattctatgaaagtaagaatagtttttttattttatttaaaaacttttaagctttatttacttagtaataaaatggcaattttcaacaaaaatttaaataattttttgtcattttacaccccttaatttgagattttttagtgtctatttttgggcttttttagcctaaaagtttataaagttcaaaattgcacagaacaaggaaagagagtacctatttatttactgacgaatattatacatactgtacatataaaaacatacattccattgtacaaatacatacgcataatcgaacaatgggatacaaatatgatcacaacaaatgacatcgtatggtgatcacaacacatggcatcttacagcggttgacgacgctcactgcgcggtatggtgcggacgaagttgtagcggcacacggggcaattggtatggtagcggagccagcggtacaagcagcgatgatggaacggatgggtgcagccgagcgtcgtccgcgtgatgtcgcccacgtttctcatgcagatggcacatcgctcgccccgctgcgcttttcttgtctgaaattaagaaaattccattttttggggagggggtttgttcaacttacgtatcctgcgcgtccaactgccgccctcctccgcttggcatcgcgcagcttcgccttggcactccgggccctcgccgcgtttgctggagtggtcatgctnngaaaaattgaaattaaaacaaataagtaaaacaaatgactaaaatctaccgggttgtgatatgtgtgacgttatgggcgacgcttttgagaatggaacagtcggagaagaagaaattgagattgactgaggaattccttttgttattttctatatttaaatgaaaatggtagcaacaaaaagttttaagtttagaaattgtaactcaaaaatgaaaattgagtataaataatcggatccatcgatcccacggtgagtcaccgtcggtgtcgttttaaaaaaagttaaaacgaatcgccaatctaatgtcagattcgagattagcgtccttgaaaactccaagtttcctgttttccgaaaataacaaaagaaaacatgggagccccccccccccattttgccagatttaaattctaaattttgtcagaaaggataccctttaaataaaatatcaagaaatggaaatgctgatatgaacaacttaaaaaattaaatagattttaggatgcaagtatcttaagaattgaaatgctttcattgtacactatgctcgagttttccctgttggtgctgaacggcattgcaattataaaccgtgaacgagttttgaacaaggttaacaaacatattgctgttttttatccaatcgttttccccttatttgaagtatttgaagaatcggcagcacagtttcggagcagaaagtgagcaatcggttgtgtttaggctcgtcaatttaattcttgcagttcaaaccgtccttagaggttccgtttaattaacttttttgcttttttattaaaagtttgacccttttagtgcctctcatcgtcatgaatattattgttatcatcataaagctgttgtttggatgaaaatatgccttggccataatcacatatttatttccagtttatttgttccttctgttgtcattaaattttttcattttgcttatctgactgataaatctcttccgaattttcaacataccaacgaagtatgttttattcatttaaaccagggctgccatccgtccttgaatggcaaggacgtccttgaaattgggtcctctttcttgaaaataaaaaatgtcctgtatgcaagaacgtccttgaaaatgagcatttggaaaagtttaaaaaaatcaaagaaatttgagaaatctttgtaattttcaacaatattttgattaaattatggcattatgtcatttaaaaatggaatttttgaaattttatggcattaagtcactagtcactatttttcttaaaaaattagccaaaaatcgcaaattttggtcatttttggacaaaaatctgtaaacaactcgcattaaaaattacaaatttttccggaccccctatcctcaaaaaaattttttaaaaagcgcgccgtaaaaaaacccattttataaacaaaaaaagtcgtcgcatggcttaaaatcgcaaaaatagactctaga

SEQ ID NO: 11749 - DNA, 2003 bp, Heterodera glycines
ccaaaaatttgcaattatctaggcacatatgccatagtttaagaggcgcaaaaatccgaaaatgtccttaggtatagacaaatctgcttggcaagctctattaatttgcaaaacatggtacaaaaaatatgccaaaaaatcagttgagaattttccgctgtttatattcgaatcttcgggaaggattttcagaattcagaagcacttactaattaatccctccccgtttgcggatgggttgaaaaaaaggcagctttatttttgctatttcagtaaaatcccattaaaaatttcaattcccatcacaaattgtcactaatgatgaaaattttaggtttttacctattttttcctgagctccctatggtctgaatgcacgaaaaacatgtttttttggggcggggggggggggttgttaggttacttttcgagttatttgcacctatttttagttttaatttttagaacttaaaaatcctaaaaaaaattaaaaacctattttaactatttggtattttgccaaaattattaacaaaaatgcaataaaaacgaaaaatataccccctaagaatcgaacccaaaaatttcaggaaaatacaccctacaccccaaagaaaagaaaattttccccaaaaattcgtctcaagaattttaattatttattttcttgacaaacgtttgactttaaaaaattatgtaactcaatattgatttggcttaattttgttgattttttgataaaattttacaattttacacccctaatttagaatagaacttactgacgcagaacaacaggtgaaaggcacttcgaccagcaacgatttgaacgttgcttcgagcgatgatgaataaaattgtgagtctgttcaattcaaaggtggcaaaacaaactgaggagcgctttgtcttttgcacaaggtgttaatagtttttttgtttcattattttcaggcttccgattaatcaaaaacagaaaatatggtagctgattcaggtgcgaacaacgcaattgaccagctacagccaaattgggcgacaacaatttgatgaccggcattttgggcccaaaagaacatcaccatggttgagcttcatcgctttatgatgctgagacgaaacgaaatcagattaagcgcctgatcaaggagaagccaaaaaagaaaccatgtcaactccgcgcacaaaattcggactgacggtcttcgaattgctcggcaccatgaagcgctcgaccaaatggcgaattcgttggtggtgtcaactgttacccatacctatgttcttttctaattcagtttaattttagctgttgtcagtgctagaacagaatgtcctctacagtttccgatctcgttttggaatgtgcaccccagggctcaaatgatcacatccgtggaaataaagaaagtgatgaaggaactgatgatgccaatggaaattgaattttaccattttcaacattttatttttattttttctttggaatttaataaatatctatttgcttacatgtacttttaggttaaatttaattattattatataagaatagctaaatatgaaccaatttagaatatatatggtcaaattcgttgtcaaaatatatatattttgggttagtaggcgaaatgaatgtttttgggttagcaggcgaaatgtcagtaggcgaaatgtcggtaggcgagatgtcgagtaggcgaaatgtccgtacaccaccgagtccactcaagcttttatcagttggtagaaaaattacaaaaaccaacaaagacatccatcgtaccagaaaaagtgttttccctagttttacggtattcgaatccaacaaatacaattcgcagaactttttgacttcttttttcaaagaagttcataaattttatcggtaaaagtgtaccgggtattggattttcaaaaaaccggggtcgggtccgggtattaaaaaaaaccgggtatccgggtctgaggcctggtcgggtacacggacccggccaacccta

SEQ ID NO: 11750 - DNA, 2333 bp, Heterodera glycines
  misc_feature (9)..(9): n is a, c, g, or t
  misc_feature (2308)..(2308): n is a, c, g, or t
gacgcacanttattgtgtcacacgaaagtcacaaaacacattttaatgttttatcaaaagcatgacacacattagtgtctcacacgaaagtcacagaacaaaccactaatgctttcaaattactaattcaagcacttacgcaagctgagtgccacatggtgtggctttgagctcttccagagtcgtaagcatggcaacaggctggcaccagatttgaaaaagcctaaccggtagaaaaaatgagccgtagcggcagaaaaacaacgataaattgtttagtcaccagatttttgaccaaactggtagaaaaaatgagccatcggcagaaaaacaattctctaattgtttaacaattctaaaataaaacaaaaattaaagtaatatatgaaataatgtgtatacaacaaaaataaatactttttctaaccaatacataaccataaaattttacgacaaacagactttgaatttaaaaaaataagcaatattaaacctttaaattaaacaatgaaagacaaaaacaaaaaattaaaatgatgaatggaggtgtggacgattttggcgttatatttgaacatacacaaaaaagcgaataaatgactaagaatgttttttgcaaaacaaaatgaaaaatcaaacatttccatttttcaaatcattttttaacgcaaaaaaaaacaaacattttcatttttcaaatgcttttttaacgcaaaacaaaacaaaaacattttcattttcaaatcattttttaacgcaaaataataacaaaacgccacacaaattcaaaaatccgtacatacatacagacactcaactttattatgtaggattgaatgaaattgttattttctgcttttgagcacaaaaagaaatatttgtggagcacttttgatgatttatttttcaatttaaagaagaaaaaaattttgcgtgcactcggactcgaaccaaagattcgctcaactagggcggcagcagtaacaactgcgccatttgcacgacattttgactccattccaattctttccttattgttctttttttaaaaataataattttttctttaacacctgcttaccagggtggcacggaattctcgaatttttttgaaaaattaattgccacaattttttaaattatttaaaacaaacaaaaaaataattgcataaagatttgaaaataatttcgtgcccatttttttaatggaaattaaaaaaaaacttgaaaaactaaattcaattttggttgcaaattaagacaattgaaaaaatatggactccaaatttttggaaattttttatttttcgggtcttttcggactacggtagagtataaaaaattttaaaaaagattgaaaattttggaatctggaaatttgaaagggtaacaacggtgactggaatttttccaaatattttttgtctaatttggaacccacaaattaaatttatagtggggattactcaaattcagtttagaatttaggctttaataaattcagacatttggcggttaacaaattcaattggtgaataaccttacgcatatttgaatagaaaaattaggcggaataaaaaaataaatgatggtagtgacagtaatgatgagaagcatgctctaaaatttttataaaattattatttgataaaaatgggaagcgctgagtaaaccatgaaaaagacattatgttattattttaataaagagaaagagactgaaaaatatttaatatatatttaaacataacattgattatatagaaaataaaattaataatttatcgggaataaggaaagcccagaaaaatgaatgaaaattagaattttaaaaaatcaatgtttactgcttataatgctttaaaaaaattaatgttatccagtgttttaaaaaaatcaatgctttttttcaaatttagcaatttgtatagttttttattaagcaaattttttcaaaaacccaatttttcctcattaactctgacattttcggaatgaaaaataatcaaagttcgcttttaaatgtgtaataaatccgagaccaaactgggaatcccttctgcttatcacatattcataacttttatacatttgtattttgcgcacattaattaaatactataaaagctgatcaatgctatttttggggaattatcatacgcactaaaagcgatgattactataataatttttaaatgaaataaatcttatattataattataattaaacactaacacttttaaaaaatatatttgtaatgaaaaccattttaatgaaatagaaaaatgttaccaaggaattttgccanaataataaaattgatcttttttttt

SEQ ID NO: 11751 - DNA, 2101 bp, Heterodera glycines
ttcgtcttgaagtgccgaaaattcatcgcccaaaacccgtgacttccggatctttctgattgattttttaattttttctaataacgcatcgattgacagctttttaatcccatcccacacacactaaattaagaaaagataatcatgaaatttttgattaatcaaaataaccaagttaaaattatgggcagtgcaatgcagtgattcaaaaccagcaatacgagtcgctttttgcattgcactttcgttgtcacgaacaataaggtgcactttttcagcgttcacaccataatcattaagaacttggctcagcaaaccacacattttttcgccagtatgactgccctaaatgtctgcaaaatttttaagtaaaaaccccttaaccgaaccttaattggcttccatcacgcgaaaagtcggttccatattactgccaatgtaatgaactgtgacacttaataacgaatgttttccttcgtgagaactccagccatcgattgtaagagaaatgaagtctgttttccgaatgtcctcttttacgcgagcttcacattcacatacaaattcctcaggacatcacttgtaaaatgccgacgacttctaaaattttaaagatttaaagaccatttttgttttagaccttattttgtacattggagctaaaattgacaataaatttttcaaggcttggtcttcaacaaaagagagagacaatgatgccgaacaaataagtgccattactgcgtcatcaaccctttttgtcatttctccatccgaactccattgtgcttaatcgactttgaaattttaaaatatccaaataattacaaaagcttttgacgatttttggctgtgaagaagagaacggcgactcatttcttggcattttggcaggtgttgggctcaagcacaagcgaccagtacttgtacttgccaacaaaagactttgaattgattgttggccatttggtttcacttttgctttttcctcttccttcaacaattcttcatatttgtccggatgatgtcgctgcaaatgttctcgtagacacgtcttcggaaaagttgtagactttgagccgtaagaataactacagctcaaacatttcgctgttccatgagaaattttaaaatatttaatatatttgctttgtggtggcattttcaagctaaaaatgtaaaatgtgttaaaaatcatttaaaaagagatatacaatatgtagaatataaaataggtaatattgaagaaatatttaatttataaaattcataaacattatcaccattactcacattaagatcaataattaggggagtatttttacttcgaaaactcaatctttaggggtgcatttttcccgaaacttcgagcattttcacgaagctcgaagcacgaaagcacgaagctcgaagtttcgcccgtccctgatcggcaccgcccgaccctctcccctcgctccttccccaaaaatttgaaaattattaaaaaaaaagactcaaataacttaaaaaaacaattcgttttttgtccaaaaatgaccaaatttaaaaatgcggttcttatagttttgtcatccgctgaagacagagactttatcgattgcccaccaaattgtgacctttttccctccctcattcattaattaattgcattttggatgctcactttcgtattgcttttctgcgcctcctcggataaaaaaatattttttgtcttcaataaataaaatatttaacagattttattgtattcctataaattttaatatttgtgaaaatatcaatatatgttatattaactaattatattgtctaatgtacaacccctttaagttcaataatttcttgaatcataaatcagggcttcgatttgttcttatttctaagaaatgttctgatttggagtgtccaaatcttagaaaatgaaaatgttcttatttctaagaaatgttctgattttgggttattgttcttattttgttcttatttcttaaaattattcaaaaattttgaaattttatggcgaaatgtcactatgtatcaagaaaaaatataatatttgtgtcaaaatttggtaatttttgacaaaaatccgttgaca

SEQ ID NO: 11752 - DNA, 3542 bp, Heterodera glycines
agtaaacttttcatagataaataagaaaatatccatccgctcctattcagcatctatatacctattgaatataacattctaatcataacaaattttaattacttaacctaatactctattagaataactaggtgtgtaaaaaaaccgcaaaaaaaaatatatttatatattctatttgtttttattgtgatgcttttcaacaaaggaaaaaaaagataaagcagaataataatacaatttttaaagttatttttaatatttaaacaaagaattaaggtttaaatcctttttaattttagccatcccagaattgatcaaaaatatggagtatagcattcaatagtcacgctttacgcacctgaggcagaggcaactgctcaaaatttgaatatataaatcttaataagaattatattttatattaaaagatagattgttgtagatattgttatttaaatatattttatataaattatagttaaatagcaagagaaaataaaaaacttttctgttggtttatttaaaataaaaattcatataaaattaaaaatataaaatttcaatcaattatatttgcaattctcctttaaagaaattaaataaaataaattaaaaatttgttcattataaatagggctcacatttataggcactaaaaaccgccaaaataggtaggctttaggctataaaaaaacccccaaaataggcactaaaaaatggaaaataggcactaaaaaaactcatttttaggtgtgtgaaatgacaaaaaattattcaaaaaagtaaaaaaattaggccaagacagtattgagattaatagttttttaaagcataaattcttgtcaagaaaataaataaatacattttggagatgaatttttggaaaatttttcatttcttagggagtttattttttaaatgattataaaacaaaatagtattaagaaaatcttttcttttttgagtaagaaaaagtaaaatatataaacccggaaataaatttttaaataaactcatatagtaaataaattcagcagattataaccatgttaaaagtgattgctggaagatgtatgatagcatttgattgctaactgaaataaattttaagtgctttcagaaaaattaaaatttaacaaaaataaataaatttttattcttctttacatcttaattgatcaataaaaagtttatcgacacctaaaattatttatttaaaaacacattatttatttaagatttcatgtgttattataaataaataatgttaaagcaaatattaacaaagagataatccaaaagcaaaaaaatgaaataagagaatgctcctattgtacaatatattaatgtttctattgttaagatgataattgaaaataatacatagatcctttatataaggatttttatttatttttatagattttgttttggtaaagggaacataaaaacaaaaggactgggtagatttccgaacgggattcccgccttttttcgtttccctaaaatcacataaattttaacgagaatccagccggtaaacattaaaattgtacgaaagtttttttagtttgatttcaagcagatattataatattagacatctttaatttttcaatataatatctggtaaaaaattaattatttttatacttatttacaagcttgctcatatgcttcggccactttcgtagacagaaattatctaatattttaattttggcttttcttttttaattattatataaactgaatcattaacattttgttaaattaatttttgtatttctttttatatctttacagtttttattatggatatttttcgatttttttttatatttatttattttataatacatatgccatttattagagctatttcgaaagttcatttgacagatttgattttaatggatgttattataattaaacttttaagtataaatatttttgtttttttttgtatgtaattttaaatgaaatcactagtaaatatttctcacatcataatagtgtaataataggagttaattatttaattctttaatcaaaagttttttatatttttaatttggagttaataagatataaataaatgaaattgacttatattttgatatgatcattctttttcttggctcaatatttctactttaatttttgctgtgcgaagttttgatttatttgattaatttcatgacaaattttagttaaaaattcaattaattcgcaataaatatatattaatttggtgttaattatctaaaatatgtgaatttaattatcaataccaaatttgatttgctttgaaagatttttaattaaattatatattttaatttaattttgctttaatcttactttaaaataaacaataaaaaaggataattgtataatatttcacctaaaaaaaattaattaaaattattaaattgtttgttaattttttgttaatattcccggttgttcccggaccttgatcaagatttaattttttatataataatccctgaaagccgttcttataatttaagttctatttattatattgcatattttattttaataaacctatgtcattatgtaattaaattttttataattccatcaaattattcattgacactttttaagaaagttaaattatttaattttgaaaaaacatttggttttttattttacataacattgtatcagcaaattaacattgtttgggttttttcaaaatttacattatctatttttgattatataaattataaattttttgaaattagatggattatatttttacatttctacaagaaaaacataattgacagtggtgggtaatttgcgttactaagttcatattggtaaatttaaaatttaatttttccaatataattaaacatgcagtgaattgagtattcatttagtttttaagttatatgttttcaatgattatgcttgcattttataatttatattttgtatgtacaataatcaaatatgagtgaaataacactatgttatctgaacaataaatattaattagtttatgcgtagtgttttgtatttatgttctttttaatttatctgcatattaaaagtcaatgaagtgatgggctgcaattttaccatttattataaaaaatttttaaaattgttcaaaagggagtagcaaccggtatacactacaaattagcacatttttttaatgttagatttattttgtatagtggaagataatgacatctagtagagctattttaaatatttcgggtgttattggcttggtgaaaaatttgtaaattttttattagattttcagggacgagagaacgaacggaaaaaaaatctataaatataaaaattataacaatttttaacaaatttttaggcaaagtaggaagaagtaattatatataattattttaaatattatttctttttaactttttgaaatgtaagactttaatttattttaatgattttcttgaaagcatttaatcaaaataatttaattttgctttatatatgaatttattcatcaatat

SEQ ID NO: 11753 - DNA, 3652 bp, Heterodera glycines
  misc_feature (54)..(54): n is a, c, g, or t
  misc_feature (57)..(57): n is a, c, g, or t
  misc_feature (60)..(60): n is a, c, g, or t
aattctttatttatatttttcaatttcttatatttttcctttatctcaattaantgntanctcaattgcctcctcgtaggcacaatttttttctattgactgttggatccttttcttacatatttttattacatttttttcttaattaattggtcgtttttggtttttttttaatggccaacaattttctctccgttcgtcgctttttgcattgctgccctccactacgaaatgttgtcaatggcagatggacgacaacgcattacacacagaggccgagagaaaaggacggaagggtggggacgtaaattaaaaatatacccatggatatgtatttccagtggaaatgcgtggacatggctcgtgtggaggacgagttcgacgtggtcattgtgggcggtggccccgctggactgtccgccgccattcgcctcaaacaattggcggcggagaaggcaaaaggtgagtgaaaaggccaatttcaaatgtaattcgagtctatgtctcaaagaattgcgcgtttgcttggttgaaaaagcacccgaaatcggtgcccatacgctctccggtgccatcattgagaccggcggattggaccgtctttttcccaattggcgagaactcgactcgcccatcaaacagccggtgaaggtcggtttatcaagtgattaaaaattaaatttaaaaaaacagtcaattcgcagaaagacgcattcgcaattctcaccaaaaatggacgaattccggtcccattggtatttgttttgctgcatttaatttcattttgtaaaatgttacactaatttgtataaatgaaaggtccccggcgtcccgctgaacaaccatggcaattacattgtccgccttggtcatttggtgcggtggttgggcgaacgtgcggaggagcacggggtcgagctgtactcgggcattgctgcgcaggaagtgctttttgacgaggctgggaaaacggtgtgcggagttgcgacgggcgatgttggaattcacaaggacggaagcccaaaggttggtaagggaatcatcaaagtttaaaaagaaagtacaaacataaaacaaaacaggagagctttgaacgcggcatggaactcaaagcaaagtgacttttgttcatttactttattatttctaatgaaattccaccgaaagggaaggaagtggatgcattttttagatttcgaaaaaattagaactccgtaatcatcataaaaattttgaaaagcgcaaaaataatttttttttttttttttgggaggaacgaactgctccggaagaaagtattccattttctctccataaacataacttcgctttcaatactttcccattctcgacagatgcacaatttttgctgagggctgtcgtggccatctgacaaagtcagtcattgaaaaattcggcctcagtgagggcagagacccgatgacttttggaattgggctgaaagagctgtgggaaattgacccgtcaaagcatcggccgggctttgccgagcacaccgttggatggccattggtgggcaaacggagggcaaaaaatgagtgaataatcaaaagtgcccaattagccgagggatcagtacggcggatcattcctttaccatttggaggacaacggacagccgctggtctccgtcggatttattgtgcgtttaaaggcttacaattaaacgaatcccttccttttcttcaggttgctctcgactacaaaaaccctttccttaatcctttcaaggcattttcataattaattacaatttaaaaattttctcccattagaccttccaaatgttcaaaacgcatccgtccattcgaaaacaattggaggacgggcggaggatagggtacggggcccgggcactcaatgagggcggcttccaatcggtgccgaaagtggtcttccccgggggctgtctggtgggctgcagcgcgtctcttttggttttaattctttttttgtaattttatttgctttacttggttagaatgttgccaaaatcaaaggcacacacaacgcaatgctcagcggatgcattgcggctgaaagcattttcgaacaattgcaaacggagggcgaaaaagcgcaaagtgcataataaagccgaaatttttttaataatctataattttatttcagcaattactccgcttaattatgccaccgctttggatgactccccggtgatgaaagagttgcagatgtgccgcaatgttcggccgtcgttcaattcgcgcctcggcttttggggtggcatggcgtacactggcactttcttcgtcatgggtttgtgtataaacatttcattgttataatttggtttttcagggcgtggcattgagccatggacaatgcaccatggacacccggacaatgagaagacggagctgaaggagaagcactcagaaatcgaatatccgaagccggacggggcattgacattcgatttgctttcatcggtccatttgaccggtaaaatccatgacttttcaatacggtggttccttccattcttcgttctttccaggcaccaaccatgaagaggatcagcccgcccatttgacgttgaaagatgactccattccggagacggtcaatttggcactgtacgccggcccagagagtcgttactgtccagcggcagtgtacgaattcgtgccgaaggaggagggctcggcagtgagtgcgcagcaacggttgcaaatcaacgcacaggtggcaaaagcaaattggcaatgctaaacagctgacaaatgggtgccatccctctcttaagaattgcatccattgcaaaacgtgtgacatcaaagacccgctgcaaaacatcaattgggtggccccggagggcggcggagggccaaagtacgacggaatgtgaacagattgggcaaaagaagaaactggtggagggatttgatggaaagaggagattgtttgtgtgccacaaccaaccagcagattctgtgcattagtttttgtcctttcatgtaaatcctcaaaccaatcgtgatgttcttaaactttctccagggctgagccaaattcgaaaaataagcagaaaaaatttgcacagccctgccaccttctgtgtttcttccaatcctttcatggtatattagactaagtgtcatcattagggcttccatttttaggcacaaaaaatcgcactaggcattaaataggcacaaaaataggcaaatacaattttttattaacgctttttaggtaacaaagcacgttaaaactttaaatatttcaattgtaaatgaaattattaaatgttttaaagttttttcgaatatgaacaaatttttaaaccaaaagatttttattaagaaataaatattaaattttgggataatttttttgaaaaattttagcacaaaaaccccgaaataggcaaaaataggcggttatagtcggttttatgcgtcccatgaatgaccatacccagtttcttagaccataacttttttattacttggtcaatacctatattcttggtattaaactaaagcttaaggtctatggaagcttttgtataagtttatttttgataaaggcaatagacaaaaaattatactcggaaaagttgaatttcgtatttttttcattgtaatttcttttttaatgccaa

SEQ ID NO: 11754 - DNA, 5920 bp, Heterodera glycines
aaatttagattttttaagaatattttctaaagaaaattttttttgaagcgaaattaattgcaaaattttacaaaggatcagttaaatattcaattttttttggcggttttttatcctcttaaaaaattggctcaaaatcgtaattttgtcatttttgaacaaaatcgtttaagaatcacattaaatattacaaaaatatttcagacggcgcctattagagcaggggtgtatttgttcttattttctaagaaatgttctgatttggggtagtgctatattttcatttaaaagaggaaatttctgaaaaatttggctaattcctaccaaaattcattaaaattcttaaaattttcccccagcggcgcttatcgactcctccggcccgccaaaactcgtatttttttttagtaaaattagcccaagatcgcaaattttggacattttttggtcagatcttgtaaaaagatagcattaaattttaaaaaaaataaaattggtagttttagaatctcactaataatcctatttattaaaaagaataaaaattaaaaaaaaattaatacaataagaaaaaataatataatcaaaccaaactatttttgcaaataaacataataaaaaaattttatatctgaaaaagtttgaaaaatgacaaaaagtttgtgtatacaatagtacaaacgaataattgtataaggaatataattctaaaacccttactagaatttactagctaaaatggcaaaatatgcatgaaatatatgcatacaaatccaaaatatgcaaataaaagtcccgatttttatacgcaaacacaaaaaagaaagtattttcctactatttatagcatggagaagctaggaaaaaattatgcatttgcatattttttgcatccctgacaattattcattttgaagagaataccaaaaaggaaaattattgagtcaaaaaattttcctaaaattaaattttcgagtcccaaatattttcaaaaaattaatttttagcacttaaaatatttttttgtttttttcctccgccgtctattactacaaaaaacttttagaacatttaaaaacaaaattctctgttttgccgttgtcgcgcaaaactacataacgccaaaacgcattaaaaatgaaatttgaaaatttgcccgagggcaccgcttttttgctcctcttgctggaggcggaggacccgtcactgaaactcaagtccattcaggtgctgaaggtgagaaccacacaatttattatgaacaatacatacacacggcacgccaccagtaggttttctctgctgtttgatcggaatggcatttttgaaatggagccgaaaatttaagaaaaaattcatttttaaaattttgtgtcatcggtgatcgaccgatcattttggtgtgcgtggcttaatgatctctgatcagagtttttgctcttagcattttgacacgctgatcaaaaatccagtaggtgaacctgatcagattacacattatctgagagttaattgtttcaatttttggtggtaagggctcggtaaaaaaacggccatgcaaactgatcagatcagcaggtcatcatgatttagcttttctaaattggtcagaccagaacgatcaaatccatctgcttttgattgatttggccggttaaagctgaaaaaatttgatcaatgcaattatttcagttccgatcagctataatcgccaattttcttaggtcactatttctgtcataaaaatgctcaaaaaataataatttttgatttaaattcgaaacatttccaatttttggctccatttcacatgcttttcctctgcttttgattcgtttttcctccgttttttatgcttttgcactattatttatttaattttattttcaattattattattattttttctttttctttttatgttttgtgactttttccatttgacaacaacactaataaaatttaaccaattttgtggtgtcaaatatgaattgaaagaaaattaatttaattttttttgtcaagaaatgtttgtactgaaaatttcttttgacacaaaattaaaaaaaaaatatttttttccatcaaaaaattttcaaatttctaattcatttaaaaatttatttaaaaaattccaaaattttaaatctttgacaacaaaatgtgaaattcctttcactccctcaaaaaaaaaaatagttggattttgccgagagtttcaaaatcacaaatttttatttgaaatttttttaatttcaaaatttgaaattccaaacttacaaatttttgataacaaaaaatgagaaattcctttttcacattttgaaagtgtgtgacttttgttttatcgtcgtcatccattgcatttttcattgtttatttaacaaaaattaattttttatttgcaattttcgccgccgccaaacaaaaaattgataaaattttgatttttgataaaataacggtccaataaaatcactcataaaagccctcagttttgtgctgctcactaatgaattcaattcacacacacacgcacaaacattaacattaacattaacttatataatttataacattttgccccaaattaattaattaattaattggctgttgaaattttatttattttttgctttttttttgttttgcccttttttgagattatttaaatttaaatttttttcagacaatggccaccaaacggacggcgttggcaactgcagccaaaacgacggtgcaagaccaaaatttggtgggcatttttgtaaaaatttattgtatttttaaattatttttattgaaaattacttttattgaaaattacttttattgtttttttttgagtaatttgctggtaatttctctgagttagaacaatatgatcaaatctgaacaaaatgtaatcatttccaaatagatttgattaggttaggtttaaaaagataaaggattgattaaatctatcaatgcgtcatgacgccatgcaataatttgatcaaacctaaaagaacagaacagacattgaattgatttgtgagtcattctttgatcaaaagagcagattagatcatcaaaacagcatgggtttatattattccgggcacaatttgatcaaatctaaaggacagaacggacaattttgaatatgatgagatttgaacaaattgggctgatcaagtgatgaaaatcgtcatgggtttatgtgatcggaatgtcctggcacaatttgatcaaatctcaaggacagaacagacaatttgaataagattagagggtctgtgattcactctgtttaatcatttgaacagctagctcaaatcagcaggagatggatgtccttatctatttttttgaatcaaggacaaaaaaaaaaccattgtccgaaatgaaggacatcatttttggaattattgaattatgaagaaaataaaaatacataaaaatattttaataattatttgaatttatttaatccagaaacaactcgtctacagaaagtgccttcaagcactgatctatccgatcagtgccacaacaccgcacaatttttgcacaacaaattttcaggtaagaatggcgccgagtggggtccaacttttggcatatatatatttttttttctaattttggcatatttttttttctaattttggcattaaatatttttatttttggcaattttttcagactcccacctggtgctatgagtgtgaaggccttttgtggggcttggccagacaaggtgggcaataaattttttcaatttgtacaataaaatcacactaccaaatgcctcggcaaaatttgttttcgttttggcattagattttttaatttttgtaaatttgtataaaaactacaaaatttcctcgagaaaagtgaggggagctaatgaatttttaagaaaacaaatcagatagaaaaatctatataccgtttttctagttagaattttctcggtttttgatttggttttggcattgcgttttttaatttttttttttgtttcgagctcatttctcgattctctttcagtaaaaatcatttctcacatatatttttttaaataaatgatttttttattttacattttgaggtaattaaatttaaaaaattcaaaaaatgtaagccatgcatagataatttttaatttaattgaatttatttaaaataagatattttttaccattttttgccaggccttcgctgttctgagtgcggcgtaaaagtgcatgaaaagtgccgagaattgctcagtgccgactgtctacaaagtgaaatatttttttaaagaactgatcggataacattaaaattttcaaggggctgccgagaaaagcaataagcatggggaaggtgatcgggcacagaatctgatcgcagtgatccgcgatcggatgaaggcccaggagcgcaacaagccggaagtgttccgccgcattgcggacgcgttcaccatggatgacagaacgcagcaggaggtggggccaaacgggggagggtcaaatagagtactggaaaagtactggaaaataaaaatttccgaaaattagacagttggaacttggaaaatcctgctaaataagccaatgttagcctggaaaatgttttcaaaaaaaaaaccaaaaaattgaaggaaattttgaagaaacatgcaccatttttttggctgaactaaatccagcaggaaagaatgccaattggcaatatatgtgtataataaatagggagcagcaggtcttgaaaaaaaaaactttgaaaatattattaatttaatttatttatttcataaataatttttaaaatattttttatttttcaggctcttcgtgtcgtcaaaaactcaattttggagggcagttcaaaatggagtgccaaaattcagctgacaggtggcatatttatgtgttaaatttggagggctgctcgtaatttcctttctcgattctcgagtcatgaaattccttgggtttttcattgtcttggcggtggcggcttcaaccggcttcaactggaaaccggcacggtacgggatcccgcgcgagattttgcgggatcccagtccgcaatccagcattttttttttttgaatttgcgggattaatcccgcggggtctcgtctcgcaaaaagcaatttgaataaattaatttcaattttaattgccagtgatttgtgccaaagggctgagcggcaaagacaaaacgggcaaaagtgatccgtacgtgacggcacaggtgggcaaagtgcgcaagcggacgcgcaccattcaccaggagctgaacccggtgtggaacgagaagttcacattgtgagtgagcattgagtgcattcaaattgattttaaatgaaatattgcttgttttaattttatttttcaattttcaatttatttattttaagaatttcatcataaatgagttaaatttttattatattaaaattgaaaaattatttctttgctaattaattgaaagaaaaaatttatttgttattcagaagttacaaaaatatgaaaaaataaataaacatttttaaaataaataaaaacaaaaaattaaatatttatttattttatttattaattacacttttttatttatttgttatttactatttttattttattagttgcatattcaatttttgaacacattttctatttaatattaaaataataatttatacttttcccgcatttaaatttacgtcgccgctttggtcaaaaaaaaaaaacttttgcagcgaatgccataataccaccgatcggatcaaagtgcgcgtgtgggacgaggacaacgatttgaagagcaaactgaggcaaaagctgacccgcgaatcggacgactttcttggccagacaatcatcgaagtgcgcactctgtccggcgagatggacgtgtggtacaatttgggta

SEQ ID NO: 11755 - DNA, 4399 bp, Heterodera glycines
cttatcttcagaattgggcttattttcaatgaaaacatctggtggacaaaaaatgttggtgattatgtcaaactttggagagacaatgctgagaaatgccaatgaggtgtcaattgatggcacatttgacaaagtcccgaggggatttaaccaattatatacgcttgcagttataattgatcggtaaaaaatacagaataatcgttataatttttaaaaatagatgctattcctgctgtatttggaatactcccagcaaaatctcatgcagtttacaatgcgttttttggttccattcgtcaagccgtcccacaatttgatcccaatgtcgtgatttctgattttgagtcatccgcgctaacgacttttggtgcaattttcccacgttgtattcgagcgggatgcgtctggcattttggagaagcaatttcaaggaatttgcgacaacaaacgaatatgcgacgaatttgggacattggcattgaacaatgcaatgcaaatgaaagagatgaaaaattgcgtttaaagtaaaacaaaatttctttctgtaattaattatttttctaggtcattcaaagcaattccttttgtgccaattgaatcggtttacagttacttttgtgttttagtagccagcttccagcctaatgacgaaatttttggtaggaaaaaggggttttaaattaagggaaaatctgttaagaatttatgcaatattatgtacggacatggtttggtggtgattttataatggcacaaccaccaattcaactgcaccaaaaccctgagattaacaacggacgcggtgttgaccaatggattaggggatggattaacaatgccggtcttgcgcatcgccgtgctttatttgctcctagattgtggaatgtttctgatcggctccaaaataacataagcaggacaaataacagcatagaggcttggcatttgcagtggaattcgaaatttcgagaagattcgcctcgtttaagcagagtgatcagagcaattattgatgaaaataatatttttcataatatggttgatgaatatatggctgcgcctatacaggggataaggggccgtggtttggatcgccgagcagcgaacattcagcaagacgaaaatttgttggctatcttcaatacacgacttgaacgtgagccgctcgattatttgcgcacaattagctatcacttaccgtattaactttttttacaaattcaacttttcaaaattaaattaagaaaaatattttcgattttttaaaaaattgcttcctggtgcccaaacttcccggtgcccaaacttctggtgcccaaacttcctggtgcccaaacttcccggtgcccaaacttcatgtcgccaaaaaacatataaaagacagagaaaattgacagttaatttcattgtttttgcaattataatttacgactaattaattgtaattgtgctcatttgtcagctaattgccgaaaaatgaaccgacgacgttcaaggaaaatgtacgaaattttgggtcataaaaacaagtttcctggtgatttcgagatcgctgatcacgaatccggcatccattttgccaattcagaaccccgaacccgaataattacatgtgataaaaaagattttcggggttagaggaacgattctgacgccctttcgatccatctcttacagcaagtgaaattctccaatcccgaatcttaaaatatttaaattaaaattatttttttttgaaaaaggggcccacaatcgacagtataatcgaaatgtgtgttttgtcatggtatttttgtgttgctttgtgaatatcccgcttttttgtggttgtaaaaactcatcagaaatcaaacccatttaatcactagtcatttttaacagtgcattttacacttgcacatcaaatacaatggaaatggacgaattttgcagcaagcaaaggtcaaataaatacatacaaacaaattgtattgtacataatattgaaatggcatagtgccaaaatcatttcgatcatataatcgcatcaattaataattaattcatttctgctgctgttgctgatcagtgatcactcggcccgtgcgaagcggcgtcgagaaaactgaaaaacgattgtttggttggactcaaaaagtctaattgaaaacaaaaaatgaaattttaaaaattgttcacccgtcgtcgaatccgccatctctgatcaaaaagtgaattggattcggcggattaagcagttcatgcagcacattgcgccatttattctcatcccattcaattggacaacgcgtgagccaaaaatcgtttgtgctatcttgatcaaggaccaattgctccccagtcacttcgttgatcagatcaaatggcataacaaagtcaattaaagtggatgaaagcctccaataaatgcggaacgtcactggtgaagaagcattggaaaatgcctaaaaatggaacaaaaatcattaaaaaccccattaaaaagtggggaataatccaccgttttgagttgttcaatagctgaagaccattggtccatcagtgaagaattaatatggcaagtgagccacttcggcacaccgtccggacgagacgtgaacaaccatttggcaactacttggccatccgacgccatggcactgtcatcgggcggaaaagcgagcacaatgtcgtcattgaaagcgacatagcgaagagacagacaattgctgagcattgacggggccaattgacggaaacggcgaaaagtgatggtgtccaaaagcatcagatgcatggaatcgcggaacattggccaaatttggagcaaaacaaagtccaaaatgtgatcattgcccgtggtattgtccaagtatattgaacaaacggcgaaaagacgctgtaaacgacggagaaatgtgacgacattgtggtcaatgtagctgaaaatgtggatgatcacacgaatcaaattccaatttcatttaattttacgcgatcgtaatgcctcttaatccgagcactttgttcggcaacggtttttgcgggattggcaatggatttccatcagatttgacaatttgcattttcttcgtgccattttcttcaatgtcccattggattagcaattgtttgttcaacgtccatttgcgtgtcttgaaatgttcgtccactcggaggtcaaatcgacggctgatcagtgcaatttcgaggccaagttgagaaggcgcaaggaaatcgaacaccaaaagccaacaatcggcgcagataaagctgaaaaaaatgaagaactttttcgatttctaaattttttgtttattttttttacatttctttgtgagggcgtcgtcgctttttgacattgtccaaaaagaaccaaaaaagaatggaggcacaatcgaccaacagaagaagcacagcacgccaactgaaaaataaattgggaaatgaagggaaaggaaaagccaatgaaaggaggtcaaagcgagggaatccaaagggaaattttagcttttttgggaatttttgaggctaattaagctaaactttaaatgcgaactgtcaaaaaaaaagaaataataaacgtacagaagtcctgaagacatttttgcagcaacaaaatgatcggcggaaatattagggagaatgaatgaatgagagaatgaatggaatgaggaggagggaaagaaacaagggcatttttatactaaaaccgtgaaaaattttcaactttaatgtctgtacaaaagttttgaatgtctgaaatttttttgaattttgcaggcagataggcctcccctaatgctaaggtgttttcctgcaaaatcctagtcattctgacaactacgagctgaagaaaaaaaatgagcattttcaaacaaagtgattaaaaatttaaaaaaattaaatctctcagctctgatcctggggattacaacaacactttttcaagggtttccagttttatggattgtttatcctaggctttaaatgtaggacacgattttctgtttcacgatgcctgttttcatacaggagagtgaaacgcagtttttcacggaacgttatgcagctagctgggcatttaaaaacatttattttttttggttttttggtgtcatggcaactcgtacaaaaaaaaatttctaagaattttcaactaaaacttagaatttttagatgaaaaaaatctaaatggatttttagcctagaaaaactttttaaaggacttaaattttcaaaaaatttaagaaaataaaaaaaatcagctgaaaaattagtaaaaaaaattttaaagaatttttttaaaagtttttctaggataaaaaattcatttagatttttttttatcgaaaaattctaagttttagttgaaaatcttagaaattttttttttgtaccagttgccattgacccg

SEQ ID NO: 11756 - DNA, 3445 bp, Heterodera glycines
  misc_feature (28)..(28): n is a, c, g, or t
attcactatttgcatctgacacatattngggaagtatctcgttgagtcaaaatcgatctttgtatatttcttctccttaattagataattgccccttcaattattaggaaatcagtaaatgaagacggcatcgatccgattttcgttgtaataatttcggtttcattgtgttttgtccataaattctctattgtactaatgtcaatctcggctatttgatcatctttgattacgaaaagtcgaccatcaatatgatcaaatctaaggtccccaccgggaaaattcctgacaaccatttcttgactccctcttgttatcgaagtttcatttgtcttttcgttttggaaaattaaataactatgatcgttgtaataaaagcacgctcggggctttaattgtcgaaaatcctggtaaagcttaacattagtgggtccgctcttttctattgaattaatttcttggattgataggctccaccctgaaatcagattcctatttatcgtacataatctcgagcgatcgaacccgaactgtctttcattgaccgaactctttgtcatagtgagatacttgtcgtcaaaaagttgtgtatcagaaagaatctgaaccctttcggcagtgagatggccgactatcgttaggagaacaattaaattaaacattactgacaaattgcttaactaataaatcggccctcgggcgaaccttatatagaccgtcaataacctcacaataagggattccgtagcatcgctgtgtcaagaaataaatgcaaaattgaccacatgcatctgagaattgatgttggacgatgcggtcgttaaagaggattcggtcgaataagttaaggtatgaacttaaatcttcattgggataatcgcccaatgaatcaaaatattcaatttctgtcggcgaatttacaaaacaggcgacccagtgttcacctatcgtgcccgcccggtcggtattcgccacaaagcagtacggaaaatgcctgtccttaaatttaggcatcttgtcggaagcaaaaaccccgataaaatattttcgggttgtcagatgtttggatagaaatatttcaatctcatgagaattcatcatatgcttccgtcgctactgagcacccgattagcattaatagatagaatcgaatcaaattcccccagaacgatcatctcataacctccgtcctttataggctcattaaattgtaccttgatgctggtcgttccgtttcgaatcaattcaaacccgggggtgtcctctagagtagaggtcatcgggatgacgaagaaacaccacccgtttacaaatttttgtatattgatcgacattgttctttcaccgtcgtccatcccgagtcctgtatacatgtcaacaaatgctcgaatgtatttgtttctatcaaaattaagagaatagggtgacccggggaatatgtttccattcgcttcgacaccgatagagcgtatttttgcatgttcaaagacgaagggtgactctttaggatttccggtatacgcaccggttgaaacaaacccgacaattaaacgtctcggaacaatgcttgtaaaaacattgtgtgagagatcagaagtgcctcgtgggatgaaaagactcctgatctcaatttttctcataggatatttggctggggtggtttgtagctgattgcttattacgttatttaatgactgggtaatgtcgactgtttttacataaattctaatatcatgtatgttaatacgatatgtgtgcgggttcgctatgactgcatttcctgaaacatatggcggtgccataattagaaaatcatcggtgttacggtgtatgctaaaaatgacatcagagttattaagcaaaagattgggctgacgggcgagatcaaaattaagtttcaccattgtttcacatttcgccccatcagcaaaacgtgacgctctgtttttaaagccgctatttgtataatcatcctggtcgacatcgtcgacataatagcaggacgcttcacagagaccctttttgacatcttctgaaaatcccaattcattcatcatatatgccctaaacgcatagtaaatgccggaatcataagactcaacacctgaaattgacacctttagtgttttgacaaagctctgcccaaaattttgaatgacaccgacgtgttggtcagcttcactgtccttggtaatcggaatccaattgcttttgtcttttctctcaattgaagttgacaaataaagaaaagttttattgagatcacaaaactgattatctgaaaaagtctaaagatatacggtccagattgatttattgctgaaagagggagtaattcccgaatactggatttattaattgcaacgttcgtcggagggatgtcgaaaagtgaaaggcccccctcgagaccgtcctcactcgccgtgtcgattttcttgagagttgtcatttttaactttttgtattatttattccatttatacctttagatgaaacttaactgatcatatacttgtttccggttcttattagtgatcagagacctttttcctttcccacattgttgtaacttgtcggtaaggttagtcagcccctgtcttgaatgttccctgacggcatcccttaaatcacgaccctgggcgatgtcactcagaactctctgccccgcggcgagcccctcatgtcctgcactcgaggcaatattcctcgcaataggggtcaagaaacgtgccacattaccgaggaaaccgaatccccgttgatacttgcttccgacaaaatattgtttctgtcctcttccatgttggggagtgataaaagatgaccaatcgaccgactcgggatcgaaaaatacgtgtgtcatttttaaaatatacttttcttaaaatgtaatgtaagaatacaacttccccagtgaaatttaacgaattcaccaaacggtgtgtgaatttcaattgtaatttctgaaattcgtttcgactgtagacgatgaaaaactaggtgctatatataacttcactaatcgatcctgggtcatcgacgacgttaactattcttaagagtggggccatctggttgccgataattgtgtttcgattaaatttggtgcataaatgtatagctgccttacacctcccgtcaaatccggcatataagtcgcctcttccgcgtgaaatagccttgtattcttaaaccccagaacatatgcgaggtgttttgacaaatctatatgggagacagcagcggaaagatagacaataaatttttgatcaatgctgtcatattgaaattgaacatcctcattggctaatctctctcttttttgtggtcctttctcagcttcagatacttgtcaattttcaatatctttacgtttaatatgctcacagagcgcctcattaagcctattcactatcccgctaaaaccttttcacgatttatcatt

SEQ ID NO: 11757 - DNA, 4286 bp, Heterodera glycines
ttttgaagggtttaaaacttaatattttggcagtttttagtgtcttttgatccatatttggtgtttttttataataaataaaaaaataaagcatcaaaaatttttttgataaatccggttttttcaaaaatgagtagtacaaaaaaaagaagttaaaactgccttcataagtggtggaattaattcataaatcatactagaaagatttatcatctgtaattaaattaaataaattaactgaatggagggaaattgccggtaataaattccttacaaacaaaactaaaaaaatttcttaaacaaggtgattaaattttgcgaggtgagccgaagtgacaaaagtatgtatgggtgtgttgttggttttggaaggaagggccgtttaagttccaaaaaaattaataattttaatatattttaattgataatttacttttccacctgcctataaattaaatattttagattaataattatcaaaaatatttagaagagtaatcaaacctaaaaatcatgtttcacccattcattctattgcacttttatttttttatttcattttaaaaaacacaagataaacccttgctatgattatggatacgatttttaagtttttacctattttttcctgagctcccagtgacctgaaaaacacaaaaaactttttttttggaaaaattaaagaatatgtgtacctctatgacgaatgatatatcatcattcgacgcctctaggtctctaaggaacgaatccaaaaaaattttttggcggaaacgcctttgggccgagttatgggcccgggactggtggccaaatggctttgggactgaactgttccaatgccttaaaatgcataaaaatgcaacaaagtatatagaaaacgattcctcacggtttaaatgacgaatttgaaagaatacttcgataaaaaagtaatttatgaaagttatgggtcctcaaaacctcaaaaaatgatcgtaagggacgggactgaattgtacaaactaaaagtgaattggtgagtgtattttggcaaaaacaccgcacactcgactacatacattcacaaggggtgtctcagcccaagggccatacgacggacgattgggacaaggaggggggggggtgtctcgggaccgatttttcatacgaaggtccaaatttttttccggcgacgacctttttttttgctattcaaagtacctttttttgcggcgcgtttttcaaaaaactttttgggaaggggtggggtggcccggcggtgccgataggcgccgccgggaaaaattttgaaaatttgagtgctatttgttaacagattttcaccaaaaactgccaaattttgcgattttttggcaagtctacgacttataaaaagaaaaaacgtttttttgcggcgtggaaaaaacatatattttttaaaattttctaatatttacaattttttaaaaataattcggaattccgaaatttttcggaaaacattccctccccagaaggcaagcgtaaccttatgatggcgtcgcacaacgtccgtcaactcgtccagcccgttcaacaccgacttgagccctttgggcggctccacgttcatgcgccttctgcgtattagacgtccaattcttcggacaaagcgaactaagaaatatttgtgtgtaattactagggctgggatttttagttttttaactatagtttgcggctttatttcgacgagaaatgcatgaaaaacacatttttagctcggaaatacctccaacttaaataatagtttgacatcttagtaagtttaccaaggcacaacttacttgtccaataaatgcccatactcagtttcttagggcatgcctttttttctaaagaaaatcccataaacttctagactttaagctttcaatttgataccatgaactaaggcatttacgaaccaagaaaaaatgtatggcctaaaaaaccgcggatagtcatttattcgacgcgtaaaacttggttagaaacgtaaacagtagaaccgaaaaatggaataccgatcaagaagccgagttccatcagcgagaagacgggcagcaacgacgagaagtccatcaccgcgttgaccacaatgccaaggattgcggaaagcattgtcagtgccaaagtgccgtaaaccttgcgcaaatggtcacgcacatggctctccctaaacaggcacattttgtggcataaattgagtgtaatcaaaaaaaaagtgtcaacaatttgtcaggccaagcggagaaagcgcgattaagattgcccagaatgtccttcttgctgcccgccggggccgaggaaccggcggcggaataagtgtaggacgccatttgttgtaataatttggaatggaatcgaataataatcacacaatgatgtatttctgaatattcggtcaattacactatgtatttaatgtctcatattttcaaatgaacgaaatggggttttttgaaccggctaaaaactacaattttttctcattaacattcaacggacatttggtaggcatgaaaaagatatagcacgggaaaagcgaataaatgagaaaggttaattgtttagattcaaaaacccctattggggcattgtaaaattaaatataaaaataaagatgaaaaaataaatgtgaaatatgttcaagtaatttttataaaaaatagagattatgatgatattttagccaggtatgcccacggtccgaattagttcgccaataggttttaaatcgactttttaatcatgaaaacctgagcccttcataaaaacgtttcaattattagtaaaatgatttaagtatatcgtggacaaaaaacattgaaagaatatgaaaaaacaataactttgggctacgaaaaaatgattggggtgtggttctctttgacaaaacgaatcttagcggaatatgtaacctgttatggcgacaaaatgggtgaagaaatattttttgaaatgactcttataaaaaaggcgtttgtttggcagagaaacattttgtgtgtaatatgtacaatcaccgtgtgatgaaaaataaaaaataaatttgttttatgaaaaaataaatagtcgtgtggttctcatcgctaaaaaacgaatcattgaggaatatgagatgacaatattaaccggttaggcgcgagcgagtgattgaagaagaaatgttttttagctgtctcttagacaaaaaatggaataacgtttggtcgactgggaaatttgtgtgtaaaaaacataaacgacaacgagtaatgaaaaataaaaaagaaaaaccaaatttggttgttatgaaaaaatgggggtgtgtttctctgtgaaaaaatgaaactttaatgaatatgatatgctcaaaataagacggtataaatacgaatgttcccgccataattttatggtcattaaataatttcctttaaaacatatggacccttccaacacctttgaagtaagtattatgtaataaattgatattaaattaaaatattaattaaaacaggttttatgtcgatgtgtaaccttttttaaaatattttaaggtggacatggttatcgggcattgctaacgaaatggctttgacgagtttttgataaagtggactttaagttttttttgggtttaaataaactgtattagccatatatagatcgagaatttttatttaaagaaagataggggaacatctaatttatgtttaccattttaagggatacggcaaccgttttaacgagtgggtcccgtcgtatcagtgtcagtatcagaccttaaacaattaaaagacggtgttgaatgaataaaaatgcacaaatcaaaacgatcacactttcgttccaaccaattcgaaacaactaatgatggagaatgaatataatatggtgcgttcaattgcgttcataacccatcacttcaaaacaaataaacgacattaaagtgtgtgcggtgatgtgccgtacacacacaacatgttcaattcagggaattgaaaagtttgaaaaatcaaaattaaaaagaacgtcatctttgttgggttttgttcatattaaaaagccgattttgacgctcagtccaacaaaaatttgcttaattttttgaaaacaagattttccgtttttttggttaaaatatcatttcgtcccatcttccatcaacttgttgttgttcaacaacggcgtttgttctccgcgtcctttttgtcgttcaaaagaaaaagcacatagcggaagatgttggcaagatcttggaacaccaagacctgaaagtggagcagaacttaacaaat

SEQ ID NO: 11758 - DNA, 962 bp, Heterodera glycines
atttttttaaaaaatatttgcaaacctcgaaattttttataaaaaaattcttaggaattttattagtacgaaaatttcgtgaaaaaaatttttttgagaaatttttagcgatttttaagaaaatttttgaaaaaacttagtgttcattataaaatttctaaaaaatcgctgaatattttctcaaaaaatttttttcttgaaattttcgtactaagaaaattcctaagaatttttttatgaaaaatttctaggtttgaaaattttttttaaatttctcggtggagaaacgacgtgggagggaaacaaccagcggggaggaaacgacggggcggggggggggggaatgaagtgcacccgtcgccggcgcgaggggggtgtgtgaagaatatggctattttttcaacaaaattcgttagaaattctcaattttttataggcaccgccggaccccaaaaaaaaactattttttcttgaaaattagcccaaaatcgcaaatttcggtcattttttagacaaaatctgttaacaaatggcactcaaattttaaaattttccacgccggcgcctatcgccactgccggactccccgtgtcccccaaaagttttggaaaaaaagcgccgcgaaagaggctttgaaaagcaaaaaaaaaggtcttcgatttacatggtcgggacgggagcaggaaggttcgccgacagacgtttcgccgataagatgtgggacagaatgttttaaacaaaattgaaataaatcagaaaaccttctgggagacctctataattaacatatttcactcggcgctgactttatccttgacatacatatatccgtttaagtttacctctggagcatcatgtacccgccgggacccctttcacaaaaatttcggttgaccccccccccccttttcatgtatgttctgcccctccccaaccaataataaatgataattacatttgtt

SEQ ID NO: 11759 - DNA, 3751 bp, Heterodera glycines
tgtcttcccgcgggccagtgttgctccccgacctttgcgggattctcatccgctttcgttcagcgtcaattcccgtgttagctgacgtccaaggcgcctttcacgccatcgaagtcgaacctgaggaccggtgcttctgcaaaatgctttggttgaaaaaccccgcccgacccgtctcaggcgacaacctcctcatttaccgctacaaacggctcgtttttggtgcgcatgtcacctgcccgccaaacggcttttccaacggctatggggagaaggaaccgcctgggacgccccactccccgacaccgaggcggcgacgtgaagccaaaccctttctctttggcaaaaccaaacaatagtcatcccgcggcactccattctcggcaagcaaagtcgcctacaactccacgtgttttgtgacgcctctgaacacacatttgccgctgccgtctacatccgaagcgagactgccgacagctcccagtcgaacctaatcttcgccaaaaaccgtcttcggccacgaaccgcaaatcagcgctttaccatcccgcgaccgaacttctcgccattctcgtcggaattcacggcatgcgtttcgccgagaaagagctccggcgcccgatcgacgggcgacacttatggtctgactcccaaattgcgctctcatgggtgaagtccaacgaacccaaggcccaatttgaacagagaagactcgtcgagatccgacaagggcagcccaccactttccatttcgtcagaaccgaccaaaatcccgccgatgtagcggtagcccagacaaaattatttctcggattcccataataacacagtggcttttgatagggcttgtacatttgataaccgcggcattgaattttgggaagaaaagcttgagttctttatcaaacttcgagtcatcacctatgagacatcgaaaaagctgctcaatttttcgagattggaccaatttataaagagattcttcttcgggccgagttgataaaaaaagggagtgaaagagatgaagttcaaaggttccgtggaaacggcggtgcttctcaaacagcctgaattggatgcagaacaaagtcttttctctaaagggaggaagaaagagtagcacacaaagcaatgccatcgatgtgggcaaaatagccactgcagcaccgagtgccagaataagaactcgaaatgcaaaaaatcggtaaggtttgtcactgggctttgatgtacaagacaaagcagggccccaattcgtcaaaaaggtaagggaagccagttcacgaggccaacactgaaagccaaaaagcgcacgacattggaacgggctaattctgaactaaaattaattctgtgccacgagcgatagtaaaatttaagctggagaggagtgcaaccgattttgagataggctgcatcgcagatatcacattcatcagtaagaacaatgggtgtcataagtccaaaacggataaatttcatgattgatgggctatggaaaaaagcgatcaacatcctaggatcattcaaaacagatgttgcgtatacaggcaaggaagtgaatgacgaaatttatgtagtggacggagaagaaaaaattttggggaagagatttaatcggcggattgcaattctatcgcaacaaagcgttcgcggtcagtcaatgaagtcaaattcaaggcagtagacctagagcttggagcggtgcttcataaatacggcgaaatctttaatgacggactcagccgatgcacaaggcaaatttcattgaaatgcaagccgggagggccaccaaccagccgaaaaatgcaaaccacgtcccgtgccttttgcattaagacctgaagttgagaaggtcaccgataaaagatcaatgatggagtgttggagcaagtgacaaattctgattgggcgactcctttggtgattgtagacaaacgcggaaacaaaattcttgtgttgcgactacaaagtcacagtaaaacaatggctcgacatttatcaatacccgttgccggggctttgagagttgttcagcttgttgaaggaagttaaattatgatttcgaaatcgaaaattattcaacctgttgtgtccacaaggaacaacagaattaaatttattttagaaagacaaatgataacaaacaaataaataataaaaccaaacaaataaaataatgatgacgacggagtcagaggaaggcaaaaatggaaggagcaaaacagaaataatttagaactgaaaatgataataaaaataataaaataataatgaatgaaacaaaacagcgggggagaatattgactgaagaatatggcgaccaaaaacaacaggaacatcatttctactgtgaattaatgcacgccaaaaaaacgttcatttattggtcatcattatgacctattggtcatcattatgacccccttcgttgtgcccatttaagccggcccttttcccctctccgtgcatttcccacatatattgttgtattccaattatattatgatccgctcgcctaccttctttttcaaattatatttatttatggaataaagcaatatttatttaacaacaaatttttcttcaataaacttagagctcgagatttggaaaaaaaactgtatctggatctagacctggattccatattggactttcatctggattttctggaaaaaatgcaggaatatccaagcaaatgtgtgaagtaaatttatttaatccttttttatatctcaaataagtcattggttatttgaaatgttaaattctaaaattttctcaaggaaatccatgtttttcgtccaggaaaagcccaggtttccgaaatcaaagcctgggtggggtagacgcctaattttaatggcccggcgttcaaaattttaaattatcacttgagaaaaaaattgcaataggaaccgacaaagtcacttcgattgattactgataaaattatgtaagaaatattttacagcataaacatatgagcacgactgtaaattcgttaactggtggttatggtttatgccttttatttttatttcctaattttacaaaattattattattttttaatatgccaaaatctaatttatattgtttaaaaaaacgatcaaatatttaaaaaaaaatattccatatcaatagtgaatcagatttttcacatttgtctgttggcttaatcggatgatgttcattttgttttttgagttggcattttggacttggttttttgcgccaattgtgtggacggctaaaataaaatttatattgtactttttaaaaattaattatttagaataccatttttgttacaaaaatagcccttcaacgcttgaaattcttttttgaacacgcgacgatattcagtgctaaaattataatttaaatttaaaaaaataaaaatataataaattaaaaataataattaaaagctataataattagagaccggaaatttcaaatttgcggatcccgctgcgggattggaactcaaaattttttgcgggacgggatcccgcgggattaatcgtacaaatctcgcatttaaaatttgcgggatcccgcgcgggattgcggattttgaaattcgaaacacttaaattaaatttcaaaaaatttccaaaaaacaaaaaatacctgatattttgaaaaagaaatttttagaggcttgcgagatgcattaaaaggggctaatgagacccctagaaggaatggattagacggtaaaaagagaacgggaataaaa

SEQ ID NO: 11760 - DNA, 3029 bp, Heterodera glycines
taataaatatttttaaagtaataaattgataggtcatctcatttctctgtttgtgtacacataaagctaacaaatgagcacctccaatataaataaagtgattgattcagagatgttaattaacaacaaattgttagcctaaggcaatcgccgaaatcatcgagaaatacgaggaaaagcattcattcccacccgctcccttaagtagctttgatcatttactaattaattacatttgtgcataaaaagaccgaacgcagcagcgctttcacattccttttttggctttgatcgcgaattattatcggatattatgtggctaaggacgttgtgctaattaatacccattaattaattgtttaatctattgaaaatgctcttcgtccgtccaacttttctcctccttttgctcttcttctgttccaccaatttctttccgattatttcggcttctgccgaccaaaatgtcgaaaattcggaggccgaacaaagtgaaaatattcttctccaaaggccgttgaacatcatagaagtgagaacaaagcagatcaaaaattgcacaaaatttcaatgttttaaaaaagtgaagttggctgacacggacggcgacggacggatcagtttggacggggaattgaagcagttcctggagtcgacaaagttcgaacgaatgttcaaggcgctgttcgaccaccagtctcggggcgaattgcgcctggagggcttcagaaagacactgacgaagcattttgagggacgaaagtacgcgccgaagttgccaactttggtgaacgaagttaacgtgaacaaaaacggtggcatcgactggcacgagttcaagctgttcatgtacgagctgggaaaacaggtggctgataaagggaggaaatttgatcattttgaaaagggttttcgaaaacaataaaactgaaacgcatttagttggtggatgccgaccatgatgggttcatcaccctcacagaatcacaagccttctattcctgggagtacacactggtggaaatgaatgaatctcaccaaaaggtttcataaaaagcatcgaatatttgttttaatttttattgtaatttaattattattttagtggttttccaccaacatattaccccaattttattattcattcgcttttcatttgtaaagtttattcaaaagaataaaaatatatgctgggacaaatatatggagaggataataatttcatgttattgggatgaattgataaatggtaatcttaatctgtaggaattgatgaaaacaaaagaattctggctaatgcaggggtgcgatctgttcttatttgtaagaaatgttctgattttggactattgttcttattggtcaatttttagacaaaatctgttaacaaatcgcattaaaaattacaaaaatttttggctctaatgcactttatgagtccaatcgacttttatgagtccaatcaattgacaatcccgggttttgattaattaattaattgctgattattttcgtttgttactttctttaaatgttagaattctctcgttttctcgtattataacattattcagactttgtgctttcgaatgataccaaaaagatagggtttgtttgaacatgaacaaagttactgtataaaaaacaaatgataccatgaattcatatacctaggtcttgatcaagtaagaaaaaagtatggctaacaataacaaaccaagtatggtcaatggattggacgggtaaaagtcatttgacgattaaaatgcagtagagccggctttttgtggaaaaaggcagggaccggaatttcgacagacccgaggctttcgaattccggtctaaaaacatttttttgaggattttctccaaattttcataaatgtttgttttgcacatatttttccatttttatacatccgaattatttccttatatgaggttttttgataaaaaatattttatcaatgaaaaaaagggttataaattatatggactaaaaaccaaaaaattttaacgtagaaatgctatttttgagcccctttcttcgtagcatatgcgcagaaaaaatatgttaatccatataatttataagtagggatgggatttttagtgataaaaaatcccaaaataattaactaaatagtgaccaaaaaatgccaaaatagtggcaaaaatagtggcgaaaaagttccaaatttaggggtgtaattttttaaatagctattttagtttgaaaataatttaaaactaaggaaaaacattttattatcactgatgaatagggctggtaaaaatatggatataaaatcgcgaaatatggccataaaatatggaccaaaaatcgcaaaatatggacataaaatggcaaaaatctcaaaatatggaaataaatggcaaaaatgtcaaaatatggacataaatttttcaaaattgagtgcaaaatttcttcaaatttgttggttgaaattgcatatgagatacatttccaaattttttgactcggtaaggcgctttgacaaagacggctttcgttttgcaattagtcggtcaacattcggaaattggtctcgaattttttcggcaatacgtgcaatcattttaaaagaaaaaaaacataaaagccaaaatttattaattttttttagcgcaaaatcaacaacaaaagcgaaattttcgcttttttgcttatttttgacataatttattaatttttaagaaaatttaaatttattcaatattctcgagaaattttggcgaaaaaatgattttttgaaaaatttttcgggttttgggctcaaaaaggctaatttagctgctgggggccgttctaatagaggtttttttgaaaaatgccaaaatatggacataaaatatggaccaaaatgccaaaatatggaaatatggacataaatcgcgaaatatggaaaaatatggaaaatatggatatagaaatccttcctagaagcttcaaaccaagctaaaaacatattttcgtgcgtttcaggcctcccacattccaggaaaaa

SEQ ID NO: 11761 - DNA, 3052 bp, Heterodera glycines
  misc_feature (65)..(65): n is a, c, g, or t
tttaaacggtatttgatttttccggcggttttcccaatttttaaattcgcaaaactttgaaattntgtctcccaaaatgtaaaccagttggtactgatgagtaggaagccctttgactttgtataaacgaaatttagggagcagtttctcccccgaaaaatttaaaaacagatttcttaatttttttacgaattaaaaattataattttcatacgaatttcattcgtaaaacatttcttcttttttttcatttcaaataaaatgaaaatttgcacccgaatttttggcttggtcctccccttaccttgtggggctttatcctcctggaactcccgaaaagggagagttccgatttgtcccgcccgcgcatagttttcctctttctcacccgttttttgggagtcgtaattttccttagccgggatcagtttgatccaaccatttttcctttatcgagactttcaccaagtctcttccaaattgcgcttctccgtcccccgcaggagcgcgaacgcgagtacggcacttggcgttggacttccggcgttgaggacggcttggtacatttggagcaggaggagaagccggcggaggagggcgaaatggcgccaggggacgacgaaatggacgaggacaagaagatactggaggcactggagcagaagcggaagaagaaggcgtggtggcgcatttggagactggggaattgatcgggaggcgatcggagatttattgattgatcagtgtgtttgtgtgtgtgatcggttggcctatccgattgatcaaccgcaattgattgatgggcttcaattcattcattgggattgatcagtgtgtgtcgttgccttaaaatttgtttgtttgtttgaacgagataattaatgattgatgatcagtgatgctaacagagtaagccccaaaaacatgttggccaatcgcgcggctttatcctttttgcctcagtttgtttttaatcgatccttcgattgatcaatgccaaaatgactgacttgatcgaaggcatttttcgttatttaaaactgatcaaatcactaataactgactcatcaatcgctgtgatttgagtaactctgtccgtggcgctgatataactgatcatttctttagtcaaccagtcacacactttctgatagttgttgtttttacatttattttcactgctcaattcctcaaattaggcttttttaaaataaataaaataaaactaatgcaattatttttgttttaaatcccttaggttaattagcaaatacatttttgttattttaatttattttactcaaaaatactaattttttggctccaaattccatggcacaactgttttctgtggccgatttgtctgccggcaaagaagcgggtgcgctccgggcgatgaatgaatacaattttgagcaacttttgccctttgaatacatcgcctcgagtgaaccgacaaaagggcttaaattcgaaccgccgactgatcattttttggtcagtattttggctgattctgatcagtgatcaatcaacttatgcctttggcaataaattaaaaattaattgttgctgattgctttcagcgtctcccgcggccgaaagtgagcggctttgaagtaagctctcaattcatttttgtacgccaatttgggcgtcgccgtttccttttttggcatttttagtcccgggctcgatttgtccgagccttatttcttcgaatcttaattagcgttttttttacatgcgcttagttggaaaatttggttggcacttgataccgaacttggcgtcttcaaaaaaaggataaagcggttggctctcggcttttctctcgagaattatccgaattctcctttgctgaaattaattttgaggttttttactctgatccaaccaaaaagtgggcacttcgcacaacgcaatggaaaagcattgccgaggacgcggtgcttttcgaatacgccggcgaactcagcgaggacagagacgagccggtggagcaggacgactacatcttcacatttgactatgtgctgttttaataacgcataattatgtttgggagtgatcggacccaaattttttgtaattatcccttccgatcaatgtgatcagtgtttttgagcagaattgcactgatcagacggcccaatttggtgcacattaatttgatctggtgcacaacgtttctcgcccgaaaaaattttcagctatattttagaaaaaaattttttgagaaaaactttgtaattcatcacaaacaaaatttggaaaatcactaaaaagttttctactttttcttgtaaaaatttatcggttttaaaaatttttagtttttttcggggcggaaattatacggaggaggcggggacggtctgctcacgaccggatcgcctctgaagagaatccactgctgatcattcgcttcaaaaaaccgattagatcaaagagagaggcctccgtgggtctatctgctgatcactttcttatcattttctgctgatcagtcatgctctcaaaaaatgatttaaaaaataagagacggctcttaatcagtcaaataaaaaatagttggctttttttgcagcaaaagcgccactttctactcgacgcgtgccgacgggggaacctggcccgctttgttaaccattcgtgcgtgccgaactgcttcactcggttggcattggtggacaacaacaacaacgatggtggcggtggcgacacggccaaggacaatatgccgcgactattcatctgcgcgagtcgccgcattttggccggcgaagagattacgctggactacggtagggggaggaaaatggatggatacggtaggacaaatcttttgaggataattgtaactgcggcaggtcttaatgccagcgcagccccatttttggaactttggcattacggacgacgacaaatttgacattttccaaattcgttaaacccaaacattgatgaaaaatcattacgaaagcatataaaattaaaatctaggacggataaatgatcattgatcagagaacttaattaccagaagagt

SEQ ID NO: 11762 - DNA, 1703 bp, Heterodera glycines
  misc_feature (127)..(127): n is a, c, g, or t
  misc_feature (1600)..(1600): n is a, c, g, or t
gaagagaatccactgctgatcatcgcttcaaaaaaccgattagatcaaagagaggcctccgtgggtctatctgctgatcactttcttatcattttctgctgatcagtcatgctctcaaaaaataatntaaaaaataagagacagctcttaatcagtcaaataaaaatgttggctttttttgcagcaaaggcgccactttctgctggatgcgtgccgacgggggaacctggcccgctttgttaaccattcgtgcgtgccgaactgcttcactcggttggcattggtggacaacaacaacaatggtggcgacacggccaagggcaatatgccgcgactgttcatctgcgcgagtcgccgcattttggccggcgaagagattacgctggactacggtagggggaggaaaatggatggatacggtaggacaaatcttttgaggataattgtaactgcggcaggtcttaatgccccatttttggaactttggcattacggacgacgacaaatttgacattttccaaattcgttaaacccaaacattgatgaaaaatcattacgaaagcatataaaattaaaatctaggaagaataaatgatcattgatcagagaacttaatttacccagaagagttacagttttaattttgtgaatccccccaggcgctgcgtggtggcgcgcgaaatggacgacaaacgcgggcatttgttgccactgcaaatgcgaaaagtgccgatacaaaacgccaatttgaaatggaattaataatattttttttatttcctcaaattttgtccattttccctatttttgatacatttccttcgtttttggtcatttttcacttttttgatcatttttcatattttttgtgaatttccatcgatctctctgcgaaatttatttaaattttatataaaattttcattcttgaattatttcctcccattggccacattttgaataaaaacatatttttcttttgtcaaaatcaaataaacaaaaagaatcaaaattttcgaaacatttggcataaataaaaataaaataattcaaaaaatggaaaacaaaacgaaatgaaaaaacaaaaacatttgcaataatttcacaattttttttgataataattaataataatgaatgataatgataaattcggtgtgaggcaaaggataaacaaagaaagaggagagagagagagatgaacaaattaagggggctgagtgcctgaggtatggttgagattttgtcgagaaaaggagggtcaagaaaactttggacaaatgaagacgtaatgaatggtgccccagggaaggggggggggcaggttttttgaatggcattttctgggagaagtgtagaaaatgccagaataggataggcggctcaattgaagtaagacttatttgagtccgctcccccgggcaaaacaatttgataacaaaaacagtaatgaggtgggattgttggacaaattgtgtcgagaatgggcacggggacgacggcacaacaaatggaaaagaaagagaacgaacaaatagcaaaactgctgatctcgggcaatttctaaaatcatcaatgatcaataatcagcatatatggncaatcatcatatcatgctacacatgagggggggggggggggggggggggggggggggggggggggttttgtgttatattattttttttttttttttttttttt

SEQ ID NO: 11763 - DNA, 4992 bp, Heterodera glycines
  misc_feature (22)..(22): n is a, c, g, or t
  misc_feature (1695)..(1695): n is a, c, g, or t
tatcgcaaatgataagtataantttttctctaaatattagttttcttattgttcccttcttttctttctctctgtttatatcactcatgtgggacggaatgacccctggttgatcctctctaacaccccaggccatccatctgagatgaaggtggacgagctgttcattattgtaatgcgcagcctggtgcgtgagtgtttggattggggaccgaagggcgaagccgttcccttgatgtgtttactcacttttttcaaagggaactctaagaattctgatatgccttcaaatctatcaaaagagttgcatactttctttttatcatttctctttattctctattttacacttgtatttttcatttgaatgtttattcagaaataaaattgaaaaaatgtgtcattactaatataaattaaccaaacaaaaaggtatttaaggagagaaatagtcagggttttgtaactcaatttagaaattagaatgtcttctacttcttcaaagaagactctccaatctgtagtggagcaagtaattcaacaagacgcagaaataaaaagcagtgagaaaccactaaaacagaatgagttggaaaagagtgaacggaaatcaacccacaccgtttataagttgcttgatcatcagcgtttcttttggaaattggctcgaccaaagtttgcagtgatcaactttctctgcccagggtgtcgtcgaattaactataagcacaatgaccagttcaagttgatgggtgaaaatgagtttcactttacccaagtgatgtgccccggttgcgtaaagtacaatatgatgcagactgatatttataataaacacactaagaacccccactaattgtatttaagattaaaatttaacattatataattaataaagatgattgatgaaaaattttttcacttgaacgatttgaaattaaaacttccttttggaatggtgataagtggaccatctagtagtggcaaaacaacatttttactaaattttttgagagaaagagatgaattgattagcccacacccaaaatcggtgctctattgttatggtcaatttaatgatagtattcctgtactacaaaaaatgggtgtacatgtgcacaaaggacctcctagggatgaattgctgagctctctaaagaagcctctcttattaattctagatgaccttttaacaataattgatgagaaaagcctatctgaattattcattaaaaaagctcatcatcttaatatgggagtgattttcataacccaaaatttatttgaaaaaaaggtgaaggtagcccgaattaattcacaatatattgttttaatgtctgctccgaatgctgcacttcaaatacgtaatttgggcgttcaactgtttccaaaaaatcttgcatttttcctaagtgcttataaagatgccactttatcaccgtatggatatttatttttggatttacacccagcatcaaatccattgctgagaatacggacaaaaatatttaaagaagatgaagaaaaagcattgtatattcaaaatgattagtttacctaaaaatgttattcaaaacttggattttttaaagaaattgacaaaaacaaaagcttttaaaaagagacaacaaatatttaaagaggctactagtgaacaaattgcattattaattgaaattagttataatatattanaggggtacttcccgctcacgaagagacaaaaatatagacttttaccatacgcaaattttgtaagaaaattagcaagagttagaactgagaagggtgcaaagaaagtttttcaacaaaacggtggtgattttttcgttaatttggctccattattattgccagtattaattgccgcgctaaaatatggagaataaattattcttgttccttccgacttgtacaaaaatttattaaaacctgagtctggcgagattaacgttgaaaatgctaaaaataaattgtcatcacttttgaagcagagaaaattagacgctacttcaaaaaatttactttataaccaggaattgaggcgtttcttgaaacttaggaaggaagttgaagataaaccggtaaaagttgagctttcagatggatctttgatggtgtttaaaccaaagcagcgtgaaagagatagcaaaattcctactcaaattgttaatgacgaaggattggatgaaacaggctctattccaacacttgaagacccttacactactgctgaagagagtgatgctgagccaacaacatcaacaccaaagacgagaccattgataagaccaatgcgtgtaggaacaactaaatttcgtcaaaagcaaaagtcttttgtagtcaagaaacaacaaaaaattatgtcaattataaataatgaccctgagaaatttggggttggttctagaggacatatactgagagctgatggaacggcatatttaaaaagtaatgttaatcaagcattagagcgaatattgagacggtcacccgagaatgctccatcacccataggtacaaaagctttagagcaacgactgagaaacgacccgaggactagtggaatattaaaacaaaaatttaatgaacaatcgggatcgggcgttaaaagtaaacaacgaaaatttataattaaaaaatggaaaagttactgaacaaattgtataatgaccctaattcacctgcgtgttatgctggacaggaaagactttacgaagaggcaataaaacatgactcttcgatcacaagaaaagatgttgaacactttctcgagggagacagaacatatactttacataaacctaggcgtgttcgatttaagaggtcacgaacagtgccctctggattcatgactgatgttcaggttgacttggcagatttccaaaaattatcacgaaaaaataaaggattcaattatatattgttgggtattgatgtgttgagtaagcgggtctttgctgcacccgtaaagtcgaagaatttcaaacacatgagagaagcgtttgacaaattgataagtcaaatgcctatggttcctcatagaatattttcagatagaggaacagaatttgaaaatagagaaatacataaatatttccaagagaagaacatacaaaagcacaaggctcatactagtacggttaaggctgcgctagccgaacggtgcataagaacgcttaaacaacgactatatcgttattttagtcaaaaacatacaatcaaatgggttgacgttttgccaaaaattgtaaatgctttgaataactcaaaatcacgtattacaggtatgaaaccagttgatattaacccgggtaatgctcaaaaaatttggaaaagagtctatggagatgaattttcacgaaaagcatatagaaagccaaggttcaaggagggtgaccatgttagacttgcaaagtataagtccagttttgaaaagtcataccttcccaattactcggatgaaattttccaagtttacgatattaaaaaggctaaacctcatcggtatggaataaaggacgacaaagaagagccctttgatacacgtttttatgctgaagacttggccaaaaccagaaaggacgcggagacgacatatcgaattgagagagtgttgaagactaggacaaggagtggacagaaggaacatttggtaaaattttacgggtacaaagaaccggagtggattaaagacaatgctattgagagatgaatgtatttaagtatttattatttatgcttttaataaaaaataaaatgtcaaatttgttttacgttcttttacctagtgactctcctggttatgacaataagcctaataaatttagggttcatttgcctaggaccctaacttttggaggtcattggttgtgtgggttgcacagtataatttatacaaattcttggcccgccattggtaccacagagaaccaatggattaaggtgcatttaaaaaatggtgataaaataaaaattgatattcccgctgggtcataccaaaatgagcaagaattggaaaatgctataaatgagtcgataaaaaatggtataaaacaaccggctacaagagttaaaagacaattggaagatggagtggatttgttttttcattataatccagatgattactgggaaaaaattgaggaagaaaggcaaagatataaagaattgttaaaattgatagatacaaagtcaagagaacgtgatgatgagacggacacgcataggaagagaaaaatagaggatgaggaaattgaccctctccaaaatcaatcattgactaagaaagcaagaatagaggcgcttgaagaagcagcaaggcaaagagatgacgggaaggaggaaaaggaggagagaactggtcaagaattcctcgaaatgtattctgttaattatagggagaaattaaatgaagttcgattagaattaataagagatttattcaacattcaagaccatatgaaaaaataccaaggagtaacagatggtagaacaattcaggctctgaatgaggaagcattaagaatgagaacagcaatgaaacacagaagaaaaaatttgaatgcttttaacaaggctgtattgaaaaaagatttacaaatatcagctgaagaatatgagaggacgagctatgaacaaaataaggattacgttgagccattttttgatagtcatccaacagattactgggaacatattcataaaaaatatgaagggcttcaagacgattacaaaaaaattcgcgaattaagagagcaacaacaatttttaactgatgaacagaaaaaacagtcaattcaggatgaaattgatcaacttcgtcgtcttgtcgattataggaaaaaaagatttgcagcgttagagtatgaagctaaaaagagggacgcactccaacaacaaccaatggctttagccttgactcatggtgaagcactgaaggaacgaataggaaaaatagagggaactaccaccacagcagacgggaaagag

SEQ ID NO: 11764 - DNA, 3446 bp, Heterodera glycines
ttgctgtgccctcagggggcatccattggccgggccaaactttggccaaccgccggggcgccagcgacgcgacaggtgcggtttattcgaattttgttatagtttaaacattttaaaatgcttccgcccgcttcgtcattgtcgtcgtcatccttttggccaaccattgaaatttagggaaaatttgtaaaaaaaaaatgtaagaatttatttgaaatgggaatcgttgggccaaggattggcgccaaataaacaaatgtaattttttcggggaggatggaaataatgctaagcctagcggattttcggacatttgtggcagcatttaagccacccacacggccaatttatcaaaatgcgccaattccaagtgtatgtaggtggtaggtactagagaccggacaactagggtcgaggattccgaatcggggtcccgaccgaatgccgatcccgattaatctcgaagattttgggaaaacgatcggtacggattccaagaacgggatcccgaataaatcccgccggatctcgatcccgtccggtttctagtagctacatgcatgcatatataaagtaggcatgggaataatttttggcaaaatttgactcataaccgaaaatcaccggatgccgaaatcgaatcggtggagtgggcaatttaaggcaaagaaattcgttgagtcccggagcaaaagtcgaaacagaaattgaggctcagttctcgagagtctcgggacagaaatttaggggcaaaagggaaaaccatgccgaaaaatgacagaaaatttgggcaaaaaattattgaaaaataaataaataaataaatggacgaaattttgttgagaattaatttgtgctagaaaaaaagtgacacataaaaacaacgcatgaaaaaatgtgatgatatgataagtaatgacgtgacaaaatttcggggacaaattttgacggaaagtttaaaaaaaaatggggaaaatgacggagcagaaaaagacggacggattgattgaatgattatggccggaatgaattaatcaaatcaaatcaaatcaacgaccgaatgattaaaaaaatatatttgcaaaaatgcgcgaaaatttatttgaaattttaaaataaaaaataaaatatttaaaatggcaaatttggaaaaattgtgcctaaaaaataagaaataataattttaattttgaatttgaaaaaaataaaaattgaaataaataattaagaaaatggaagtattctttcgatgattttgtgaatatttaaaaaatagaaaataaaccattttaatattgaaattttactaaaaattcaaatttttctaaattttttttacttttcgataaaaatacattttataaaaatataaaataatttttatttctactgatgaaaaagtcgcttaagcttattgttagaaggaagcagcatttctgctgtggataattagtgcgcgaaatttgagttaatttgcgaagtgcgcgaaagtcagccgacgaaaaattggagagacaattttaaaatgggaaatttgggggaatttctcaattttcaaagaattaatttattaatgaatatggcaatttaatgaaaaaaggcacaatcattttcatcagaaaaggcgaatcaaatcaaatggtgcgcgaaattttcgcattttttaagtttttcgtcagagatcggtgccgacggaagtgtggggaacagaatgtgccgtactcgtcggagctgtaaaaaatatattaataaaatatgaataatttaaatatgcaattaaatattaattatttattcaattaattaaattttttgaatattttatttttatgatattataagtatttttttatttattaaataaattattgtgcttttgtttaaaatttaattaattactattcttaaatttaattatatggtgtctttattaaattttaagtgatttgtgtgtttataatttaatttaatatcaataaataattaatttttttatttttcataaattaattattattcaaaaaattaattatataaaattgatgattaattacgtttaataattttatttatttttaattatttttctcatattcacatgctgttgttgtcatttcggcaccgctgctgatcatttccatctcggcacgttctttgtacgaatttgatgtttgcatttcttcgctaacagtgcgctcaaaatctgaaaaaacataaaaggtaattttaggaataggaaaaataaattttaaaattgatttaattttaattattttttttggaaaatttaaattttgccaaaaagtcaccttcaatggttaaacggcgccacgtttggctttgctcgcagaaaatctttaaaaatattattaataattatataaaaagtaattaaatatataaaaatgtatttaaaatttaattaaacaaatttaagaaaatttaattaatttcatttcgcataaaaatccccaaaaatgttaaaaattaatttcaaaatgtacaaaaaaagcatagaaaaattcccattcccatttaattagtattaaaaaaaatttctaattaaataaatcaattaaataattaatttaaatgcgaaataaaattctcattaaaataattaaaaaagtataatttttcccacttgctcttctcgcaaaatgcggcccaaatgcacaatgtatcggttggccaatcgcagcgttcgaatgcgcggaatttccgactttacgccgggcacttaattaattaattatggaattaattaattgattggccaactaattaaggctaattaattaggctcacaaagtgttgtcaatgtcctcatgtattgtttgatctgcaaatttcgttggcgctccttttcactcgattttttgcgctttggccgttgaattggcagcagtgaatttgttggcacttttttggtcgaatttcgcagccgattggttctaataaaattttaatttaaaaaaaaatcgaattaggaaattccatggaaaataaattgtaaaaattgatgacggcttaaagataaaaccaaatttttaattcaccaaaaataaagctttatcaatccattaaaaattatttcgaccaaaaaaaaatgctataaatcaaaaaattggcaaatttttaattaaaattaatgtggtttaatcccgatgccgtcttacatcagcttaaaatttgaatttcaagcccaaaaatggaaataatttgtctgttttgtgcacaaattttattcactttcttggccgattttggcacgacaaaccctccgagaaattctgatcatggcactcggaaaagcctggaaaagacaaaattaaatttaattaattaaattaaattaattttttatagtgaccctgagaagaagaagaggaggaggagggaactagtagggcggaccaaaatttgacgtctaaaatggcaaaata

SEQ ID NO: 11765 - DNA, 964 bp, Heterodera glycines
gtcctcatgtattgttgatctgcaaatttcgttggcgctccttttcactcgattttttgcgctttggccgttgaattggcagcagtgaatttgttggcacttttttggtcgaatttcgcagccgattggttctaataaaattttaatttaaaaaaaaatcgaattaggaaattccatggaaaataaattgtaaaaattgatgacggcttaaagataaaaccaaatttttaattcaccaaaaataaagctttattaatccattaaaaattatttcgaccaaaaaaaaatgctataaatcaaaaaattggcaaatttttaattaaaattaatgtggtttaatcccgatgccgtcttacatcagcttaaaatttgaatttcaagcccaaaaatggaaataatttctctgttttgtgcacaaattttattcactttcttggccgattttggcacgacaaaccctccgacaaattctgatcatggcactcggaaaagcctggaaaagacaaaattaaaattaaatttaattaattaaattaaattaatttttttaatgaccctgagaagaagaagaggaggaggagggaactcgagaagcggaccaaaatttgacgtctaaaattagcaaaatattaaataaaatttatttaacattgaaaattcattgtttttaccgtcatggacaaattgaccaagcaaaaaattgtcataattttccattttttcgaagaaattttcctgaaaaattttgtccatctgttggggcgacggaatgccagaaaaagaaaaaataaaatggggaaaaagaggcaaaagttttaaggaccaattggaggcggacggacaaaaaaactgagccgagaaaattgcgtaacattgtgagatgaaagaaaaatggagaatggcgcaaatcttttgaggattttgtggacagaaaaaaagaattattaaaaaaaaacatttgtat

SEQ ID NO: 11766 - DNA, 969 bp, Heterodera glycines
  misc_feature (7)..(8): n is a, c, g, or t
  misc_feature (16)..(17): n is a, c, g, or t
  misc_feature (39)..(39): n is a, c, g, or t
  misc_feature (46)..(47): n is a, c, g, or t
ttgcatnngcctgcannggtccactttcaatgggcaacnataaaannattgttggcacttttcggtggcaacataaaaattgttggcactttcggtggcaacataaaaattgttggcattttcaatggcaacataaaaattgttggcattttcgatggcaactgaaaatttgttggtattttgtgtcctaaatttgttcgcattttcgatggcaatatttcttggcactttcgatggcaacctaaatttggtgtttggcattaaatttgcaaagactttaataaggacatcactctatcaagtgagcaattgcttacattttgccaaatttatgacgtaaagtgtttattatgaataaattttatagagtccggaataattaggaatgttgtcagatttctcaggtcccgattttttttttggaatttcaagatcagatcctggcatttgattcaaatcctggaaattctgtcctgtcccgcccgactctcaactctcgaccctgactttgtttttgaaaattccaggctctcggagacattttttcataatggcaaaaaggacaatccgcaaattgattgttgtaataataaccccccaggggattgtgccattccctcaggggattgtgtcgttcccacccaatctctcccggattgagtcttaaatttttcggcactttaaaaacaaaaacaaaaatttttttttgcggtctctctcatatggtctcttcttgagtgtcctcacagaacacacagttttagtgatggagaagatgaaaaattggggcatcgtaaacaaatctttggcggaaaatttccttttttttgagggatgggccgacggatgacgcactttgcccgaggcaaaaattgcaatttttgaattggaatctttttttaattttttatcattcggttacccgcctcaaattaagtaagtatattcatttcaaggattataaaggat

SEQ ID NO: 11767 - DNA, 4613 bp, Heterodera glycines
  misc_feature (4580)..(4580): n is a, c, g, or t
cggcaatcatttcgtgtgcttccgaattcttcccggtcatgttggttgcccattggttggtctgtggacgagccgagcaacgggctgacgaactgatcaggcgtagacaggtgggtcagttttagccgtggtttgtgcacaggattctgatcagacacatagacagacgcacctgagactgtttgaatagccgaacaaagaaacataacggggtaaagctgatcaatcgtctaaagttagacacgcgatcaacttgaaggggtctgcctgcatggtggcataagattactgatctggtgttgattgcattgcgcacaacaatgtgctcagatagtggggtctgctctgatcagtttcatatttgatatcgttaatcaagtgtccttgtcttgtaaataagcaaaatttgagttcaggaaaagaaaagtgtgcgccgaatgttgcatggtatgatgggcgatgtgagcaaagtttacggtgagaatggacaaaaaaaaaagctcgagatctcgaggatgttatgtcattatcacactttgcttgtcataaatatgctgccctgttctgtgtgcaggtgttgatccaactgcacagcatcgccgtgaactgcccgcacttgacatccctccgggcctttcctgcgccctattgctgctcgcttcggtcaccgccgtgctggcactgctcaattggttcgtcggtctctactttgccatcaagtgagaaacatgcaacaacaacaaacaaataactataattaccgtaactttctgaaattgagccccccgggggctttgtttctcaacccccctcaaaaggggggctctaattcaggggcggctatattataggtaaaaaaaaaacaaattctttctgtgttgcagttatgatttgatgatgccgtccgtgttggatgattttgtcgaatgtgttgcctctggctgtcagctgattttattcggaacggtcggtaaaaaaaaaaaaaaattttttttcgactaataggtatatgtgttacaaagagttgtccaagagtcatgaatggcattctcactgaagtgcctgttcccctgatctttttcttcacagcaaatctaaatttaaataaaatccaagtttttttacaagaaagtttttcaagaacaaaataaattggaaatcaatagttttttagaaaatttttgaaaaaatttagtaattcatcttaaaatttgactccttctgtgttttcagctttggtggtggacccgacgagtgatcactttcaagcgatgggacccgcaccacaaggccgagtcccggggcgatttggtgctgatcggcggcagtgccgcctttatgactgtcaaactttttctccaagtaaaaaaaaaagaagctatatccaattctttcctcccccccccattttttcaggtgcttgagctgaattttcaacgcattgacggctttttgccattgtctgaggccatcttgcgcactgcctccctggtgctcatccaatccgctgaatggctccaattttgcagtctacaacgtgtgatggcactccatttcgagtacagcttcggggaccagcagcagggctgcccatcacttaattagttatctaattgggatcatttcccacacaaagggatgtgtacgctactcgacgtttcctgcccgttgtcacattagcagcgatcattgtcaactgggttggctttggcaccacattttttgaaacgtaagttttaggccagaaactgtacataaagtgagtggagtggtgttacattcggaatgatcccatgtgagatttttggtctcgacatccaatttaataaacatcacggcacggcacactttttgatcaaaatttgatgaatgatgccatttagaaacagcatcaagtatcagctgggtttggagcatcgtcacttctcacagtcaactctgatcagtatgatgtacgtgtacatgttataacaagagttcgaaaaatatggataaaatggcaaaaacatggacatatattgttttttttccaaattgcgggtataattccatttttatatgaaaaaaacgacctaaaaagcgaagttttttatttgttaaatttttatttttgacataaatttacaatttttaagaacgattagaattaaacagaactctcgataaattttccggtctttaagaatggaattccgcatgagggccgttttaataaagagattttcgaaattttcatgcgtttcaggcgcatcccatagtcgagaaaaaaagggatttccagattttcgaattaaatatgattcggagattcgggttgagcatttttttttcgtttccatgttcagtttcacccaaaccatttatccggccgactatctgttctgtttcactgcagccggttgttggacggatgtgctgcttcgctacatggagttgggcctgttccagctgggcccaccaatggagctggacgagttggaggagttggagcagcgcaggcacagctgtggcgaggagggcgccgtttggggcacggcaccagggcacatggcgatgaagaaggtgggcggctgttcggcttgaacacgttttcttcactgattatgggacagacccccaccaggcgccatttttatcaaaattttgttgccaaagattccattcgtctcaatttttatgtgtgtttagagtcatttcggcaatggaatccatgccaaccatggtgaaaaatggatgccaacgcatcgtccgctgacgacgagggcggcgttggaagtgcccactgatccgtaccgtccggaccggccaatacattttgtacagccagtggtgccaaaagaagaaattgttgatgatgacgaagatgtagtggaggaagtgatgaaggtgggcaatggaataatggtggaagaacaaccaaacaccatggaaaaggggaggaagtggaggaaaaggagagaagggaaggcacagtgggaggaggaggaagaggaggaggaaaagcactttgagagggagagaaggaacagagaggaggaagaggaggaggaaaagcactttgagagggagagaaggaacagagaggaggaagaggaacgcagtgataaaagagagaaaatgggaaggagaggaggaaaaagggagggaaaagaggaagaagacgacagaagagaaaacgggcatcaaaaacaacaacagcagagagagaaagacaaaaaagaagaagcaataaatgcagcagcagaaggagactgattcgttgttgataagagaatacctaaactagagttcaacctggacagatggactggttttttcctgcgtccaggtccaggtcatttttcggcaacttcgctggtttttttcctttggcatggcttttactggttttttagccaggtccaacatagaatcaaggtcaaggccgtttttcgtttcaacctagattttccttggacttgatttttgtccagaaaatccaggtccaacatggaatccagtggtccacgcgtttttcaaagggtcgaactctagagacaacagtgattgtgagagagaattaaagtgcaatataatattttttatttttatttaaaacaaacatttttgaagtaaaatatttaattaaatttttgaaaaatttcacaatttatacatattttatttccaaacaaaatcctcaaaattctcttgaaacttgtattgggggatcggggcagggaagtgcacacaccacaccattcattaattaagtcacaaaattacgcaccaccaccagctgtttaaggcgcctgctgccgccgccgccgctgatcatttatgatcagccaaccggacaagccattaatttgggggggggggggcggcggataaaagttcccgttttgggtggcgccgcgtgtctcgtgtcattgaaaatttatttgaatatctctgtgtgtatgtgtacaaatttgtatgaattgtatatgacacacacacacaaacaaaatggtggtggtgatggaaggaaagcaaccggaattttaatttattccaaaatttaccagccccccggggcatcattaaattctcttctttgtctgctgctggtcgccgcagaatcccacccatctccgccggcagtggcagtcggcagctctttcggcggcttctaatcctccgccattttcccatattccaattatctcatccattgcattatttttgatcattttctgctgctcctgttgctgtaatactgagcatcatgttgagcaatagcaattattcaaagaataagactgctgctactgctgggtttggccatcgtcaaaggtaattataattaatgagtgaataaccagcacagcagtagcataagaggtccaacgactccaaggagttcaccctctgtcaatcttattttaaaaaaataagaggaaaaaacgcttaacgtaactatgccatttacttggccaattctttcaaaaagaccaaaataggttttatcatcattaccgggatttaattatgaatattcaaaagaaattaaaatctaattttgtcgcgcgcataaaatggccccaaattcgcaccanaaatttgtacgcgtttaaaggacttccacagcg

SEQ ID NO: 11768 - DNA, 1241 bp, Heterodera glycines
ccccccaaatgtggcaaacgcggacttttggaaacttttttgttgtggttgaaaaagaaagcccctggacgaatttgccacagcggttgctgaaggggacgactttttttggtcgacttgttgtcttccatgtagtcaaaaggtgaaaaggtgacttgagcgggtgaggaccgcaaatttggcactttttcccctgcaggaatttgttccagtcgcccgttgataatgcagtcggtgcagatgatggtagccgctgcaaaagttaacttcatgctcgagccggttctccacttttttctcctgtgtcgcctcaaagtcatacacgatgatcctgtatggcttaattcgttgttgcttcaggggttggatgaagcatttcgtgcaggggttcatcccgtcgtcgtcgtcttcttttatatggaattgtttgcaaagtttacaaaactgttccccacatttatgcccaactactctccatgaacgcataatgttataaattaccccacaatcttcgcagcgctgaaatttggtgcacaaatccttgtggaggtggcgctcataacagctgttgttgtaaaaggtgttgttacagtgatcacattttttgatgtatccttgttgtggctcgcagggatagtcaacgcgcccccgaaacgaaaattaaagaaattttcaagaaaagtgggcaaatttttttgaaaattttaagcaataatttaacccaaatggcaaaaattagtctttttttggcaaaaatggctaaaattcctgctttttctccccggcgctgaaaattttcaaataaaactggagaaacagtgttttctgttcaaggtgtggatgagcagcaagttgtcaagcgtgccgatcgcttctattgtgctttgcatggccaacaacaccaaaggctcatacaaaaacagcttcaaaaagtgcgtgggtatgacgacgacgacaatttgatgatgaggacggcacgaaaaatgccatcgttgtcaactccaaaactgtcaaattgtgccatcgccgctcacaatgatggaacagcagcggcgtggaagagaggggccaacatgacgacgacgaggacgacgaacatgacgacaactgttgatgaacaacaacacaatcatagccgatcaagcagttacggtgaaaaatgtagcaacaacagcaacaaaaataatggtggtgatgaacatcatctgctgctgcaaaagtggtgggaacgccggacggag

SEQ ID NO: 11769 - DNA, 2294 bp, Heterodera glycines
  misc_feature (2114)..(2115): n is a, c, g, or t
  misc_feature (2208)..(2208): n is a, c, g, or t
attttctggtgtccattttccggtgtccaatttaccggtcccccctattgctaaatctacggcatatttgtccccgaaagattaggggatgacaagggctggagcgtggacagaaaaacccaaccgctaatggatcgcgcattcaaatcgcaaaaaattccccgcggtttcggattcaaattatcgcagttgcgaatcgcgaaaaaaaagtgccgcaagtcacgggtcgcgcgttgcggatgtgctccactgctccaccctcaagtctcttaactatacacctattgtggctagttcccgatcgcattgctcaactcaacatttggccaatgccttgccaaatttgaatcctcttttcccgtgttggcccacccctgctgctgtccgaactgcttcacccattcgtcccatccgcttcattttccggctccattccgtcgtccgtcgttccatcgctctcttccgcctccgttgtttcatccccatcagttccttccgttttcttcgtccttcccttcgtctccacagggcaaaaaagtgccgaattcgcctcagttttctattgttgtcctttgacgaatgttgagaaatgaacatttgtctggctttttctgctgcttttgtcgactcatttcctataaatttttctaataaaaaattatttattatacaaaaaaaaaatccaaaattttgacccgtgactgaatcgaattttacatcaaaaagagaaaatttatatatattgtaaataaataatttttactttttgatggaattcaataaaacaactgaaatggtaaattaaataaaatttatgaaactagaaagcaaattcaaaaactaaaaaataaataaaattattggggcaattaaattattattaaaaaattttccgattccttttggtcatgctccgacaaaggcttttggctattttcttaaccacatccagcaactaaataaaactcactttccgcccatttgttttgtctgtgaagctgttgttggtcccggctggaccgtatcaatttggccaagcatttggccaacttcaccggacatattgcctcctttgactcggccacacactgcttgaacaacacttgttcaaccaatggaacagtgtccatgagagtatttgccttggcctttaaaaatcaatgctttattgaactgttgggatttttaaattgcgttaaaaattaaggcgcaaaattttcgccgcggaattttggcaccgtaaaaatttcaggtattagacccacaagccgactttgtcaaatttgtatcgacaaaaaatccctcactggcccctaacaattttataacactgtactttaattaccctcaacaaagccatcagtgcagtacgacgaagaaaaatatcaattttggccggatttagctcaaattgatcgggaattgtcgtcggtatctgggaagaagaggaggaggaggaggatgaggagtggtgcacaaattgaaaaaggatgacactgatcagtggaaggaggagggcaaagttaaatggcattcagcagagataaaagtatggagagaagaaaacaaaatggaggaagtgatcaggaaaggaaaagtgattggaagcagcagcagcaagaagagaaaaagcttatcctcagccattatttgtctcgcgtgctcgtggcagcagcagcagcagcagcagccgaataatccaaccagtctgatcagtaaaggggggatttttttggatcaccggcgaagaaattgtgatcagaagggataggatttttttggatcaccggcgaagaaattgtgatcagaagggataggatttttttggatcaccggcgaagaaattgtgatcagaagggatgggatttttttggatcaccggcgaagaaattcaaactactaatgaacgagaaaaaagtgctaagaatgcattcattttcatttggttatttattggttgatggtcggtcattcttctgtggaaaatttattacggagtatggcgtaaagtaaatgttaattgtactaatagaaccgataaaatccaattaagtcaaagccccaatcaatactgaccaataaaaaaatgaatgagaatgaatgaatggaattgnnggtagtttgagtaatttaatcctataaattgtacaaatttgttggctaattccaattgatattgaattcgattttattttttattgaattttnaattgtttattttttcattatataatccccactaaaatatggaagcaattatttttatttttgttgctgctgatcaaaagttgatt

SEQ ID NO: 11770 - DNA, 3159 bp, Heterodera glycines
tgcaaaaattctccttttccatcaaaacttatttattaaagaagaaattaattttatttaaaaatttttgagcttcttttatgtaatgataaactaacagttttcaacaaaaatcttaaaaaaagattaaaatagatctctatgagaaagaattgcctgagaaagaagcaagagaatctaagagattaaatttttatttcctccaactttgctcaacattttaatccagacccccattcttaccagtgaacttttggacccggacctaccgggtcgggtaccgggtattggattttcaaaaaaccgggtctgggtcctggtattgaaaaaaccgggtatccgggtctgggacccggtcgggtacccggacccggcctaccctagtttttacctcaaagaagcatcaaaattaaaattgtttatttggactcatgaccaaccaaatttttattcttgacttaaaggctgacaagctacaaaagtttttcttttttacaaaatacaatttcgataaataaatttaagtttatttttcaatgcgataaatgaacataaagattaaaattggactttaaaaaaccaaaatttaaaaaataatgaaaccaaaaactcaaaaatatttaaattttcatatttcttagattttttttctgtctatatatttccagtttattatattaactttttaaataaatttataaattttttggattaaattaagcccataaatttgattgccacattaaaataatgtaagcctttttatttgcttcaacacctcccctcactcgtcccatgcttaatttgttgtatccaccgcttcacttacaaattagcgcaactaaaagcacttcccccagcaagaacagacgacctcccataaataagtgaggcaaaaaatagcgtcgtccatcaaatgggcagagagtgaatgggcgggggaatctccgtgccgccgacggggaccggcgggcgggggcgcttggaagtaacacttttgtcgcggcgacttcatgccggccgacccctttagatacgcttcatcgcccagcagcagagcaaaatatccgttgcgcgatgaacgacgaccatttttatccggagggggggggggaaggaagctgagggaatctaattttttttatgtgtcaattttcgcggaaactcaagcaaattgtgaacacttgactggattggaactcaatggacgggaagagggagggaatggaggagaggaacggcgggacgggcgggggggaaggagggggaggaagcaactaaatttgaacaaatttcaacattggatgatcgggtgggtcaccaaatcaaaaactgacagcagcaagcatttttcaacactcaccacagcttcgtacatcagaagagcgagcaggaagggcgatgatgatgaagactaacaaaatttggctcattatatccatttttctgaggtattaacttcttacgggggattagcaatatctgtcgccctccctcatgaagtctctctcgttcagcccctccctgtatgatgatgccttcggggcatatgtatccatcccaattatggggtacagcttcaatcgacaaaagtccttcctccgcccccgcccccgtcgagggtttactatgccttgtttttcgtgtcatttcaagagggggatgaggcgggggggggatcgatgaccattgtgtgttattgggtgggtggttttttgtttgaaatgtgaagagtgtgaagcgggggatgggggcggaagacgattcaatctcctgctgccctttcaacaattatgtattcgtcattccattcatcatcactcctgcaattccttaagcaaaatcccgctcatttgtcacccaccagccgctgaagccgttaaatcacagcggccctcacagatcgtcgtacaaaacgcaaatttttatataaatttttgaagcattcaaaaaaaaggttacattaaaaagtttaattggggtttttttgaattctcgctcacgcacgaattttagtaaaaattatgcggctttttcaagtttttttttcataaaaacattcgaaatgggaaaaacggttatgaacccagacattgacaccaattcctcccccaccaccccagcaggagaaagttgtacattcaatacacccgcaaaatcattccatcggacgctttgtcgcctcaattatcttatgcatatcacagctcattgagttaatttgattagacatatcatatcgggttgggggggggggcgggagtggtggtgattggggtgtgattttcccctttgatcccgacagaagatcattatcatcatcataattatcatcaccatcaaatccaaatcttagagtgcagtttttctacatagcatattagcatgccccttattcatcgccttctcccaaattttcttgacacataattcccgccggcaaaacggccgcttcattccattgaaccgcttcattgtcacagccgccaaatgcctccggctgctccactgatcagattcctaatcagtcgtcgtcggcttatttcggcatgaacgcctttggaagtgtgttcaagtggtgtagttcacacatttatctgccctcataatcgtttatccctcaaaagcctcacccaattaattattcattactcatatctggataatgagcaccacccaccgcacttcattccactttattattcggttcaaatctcgttaaataaaactcaatgccaccaatcgcccccacccaatttttcccattcccatcaatcttcagcagctttatcgtcatcattctccatgcttaaatccagctttttatcatcagttcacgaaattacccatcccattctcttacatactttgtcattctccaactttccatttttgcacttcaatcatcagtagggcatccaattatatggaaatccatatttttttcctggactgtgggaggcctgaaacgcacgaaaaacatgtttttagcttggtttgaagcttctaggatgggtttccatatccatatttttccatatttcgcgatttatgtccatatttccatattagtccatattttggcatttaagtaatatttccatatttccatatttgtccatattttggcatttaagtaaatattttatgtccatattt

SEQ ID NO: 11771 - DNA, 1203 bp, Heterodera glycines
cccccatcgttttcccccaacaaatttttttttaaataaccaattaagaaatttttcgaaaaaaattttttaagaaattgcggctctagtgcactttatgagtccaatcgacttttatgagtccaatcaatggtttttatacaataactttgtttatgctcgaacaaaccctatctttttggtatcattcgaaagtacgaagtctaaataatgtaataatacgagaaaacaagaaaattctaacatttcaagaaagttacaaacgaaaataataagtatttacttaaataatcaaatcttttttggtaattgcctaaacgctgcgattttatatattttagcttcgttagactttgaattttcttgctaaaaaattctcaatatttttttttttttaattttttgaaaattctgttaaaaaattttctttaaattttcttgctaaaaatttcaaatggtctttatgatgtgtcggaatttgtttttgtttttagccattccgtacgatgaaacgccgccgcccaaatttgtgtacacattccaaggccctggccgcggtcggtggaccttctcgtgccaattcacttctgccgacgcgttggacctgttcaggaaggggcacggaatgtaccagacaaagaaggacggatgccgctatttcttctgctcagtgaagcgatgcccgtacaaaatgatcggcattgaaaatggttggtttattgtttttttcttttttgcaatttcaatttgctaattagtatttaataatcagcaagcaaagagcgtttcgtttacccttgggaatttaaaaaaatcagaaacataaaattttcagaaattttcgtataaattttaaggaaaaaaaattttgtacattttttttttgttgaaaagcctagtaattttttttacaaaaattttctaaaattttcctcaattttttcttgattttttcatgttttaaaaaaaaattctgttgtgtgaatagtgtcgaagaggtcaaaacattgtggatgttgcttggaccattttttctcaccaaattaaacatttttgctgttatttgaaagaactaaatgcctaaacgctatcaacccgcaaaatttaaaaattcttcatttaaactttttctggccattttgtccatagattttttgggggaataagaatgctcaatttggataacaacaaagggcttggtct

SEQ ID NO: 11772 - DNA, 766 bp, Heterodera glycines
catagccatttgatttttcaggccattcaatatctcgtgagtgcgctcaaacattcccccaacaatgtgccgtgacgctttctcaaagtgcccccctactgacgccctcccaccaatttcggataaaatgcagaccaaatcgtcgtcgtcatcgcccaaaaagcaacaaaattcgcccaaggccaatcgtccgcgcattgtgctcaaacttcggtggaatgccggcggttttttgcccgaccattcgccgaacgattcaacagcagcgagttcttcgtcgtgtactgctactgcagatgattgtgccaacatgaaagtgccaaaaagcgaaacgcaaccgccgctgccgctgccccaggcaaaattgttcgagttggccatgtgtgtgcaggaaatgaggcaaattgcggccggatggaacctgttgttcagggagaagcggtaagatttttgaaaaactcaagaaataatatcagaaaattcaaaaaaaaattttcaactctttttgttttttttctggaaattcagcaaattgggttttcagtaacgggtgtacttacattttcccccgccggtcccccccccccgcatcgtttccgcaccggaaaattaaaaaaaattattctaacctagaaattttttaagaaaaagcccttaggaaattttttataagcaaatttcaagaaaaaaaaaatttaaaaaattttcagccaatcttgggaaatttttgcgaaaaacttagtaactcaccataaaattttgaaaa

SEQ ID NO: 11773 - DNA, 1364 bp, Heterodera glycines
taatttaattttattttattaaatcccgaattaaagatggatgagttcctcgcgcttcggctgcgcaaggacaaaatacagcgttggccaaaagagctcggccacgcgacgatcatgcgactcgcctgcgaacaatgtgctcggctgtttgcttcttcttcctgactgtgccgagaaaattgatcacaactgattggaaggaaaaaatatgtgaaattttgtcaattttagaattgttagtgttgtttttctttgtcccatttgaattttccattaaaattttttgtttttatttatatattatttatttcatttgaagtacgccgccttaaaaaataataaaaaatgccaccttctaaaaaataatatatgtagtatgtagggctaatatttttttgcaaaagcctattttttcctgacagatgagctccccgtggcctgaaacgcacgaaaaacatgtttttttgggctgttgttaagctacttttcgagttattagtgcctattttctaggcttttatttttagagtctaaaagcctaaaaatttttgaaaaaacctatttttgcctattttgtcgttttgtccaaaatttgttaacaaaaatgcaataaaaacgaaaaatacaccccccaagaatcggcctaaaaatttttcaaaaaatacacccccaagaatcggcccgaaaattttcaaaaatacacccctaagaaatgaaaaatttttcacaaaaatcgtcttttaaattttttgaacaaatttttgaatttaaaaattaatgtaaactgatttgacttattttttacatttttgaatgaattttgttattttacaccaggggtgcgatcgaaaatttttcaaaatcaaaacatcgggctcaaaaaatcagattttggggtcgaaaatcagaacattttgcggaattgcttcaaatctattttttagcaaaaatttatcaaatattatatttttcgcctccaattatcgaattaaacaattttggggaggaaatatgcaaatcgttaaatttcagtcgggatcaaaaaatcagatttttaacattttttttgcggcgtatttttcaaaaaaaaacttttggggaatgcgagaggggagagggtccgacggtgccgataggcgccgccggaaaatttttataatttttaatgcgaattgttaacagatttttgtctaaaattggccaaattttgcctaaaaccttatattttcttgataaaatagttacattatgccataaaattttaaaattatgaggttatttaagaaaccagaacaaattttggtcgctaccccaaaatcagaacatttctgataaatcggaacagatcgcagagcacttactgc

SEQ ID NO: 11774 - DNA, 4499 bp, Heterodera glycines
cggcgaatcaataaaaaaattgagatgcaaaaaagttttccaatattgaaatggagtgaaatatagaagaaaaaaacacctttttcaccgtggcaaaaaaaaatcagaaaaaatatttgttttttcaattggaaagggattaagttgtaaaaggtagtgaagagcataattttaaaaaaagtcaacaggaatttgttaatttcccaaaatttttgggctctgatgggggaggagggaagtcaataggtcaaaaggagttcgaatcaacccacctcatccctcccccctttttatgcattgaatagactgaccacgtgtcggttgtccgtcgacgtgaaaaatgttatccatcgcattttgtgttcttcttaaatagaaaagaaatgaggaattcttctaattgtaagtcttctgccatttctcgccttaccaatttctgtcgtgtaaattacttcggaaaagcaaacgctaaatgaaaaagagaagcatggaaggagaaataaagtaccaacagcagcaatttcagaatttccgttctgttcgcatcgtaaacagcactttgcggtgttttatttgcaaatccgacgccggactgccaaatgttctcacaactgtcgactttggagatgttttccaagtgctaaacaatgcaaaatcggcgaagagaacgaaacttgcaacttgaggacacttacaatgtttttgtccaaaataccaatggtaaaatttggacaaaacaaaaggtcggagagagccgtgaggagcagtttcgaaagaggtaactctttttggctgtcgtttagaccggctttttcatcttggggaagatttgtccaaaagaattcgcgccactcattttgctcaaagaaaaatggcatcagacgggtgagaagccgaatacaattgagcatctgaagaaactcatatttaacagtccctaatttttaatgaaaagtacgacttttctgtgctctttttgcgggggattcgtctgagtggctcggaccaaaagtttcacggctttataacacaaaatagaaagtgcctgaaaatcaaaaattaaattaaaattgtggtaataaccctgacacccaatttatttcattgggaactctgaacggattcgaataaaaagtaaatttaaattccaaaaaactccactttatgaaaaaaataaatctttttttaaatattttcgaaaaataagtaggggtgattagtagtattacaaaatcttttgattaataaatctaacagacatttggttgtccgtctcgcagatcacgaataccggagggttgtagcgccataaaaaggtccttcgccgtgttaattggaagcaatttttcccagtctaattcctctccggtggtcgaactcttcgtggttagttcgacgacggttttgccaaattctccttaaattccgaagaagcatttgttgaacaataattgtataccacaacatacccaatgaagtttcggtgttccccattgttgtttgttgttcgtaaatataacttttaattggacgcttctaaaaaaacaaataaaatattaaaaattatggaggcgttggctcttatttcaaggacctaatcagattcttagaaataagaagaaatggcaacaatataagttttttaagatttactttttagtcgaggttttcggaacgccaaacaatgttttcatcgatgttttgaattaattcgaatatggatatgaactgcaaaatacagtcaaaatttttctaaattatttttaacgaaaaaagaacctaaatcgaaattttacacttttatttttgacataattaaccaattaataatattttcgcgtgcgaaaaccaaagccaatcggacaaagtaacgcgctgtctccataaaaccaaaaagtaatatgtacaattgcattgaaaaataaaacagcaaataaaaaattaaaatggcaaaaaaacatgagatcagttcggaaaatggacaatggccattgggcgatttcttttctttacaacgaaaatgtctaaattggtgtttatttgttccatcatcatgtcacattatcccaccctcattattcgttggtcgataaaacttgtcgtcatatggccatccgtcgttgatcttctcgaggaagtactgctgaaaggccttttggcttcgtctctcttccgcgtcttccctctctttctcaatcgtttctttcaatgcttttccttccgcataatcttttcctggcgccctctcatttttggccattatattctccattttgaccatttgttgagtcgacggtatttgtgacggtggtacatcaacggaaaaggcagaaacggattcttcctgctgctgtacaaccgaattgttggtgtgctattgcggtttcaccccaagtgctttcccttgagataagtccacttggatacagcactcctttcgttttgaacaaaaattcccctctcccctcaagctcagagcactacagtatattttacagtatctttccactacttacaggaatgtctgtttcatttgggtctgctgttgttttgtgagtcagtgctgggtaattgcttttggactcctttttcaccgttccgactgattgtatttgtgcactgctttttcttgccaattccttctgcggtttgaccctttgtccgtcgcccttttgtccgctttttgtgctcttttcggttcgctgcttttccccgctgtttgaaatggtcacttcgccgctcacttgcgttgttaaatgggactgaatgggttgcgacttttcgttctcaaagcgttcacaacaaagcttcatcgtcgcaccggtgtaacaaaacattttcggcttaattggacaaattagccatttaaattaactcaaattaaacatttctttgtgcgggttgattggcttgccttacttcaaaacattcccttttggtgcccaattggccacaacccatcgccgtcccctcggagttcaacacactgaaagaaccctccgggcactcctcctcaatcatttggccttcttcactttccgtttctcgctttccgtcttcgtcgtcaattaattgttttatcatattatcaccgtcatcttcttcatcatccgatagacttggacagcactgataattaaagccggaaaagaaacacgcgtggccaaagccacaaatcgcagaagatgaacggcgtcctgcgcaagagaaggcaattcgacaaatgaattaccagatgaaattagttagtctgctatttgattcattaatttgcgagtctaaagagtcgccagcagggcattccccgccgaaagaattaatgaataaattaatgacccaattgacccggcaaacactgcaacggtttcccggtccgttcgtccatttttggctctcctccatttggacaattaaattggcctccgaattctgtgtaattaatgagtttttaatctgtttgcatgttcttttgtgattctcacccgccgaagaaattgtgaaagaaatgaaaggcaaaagaaaggcgaagaaaatgcaaagggataaaagggaaaaacgcatcgaaaaaagggacggggaaaggcaattagggataatttatcagcaattaaaatgtagcggctttttgaattcctcgcaatcatcagaaagcaacatacgaaagttgcttaaatatgctttcaatcagttaagttttgttccaaagaaatgtccgatcccttttaattgaagcgacggaagggcgggcttttgctgggatttgaccgcccaaaaagagaaacaatgcgcggcgcgcccaaattagagcagccaccaacggattagaagaagcaaagcttaaaaaagtgaaggcgaccgacggacgctcccgctgttatttcttttcacggaggttcaaatttggggggggggggcaaatgaagaaaatggttggattaacggaggaaccgaccgaatggaaagcggcgcctttgaaatataaaagggatttgtaaagcaaaaaaacattcagtgatgaaagtctatgggcaaaaggcaaaaagcggcgagagaaagtgaaacgaatgaaagcggacgaaaatgcctgagggcaaagctttggggctcatatcgccggtcctcccatccctcgctgagcacttccgccactctctcccaacttccgttgctttggtgggtcggctcaacgccaagaatgttcaggacgagctgaagcacaaatggaaaagcgatcatccgaccaaaggagggagggagggacctggtaaatgtccaccacctcaatcggttcgcttttgtagtccgctttgaatgcttaattaattagcaattccaactgattattattggcaattttacccggtcctcttgccatgaaaattcctaaaattctttttttacataaaatttggccaataaatgtgccctttcccacccttctgtccccaccttgcattgcttcgtgttcattttcccatccgtcgagcattttccatttt

SEQ ID NO: 11775 - DNA, 846 bp, Heterodera glycines
agtcgcgccaatggaaatgctcggggagttcgtgcctaattgggacaattatggaattgtcgttaattattattattattttgagtgccggtgccttctgtaaacattgactaaaggtgccgtctcttcattttcgtaatcgccgacgaaagcccactgatcgcacactttaagttcgaagaaagttgtgtcctgaaggaaggggtggcacttatacaataaagggacattggacgaaggacctcttccccgtcgatgggccaaaccatggcaaatgccaacgaattggccactcgtctgaccatggaggggtccgccaaacactcgtcgatgtaaaactggtcctcctcctccaccgccatcagtccgtggtctgacagcaccaccaaattggtcgactggtgaaggtccatcgtgtccaactcctccttttgggggatgagtgcttggattagttgagttcgccaaatcacttggatctttcgcaggtaattgtcgaccgtggaaagtgcttgtcgtgtttgacttgacgactgaccgcccgagcgaagtgcctttgggaaaatgccaatgagtaaaaatatttgccagaattcaatttttgtttttttgccatttaccttgtccaatccattgtatcgtagaaggacaagctgaaaatatttgatcaaaagtagttttaataagttataatcaattaataaatgacataatccaatcaaaaatatttgttaaaattcaattaaattccagatttattcgcctgttgtctgtagggctgatattttttgatatgtttgacaatggttggcaaatgcggcagcagatcgatgctattggaattgt

SEQ ID NO: 11776 - DNA, 884 bp, Heterodera glycines
ttttgagttgggtaaacaaaggaaaaaaaaattaagacgaataaaatatattaaaaaaattatcgaaaaaagtcttggtatcattaaatggccctttaggttctctatctacttaaaatgtttccaaaaaaatatgagcaaatattgtaaaaaaaaatatttgtccaaaacttttttttgattcataaccaaattttttggaattttgcaagaaaatagagaagcttaaaggctatcgaatgttttgtaatcctcaaaaagaaaaataaggcctagcttatggatatatattgtggaaagagtttttcttttacatataacctcaaaaataatggattcttttcagcttccggcgacacatgatgcccaatattttagaagcacaactgccaaatgactattttttctatattttacgtctttttgccgttaaacttgaccaaaatgcgaaagaaaggcatgaattgaaaaccagaaatttgcttattaatgaaattttagtctcaagactagtcgccctgggtgcaaaattatcacagaggcaggaacttctttcctgaatgcctataatgaaagtgggtttttttaacaatgaataataattttaaattttaataattaattttaaaagaactgggattttatgttgcggtttttacttgttcaatttcaaattaaacacttaattagtttccaaagccctttttcgggacgggattccgcaggcattacttatcaaatttgcgggtcctgctgcttcaggtcaatttagccgatttaatattaaaaacattaattttttgaaaaatgcaatatacagattttctaatttttcctaattttccccagtattttgggtgctttggcttttttaatcatattta

SEQ ID NO: 11777 - DNA, 929 bp, Heterodera glycines
catattttttctcttttaattattttttacctgcaacaagcatcatttagtaatatttttaatatttatgacatgtggttttgagttcgtttatgatttatttttaaaccttttcaacccaaagaatttcctcgtatacgactacattttgcgctctaataattattgtcaattcttaacaaaatcaattgatcaatgttttcgttattttagcgagtggttttgggctaattcagaattttttcaaagttacaggtttatgcataagacggctacatatttttttctcttctaattattttttacctgcaacaagcatcatttagtaatatttttaatatttgggacatgtggttttgagttcgtttatgatttatttttaaaccttttcaacccaaagaatttcctcgtatacgactacattttgcgctctaataattattgtcaattcttaacaaaatcaattgatcaatgttttcgttattttagcgagtggttttgggctaattcagaattttttcaaagttacaggtttatgcataagacggctacatatttttttctcttctaattattttttacctgcaacaagcatcatttagtaatatttttaatatttgggacatgtggttttgagttcgtttacgatttatttttaaaccttttcaacccaaagaatttcctcgtatacgactacattttgcgctttaataattattgtcaattcttaacaaaatcaattgatcaatgttttagttattttagcgagtggttttgggctaattcagaattttttcaaagttacaggtttatgcataagacggctacatatttttttctcttctaattattttttacgttcaacgagcatcatttagtaatatttttaatatttatgacatgtggttttgagttcgtttatgatttat

SEQ ID NO: 11778 - DNA, 2690 bp, Heterodera glycines
  misc_feature (53)..(53): n is a, c, g, or t
  misc_feature (2674)..(2675): n is a, c, g, or t
ggcgacaaaaaggacgggtgggatttgaaaattggcaaaaagaagaaaatttnggcgaagggcctggcgaaatgggcgcaccgctgctgcttttggaggagcacgaggcgaaattgggcagcgaagacatgaaaaagtgtgcattttatagacttgggtatttaatctttctcttagccaattacaaaacattttccattttgaacggcgcgaaatgctttccagcttttgtccatttaaaaatgtcattcattcatccattcttcctccctgaaagatggtttatgaatgtccatgccagcgacaaaatttccttagaccgttcgctgcccgactttcgcttgtccgagtgcaaaggcattgcctatgagctgagtttactcccccggtaaatatatttagggtatttgcactccccaattcatttaattgaagtgcttcggtggtgatcatcttcaccgacgaagcctggtcaccgctgatgagaacggtgcactccgtcgtcaatcggtcgccgcccgaactgctcgaggaagtgctattggttgacgacgcaagtcaaaggggcgagttgcaggaccaacacgcaaatggacacgctttgagttctcttcagacgaactcaaggacaatttggacgcgtacatccgacgatttggaggcaaagtaaagcttttgcgcaagacggaacgccagggactgatccgcgcgaaattgtttggcgctttgcattccaaaggcgaagttgtggtttttttggactcgcattgcgaagcaaccgacggatggtgcgcttttcatttaatatgccaaatttgacgaattctgctcaaattcaccctttccctgtgccatcatttgccattcgcaggttggagccgttgttggcccgaataaaggaaaagcggtcggccattgtctgtccgtcaatcgatcacatcgatgccgaaacactttccttcagcggctcgtccgaactcggctccattgggggcttttggtacgttgtgcactttctgtttgcctcatttgccccccccccttttcaggtggagtttgcattttcggtgggatcgaatccccggccgaattctcagcgtgcgaaagtcgagaaccgatcccattccgttggccaacttctgtctgtttgcttttatcatcttttcttcacttttagctcaccgacaatggccggcggactattggcagccgatcgcaattatttcctggaaattggcggatacgacccgggaatggacatttggggaggcgagaacttggaaatctcatttcgagtaaattcccgtcctttggctataaacagttgcatatcgttcttacaattagaataattctggtcatatgcaaaatacaaaatcaatgttttcaacataatcggaattatttatattgaaagatatgagaggaaattggcaaggcctccattcttcgttcacatctttttacttcccctgccatctctttccatctaaattttcaattcacaatcagcatcatacttaatgcaaatgagccaatttacaaaaaataaaattaaaaatgcacaaaaattaaatgaaataaattaaatataataaaaataaatatttttgaggtgtggatgtgcggtgggtccatcgaattcgtcccctgctcccacgtcgggcacattttccgtgccggccacccgtacaacatgacgggccctggcggcaacaaggacgtgcacggcaccaactccaagcgactggccgaagtttggatggacgactacaaacggttgtactatttgcaccggagcgacctcaagcacaaagacgtgggcaacctcgagggacgaaaagcgttgagggacaaattgcgatgcaaaagcttcaaatggtacctggacaatgtgatccccgagaaattcgtacccgacgaaaatgtgaaggaatacggagcggtgagggaaagaaatgggcattatcatcaggcattttgggatttaagttgcgaaacccggagagtcaattgtgtctggacacccttcagaaggacgaatcgaacaccattccgttgtttctgttccaagtcggggggaagggaagggtccgcccaatgggacactttcttccatccattggcatggattaatttttaaaaattgtttagtgtcaaggcggtggcagttcagcacaggtgaaaattgccatgagaaaagtgtatccaaatttccacagatgttttctctcgctaaaaatcagcaaattcgtcgcgaaatttcgtgtgccgttgccggacaaaacgacaaagtcgagctgagagtttgtgccgaagaagagagcagcagacaacaaaagtgggacttaggaaaggtgagttgggcgaatggcaaagggcgaggggtgccatcgtccgtttgccttgccaattgcgtttggtttttgcttgcccttttgtgccgattcgtcagtctgtcggtcccttccaaatttcgtctgtccctttcccccctctcttttttgcgtcgtccctctccccctttactcatttcctctcctttatttttccccattgtctcaatttatatgcaaatgcctcgagaattgctcatcaattcgcttttccctttcgcttcttcggggggggttctcattgtcgggtttcaatttattttaaatttctccgaccnntgcaggcccatgcaa

SEQ ID NO: 11779 - DNA, 2454 bp, Heterodera glycines
  misc_feature (89)..(89): n is a, c, g, or t
ggctcgaaagagcagtccgctgcggtgccgcggattacgctgaagacggaagtgcggagcaaaaacaaagcggtgaccgtcgttaaagncctcaccacttgcggtcagtcgcccgggcgaacaaatcgatggacaattacaacaacggttttgattgacaaaaggtgtcgacttgaaaaccgcctccaaattcttcgcaaatcgtttcgcctgcggctgttccgtcaccgttggctcagccgacgaattggtcattcagggcgactttaaggtgaaagtgtgcagcccttcccacacattgccattttgttgattgaaggacaaactcttcgtagaaatcccgaagaaatggggcgtcgatgaggaagtcattgaggatttggacgaccaaaagaagtgaccactcccctttcacactgcttgtttttactttaatttatatactaattcattgctttgttgtcgtgccgaaaagataaattttaattcatttattggttttccattaattatggcgtttaaattacgcggttccaagcgacctaaaaacaatgttttactcgtccaagtgaatgtttggggcaacatgtaattaattttggagtttctcttatggaagtgccttctcatttctcaaggattcctctcccatttttggcatcgccgcgacaacgccgccggcggaaaagcgaaaggtgccgatggcttctcgctttgttcctttccgtcgtattttttgccatttacgtccttttctatgcctttctgagtgggcggcagcattttggcactgattatttttccgatgggtaatcgtaaattcaaattttgttgagtctttggcataatgttccttctcttttcccctaagtcaccctttgcctgccgaatttgccctcatcgcttttcctgttgacgaacattctctggttggccccgatggcgagtcgcctctgttcacccaccgaatcggcaaatcggcgccggagggccaaccgggcgaaaatggcgcggcagtgacactgacgggggaggaggcggctgaagggcggcgccaaatgagctactggttcatgaacgtcaaggcaagcgacaaaatgtcgctggaccgcgcagtgccggacgtgcggccgtaagttgacggagtcgtgccaaaaacgcaattttcggcaattttgaagtttaggtggccggtaaaaagccaaaaaagtgaaccattttaattttataatttttttgtaaaaaaacatagttgattaaaataaataacacgtcattgttcaacgactctaaaaatagcaagttgaaagggttcctctttgggttttcactgggccacatgaactgaaaaagtgccgaattctcttttcggccaatacgattatagcaatgcccctgatcagcagcagttgatcacttctctttttccaattcccccccccccccaaaggaacgcctgtcgctcgctttcctacgatttggccaatctcccttccgcctcggtggtcattgtgttcactgatgagcccacttccgtccttttgcgcaccgtccattcggtaaggtccccattattttgtccaaatttcttttccattttaggttttcaatcgttcgccaatgtctctgctgcgcgaagttgtcctcgtggacgacttcagtcagagaggtctcccaaatttgattcttttcagaaactcattctttctttcttccagaggagctcaaagctccgcttgtcgcccatttgcgtcgcttcggttcgcgcgttcggctctttcgagcgaacgaacgtttgggattgataagggcgaagatagtgggagcgaaatacgcccgcggtgatgtcgtcgtatttttggactcgcattgtgaaacatcgccgggatggtcagttgggggagatggagaaagaagagataatgaaaccacagagacaccagcgagagaaaatgacgacagttagagagtgagacagacaaaggggaggacagagtggagtgggagacaaaggggaggacagagtggagagagagagataaagaggaagacacagtggagagagagagagttgagggaggagaggtgtatgggagagagagagagggaggggagcgacagatgcgtatgggagagcgcaaaaggaaaaagtgaccaaaattaaaaaaaggctcgagcctctcctccatcggatcaaagacaaacggtcggctgtcgtttgccccgtcatcgacatgatttctgactcttcgatgcaatactcgggcggatcagccgctggcattggcactttttggtcagtgtcaaaaagatgggccagggagcattttctatagtaacaatcttcaggtggagtttgcatttcaaaatggaccccatcccggagagagtggcaaagatgcggaaacacgcggaccatttggacagcccgacaatggccggcggactgtttgc

SEQ ID NO: 11780 - DNA, 4236 bp, Heterodera glycines
  misc_feature (3939)..(3939): n is a, c, g, or t
  misc_feature (4049)..(4049): n is a, c, g, or t
  misc_feature (4213)..(4213): n is a, c, g, or t
ttttgatgatcttatgttgggcgttcggagaagacaaaatgagagcattgatgagttggctggaagaatttctcgcctagtaaagagtgcttatccgggtttgaccaacaatttgtgcgacgaatattcgatcaaatttctgatcagatcgatgggaaatcccgatcttgcgttaaatttggaattaatccgcacaccgggaatgactcttgatcattttgtgtcactagcagcaagggctgaatcgacccaacgcgccgcaaaacggttcagtacacacccaaatgatggctttcaacagcgcgagcaacaacccaaatggcgacaaaattttggtggtaactcaagccaaaacatggcgaagggtcaaaattttgctggaaacataaatcagcacccccagcccaaagaagacacaagaaatcaatggaaatgttacaattgtgatgaatttggccacctttcacgcaattgttcacgtccaagaacttttatgcaaaaccagccaataaatcagcaaaaaaactttgttgctactggtgcgaaccgaactcaaatccaacccccaaatcagaaccgaaattttcaaacaccaaaaccaaattcagctaatttcctaaagcaaaattgtttggtggtccagcgtgaagaggttttagccgaggcgagggtaaacaaaattgagttggcaccggaagtaagtgaattttatgaaaaattagaacggatcaccgaaagcaaaaatgaaatttttttgccaacaattggaaaggttatgtcgttgaaacttgaagtgtttggcacagaaaccgacgcaatgcttgacggaggcgcacaaatctcattgattagtagtgattttctgcataagttgctgattgagaaagcgattacgctggaaacattggagattttcaaaacgaaaacccaaatttttgacgtaaacggaaaactagtgaaatgtctcggcacgattaaattgcctgtcaatcgtcacggtttttatgaaccggtgaccattcctttgcacatcactaatgccccaatggtttcggtcttttaattcggaaccaacgcacttcaggatttgggatttaagttgtatcgatggacgaaataaggcactcggttgaattcgaaaaagttgaacctcgaaaagaaagaattttctgacggtcatttatcggacaataattgaggccggcacagttaagaaatttagaattcagcattaacactcgaattcgaaggacaggaaatggtcgttacttcggacgaaacttcagcaattcgtggtagaaaccgaccataggaatccccgaaaaaggaaaaatagttggtcccagtggacaaattcattcgtttttggccattactctggtttgaaaaatcttcgatcggaaaagtcgaacgagtgggactcaatcagtgagactggaaaatttgttaagtagcccaattattcggttccacgaaatatgaacaaaatggcggcccccgaatgttacgagaaattcttcgaatgtttacaagtcagaattggtcaactgaacgaagcgaacgacaaagaagtggggaaaatgatttgcacttttcctgaaattttcgctttaagcgatgatgactggaagcagacaaatttagtcgaacaccaaataaataccgcggaaaattcgccagtaaaaatgaaaatgcgcctggtcccatacgcttatcgcgaaaaaatagcagaaatgctccaaaattatttggcaagaggcatcattcgtccgtctatgtctccatgggcaagtcccattgtgattgtcccaaaacgtgatggaacgttacgtttttgtgtggactaccggggcttaaattcaatcacccgcaaagatagttttccactcccaaacatcgacaatactcttttaatgcttggaggacaaaaattcttcagcactttagactttatgtctggatattggcagataagaatggatgaaaattccattgaaaaaactgccttttcgactgagtacggtctttacgaatttacagtaatgccatttggtctaaccaatgcagtggcaactttccagcgatttatgtcgcgtctctttgagggaatgattaatgactttctgttcgtttacattgacgatattttaatcgcatctaaatcctttgatgagcatctgaaacaccttgaagcggtcttttctcgagttaaagcagcagaattaaaactaaaatttgaaaagtgtaatttttgcacaaccgaattaccatttttgggccacatcctcacaagggaagggattaaaatggatgcggataagctaaagcctgtgatggatttgcctatgccaacgaccaaaaaacaactccattctctgcttggttttctgacttattatagaaaatttatccattcattcggcacgattgctgctccgcttttcaaattgataagcgaaaaagctgaattcaaaatcggagaacaggaaaaacaagcaatcgaagaattaaagtcaaaaatcattcgagatgttgtgcttcattttccggatttcgatgcagcacagaatgacctaactaggcagtttataatcatgactgatgcgtgtaagaccggcattgcagcaattttatgtcagcctgatccggagaaacagattaggccaatttattttgcctcaagacaatgcaatgtccatgagtcacgctacagtgctaccgaattagaggctttagccgtcagatttggtgtaaaaaagttcgcacaattcatcactatgattccgactcgggtcattactgaccataaagcactaatttggatgttccggagtaaaaatgagacaggaaattcacgtgttgaccgttggcttcttgagttaagctctcgtttcatcctaaaggtggaattccaaccaggaaagaaaaacataattgctgatgttctatctcgttcgggaaaatcaaatgagagcgtcactgaatccttacaggaggaagacattgcctttattgggaaagttcgagtttttgaactcagtaataatgtcgaagatttcaatgaacaccgggaaaaatggatcgaggagaccaaaaacagcgaaatgcggccaatttatgagtttttggagaaaaaaattatgcctgctgatccgcgaattcgacagagcacaatggacaaatgccatagatttgtgttaattgagaagtttttgcatctttgtgaaaatgacggaaaacttagactctttgttccattatcatttcgtgaaaatttggttaaagaacggcatgaaggaaagtgttcgggccacatgagcgccaaaaaattgtataaacaattggcagagttatatttttggccaaacatgttttctgattgcattcatgcacataatgcatgcagaatttgtgcacatacccgaaatgcacgttcaaatgaacctcccttaaaagtagttcactcatcagaaccattggaattggtctgtatggacattttggacgttgggccaagtcagtcaaacttcaaatatatttgtgttatcatcgatcatttcaccaagtacttggtcgctgaaccaatcccgaataaatcagcagattctgtagcaaaagtatttgtcgaaaaatttttgttaatctttggaacgccgaaaaaaattcattccgacaaaggaaaggaatttatgaacactatttttaaaaaaataagtgaaattcttgggtttgagagatcctttacggctggatatgacccacaggcaaacggtttggcggaaagagtaaatggagttttgattcaaatattaaaaaagtctacagcaagtaattggacgtgggacgaacgattaccatactcagtttttgcttacaatataacgccatccgagtcaacgggtttttcaccatttcttttaatgtttggcacatcagcgnacattccgatggataagatcaccgaaatgaaatttaaccccttatacacaattgattatgaaaattattttcaatttgtttttggaaacctccttaatattcaaaatganggccaacaaaatttggatgagtatcggaaaagaagtaaagattggtatgatgcaaaacctcaagtgaaagccaataaatttgaaatttcggagcgagttatggtggcttttcccggaatgcatcgcaattcacgacacaaaaaattattgtggaatcattttgngccttacaccattacaaaaatct

SEQ ID NO: 11781 - DNA, 2907 bp, Heterodera glycines
aaaaaattccaatcgactctgacccatacggatacgggaccggggacaatgctataaacgtccccttctgacacgtcttgcgcatcgttttctttcagcgccggcgacgtcagcagaaagtgagcgcctattcagcgctcgcaggattaaaaattactgatctgagaaaaagattgactccggaaaatacaaaaattttatttttttacatcacaacctcaaaatctatgattttgactattcgcaaattttttttaaaacttccgcctttcgcatttttgcacattttggcgtttcgcatttcacttttatttttcaatttggcccatccttgctcgacacggacgaggaggaataagaagaaaatacacagaggagatcgggtggtctcccgactaatcaatcgttgattccatcatttttctcttaatttcttcgtgacagcccatttgatttccttatttcaagtcgaaggaggcactgaaggaaggaagagccgagcggtgccaaaccgtccgtccaccgaagggcaggcccttcgccgcgaattccaccagccggagaagtgagtatcattcaaagcggattcccgcctgccggagcatccgcaggaagagacgggagtccaaatccgtcctcatcgagtcgagagcgaagcagcagcttccgcccattcggaagcagttcgaaggcgtccgacaagcccttcaacccaaatcttgtcggtggtgccgataaatcacttatgtcaagagtggtgtctttggcacaatatgaccaaatatttcttgcacatgcacaaaataatgaagtttattcaaaggttgaagaggaaaaaacaaaagaatatacaaaattttaaattctgcaggggtaccagacaacatttttgaaattcctgaaaattctttttttcttctttaaaccttgccattttcttaaaattttcctctcgaaatgaaattgatatcattcgatagccttaactgttttctattagccagcaagatttcattggatttgatttccttagggttcaattaagttacatatttaggaatttattcgactattgataaaaattgttttcaatgtttggcttacaaattagtttctaattttccactcttccaattgttctgacaccacacgattgtatttttgaaaaatttacagacaaaattttttatttttttttaaataattttttttaatttaggaaacagcataaaggtacaggaaaaataaacacaaagtgtcggtttcttagaaatgacatcgttaggaaaagccaatatctttcattttcgttgatcagtgggtttggtcctttcgagaatcaaagggtccttcctttttaatgactgccctttcactgatcagtgagtccactgtactcctgatcagtgattctctttttggcattatcgtttcgctcatcaatcggtccgcttttgtctttatctcgtgctcctcccatttctccaaaatccagcgctttgctgacacatttgttcccctcctgctgctccaggcatacactaaatttacagtagtacccgccttgctcttcctcttcttcttcgtcttcctcttcttcttgttcatcatcttcgactggcactttattgttgatcggatcacaggacaaatatttggagtcaatttccacaatttgatcattgtgatctgaaatttagcgtggataaattcaattttaaaaataaattgaaaaaaaatttatataaaaataaaatttgatttgggcgacatacggagcatcagagagttcggaatttgtggcacaaaaagactgatcagcaagcaaacgtagaaactgtaaatgatgattgaggtaggcaaattaaacaaagaataaatgccagccaaaattatgaacaaaagcccgaaaatggaacctaaaaagattttcgaaacccttaaaaagcaaaatccaaaattttgtcaagccctggtgaactcccatcaacccatgctaagttaagtgtaatgggttttctgcactgccaccggccttacgtgcttgcgccccacaatgaggaggagaacagcggtcttggcagtgtgctgctggcgccgttgccgaaatagtgtggaaacaacgaatgctggggcgtctttgtgtatggggggaattggttgcccgggccgacgggcgggcagccgacggtgtttggagggtacggtgaaccagcagcgccaggcgggcccccggcggttggcacttgctgctggggcgtggacgacgcggcacccgccgtctccagtgccacttggctggtgctgtagccgcacgggccctgcccgtcctggttggccgtgaatacttcttctggatgtctgttttttttggacttgccgctgtatatctgaaccggaggggggggggggcaaataaaggttttatgggtcaaacacaagaaatttattacaaaaacaatttcgttaaatcaaccctttcaataaacttttttattaaaaataatggcgcacaaaatgattatgggacacataatattatacatagcaaagaccgcaaaaaaaagtcaccaaaaatcgcgaaaaaggcaaataatagtcaacaaaaaatagaaaaaaaagacatgaaaaggctggaaaatcccgaaaaaggcatgaaaaaaggcatttaaaattttttatgaaggctttttagggagcaaaacacgtaaaacttaatcaaaaaaacttaattttggccatttaaatgattattaaatattttataatgttttttcaataaggaaaatttttaaaccctaaactttttatcaataaaaaaaatgaaaattttagcgatcaatttttgagaaaattttttaattccttaggggtgtattttttttgaaaatttttcaattaattttt

SEQ ID NO: 11782 - DNA, 3776 bp, Heterodera glycines
cgggttcggattcgaaacatggatgatttgcatgcacaaacccgaccaatttcagtcctaaacagttactcacgcgaaaacgtaccccacgcgaaaacggccacgcgaaaacgaccccgaccggccttcttttaattatttttatttttgaataaataaataacatattttggcgttttgcctgaattattaacaaaaatgtaataaaaacgaaaaatacacccctaagaatcgaccaaaaatttttcaaaatataacccttaagaaacgaccctaaatttttaaaaatatacccctaggaaacgaaaaatttctcaaaaaatgcatctccaaaataaattaatttattttttgacgagaattttagtttccactaaaataaaaaaaattcggcttatatttcccattgaacaaaagatgttctcaattaactaggtaatttataaccttttaatgttaccaaactttcctttatgcaataaatccggcaccggaaaacaccaaaattttccaacacttattagtccaaattaattattggttgatcaaattgtatgtcaaatgaaaatcgtcagcaatcctttttgcacgtgcttttccatcatcatttctcgctggcgacggcacggcatggctggctacagattggacaggcgacgcaccacgccggccaactcggcacggagaaaacagtctccgccgaccgactgccgctgccgctcatcagccctattatggtaattagcggacagtagcgatgtcgtcggtacggtagtagatgaggatgatacggtggatggttgtggaagcggtggtgaatcattgtcaacgtcatcatctgccggattaataaatgtgtaaaaaatcaagttacaggcagccaaatgcttagtgtcaattggcgagagtatgtacgagaaattggacaccaacagaaaacagcgtgccaaggatttttgaaaaatttcaataattacataagctaacaagaattgtaataaactttttgacattgatcagcaggccaatttggcgccaacgctctaatttttctaaaagattagcagtctacatttggcggcaaaatttaaaaaaaatttggttgtggcacaaaaatttgctttcaataagaataattattaaagtgtatgtgaaaaacttatgaattattttaaaatttaaagcacaaaaatattgggtgccaaagagacccgtgtccccccccccatttgccaccttcgtttgatgccgccgatcggacggatttcagcggatttgtcaccgaattgcgcttcacagttgcgttgtcgttgtgctcaaaaaggggcgtcgccagcgcgcccgcggcactgctcaacagggcggaggaggtgcggcgccgttggcttcgcaattcgccggtgaaacccgtcacaatgtgatcaatgattttagcgatcagaactggagggaatgtggtgaaattttgatccaatcaatctgattgaaaatggcacaggggtgatcgaaggggaagctttgagaataaaaattgtatatttcgacatttatggcaccgatgaaaatggcacaggggtgatcaaaggtaaaaattgtatatttcgccatttatggcgccggcaaagataagaaaatgtaaacaattagaatgcctcagtcaaaaatatattttaaaaatattcttgcaaaatttcaacaaaattttctcagagactgtgcaacaataaaaaatctaattaaatgaataatcactagggcatccaattatatgcacatgcatatttttttcctggactgtgggaggcctgaaacgcacgaaaaacatgtttttagcttggtttgaagcttctaggatggagttctgtacccatattttcaatattttattttctgttttgggcattatgaccatgttttggcatttttcaaaaaatttctattagtacggctccgatcagctaaattggcctttttgagcccaaaagaccatgaaattttccaacaaatcagttttgagcaaatttttctcgagagtattgaatatttttaaatttattaatgatggtaaatttatgttaaaaatttgcattttggcttgttttttcgcaaaagtttagtaaatttggtccattttaatggcactattcgcgattttatatcatattttccgagtcctaattatgatcataaataggttaaaaaatagggaaatcgcgtattacctaaaatatcctcccccaattaaaaaagctgaaatatttaaataaaaatatagtttaactctggcacaaaatcgtttcatgttttttgatccaaaatttggggttttaaggctgtatgtttaattttttaattttcgagatggaaaccctgcccaaaatctgctaaacctggcaaatgtattcgacccctttgtccgtctcttgatcatacaactgaatgccactcagggttgctgtatccccgtatatttggttgacagctaaacaaatatcaattgggattttttcctctaactgtatggtgtcccactttcttaccccctcccctctctctctcctcactctctctctcctccctctctctctcacactctctctttcctctctatctttctcgcgtgtgattagttaacagattttcacctaaaaatgaccaatttttgaaatttggcaaatttttgtggatttttctagaaaaaaatagcgaaattttctttaaaatttgagtgcggttggtcttagaggtggaacgaagaaggaaaaatcagaaattttggtcagaaaatatactagtttaccgttaaaaatttctgttgtggatgctaacttttaactcacaaatcagcagaattacgacacccaaaattctcgtgaattcggaattccatggcatccctaggccgggcgtgcgctctcagaaaatgcatcagtggaaaatgtaaatttccgaatgaatactgtagggttctttccctcactattttcactactactgtattacaactgtttgtattttccggcacacgctctgctgttggtgtgccgcagaatgtacatattcagttaaaaacataccgacaagcgtcagtccgggcccccgcattttgacgtccgaaattgtcacatgtggcgttccacctgatcagaacagctgccacatgaacagaagagttttccgaacttgcctatatttaataattattacttagggatgggactttaaatcactaaaaatgtggaaaaaatcggcttaaaaagtcatgaaaaaatagccaaaaaattcacaaaagacgccaaaaaaacacgaaagaattcaaaaaaaaccgccagattttattatcccaccatttgagtcttaatggtataggaaatttcggtacgtctcgaagatagacttattgttcggaattttcttcgctaaaattcaaattttgccttaaaaagtgaaaaaaaaattcattaaaaaagtcataaaaatggattttataagcttcaaacaaagtgtagaacacttcttaagtcattttaagcgggcggaatcgttatttaaaaaaccatcattatggcttaaactagagttgagcgggaccaggactggtactgaaaaaaacgggtacaactgagtacccagtcccggttttgaccaattttgaccgggaccgggaaattcccgggttttttcccggttttcccagcaaaaagtcccggtttttcaacccgaaaattcccggtcccggttttggtcaaaattcccggtcccgctcaactctagtt

SEQ ID NO: 11783 - DNA, 1889 bp, Heterodera glycines
  misc_feature (535)..(535): n is a, c, g, or t
  misc_feature (537)..(538): n is a, c, g, or t
  misc_feature (1856)..(1856): n is a, c, g, or t
ataagcaaatctgtggtcagcttggtgatcagcacctttgaaaaccaaaagcaaataatcatacctcgacgccggaatttgttttttattttttgacattttgttcccgacgctgggttgagcaccagctttaaatttgtaaattttaatttacatacatatgctttaccgttttcctcgttttagttgttgtatcgagaaaaagctgaaaaatttaatgattaataaatgcattataaaaaccaaaattatattcgtaagaaattaaattagaatttcttaaataaaagtatttttcattatattcaatagcgaatcaatgaattgtttttgaaaaaaactataagacaaagatttgaatatttaaatcaataaactgaggctggcaccaaaacgtcggcgccaaaacgacccgacctagtcccccctgcccgatccgatctctagtttataggctgtttttaaataaatggatcaaaaaatgtcctggaatgaggggcaatataatttgcagtaatttaaattgattcaattnannatgcatatgaacatttactgctaatgtgaaatattaattgtcgggtgagaagatgaaaattttgaagcatataataaatagtaaaatgtttattttataattaaatattttagatgaaaattttattttatttttttgccttattgttagaatcacattttagtatttaaaaagaatttttggtaactcttttttgaagaaaaaaaacaaatttttaggggtagattttcaataaaaaacttaattttcacgtgaaatttctacaaattcttagaaattctcctatgaaaataaataaagaaaaattcaaaattttgattttttggggcatttaataaaaaatttccttaactcctcaaaaaatgtaggaaaaattactaaaatgtccaaaatatttaccaaaaatgtataaaatcccgaaatatgttttcctgcacggtaattaataaatcctaactatttattcacttaatatactttggaacagcattcgcagcttgttgttttgtcacagcacatcccagtcataatgtgatcaaaatgcagtggatcacatgcgcaataaatgggcttgcctttgcattcattgttcgacttcttttccaattctgcaaccatgtcttcctttaataacaaaatatttaaaaaatttctatgaattaaggtgtatactgttttttttttgagccaatgatgaaaaacatatgagggaggctttataaataaaatgaggttgcgaaaattaaattatttaattatattttcttgtgattccaactaacttttgtagcaaaaccgggaataggactcaaaatctgaattaaaggtttttttaagaaatttgttacaaggcaagttttttacccaaagtttatgcacatcgtcttcatacgagaacttagtctttcctttgtgtattagattccaggtaataaagtctccatttcgactgactatagatatcagcgaataagagaaatttgcgtagttaataatttttatgagagaattataagtggcgtgaactccttgctaggccctctacaaactaaaatttttagttctctattcttagaggtattccctattaaaatattatttttaaatgttcaaattattcgtcaaaacattttgattagaaaaactatgtcagaaaactaaataattggtgatatatcgttatataaaaccatcaaaaagggcgctatataaaaaacgatcaaatgaaaattttcaacaaaaaactgcccataacttttgtccaaatcaataaaattagacattctttatagcactcgatagccctaagaattctctnataactcacctaaataaatcgcgaattgaactg

SEQ ID NO: 11784 - DNA, 3792 bp, Heterodera glycines
  misc_feature (3762)..(3762): n is a, c, g, or t
aaaaataaaactcaaaaaatccacaatcaataattcccctcctgatttaagtctgacaaaatttgaataccatgtttttcctaaaaccatgtcctgatctctttatatagaatcaaaaataatgaaattaaaaaattgggttggacggatgcgggtattaaaattctcgtattataatctgcaaatattttatatttaataaaaatttaattattgaaattttcggtatttttgaagttttttacaaaattttcgatttgctgcgaatctattgaatatatatttttaaataattttaaattacagtttaaattaattattttatgaaaactcggcctgccctaataaataatttgcctgtgtaacttacagcagaaccaacatattccagcgggcttgcttttctccagataatggatttaatagttgaaagcgcataattttcatcgcaacattttgacgccttttctccttctttgaaatagcatgcgaggttatagtcttctgtttaaaaaaacaatttcttttgtattatactttatgaaaaaattaaatttatctcatcaaattttttctgattttgaaaaaaaaacatcgttaatctttaaccaataaatttcttttttaattttttaagatttcctttagttaatttattttttgaaaattcaaacatagataaactgaaaaaaaaaatttaccatttctttcagtattatgctttgtggtctccaatttgcactcgtcgtcttcactccattttgtaaatttgaaaagctaaaattgtcaaaataaaaatagttttatattaaatgaatttcaattttatacctctggtaattttgcaattctcttgttctaaaaaattaaaatgtattaaaatttaagtttctgtttttatgtaaaaaaccaccgttgtgcaacagttgcatggatgttctttcgacccagtgcttcggtagaaatattcgcagcatgtatcacgcaccattgagtccgccatgatatcacaataacactgatattcaccgtaagatgaataaattctgttacccgtgcaaacatttctctgttcatattcaaaaacagccttaaattaagaattttaaaggtcacttatttattagaacattaattgtctgcgcaaaatatgctacaataaatctgttgtatatgtttagattccatcttttcactcatatatcctccaccccaattcatgcatgtgtaatttcattcacgtacttttgagagaaaaaaaattatttaacgggaaatgggaacttaaaaaagcgttatgacggtgctgggacgaattgactttcagagaaaacaggtaacattgctatttttgagcttttcatgtgatagcatatgcgcaaaaaaaacatgtaaaaacatataaatccgttccctgattattagtcataaacttttgaaaacaacgaaattttttgaaattttcatggcaaacagaaacatttaaggctttcgaagatatcatgagttccaaatttggttgcttctgagcaaagtcataggcaaattttttttttgccacaatagacatcaaggttgattgttttcctctttttattttagggtttttgatattgtttttgatcaaaatttctcagataatcctttaaaattttcgatatttcaaaccctttttataaataaatctctattgcaaaaaagaagaaaatgctcattttgaatatcaattttaaatttgaaaaataaaattaaaattttccacgaaaaaatgtcgcttttttccagattccaattgaaaactgagacccggactttttctagtccatggtagtgcaggtcccggcttttcaacaatttccctgcttcattaataaaaaaacctattgaattctcaccatgtgctccccgcgccatgtatatttctgttcagataacttaaaataaaaaatcatctttcataggcaaatactgttttaatatgtaccaatgtgcagcacttgaaaacgtagttagtcgggcagcaaaacccaagatcactttgatctctcaattccaaatcaggcggataaaaaaaaggctgaagatattctaaaaatgctaaggttagcttaaaacaagaaatgcgaattcaacaatgatagtattttttcattatgcattcaaagcagaaaatttttttgtttagtttcttgaaaaacataaatactttggatgagaatttattcacggtttttactttaccgtgcctattaattgagcccggtctctttcgaacatgtgggcagcaagtgacatcatttggctcattattatattcacttggcacacaatttgcccagccacattccgtgcacacaacttgcgcttcttctttgcattcttggctcacaaacaaatgccaaggcatcggctacagtgtgaaaaatttataattaattgttgtctttagcgcgtcgaaaatcccaaaaattctttttttatcgatgaattagatcttttttgaattaaaaataaataaataaattcatatactagaatatttcctacaaattaaaaaaaaaattatttttgattaacgaaaaaataattttaaaaaatttaaaaattctatcacaaaagaaatacaaataagaaacaaatgaattattttataatagctatattttaaattaaattcattactttgcccacagcagatatccgcttaatggacaaaacgttgcgcatagcgcacaatgaaatgataagccgtaaaaagccaatcatctaaaaattatacgataaaatgttaaaattaatctatatcaataatatattatagcgagagagcattaaatgaattaatttttttttaaatttttagattttaaattaatattgatcataaagaatttaagattttattaaattaaaaaatatatatattttggtaatattttcgtaaatgttttttaatacaaaatatagaaattaattaacaaataaataaaagaaaaacaccataaaaattatcggtaaacgctgacccaataaatcaaatagcaaacgtaaaatacggataaaaatcttttaagcgattcattttattgaataaaaatgataaaaaaataaaaaaaataaaagtgggcaccgaaatttcaaatttcttaaatcttcatgaaataatttggcctaaaatctaaaagagcaaataattaaaaaacataatttcaaacattatataaaatagtaaataaatcacatttttaatgaagaaatgttttatatagattctgatcaagttgagaagacgtcgccagaatattaattttccaatttttatcaaataaaactaaggaaatttgtctccctaattgaaaattctcattcattctgatgaaaagcttgtttatcatgtattggatggaatattaattatgtattcaagtgtctagcaaattttcgcgttaaaaatatttcagatccaaatttattcaacacagcaagcatccttcttaaacagattgatagacaaacggtatggcatatcacgtggaattgttattacgaatttataaaaaatttaaataagtaaaaaggccaagttttttgggttttagatccctcgctaattttggggctaatgattgtctgtgttaatatgtttgttaatttaatatacgctacatatatataatttcggtgttttaactcattaataaaatgtatgaggaaatagaattgaaacaaaatttaaatggcacacttataaaataccgccanaaaaatatttgtctccaatttataaattaa

SEQ ID NO: 11785 - DNA, 1020 bp, Heterodera glycines
  misc_feature (858)..(858): n is a, c, g, or t
  misc_feature (933)..(934): n is a, c, g, or t
  misc_feature (964)..(965): n is a, c, g, or t
  misc_feature (1009)..(1009): n is a, c, g, or t
tccaaatgtgccaaagtgagtacaaaagtgccaatgaccataggccgcacaaatttgcccgtcccgaatcggcaccgacgctttgcgcagcaatactgcccaatcggtccattttccaacaacggcacttccgcatgtggccaagtgccgttctgtccgttgtccttttgccaataatcgctgaacatcatctcacttttgatgtctttcattgagggaatccaattctcagagttctgttgtccaattaaaaaatgcacaaaatgaaaagggcgaaagtgtcacctgataatatttcaacgcttcaaaagcttcattttctttgcccagcaaaaaaagtgcccgcggcgagtcgggcgccataaaaagcaccgccagggaaaagggaatgatcagaacgggaaggccgagggcaatgtgccaagtctcatcggtgccgagaaccaaaaattggataaaacaaaaatgaattgggcagtcagaaaataaaaatgtacggtgtccaggctcatgaaaagaccggccaattcgccgacacaggcccaaacagtgagagaagcgaggcaagtcccttaagctgccgattcaattagctggtcaattgaatttccattttctcacctcttaatcggatttggggaatttcggctaacattgcggaaccgacgacctgaaaagccaatgctatcaaggcggattttgccgcgattacctgcgccagtcccgagccgagcccactcagaaagcggccaaggcaacagaggaaaatgcccaagtcgggcactctgatcaacatgcagagaatgccaccaacaaaactgattagaaaggagcagataagtggccactttctgctgngacagtcggaacagagaaaggcacaaaaacagccgaaagcgatgcccataggaacgggcggacaccacccaaccnncagggcgaagtggctaaacagaaaagtggnncatttaaaaatttgattgacacatcatcttttttacctcctttntccgaaccata

SEQ ID NO: 11786 - DNA, 2683 bp, Heterodera glycines
ttttttactgctatatgtcatttctcgctatctctgaaaaatcgcggaattttttgtgttcatgattatattgtatttgaaaaggagggataagtccaaaaaattgaagaaccacaattccaatttatgcatttgattttacatactttttcaaaagtgtgatattaacttatgacacattgttgctgatacaattgacaccggcgacacccaccaaattttacaaaatctttgacgacgggtggaggcatcaaaaaaaaatgatgaaagaactgatttttcattcgttcggtcaatactacggcatgggaccatatctaggggagaagcgaggcaagtcccttaagctgccgattcaattagctggtcaattgaatttccattttctcacctcttaatcggatttggggaatttcggctaacattgcggaaccgacgacctgaaaagccaatgctatcaaggcggattttgccgcgattacctgcgccagtcccgagccgagcccactcagaaagcggccaaggcaacagaggaaaatgcccaagtcgggcactctgatcaacatgcagagaatgccaccaacaaaactgattagaaaggagcagataagtggccactttctgctgggacagtcggaacagagaaaggcacaaaaacagccgaaagcgatgccataggaacgggcggacaccacccaaccccaggcgaaagtggctaacagaaagttggcatttaaaatttgattgacacatcatcttttttacctcctttttccgaaccataaaaacgtatcaaatattttcgtgccatgggaattaaattatcgacgacactgtcgagggaaacctgaagaacagcttcgaattggtgagttcgatttaaatgatcaatctgattaatatatttttttaatagttgcttaagaatttggccatttcattttccattttttggccacccaccaaaaacattgaccctgcaccgatactcaaagcgaccacaaacattcgcatttttggtgccaaaatgcattcgggccgccccgtgccaacattcggtggagtgactgcccttttcacaccgtattggcacttctgctgatggtaatttttgctatgcgaaacaacaatttccatagcatcggaagaagaaaatttgtgcggcatttgttaataaaaaaactatttcagaatgattaaataataaaataataaaaaatgttcggttgaaaattaaaagatgggataataattcaaaaatgaataaattaacatccattttctctcttcaatctctgagggatgaagaaattttagaaattttttgttaaataaaataattaattgtcgttaattaaaagaacaaacataaaaataaatgccttttttataatgaataaattcgaccgaaaacatttttattgacaatgtgacggaattcgaacgaaactcattaggaaaaagggaaattcaatttcaatgcaaataaaagaaagtgatgaacaaatagcagcaggtgggaatgattagcaaatgttttaacaaatcgattcggtctcaaaattcacacattttaaaagttaaacaataaatgagcagcaccaattaaagcgaattgccatttggccaatctaataaaaaaattcttcggttacaaataaaacaatgggacagaacgaaagcgaaaagtgtgggggaggggggaggggtggcatatctcagcaaaaatcaggatcaaatcggagggggggggggagaagcagcgaaaagccgaagccaacggatgaagcgagcagaaccggcgacaatttatcagcgaatcgcatctcagcaaacgaataagcagcagaacccacacagagacaaactttgcattgaaaatgcattggttttttttggagttctttaattcgtaagaaatttatttgaaataaattaataaaatagcaaaaaatgaaaatgaacggacaaatggaagtgaaacaaacaaaacattgtgaatgtttattccgagctgttgttggtcgtcattctttttgaaaggtctttcaaaaagtcggaattatttaaaagaattaaaatggctgtgattaatcaaataaatacaaaggaataaattcaaaaaagaaagacaaaattggaaaatattaaaaataaaattaaatacaaagaaaataaaataaaaaatggcaaataatgaccatttccaaataataatcagatcaaatggacagaattcggcgattgcgaaggaattttctgacgaacgcttttaaaaccaatgtaacctaaagaaagggcaaaaatggacaattaaatgccgatatcaaacaaaattagcatgacctgaataacaaataccattttcaattgaaggaattttttggtgcaattttaatcggacctgaaaaggttttaagaaagattcttagccaatgactgatgattggccaacaattgaaaattgttggcacttttttacctttgtcattcaaatgtttgctgaccttttttgtggtagtgccaaagttgaccgatcatttttgccgaagtgagcggagggcaattggcattgacaatgtgcagaagggttacggtgtcacggcccaaactgtacttgacaaactcatgaaaatcagtctccgtgggaattgcgtcgtcgtttttaattttgagcttaaat

SEQ ID NO: 11787 - DNA, 2273 bp, Heterodera glycines
cttaaatcgtttatgattttcataattttgattttgtttaaaatattacgagctcatcgcgaacaaactgttcggcagatcgccaggagaaacagcggtggagccaaagcgccaaatttaaacagccgacgaatgccaaagcgaacagggcgaacggaatgaacagaaaaatctgaaggaaaatgggcaaagcgaggccaatcccaagcagcgcagaagtggccaagcggacgcaccttctcgttgagagtgttcatgttcagcaaacattggaaagtgaggcgaagcggctttaagtcgcgctggggaggacggacgagcaaatcgcagaaagtcacctgaaaagccaacgcatttgggcgaaactgagcaaataaaatcactctcggaaaatgtggcgactcgcgcccggccgaaagattggctagggcattcagtgcccaaggggacgacaattggccatcgtcgggcccaaaatactaaatatgaggtcattcaaaatggaaattccattaaattcaccgaattcaacaaatggagctgaaggaggacaacggccaaattggccaatttgaagccaaagtaaccgaaagtgaacttctgatcgttaaaccaccaggccaacatagaaaacgcatttttgctcgttgatttggggcctaataaatacaaattgaggttaattgagcggggggggggggtaattagacccaccgtctcccgccttcgattcctccgcttccattttcaattggattcccctccgaaagcacagctgatcccgcctgtccttggcgattcgcactgcgaattcctccgctgtcgtaatctctcggctaatgtcatttccgtacgcctttccgattttggccattttgtcaaacaaaaaactgacggcaaagcctaatgaaagaattaattagcaacggaaattttgagcaaaaaatgccatttttttggatgaacaaaaaccaaatggccttgggcaaaatgagcagaagcgcctgagccatcagaatgaaagggacccatctaagaagaaaaaaggtcagcggaaaagcgattaatggcccactggtaaaaatgcaattggcgatggtcgcggtcgacccgacggatgggaaagcgttcgttgaagccgacgaagtaagtgttctccacgaagcaaaagccgtggatgtaattcagccaatgctcacgcgccatctccgccgggggccaacacttaacaaatcaatcaatgccattattgggtcattggtttttaatggtctcagtgattaatctccccgccgccccttttcttttgcccgatcacctccaccggtcggccgaagtactgcttgagcccgtgaagcccggccatggacagaagcacagccggtgccaaaaggtaatggagacggtcggcacaatcgtcgtcatttcgggaaaggatgcgcaattggagcgcactaagcacttttaaagcggtggaagcgggcatttgggaggaatgaaaataaccaaattaaatgaaaaagattaagcatccaactcaaattaatatcgtatggttattttgtgcgtttttattcatagaaatgtcccttcattcccttacaaaatcagacaaaaatgggttgaaaatgacaataatttgaagaattaatataattgttttttataattaccaacattttaatttacttttgcatgtatttaaaatcattaataataaattaaataattttaatattatttaaaaatattttagccttttccctttaaataaccgaaaatttttttttgtgtaaaaattgaatgaataaatattttaaaatgggaagagaaaagggatgaatggccaaccaaatgaaagaacgatttgttgaatgaaaagcgaaaacatttaatattacaaaacagtggagagagaaaggaaagggaaaacaaaggcaaaaaaacggaggcggaaatcccaactgaactgatgcaatctgtgaaatcagccccaccattattatgttaaaagactgatcgatgcaaaagataccggcagaaaatgccaaaggcaccgccagtgaaagtgccacaattgcgaaggcaaaggaaagtgatcacttccgtcctctcttttatttgatcccccctatttatgtacctaatgatttgaacgtataacaaaacatatttttatttgaatgcaattaaatatgaaaaacaaaacaaaaaagggggtaaaaaggaaaaatgaaaaatgaaaaatcagtgatcgatctaatcaattcggt

SEQ ID NO: 11788 - DNA, 4079 bp, Heterodera glycines
tatttaaaaagttttttgaagcagaaaggtttaagaattggtcaagctggatccgcaacaactgtctcaacagcaggttggcgagtcgcaacagctgcagactgctgttagcggtgcccaacaacagctttccatgccgactcagcccaatcaattgctgtcccaacagcaacagcctcagatggcatccatagaacagcaagcggtgctgaacatttttggtaaaaggcatatttacgcttagcgctaattctaacttttagaagcattgaccgtcaatgattcgggaatgcctcccacttatgtgcctgctggccttctcggggggagcggtataggcggccccagtgggtcccaatttccacttgggtctgtgcatggcggacctccatttgcacaacctccgatacaggcacgacaggctataataaacctaaaaaatctttaatcttttgtaataaaaaatagccctataatctaacaacaacaaaaaaagtttagtatcccgaacatttctatatgcaacaaatgatgcaatctgccacaacgccggtcctttcgaccggaggcggaggtttgggcaatacgcagtttctttatgagcgccaaagtgcgttggggagtggcacgatgggaagagggacgggcggagaggtagcagtagcgagccaattcaccactacactacaacagccgcaacagcagcgctcactcgtccaaccccaacaacagcagcagctgcaacaagcagtcacaagcggtacaccgctgcaaggtgtgaccgaatgcaattcggacaaaaaatgaaacggaagcaagacgattagccttgggccaacatttacattgttaaaaagcaattcttatccacttttttcaagggtcccaattccaatgccctcgtcgacccaatcacggcactgaggggagagcaatacttttacgtgcaaatcatttcaaagtcaaaattcccggtggatttattcattactacaatgttgacattcagtgagttttgttgttgtttaaatgccattttaacatttttagacctgacaaatgcccaaggaaggtaaacaggtaaatacaatataaatgaacttcatttaaaagctaattttagagaaattgtgaatcggatggtggagtcgttcggtaaaatattcaacggaatcaatccagtttttgacggaaagaaaagtatgtactcgaaggatccgcttcctattggccacgacagagtcgaattggagggtaaactatttttcatctttgattatccctcatgaacaaatttcagttgtcatgcccggtgattcggcggttgataggaaattcaaagtcgctatcaaggtcatcatcattcattatggctgctctatttatttattatgcgcttgctagtattaacacttcagcttgtggcacgggtttgtctgcagactttggatgatgcgatggagggccgaattcggcaaattccgccggaatcagtgcaggcaatggatgttattttgcgtcatttgccgagtatgaaatacactccaggtgtgtcaaaatgattggcgactttttgctgtgctatttttgcaaaaaaatggaaaatattttgtgtttgcagtcgggcgttcttttttttcatctcctcgttcggcggtcggggctcagcacataaacacgggtgtcggtactttccaaacgggtgacaacaaaggatattcggcaatgggcgatggcaaaagcgatgccaaaggacactcagcgatggacagcaaattgggtggtggtcgcgaagtttggttcggattccatcagagtgttcgtccctctcagtggaaaatgatgctaaacatcgatggtttttcacgctttcattttgttcacctttcatttttaagtgtctgcgactgcattttatcgcgaaatgcccgtcatcgagtttatggccgatgtgcttgaattgcctattcaagcgctttccgaccggcgcactttgggagaccctcaacgaacgcgattcaccaaggaaatcagggggttgaaaatcgaaattacccattgtgggaatatgaaacggaaataccgcgtgagcaatgtgacgagacgccctgcgcagactcaaacgtccgtacatcggagggatttgtccctaaaaaagaatatgatttttagatttcctctccagcttgacactggacagatcatcgactgcacagtggcgaaatatttttatgataaatatcgtcttcaactcaaatacccccatttgccatgtctacaagttgggcaggagcagaaacacacgtatcttccgccggaagtttgcatgattgtttcgggccaacggtgtatcaaaaaactgactgacaaccaaacgtccacaatgatcaaggtacagacccctttttgcgtctttcgattgtccattaaggcaactgctcgatctgctccggaacgtgaaaaagaaatttccgagttagtccgacgcgccgaattcatcaatgaccccttcgctcatgagtttgggatttcaatcactccggtagtgttcatagttcgttcgttcctttaacgattcgcttcgacaggtcatgacggaagtcaaaggccgtgtgttgactgccccaaaattgctttacggaggacggaatcgggcaacggcactgcccaaccaaggggtgtgggacatgcgggccaaacagtttcacactggtatagaagtgaaaacgtgggcaatcgcttgttttgcaccgcaacaatccgtcaaagagaacgatctcaggtcagtggagagcggagactgaccatcaataagtgggtgcattgctactacaggaattttaccgtgcaactccaacgaatctccgctgatgctggcatgccgattcagggtcagccctgtttctgcaaatatgcgcttggagcggaccaagtggagccaatgctcaaatacctcaagcagaatttccccggcctccaactcgtctgcgtcattcttcccggaaagacgccggtttatggtctatagcaatttacactgccttttgattgtaccacaaatcttaaaatgcttaacttttaagccgaggttaaacgcgtgggtgacattgtactgggcattgccactcaatgcgtccaagcaaaaaatgtaaccaaaacaacgccccaaactttgtcaaatctttgtctcaaaatgaatgtaaaacttggcggcgttaacaggtggatgacaaaatatgcttcttttccttactgattcgcattaagcattcttttgccgaatattcgaccgcgtattttcaatgagcccgtcatttttcttggcgctgacataacacatccgccagccggcgattcgcggaaaccttcgatcgctgctgtcgtgggaagtatggacgcacatccatcgcgatatgctgcgacagttcgagtacaacagcacagacacgtgaggaaacggactattctctacgggaccaatcttttaggacatcatttccgaactcacatatatggtcagggaattgttgatccaattctatcgaaacacgcgcttcaaacccactcggattgtgctctaccgcgatggggtcagcgagggacaattccttaacgtaagttccctaaatgatgacccggctaaatccggctcattttcaggtcctccaaagcgaattacgttcaatgcgcgaggcttgcatgatgttggagcgtgggtatcagccggggatcactttcattgccgtacagaaacgacaccacacacggtagtattagtaataaggaattggaaaagttatactatcccttgcacttcggtccaggttgttcgctgtgaacaaacaggaccaagtggggaaagcatcaaacattcctccggggacaactgtcgatgttggcattacgcatccaaccgaattcgacttttatctctgctcacatgccggcattcaggtacattgaggcattgattctgaatctatttatgtttattatttcctactccacctggacgtagccaaatcaggatgtatccagagggtttaatggggaaatcttccacacaaaacttctaaaaa

SEQ ID NO: 11789 - DNA, 2294 bp, Heterodera glycines
  misc_feature (31)..(31): n is a, c, g, or t
cttaggcttttcctccacaaccggcccaatnaggcttggggtttcacccaataggttttggttttcccttacccacaggctcttgacccggaccggagcacagcccttactactcattttttatttttaaaatattataaaaattattactaattatttcttatatttcaaagataaatttatttattatttaaatgttttagaatattcttaatgatttttttacttgtgtgttcgaatttttgatttaattatgtgaagtttcatttatttttgagctattcggcgattttctgtattcaccaaaatacataaataaaaaattttattaaaattttttatcaaattaaaaaaaaagataataggaaaaaagccataaaaatcaaactaataatataaaaaatgtaaaaaatctagaaaatttgaaatttagattattgagcatttaacaaaatacccattcatactaataattgccattataaattcagttatttttgtctattttaaatttattcaaaaataaaataaccaaaagaaaggcatatgcacttacacttttgatgaaaatgaggaaagataaatgcatagatgaaaaaatacaattgaatttcgagaagcatatagtcagacttccagttagaaaaaaaaaaattttttttgaggaaaaaattttgttgagaaattggaagtactggaagaaaatgtttttttttgattagaggaaatattttggaggtctgacagaactatttattaaaaagatgagggtattgttttttgagcgattgaatttggtgaataattttgtcggtgggtggcaatgatattaatgcttcataacatgcgaggattgtttggtcaaaaacatccggtggtttggaaacgtcttcactggcctcgttctggtttggtcctttagcaacatcgggtgtctggtcatttgtcgtttttgggagctgggttggaggtgccggtggagctgggttttgttgacgttttcggagacgcgcttcgtattcctctttgagttgttctttggacagcgccggacggacgaacagacggttcaggttctgttgggaacggagccgagcacgctcgcgcttccatcctccgagtaccacatgttggtgtgtgggcgttggcatgaccaccttgagcgggcgtggtgttgttcgctgcgggtcgtatcgtccgagtcgaaagacggccgttggttgggcctcaacttcaagatggtccaggatttttgtgatggcttccctgtcttcctgaacacgctccgatgggcggatggcattgctttccgggaggccaatgaagaccagggtgcgttggcgttcttgctcttcgagtgtggcagtgttttggtccaggtccagtgcaggtggcattgcacgtttggcgcgaggtggagtgatgtttgatgcgttggttcgcttcatgtcgattaattaggaaagaaaatttgttgttttttgcgatcttatttggacaattaattgtcaaattaattgtgttattcttatatttattaattaatttaaattcgaccataaattttaaacattttaagcctttattattctgtaccgttatgcaacatcaaatgacaccaaaagaaataccccaaagctacagcaggtggccatctctacaaccaagataagtgccgatgacggcaatactatagatggtacccccccccctttttgacgaaaaatttttttattctggaaagtattggaaacatgtttatgggggttttcagggtcgctgatcacgaatatgaccttcattggaccaatttcgaatcccggacccgaattcgaacaaaaagtctaaaactcaaaattttaaaaattctcactttagttcctaaattgattaaaacatgctaaatttggtcacaaaccattggaatatcaaagaatggtcattctgtacagctacgaacataaaagtgaattttcaaaattttgagttttcgactttttttcgaattcgggtccgggatcccgaattggttgaaatggatgccatattcgtaatcagcgacctcgaaaacccgaaaattttcttcaaaaaggggggtaccatctatagtattaccgaaaatgttagtaggcctatcataaaaagttcaaaatttctttaccgaatttcgttttggagtgagtcggtctacgctttttccccactgagatagaggagaaggtgtcaaaatcgatcaacacaaaaaatgactcctttctaccgtatattaagaaaaaatgaacggtaattgatca

SEQ ID NO: 11790 - DNA, 5068 bp, Heterodera glycines
tgtgctggttgttgttgctgtcctgcttcaaaagccgcgcgttcagcgtattccgtgcgctggcagctgcttgactaaaatgggaattcattaatccagggatataagccgaaccgatttaattttcaattccttccctttgaggatcggtaaactaattagtaatgctcgagagaccgagaccaaaaaacccgagacttttctcgagtggaaactcgaggccgagactctcgagaattactaatgccaatgccaaaaccatttaaagcccctagaatcctgaattcaatgtacacgtacagcagttggtccagcagttgcgggtgcagtcccagcggtgtgccgttgctgtcattcattatcggtggggaagcaacaatgccaattttggcggtttccgcgggcggcgacggcggtggcacattttgcagcacggcagcgatcagtgcgatcagttcagtgggtggtaacgcaccgccgcatggcggctgctcattgtgggcaacaacggcaccagcagcagaaggtggcacagcgtggaggggagaaagctaaaatatacgcggaaaattggggaaaaacaaaaatttgaggaaaatagaaaatttgggaaaaatggaaaatttggagaaatttctttttaaatgccgaaagaggaggctaaaaaacggggtttttatgttaatccgaaattagagagatgaagccaaaatttaagtgtatgcggaaatccgataagcagaaattctccaaatgtgcgactttttgtggcatcaaaatctcacttcgtcctcaaattgggcaaccgctgcctgcattggccatgcactgcgccgctgctcacttcggcaccgtgccaacttagcaacatgatggtgatgctgttgtgggtgatggtgccaatcggcgacaccaggcggagaccgactcgcgaaattgccaggctaaaaatggaaaatttaaaattgcaatgaattaatttaaacgtcaattttgcgtgaaaaaatggacaaattggcccaaaaatggaaattgccatcattttcaagcagtaaaagcatgtcataccattccacaaacacacctgttcctgacttaacggtcgcttctgcttctgctgctgctgcgtttgatggcaccgcggcgatgccgccacgactgtcgtcgtctgttggctgagccggcgtcgccagtgcgcacggcaccgctcctcccaacgctggtcatgcagttggagcaattcacgcgtcaatgctgtgccgacaccgccgcccgccgacggtgtcgtcgccgcagcggcgacagtcgtcgcataaggcggcgacgcagagggcacaagttgcgacggcggcagtggttgagatggtggcgctgagtcggccggcattttgccaccgccgcacggttcgccgtctgcagccgacccatttgaggactgactcttcagcagacggtgcacattctccaggcagttgatctgcaagggatttggatacattagagatacttaagaatctcggtctcgagtctagactcaaaaaaaagtcgcgggtttttttttcgtcgtctcctcgagttttaggaaattttcggtccagcagcagcaataggggacataataccacgaaaaaacttcacattgattgatcactgatttttataaaattgccccaggcttaactctctcacctcccacgacggcactcacttggttgtacgacaggtaaacttggctagtgccattgctcagttcgttgcccgtcgttgtgccattgttgttgttctggttgttggtgttgttcgccttccacttgagctgctgctgttggtggtgttgctgatccatttccacaacctctggctcctcctgtttgaccatcaccgccatttttggcatttcattttgacacacagcgacgacggcatttggcattggcggcgatggttgtgcagcaggtacatgctgaaaatatgatggtacataaaaaaattcattatcttaaagatacattaaaaaatttcttcttcttttttgtcctatgtaaaattggaaattttatttttttaatgtttacgaggccgaagcctccgaatttctcagactagaaaaaaatttttccttctttggaaaatatttttattttcccaaattgggtttttcaatttaaatacaaaatataaaactaattttgaattttttttgttgatgttttcgaggcttaaaagcttccgatttattttcccaattttaccttcataaacaattcctggagaaaggcggtgtctgctgccgattcgtccgccgattgaagaataacatttttgcccgttggcatattattaattggcttttgttgatgttgctgatgatgatgatgttgttgttgtgccgttgcgttttgcccatccgccacaaaagtgtgccgtccgacgaccatttcgacagtctgagcacagaaaaatgcaaattattatattgattaaaataatccattaaatttgatttaaaattttcaaaaatcaatcttgaattattaaaaatagaaactaaaataaattaatataattattaaaaaataaaaattcaattttttaatggaaaataaaaacattttttaattcccaccgatgtccacgggttaacaaaggcggcccattccgcgtccacggtgaccgcgtggcccgcataggcggctagccgaagtgccggcgtgcgcacaatttgaacaccgcccgtggcatggactaaaattaattaaaaataaattttaaaaagttttaaaaattaatttccatacgctgttggtgcgcgtcgcggacgcgttgcgcgtcctccggatggaccaaagcgaacaacgatttgccggtgatttcacttgggaaatggcccagcagagggatggagctgaaaaattatagtcaatttatttcaaaaaatttggcattggcacaattttagcaatttttccgctacagtattcccgtggctatgtaaattagtcttcgactaccgtaacccactcgctcgcgcactctctgcccatgtccatcaatcatttggtggatgggatgaagcagcaccaacatcacccgccaccacaccaatctctgtgtttaactagcacacacacgaaactactcaaatttctcgcaacaaataccgtaactttgcgcaaatacgcttttctctcgcttctctcattaactaacgctctctctttccgatactctctctgtctctgtgtctctctgtctgtctatctatctctcttttacacattctctctctatacattccaggggctggacgccgtgagcaagcagtacacacgccgtagcagctggcagcggctggctccaacaggcataaaactttttcatgccagccgcgtacgcccgcccgtacgcatgcatccacgcgaatgacacccgccgaggggaaaaacatgagggatgaatgaatgagaaagtaatgagtgagtgaccagcgccggcggcgcggtcgcgcgagtgaccgaccacagtaagtgccagccgccgcccgccgctgccggcgccggcgccgaactaagcgcaccgcagttacaaccagccgcagattggctggtggcgactgcgacgcgccaccctcgcgcccgccccgcagccgcctcctacaacaattccagtttccgtatgccaacacccggcacatcaatgacgcgccaagacacaataaatcacgcgccgaaaagacggacgacgccgcaggggtcatttgcacccactcactcactcattgctgacccaaatcccacaggagagggggggggggggggggggagacgggtttcactggttgttggttgtgctggtggtggtggtgccgctccccaaaattcactccctggaaaagggatcgctgcgccttggaaggcatcacaaagtgccggagggcataatttggatcggactggttttatgccaaaaaaaaaacggtgcgtaaatccgcggatgaatgcattcggaaaaagaaagtgggagcggagcggctgctttttttaatcgcgcttcaatctttggtgactttatgcatttgatgtatgggaaagtcattttgaaatggcattttgaaaaacagggttttatttagatatgagtgtcatttaaaatttaaaaaattaaaaattaaaaaaaattaaaatagaaaattaaattcgaatgaacaaataaaattcaaaaaaaaaaattgtcatttaatttatgaatttataaaattaaattcatatgaattttcgttaagcaaaacattcgtataaaaaaataaacaaataattttgaaaaattgacaattaaatttttgtatttaatttaattaacaaatgctttttaattaaacaaaaaagatttcctttaaaaaaaataaaggaaaagtttttcaaaactgctgctgctgcttttagtgggcaaatggaaatgaaataaattttccggagaatatttaaacccaattccccgccccctccccccgcccattgttttgttttgagtgtctctctctctctctctctctctgtccgtctgtctgtctgttccccgccccctcccccgggggctcagtcggtggtggtgacatcccctcgggggtaatgtgctgtggtggctagactggtctcgcttggtatcgtagaagacgatttcggaccgatcttattggtcttgctgacccaaataatagttaacggagacaaactgggcctttcttattgttacgtgagatgtgaaattcttggaccgtaacaagacagactacaatgatagcatttggcaataatgtcttcattagtcaacaacgaaagtcagaggttctaaggccatcagataccgccctagttctgaccgtaaacgatgccaactatctatccgccggcgaatttattcgccctggtggggagcttcccggaaacgaaagtcttccggttccgggggaagtatggctgcaaagctgaaacttaaaggaattgacggaagggcaccacccggagtgttacctgcggcttaattttgactcaacactgtgaaactcccc

SEQ ID NO: 11791 - DNA, 1313 bp, Heterodera glycines
  misc_feature (39)..(39): n is a, c, g, or t
  misc_feature (69)..(69): n is a, c, g, or t
  misc_feature (109)..(109): n is a, c, g, or t
gggatggtgcgcgcaaagactttgccgatcgagtacacngtctgatggaaggatgcttcgtcacctcancatggacatgataggatcccaccgtcccaaaattgtcatnttgtcccccatcatgtaaattgttgtatctgtatgtaaatttctgtgatcatcacttcaaatgaatgtatatttaattgttgcctatgtaattgtattgttgttgtgcttaataaatgctcatatgtgcttcaattcaactgcttttgtaggaaggggggcggggtggtaaaatttggcgtctgtttggtcggagggttagctcgcgtagaactcggtctgctcactccttgtaaattcaggtcaaaatgagttttagacaaaagtggtccttcctataagtctaccagtcacacatttcgtttggaattcgaatgtcagccgcccaaatttggagataaactgaaattcagagtgtgcccttccttctgtttcaattcctgagataggtaacactggtacaaaaatgacgaaattcacaaataaggacagaactcgttcaaaaaatcacaaataacaagccggacaatcaaatctttcctttgaaaaagtcattgcttgccttttattggaaaaattggccttttttggtctgttaacaaatcagttttccgccggaccccctcccctcgcccgttcaccagaagttttatggaaaaactgcacccgcaaaaaattgttaaaaatcttattgtttgatcccgtgaaatttacgatttgcttatttcctccccaaaaatcgttaaattcgacaatcggaggcgaaaaaaataatacattattgatcgaataattttaaaaataactaatttggaggcagtttcgcaaaacaaaatctgttctgattttgaaaaattgtcgatccgagccctgggtttaacgactttttaaaattttcatttttttcgaaaatggggggaacaaggtaaaaaaaaattcagggggatgacaaaaaggataagtaccgtatgtccaacggtttctgtgatgacccgctaataggggacgaatgtttaaacgccaaaaaacttaatgccatccaaatgtctacgtcaaacagagagagggagggagggagggagaggaccaaatttcagttaataaattgacacacgcttaatgaccatcaattcaatttatttcggaacacagatggaaataaagtgataatacacagcaaatgatatatgcatacaaatgtacaatacatcaaataatacagatcacgattatgagacatcttctttatctttgcatcttctgac

SEQ ID NO: 11792 - DNA, 2380 bp, Heterodera glycines
cccaaatttggagataaacggaaattcagagtgtgccctcctttctgtttcaattctggagataggtaacactggtacaaaaatgacgaaattcacaaataaggacagaactcggtcaaaaaatcacaaataacaagccggacaatcaaatctttcctttgaaaaagtcattgcttgccttttattggaaaaattggccttttttggtctgttaacaaatcagttttccgccggaccccctcccctcgcccgttcaccagaagttttatggaaaaactgcacccgcaaaaaattgttaaaaatcttattgtttgatcccgaatgcactgaaatttacgatttgcttatttcctccccaaaaatcgttaaattcgacaatcggaggcgaaaaaataatacattattgatcgaataattttaaaaataactaatttggaggcagtttcgcaaaacaaaatctgttctgattttgaaaaattgtcgatccgagccctgggtttaacgactttttaaaattttcatttttttcgaaaatggggggaacaaggtaaaaaaaaattcagggggatgacaaaaaggataagtaccgtatgtccaacggtttctgtgatgacccgctaataggggacgaatgtttaaacgccaaaaaacttaatgccatccaaatgtctacgtcaaacagagagagggagggagggagggagaggaccaaatttcagttaataaattgacacacgcttaatgaccatcaattcaatttatttcggaacacagatggaaataaagtgataatacacagcaaatgatatatgcatacaaatgtacaatacatcaataaatacagatcacgattatgagacatcttctttatctttgcatcttctgacaggtcgctcgctcttcaggtttcgtccatccatccgccggtcgttgttgcatcttctcacatgtaggcgctctgatccggggacttctccggctgcaaaaacaaaagattagtgatgcgtttgctcccgtgtcccccttaaaccaaccgctggcggctcgtacgcgggcgaggctcccatgtaggcgctcgcgactcctgacgatggagaggcttccgcggcgccggacgacggtgcaggctcggcggggccggatcccatgtaggcgctcgcgactcctgacgatgaagaggcttccgcggcgccggacgacggtgcaggctcggcggggccggatcccatgtaggcgctcatgtcgctcatgatgaagtgatgagttgtcgcgacgaaatgtgtagatgagcttggcgcgcactggtgttgatgttgcgttgagttgaaggctggctggcactggtgaaaagtgaagaaaaccgtcgccttttatacacttttttttgctgcatgaatttttgcacccgaattttgtatataaggaggtggattttgcacattctcctcactcagcagcagcaacacttcaagcaacgctctcaacgatcacacatcaagcacccacaaagccagcccgacaacagcgacaacaacagcaatggcgcaacttccaccagaggacgtcgcaacaatgcccacgcagaaggtcgtcttcaacgccccgttcgacaacaaggccacctactacatgcgggtgcgtttggcgtggtgcacgtggcatgcggaataacccctccccctttttcaggtgatcaaccctgggacgaagcgcatcggctacgccttcaagaccaccaaaccgaagcgcatcaacatgaacccgccgaacggagtgctcggcccaaaggagtccgtcaacgtggccgtctcctgcgacgccttcgaccccggcagcgaggacaccaagggcgaccgtgtgaccgtggagtggaccaacacgccggacccagccgccaccgcgttcaagctcgagtggttccagggagacgggatggtgcgccgcaagaacttgccgatcgagtacaacgtctgatggaaggatgcttcgtcacctcaacatggacataataggatcccacccatcccaccgtcccaaaattgtcattttgtcccccatcatgtaaattgttgtacctgtatgtaaatttctgtgatcatcacttcaaatgaatgtatatttaattgttgcctatgtaattgtattgttgttgtgcttaataaatgctcatatgtgcttcaattcaatgcttttgtaggaaggggggcggggtggtaaaatttggcgtctgtttggtcggaggcttagctcgcgtagaactcggtctgctcactccttgtaaattcaggtcaaaatgagttttagacaaaagtggtccttcctataagtctaccagtcacacatttcgtttggaattcgaatgttagccgccaaaattgga

SEQ ID NO: 11793 - DNA, 4516 bp, Heterodera glycines
  misc_feature (4474)..(4474): n is a, c, g, or t
  misc_feature (4480)..(4480): n is a, c, g, or t
  misc_feature (4495)..(4495): n is a, c, g, or t
ctggtccgtctaagtctgttgggctgggtaaacccgactttccccaaataaacgtcacacaggcgccttgccggttctgagcgagcctcgtttatttaattgtccttttatttcccttattaatgttttcaaaatttaaaacaagatttaacaattatttgattattaacccattcacactactctgtccacatgaactcaacaacttgcacgggctgcgaggtaattaatcattgaaaaataacaaacgcaatttggttttttggagcttattttccaattgaaaggtcagccctttcatcataagcttgggcggctttttgaaatttgtctttgatgtttccctttcaaaattgggacgagcacctttaataaggacggagaatacatatgtctgtgtagtcgttacagcttacgcaaagtatgccatgccgaaaatccttcacaaatcagtcaaaggggagggagagatttatttacgacgacacataaactccaccccctcttccacctcattcactaaaagattttgtatttttctaaccaaaaagccatgcaattgttaaaaaaattacaactgccagccgagcttatttacgaaatgactggcgcacttccctttgaccttcgctgggccgttacccgagtttcttcgtccattgattattttttaaagaaaaaacagtttaattggatcaggactaaaataattcgggtaagaaacagggaataaaatgatagtttaatccgaccattaaatgaaaacagggttcagcaatatctcactaaaggttattccttctttagaaactcgcagaacgttgcaaagagttggagacggaaattaccaaattggaacatcaaaacgtgggttttactttaaaatcttttaaaaatcatttaacttattcattagacaattgccaaattggaacatcaaaacgtaggttttactttaaaatcttttaaaaatcatttaacttattcattagacaattgccaaattggaacatcaaaacgtaggttttactttaaaatcttttaaaaatcatttaacttattcattagacaattgccaaattggaacatcaaaacgtaggttttactttaaaatcttttaaaaatcatttaactttctttcattagaccaaactggaactagaaaacgtaaagttgaaacacctggaagaaatgcgcatgtaccaagcaaagattgcaaaaatggaacaggaacgtaaacagcaccttattcccggtaaaacaaattgatgaaattttgtaattccaaattctccaggaccgtccattgtctctggcgcttctgttccgccgtttctccactgttggtggagcagaaactgattatggtagtgcgcaacagaatccacttttgatgatttcatttgaaaatgaggggaggaagggattggatggaaaatgaagcaaaacccaaataaaggattattttcgagcaaagtcacaaaaatttcgattacagaattcattttctgatatgtttgccgagttttaagttaaaacggtcccctaatgacataaccaggctcttcacttatttaaattatcaaagtaaatcgtaaaagttaaacaaatgagaaatattaatgttttgccttttacagaacatcaatttggccggcatgccgttcgcgactcttcccgaacagaaccaaccaaatttcggcggttgtgaaaacgcattcattcagcagcaacaattgacggaaaatgtattgaatcatgttgtgtccgagcaacagttaaagggaatattgatttattccaaataaataaagcacagaaaattgggaggtcaaaggacaaataataaatgcagataaattaaatgacaaatgaatggtggaaaaagcaaaggaaggggaaacaattccatatttatgggcagtaaaatgggcgggaaatgtgggcatttaaaattcaaaatatccacttaaacactacaaatcaggtagaggaaagagtagcagaattcactttcaaatgtgaaaaaaggggaagtcacagtgatcccaaaacacaataaaattttcaaaaaatgactcaaaccacgggaaacgtggcctcggataattttttgcttgtccgggaacaccccttgccgataatttattggaaaataacacttaaaacatttcttcaggccgatctttcttccattccgccaccaactccccaatcgcaccagaaattcggtagcggtagcggcggcactctctcggaaaccggcaaccaattaccgcgttccaccgggcacaagcggatcaaaaaaaccaaaccaaagggcgaagaactcgcgaagaaggctaaagaaaatgtaagtggagtttagttgctctccaagtctttttggtgttttttaaagaattataaaaaacgaaaaaatttcctataaattttttgtcacaggtgccgccgccttttggtcctccgaatcagctaccacagcagacaattggctacgttcctccggccacagaaccaaacaatttttttccaaacccgaacctcgcgtggcttcaagctttggcttacgctcggatgaaccccggtgctggcacgtcgacttcggcgtacattggaggaacgatgccaacgactgtttggcagcagatgccgtactctgctgccgacggtatgccttcatcgaccgcagcgaatcaccatccgatgacgaacattcaatcggccagcaattagcagcagacacagaaggcaatttgaaattcagacattcttccaaattttaaatgtttattttaaggaatccaacgggaacggagctggcgcacatttcgcggacaattaattatgctggttttttgatgtttgatgtttcatttaatcttaaacttttaatcgcactcaatactattttttctcacattcatttaaccatcgttaacggataccttcgggatcataatgaacgagcacttcggttgatgacaaaatttctttaatcctttgaaatgctttctgctgttcacttccccaatgccacttttcttccattctccgcaattggtttaatggctcggaaacggtagccattgcgggcacgaatttgccataataattaaccatacctaaaaaggattgaagctcctttaaattttggggcggtggcattttgcgaattgcttccagcttttcctctgaagcatgtactccgtttttgtccactcggtgtcccaaatattctatgctttcacgcataaattcgcatttgtcccgtttaactctcaggtccatttgccttgagccgctgaagcacctgcgtaattcggcaaagatgttctgcctgtgttggtgctgtgatcagtatatcgtcgagatacactgccactccttcaattccttgcaaaatttcgtccatgacctgctggaaaatcgccggtgctgacgctacgccaaaaggaagtctcgtaaattggaacaatcctttgtgcgtgcatactgccaaacacttttttgcttcatcatccaacatcagctgcagataggcgtctttcaaatccacttttgaaaatttctgaccgccatttagcacactgaataggtcgtccggtcttggtagtggatattggtgcacgtccaaccattggttgacggtcactttgtaatcacagcagagccgaatttttccgttcggttttggtacaatgaccaaaggtgtggcccaatcactgttgttcatcggctccagcactccctgctgtacccactgatccaaaatcttctccacttcggctttgagcgcaaatggtacaggacgagccttacacctttttggttgcactccaggcttgaatttcaatgaaatttgacgggtgcatcggcccaattcgtctcgaaatacttcaattttccgagaattttgtccacctctttctgatcattattcgtggatccgatttggattgcgttaatgccgaatgctttgttcaaatcaatgcgcagtccgcgaatcaaatcacgaccgcacaaattactcttatttcctttaacacataaatatccgtgttgatttacatgccattgtattccacatttacattggccatgccgaggacgccttctatcggtatgcccccagaagccattaatccttggcattgcttcaattcgggctttccaatgtggctccaatcttggctgctgatgattgatacatctgcaccactgtccaattcaaaatcggcatttccttcatgcactttgagttggatgaagctcggcggaacagtcacagttttggccgacttctgctccaaactcgaaattgctagtggcttagcaccgcactgcagctgtatttgcttcaccctgttgctacctttccatggtcgactttccgtcttgacgaatttttgttgcctccatttgtcctgcacacgatcgcccaatgtccgactcttccgcatttgctgcattntatcgnttttgccgggacaantatttagcccaatgtccgctt

SEQ ID NO: 11794 - DNA, 1039 bp, Heterodera glycines
  misc_feature (5)..(6): n is a, c, g, or t
ttatnntggctggggccgcaaatggtcggggccgcaaatggtggcgctccgtttttagcacctaaaaatcgtatccctagttatagtgctgtttgaaaaggccaatacttttgcatttgactgtataaaaggtcaaatctgataaattcatccgaattttacatattattttggtaatgagttttctgctggcaaattgaataagcgcccattatttccaattccgtttcttcaatgctttcaactaaaattgcggtgtccagacatttgtgcccggacatttgcgccctcagtgaaaataagacatttgcgcccctcagtgaaaatcggacatttgggcactcaaaaaaaaatcggaaatttacaccaccagtgaaaatcggatatttgtgcctctgacatttgcgccctcagtgaaaatcggacatttgctcccctcgacatttgggcacccaacgaaaattcggcataaactttagcgaaaatgtccgattttcactgagagcgcaaatgtccgggcgcaacagtccgaaaatgatcctcaagaattggggcgcaaatgtccaggcacaaatgtcgggcgcagaagtacgggcgcaaacgtacccgcgcgtgattttgcgggatctcactccagaaccccataatttctggaattgcggaattttgcgaaataatcccgcgggatcccacatcacaaaagttttgcttcctatcccgcagcggaatccgcaaatttgaattttcgggcttactttttaaagttatacatacatgaaaattgcgaaaaagtcgaaattttgaaattttttcttaataaatttctgaagccaaaaaaccttttgctttttgtaaggctaatagagcatgtgaaagctttcgaatgataccgagaacctgagactaaccaatgtcatttaccgtgtattacgctaatgccaatgtgaatgcttaaaacattctcaattcttccgcttgttttcccgaaactatgagtagagaggtaaattatgaattcttgaaaataaatctataaagt

SEQ ID NO: 11795 - DNA, 2505 bp, Heterodera glycines
  misc_feature (21)..(21): n is a, c, g, or t
aggtcatgggacataaaatantggacaaaatgccaacatatggaaaaatatggaaatatggacataaatcgcgaaatatggaaaaatatggaaaatatggatatagaaatccatcctagaagcttcaaaccaagctaaaaacatgtttttcgtgcgtttcaggcctcccacagatcggacatttacactaccagtgaaaatcgaatatttgtgcctctgacatttgcgcccccaatgaaaatcggacattttggtccccaacaaaaatcggacatttgcgcccccaatgaaaattggaaatttgggcccccaacaaaaatcggacatttgcgcccccaatgaaaattggaaatttgggcccccaacgaaaatcgggcatttgcgcctcatctttaaaatttaatttataaatttagcgcaaatgtccgattttcactgggaactcaaatgtcttttgcgcaactgtccaaaaatagtcatcaagaattgtggcgcaaatgtttataaatgtaaaataaaaaagatcaaattttggttatattaggtatgaagcttttcaactcaatctgacgtttgtgcaacaattagtacaaaaactgcgccgaatgaaaagtatcctgaccgaaaagtgttggaaagctcaagaatttaaattggaagataagtggcgaatttagagaaaatgtcaaggttgttggcacttttcaaagccaaatggaaatgagtcgctaattaaattttgacgcaaattcgcacgagccatcgttttcgaaatgtcctttctgatcatcggataatccaaaatgaattcgcatccaaagtgattgctgcttcgtgaaaaaacggagatggacgaaaaaatgacgaacattcaaaaaatgtgatttccaatccgtttttatttttatttttaaatttttgccataaaagttttgtgttgaattattttttaatcttaagactcaacataaacgtactctctgtgataaattgatcatttgtgaaaaagctgttaacaaattgatcaaaattcttccgccggcattttttgcaccgccagccagccaatttttaaaaacattccattcgttctcactaacatttctcggctgatattatgatatgaatttgggcactcactgataattcattcaacgtacatccatatgcaattttcatttttcacaagcttttatttttcgtgccatgagctctttggtccatttttctcgtctcaacctaatgcttttgcaatttgcgattgaaaacggcacgccgattccccacataatggcataatatgggcatctaatgctgtacatttgtggtgtcatattctctaatttttgaattatttcaacattgtggggtgtgggtcgaactattggaggggaggaggggggggggggggggtccgcaattgcgggttgctcgcaatcaaatccgatcgcaccaccctccattgggtgtccaatccaaggtgataggaaaatttgaaaacttgctgaagggatttcacttgatgtcgatttctgaaggatgggctgaaaatagtgaaaattttttatttaaaaaagtatttcttatgcttctgttgttctgttgtaaccaccgacatttgcgcccccagccaaaaaatgatattttcggcccgtcatttgcgccccggacatttgcgtcacatttcttaagggccattttgggattttgaggccccctgccaaaaacaacacttgcgaccccaaccaaatataaaccgggataaaaaaaaagatatgtggaagtgacagagcgattaaaaatcaatgttatttttgaagggattggatcattttaggacacctcagcagtcaaattaaaatcagatcagtgatcagattaaatgactaatcaaatgcacgttcaaattaaaaccattcatcatttcagagacatgatgatcatcagatcatatgaagggtaatcatatgataatttgtaatgtcgagcgtatcggattagccatcacataatgaattttgttcaaattatttttggcttatattactttcatcataccacttaatgcattgatggaacaagtttggccaaaatttgaacagaaaaagaggaattttgattaaaaaaaaattggataagtgcaatattttgaataacttaaaattattgggtaattggttggaaattatatttaaaaattggattaattttcatttttgttcaagtgtttcctattttggttgagcctgcaaaaaaggggcctcaaatgtccgaaaattgtcctaagaaatgagcagcaaatatttctccttcccactccctcttttgctccaaaaatcgaaaatccgttgcggtgcaccattctttgcaagtgaaagaataaatgcgtaatgtgccgtccgcatttcgttgctgccgtgtcggtacagacagtgctgaaatttaatttaaatttcgtgccgttcgatgttctctttttttttgccttggttccacaactctcga

SEQ ID NO: 11796 - DNA, 1381 bp, Heterodera glycines
  misc_feature (1269)..(1269): n is a, c, g, or t
tttgaagttttctttaagtgttagtattctcttgttttctcaaattattaactaacttattcagtctttgggctttcgaatgatactaaaaagatagggtttgttcgaacatgaacaaacttattgttttaaacctggtatgtttaattaaatggactcataagtgcattagagcccaaatttctatttccatttggcaatttcttcattctctgccccttttccccaattttcatttatttcttttttcagaacttttggtggtcggcaccgaatcggtccttcacatcatcggattgcccgcttttcagagggacggggcgacacgcaaagtgcagcggggactgatggaaatttggtttgcgcaggggacgccaacgccgggacactttttgacaggtaaaaaatggaggagaaaagcaaccgctaactgttacccttttcagtcaatttccaagcaaatcaactccaaattctgaacactcgcggcgaattaacgcacgccgtcccctttgaaaaggccaagcaaatctcggctattgtttacgtactgtttatttgaacttttatccaatctcggcatttcaaatggcttacaattagggcactcaattcgtcgccattggcaattcccacggtgtcatttcgttgctcacttcgcccgccctccaatccctttacagcatcgaaggtgttcagccaagtcggaaatggtcgtattgttgttctttcccgttcagcccattcgatgaaagtgcgctgcttaacttttctcactgaccattgcaaattgctgagcggttccgacgacaaaaccatcaaactctttgcgttgggcgaaacgcgtgcacagcttttgcgcattttctgtggccacaaaggcattgtcacggggttggccgtctgcgaagcatccgaaagcgaacggtttgcgagttgcgggacggacaattgcgcaattgtatgggacacggagagcggagagcaaagacatgtgttttccgaatgcacgggaatggccaacgacgtggtgagttttttcgcgcggggaggggggggggctgaaaaagaaattatctagcatatgtggtttttgaattatgagtttatatttgttaaaacattcctaacccaagtttttggttattctgtagcttaattaattaaagttatttttaaaattatacgaaaaaattaattttttggtttttgtttaaattaatttggttttcagcgactccgaaaacctctaggacttacaaaatatanagggggggggggttgcaagcaaaaaaaaaaaggtcgtcaatttacatggctggaccatttcgcaaaaatttgggttgaccacccccccccccccccatattttgcaggggac

SEQ ID NO: 11797 - DNA, 1309 bp, Heterodera glycines
aaatttaaaaaaaaaatttttttttttactttaaaattttttcaaaaaaaaaatttttaaaaattttttaataaaaaaatttcaagaaacaaattttagaaaaacttttcagcgatttttttcaaatttaatgaaaatttttaaagttttttgaaaaaattttctaaaaaaaaattttcaaatatttttcaggaaaatttttttactacgataagaaattcctaaaaatttttatgaaaaatttttaattttttgaaattttctgcggcgatattttgtctcggcgatattttggggtgtacccattttgtatgctctgggatatttaaatattaaattctattaattttcagtttgtttaacgaccaataacacttccttaaaatttaagaagcgattataaactccgtatcggagcaggaaaaaacgtctttcgagaccatatttttaggggctgcagttgcaccgaccccgtttacccgggtgcacccccccccccccccctccgttgggttccaacattcattaaataagtacttataaaagggccattcgtgaccattttctcattctcgttgtccctcttcagccccgttgtgtcgcatttactcccaacggtcgatttttggttgccggttccgaggaggcgagcattttggcctttcgcgtcccgcaacccaaaaattatgtggaacaattgtcattgtggacagaggaacaacagagggaatcggttggagaggcaaacggcgaaggaatggccgacgaatgggcggaagagagaagtgagcgaacggaatgacacaaacaaatacatttcaaatgttgtcatagaaaatttttaaaacattgtcctgcgggacaaaagaatctccgattggtgcctttatgcctcttttccctttaaagtgtcgccatttgccgaattcgactcgccgcatgcaaattcgaagcaaaaccgacaaaaagggagaatgggcgccacttcttccggtggagagacgccgaacgatgcggcggaatttggggatgacaatggaggggacgacaatcggcaaacggaagaggcggcggcgatggacgtggaagagatggaaagacgcgagttggaaatgcaattgggcatcgactgacaatgagcaaactttctcactttcaaacattttcataattatttaaaaaacatttactaattcatcataataaatgtttctacaaaacaaattttcctttggcacgacttttgactaatggtcaattgaggctttcacagctcatttttgtctaaggcattttgaatgctatgtgt

SEQ ID NO: 11798 - DNA, 1017 bp, Heterodera glycines
gtacattggctttcaatgcgttgagaacattcgattaaattggcaaaaccaaatattatttttcaatacaaaatcaggacagaaaggagggcgagaagatgctgaccatcagataagcttgagtgagaatggccggcgaaagcattacgggcgaaaagatggcaccaccgagcgtttggggggaaacgatgtcgggcgcgagcactgacaaagggtaattagccaaatgagaggggactattgcctcacagaggggactgaaaatgacgggcgacagcgcgaaagggttcaaaatgctcggaccgatggccttggagggaaattaagcttttagcactggcttagccagaaatttgtcggaaggaatcactcgcgtcgtccccccccccccaaatgactaatttgggcctattaaaagggaaaattagcagcagcagaaagcccattttgttgaaacagagaaaaagcaaaccaaccactgggctgaggatgaacggagtgagaatggtctgtttttgttgggatgtaaaacaattagagtcccattgattaccggattcagaataagcgaacccaacacaccgggactaaacgccaatcaaatgaagggattaagcaacaatgccgagttcaaattggattttgtacctcaatatgtacggctgggccataagtggggacaaaatgatagggcccaaactgaacgaaagcattttgactaataaatgaaaaaaggaataaataaaaaaagcttctcacagagagggactgagaatttgtgccctgaaaagaaaaaacaaagtgagaaatttgaagaaattaaagtgggaaagatgtggaaatcacctgaagagatttggcgaaagaacatgcggagagaggctaaaaggggcggaaaagttttcgcaaatgttttttgattctcacgaacaccgtcggggacaaaatgctgggactgaaaaggcaaggacaaaatggcgggggggaggcagaagaaggacctgaacgcgttggggg

SEQ ID NO: 11799 - DNA, 3132 bp, Heterodera glycines
aaaaattttataccatatgaaaatttcaattacacgtatttttgcagtcaataagtcatttgtataatggatttattttgtaagatgcaattaatccatgtaaaatacgcttgttaggccttaagataatcacgttcttttgcgcgactgaagaagcatgtttttttataagtaaaattctgtttaattaatcttattataaaaatgatttttttatattaattttttataaggttaacataaaattgcatttattttttttaaacgaacgaattatttttaaaattaattttgtttttatcaattctttttgatgtcttttatttatgatgctacattcttcgcgccacgggttgatcgttcattctcgttttcattatatattttcagatataataaccgaaaaataaatttcatttatattaattttttttttttggtcgcataaggtgcactattcataattgctttatattttattttatatactaatttagaatatactttttcaattcattaaatatcaaaaaaaaaattttgttaaatttatgacttttaacttaccggcttctatattttatttgattatataaaagtgttgttttttattttaattttatgagtttttagtcattatgcatgtttgcttacaatttccttcgaagtttcggtcttggacatattaattttaacttaattagaaaaaaaagtaggtacataatttttaattttaattaattttattttatctattatatttaatgaagtttttaattcaatcagtaacttcagttttttatacctttattttcaaatcaataaaaaaattattaattttcataaataattttgttttagaataaacaagtaatgattatttttaattattattcacaattaattaaatattaaccaacgatttatttgataattccatttaacaattaaaaatgcactagcattttggttttaaggtttcattaatttcactaattttttttgtgtttactcaaatattttccagttatcaattttgtgtaagtgcgcagcttaattgtagattatcacttgctgtcttttttatatataggaaaaatttcatttttatctttgttattttaaagtgttaataatatatttaataattttcttataaaaatttagtttatttttagaaatctaaaattaaaattcattgaaactaacacttttcgatatttgtcgaaaagtggataaaaccgtgcgaataccattttactaagcttgtggagccgagtctaatggtaccaaaaatccacaattctgttcagttttcgacaaattccaatagtgtctatttttttttgaaaaaatcagttttcgatggcaaaaagtgaattttttttagggtttttgttattttttaaggttttagtcccaaaaaggagcctccaatttctaagaatttttgcctaaaaaccatattccgttttttgttgtaaaagtgcccgttttttagggttattttcttaacttttcagtagggttcggaccccgcccccgcccccgtccccgggggcgggacaggtttttggggctcacccccgcccccgcccccgtgactttgacccccgcatcccccgcccccgcgaccttcgcccctgcgggggcacgggggtgaaaatacacccctaagaatggcatattcgtgggaaataaggcaaaaaatttagcaattttgaattttttttaactatcgagaaatttttatgaaataaaataaattttacttgtttttattttatttgtggattggtggatagtgcttcaatactaaacagtacttttgtcatgagttcgattccggctaacgttttcctttaatttatttattttttctgattaatacagggtttctttatgttcttgtttctaagaaatgttctgatttgggggtaatgccttattttcatctaaaagaagaaaatttctgaaaaatttggctaagttctaacaaaattcatataaattcttaaaattttccccggttgcgcctatcggcaccgccggcccccaaaattcctatattttttcttaaaaattatcccaagctcgcgaattttgctcattttttgtacaaaatttgttaacaaattgcattcaaattttcaaaaaattttcccggcggcgcctatcggcaccgccggaactctcccctcgcacattcatcaagttttttttttttttggaaaaatgtgccacaagaaaatatgttacaaatctgagttccaattttgcttgagtaaatcatgataatttaatatattaaaaaacaaaaatttatcgtaaaaatcttatttttttttgtaaacatctattagaaatcgagcttaaatttcaaaataggcgatacattgactaaaggaatgtggagccatcacatcattcataaaaaattaattttttgtaaaattttttggagttaattcaaatcaaacccccgcccccgtccccgcgggggcgaaattttcgtgcccccgtccccgcccccgcgactctgacccccgccatcccccgcccccgcgaaaagccacccccgcccacggggtccgaaccctacttttcagcaaacgcgcaacaatgtttggatggacattttcccttttttgccgtcctcaactcggcctcaaattggcacttctttcgccacgtttcgaacttttggtggacaaacatttcgatggcaaaaaaagttgtcgcggaatggacaaaaaatcactggaaaggaaatctttccctctaagggaattctttcctttccctgtccgacggggacagtgttgaaaaaatgcaagtgatgatttcagtgcccaaatgtggacactgaaactgagagtcctctttaaccctcttaatgacccaacgggggtcaatttaatggtctgcatgaaagggctcctgaatgtcccctttacagattgagagaagagcttttctcttactctttattcgattaaacaaatataattcggtgctgggcagaagaagtcgaagaagtgaagagaatgaaaatggggcgggcttgtataccctcacaaatcaatggggcggaggaaatcacgaaagaaatgtacatacaaaaaatcgatcgat

SEQ ID NO: 11800 - DNA, 1028 bp, Heterodera glycines
aaaatttcaagcatttttttgtaattttttaatattatttttgtacaagaaatttaacttcacaaattacgaatttaaatttaaatttttcatttacgtaaatgccttttttttgctgacattttggtttctgccaatttctgttctattttctgtcaatttgttcagcttcccgccaaatttgctgtcattttcgtgccaaattcttcctttctcccttttcgctattcccttggggtgaataacacaatttggccataattaatgcgtttcttccaaatttgatggatattttaatattgtgatgcacagcacacagtatccgcctgctgactcagtacattttttgaaattatcaatcaatcataatgccaaaatttaatcaaataacccattgacaaagtgcaaagaattcggaattaaaatacccaaataaaattgtagattaattcaatttgtttttgagttttaattttttataatatttcattaaagaaaataatttttaaaattgataaaataattttttaaatttattgtctcttgtcaaatgcaaaaattgacaagactttgaattaacgcttaaccgaatgcgttccccacggatttgtgaaaaattttcgctaatttgccaataatttccatttttcttcgctgtccattagaggtgagtgtatatgtgtcagtccaatatttattgaattgtgggctttaaatggaacataaattatgcaaattctttttttgttactccaatgtgggcattggcattttgaatacattactcaaatgacaattacaatttttataaatttagttaaactttggcaaaattttaaactaaaccgtacatttgattgttgcccatgaatcccacgcagccaaacatttccgagcaaatggctccccccgacaactcgggccaagagtaccatttgctcgtgttgccattcatcgtgctgttcggcctctgcggcaatacgctgtcattggtcgccattttccattctcgactgagaaaggtgcca

SEQ ID NO: 11801 - DNA, 4663 bp, Heterodera glycines
  misc_feature (1751)..(1751): n is a, c, g, or t
tgttggctgccgctgccttttctgctcatttggtccatttcgtgacgctaacgcccaacccatccaatgaaccaaacgattgcaagtgcggcatcagcgacggcggacgattgcaggttggcacttttaacggtctcgagcactcattcccgaagtgtgctggtcaataaagtgtccacttaccatgattaaattggacttgcaaaaacagggttccaagaaaaaaaataatactaccaatctgcaaaatttcataaaatttcatacatccaggtttttttaaatccgtctgtttttaaaactagaaaaaacaattcacgacaatcatgaatttttcaagttttgaaaatacaaaaatttccgaaaaaattcttgaatccatgaaattttatgaaatttttgcagacaagtagcccttttgccaaaatattttcctgcaaaattccaaatcattccgaccataatgaacaatggttaacaacaaatcacctttttcaaactccgtgaggttcttcgtcactaaattgccagtcctaaataatcatagctttttcttactgtattttctgtccatcttacagtattcccctttttaagatgatcactgagttcgctgacgtgctgttgtgctatttgttcccgtgctgtgtggtggttgtgctcaattcggtgattgcttccaaagtgcgccgttctgagaaatgctttcacatcggtccgtcgccgactccgtccgccaccaaaaagtcctactgtacgctgcccacctcggccagcactggttcaacgacggcggcggcagcggtcgcctcggcttccgccattgcaccgccgcgtcgccagcactacgcgtcgccgaaagcgatgacgacggtggtgggcggaggggcgtcgccatctgcggacgcagacgagcggccggcaatgcgtaaactgtccacgcgcaccgcacccggcaacgtgccagtcggcgcccgaacagccggcggtgagtggactaattgattaggctattaattaatagagatgagatatttgggcacaaaaatgggccaagaaaaataaatttagagaattaattttttgagaaattatgtattcattttatagtagattttttgaaattttggaaaggccaaacaatcccttttttattttattgaatttttaaaatcctaaaaatagtcgcaaaaatggctaaaagtattacacaaagtgatttcacattctttttaataattatgctttatttccattgccacattaaatgatcaattcgttttatatttaattgattttaaaataattattttttaaaatgtatttcttattttttaaatggagttttaggctcctcctctggaaatccggcgggaacaacgcgcattctgttggttgtaccggtggtgtacattctgctcaacactccgttctacatgtttcgcattttggatacggtggcgttgaacgtgttcaactccacgatgtttcagtacgacggactgaaccgtaaccccgtgctggcatggtgttacaatgtcgcacactatttgtactacgtgaactttgcctgtgacgtgattgtctacgcattttccaggtagaaaagcacgtgtttgaatttgggagggtttaattgggagaattttttgtaattagctccaaattatttgaaattttgacaaataaattttaacttttcttactcaaaattccatgcttattcataaaattaaaataaaagcaattanattgaattaattaaccccaagttttcaaaaagtttttgaaaagcgcaccactaaaattgtcaaattttttaggttaaaattgagcctcggaattcgatttctgaaaattttggggcctgggatgccttgtataaaatgccaaattggacgcacgtttactggcgccaacgaatgaattggatcagatgattaaagtgaaaaaaggaagatttcgagcatttaaagagaaaatttggtctttttttgttaaaaaagtttgttgatcactactcaatcggggtccccgacccccgaagaggagaggggcatgggatggcatttttggagaggagaggagcatgggatggcatttttggagaggagaggagcatgggatggcatttttggagaggagaggagcatgggatggcatttttggagaggagaggagcatgggatggcagttttgggaatggggaggagagggacatggaattgcatttttgtggtatgggaagacggaggagggaccaatcaatttgatttattaatttttacttaatttcccataaattgcaatggagtaattccagttaaatcagggctcggatcgggcacctccctttccaaggacgggtataccatttccaaggacataagagaaaagttccattaaattcaaggacatttaaaaattttatcatatgcaatgaaaatgattaaatttccaaatggtttatatttttcgcgaaaagaaatttttaccaatatttttttgtttctttttgtaattttcctcatttcaccgcatatgcacttttttgcggcgcgttttttacaaaaaatttccgaggaacaaggcgccgccggggaaacatttgaaaattagagtgtaatttgctaacagattttcaccaagtaaattcgggttttaatactatggcgatgaccattttttattttcgcaacacttcttgcggctgctttttccgaaagactttttgggaatgggggggggggcggcgggaaattgttaataggtttttccaaaattggtcatttttaacgctttttgggtgtcttaataagttaataaaaatttggtatagaaggtcaaatgctcattttcaaggacttcttgaattcaaggatactttcaaattttaaagtgagagggtccaatttccaggacgtccttgccattcaaggacgaatccgagccctgagttaaatggaatgggctgattaatatgtgtttttatttctgtactttcaccaatttctaaactcagctgggacagttgtggctgtgagtctggcattgtcttacgcgactcagctgagcgcgatgatgcgtcgcgcaacgtcgacttgctcgaggctgcatttggtggaggagagttggcaatcaagccgaaaacgatgacacgcgagggaggacagcaccccgcggggacgacaccggtgcaaaggcaaggcatagccaaagtaaagcaatattaagccaaattcaattagcattcaaccaaagtctttcagtcgagagaataaacgagggccaagcgaagaagggttttgtctacggggaccaattagcaaatagcagagaaagacgacaaagtccccggggcaaattgggggggggggagccatggcggcaggtcctttgacgtctttggtcagttacacacacaaaacatattaataattcccctgaggagacggttagaatttagagaagttttggctgtccaactgaaaaattaatgtgccggaaggagacgacataaatggaaagggaaggaatggcctaggcaagcaaaggaaggagaaggcaatgttgcggaagattggcaaactccgctaacggcacaattctttcagcaaaaatgcctttccgacacactttcgttcaatgcccatcgatttctcggcactgcgcaactcggagcttttgttgagtgatcctttgcccgggggggacgatgtgccgactccgatcggctctcagagggagtccggtcgcggggccattctaatggatgcgcatttggcacgaagccaaaacagccatcagtcgcaacaaacagagggggctgatcaccacgggtctcaccaaggggcattccgccgcgtgctgcgccgaactcgacggaattccaacgggggaagttcggtgccttcggtcgctgcccgaacgatttcaccacaactgagtgttggccttggcgaaaagcgtcgctgggggaatacactcaacgccgaacaacagcaacaattgtcacgaatggaactgtcggcacttccgatcgcggcacgcactcgcggcagtctgatgggaggcgcagctcaaacaggtgaaaagggaagggaaaaggagagaaagacgcgacgatgagcacaattggtcaactgataaaagcttattcattcagcgacttttcacagcatttgctgcgcaattttctgaataattaaatcttaagggtttttggtcataacttaaatttagctttttgggttttggaactaggcaccgccgaaataacttttagaacctttaatgaaattgttgaggaaagtcaaaatttaagtctttctctatctctcccccccccccctctctctcgtgttcgttttcgtctcgctctttccatctcatctcatcttatttatgcagaacacctccttcatatttccgtgaagtcctccccctagtgacaataacgcaagaatctccgtatctttttcgcctgtacagtgacaatctttggaccgatctttcccggatttatctcttccttgacctttcaatagaaaaaccggatgtggaccggaaactgggtgtcaatcgcagctacccgaagctcaagtcagccaccattcagggaattgggcaaacatttgttcaacaactaaaaagctcagttgga

SEQ ID NO: 11802 - DNA, 2003 bp, Heterodera glycines
  misc_feature (5)..(5): n is a, c, g, or t
ttttntatcgtgttcacattggttaaaaaattgaaaatgatctcatcttgcatggattcaacaaaagtatgttggcttatagaagtgaaacggaaaaatgttcgaatatgagcagaacattaaagacttggtgaatcccggtaacaaaatctcaatttagctagggaagcacgcacagaagtgattacttgaaaacaggatgcatatccttggcaacttgttaggagattctggcaataaattaagaaacaacaaaacagaaagaaatattcaaaagtgagcactttttttcgaatgggcctgattcttctgaacattttatttttcttaattttctttgctaaaaattatgacattattgcaaaactaattcacggcccttttttgattagagacaaattaatatatgcgaaattttttaaaaacgtgcttagggaaagtcttcttatttaggatatttccttggcaacgatagcgtagattctagcaataaatttaataactagaaaagtgaaacaaaggctaaaatgtgagtgatttttttaaaaaaggccgcacagctttctcgcggaagcgtttttctgaacctttttctcagaaaaaaatagtcgtattataaaattaattttcacccattattttggttgttaaacaatattaatatcttacgcgttaggtaaagcgctggcaatatcgcttttttaaattggtgttacaacaagaaccttaaacgatatgtagcggcaccgaataataaaaataaattttttatcgtgttcacattgttaaaaaattgaaaatgatctcatcttgcatggattcaacaaaagtatgttggcttatagaagtgaaacggaaaaatgttcgaatatgagcagaacattaaagacttggtgaatcccggtaacaaaatctcaatttagctagggaagcacgcacagaagtgattacttgaaaacaggatgcatatccttggcaacttgttaggagattctggcaataaattaagaaacaacaaaacagaaagaaatattcaaaagtgagcactttttttcgaatgggccggattcttctgaacattttatttttcttaattttctttgctaaaaattatgacattattgcaaaactaattcacggcccttttttgattagagacaaatgaatatatgcgaaattttttaaaaacgtgcttagggaaagtcttcttatttaggatatttccttggcaacgatagcgtagattctagcaataaatttaataactagaaaagtgaaacaaaggctaaaatgtgagtgatttttttaaaaaaggccgcacagctttctcgcggaagcgtttttctgaacctttttctcagaaaaaaatagtcgtattataaaattaattttcacccattattttggttgttaaacaatattaatatcttacgcgttaggtaaagcgctggcaatatcgcttttttaaattggtgttacaacaagaaccttaaacgatatgtagcggcaccgaataataaaaataaattttttatcgtgttcacattgttaaaaaattgaaaatgatctcatcttgcatggattcaacaaaagtatgttggcttatagaagtgaaacggaaaaatgttcgaatatgagcagaacattaaagacttggtgaatcccggtaacaaaatctcaatttagctagggaagcatgcacagaagtgattacttgaaaaaaggatgcatatccttggcaacttattaggagattctggcaataaattaagaaacaacaaaacagaaagaaatattcaaaagtgagcaatttttttcgaatgggccggattcttctgaacattttatttttcttaattttctttgctaaaaattatgacattattgcaaaactaattcacggcccttttttgattagagacagatgaatatatgcgaaattttttaaaaacgtgcttaggaaaggtcttcttatttaggatatttccttggcaacgatagcg

SEQ ID NO: 11803 - DNA, 1224 bp, Heterodera glycines
ttttgcaccaaaaagaaatcaaattaatgttgttaaaatgtaaatttccgccgcttttcagagcatcgaattggagaccattgtggtggaggcggtgaccggccgcggcgttcactctccgcacgttttctgcttctgctacgactgcagccaaaagccgaacaattacatcattcggattgggctgaacgagtgagtttttcaactctctcttcttttccatccaaattatcgaaacaaaaccatttttttaaattggttttaattttattgcaccaatcccaaaatgtcctaatcgtttatatatcactaatagaaagattgctgttttaagaaatggaatgataggggtacggcagtgccgaaatgattcaattagttcatcgtaaatactgaaccaagtatttcctggactgaaaacgacagtttcgtttcaccgaattaagcctaaatcaaaaaatctgtaattttatgtagtaaagcttcagactgataacctaaagataacacgtaatctgagaaacatgacccgaattgttgaaaagagcccgatcgcttaatgtgcatcaatcatttcattgcagttttttgggacaatagtctcccttttttgtcccctttttagggtcgacgaattgcccacccccgggcaatgggttcgcgttgtgatgaagcaggaagtgcacgggaagcgggtggactacagcttgtgggaggcgcagaacatgagcaaggccaagcacgagacggactttaccattgacaacggaatccgtaccgttttggtgggttcaatcgaagacaatcccatccaacttttcctaactcaaaaacatttttcccgcttctcaggtccgtgttcccctgaaagtgtccggcgatggcttctacaaccaattcttgggcccagtttcggacatcaaacgaaggtcacgacatcccctcccctctttctaattttatttggatttttaaaaatttcaaaatttagacttaaaatcccaaccggcaaagaacgccgatttgtcagcgcgtggtgccgcaaagtgatgccgttgagcatatgcacaatggatgggtgagaagggggactttttacgatattttaatatattattattgttaatcttttgccttttcagtctttgccattggggaattgcgccgcttccctgaggagaatgggggagtgatcagtcaatttataaattattcataaattaa

SEQ ID NO: 11804 - DNA, 2888 bp, Heterodera glycines
  misc_feature (124)..(124): n is a, c, g, or t
gttccatagaatcactgataattgctttctccctcttttcagcatgatgaacccccgattgagctgccgcacgagagcaaaacgaccttcaaaatccccgtatgttttctctcttcttttcctnttctcccaatcgatcgaaattcgagtttaaataatcccacatttaacggagcgcaacactgtgccgtttgaaattaatttctaatcggaatgctaacaataagcattttactaatgttgtttttaatggtatccgttatccattcctctaagcatacatatgtatatgtatttgtttttaaatttaatttaattttttattttactttattttcgtttaactgtaaatttattgcattaatttattttattttttgtttgtttattcaacgaatgctttcgaatgaatcaaagttcgttgtgcataaataatttccctttcccacccgccgcttaagcgcacaccaaacacaacgcaattcgttcccccccgcccccacttgtccttccatcgtccttcccttccttcaccaaacacccctcccctccccctctctttttttttgcttcaaaagaaatcatcaaaaagcacaacgcccaccacacgcacacattcccttttttaaaatagaatttaatacaaaaaagcaattggtcgggcggtgtttaagcgcataaaaatttgttttatttttacaattatttgccatttttaatttaattcggcctaaatttgaagtcccttttcgccctttctgtttaatggaattacaacattcgtatttcctcttctgctttattcccgacaaaattgctctgcattctgtacattgtagtatgctcctcatactgtcagtgtaaatactacagtacgcattggggcgtgtcccatcccataattattatttgtctgccccccgatatgaatgttttcttcacccgtccgtttcaccatctccatcacccatttccctgttcttttacagtttgtgggttctcgttatcgatcgcagccaacgacgaccgagggacaattagcgaagggaacgacgccgccaatgccccaaacgtcacaacagcagcaaatacagcaggtggagggggtgaggaaagacaagaatggaacgaagtgggcaatgcttaaattcgtttcccacccttttagccaatgaccatcagcaaaccgaaccagcatcacaacgccaacaccggtggacaccgtgccaacgccagcttgtcgccggcgctgggatcctccggtttcggctcgtccgcctccagcaacgcttccgcccaggtcgagcgcgacctgatcgacctcttcgacgagaagtgttcgattgggccgccgctcaaatggacgccttcccctcctccgcttcaacagcaccaggtgtttatcagattataaagatgacaacatgacgtcaaagatatttgacgacaagaaaaatgctttgaccttttgctttattttaattctcatacttttttatatttgtttcgtttggaatgttttatttgtttcatatgataatccaaacctattagcataatgagtataaaattaaaattgcgagagggattgacaaaataaataaataaattacaattcccattcactcccgttttctgtcagcttatcatttttgtaatgttgcaacttgcaatctgttccagttctccggtgtgatgtacccacacaccggcgtaatagcctccatggacctcaaatccagaggctactacgtctacagcaacgagttcgacaacgaactctacctgttaacggaggagttgctggagaagggaagctggattaaatttaacatcctgtaagatagggaatttgggaaacaaaaaatgcaaaatttccctcgattcagcgacgattattaccgcttgacgattggacagtacgccctgctcaaaaaatcccccttcgacgtaagagtcgaaagaaacacaatttatgtgggttttttcactgggtcttgggttaagtttgtcttgatatattgatttttccagatgtgtgtcagcgcgtacattacccccgaggcactgacgcaacgtacaatcgacacttcctacgtcaaaaatgtaaaaaaaaatcgattttttttaaatgtaatgaaatgatttttaaggtctacgacagatgccgcttgcttcagcatgcgcatgttgggaaggagctgaagctggaggtgaagcgcggcaaagtggacggattttgctgggccatcagcagaattatgaaaattgggaattaaaaagagtgaccattagcgaaaagcgataaaaacccttaaatttgtgcctttttgtacagatatttttgtggacaaattttcattatcctttttaacaagcccagatataaaaggctttttacttattccttgacatttatttcataaataaacttgtgatcttttttgtttttactaatttgttcaaaatgaaattggtttgatcggcctggcaaaataaaataaaagtgattgaaagtttttttttgaaaaaaaacaagacactcaaatctggttctaagggttttcggggctgctgaattcgaatttgacatttgttttgaccaatttcgagtccttgacccggattcgaaccaaaagtcaaaatattcgaatttcgcacatttattttaaaattaattaaatcacgcgaatgtcctttgcaaacaattgtaacattaaaaatgggttataaataaaagtgaatttgaaaaattggattttgacttttttgtttgggtccgggtcagggttggacgaaatttcgtttcgtcctacaaatcacattttgagttttgtccacccaccactttcacccctttccattcattttgcccgcccattgtgagt

SEQ ID NO: 11805 - DNA, 869 bp, Heterodera glycines
  misc_feature (52)..(54): n is a, c, g, or t
agcgaaggttttctcgtgggcggatggatgggccacaaaaaacaaaaatcannncagggtacactcattaattaaacaatttggagtatttggcaggtgccgccaacaacgaaattttccaccgtcttccgccgattccgtcgtccctccgccgtccgcgccgcctccgccgtacagtgcgtacgctgtcactgctgcgacggacgcgcgccgaatgcgccaaaacgtgtcgccacattcaaattgtccttccgtcgtctcggccctctcctcgtcaatgattccgcaacatttcgttaggtgggttaaagctcgaattagttgcagaatcccgaattctttttttgtccctaaattgattattaaaatcgcattttcagaccccctggcggtggtcccatggcggaccctccggcactgtcgcgtgaccgtccgcgcagcgtagtctctaacattgagcacggcgtcgtgttgcaccaccgccttccccacgcgacgaacacagcgggggtaaaagcatcgccaaagattgtgctaattttagaaatttgataaatgttcaccatttgtcctattccagcagccttctccactccatcatgctcaagcagtcgctgcaacaccaccaccgccgtcgtcgtcggcggtagcgtcggcgttgttccaccaccatcggtcgccacaaaatgttaccagcagcaacagtgcatcttcactgatgacaatggcggcgatgatgcaccaccagcaacaacgacaacaacagcaacagaacagcgggtgaacgagttcacctccttccctccccccttcgcccatctctttcaaaattgtattttcaatcccatgagaaaaagccaaaaggagaa

SEQ ID NO: 11806 - DNA, 2337 bp, Heterodera glycines
  misc_feature (2328)..(2328): n is a, c, g, or t
tttttttgataaaaattttaggtgtaaaacttttcttattcgaaaaagcaatattaataatcatttaaatgaccaaaaatgaattttttgattaagttttacgtgttttgctccctataaatcattaataaaaaaaatttaaatgcctattttcatgcctttttcgtgattttcgtgccttttaatgcctttttttcaaatttttggtgcctattatagtgcctttttcgcatttttggtgactttttagtcgtgctctacttattattgtatttaactcacaattatccaaattattattacagtcgattgtgtgcccattcgctcatatcttttggccaaaaaggttgaacgtattcgttcaaatgcaattgcaaaatgaaaacatgggtaagcgatggagtacaattttggcggtcccaaaaacatcggaaccatccaaacggggctcagaaagtcacaaggatgtttatacgtgaacatttgaatctgaataagcatttaaaaattaaaattatttttaaaatccctgcatttttaataagcattcatttaaatttttaaaaaagctttgggattacccgatatcgtaaaaagaagacaatccaaaccagtgaattaataatgtaaagaatgatggtgttgacaagtagaagcttaaaaaataattatgtatttaaatattcaaaaatttgggttaaaaacaatttttcatgaaaaatttcaaacatttttttttgcatctttcgatagccattaatgttaatctttcattgctttttcaaaaaaaattgatcttgtttcaaaaaagataaagacgaaatttttttttacaatttttggtcatctttttttttgaaacatgagaaaattgacgatttttttgtcgaataacagtacgagttgggttttaccgtataatccatagaaataaaagaaactttcacctttaaattcttatgaattgggatgcaatttttgttgtatttgtggatcaatgaacaaattgcaattagcacaacgccaagcaaaaacagttgaatatgaatgacaaggtaattagaaccgaacaaagctgtctcaatatcaatacaacttttgtcggcgggcggtaaaggagatgataatgatgagttattagccattaattgttcacttgaaataatcaaaatggaagtattaataataaattaatactaaaaaattatttaacttttatatatttgaaatttcaaataatttactaaaaaaagatgaacaaaaattcatcaaccaactgcacagaaaggggattccgtaatgtgttgtaattaagtagagcacatagtaattactggctcatttataattaacgctctataattatggacttactttacttttaccacattatgatgaagagaaagtgccaaatgcaagtgtgcaatttgggcaaaaatgtacaaattctcttacgtaaacaaggctattagtgcttacattcttttttatcaaatttaatttgcacttccgttgtcccacgaattgtccggcaaggcggcaaaaagcgcggaaactttggcagcgaaagaaagcaattgtgcacatggatggatatatgagaaaattggaattgattttgtgcgaatatttctcatccatttttcttagtgaattaatcttaattaaaagtttgagttttattaataaacaattaattgaaatgtaaatgaagattttttatttttctctacagtttttggcttgcgcttttctcaaaaaatttgaattaggattttggagttctgcagtgccgaaaaacgcggtttgggtccacaaaacgcggcaaatgtgctccgagtttttatctcttacaaacaaaatagttttaaatcatttattattttatccaaaaaatgttcaaaaacaaattttggatttttgaatattgttttattttttcagtttgtaatttccatatgtgctaattgtttaatccattgttatttggaggatggttctgaatttcgggcgtttcttcgtttccaataagcttctttaaccaagcaaattctttgcaaattgcgcgccgataatcttcactaaaaatttcaattttagtgaatttaaaaatatttataattcatcttaattaaaatacatatttgaataattattttaaacaatttatttttattgccttgtcatgtacagaattggaccaatagacgcggaagatatattggataaaatggccaaaatttggcgcgtgaaccataagactattggtgaagcaatatgtggcccaataaaactgcaaagaatgtttagagtaaaataaccgccgantattgacac

SEQ ID NO: 11807 - DNA, 1802 bp, Heterodera glycines
  misc_feature (1752)..(1752): n is a, c, g, or t
gtttttaattgcacaccacaaaattgtttgtcactttacaggtgttaaatgtaattactacggagtaaaaatggtacccaagaataatttaatttaaaattatgaagcatggaaaaaagaaaattgaacaactcaattaccaaacaaagcaaaaatataatcactttttttacaattgacgttacaaacctgggcaagcttaaagcaattgaaataatggattcttgagttttgtccatgttggcttttgtaaatctgttctgattccgatctctagtccagaggtggtaccgttttccaaagtgccgtttccgtctcggccattgtcgattgtcatggccatcgtactgaagaggagcgccacaaggcaaaacagtaaaacgatcatttgtcaaatagttgaaattcaaaaatgatttaatcttagtatggattttgaaaaagaatttaatattcatttgataataaagtaaataaataaaatatttttatatttttttattgaaattgcttttcatataatgaatgaaatgacagttgataaattgggaacagtcaacagaaagagataaaaataataatttattcattattacatattagcattttattataatgcatttgctgacagaaccgatgaaaacaccaaccgtcgatgctataggagatttgatctaataaaatataaaaatacataaataaatgctaaatcaatgcagcacaaataaaagaagaaattaaaatcagaaaaaatattttttatttaattttaacataaatttccgtactatattttttgcaaagaaatttttttttctacatccaacagaaaataatgtctcaaaatcaagtggaaaagaaaatgtaattaaaataaagcaaagttaggaactattgtaaaaataaactaagaaaaaatttaaaaaaatcaatttttttaacatagtcggatcttgtccaattaatatgtaaatattttaatttcattaaacaaaacaataggcatataatgactgataatttcttctttttttattttctaatgctgcctatgtaatatttctataaattatgaattgcaattacttaattgtcttgtaatgacataacttttgctttccaaatcacattcatcatcattagcatcattcatgaacgcacaaatgagttgtttttttaagaaagttttttttttgtttggaaatcggagcgagtaactgatcggacaaatgtcatttcgcgcacccaaataagcgttaaaaaacggttccacatcgactttttatacacagaaaaacggtttatgctttaatgagagcaaattaaatttaaaaaataaatatatggcaataattagcaaattttttttcatcattttgttccatataaaagcggagtaatcacaacgaaacaccataactctacatattttcctcattaacgtcaataaattttccacaaaatgtacatttcgatttttttattcaaaattgtatccaaccaaaaagcattttaaatttgaaaattttaattctaaattgaaaatccgcaaaatttagcgcttaatatgcaagagactcacattgttctcggcattgcctcgctttgctctctgctggcgattattgtcaccgtagtcactttgccatcgctgtactcggagatgagccaactgaacaacaaagtgcgcgacggcgttcaagtaaaaacaattttaaaaaataccgtaatttattaccgtattccccaggncttccgcgtcaacaccgactcggcttggactgacctgatggacgtgcaag

SEQ ID NO: 11808 - DNA, 1947 bp, Heterodera glycines
gttccttcccccccccccctccttccgccccaccaatttttctcggcatttcgcgccttctcaaaatgtttcgattaattcctcttatccctcctctgccccaactcttaatttgagtttcttctcaaagtgcaagaaatgggcactccaagttacgcaattgttccaacaaaatttgtttggggtgagtaatggcaatggaaaaggcaatggcactggtaatgatctgtctaatgatggcccaccattccattaattgtaagccatcccattaatgcggaagacaaacatttgctactcaataaataaattgaagaagataaaggtggaaaaatcaaagacagaacaatgctacaagaaaaaaaaggaaaaagaaaattagaaaaagaaaattagaggtttgtttccctctccaacaaaactaaatgttctgccaaaacgcaaaatgcaaaaccttttcaaattattgtgccattctgccgtactttgcttcttttaccttatgtgtgatcagagtgttcgatcggctgaatgttttgtcgcaaatgtcacatcgatatttcttcgcgttggatgaccgcgtgttgcgattgccatttgtcgcgtgcctttgctgttgccgtgccgttgtgctcgacctgcgtccgattttgttttcatttttgttgtttgttaagctgtaagtgccaaaatttgcctttccatttgcatttttttaatggcactgactttgcctcgttggcacttacgctgtttctgctccattggtgccgtggttttgtgccgatgccgctgctgccgctcgaaatgcgccgatggtggccaacacggcactggcgggcccaccgttgaaaaagttcggcatcgtccattccgacgagtaattggtgctgtccatttgtgcagaattcatacccgatgtgcccgatgttccgtttatattttggctattcggtgctttgatgcgacattttactgatgttgccattgaagtggttggcattaaatgacgccacggatttgaaggagaataaaagcattttggcatccgattgttggaaggatttgtgggaagagaaaaggatgaagcagggaaaagagggagtcggaaaaagctaaatgaataactaaataatggttgatggttaaatgactgacgagtgatactttgtcggaatgggcgagtgaccggggggcacaaatggccacggcacagaagcagcagcggaggaagccaattgttgttggaaaagatgaagcttgtacaggaactcagccgcttggcccttttcctacagtttttgaatgtttcgcttttcgcccttttgtccttcgcttttttcaccgtctcgctcccctcgccgctctctctcccttccgcactctctcccgctcctctatcgggttggcgttccgtttcttgcgctccctgtcgcactgccacgggcactaatttgttcaatgcttccaacaatgctttgctgtgatggtcgttgccaattccggccgggcccactcgctgatcagtccggtcagttctgccacttgtgttcgtctctttctcctcctcaaaagtgggcagcacttcttcgcttacggtttcttctccctctgttccgtcgttttttgtcccaatgatcggccctttgtcttccaaattcaactccggcattgtcttaatttgatggcgctttccacccaattggctttgcttctcacttgcctctttgccaatttcttccctttccctttttggctcttccggcggattaaatgcattagtgccatattttgctgccactgtcgcggccaaccttttctgacgttcttcaagcaaagaatcgatgaggaagcagcgcctttgagaagcgactgatcggaccgaacacgacgaagtgaacgacggacgcattggggattaagcaaaagtaagcgcaattggtggaa

SEQ ID NO: 11809 - DNA, 1786 bp, Heterodera glycines
ggtaattaattatgttgatttggtcattgattagtcacttcaattttcaattggcgcgcagtttcaatcagtcgccgaatgttcggaattaccaccttttgagcatgttcgtggaattgcccactgaacgggtgcttttccatcacataattttggacgtccaccaccaaaatggccattttatgggccaaaagcggacggacgcggccatttgggaaaatgtcacagggccgaggacgacaatccatgcaaaagtctaaatggtgataaataacaattaattgcatttacttattatttatttgggtggaacgggggaaaggggcgaaaagggaaggaaaagcgatcgataaaatgcaaagaatcgccgaaaaaaataaacaaaataaaatgggagaaatgtaaattattatatttattttttgttttcactagcgttcagtttgatctggtagttttcatgctattttttggcaacttgaattcgaataaaagaatgtgtggagggatgagacaaaaagataagggatggcagtgggttaggagaagacgggacaaaaataaatatattatttttacaatattttttaaaaattgattgttatttcaattaaaatgagaaaaaccatttaaaatattaagcaaatatttattttatatttcagtaagaaataaatatgaaacacatattcaatttaatttattaaactgaataaaaaaatatatttatgtaaacaaatttattttgaaaactaaaaatataaattaatggtcatttttcatttttaaaaatttaacatttttcataaatgcaaaaagataatgatggattagttggctttgtacttttcatctgtaggtttctattttgttattaatttttaaatacattttttttgtctatttattttgatttcatgaaaatatgaaacatgagaaacggaaaggtgttttttattcacacaaaatattttccaagaaaatgtatttaaatttaaatttgttttacgaattcttctgatttgaattttctgctgcgtatttgcgattcttcgagctcaatgtttcaacgagcaactgatttcattattaaacaataataaaataaaaatgaattaacattcaattgcttagcattttataatatgaatgctttattatctaaattggtttttgttaaatgattttgtcaataaaataaagtgccaaaagtggcaaaagtgccgccgtgcccatcagcaacttttttcccctcaaagtgttctctccacccgcccgcataatgccaacggccgccgacttttcggctgccaattcgctccaataattgcaaacattgcaaaaatcgctgtccgcacaaatgcccaataaatattcgatgtctttccacaaactgaaaaagaaatcacttccattatatgtttaattgacttgcatctttcggcattcgttcagcgaagtgaacggcttcaactcgttgttgtaccgaatctgcggggattcactgccgaaacagccgcgacggagcaaaaagtgaccactgttagtcacattttgaagtcgaactggcgaaaagtgaacaaaacaatagataatgggcaaatatttggctaattattacgaatgtagcaaaaggaaccctcgcaaatgtcccaaccgaaggcacaggcaaaagcatccgaacattccttacgatggcaaagcaatgccaaggcaactaaataaagaagcatgcttaaggcgaattaaagggagaatttaaatgattttaccgactctgaaaaag

SEQ ID NO: 11810 - DNA, 3771 bp, Heterodera glycines
acgcaacacgcgctacttccgccttcgactcaaacagatgggcttcattgtgtacgggtcgaacgattcgccggtcattccgataatgatttaccaccctaccaaatgcgggtccgttttataccgaaattttgaaatgaaagggatagaagagacctgacaatgcatcgggacttgagcacttgtaggagacggactgagacttttagtacatgactaacgtgtcatttgccgggattcctagtcccggtctttcctcttgataagtcccgtctggctcgcgtcatgtctttagtccgtcaggctgctcttttggtacactttattccattttgtccattccccattttcagactttgggggcgtcttttgctggagcgcaaaatcagcgcggtttgtgtttccatttcccaaaaattattgcattttccatttggtaggtggtcgtctcttttcccgccactgcaatgacagaaagtcgttgtcgcatttgtatcagtgcggcacatgacaaagagatgctggacagagtgttggatgccatcgacgaagttggcgacatcagtgccaccaaacattcgcacagaacgcaccgttaccgccaattggacgtgaaatggtgaacaaagaaaggggagaacggacacacgagaagagaagagacaatgacgggaaataaacaaaaggaccgacttttgccttattttatgttttttgttagatcatccgttgagttttgctacgcatttctttcacgcgaacttttgccattgccttttcttgccgaccctttcctccctaattttgctcatcactttgcttcttctaatgccctccctccccctttcgtctgctgattgtttccctccgccgttcttcgccctcgctttttcccactcgtcgaccttttttaattgattaattgcttagaaaataaaggagatgaaagcaaaaataaataaatttgttagtccttcggatgaacgaacatatggcacttttggtgctctttgggcgggagcgtggaaccgattcattcctgatcactttgacaaaataaaatgcgcctcctccgtttcgctgttctgttgatcctttccctccaaattgcggagatcattgccaaaaagcccaaatattgtggtgaacgctttgccaaaatgcgggataaggtgggcgacacggcacaaaaggggagacgtacactttttgccttcccccacttttcgctaggtttgtcgctggcccggcgaacagcagccgtgtcttcaactgcaccacagcatcagtaaaacattttacgcacagcaattcttccccccccccctaaaaacactaatggaattcccctttttcgagccttggaaatgctagtgaatttcgtcttttcgggggcacaaatgcctttattaaccaaaatcagcttaaaatccccgcgacagaagagcgtgttcgtacgaagtgctgtgcggagggctgctccctggaggaaatgaaggaggaaatgtgctgcatgacggacgcatgcctacggaggtgctacccgggaaaaggctaccgactgggctccgtttactgaatttggcacaaagggccaacagataaaatgacaaagatgaaattcacggcactatccagaaatcatttcttaacaagaaaggctatatccaaaagagaacatgtgctggtgaagtgagatccaaagggaacaaaacaaagtgaggggaaggaagggaaaacaaccaaaggttaaggggtgaacaatcaaaaaaaaaatattgcttcatattttccttccattacatcggtcatcggatcactcgtcctttcgcttcatcaccatgacttttggcttgtaagagtaagcgggcacttgcagtttattgagcggagaccaattgagccaattggggagagtcggcttcttccaaaattgctaaaaatcaattgattaaacataaaaaccaattgcattttttggaccttatgaaatgccttgacaatgaaatgtttcgtgtgtgtttcattcaaattgttttttgtcatctcagcacgaagacgaccatcgtaattgccgaccaaaatgtaatcgaatcgaccaaactcctcttgcgccaaattctcagttttgttgtatctgataatgagatttgattgtaaagaagtttgctaattatcggcaataaagatcaatagcgaagccagggaatcaaaggtacgccttgaacgagacatttagacaatacactcactcccacgcgtcatagaggtgcaaaaagcgactgatcccagtctcagccgaaaattggtcgatgtgaacggcgattggcttgtcccgaaggaagcggtgcttatgctgaacaatacgtaaatgcacaccgaatcttttaaacgggcgccccgggatggtcccaaaaattggccgggcgccagaagggcgcggcctttttggaatgctgacttaaattaaaaacattgcgtatgcttggaattaattgtttaaaataatgagtgatcgggaaaatgcttcataagtaaatctttgttgaaattggagaattcacctgcaatttgagcagtgcaactccgcccgggtagttttgtgcgctcgcataaacaaaactgacggagaaaatggcattgacgagcaaatgcaacgcaaccaaaaaggcacagaagcggaagaaccacgagtcgcgagcctttttccatctttaaatgcaattaatgcaaaaacatcaaaatcaaaacaaaataacccatagcaaatcaaaattttttagatttttgatgaaatctgctaaagatggctcaaaattacaaaatttggtcattttttggacaaaatctgttaacaaaccgcatttaaaaccgcaaaaaatttccctggcggcgcctatcggcaccaccggaccccctgtcccccaaaagtttttggaaaaaccgccgcaaaaaagtgggtgtgaaacaaaaaggtcgtcgcccggggggaggcactcgcccccaagccgaaatcctgggaccgtccctgccccctcccattttttacatccaagcgcaaaaaacagcaacggaagtgttgaacaatgggacagcgtagagaatgaaacggagttccttgtgcggcaaaaaggagaagagaagcacaaaaagaaaggcgggaagacacagcgaaaccaaagcgaattggacacgttgatggatgagaaggccaaaagggaccaaaaagacggagagaaacatggcacgaggcaaagcggagaaaaagtaccaccaaaagggcaacacctgaggagacgaaagggagggacaaatgggaaaatttgaatattttaacagaatttgttgagggatttcttccagtgtatccctcataaaacaataaacgagtaagagcaggagggggaaagtccccccattggtgcatttttcaaaaattgtctacgccaccccccccccctttttgaatttatgggccaatttgtgaaactcacgccgtactcgctgctacgattgtgccacacattaaagtgaatcacttccccctcaggccaaacccaacgacgccacatgagagagtcgagaagcacagacaaaactgccaatgataagagaatgaagaaaagaaagaaatcaaaataaataaaaaacaaactcaagacgataatcagcgaacaaaatccaacgagcaaagttttgagcaccgaaatgtgacgccaataaacgacaaaaacgaaaagaaaggccgggccgaagagaaggagaagttca

SEQ ID NO: 11811 - DNA, 1509 bp, Heterodera glycines
atttccctatagaactttttttgttgccattcgatgcttcttattctcagccgacggcgatgtccgacattgagcaccaccggccgctgtttccccacagtttttgtaggattggccgacgacgacacattcttctcattttccgcaaaataagattttatcttttcaatgagattcattttttaaaaaagggagaaaaaacacacacggatcaacagaagcagcatttttccttctcatatttattcatcgcctattgcttacacaaaaacgatcagaacacaaaccaaaaaatgttgcgaacagaattttgttgtcatggcagtcttaagatagagtttcgaatagttttttttaattaaaaggctagaatcgttctcaaaaatcataatgaaattctctagaaaaataaaattgtgaaactctgtggtatgaatgccattgactcgaaatttagttgcctcccgagggctcggggctcggctaactctaatccatttatgccaatttccttggacgaatttcaaactaataaatccttccttcatgtgctttaccctttatctcaatgtgttatttttcagaaattttttgttgaacttttcaaaaatacaacgaacgcaccatgatgaatcagcaagtaagttatttgataaaatcgaatattcttatcatttgggagggtcacgaagaaagctgcgataaaatattatcaaattcattataaaaaataagtttttgccctttctcctcaaaattattattattttaaaatttggctgccaaataaggatgggtcaaaagaaaaagtgccattgtcttcccactgagcttgtccatgagttggtttcggcattgccgtttaaccaacgctgggcaactgagcgggtttcatggttatttgaccactttattttgtcaattcaaattgaatggatcaaacaaattttgtcttcggtagaaaattaaattaaaaatctgattgtgtattttaattgtgcataattaattgaggtgcatgccttaattgcggcaaaagacgcgttgttggtacgtgtgaagcacagtgcgggcgctgaccttcgtattttgtttcagagtgggtaaaactccaaaaactgtgctaataaagaaaattttaaaaatttttaaatccctctcaatatcataaatttgttgccaattttaggtcttgctttgcatttcgaagtgccagaaaatctcggaattgaggaatggctggaggagaacgatgtgggcaattacagcatcgaccaattccgcgcacaagtgcatacgctttacttggagattgttcgaactggcaattctgatctgatccgggctgcgacggcgtgtttgttttttcggggtatcaattaacacaacatgggccagatggtgtgaccggaaaatgtgacagtgataatttaatatttgtttgaaaacgagatgcaaatttagttttgttaaggttgggttgaaaagggaaccaaatttcatttttag

SEQ ID NO: 11812 - DNA, 2903 bp, Heterodera glycines
  misc_feature (28)..(29): n is a, c, g, or t
  misc_feature (2896)..(2896): n is a, c, g, or t
ctttttatatacctaacacaaaatacanntttacggcaaacctcttttatcattgttaaaatgctattgcatgaattgaattttatttgaaagaatttttattaaatcctagtccaaattggataggtaattattttgaaactcatgcacaacaaaaatttgacaaattcaaaatccaattcatacagcaaattcgatcagcacctatttttttgaagtatgttttgtttttaatctattgtataaccaaataaaccattttttcctcaaactggctaaaatgttaggatattgctagaaaaatttgccatttgaccaagagctcttcccttttttttgtatttggaattcggaggtgatatttccaaaattaataatccctttttatttgatttgtcaaaaaatgtattattttcactatttattcaacaatcaaaactaaaattctaaaaaagcattgaagatttttcaattccattttccagattttcgaatttctttggctttggtttaagttctattgctcgtgatattaattttttaccgtatatcaatgaaaaacatggaatatttctaaaaaatatagttattttagcaaattcgcatatttttacaaaaaatgccgtcatagttaaagagattatgtatttaaaagatttttcaaaattttcaagtttaatgttaatcggtgaggtgcccttcttgaccatgcacaggaaacaatggtgtgaactaaaaaattaaaaactaagtttgttttatttgcttatcttgatccgtattttgaaaaaataccctctcgatacataaaattaattttattggattacttttgtcaaaaattaaatcattaaaaaattaattgctttaccattttggttagaagacacatttgattagctttcgctcacaaaacggctggtcactgaagtgtccaaattgtcaaaattaattactggcattccgtccagcaggtcacgtggcctagcccaaagaatcaatggacattattttattttgaactaattaaatgacgaggcttattttatgaaaataagtgccaaaaattttatatgccaatttggataatgtcatacgtgttaaaccggtatttctttaaaatacggtttagaataatcaggcactaaaattcgggaaaaataagattttgattaagtatttatcatttcttttattagcaaatggcaagatttcgtcaattaagcattttcataaaaaaacaaaattaattctaatggaaataatatagttaaaaatgtcttgaggagggtacgtaccccgcgtatgccctcccccctcccctctggctggggccgtccttgtccttggcctgagacaacctctgtttatggatgatttaaaaatttctattttaaaaaaaatattttttctgaaaaggattgatgaatacgaatttccaaaattttttcgtaaatatgagtgaacgcccatttaaaaaacgggttttatttttattttttaaaaaatgtcatttaaatattggacgtttttaattttttaaagtatttgcttaatgattaaattaattaatcataattgaaaaataacgcttttatattgaaaaacttaaataatttgttgtactattaaattaaatcaattcgttaattaaatttataaaattcgccttttataaaaaatggtaaacaaacaacaatcaaaatgcttgagaatagagttggccgagtccgggtatttgggcaaaaatcgggtccagaaaagcggggtccgagtccaagtttttcaactgggtatccgggtatgggaccaggtcaggtacccgaacccggccaacccttgtattttaacaagaaatttgctttctgctgcacaaaaatgcaatttccacaacgcaaaactgagtctgagtccgtcgatgtcgggctggtgttgacggaagctctgagcaacggtgcggaaccgttcaaggtgcgtataaactaggaatggcataaacccatctcatcataaccatacccaacttagccattgtccaaatttgtggccggaggagtgactgcaattgcgcctaaggctgtggatggaggagtgagtactattgcgtctaagttaattgatttgacttataaatgcatttaggtgccaattgtgccgttctatgcgctccgtgacaccaagcctggcgaggaagaattgtctatggactacggtacatacaatatattggggtcccagggacgtagttccgaagaacgaaattggaagtcggaaacggaaacgacccaaaattatcggaagattgagaattaaggaatttcttttttccagtgcaataatgctagctagacttctgaaatttatttttaaaattttgtataactgaattgcgaattctagatggaggagtgattgcgcccaaatctgtggacggaggatcgataatactgttaccagtggtcgccataaaaacggtggagggataaagcgataaatttgatgggctattagctatgattgctatctaatttgttccttttgtcattttctggtggaacatccaataaaaccatttgatgttttatcattttaaaattgattattgcatttccatttttgatagttcacgttaaatggactcgttataagttatttaaattcggggttcgaaattgggcaaacccgagttcggattcgtgatcgccaccctcgaaaactgatttttataccaaaaatgtgtagcgataaacagttacctgaacagaaatcgaaaaaaatatgagtaaattaatttcaggaatgtatggcctatttattgcgatacaaaaggttggggatgtatgaagtattgacaaatcggcacaaaaatattgttttcattgtatagttcaaggantgtcatt

SEQ ID NO: 11813 - DNA, 878 bp, Heterodera glycines
catgaaaacggtggaggaataaagcgatcaatttgatgggctaattagctatgattgctacctaatttgttccttttgtcatttttttgtggaacattcaatgaaataatttgatgttttatcatttttaaattagttattgctttccatttttgatagtccaagttaaatggactcattataagttttttttaatttaattttcaacgctaaaagaaaaaataacaaaaaataatatggaaagcgtttttatttatatttaaaccagtgttcattaaatattcctctgagttccggggttcggaattggacagaccgagttcagaaccctcgaaactgatttttagaccaaaaatgtgtagcgataaacagttacctgaacataaatcgaaaaaatacgagtatattattcaggcaatgtatggtatatttattgataatataaaaggttagggatgtatgaagtattttttattataagaagtaaaaaggttaattgaaaatttaatcaaaagttttttgaccctaccctttttaataaaatttacgtactaagtatatagcttggattttgatttatttaaactttattgcttacctatcagttcgtcactgagacataatttttaaaaaatattgacaaatttcaataaaattgtcccataaaattataattggtttaaaattctctaaaaattattcctgggtaagagtactaccagtagtagccctttttcgaacattttttttgagattttaaaaaatcgaaaaatgagtttatacggttttcaaggtcgctgctgatcatcgaatttgatgttgtactaaatgatattgctctgagatatcgatggagattttatgcaagagctttctgc

SEQ ID NO: 11814 - DNA, 4199 bp, Heterodera glycines
  misc_feature (3291)..(3291): n is a, c, g, or t
  misc_feature (3335)..(3335): n is a, c, g, or t
  misc_feature (3347)..(3347): n is a, c, g, or t
tgcataatgaacctacgcctaaaatttttttcggagaacgggaaatgaaatacccgaggcctaaaaaatccaaaagtgatatcactaaagttgagcgcctttaaacgaacttctattatttcttccattttacacttatttttaattctcaaacttttttgtggcgaacccctggcatttaaattttcaaaatttttcactggcgcctgtgaaaatatttaaaagctaatatttattgaaaaaaatttacaaaaaatatttgcatagtaaattaaaattaatttttatttaagaaaatgatcatgcttagcttattactgatcacttttatttttaaagtggggccctactcactttcctcaatttatcctgcacatgattcagcagatccttttttctactgcatatcctaataataatatctgatcactatcaaaaatggatgctccgccatcatccacattaaataattttgacgctttaccatcacatcattattttttaattatccttcatgcgtataaatttgcaccacaaaactccacataaatgtttgaaactgcgaccagtataattatttaagcattatgataatgatgatgacggagctgatcattttcagatcgcaaattctctcccataaattttttaaacaaattaaaacaattttcgcccattttctttcctctttcttctcgtccccgccacttaatttggatcattttttgcaaagagtttataaaaaattttgcgatcaaaattttgcgggctgatgtgatgaatgatgatcacgaacaaaaataaaagaaagagtgatcggcagtctttagtttttataataaatgtatttattactaatttgtttcaccttcataacgtcattttgtctttttcgtcaaactcaaactttgatcacaaaaaaagatgatcagagtggtacataggcatattaaactgatcagagagaagcagtgaattaaattttattattttgctgatattattgtagtgatcaaagtgatcagatttcgggaaatacatagaaacagagattgaatggtgccagttgagagagagagagagagaaagagatgatacaaatgatttacataaagagagtgcaactgatcagtgttcttctattgtttgctggatgagtgatcagcgttttggagggtgggtgacagagtgcgcactgatcactttccgattaatgctgcctgccgaaaatttagcacatccattttttttttgctgggaggatggtagcaactaacatatcagacgacacataacgccagtcgctccctttatcccccatccgctaattagatcaatcaatttaagagcgccagaatggttgataggaattcagtttgcttccttctgatcaaaatccatatcctgcccgttttttggagcgatcactggagtgtatttaattagttttaatttacacagtttaagctaatcaccaatctcaatgatcggtcgaagcattcaactggctggcctaactgatcagatgattttcttgatctggtgggtagcattgccaacaaaagcgcgtctaatcatgtttcagggtgttaatgtacagatgagagagaagagagagcgagagaaagtgagaagccgacgaaatagcgtattcgtcagtgataaaaaagaccatttactttagcccccggcgccggctgagttgcgggggaatccccccacccaccctcccgcatcatcaccgccagcaaaagcagcaaaatcgttttgctgtatgtgcagttcaccccgacggcaaaaaaaagcagcccgcctccgacgcgcccacactttattagcgcgttagtcaaacaaaaaatctcattagcccccctcattagcggtcccccgactgatcagtcaccacacttccacaccacaactcatcgtcatttttacttgttggtgctcttatacacctctcaaaacattgatgaggcgaccggcgccactttaaaaaaaattttttttttttttggttggtaatacatatgttgaaaaaacaatgttttaaatgctataaattaataaataaaaatataatgcttccccgctttttgaattttctaccaatttctctaattttttcttttttttaaatctctctctctctcttttgtctctcaccttctttttttcttccttttctatcacattcatttcgttttttatcatcgtcttatgcctatgataaaacactttactctcaccttcattctctctcccccacccatctaaatgtccctaaatcacttccccgcacctctctctctctctctttctctcactctcttttttctttcttgtatatctcattcattttctttctctctctctctctcctcaccccctctctcttatccctaagtcacttcccctcccctctctctctttctctcaccctcttttttcttccttctctctctctctctcgtctctctccttctctctctctctgctaatctccaccttttccacacactttctgccctcttcccttggctttctgcttttggcgccgaatgttcaaaagttttcttttttttgtttgtttttcccaatgcttgttgttgtttggcccgctttgcacacggtaaatctttttcatgctttttctttctcaaaatttttgtggaaaattcgagtggtgtcatgaatggtaaagctaagtttgtaataatccatacgtgagattcttgagaaacaaacattttttgtaaactacttaaatggcgtacaaaatttttgtttgttttttgaactccccaaaaaatgaatttttatatgattactctttggcatactgtaataaaacaacaaaacaaaaaatgtttatttggcatactgtattaagttaaacagaattatcgtcaatatttagaaaatttacgaaaattttatttttgatttcctttttcgaatacttaagaaaatgttaaattataaaaattaaaacaattttcgagggccaatgcattcttcagatgaacaaaaacattatttactataataatattaatccaaacaaaaataaatctgcaatttgatccatctccttgcattttaatagaaaaaaaaacgatttttgtttattttatggcattatgactcctcctgcttttagctggttgaatttcacaatgtgtagcagcagaaaatagacacagaaaatttgctcaaaatcgtcaaattatttactattattattattattattattttcccatttcccgggaatcccgcaaaatttgngccaatttgtcctcccatccccaattgaaaccccggggggctgntcctctccccgntgccgggcccaaattgaccaaacatcaacgcttaattgggactgatttggatggcttcccccaataccaaaattttttttaaatgcccataaatttgaaggagaattatgaaggggtttgggggggtttatccaggggatccccccggaaattttgcttcgaaacgaaaaaatttatttgccccaatttcccccccccctgggggggggaatttttcctccaaaatgggccaaattttcccccccctcggagggggggccccttttttaatttgccccaaatttttttgggggaattttcccctttgggggaaaaaaaattccccccctctttttttttttctttttttttttacaccccccccccccccccccccttaatgggggggggggggggccccccacaaaaaaaaaaaaaaaaaaaaaaaaaaaaaaaaaaacccccccccccccccccccccctttttttttttttttttttttttttttatttctttttccccccccccccccctcccccccctctccttttttttttttttatataattaaaaaaaaaaaaaaagaaaaaatttttttttttttttttttttttacaaaaaactcttttttttttttttttttttttttttttttggtgggggggaaaaaaaaaaaaaaaaaaaataaaaattttttttttttttttttttttaaccaccccccacccacccaccaccactcccttttctttttttttttttttttttttttttaataaaaaaaaaaaaaaccctttttttataaaaaaaaataaaaagaccccccaccccccccccccccccccccctcaaaaaaaaaaaaaaaaaaaaaa

SEQ ID NO: 11815 - DNA, 2652 bp, Heterodera glycines
cccaaaatcccccgaggggagggacatttttcggcggtgggatttcacgggtggcagatccatcggattcgaactgtcgtggtgcactttctcccccccccccctccataattcattcatgcgcaaatcggggagcattatttaagcaaaaaatttaccaaattttctacatttgtctgcctctcgccgctggggttgttttcccattaattttttttctgtttggccctgctttttggttcgaaaaagcatttcccaagcgctctattagtcagccctacacaaaaaagcacaatgcttttccagaaaataataataaattttaatgacacccaaaattgttgggtttgacagaacaaaatattacagtaaaataatttcaacaaaaattcaaatttttgcttcaaaaactcatgtagcttctagccttgttcagtttgtttttaggttctaaaaaattaaaccgaaatcagtattgaaatatttaattttaaaatcgcaaattcttgttaaaaaataaataaattttggagatgaatttttaaaaatgttacattcttagggtgtattttttggaaatttttggggtcgattctcaagcgtgtattttttgtttttattgcaattttctgttttggatcttttagaacaatttcaaatttacaaaaaaagcggctttactaagccggcggagagttactggcttttccaacctcggaagatttccaaaaaaatgagaaattaaattcggcaaatgatgcccccaggcgggcacaaagccgcttctcctcctgcacacacttttgagggaggagagcgggcggattatgtaaaatcgctcgccgctggacattttcatcaatcgctgctgtccacgcaaaagcctggcgccagcccacagcaattgattgatcaatggcggtggcgccgctgaggaggaaaagccgctttcaaaaaacggcgacggcgccccaggcgatttacccacctaattccacgcggctggcgagccactggcaacaaaacgccgatcgcgggcgcgcgcgccagcgccgctttttctctcggcgcggtgatcggagacacacatttattttatcctctgccaccattcaacaacatagctctgatctgatcagaatagggtgggggcttcaaatagcggtggctgggcgactgatgatcgactgaccaccgaaccgatcgcatttctcgcgccccgttattacatatattcttgctgcttttcctctccgatagctcttcatcttccttcccctctcgtcccctttcgtcccaccctacccactcctaattcgatcggttggcttatgtttttcctctcatatgctttccctcataatttgatcagtcccacacccactatccctgggttgccattgttcggttggttactgaaacttttcccctcatttgctttatcctcccctaatttgatcggtccccacccctctccccgggtcccatcccttatttagccttcctaatttgattgcccccactcccgctcttcccgggtcccccgcccaccgcctctcaatcatattcacatagctttaacacccattgaggcttcctctgcctgcctgcctgcctttatcgcataacaaaacaacaattatcaaatgatggccgccgctgatcgccgggcgagtggacaacgacaacagcaagcagcatcgcggccatcatcagcatcatgctcattgtcagcatcgtcggttctactgatcaatcgatgccagtgcttaccgccaggcaaagtggtggtgatcagtggcagtaaaagtgccgagatcccgagccgaaataattttgttggtagtgaacagtgccgtcatcgctgttgtgtgcgacaatggcacgccggccggggccccaactgccggctcttcccaccgctgctgcaatcggttggcacccgtcgtcaacagcacatggcgcagcaaccgcttatttcgctgctgcttctttgcttgctcacaatcagtcagtgctttgattctaaagtcctgactgagacaaacaattgatttgggttaaagtgatctgttgcgaccggtaataaaagtgatgcaatgccaactgttgatcagtcagattaatcaataatcagaaacttgctaagctctagatgtcttttaaagtgatcattaatgctttatttgtcggtaaaagtgatcatttataattttggtctaaatgctttctttagcactgaaattatctttgattggtctctgatcagcgcagattgaccacagaatgggttttaatttttttaaattcaacgaaattgccaagcattgtcaaaataaaattttgtacaggtgccaccgtttgtccatcgttggcccaaatgccaccatttccaatgccatcgatgcccttaccggcggctgcgacaaatgcttttgtgccagccgtcgatgcaaatgataataatgacgcatcagtggcggccattgtcgacgctcagccggtggaagttgtgccagccgaactgacggtggacggggccacagatgacgaccaatcgacaacaaatggttgcactgaaatttgagtagagaactcgggtcagagattcgttgaaaatgggatataagatgggccagttcttacaatgaa

SEQ ID NO: 11816 - DNA, 2347 bp, Heterodera glycines
ggcaaaaaataacagtttgtaattttaaattttcaaatttggacaacaaaaaaaaaaaccatttttaaattgttaaagaaaaacttaattttaaaataaaaatttttatatgaaatttaattatgggaattagagctgattttgaaaaaacccgggataccggactggccaggctgggataggattatcgggattcaaattatgtttgccgggctttgaaccccgattctcggccttggtgtttacttgataatttctgagcattataactatcctcgttatctcgagactctcgaccctggctttgatcaaaattaaagaattttctgtgtcatttatactttattaatatattctggaaccacccaaaaaatgtctatcccatccagcgctacgcattggcggcgtccgtgcaaatgccataatgagcgaagcagtgccgttgttgccgccttctgccgttgcggcggcacgcgcgtggaccaaacgatttcaatacgcgtctgccggtgccgccgtcacccacttggccagccctcctgggactgtgcctttgatgattggcggtggtcttcctacgaaggcatttggaggccccgccggtggcggcacggaacggcgccgaaagccgccaacaatcggtgccgcaggcgatgaaatgccaaaggagcaaaagcaacggcacggagcgaaaacgacggaagaaggggcggcggatgacgaggtgtgagtgaggggaggaagaagtgatcggacaaatccaatggaatgaatcgatttcaaaaattttgcgaaaatttttgaaaaattttcccaacggcacctcggcatttttgccacccgtttgttgaaatttttcaaaatttaaatcaaaagtcctcaaaaagttcgacaatggcctgctaggccccgatcaaatgagggtaattaacggattgatgacgatcggttatcgattgaccaaactgattgaactcacacacagtccgacaccagtgaggcggtgggcactgcccgtctggtggccatggaggacgttgatcgggacgaactcagcgcagctgcttcacaaactggtgctgctgatcaacatgcttcgacagcagtgacaggtgattttttgaataagtttgggtttacaataattaatcccttctgatcaatcactaataaaatgatcatctgatcagtcctttgaaatatgcattcaaaaaagagtaacatgagtccattaaaaatgtatgccttgatcacttcctaccaaaattgagtcctctgataatcagtcccctcaaaggcgagcccctgatcagtcccttcaaaaatacatcccctattcaatcccctcaaaaatcaatccctccgatcaatcagattactcatccacccacgatgatcatctgttgactgcgtcctccgcttcgcccactatttccaccgcttcttccgtgccggaagatgataatgatagtggtgctgataatgttcctcctccgccacctccgattcatccatctgctgcttctccactggatgatgatcactcgccgccgttgttgtcctccttgtccggctctcagttagccccatcgcctatttcaccgccacccatcgtcattctgtcaccatccgaaggcaccgtcgaattggttggtggctgatgggctggcctagagtcgaaattttccgagactcttgagaccccaaaaaaccgcgaaattaattgagcccgagagtcgagaccgagaagctcgagcagccctagtgggtgaagacggtgtttgttggattacacaacgctctctcacttcctaccacaattgcccataatcatcaataaatagatgtagcaaaaaaatgatcaaaaatgctttttcaccaggaaaatccgactaccgtcgtgccgcaaccgtcgtactccgttggcactacggccgcaacggcggcaacaaccgctgatgctgccgccggggacaattcgtcgtcgtcgccattctcgccagttgctgttgagttgacggcatcacaacctaaattgccagaggcggcggaaccatttccaagcagtagcagtgacaatgcgccgcgagtcgcggcggctgcgcaacggtcgccgagtgccgcggcggcggacagcgacggcaacatcaacatgaacaacgaggcgaagaacacgcacgcggtgggcgagctggacctgaagtcggaccgcgaattggccaagctgatgcgacgcacaacgtatgtgctgtgtttgttataccgtgttgttgctagcgattaataaattgtgccagggattaccgggattaagcagggatggtcccaggatttctgtttgtagagg

SEQ ID NO: 11817 - DNA, 1645 bp, Heterodera glycines
tcccatcaaagaccgtgggaatccctttcttccgtttctttttgttgcttaccctcgggcgccatccaagcgggcgacttaatcggccgacctcctggaaggagaactttgtgtcggccatggaaattttggcggacaaatcctcgtcgatgagcacgtgctttgagctcagataatatcgcaggacgggctggtccaaggagtgcaggaaggacatgccacgggcgaggtccagcgcaaaacgaatggcctggtggtggtcgatgaccacagctgaattttgcaaaaatttgtcttattaattagttcaaattgcaaaagatctatcaatttacatatatttgcttaagtttttgctcacatgactgctcatgtagcacattgtaaagcgagccgaaaggcatgaattggctgatgacaatcagttggggcggttggttgaccacggccaacacggggttgacgaaggcactggcgaatattcttaacaaaaaacaatacccccatttaaaaaggagaaaatgggaaattcaaaaaagttgataattgtaagtatatttccaatccaataaaaaaaatttaaaaggcaaaaattgggcatttttttaaaattaggattttgaaagacacattcggaatgtggcataaatttctttaaaatgaatgaaagggcctctctcatcgtgccaagcttcaagaattttcatttccgaactcgccttagttgcaaaaattcggtggcaaaatcgcgcgatattcgctccgtcacattcggcacattgagcacccgtgccacaatgtcgttgttctgccatttgccgcggtacaaaatgccggaatgcgactgcgcaatttgtttggtcagcgccaacgattggaggtcaacgccggtgtatctgtgggaaaatgatgacaatggatcatcaattgggaaagcggaagaagggacacagaaaggtgccattcaaaaaacgccggaatttgctccctgttttttccccttgaacataccgtgaccacgtcgcgtcgcgtgaacgaaatgtttttgtgttttgccacgcgtcgccgctgtattggatcttctgctgcggattctgtccattgctcaacgcaatctctgaaagcagtgatttctaattggccacatgagaaataaagaaagaaaattcatttaatttttttttttgctgggaaggtttttcctaaaaagctctcacctttttttaattcaaaaagaaattttcagaaaatcagcccccccaaaaaaaaagaaaaaacgtgccatagacggactgtcggacttgtggttggcacacatccaacggggtgagcccgcgcttgttgcacattgtggtaagcgcaccggaacggatcaaatcctaacaagtgggggaaaagcaatgaaaacagcacaaggcatagcaaaagcaaaggcacggcttaaaaacacacctcacaaatttgttcgtagccccaaaagcaggcgtagtgcagcggggtcatcccatgctcattctgcacgttcacctccgcttttcgcaatagcagcttctgaagtaaatttttaatggtgggttcattaggtgtcatcgccggacgaatttttggatttattttctgacagctaattgtaagtttaaaattc

SEQ ID NO: 11818 - DNA, 1950 bp, Heterodera glycines
  misc_feature (1906)..(1906): n is a, c, g, or t
cgtgatttggcatgcgtaatacttataatacatttttcgtttttgtgcggaagaactttaaaggactggacattttcgtttaaatcgcgtttaagatttaaaaaataaaaccaaaacggaaacaaactccacaaataacaaaaactcagccaaatttgttattcaagtttaaaaaaatggtaaattttttagatttactaaattctttaacgtgtcaaaaaaggttaaatgtgtttttggatcgaaaattccgtccaccgccccttcacattacccaacattcaaatcgtgctcagagtcgtccaaccaaacgcgcacttggaacgaatttccctcgcgaacccagccaaaaatgtcctgaaaatgtccaccactttttaatttggaaagggctcaatttatttgatttgcaaatgttatgaatgaatgtccaacctccatgagaatgggcacatttggcttgtgcactttgtaagtgggcgctattgacatggcaacaaaatttacaacaaaaaaagacgaaatgaaatgttaacaaaagaaacaggaaagccctaaacaatgaaaatggttgaaaaagggaaaactgaaaaaaaactcataaaattgggtcctttccaaaggaaacgaaacaaacaccgcaaggccaaaatatgcaaaagcagtggctgatcgatattcttcaaataaacacattttggcacaaatctgaggccttctgcttcggccgatggacgaaaatccaccaaaattggggtatttgttttatgtgtgaccgtggtcagcagagtatgttaggcttacatttgtcgcatttgctcgagaattagtcctttataattttgtaaaaaatgtcagcttactgcacaatataactttcccacacatataaagctaacaacaattgagtctcacaaagtgtaaaagccgtttcattcaatcgattttgttttattgaatataccctcgggcccgtacgctttggatgaatcgcaacgcatttgttgctgatcggtccacccacacacccagccaaacaactgttggccgatccgccaaacatacacacacaattaccccccccccgccccaggggtttatatcccccggatgatccatcccaaaatatgtggtcggatgggcggggtgattctttgttgttttgtccacagcaaaaacaattcgacggcggcgtgaaaggaatttagccaaagcggcggagctgcaaaaatatgtgcgaaagagaggggcaaaacaaaagcggagggatttgatttagtcaccattttagccaagagattttggggggaggggtaggtgaccgatggaattccagcgtattaagcggctttaccgacttcgccagaaagtgtcgttgacccatgaaaacgaatgcttacaattcagacggaagtgtttaataataaagagtgtatctgcacaaactcatgaaatatttaattcctcaaaatttgttgctgtacaattttggtcaaaatttctttgttttattgcctcacaacactttttgtgaacgccccaatcaaatcgttggcattcgacggaacagtaaaatgtctgaaaatgaaaaaatgcataaaagttaagaaaaaccatggaatttttactttacaatctttgcaacgctttttggccgatggcactgcgcacgttctgcaaaagtgtgccgtttggacaaaacgagcgccgagcaaagtttgacagagcaaaacgaaggcggacggaggctcaccgaatggaaccgtggaaatgttacggcccaatgtctgccaaagcatctgacaatcagaaaggacaattaggcttataaagattgacggggcccggcgacttattgttagactcccccccccccccccttcgcccgcaaaaggtcgaaacttgnggatggggacctcttcgcagcaaagggaggccggtgtaaaagag

SEQ ID NO: 11819 - DNA, 1125 bp, Heterodera glycines
cggacgcatcgaatgccaatttgaccgggtgaaaggcgtgggtccgcgtcaactgttggatgaatttggccaactcgggcgggtaaaggacggcactgtccgccccttggggatgcagaatcgcgtccacgtcgcgcaaactgatgtaattggagatgatgctcacgcattcgtgttgcccttaaagggtttttgggatatttttcagttttacaaaaaaaaaataagtttattgtcaggtaaattattttaaaaaatcccaaaatttctcgaggaagatagacaaaccggaatatttccgactgaaatttgaaaggatatgaaatcgaaaataaaatgactttggaattaatcggtttaaaaagttccgacctacaaaagctgcgagttcggctgctgttttaccaatgttgttctgcgcatgcgcatttgccccagcatccaacaatagttgacatattcggccgttaccttcagcaattaatgattggcattatatttatatggattatagattaagaaggttcaagaataaatggacagttcttaaaatggatcggttttagggtaagtgcttaaatgctccataattttgtttgaaaatttaaaatttttttgtgttttaaatgtatcccatagggaaattttgaaagtaaaatgacccaaaccaaatgcttattaatagcttgtggccacacctgcgagtgctgcgaacatcagtgccgtgtatccgtccgagtgcgctcggttgtccgagtccgacccattttcaagcaaaaactcgaccaacgcttcgttgcccttgaaacacgcgtggtccaacgcgttcatcccgctgttgtccagcgaattcacacgcactttgccactcttaaccaattcctcggtttcctcaattttgtctataaaacgaaaacaaacaaataaaaaatacataaactattcaggagcaaaaaccttcattgatgagctgaaaaagctgtttctcttcatctgtctgatttttaagctccttcaatgtgaaattgtccttttggtttagcattttgtccaacaacttaaaatttaagaggttttatgtcggaatgtgatgaaaattaaatttcgcgcgcaaattttggacat

SEQ ID NO: 11820 - DNA, 1117 bp, Heterodera glycines
  misc_feature (1023)..(1023): n is a, c, g, or t
  misc_feature (1087)..(1087): n is a, c, g, or t
  misc_feature (1100)..(1101): n is a, c, g, or t
ttctctattgacactcgagttttgccgagactctagcctactagccgagactctcgagctttcccaacaatcatcgagccttaaccgctaattagaaaaatgaatgaatgtgccaataaatgagtatcgatgacagcctaattaatgccgttttttgcccacccttggcaatgttgtgcttcccccattttgccaattcatttgttcatgttcatgctcatgccgttgctggtgttgcagttgatgatacatggactggcgctgcaactgctgctgttgttgctgattcgctttgctgccgccgtttgttggccccggcgtttttgagcgttggatgaacagcggcttaaatgcaattaaaataaaatttaattaaataaattaattaaatttaaaatgcgaaaaaatccatgcccaacacactctgtgctgttgttgtgcctgctgttgcctttgtccgcttacgccagcagttgtggtgccattcagcggttggcctcctcccacaccgtcgccgccattaccgtatccgtaccggaaaccggcggtcggtgtacgagaccttgaacaaataccaagtaaaaactggtcgagattctattgcgttttctcaattccggaaatatgttaaatttaatcatgcatactgtacagaagactggactactactgtagtatgtagtagattacggtaccaattttctgcttcacctttgtttgggcgctcgccggtggaccaacattttgcagcggctgccaatcgggaagtcgtgcagcatttggacgagttgcgcatggggcagggcacgcacattgtgaccgttcacctgtgttaccgtagtaatacatacagtacgaaacaggttttaacctcacccccatttacagtacctccaaaatggtgtcaccttcgagcaaattcgggcactggtccggatgcaaaatgctcttcacgcgttggccttcaaaaatggaatcacattacttaaatttttgacaatttgccgcatgaataattatttnaattgggtatttccccgcaggacttctcagtcgcgaatcaaaaaaatggatcaagactcgtttncagaattgtgccnnatttaaacatgtgcca

SEQ ID NO: 11821 - DNA, 4450 bp, Heterodera glycines
aataatttttaaattaaatgaatttaatttataattattaaaaaataattgaataaaaatataaaataaatttaagtataagtacaatattttaaatatctaaatttttgttattattaattaaataatttaaatttacgcattaatatttaatattacttttattgtttttgaattctataattttctctatttacaaatcaaattctaaaatattgttctaatacagggatgggaatcgtacttgaattgcaagtacgtacttgaaaatcggccctaatgcaggaaaatatgaaatttgcttattttcaagattgtacttgaaaaagagaattcaaaaaaaaaatacattcaaaaatttattattttttgaaatttacaccaatttttttattaatgccaaaaaataaatttaccaaaaaatgtgtcggaaacaaaaaagaaaatgttggataaactttttttttaaagcgtgccgaaaaaagtgcacatgcagcgaaatgggattggaaaaaccccattctggcgcaaaacacaaacaaccatctgaataaacagttacccctttttcacatgttattttttgcgtacttgaattttatgaaattttccagttgtgtacttggaaatcagtatgaccgtacttgagaagagtgtttggacgatcccaaccagggctgtgcgaaaatcacaaaaaaattttttcgtatacgaaagcgaaacgaaaagctcattcgatacgaaaatgaaacacgaaacgaaaaataaaattttgaaaaccgaaaacgaaacgaaaaaattttggcggacgaaaacgaaacacgaaaacgaaactcaaaaagtgctgaaaatgtaggacgaaacgaaaacgaaacgaaatttcgtccatccctgatccccgcctcttgggcagtaccgtacccaccgaatgcgtcatcgtacaccgtaaagccaaatcccttttggcccttgcacagctcgaccacgtgttgctcacggaaacggtggtgattctgatggttgttgtattgctgctgctggttactgttgctacagttttgctgctgttggacggaggaagcggcggcgtaaacattttcagtgaaaatctttaaaattcaaatttttaattttttttttaaaatttaaatcaattgcaaaaaaaatgccgttgtgtgttttaccctgtttgtcgggtccatttgaaggggatagccacggcacacttggattcggacaaattcaccaacctaaagcgagtaagtaccgtttatttccaagcgtattacggtattctacagtgaccacacaagaccgtacaattaaatatttagttctctagtgattttttttcacaaaggtctcattcccgaatactgtaggccttatggacagtgtactgtaacgtactgttaataaggtacaaaaggatatacttttgtattagattagaatttcgaaaatatgaaagaatttttttttaattgatgccaaacaaaatatgcccattgagtgtaatttatgggtcaggggcaatcaatcaatcaattagcagcactaattaatgcctaattaccccccctcaaaaaaaatgtgcccgcccgcccgcacattgatggcacggaacacttggcacgcgtcgtcctggctggcgccgagcatgcaccggtcgttgaccatcaccagcacgtcgcccgagcgcagtgtgccctccgcagcggccggcccattggcaatgattgttttgatccaaaataatttggcaatttgaaccgacataattaattgattaattacaatacaacactaatggcaattgaatgccgcacactcaaccattttcaaaaagtttctgggacatttatcaatttttggtttatgcaagtcttaaaacaaattcataaatttttgagaggcggcttaaaacattaataaaaggaagggtaattaaacggatttgtggctcttcaaaaaggagaagcgggtcatttgtccatgaaaggaagggcacttcaccacccggtccttaattgcctatgtgagtttaaagtgtttgaaaaggactgacaattcaataaacggatttgtggccctacaaataaggataattggccttctgtccttgaaaggaaggacacgcccaccccgtccttaatttgttgtaatgcaataaaaccagcttctcccaccacacctggatgaactcgtcgtgcaaatttgtgccatcgttgccgatcagtgtgaagccgagccctttgggccccttttggacacgggcatttaaaatgtcgcctttttttggggtggggattaaaacacttcgccaaaaattcccgcgctttttgaactgaccacaaagttcgccgggatttcgcgtgaaatgaattcgctgctgctgctgacgctgataaccaagcccagcaccaccgccactatcataatgatcctgctgatgaggctgataataattggcggcgccggtgccgttgttgtgaaaaacggcggtgccataaattcctgccaatgtaaaaaaaaagtaaataaatatattaggaaaaaatctcaagtctcgagtaaaaaaataccaattcttgagcaatcggttggcattttggaaaaaaacatgatggacaatacaatggctggtcaaatggctttcatatttagcctaagacaaacccaggcccattgaaatcgagtcaatggcaactcgtacaaaagacaattcatacaattaaaaaatttacaaataaagcctaagcctagcctaaagcttaggccaagcctaaagctacgacaccaaaaaatccgggtaaattctcaaacccagaatatctgtccgagtccatctcggaatttcgtgacccctaatccggctcgggttttttgaaaattccagactctactacccaggtccaggtcaaatatctatctatctctacaaatgtgcatttatgtaataattggcatgtgctctaccattattggcaccactgttcaatggaatgccgccacctgccgtcgatgccatggacaccaatcgctcgtggtggttgtggtggagattcggcggcggcggcgccgtggaggtggttgccgtctgctgttggtgctggtacggctcgtagatgggctgcttggtggacggcaccatgaccagcgaagttggccgctcatactgagtccgcttgttgatgtggctggagaaaaagcaattatgcaattttataaattagatacagtatgccgctgttttcagttagatacagtaatgccttcagaactggggagagcagcccgtccccctccgccctcgcccaccctccgacatgaattgccaaaaaattaaaaacaaaatttttataactttcaaagaatttccgaaaaaaaaaaatctttgtctgattcctggtcttttactgcacgaatttaaaagttctctcgggaattgcctgctttctaagcaatttgaataccaacattttaaaatttccaacgctctttggcgttcccttcagtgtcttccacttttaaaattggatttttttttaattcgaggcaaaaccctctctctctcccttcactaactctaattggtgatttccagggatttgtgagtcccgtctaagtctcaggggttaaatctcggtctcgagtcttgctcaacccgagaaaaactcgtgtgtttttttggatctcgaatcttgaaaaattttcggtcactcgagaaactaattcaaaaattttcgacaattcaattctcgactttgtaccctttgagtcttacacattgtaagaagtttgacatttcttttaggttagcaaatgccttccttacaaatagaccacttggtcaagcagttcgctgccgtttctgaatgatgccgtgctggaggagcgggggcacccgcactggccacagatgggccggccggggaacataatttttcaaatcaaaaaatgcataattttttaaagcgattttctgtgacggaaaaaaacaatttttttttaattttcagacaataaaaatgaataaattttcgagaattaattcgctgttcaaacattggttttttctttccctttttttggggtcttcggagcgtgggaaaaattgacgaagaatttttttttcacctttttgaatgatgacggaataatatatgaattgaataatggttgaaaaaataaaattaaaaataggaataaaaataaataaaatttataatgtttaaaaactttgccaggaaatttttcgaaatttccaaaaaattcgtttaagaaaaaaccttaaaaacaaaaatggcaataaaataaatttaaaatgttaaaaattatgccaggaaattttttcggaatttccaaaaaattattttcgaaacccccaagttttactgcttctcccccggtggtgatctgcgccggcagctactttcgaggcgcaaaa

SEQ ID NO: 11822 - DNA, 3161 bp, Heterodera glycines
  misc_feature (109)..(109): n is a, c, g, or t
  misc_feature (3109)..(3109): n is a, c, g, or t
  misc_feature (3130)..(3130): n is a, c, g, or t
atatgtgaagatatgcaaaaaaataacaagaatatataaaataagtttaccaaaagccaatcattcaaataacaatggaatttttttcagttttcgacccttggaaatntaggcgaatctttgaaaattccaactcgcttcaaagtgaataagttacggtgaataaagctctaaaaatataaaaaacataattttctatcttcaaaaagaaagttgttattacataaactttgaaaaatttgttatttagaaaaattactattcagaaaaggtgtataaccgaaatttttcttggtgtaacaatgattttgttttataattattatcctaattaagcaataatttagtgaaaggtacttaattgcttttgtgggttttattttccacattttatttaaactttaatttttttaaatttaaattaccaaaagcgtttcgatgcaatccctccgggtacggaatttcaggattggaatgcttaaccgaattgtcacgggccttgtttcggttgagttatatgggccatttccaaagtcgtcggtggtgctggccacttccacagggaaagaccattgacaatactaaattgttttcattaaattttagaaaaaagataaataaattattcacaaacattaatttaattattagagaccgcattttgaggcaaatgcctttttttatgcgcactagtttcgatatattaagcataaataacgcattctccacttggtttgaggcttctacgttgacttttattatgcctttttttgcctttttcgggattttcgtgccttaaatgccttttttggcattttgccgttttggtgcctttttggctttttttccgatttggtgtttttttgccgttttctttcgaaaaagtccataaaaaatacaataaaatcgggaaaattcacccctaagaattgaaaaattttcagaaaatagacccataagaatttaaaattttctcaaaaattgttcgccaaaatttcatcttttttctttaaaaatttttggttttcaaatttgttcttttcgaaaaacattataaaaatctttaaaaatgaccaaaattaagttatttggttagctttacgtgttttgctcactaaaaaccttagaaaatttttttaaatgcctttttcgggattttcgtgccttttcatgcctttttttcaattttttggtgcctattatagtacctttttcgcgatttttggtgcctttttttgcggtctctattaattatgcaaaatataatttggcaaataaaattaatttacatgtccccgacattccagtgcaattcggaatgcctttcgaattcctatcggtgaaagcgcaccatgcgcttcgtcgcggatgtcaacagaagaaagatggcactttatttcaaattggccattattcaaagtgttggggtaacgctttttggtgtcagttcgttgttggaaaaatgttgaaaattggtcaattttaaagcaaatttttgtatcagggttaaatgcttccatttctacaaaaacacactaaattaatgcattagaaataagaaagactataggaaatagtgataaggtagattaaccgaatagcagttttcttatttatcattttattagagataattattatttattttgatttgttatccatttcaaatgaaatgtaaaatcaaggaaataataataaaacaagaaaaaattaacatgaaagttcaaaaaaatcttataaaatacaaaaataagaaaagaaaatggtggagcatacggtaaattaatcctaattgtttttgcattttgagcctatttagagtaatattatttatttaaataattaaaattgtttaaaatggaattaaaaaattaaaaaaacacataaaaatgggaaataataaccatgaaaaataaataaaaatctgatgaaaatgcaaggaaagatgaaggatacggtaggtcgatcgattattcattttctttttaacattttattaccgttaatttattattttggattattaattatcggattaaaaagtccaaaaaaatcatataaaaataaaaaacatgaaaattcaatgactaaaatgcaaaaaaaggaaggaaatattaaataaaggaaaaaatgtaagatatggtcgattaaagattagacattaaaaccactaagaatctttaggatatggtggacgagaaatatgaaatcgaataaaagttatattttaaaaaaagaaattaatacccatacaaaaaaataaaaaatactataattaagagaaatggtggggagtttacggtaggacagtttatttgaaatggacaaactaataataaattaaaaataaagaggaaaataaaggttgcaggaggatacggtagatcatttgacttaaatgggttgaataaaagttattaattataaaaaataatattcgcaaataaaaacaaaaaataaaattaggaagaggaaacagagtccttctgtatcgatactgtaatgcgtttaaatgatgaatcaaactcggtatttttcggtttgtggcagaacatttatgttttaaaatgtcaacgaaaaacccactgatattcaaaacagcgcttcagttattttcgcaaataaaaatgaaaataaaatttatgagaggaaaataaaggaaagaggaggataaggtagatcatttaatttaaattgttaatgctctgataaatctaaaaattatgtaacttgtttcgaagtacaagtgctgctaaacttatcgttagagaaaaacatatttgaatttgtgacgtgatatttgctctcttatgtgcccatactaagtgaaatttgggtgaagccgtaaatgtcgggccgcaaatgtccgaaaatggcccttaagaatgagccgcaaatgtacgggacgacaaatgtctattattaaaaaaatggtgaaagatattgtagatcgaccgatttgtcattgtctaatttattattttatttcaatttattttgattattaatccatttaaaattaaatgaaaaaatcaaaaaatattcattaaaaaaataactaagaaaattcaatgatgaaaatgcaaaaaaatagggaaatattaaatanaggagatgatgaatttttacnatgcttctttttttagaaaaatgtataaaaa

SEQ ID NO: 11823 - DNA, 1059 bp, Heterodera glycines
  misc_feature (1007)..(1007): n is a, c, g, or t
ttttggaaaattctttaacaaaaatgcaataaaaccaacttttacacccctaagaatcgacctaaaaattttttcaaaaaatacacccctaagaatcgacaaaaaaaatttcaaaaagcactcctaagaaatgaaaaaaaatttctcaaaaaggtattttcgtggcaagaattttaattttaaaaattatttttttatgtacctattttgtttttttgcccttaaaaatcccagccctactcatttgcaatgcaatcagtgaataaaaattatttttgcttaatttttggctgaaaattatgtcactattcgtcactatttcggactttttgacactattttgtcactattttggcatttttactcactattttagttaactatttcgggatttttcgtcactaaaagttgctaccctataaatcaccatctgtcgacgccacagaaaaatattgaaagaaattccttcttcagacaattcatgtggtgaaacgaacgctgcccatatgcgaatagacagaccaatgaataaacaagatggaatttgtgcatttttcatttaaatttgaattgcaaaaaaaacagagagtggaaggaatcatattattttttcgcatcttgtttatttgcgattcttatcttctgaccattaaccgattacctaattgttatttcaagaccaaattctacctgaagcatttatgctaaaatgtatttgaaatattatttggacgagcaaggcaaccgcgtatacacacttaaggcaagtcgtgaatcccttaatattttgtataaatctgttgggtttggtaatttgtcttggtgaactccaaaattcgttgaaagtttagaaacaggacccagtcggacacaacactttctccgctcatccagcccgtttttcacccgaagacaaatattccaagtaccgtttaatcgtcaaaaagcgcttcggtcttttgccaactcaacagccgccgcagaaatattaatttcgcaccgattgngttcaccgtttgttaggtaaacaccgtttgtccttaatggatattcatcttt

SEQ ID NO: 11824 - DNA, 3900 bp, Heterodera glycines
tatattttgttttcaggcgttgaggttcaggttcattttgaatgggattttctttctgatcggttggtccgttctcggttggaaggtcttctcttccctgattatagtaagttcttttatccattataatgtgtcatttattctttccctgttaaagttggacgaagagaccggtgaagagaaagtgtcaattgtttatcatctccaggagaggcaagccaaacaaatgaactcgatgaacatcatcgaatatatgacggggagggagttgactccgcgcagacccccagttgaaataaccaaaacggaattccctgccgatgagttcaattgatccacatcgcaattttttgttgctcgcgtcctcaaacaaaaaagccgtagctgggaaaaagctactcacaatacgaagatttagtaatttttagacaaatgatctttcttacaattagttattctgtaactaccctgcccaagatacattcatattcttttcctcagttacggctttgccctgtctagaccaaactatccgcctcagcccgcccaacccatttgttgttgtgtttcatccgttgtttcaataaattggaaaacattatttttgcatttattaatagtaagattcgttatgaaaataaggttcagtgtgcttttttcgattcaacatcatttgattcagtgccagtccacgagtctctaaagcctctgaaaaggaaataaattttttagtcaaaaagtattgtaacgcacagtaagtccctgtccaaaaaggggtcctttgcatatttgcgaaacaaattcagaaattgtaatgctgccgaatgtaagtcccaagtcacttcaatgccgggcactttgtatgagttggacatacagtttctcagtttagaaacagcgatgagcacttgtttgatgtcgtcggatggctctctgattcttagaaagtcgacgtaggaaaagtcgcgatatcttaagaaaatttaaagcaaaggttgtattgatagacaaaaaagaaaaatagtcgaacttattcataaaatagagtaaataatcggccacgaaattgggccgtgtggtcgtatccaacaccaaattgcaaatggccaatttcatcgccgcgtcaatgttgttagccccgaaaaatgtttggggatgtttaaatggtataatgtcataattaccatgggttaagcactcctggggtgtccatcagataggtgggcggacgatcgctgggaaagccaaattaaaggttaatccctattgtttttcttgctcacagaattcgaacacggttttgcacccgaatggtcacgccgggcctcgcgccctctttcacagcttttccaaagtccaaattcacattgcgtaatgcgtttatcaacgaggatttgcctgtctaaaaacaaaatataattcaatctttttgaaggttttgccaaacaagttggacaatttttctaaacaattataaaaaagttacgaatttaaaattatataaaaatcaatcttataaaaaaaaaatttggaaaatttttctctagctatctaagacagaaaagttttgtagagcaaagtaaattgtgacattttttgttcggacggggtgaaggacaactcaaagcccccccccccgtttcacttacattcggaataccaacaaccatcactgggtattccgtcttcactgtttctgttgaagcgatgttcatttcgcaacaaatccaacattttgtccatcaaattttgaactgcgttttgtttgtcaaattcttgcaatttgtccagcaaatattggtaatgttctgctcattccggtagtactcttcgatgggttcccttaaatgcgaaaaacgtcgaataatcaccggtaaacaaagcctcgaaaaagacaatactggcctttacaaattttaattttctcgatcatgttgttatactaaactaaaaccaattttggtgcctcacttgtagcgtttcatgttgattaaatccatcttgttaaagacgagaatgtgcggtcgcactgaatataatttggcaccgaacgaaggattccttccggtcagggcaacccgggctgaaattccgtattaaaattatattttgttacactaaatttaatttcttctgaccgtcatgcacttcaatgaccaaatcgacggttcgaagttttccctccattactttcagttgaacgcccatgtgttttgggaacatgaaaaagaaaggtcaccagcaaatacaaaaagaataaatagctaattgactcaccagtcttgcttttcatatgtggaagagagagtaaatttctgacgagaaacaaagtgggggaagcgaattgaagatgccaacggtggtgaagaaccttccaatcggggagcactgccatcagagggtgaggagaaacacgcggaaaaattgagcaaatttggtcgaattcttggagaacgaagcaaactgttcctagggaaagtcattggcacttattaacaaattttacaaaattaatagccttataaaaaataaaataaaataggtattcatgcaagaaaacaagaaaattattgacaattaaacatttacaaagtaattttatcaaaaaataaatctgagatcaaaccaaaacatctttttgaacacttgaatttcattatcaaaatggctgccactcagactcgtcagcgggcttcaaatgaccaaaaagcagcaagaaaatatcaactaaccaccaaacacctgcaaaaacaaacttttgaaggaaaaattatacaatattaagcattttgggagaaaaattgaaagatcaaaacaaaggaagttccggaaaatattttcgttttgaaatgacattgctgataaatgataacttacccaatcctcccaatgtcatcaatttgcccaccgcaatcgccgaataacccaaatagaagcgatcaaccgcaaaaggtccaaggaaaatggaataaagaagtgccgagagaaagtaatgaccagtatacctagaaatggatggataattgaaagagttccccatttttttggcaatcatggagtttactggtcccgtttttttttctttaaaaatcatggaaaaatttttctagggctattttactgagctgagcacgaatccgaccttatttttgaccgattctgaaccccgaacccggattctaacatttttcaaaaaaaatttttaaagagattttcttacatctatgtgtgggttgagcataagcaacaaactgatatgaattaatataagaaaaacctatgcatacgcgacccccccccccaggaataagaagttaggatcaacaatgtggtatcgagccgtaaaattgctcatggagtggaactcggcttattttaaacaaacttttctactgattgaaaccatcccggagcagcagatgttcgctttgaaaatgagcacaaaatttattaacaattaataaataattaggggaaaaacaacaaaatgatgattaattgttggtcaaaattggaatcattttttaaattaaaaatttgttgaaattgcttataatgaccccattgatccattgattcggctttcaactcaatcaaagtcatcctcttcaaaaaaaaaagttaaagcaaaccgacaaaaaattaatcggcttcttcccatcaaaaggaccgaaagtgcaaacagaagcaaaaagacagtcagtgcacggaaagcgaggagcgactgatcagcagaccccgggggacactttgaaggaatgggaggagaaagcaaatgcaaaagcgtaactgctcaaagttggaccccccggtggtttggcattggcacacaacggaaaatgccatccgaacaaaatgcccgaattttgattttcataatatatagaaattttttgaaaa

SEQ ID NO: 11825 - DNA, 2791 bp, Heterodera glycines
  misc_feature (2486)..(2487): n is a, c, g, or t
  misc_feature (2490)..(2490): n is a, c, g, or t
  misc_feature (2499)..(2502): n is a, c, g, or t
  misc_feature (2504)..(2504): n is a, c, g, or t
  misc_feature (2508)..(2508): n is a, c, g, or t
  misc_feature (2510)..(2511): n is a, c, g, or t
  misc_feature (2513)..(2514): n is a, c, g, or t
  misc_feature (2520)..(2520): n is a, c, g, or t
  misc_feature (2528)..(2528): n is a, c, g, or t
  misc_feature (2530)..(2531): n is a, c, g, or t
  misc_feature (2537)..(2537): n is a, c, g, or t
  misc_feature (2541)..(2541): n is a, c, g, or t
  misc_feature (2549)..(2549): n is a, c, g, or t
  misc_feature (2552)..(2553): n is a, c, g, or t
  misc_feature (2560)..(2560): n is a, c, g, or t
  misc_feature (2568)..(2568): n is a, c, g, or t
  misc_feature (2570)..(2571): n is a, c, g, or t
  misc_feature (2574)..(2574): n is a, c, g, or t
  misc_feature (2581)..(2581): n is a, c, g, or t
  misc_feature (2590)..(2592): n is a, c, g, or t
  misc_feature (2597)..(2600): n is a, c, g, or t
  misc_feature (2605)..(2605): n is a, c, g, or t
  misc_feature (2607)..(2607): n is a, c, g, or t
  misc_feature (2609)..(2609): n is a, c, g, or t
  misc_feature (2611)..(2611): n is a, c, g, or t
  misc_feature (2616)..(2616): n is a, c, g, or t
  misc_feature (2620)..(2621): n is a, c, g, or t
  misc_feature (2624)..(2624): n is a, c, g, or t
  misc_feature (2634)..(2634): n is a, c, g, or t
  misc_feature (2636)..(2636): n is a, c, g, or t
  misc_feature (2639)..(2640): n is a, c, g, or t
  misc_feature (2645)..(2646): n is a, c, g, or t
  misc_feature (2648)..(2648): n is a, c, g, or t
  misc_feature (2650)..(2654): n is a, c, g, or t
  misc_feature (2660)..(2660): n is a, c, g, or t
  misc_feature (2662)..(2662): n is a, c, g, or t
  misc_feature (2668)..(2671): n is a, c, g, or t
  misc_feature (2675)..(2675): n is a, c, g, or t
  misc_feature (2680)..(2680): n is a, c, g, or t
  misc_feature (2682)..(2684): n is a, c, g, or t
  misc_feature (2690)..(2693): n is a, c, g, or t
  misc_feature (2697)..(2697): n is a, c, g, or t
  misc_feature (2700)..(2701): n is a, c, g, or t
  misc_feature (2704)..(2704): n is a, c, g, or t
  misc_feature (2706)..(2706): n is a, c, g, or t
  misc_feature (2709)..(2709): n is a, c, g, or t
  misc_feature (2711)..(2711): n is a, c, g, or t
  misc_feature (2716)..(2719): n is a, c, g, or t
  misc_feature (2721)..(2721): n is a, c, g, or t
  misc_feature (2725)..(2725): n is a, c, g, or t
  misc_feature (2729)..(2730): n is a, c, g, or t
  misc_feature (2732)..(2732): n is a, c, g, or t
  misc_feature (2735)..(2736): n is a, c, g, or t
gaagcgatgcttggcgtcggtggtgaaaggatgattggttggacgttttctcctcctcccgctgctgttgctgcggttggcaattgttggctgagtttgagctgctgcatttggccatcgtcttcccattttgcgagggaggaggaattgagtcgatccgtttccacaatgttcagcacttcgatctcattcctctctccgtaggcatcgtcgtcaatgtacatcctcagtccgccactgcccccacaattgccgttacggcagagtctgaacggcaaaatgggggtcaattagtaaaggaaataggggcatccttaaaaaattgaaaaatcaattagtgaaaaaagtgcttacgacaatgggaccactccgtacacataggctaacatgaccggcacaccaacacctgaaaaatgcagaagaaatattcatccaaccaatcaaaaacttggattggtggtccaattgatgaactaattaatggcactcaccaacggacagaacggcgagcaccggcgaaacaatgagcgaaccgaacacggccaacgcagtgacaaaacgccgccgcattttggacagattttcaaagcgttggtagactttcctgcgggtggaaaaaaagcaattgcagttttgtagataaaaaatgggaaaccttccgacaaaaatgggcactccgcaaattattcctgcaaaaaacgaaaaaatgatgggttaaccaatccaattgcataccgggcacggccaatccggcgatcaatgcgatgcccaacggtgcaccgatcagtgtcccgatctgccagagcaacttctttttgcgagtccatggctttttgccccaaaatgtgcaaccggttggactgaaaagaagcattttaaattgttggaatggaggaatgaaacgacctgagataatgcaattcgttgatctgtttcagacaaagccaacaaaactcggcatggcacagaacgcattgcatgtgattgcaggagccgtcattcatctgaggttttcatgattagcaaattcacggacaggcagagggggtaataacacaatgaaaggacggactatcattggtttaaaagttttattctcttttgggaatggagacccaatttccgatttggtgtaaaaacagatttgtcaattttcaatgttaagcaaacttttaagctgaatttttaaacatatttgaatgcattggtcattttcgcctagatttctaaaatgatcatcaaccaaccttcatgatttggacaccgcaccgcggacacgctttggtcacgtcgcctgcacctgatccggacaaaaagaaacattaaaaatgaatattaattcaaaagtcggctctttgctattttccccatttcactcactgcttgcgctgtccgtcataagtgccgtcgcttgggcagcaaagccacgcagtccgccggtcagtttggctcgggcctggtcacacgtttgcttgggatgccaattgtttttgcaatggctaaagagattggggtagaaaacaactaaacgcctaacggcaccgctagatcccaattttcttatatatttgtcaaaaatttgtctcaaaatttctttctgattacgggcccgttgacaacaattttaatgtccagaaacatgtaatattccaaagatgggaaatatccgcatattaaatgtttgtaaagtcactcactagcagaacattgtgtcacaccgttcgcatttaagctggggacaggcggcgcacgaataagcgatcacggcataactaaacaaacaaaatgagcacattaaaaccaaaaagcacttttacattatttaatttattttttacactattttatttcatttcgcggtgtcagtgtatacgaatcaatttattttaattgaaaattcaaataaaatacgctacgtgcagtcgggcgccggacaccaacgcgcgtccgggtcagtgctgagcgcacggcgcaatgagaacatttcatagcggtccaacagctcaggctggtggtcaagcagtgcataaatgtcactggcgtggagaagagcggaacaatttggacaacttcaacaaaaaagggtaaattgaaaagttattatttaaaaattcaagagacaacgtacgaaatgttagtccgactctccatgatttcgaggttcaaatactgaaaacgaaacaatgattaagaaaaagatggatattaaatagctcgattttcctgatgtcttcgattttgctttgagaaaatgaaacaataaatatttttgatttttccccaatatttaaacacctcacacaatttttgcccctcttaaattgctgacaaaaaggcaccttgacgagacaggctttgcacgtcaaatgcgagcaggtttggagcttgtggaaattggtggggtgctgtcgaatgtaacaaacggggcattcccgggccttcatctgtttgcccaccctcaaattgcactgggactcggaatgggnntgnccgccctgnnnncngcgncnntnncctttnccttctcngnntgggtngcgnttttcttngcnnttctctntcgttttntnnggnggccttnggccgtcgnnncctcnnnntcttntncntnctcgncccnnctntgtctttttngnccnnccctnntncnnnnntgccgntntttctnnnnggcntcgcntnnnccgtgnnnnttgngtnntgncntgncncgcgnnnntncccnccgnngncgnngtgctgctgccccctatggtgatggacagacggtcagccaccatcacattgccaa

SEQ ID NO: 11826 - DNA, 1250 bp, Heterodera glycines
caggctttgcacgtcaaatgcgagcaggtttggagcttgtggaaattggtggggtgctgtcgaatgtaacagacggggcattcccgggccttcatctgtttgcccacactcaaattgcactgggactcggaatgggaatgaccgccctgaaaacagcgacaataacatttacattctcagaatgggtagcgattttcttagcaattctctatcgttttataaggaggcattaggcagtcgaaacctcaaaatcttatacatactcgaccaaactatgtctttttagacaaaaccctaatacaaaaatgccgatatttctaaaaggcatcgcataaacagtgaaaattgagtaatgacataagacacccaaaaataccaaccgaagacgaagtgctgctggccccacttttgatggacagacggtcagccaccatcacattgccaacgcagccattggccttgccaattgacgccatgccgccaccaccacaacaacccgtgccactactgctgctatcgcctttctcgatatttaccgcgcaatacgacgtggtgccatggtcacggtcggcaccaccaccaccgcccccatctgtgccatcggtgtgcgcatggcgcaactcatccgccgctttgccgcaaaggcttttcgtcagccgatggccactggcggagcatccgccgccgtccttttcagtcccactgtccgtcagcggcaccattttctgcttgtccgactccatttggctgtgctccgcggatgttgacgatggcgtatgcgaatggtgcggctgtttttgttgttgaacagacgaagcactcacactcaaactgcgccgccaacttttgctgaaaatgtttggaaataaatttttaaatctaaaaatacagtcgaaagaataattatgaagttgggaccggcacttggcaaaggaatttgatcattcaaaaaggccaaccattagcatatccaatctattctcgtcaaattttttaaatttaaaacctaacttaattaattttcaaatgatagtcattttatttacaaatgtcgtattttctacaagttgtctcttttcgaggttctgttggttggccccctgacggtcaatggtattaatcgtaaaccgttgcccatcaaaaacccatccaatttcccaaattaaacacaaaacgaacccgccgccgccgccgtctgtccgcgtcgccggcgctgtgatgttgttcaggaaagtgatcacactgagccg

SEQ ID NO: 11827 - DNA, 948 bp, Heterodera glycines
cccccccccccctccttccctctccacaccaatcatttcgcatcaaaatttgatcaatcaattcatttccccatttctccctcaccattttgagcattgtcgtcgacggttgtgcatgttgcgcttgggcactgtccgttcgatttggctgttgctgttcagcagatgatgatgatgtcccttcaccgtccggaatgccatcagcagcagaaacggaagtgatggttgtggtgttgttggggttgtcttgaagcagtgcctggccttcgtccgcactttccattacaatgtccaaatttttcaagcattttgagccaccagcgccaacactgctgttgctggaggaaatcatagctaaggcctaaggaaacgggaaatatgggaattgaaatggaaaaattatgaaaattttatgtaatgaaaaagaatgcttcatatatttgccaaccaaacatggaaagagttgggaaacaaatacgaataaacaaaaatggcatagcgaatatccaaatgtggggctgttggttatccgataccaaatgaatgaacagcaaaaaattacaataaatgaatgggcttgtgctgctgcaattgatataaataatgaaagtgttaatgacgatgatgctgatgatgacgaagtgtggtgggtggaattgataaatggaataaatgaacgaaagcccattcattgaggtgggaggaaaacaaatcgacgaatcgatgaaataaatgaacgaaggaaagaaagggagaaagagagagaaagaaagagagaaaatagaaacggaagcacagagagaaagaaagagaagaaggcacagacagcgcacagcccccgggggaagaaagggagaaaagcgagtggcaaacgaaacacatcaaaagggtgggcgagggaggaaagacctcgaggagaaaccgcgccgcgctcaaacagcaaaagaa

SEQ ID NO: 11828 - DNA, 2819 bp, Heterodera glycines
ttttatgcatagcgtaaatgtgaatattttatgaatagagcaaatgaatgcactttttaggcatatgtatgcctctcatatatgaatatttatgaatatagcaagcaatatattgaaggtcggatttgttgaatctgctttttacgatttagcatatatacatgtagcatcatcaaaccagtgatatttagttgagtcatcaggtttttggcttaaggctgacttcgtttaattgtacggttattttgcttttcccctgggggcattccccttggctttatcccagggctgccaaatgtgatgatgatttttccttttgaaatgaagattttgcaaaatcgtaaattgacataaaatggtcaattttcagtgaaaattaaaaaaattggctcaaattcgaacattttgtctttttttggcgccgcaaaagaaaaaaacatttttttttgatttgaaataaattttttcaaaattacgatctttgaccccaaatgctgattttttgatgacaaaatgatggttttgaattttttcatctggcagccatgctttatcccatccaatataaacaatgttcacaatacatattatgttcattcaccgtcaaaaatgcttcccatcgcttgaatgcaacgcattgtgacgacgaaacaaacgaagcggacacaattggctaattagtgtgcaattagcacagcaattacataattaattgttcaatgttcacttcactaaacagtgctttcattttttattgttgttggttcctgtcattttgatccatctttgatcattgttttttgaaaaaaagaattggatagaatttaatttaattagatcataaataggctaatacatctataaagaatagggggactcccagtgattggaatgtcaatgaattgagtccaaatgattgaaaattgcagaagatctaattttattttatagattgagagaaaagacgagaaaactgctaagaaataatgtaccataagaaaatgccaatagaagagtgcgaggccgcgaagcagccgagtcacagtaggttttatcattcataattttattaaaaaaatcgcactgcctagcttgggatgcgccgaaggcgctaaatgaggacaaatcttcaatttcggagcttatatgtttctactttaaagaattttttgcattaactaatagaataaaataactaacgtgacggaagcggtcgcgacagtgcttcaacttccacattagtgtgccgtggccggcttcgtgccccgagactcgcgctcggccttgttcttcttgccctgtttgtagaacggccgctttaaattctcttctttttaccagaaattctttgcaactttttaattgctaaaattacttccgagcaattggatagtattagaggtcaatttggtcggattttttcgcgttttctattagaatatttatccaaaaaaccggtcgaagaatttttcgattttttggtgtttttcgactttcttaccagacataaaataaattcacattagactagtaattttttttattgcaaatgaccatatttccacatttcaaacaatttatatatgtacatattaccattttttgataatgcttgtttttcaaattttttcttttttcacaaattttctttattatttcgtcttaatacacatccaaaaaatgccaaagaattcgttgagattgtccccaacttataagcgatggcatttccaaccattgggaccaagccgggtcaaatgccgaaaccagcacagtttttaattattttttgatgcagaaattcggtgaaaattctggggcaacgaaactcaagaataattttttttcaaaaatatctgcaacaaaatactatgcaatttagaattcgttcagcaagaaccagccaaggaatcagaatcgatttgacttatttagaattcgttcagcaagaaccagccaaggaatcagaatcgatttgacttaaatttattatttacaaaaccgtgacaataattttttttcagaaatatctgcaaaaaaatatcatgcaatttagaattcgttcagcaatgagaaccagccaaggaatcagaatcgatttcactgaaatttattatttataaaaccgtggcaataattttttttcaaaaatatctgcaacaaaatattatgcaatttagaattcgttcagcaatgagaaccagccaaggaatcagaatagatttgacttaaatttattatttataaaaccgtggcaataattttttttcagaaatatctgcaacaaatactatgcaatttagaattcgttcagcaatgagaaccagccaaggaatcagaatcgatttgactgaaatttattatttataaaaccgtgacaataattttttttcagaaatatctgcaaaaaaataccatgcaatttagaattcgttcagcaatgagaaccagccaaggaatcagaatcgatttcactgaaatttattatttataaaaccgtggcaataattttttttcaaaaatatctgcaacaaaatactatgcaatttagaatccgttcagcaatgagaaccagccaaggaatcagaatagatttgacttaaatttattatttataaaaccgtgacaataattttttttcagaaatatctgcaaaaaaataccatgcaatttagaattcgttcagcaatgagaaccagccaaggaatcagaatcgatttgactgaaatttattatttataaaaccgtgacaataattttttttcagaaatatctgcaaaaaaataccatgcaatttagaattcgttcagcaatgagaa

SEQ ID NO: 11829 - DNA, 1855 bp, Heterodera glycines
gctcattaagcatcattaacattcattaattatgtaattgctggcaaccgcccgccgaacggagcagcacattaaagccaatcattcattcatcattcgactaatttattatgatgaacataaaagggcgcaacagaatgccaattcattaaaatttttgacaaaaaattaatttttggattttcgtgaaagtcaaatttggatttcattttttaaataaattcagaaaattgtgttattttttatttttaaattttttgctatgcaaaagagcatcttcccaccaaaatttccaattgaaaacccgtttttcaacaagtttttgcatttgaaaatgttgtttttccaccatcccctccccccccccaaatgagtgccaatttgtaagacgaccccgcccatgaaaagagaaggtgcgatcggtggtcatttttaattggcgctggagcaaagcactcctcactcactgcccaacaaaagttcattcgccaagtgccgaaaacttccattgggggtggttcaaattcaaatgaaaccccaaaattttcaaaaaattcgatttttttttaatcgctatccttcaaatttcaattttttccaaaaaaatgccaaagttgaatttataaaaaaggaaaattgatattccgctgctagaaaattcgatagtttttcgacaaaagttggaaataatttttgaatataaacccgagagtctcgaacacatttctaacaaattttaaacaatctatgatttatttagccaaaatttattaaaaatgaaaattgtgggagaagcattaattttttcacattggaagtgccatttttgggcaatggcactattatgcctttcattgcttggccaactgtgttccgaaacagaagctgctgatgacagtgccaaaagtgagttttttaaaaaaatttcgcgcttttccatgtccaaaaatttcaaaaaaaattcctaaatttctcctagccccaaaattatttttttgtgacaattttatggtttttctgagcttaaaagtccattctctaacaatagaccctttctcccatgggtggccattccgtcacaaattagcagctaaatgatgctaatttgattagcgtattatgtgcattattttatttatcggcgatcgaacggtccattgatcacacgcattaattaatgatcgcaaattaataaaaatagaaaagaaaaaataatagaaattgtgcaaataatagaaaatattttataattgtgaaaatatataaaatcttattaaaaaattaattaatattttccatttaatttttaaatttcatccaaaaatgtaatttttaaatattttcaatattattttattttttacatatattatacctacataattaaaatcaaaacaatttttcaaatttgttagtgccatttgcgcaatcagttcggcgccattttcacccaattggtagtggacgtccgacaattattcaacatggccacaacaattttcgtgatgaaacggtggaataaaaataattaatttataaaaaatttaaaaattttggaatttttaaaatatttaacaagaaaaaaatagaatgttgttgccgcttctccgattcaagctcctcatcagcagcagcagagttttgcggtagccgcgcctcaggcaaaaaaaaaataatagaaattttaaattgaaaaatgtagaaagatttaaactgagaaataaacgatattttggcataaataaggggtgggggcaaaatccggaaattcgaaatttaaaaaatttatgacccctcattcgtaggcttctcctcatgtggcgttcgattatggggcgacaaagcttgctgcagc

SEQ ID NO: 11830 - DNA, 3266 bp, Heterodera glycines
  misc_feature (3219)..(3219): n is a, c, g, or t
ttccccaattttgagatttttaggtagccgtagtgtcgtaatcaaggaggctgtagccatgcggaacattaattttgtttagtttaggtattagctttcgccctcagcccctcacaccaacaacaggaccgtctctggtcctaattttgcaggagtattgacggaaaagataaaaagaaggtcatggaagagtgaaaagaaagaggatgggagaaaaagtaaatgcgtgtgaaaaggtaagagagaaaaatactaagtgcaattagaacgtggaagaataaattcattgccaagaaaattaagagaaactgagaaatggtagacaggaaagaagagcgtgaaaacggagaagaaaggccctgtctccaattatcccccccccctttctgaggaggttgaaaaaatcccccgtctctatttatcctcccgggggttaaatggaatttatattaaaagaaacaagggacctatttcctgtttttgtttgtagttttgggcccataacttttttacaaaagccgaatcaaaaagtgtccgatgttcggattttaattgaagtgttatctaaaattcaaaaaaattccgggcctctacctataataggaagggctgcagaaattggcaacttttcagtaccaactttgtccaattcagtccccgtcgaataacttatcaggctttgatctgagtggagggtggccagcggacttattagaactcaatgagctcgattttttcagatttaaaaatttcgaaaattttcaaaatttttcgagttaggctccctaggaggttttagggtttttgaattttaggattttttaacgaattttcaaggaaaacggataccacttccaaacatagttttttgagttctatcgactggtattttttcggaaaaaatttcgattttttcccggaaatagaaaaatttttggcataagcgggacatttgagtcccgggtccataactcgtcaggggttgtttttagccaaaaagtgtcttagagcaaaattgtagagctttttaagctccatcgaatggtgtgtcatatgctgtgaaattttcaaaaattttcgagctaggcccactagtatccgtcattaacagggctgcaaaaaatatgcaaatgcatattttttcctggcttctccatgctctaaatagcaggaaaacactttcttttttgtgtttgcttataaaagtctggacttttatttgcatatttttgcatatttcgaggtttttgtgcatatttgcatattttggctttttctgcatatttcgtgcatattttgccattttctggaaaatttgttaacaaaaatgcaataaaaacggaaaatacacccctaagaatcggccctaaaaattcagaaaaatacacccctaaaaatcgaccgaaaatttttaaaaaacacaccactaagaattggaaaattttctcaaaaattcttcccccaaattttttttttcttgacaaaatttttgatttaaaaatgtcaatatttgctaagagaattttataaaagaactgtagctcattgtcaagtgtactaatgaaaaaaaatttttaaattaatttgcacccctaattttcaagtttttttgtgcatattttgcgatttttgtgcatacatatttgatgcatatttcacgagtttatttgcatatttatgcgcatattttgtccatttttcgtgcatattttttgcagccctgttaataaataatacaaaaacaaaaaatgaatttaaataaaagaaaaaaacttaattctttaaatctgtaattagatgaaatttatttatttatttatttatttatttattcgtgaataaaaagtcatcagaagggcaaaaaaccacttactctgacgactgttcagatagtatgtcgtagagtaagtgatataatatatatggatgatcaaaaaataaaatcaaaatatatgaataaaatgaggtcaaagtcaattgagatcgataacacaaatgtaaaatcacttaaaaaattaattctgtttttgcttttccggttattaccctaatgaatttttaagttttgttttaaattgatttaaagaatttgtttttattagttctttatcaagttgattccataattttgttaccctcccggcaaagggaatgaattttttgcctattttatattttgtgttaaatctgtaaaaggggatgttaaagcgtgtcgatggattaaaaattgaaaatagtttcagatctgttcggccataaacaattttatgcgccatgaacagatcaaatagctttcgcctattctcaagtgtcggcagttgcaggtattttaatcgattttggtatggaattggcggaaggctgcatttaaaaaatacccgtttggtgaaatatttttgacacttttctatttttttaatatttttttgaagagacggattccaaacctccggagcgtattccaataaaggcctaatataagttttatataacgtaatccaaatcttagatgatttggatttaattattcgaaacaaggaacgcatacgtaaatacgcattccttgttattttgtttacatgatcggaaaattgtaatttattatcaatgtttactcctaaatccctaattgtatccacagcatttattgtatttccatcaaatttatatgtttcttttgggttttttgaacccaaatataatacaaaagttttttgaactgaaacttttatttgccatttatttgcccattctgataaattatgcaatgctttatgcataatttctgtatctgctcttgctttatagcatatatacaatttaacatcatcagcatataattttattttcactcctgatggcaaagcatcaggaagatcgttaatataaatcaaaaatagtaaagggcccaggacagagccctgggggacaccagagccaacttttttatttgaggataaagcatccccaattttaacacgaaaagtcctattactcaaaaagctttttatccacattaaaagtttgccccgtataccaattttttccaatttgtataaaagtaagttatggggcactgagtcaaaagctttctgaaaatcaatataaatacagtccgcattttttccattaataattgcatcataccaatcttccacaactgttattagttgacttgtcgtagacctatttctaacaaaaccaaattggtattccganaattttaagagttttaggagaaagttgtaaatattttggctaagaat

SEQ ID NO: 11831 - DNA, 893 bp, Heterodera glycines
ggggaaaaacatccaatgcatttcaaaaaaaaacaatttcataatgatcgatcatttctcaaatctcccaagcattgctgggcccggggtttcgatgacatttcttcgttgctttgtcccaccgctggtgcagtcaatggcctaaatcatgttcaatttgattcggtgaaaattaacaatgttaagtgccaatcgctcgttgctcacccaagaaaattggcaccatttatttggcccatcatttgcaatctctggggtcacacaatgcgagaatattgcactcaggttcagatcgaagagaattgttggcgaaatttcacgacataaattgtccagaggtgatcaccaccatcttcgatgtacaaaaggcggactttggtcgtcgtaaaaataggcaaaatttcacgggcaaaaacgcgccaaatcgggattatggtgcccttggacgaattaagatgaatgtgcaaattgacccctttgtccaagagacgtttgttggaacggagaaaagcaatgacggagtaattgatgtaactgaaaaaatgatgctttacgcgttgaaatgaatttaaaaaatcggatttacttaatccgaaggtctttaaagcaaattttgtcgggcagcggacggtccgaagacggaaattcaacgtgacggcaattgatggacagttttgcctttggtccttccttgtaaatgctaatgtctcgccaaattgtcaattccgttttgccatcgaaatgcgtgtccaccagcgaatcgtaacgagaacaaagcagcgcaatattgagaccgagttgaggaagacggaaaaacgggagaatgttgatccaaacatcgttacaaatccagctgaaatgcgtaaaaactgattgaatgactgccaatgcaa

SEQ ID NO: 11832 - DNA, 1239 bp, Heterodera glycines
cgctctgctcgtactccagcacgcggaataccctcgtgacgatgtagccctcgtccagcgccgcgttgagctcaatcgaagtgcatgtgctgacccaacctcgttgtctgtcattgtgcgcgcagtggtagtcgggattcacgccaccagtcggatgctctttggcacaagtgatgcagagcggaaaacaaagccgctctccaactttaacaggcagaacgggcacgtcgacgcgacgggggggggcacaacccacactttgagtcacgccaagggatagcgattgtctgctgcgctgcgccactcaacttgccggctcagcacatgcacttttggatgaccaatggggtagcgagtgacgaaactaaagttcaaaatttttgaaaaaactaccatcaccacacatacttaatatacgggtacaaggacgtgaagtcgtagtaggagatcttctctcctggtcccgctttgcgcagcagcttcagcggtcccgtccgccctcccatgaacgcgtcccggatcaccagcggaccatcatccacatagtccgaaaacgacttgcgcatttctctgctctgctccagcatccgatggatttcgcactcccagtagacgtccactcggttcacttgccgcagcaggaagtccaggcgtttggcgtcccgctcgcgcacctccccctctgtcttcccactggggagcagcatgttgtcgttgggatagcaccttttgcacccgtgccaagtgcagcctaaaattatacgcataaaatttttttttaaatatataaattaggcaccgttgacttcaatggcgcacccctccgcctcaatccatccatccagcgaatacgctccgattctcttctctcctccggctgagtgggcagtttgcacttccactccgtgctgctccgcgtaccagtggaagaagcgtaaggcgagcaggctttggttctgcgcgttgtcatagccgcgctcagggacaatggccagatgcgcgtcgggcatttggtttgtgcggaagtgacgcatgcatgcgcccgcgatggtcatgcattctcgcagaacatcgattccgtcgtggttctccttgtcgtcaatcccatcaacgtattcttggcgccgcgaaatgtcgaagaattcccggcgaaacgcgacgagagcgggcatcaagatttccacatcattggtgcaatagctgagagaggcaaaatgagaagactttggcaacattttt

SEQ ID NO: 11833 - DNA, 2983 bp, Heterodera glycines
  misc_feature (87)..(87): n is a, c, g, or t
tggtgcaatagctgagagagccaaaatgagaggacttggcaacatttttttttgaaacgccaccttgctaatgcctcatccagctgnaagtggtggtgacggttctcggcgtaccacgcatcgaattgccgccttttgctgggcatcataccgctggccaggtagtcgtcgggcgtcggatggatttccctgccgtagttttccggtcgattggccatgtgggggaagaacggcttgtcctcaacctccagcccatatgaagggacgagcgcggccagtgagcaaggcattaggttgaaggagtcccggaagacgacgttggggttgcgcttcttctgcttacgcactttcatctcatacattttgttgccctaaagatttgaaattatatcaccataaaaaatgttttgcttttactcgtctcagcatctctgggttaaagccaattctgaagagctcgcgaaaaacgagcaccatgtcgaaccgtccgccaaagtgtgagtaggcgtatgtgtcgtagctcatcggcagttcgaagacgagccaatgcacaaatgccaccaatggattgtcggccaccaccacctgatggttcacgtgcgtgtccacaaagcggcgttgacaaaaggcaacagttcgatgcggcccacaaattcgacagcctgctgttgttctgctgcgccaggttgggttggatgaagcacccccgctcgggattgtgaaaagtgttgcacaattgacagaaggattcaaagcacttatggccctaaaaacgttaagaaattgcgttttcaaccatttttttgacctttcgcccatttcgattgttgtctcgcacattccaaattaccccgcattctttgcactgcttcgatttggcacaaaaatgtgatgccaaatggtgttggtggcatcacacacggcacacaaatctccgcatcatatgcattcagtcctgcccgtacacgaatttgctgcatcagttgtaaagcatcccgctgcagacatccctgctgtcccctccgactgtgcaaatagtcgtagaatttccaacgaggccaaccacgcgttttggccaccatcgttgcctgctacgcgtagaacaggcaatgcccgtccgggttgcaaatcttaaaacaaattgtcatcgaatagtcttgatttgatggcgcgacacgaccttaatcaaacaattttccgtcactcggtgatgcacgggtgctaggcttcgtcgagcaccgcccttcagggttctccgagcgggaagattggagcgatcgactgtcgtcactacaacagtgaagggctcgcccccaaagcgtgacgttttgctgctgtttgctctgcgccactttggtgaactgattcagtattgtgtcaacggtgttatcggtaatctgtcgaaccgggatggggatgtccccgccggtgagcaacggactgctgatcatgcagccgagatgagtgggttcaattccacgtccacgactctcctccatcgctgcgtcaaggcagtactggaagatgccggccaggagtccctcaggatttgctgctggcacatcctcaatgctgaaccgcgacttaattttactgtactggaagcggggcacatgctcaacggtgctgtccaacttttttacgtagtcctttgcagactttgatgatgatgagctgctgccgccgccctcttgaagcacctctccaagcaattcattaatgaggaaaccgcgacgcggctttttgcttggggctgatagaatttgatcaatggaaaacagagagggatgcttgggaggctgattttgcattatctaattttatagggaaaaataatgaaaagaatgcatgaaaatgaacaatcttgacatttgccaatatttatggggcatggaaattgccgttgtgaatgcaaattaatggataataataattttaaaaatttttaaccaattatgccctgaagagcagcacactgccacccatgaaacacaagacgacagggcacctaaacggctcgggtaattagtaaaggtcacgcgtaaaaccccaagccctaaaagacacacaagtgctgccaggataaacggatcccaataattggagcaaccgccctggttaacagcaataaattaactatttaaaatattattattattaaagtgagtaaagatatgaacagatgtgaatgaaatgtgatttagactgggtatttatgaagattggagagggggggggggcggggtgtcccaatccgaatgccaattaattttctcgaactctccttcgttgtgtcggcaaattcaaatttcctttgaagtcatcttcttcactattgtcgcaaattcaaatgtactattgaataattaatgagcccatgaggaccgggcacaaaaatattttaattcactcttcattcattcattcattcaaattttatgaccaatatgatacccaagcgattaccagccgagctcctcttcgaaattatctactcacttcccataatgtatttgtttggcggggtaacacccaagccaggtggaaaaaaaaatcatatttcaaatttttcgcaaaatttaaggccgtccaccatccggtatcgcagtggtcaatcggattatcgagatatttcgggcgaagcgtcacccaaacttcacccaaattgtaataataatttaatttaattttgtttatttttaatttgtcaattaagaaacggcttgctctcaactttgacatgatcagtgcaaaaggatggatgtcagacggacagctctacctgcattttcgtttcacaacaatgagctgtgttacccggctttttcaatgagttcgcccgatatatttgcttcggcaatctgggcgcattttctgctcccgaaattttggtcgactcgcacaattcgctcgtaaaatttttgaactatttttgctttttccattttatgggaaaaaagttaaagggaaaatgttgcacttt

SEQ ID NO: 11834 - DNA, 1378 bp, Heterodera glycines
  misc_feature (1274)..(1274): n is a, c, g, or t
tgacgaccatcctgttgttttctgcttaaaatacagtacttttctcgcactccctataccgtaattccttggtgttactgtgtaactcatttaaaatttttttcaaaatttccacaaatatatagggtttcaccgacccaacatacagagcgcggcgcaaatattttgccgacattgcagcaaactacagacatggcgaaaaaattccacgcgtcgagtacaccgcggaagagattggcacatggcggacaatttacaacgaggtgaggctgggaaggggggccgcatggaaaaaaaaattgaaaaattcaatagaaaaaccaaggtccaaggcccgtagtcccaggggtttgggaatttcgcttccccgtgaaacgaaaaaatcggaaattttttcattcagttttcaaaaaaattcattaaaaatttccaaaaagggctaaattttcaaatttgacaattccggcgagggggcggggattttttgggtggcgggggagggggggagggaagaatggaaaacctcaccaagaaagtttcgagaaatttatttttgtaaaaaattagaaaaccggaaaaccataaaaaaatttctattataattttaattaacttacaactttaaaaatttttttaattagaattataattaatttaaaataaaaaatttattttggaacaaaaaaggtattccttaacggtgaacttaattaaaccatttaaaaaaggcaaaaaaaaaaaagaaaaagaaaataaattaaaaaaacaaaacaaaaaataatttaagaaaataatcaatatgaaataaaactaattatttaataaaaaaaaatactttttggtcaaaatgtttcaaaatttgctaaacgttttttcatttttaactttagatttggaaaaaaaaataccaaaaaaaaagcgcagcgtttttgggaacacaaaaaaaatatatgaaaattaaagcctaaaaaatatatttaaaaaattaataaattagttaactctccattaaaatttcaaaaaagtttttataataaatataaatttttgtatcgatgtgccgttgttttccccccattcagctgatcaatttgtatcccatccacgcgtgccgtgagttcaactacattttcccgctgcttcagcagaactgcggttatgcgcctgatcggattccgcagctgcaagtgagtgccatctttttttggcattatttaatggaataattagaattaattttaggatgtttccgacttcctcaaaggtaattttgngggcagcattttttcaaaaatcccggcaccggcttgaaaatcttgcattttttatgcccacaaaaagtgtcaatttgaagattctaggcattaaaaattttttt

SEQ ID NO: 11835 - DNA, 1149 bp, Heterodera glycines
gaaaaattagtaatgaaacttagagtcaaaagaaaaaaaaattaatatattctttaaaagtaacactgcaaagtgtgaaatggcctagtggctagtccccttcactttcccttcttctttcccctggttcaatccctctacagaaattaaattcgtttgaattttctttttgtatacgcgcgggtttcctatagagaaaatatgattactcatagttttttttaaattgatacatattttatcattttttaaatgaaaatcctaccaatataaaaatttaattttgtattattttcagttgaaaaaaaattaaaatttgaatttttaaaaaaatttttgaatttttttgaatttttaaaaattcccggttggtcccggttcccggtcccggtgccgaaaaaaatcgaggtcccggtcccggtctcggcttctcaggtcccggcaagtgccggtcccggttttgctcaaaattcccggtcccgtggcactctagcaatgacaattaaagagcggaaaattgaaatggattttgtcagggattttcacatttttcccgatcgggtaattttttgaaaaaaaggatccggatcacgaagaaacaggatttgaaaatcctgaaacaggcccggggttgagagcgccccgaattccctgatccttaggcggaatttttaaatttcggcctcttctgacgactaacggccacccgtgaaattaaaattcaaattcaatcgagtcggttttcacagactgtaccggcttcacacttcgaccggtggccggccttctaagttcccgcgattttctggccgggctggcattcagggtaagaagggcacggtttctaaggaaaattctatcaaacaaaaaaagtgctcattaacgataataaatatttaaatttgatttaattataatttagctcaatcttaatcaaattaaatattttatttgtattgagcaaatagaacgtcctaaatttgttgtatcaaaaacattaatttttaacaatttctattatccaaataaaattttatgacatttcagctaattttaagcattattttttttattattctacaaacagaaattaaaataatatttaattggagaggtattacaatcaaattagataaattttattaatcc

SEQ ID NO: 11836 - DNA, 2253 bp, Heterodera glycines
aagaatttggactcgcatcgcttggcgccttcgatgaaatggtggagaaattggctacggtaaatactcgctgccccacggtgggagtgtactgtattttttagtagtaatatgagggaggcgcttttcctaaaagactaaaaaaagtttctcagagtttctcggttacttcaaaatgcttctctggacagatttctaccataacaaaatacagtagaccaaactgctaccgtaatcattgatttgccgactgtttttgtgccccttttttagctctattggttcaccgtggagttcggcatttgcattcaaaatggggcaaaaaaggcgtacggtgcgggactgttgagctcatttggcgaattggaatatgcgctcagcggacaggtgaataaaagacaatttaattttccatttttgtacggatttagtaaatcccggtttatataaatttttccactaacactgatttatctcctctctctattatctgcccccaatttgtagcccgaattggctgcgttcaacccgccggagacgtgccaaaccaaatacccgatcactagctaccaacccaaatattttgtggccgaatcgttcgcggatgccaaaaacaaactcgcgtactgtatttgtcgcgctcgcgttttgagcatttttaaccctccccgctcccgcagtacatggtcaacgagcataccaagacagttccaagtcaactacaacccatacacacaacgcatcgaaatgttggacaatgagagtgcagcaaacaagcttgtccgggatgtgaaaagtgagtcacaaccgtggtgagtcgaagtgacaaaagtgcgaatgagtggtgatcagaaggggcgggtcttttcagtacggaataaattattttaataattaaataacataattatttgataaggaattaacaatctaataataataaatatatttgtcctctatatcagtttacacgaccacaaaaattgacatgacaatataataatttgacaaatttaaggcaccgtaacttttacaagaagcatccaaattaaaccttcttggtaccatttggtagccctaagtgtcctctatttgcctataaaatttcaaaaaatttcgttgagtttctaagaagttgtggtcaaaaaggtttaccaaatcaatttgtgaagtttacaagccacaacttttttgaaacacaaccaaattttaaaagcaaatagaggacacttagcgctatcaaatgataccaagaatgcttaatttggatgcttctagaaaaagttatgacgccgatcaaaaatttataatttttatggtgatcacttattcaatcaagtataactttctattagagagcgggaaaaaaatttttccgggaacgggaaaacaaaaatgaacggtgacgggaaaaatttcttttcgaaaaaatattgatttttttctaaaattttaatttaattattttttaaagttcaaatattatattttaacaattaaaaaaatttatttctgtttaaatgattaaatattgcttttattaatgaacaaaaatttaataaaatttaattttttgaattgatttgttttaaaaataagtcggtaacaatattttcgaggtaccggcaaaaactggtaattttctgagttctaaaattctagaaaattttttatagtgcaataattttcgttaaaattgtatattattttttaaaattccaaaatattcttatagaatttttctgtgttttcaacttattgacaaaatcttttttttttgttttgattaaaacgttttttttcggcgcacctttaccaaaaattgaaaaaataagaaaatccaaaatgttaaccactcggctacacatatgttaaatagttaatttgaaatcaatttaatttaattttctcaaaaaattctcttttcccaccaatttccttcaaaatttttcactcagaccctcattcttaccagtgtatttttgtagaagcatccaaattaaacattctttgtatcatttagcagcctaaagtgtcctaagttatggctttgatcataaattgatcattttatggtgatcaattattcaatcaagtatagctttctatgtacaaatcttagactaaccattccaaaagcaattcggtagcaaattttgtgctcttgccagtggacttgcccattttttctagaaaaaatttcccaacccttctagggatttcgaaaatttccccgattttcagtgtatttta

SEQ ID NO: 11837 - DNA, 2236 bp, Heterodera glycines
  misc_feature (1955)..(1955): n is a, c, g, or t
actaaataaaatattttaaattattaaaaactaaatcaactttctatttattattaactaagagtatttttaagcaagttcgagagtctcggttataaatatttacaaatttctaataaaaataaataattgctaaataaatcaattatttattgcttcttacatgataattacaaacaaatactattaataagaaagagtttattaaaaaaactaaatttttatgtagaatgaatgattaggacataaataaaacctacaagataataattgcaacaaattttaatatttaaacaaataaaaaatcaccccaaagatggtttttttgttgacttttgcacaagaaatatgagcatgaattttaaaataaatttaaatttctttttaaattaattaaagaatatttatcaattataataaaaatataatattttaaaagataatattaatgtttttcggtaaatgaaagtaagtttaaatggtaaagaaagaaaaaatattattatgttgctaataaataatatttattataaaaatatagtttatttatatttttaaatactttataaataaaaaaaaattttgtataaaaattgcttaggcgcacgccttagaataaaataagaaaagttaattttaaataatacacaaacagataaaatacatttattaataaaaatggcaactatacatacgaagtgtcagagaggcgccttgtcatggaaataaatttcatcataatgaaggggttcgacaattttgaataaaaaaattattatgagtaaaataaaatttttattaatgtttcgaaattagaaaaaaaagtaaaaagataataaatattaaatataaaaatttaaaaaacatattcaaaaatcaaaaaaaaaaaaaaagattttaagaaaaatgaaattaaaaaaaagatcgacgaataaattttatgagtaaaataaaattttgtattaatgtttcgaaattatagtaagggataattgaataatttgtattaatatgaaagaattttttgtgttcataattatatattttttaaaataaatataaaaataagaaaaaaattttattaccaaaaatatcagtcgtataaaaatattatagcattaatcgcaatataaattataaataatttcgacaaaaatcggcgcaaaatatgaaattataaaatattttaatatcatctttatctctgctatgaactgcaccaaaaaaaactacatcatgagattaaaagaaaaaagatattaaagataggattatgaaagttatcaaaaagtagaaaataaagaaattaaaagaaatttgttgagaaaaacaaagcaaaaagaaaatattaaagtctggtaaaaaaattttttttactaaaagttgattttttataaaattgaatttgaaaactgatttttggtttaaaaaataatccgctaccaataatgtaccggaaaaattggtaattttctgaattgtaaaatttaagtgaacttttttaatttgacaattttcgttactttttgtggcgtattttcttaatttaatttttgggaaattatgggtggagaggtcaggcagtgccgatgagcgccgccggttaaaaaattaaattaaatttggagaattataaagaataattgttctataatgagtaattcttggaaaatataaaataaaaattcactaaaattaaaaacaaataaaataataaaaaaactatcaagtaaggcgctcttaatgtaaagtaaaaataactcttaataaaaatacaaataactagatttttagcagaatcaggacaaacaaaattgataataaattattgtaattttaagaaaaaccgttaaaatatgatatcacaaataatattatttcgatttgtttagcttatatacaaatttacgctagaaaaattcatttaaatgattttttattatcttattatgtancacaggaatagaaaataaagaataatgtcaagcgtttgcagttcgcataaccaaaagtaaaaaaattatgatttaaaaaatgtactcactctataaatgattggagaattaaaaaaaaggatttgtgcattgtgtaaataaaaaagtttataataaacaaaaattggtttttattttattttttttcctcaataacattataaagcaataaaattaaaaataaataaataaagattggaaacaataagtgataaaaatggacagaaattaaatttcgaaaa

SEQ ID NO: 11838 - DNA, 1381 bp, Heterodera glycines
  misc_feature (42)..(42): n is a, c, g, or t
aaaacaaaattttcaattattagtttcttaaacaaatataanaataagaaataattcatgcaatagcagccaatgatatttttcaatgtttgagcaccggtgtaaaaataggaaattattaataatttaattataataattctcatgacaaatgatcgcagcagcattaagaatatttttaggggcaaaaaattatatatttttcttttcataaaaataatcaaaaatataaattatttaatatagggtaatttcgcatttaaatttataattaatgtctttataatataaaaaattttaaatttttgatgcctacaattaaaatgacataatgaaaacttaaaaactaatctaattataaaaaaaggaatcattgaccttttaaacatataagttgttaaatgaggataataaaaaatttattttatgaactattcaacaattttctataaccgattagatggaataatgaatattttatgatattaaatatgtacattcaaaaaatataataaaataaaaaaaataggtacatatttcaaataattctaaaacaaaattatataaacatatcaatattataataaaaggtagaaaattgaacaaatagtctaaaatataattaagcaatttatataattatttatgaactgctcctcaactttgcttggcacgcaattgtcttacagtacaatgcggcaaagaacaagaaaatttatttttatcttacctaaatattcaattcagataataaatacattcaaaaataaaatataataaaaattaaaaaatgcaagtaaagtaatttttaaacaaaaaatataattaaaatagaatactttcagaaaaaaaaagacttgaggcaaaagattaaactgaataatttaaaatctaattcttctttcttatggccaaaaggttgtaaaaatctttatttttaaatatgaatacggagaaaaattttatttaagctaaatttatgtgatggatatataaagataaaaatttaattatatgtttcaaacctcaacaatagaagcaataccagaaattttaaaataaatataatttataagtagggttcgaagttgtatgcactaaaaaatgtcaaatatgcgcataaaatatgcactaaaaatcccccaaatatgccctaaaaaccggaaaaatgcccaaatatgcactaaaatatgccttaaaaattacccaaaatggcttttaaccctcaaaaaatgccaaaaattgtgtataaagaaaagaccaaaacaagggctaaggaacattttttagacaattgcaaaaatattgaatttctaaatttttattatatgctaaaacaaaattacattttttatataaataattttttcctaaagttctt

SEQ ID NO: 11839 - DNA, 1098 bp, Heterodera glycines
aaaatatattataaggttttcattaattaataataataaaaataatttgatttataatggcagaaaaaaataaagtaacctaaaaaataaaatttcaaattttttgaaaaaaactcagcgaatcttccaacatgacaaacattaattatattaacaataccagtttatatgttattccaaaggtaaattcgcccatgtaaatagcgcatggaacttggtatggcctccgcatcgatggtcaattcactcggatgacaagggtaaaattattccaatcaccataaatgataattgacaatgtgaatgataaaatataataatgataaaatcactcgtaaaattatttattgaactcaaatatcatattttaaaacaaaaaattatattttaaaactaaattttcaattattagtttcttaaacaaatataaaattaagaaataattcatgcaatagcagccaatgatatttttcaatgtttgagcaccggtgtaaaaataggaaattattaataatttaattataataattctcatgacaaatgatcgcagcagcattaagaatatttttaggggcaaaaaattatatattttacttttcataaacaataatcaaaaatataaattatttaatatagggtaatttcacatttaaatttataattaatgtctttataatataaaagattttaaatttgatttataaaatttaattttattattttatcttattttttcataataaagtgcgttattgttaagtttacaatatcagtatcattaaatggtttgaacaattttttataacgagtaatataaaagaattattggcaagaagtaattactgaagaatattaaaattttataataatttatattaactaaatgaaatgaaaaaacataattaattaagaagattcataaaataaaagaaaaataaataaacaaacgtacattgcagctaattgaggggcgttttgttgaagatcgactatccaaaaaatgatccaattcagaccatttttattttattttttcaacttcatatttaaacaaaagccactcagtggagccgcatcgaagagatatcattccattag

SEQ ID NO: 11840 - DNA, 2787 bp, Heterodera glycines
cggcataatgattttcaaaaatataattcagaaaatacttattattcgtgcctaatcaaatctagagcttgatcttgacttccagattgacctttgtgtattttctggaaaaatccaaaaaacccggacccataattacccaggcctagatacagatggtgctgagtcgggggcggagtcgttatttaaaaaaaccaacaatatgaaaagttttaaggaaaaattatatataactttgctcaaaagtaactaatttttttattcttgatataataagatagccccaagtgttctctattagcctgcaaaatttcaaaaaatttcgttcatttcaacaaagtaatggccaaaaagtactcaaagaaccagggtttttatatatttttcaaaaattttttgttaagtttcagaaaaattatgccaaaaaatatttgaaaacctggttccttgtatacttttcgccataactttgttcaaacttgacgtaaatttttgaaattttagaaaccactagagaactcttaaagctatcgaatgatatcaagaattaaaatcaataaataaaataccctaagaatcgagctttattaaaatttacgaaaagacccttaaaaacttaaaaatttgaattttgttagatttctaagtcaaatattatataaatatttcttttaaattacacaaaaaagaatcattttaaaaatgactttttattatacaaaatatctttaagaattgactgtggctttaaatgtttaactattttcagctgcttttttgacgagaaatgcacgaaaaagctaaacatttttagcccgaaacattttaattttaacttcattcttcgtcattaggaaatcctttattctcaatttaaataattacgtcactattttggaaaaatttctttagaaaattccataatgaaaaatttagccgtaagattcgaactttatgaaaattttcgaaaaaagaccccctaaaaactcaaaatttgaagttagattttttgttaaatattgtataatatttcttttaaaatatacaagaaatggatcgtttttaaaattacttttaggacaacaaattatcatttttacatccggcagcgcttgaaattcatgccaattctctaaaattcccagccctaataaaaaaaaacatttcgtgtatttaaattgctacagatttgatcccaccagcattaattacttctaaaaattctctggtactactgaagtgaaataaaagttttattttgtaatttgtagcattttttatgcgctatccaaaagcaccaccattcagtgttttgtagatgctctttgtatgccgatacaatttggtaaggtgatacacccccaaaaattttttgattttaaaccgatttttttgtcaaattatgtgtaaaaagcgtgccaatgaattgttttgaaaaccaaatttggacgaaaaacggcactaaaaatgcacgaaaaatctttttaatcataatcattacaacactttgacatgacagaaaacattttttgacaatataaaaaaaccaccaaattctccgattttctcaaaattacttcttttctcgcatcaatttgtattcaaatgtttttgcctttctttttgccatcatttttcggcaattctttttgatttgccattccttttgggcaattcatttgattttccaccacttttcggcactttgtttgattttccaccatttttcgaaaattcgtttgattttccacaacttttcggcactttgtttgatttgccattctttttcagcgtttccttgtgtttgggcgttttcaatggaccactcagagatgaagaagaagaagcatttagggaagcacttaggcttttcgacagctttgactttggtgatggcgacgctttgaatggattgaaattggccagacttggtggcaatgaaattgaatggcttttcaatacttttcctctcgaggatgaagccccccgctcttcgggcagcggcggcatttcgtccaaaatttttgagaccttcaggtcggacaagtccaatttgtgtttttcgccattgtacgcgtccatcgtttgtgattgggttgcggacataaaatgtgcaaatgatactttgtcttgatcttgccatattgagtccatgcctccgctttcaacttttctttcggttaaatccatgaacaatttacgcgaatcgaaaccgaaatcttctattttgaaatttaaattaaaagccaaattcattaagaaatatttaaaataaatatgttatgtatggacaaaattcaaaagtgctattatggatgaaacttgggttcccgcccccgccgggggcgggacaggtttttggcctcacccccgcccccgcgactcagacctccacaacccccgcccccatgaccttcacccccgcgggggcgcgggagtgaaatacacccctaagaatggcatattcgtgggatataaggcaaaaaatttatacaattttgaattttttaaccattttgagaaatttttttgaaataaagtaaattttacttgtgttttttattttatttgtggattggtggatagtgcttcaacaataacagtacttttgtcatgagttcgacttcggctaaagttttcctttaactttttttttgattaatacagggtttctttatgttcttatttctaaaaatattttgatttgtgggtaatgccttattttcttctaaaagaggaaaatttctgaaaaatttggcaaagttctaacaaaattcatgtaaattc

SEQ ID NO: 11841 - DNA, 1462 bp, Heterodera glycines
atcccagataatattttttgttacaataatatttgtggttttatctttttgggtaaatagttatatcctcataaactttcgaatgatatagcatttgttggatttggttttaaaatacacaagtgtgatgagtggtgggggtcagcgtggtcacttaccaccccacatttttgatttggtcccggacggaaaccccagttgggcgccgcaagtttttggctataatttttttttgccaacaataggaaaaagactaattaaattggacaaatcaccgctttaatttgttccaagtttgccaaccattgttgctccactgctgaattgccagttctgacagagagctgcttcggcagtcttttaatttcggaccctgaacccggattcgaacatttttgaaaactcaatttttaatgctttgcaaattaattatggatcacttttctcattatattttcagctgatctcatatcgtttttatgaattcatgtgcaaaaatcagaaacaactacacgtaaatggaaaaatctgatcatttaggtcacaaaatcgcatcaatcaatcaattcatctttttaattgctgtttctgatcagtgatcaccactcggcccgggcgaatcgtcgagaacactttaaaaacaataaaataaaaatatgcaactgaatttttaaattattcacccatcgtcgactgcgccgtctccgatgtaaagctttatttggttccgtccaatagcataaaatagttcaacgttagtcttccaccactctctctcatcgtgtgcaattggacaacggataagcttaaaatggtttgcatcttctttggacagtgccaattcctctccagtcaattcgttggtcaatttaaatggcacaatggcagaaagcgaagaggacaacggaaagccaaccaaaatgatgaaattaacaggagaagaagcagaggaaaatgcctaaaaagacaaaaaaataggcaaagacaaattaaattggataaatcaccgctttgatttgttccaatgttgacaaccattgctccagtgctgaattgccaattgtgacagagagcaccttccgaaaattgtcgggacgagccgagaacagccatttggtcaccgcttggccatccgacgcattggcactgtcatcaggtggaaattcgggcaaaatggtgccggtgccacggaaacaaagatttggacaatcgttgagcaatgacggggccaattggcgcattcgacgaaaagcgatggagggaaattgcatccaatgaatgatggtgtccttgagcattggccaaatgttgagcgcaaaaaactccgaaatgcgaacatttttagttataatccataaatctgtcacacatttgtcaaaaaaacggtgaaaacgacgaaggaaagtgagcacattttggtcgatgaatctgaaaatcagaagaaggtatgatgggcacaaat

SEQ ID NO: 11842 - DNA, 2723 bp, Heterodera glycines
ggaacccaaaaatgcaaaaaatttactcaatcaaaacacgttaatttcacttacaaaattgttactacctaaattttaggaattaacaaaacaactacacaaaaaaattttttttgttgatattattgttttttgaagatatttgtataatatttatccattatttgaaaaacaaataaataaacaatgtttttggcagaaagtaaattttgtttcaaataaaatattatataaatatataaagttcattatgaaattaaagaccaaaggaaataaatacaaacaaaaagttttaaattttatttgttatactttaaaaacataaagaacaaatagattcaacaaaacaacaaaaatgaattaattgttgaactctggttaacgcagaaagttaaataaaataacagcaatgaaaagccaaaatatttataaaaaaatagccaaaaattttcaaaaaaatacaaacttcggaacgtaaaaagcaacagaagaaaaaaggaccggaaaagacaagccttataatctgaaaaaaagttcatatacaaaataataaatatataggtaaaagacattgaagaagtaaaatattgatttaatgcataaattaattttttattcgatgctttatcctagatagtatttaaaaccccaaaatgtaaaacaaaaaatcgataaattaatcataaatattgtttaaaaattcggaataaggtaaagttgaatcaaaatccagctattaacgaaaaattggtaatttatattataaaatatctttataataaatataaatttgaaccaaaataataataatttgttaagcatacatttctgtttaaagaaaatcaatttccttaataaattaaaaaataatatttaaataagcaaagatttggatatatatttaaaaaataataattttaatcattttttgaattaaggcgggaggtgtttgttgacccaaagaatattctccaatttgacaaggttttactgaaaaatacaataatttaaaacacggtgataaacgtaaattaacaaccaggaataaaaagaataaagtattagaatatggtcttaaaattttttaaactaaacatacaagcttcagagtgaaaaaaagctatattaagaaaataggaatggaagagtatgtccgatggaagagaatctgctaaaactttggtacgaatacaaggaatgaaattagttttctttatttgttaaataaagttaaaaaatattttcagaagattcaatatggcttattgctaaattcatgtgaattttaaacctatacttagagatcggcctgtacctggatccaggcctgtatttttcctggatccaggtacaggtacaggccatttttcggcaacctgtatttttcctgtacttttgtacagaaaatacaggtacaggccatttttggaatacaggtacaggtacaggccttaagaacctgtacatatttcctgtattaatttttaatcactattttttggcgaaatgtctgaaaaattaggaaaaattcaaaaaaatatcattttattcagtgaaactgtcaaatttgaaaaattaataatgttttggcgaaatgtcataaatagttcaaggtggacttggtcgttttggcgccaacccattgtgctatacctttttttattttcaacaaaatctaacgatcttggtagcattcgaacgcccttcacatttcaatttggcgcatgctttaataaaattataatgttcttatgagcacaaattttttgatcaaaattccgatttgtaaaagctacattttcaggtagccccgaaaatccttataaaaaattggttaaaatcgcaaaaatgtgtcttttttgaaaaaatctgttaacaaactgcttttaaaattgcaaattttatcccggcggcgcctaccggcaccgccggacccccgtcccctccccaagtttcccaaaaaaatttttttgaaaaagcgcgccgttaaaaaagtaagaaaatcaaaaaagggtcatttagggatattaaaaattttgggaaaaaattcttggtagagggtaagataggcacaaaatgtaacctaattaagcttataatcatcttttagtattcgaaaaattaatttttagtattttttatagggtaaattttcaaaaaaatatttgtttttttttctcaagaaaaatttttcaaaaattctcaaaatatttaaaaaaatgaaatatgtacgaaaaaaagtttaaatacattattattaagcaatattattgtttaattaataataaatacttttaggtatttttacgttattttatacaggccaatcgggaaatacaggtacaggtacaggctttttacaaaataccgatctctagtccatataatttattaaccttagtcacgacaccaaaatacatgcgtgattttaggctttggcctattagtatcaatttgactattcatttcacccaaatattaacgcccaaattacgctaaataaggaaaatgaatgtgaagaaataaagaatgattaaatttaatagagaccattcttttattgacttcactcttcggaaacaaaacaaaaatgaattcttgttatttcagcgtctgcatttttttggcgccgaattttggcgaatttcgaactccgaacccgaattcgaacatccggaaattcaaatttttaacattcgaatattgattcgtgctcagcacat

SEQ ID NO: 11843 - DNA, 4565 bp, Heterodera glycines
ctattcctgtgactcgtcacaactcgcgttccattgctctgcccttccatcgtcaatgcccgccggcgcaacagcctattttcgggtccacctgatctcgtcacttggccatagccgaattttcaatgtgacagcggcatctttggacaagaaaaacacagcacataaggcaaatgccaacaaaaaaatatgattttttattttttaaataaaaattccaaaaaaaaaacaatttaagttaatttcgacattttatgggtggcaatagagcattttactaacaaatcaataatataattcatatttttttcagaaatgatgaattaaaaatattctatatttccttgaaatcaaaaatttttatgtttttggcatttttatataattttttaaattttctggcatcagcaggagttaattaaatatttatatattaattaatttaacaatacttttggagttttattggtaccaaatgactaaaacttaatataaattgagtatttttacttagtttttaaaaattctttgtgaaaggtttccaattttctattttttctctaagtaaaaaatttatgtgtttttcacttttttataattttttaaattttctgtcggtaaggtaaaactcttcaattcaattattaaaattgaatattatttcataaaattaatttaaaattataaatataatttttattccaatttagcttttaattgacaaagtacagcaaaatgagcgaatttcattgacaattttggcatcagtacaaagtcgcgcggacccaacagtttggctggacgggcccatctcaacacaggcgcattttgtgcttttggcagccggtttaatattttatttaaaaaaaactaattaaataatttctttttaaaatttattattaatgataattttaattttttaaattttatttataatatttaatttaatttttataatttttttttgaatttttttggatagtttcacgataaaattcaaattttaaaaaattaattaggattcattaattttatttatttaaatcaattattttatatttaaaatagtttcaatttaaataattttttttttttgaaatttaattgaatatttttgataataaattaaatcattaatttattttatttatttatttttaaggttggaaatgccgttttcgctcaagtgcatgtccacccgcaaattggttaagcaaaacaatcatttgtgacatttgccactacaaattcggcgaacacccaacagtttgctggcatcccatcaaggcgaaccagcaacgagggcgatgccaatggcgtaatgccccatatttttatttttgaattttatggcaaaaaaaatattgttaaatcatctcttaaataatatatatttggcgacccgattatatggttaaaaaaattatacatttaataaataatcaatagctataaaatttattttaaaataatggactaattatttttattttttaattgattctaaaaaaaattatgaaacaatataatttgaaataattaagttacaattaatgacacggttcatatgtataataaaattaaaaaagccaaaaatctaaatataaatttttcagcagtcaggatgaaatttttttttaatttctttcattttataaatttttagtaaaaaagtgaaaaattcatcttaattagattaaaattttataaaattacataattcgaagccttattaagaaagaaatgttatttatataaaaaaaattttttttaataaaattcgtataattgtaattttttgaaaaatatatcattttttgcatttttcaattaaaacacaaaaatgtttgctacgagtttagaaagaaaataaattaaatagataaaatttgtttttttaactttttatataattgcatttaaaaataaaattgttaaaaataagcattaaaccgaataattttaacttttttttttatttttcatttcagcactttatttttctgatttttggtgccgcaattacttttgccatctccgtacttttcacatgcattttgcgaaggtgtgtttattataaaataatatattatatattttttaatttataatttaatttcatttttagacgatgctttttgtttaaagcctttttacggcacaacaaaaaacatcatcaaaaacgtggtccatcagtgtccgaaaaatcgcatcaaaagcaccgtggagctgaaagcacttcgctggttcaacgcggcacgagaggtaaattaattaaagaaaaacaacgcggcactaaaaattaattaagtaaaaacaaaaaattaatcaaaaatattattttacagtaaaaaaataaattattttggcaaaattccgaaatagacaatttcttcattctttaatttttttttaacaatttcaaaaaaaaacacttaaaaccttttcgttcaataatatataatgagtgtatttttgcatttatttacatcaattgaaatcaaagcgattaaaaattcttacaaattttaaaattattattattttttttttgaaaaaccgattcaacctctaaattttcaaccaattgaacgataatgaacccaataccaaaatcccgaaaaaacccgaagctttcctttcgtcgaactcgagaccaccgagattatttgaaaataaagaccacaattttctcagatgcccagctgcagggggaaagtgttgtgttgccaccgatcactttgttgccaaatggtggcacagcggcggatggcatttgcacaatgccaacttcaaacggcacaaatgggatgcatttggccacaacatgtgcctgtccaactgtggatgatcaaaatgaagaaaatctgaatgaagcggcggatgatgaagccgaaaatgtgttaccaactgtgtcggtgctccactttgatgcctattttgaggaaatgtgtgccaatgccaacgcgggattcaagcggcaatttaaggtgccgccgctgggacctaaacatacgattaaattatttaatttattgatgtttaaaaatattttaaagaggtgctctaagaaaaattaatcctttaataattactcatttttgttctttttttaagaaattttagttttcatttcaccaaaacgattgataattaacatatttttaaatatttttttttatttgaaaaaattttctgcgtccgaagcaaaaaaaaaagttcatgacttaagtgattttcaatttattttaaagtgccgtagaccattaaaacattttaattaattctaataatatttaaatttaaaattaattaatttaattgattcaaaccaatgagattttttaaagaaattcattttctaattgttaattttttaaatttttttttaacgaaaatttagatttatttttatttcactgaaacagtctttgacctttttaataattaaactaatttttatatttgttttagcatatttaaaaaattatgatgcatctttagttaaaaaattaaataaatgttttttaatttattttttgcatgtaaaaaatatttttctctgcaaaatgccaaaaaattataatattttaattttaggagctcgagttagatactattgccatgttagaacgtgaaaaagcctcttcatctgatggtgaactttctgctggccgagcatcaaggtgttcagcaacaatggcaatgagcaacaatgagggagaaaaattgaaaaatcggtaatttaaaatattttattttaattataatatgtttatttttaataatttttaattaaaaattatttaaattatttttattgaaattgataagttaaaaaattctatttgataaaatcaattttaaagatttttattacaataaaagaaatttttcgtttaaactttaataatactttattgaaattgtatgttaaaataaatataattaatattttaaacaaatttaaaaaattttatttaaaaaaacactcgaaaaaatataatgcaaataaaaatttatatttttctatatatacaaaaattagtaattaaattaaattatttttttttacaaataatatttaatttaattacctttttaaaagtaaaaaataaatttttccatcataaaaattaatttcttaatccaccaaatgaagctatgtggatgtaaatgcattgcctcggaagagcagaattcaactggtggaccccagaacgggatgtcttcaacattacattaatgcaaattatgtagactcatgtgacgagaagcgggcatacagtaatccaaataattcctatcattactgtattactgtatttatttaataaataatatttttatattttcagtagcaactcaagcaccgttgccacacacatttgccgacttttgggcaatggtttggcaagagcggagcagtgttttggttgcattgaccaacattgtggagagtgggctcaaaaaatgcgatcagtaatatttaaaaataaataaattataatgaattttaaacattttttaaattttgtttcaaatttataaataattttaat

SEQ ID NO: 11844 - DNA, 2136 bp, Heterodera glycines
  misc_feature (19)..(19): n is a, c, g, or t
caatcaaaattaaatttanttttgctcataatatatagctttttttttaaagaatcggttttttaaatattaaaaatgattttatagccccggaattctgaggcaccgctggtgaaattttttttgaaaaactaggctcaatttgataacacattttctcaaaaattaccaaatcttgtgtaaacttaaaaaaattatgaagaatcatggggccggcggtgtagtaaattaatttactagtaattgatttgttcaatatagaaaaattatatttacttaaaaattacattatgtaaaagaaatttaattattgttgaggaaatgaaacagtgcgaaagtatttgaaaagccagaagctttgccactaggccatttgaaaaaaaagttgtaaatttacaggagaatataattttttttcagcgttgtctaaatctaactacacaaaaaaattaaaaagaataaatagccccaaaaatggatttcattttgttagaattttttgtttggattcaaaataaaactgttggttgtactgctataactctatgcatgaagacgaagcagtacaagaaaagtgagaagccaacacataatgccttttggtaaatgttggcttaaaaattctattctaacaaaattaacgaattctaggaaaattttaaaatttaattttatcacttgttaaaaaaatgtgaaaataaattatatattttgagaaagatttttatttttgtttttttttattcgaaaattaagtcaattaaaatactttgttaaattaaattttttgcttttttggagaaagccatgttttttccgggcacaattgaaacacaaatccatgcccgatcattccgtaaaaaaagctccaaaaaattttgtgtaattattagataaataaaattctcatatcgtctcgtctcgtatttttttcctttttgcaacatccctgatgtacaatttccttgccttgttaattggagaaaaattttaaaaataattttttattgcttttaagtgatggtcaacgtgttccggtcatgaaaaggacagcttcactcaacgaacaaaacaatgaaatttgccaaattttgcccaacaattatctggccgccattgataaacagcgcaacaaaaaagcaatgctcaatgaggataaaaatgcttttctaaaagctcacggggttcggatatgctccaagccaattgaagcggaagcgcgacgcctgtacccaccggcaatagcctgcttattagccgaagaagacaaggaccaaaagaatagagagcatttggagccaaatcaaaatggaggtcggcaaatcatttgaattagggatgatattattatgcactaaaaaccatcaaaatagtaaccaaaaatgggagcatatgtattaaaagtcccccaaaaatttgatttatttcaaaaaattgtttaattagttgttaagatggtagacttaaactaaaaaacacagttatttttaagaatttcctacaaatcctaaaaatatatgtttttaaatttttttttttagatttgaatttttgttttactgaatattacgaaagtttacaatacacaaagccatcaaattttcccgaaaaattaaaatgggtaattgtcatcattggagaatcccaacaaatgtgcaagtgagtttttataataatatcacaaataaagtctggtaaaaaaatttgtgagccccggactataacttttttctttgtcaaccaaatccaacattgttttatcattcattcgattgcactaacaaataagtgtcgaaaatatggtttgatgtatttttggccataagtttgttttatcttaacaaaattttttgaagtttttgcacgctaatagaggaaacttagggctattgaataataccaatattgtaggatttggtctacaatgaaaaaagttatagtccaaaacatggctggggcacaaccgttcaggccccaactgaggtaaaccggaagtaaacactggggtcgaaaaaagtcttgatttaatttacaagtttacctgtaaaactaattcaaaatacaacctagaaataattttatattggtccaataatttattcaaaaaaaaaacaaatattttactcatacatttgc

SEQ ID NO: 11845 - DNA, 2360 bp, Heterodera glycines
  misc_feature (1710)..(1710): n is a, c, g, or t
aatattttacacgtaaatttgcaaatttataacttttcacaatcaatcaagactttttccaccaccctgtatgtgcattttataattatcaaaatggacgcggttagttgggcggttccccgcgggattcccgctcatgtggaaattattttttattcttggatttgaatgaaaaatggctttttatatctttgagcttaaagaggtcaaatttgatctcaaatttagaatgattaaattctgatttttctcaggaatttttatgatctattgaaagattgtgcaaaacatcgtggtgttgtttttacaactccagtggttcaaaatatttctcataaagaagccaattcattgtaagttgatcttttaatagcttgggcaatgttgctagtttgctttttcaattaactttcagagagctcgttcgaaaaagttttgaagcgcacaagaaaaataacgtgcgctttttactattgttagcgcccggaaaggattcggccaattctattgatgtgcattactttttcaaattgatggaacagcagactggtgagagtttattgaattttaatgtgtttttcaattcaaaaaattaatttctcgatacgaaaattgaaaaaaaaatgtgtatagtggggaaataataacaataatacagaataatcaaccaggaaacacggggctttacttaaaaaaattatgaatagggatgggattcttagttttttaactattttttctgcggctttaactcgacgagaaatgcacgaaaaacacattctttttcgaaaatttttcatttttagtgccacaattcatcactaggaatcactattttggagctttgccactaaaaaaaactatttcggaagttggccactaaaataattttttgccactattttggcgtttcgtcattatttttgccactattttggcatttttgaaaaacttcccaaaattgcaataaaaatgaaaaataaacccctaagaatcgacctaaaaaattttcaaaaatacacccctaagaatcgacctaaaaattttcaaaaatacacccctaagaattggaaaaatttcgcaaagattcttcccccaaatttttttttcttgttcaatatttgctacgaaaatattttgtaactgcaattagtgaataaaatctttttccttaattttaaattattttcaaattaaaaatatatttaaaaaattacacccctaaatttggaactttttcgccactatttttaccactattttggcattttttggtcactatttagttaattattttgagattttttatcactaaaaatcccatccctaattatgaatattaatttttaattatttaaactctctttatctgtttaaattttgttatttcatgattttttatcacaagggattttgacgcagcacatttcgattaaaactgtgcgtacggtagtgcaaagaccaaaagaatttcgattcattcttgacaatataatgcttaaaatgaacctcaaacttggtggcattaattacggaatatgtgcttcgcaagcttttatgaatgccagacgaagcactgaagacattgtgtaagtgattatctatgggaaaaatttaagaaacctccatattggacgcttaaaaacatttttgatgataattcatttacagctaaatgataactcaaaataagcaagaaatccatttcgnatttttaataaacgcgaggcgtggactcttgagccttacaagaccaacacggaattctatttttaattttaaaatactttattaaatttttaaaaatccaaaatcttttagtttgtgaatcaaagcctttaaaattaaaaaaaaaaaaacaaaattcccttatttttttagggggccaaatccaatttaaaacccctttttttccgggttaaaaataaacaattttgattttttaaattttttgggaattttttttcctgccccccaaacttaaaaaaaaaaaatcctttaaaagaaaatttttcccaaaaaaagttttattttggggggttttttttcttcaaaattttaaaaagaaatattttttttctggggccgccccccccccccaaataaaaaaaaaaaaaagtttttttttatttttttttttaaatatttttttcccccccaaaaaaaatttttttttttttttttttttaaaaaattttttaaaaaattttttttttaaaagaaaaaaaaatttttttgtttgtctctcttttttaaaaaaaaaaaaagggggggggcgccccaacaacacaactttttaaaatatattttttttataaaaaaaaaaaaaaaaaaaaaaattttttttttttttttttttt

SEQ ID NO: 11846 - DNA, 1001 bp, Heterodera glycines
  misc_feature (971)..(971): n is a, c, g, or t
ttttaaatgcaaaaaaaagtcgtcgggattttaatttttaaaatgtgtatctcaatactgacatggttattttgtgagaacttttgaataagttgtcaatttacacgccctaaatttgaggcttgttagagccaattttcaatttttatagcctattttggggttttttagaacctaaaattggaattaccatagctataattttttcagagtaaataaatttttcttttaaaatttgatatttttggtaattatacataaatatttcaaaaattcattgatttttaaaaagacatgaccaaaataaaaggataactagagcacttgaatgatacgaaaaatattaatttgtatgaaactgaaacaataagaaacgccattaaagtttccttccttctcttgattgataagggaaaacaaaatttttattagtttcttttttaaaaaatcacaaattaagtttagcaaaaccagcacatctatataaacaattatttaagttcaaaacaatggttgagcagcaaacggatgtttttcgggatggatatttcgcaagctccaccgcaaactctgttcgaaaggcgcacagggaaagcacccgccattccgacaatttttggagtaggtttggactttgttcggcattgtcctgtgttgggcatgatttagaacaaagagttttatgaatgggaagcagaatttcagatttctgaaaaatatatttttttaattatcttgctttcaatttgaaagcacttgatagggattagaaaatttaaaaaataaagttaaattggcaagccattttgtagagaattttgtgctctttctgttcgtcatattcatcttctacggaaaattttttcaaacctactagaattttttttcgaatttactcagattttcgtattttttcaaacgtaaaaattttgtgtttaatgacttttttctggcatagaaggaaatagaanaatgcttataggatatctgtacgttatctt

SEQ ID NO: 11847 - DNA, 2895 bp, Heterodera glycines
  misc_feature (2723)..(2723): n is a, c, g, or t
  misc_feature (2804)..(2804): n is a, c, g, or t
  misc_feature (2854)..(2854): n is a, c, g, or t
tttaggatcttaataaacaaatgaaaaatttcagatttcatattttgaaatatgatcctaaaaaaccattgatctcagatatacccaaatgcttatgtatgcttcaaaacttttcgctttgtaatgcgaaataatctttaataaattaacaccaaattcacttttatagtacccaaatctttgaatcaatatatttttattcaaattcaatgtatttgatttcgctaaccttttattttaattttcaccttctgtttgctattcaaatgtataacaattaatcaaatattgtttaataacttcattaatttaacactaatattgctctacacggtttaatcattttaattaaaaggatgttagaaaagtatatggatatggggggggggcggcgtacaaaggatatgcgagaaaaagtggtagcaaaattatgtaaaaaatttattttgaaaaatttaagtgtttgtaatataaaaaaataaatgtgaacaatcaaatttaaatttgaaattcaaaaaaaatttatttatttatttatgcaaaaaagaaaaaagtccacaaaaggggtaatccacttactctgcggacgtgtcatagattaaattgtcctcgagtaatatggattaaacattaaacaaaaaaagaaatcacaacaaaattacatataagaatgaggtcaatgattaataaaaccaaatcactatatcactataaaaaccaaatcactatataaaatatataatatctttaattaaagagataattcacttttccggtcattttatacgttaaggagtttaattttagttttaaattgatttaaagaatttattttaatgatttctttatccagctgattccacaattttgtagccctccccgcaaagggaataaattttttgcctaatttatattttgtgttaaacctataaaaggggacattaaagcgtttagaaggtttgaaaatttttaatatatctagatctgttcggccataaacaattttatgcgccaagaacagatcaaatagctttcgccttttctcaagtgttggcagttgcaggtattctaatcgattttggtatggaattggcggaaggctgcatttaaaaaatactcttttggtgaaatatttttgacacttttcgatttttttaatatttttttgaagagacggattccaaacctccggagcgtattccaataaaggcctaatataagttttatataacgtaatccaaatcttagatgatttggatttaattattcggaacaaggaacgcatacgtaaatacgcattccttgttatatgattaacatgatcggaaaattgtaatttgttatcaatgtttactcctaaatccctaattgtatccacagcatttattgtattcccataaaatttataagtttcttttgggttttttgaacccaaataaagtacaaaagttttttgaattgaaacttttatttgccatttattttcccattcgaataaattatgcaatgctttatgcataatttccgtttctgttcttgctttataacaaatatagattttaacatcatcagcatataatttaatattcactcctgatggttaaattaatattacaattatatttttttactttagtgaaaataatcgttttggaaataggcaaaaaaatttttaaaactaaattaaaatatcattttaaaccaaacaatttaatcaatcaattcaaaaagccattaaaaaaaattaaacttgtgataacaaaatttcaacttaaaaataataattttacagttttaaatttcaagtattaatttatatattaaatccatggcttattagttaattacccttcggcttcttcccaaaaatgcattgacacaaaaattaagccgcggaacttaatgcgcggaccgctcgcacttctcactggcgtatgcgcaaatgcaaaatttttgcataaaaaaaaattggagtacaataattaagggtaatgaacagcatttgatcaacaattaataaatattaaaataaagccaaaaattatttatttattttttgttttttccatttgccttttgagattttcaagaatccaacaattatttctttgtaacttaaaaaaggattttctttctttagcttacaataaaaattcattggccatttttcgatcatttaactacgcatttccttctaaaacagaaaaataaaaatttaaattaaaataattttacattcgatacattttatgccaaatttgtttttccatctgcttagtgttgttttgtcaatgcccaactcttaaccgcaaattgtttctgttttccatattttggcattttttaaaattcgtttattcttttaataaattcgttctttttcttttcataataattcttatcattcattttgtttttcttaaattttaattcttttttccattcgtaaatttttgtttggccaattcccaaattttctgcaattttttgctcaattttactccaaatttttgtcgaatattttcttttttcttaattccatcttttattgcatggaatttataaacaatttcacttttttgctgatctttgaattgttcgttgttctgatcattgccaattggataaattaattcattttgatcactttcataataatttggggcctgatcagtttcattttccgttttttcactttcccatctttggccaaatagttcatncaaagatggccaaacttttacattttttgccaaatcaacagacaaagctttatccgttgaattgattatgaataaaaatancaatattaataataaaattgcattttcttaaaaatttgtgtttttatcanggctcccaaattttttttttcaaaataagacaaaatggctt

SEQ ID NO: 11848 - DNA, 983 bp, Heterodera glycines
ttttcgtgcgttcagggcctcccacagtccaggaaaaaaatatggatttccatataattggactccctaatcatcatcatcatcaaatgtaaaaaagttttacaaaaaaatatattaataaatcctaaaacgatttaaaaatctcaaaattgtgataagttaatattgattttgctaagcatgaatccgaactcaattttcattatctatgcatttttatctatgtttttcatcgtgtcatttatttctttagaatttaatttaggattcgaattatagcgaaataaacgttagtttaggaatattcgaacccaaaaagccataaaaatcttattattttgaaatttttaaattctctaaaatttttggttgcttttaaagaaattcatgacaaacgataaatttacggtagattttcattttgaaatttgaagacaattcacattaatttttaataaagaattaaattttaatttcgaaacccgtgaagaaacagacgactgaaagggctcgaatttcggatggcttgttgattggtcttaccgtggggcggggtatgtttggggcgggttttttggcgccgcttttttggcgctggttttttggcgcggccgttttggcgccctttataaaatagcttttttggcgccagtgtttaaaaatctttaaaatttttgaaaaatttttaatttgtctttctttgttcataactataagcaattttctttcaaagtgccattctaatgcagtggtgtgcaatagtgcataattttcggccctaattaacttttagattttggttcaaaatcaaactatccggggagttttcgagggtgctgctcataaatctgaccataggtttacctatttccgaatcccggaattaaattggaatatttgtactaggtcactcgaaaattcaaaatccgacccggtaatcgatagtacataacactgcaaaaacttatttttactttttctca

SEQ ID NO: 11849 - DNA, 4320 bp, Heterodera glycines
ccgcgctgcggcacacttcaaagggacccacaccctgttttttttagaatttttgggacgggggccatccggggggatggccccttaaaaattcaatttatctgaagtttatcaaatttaatttacgcggaattgggtaggcaaatcggtgcgggtgcagcttgatcagcgtgtttttgatgtgccgtcgaccaaccccgtgggcgccgagcagtacaagcgttttgcggcggaacgaggctaacctgaccacctagaaattaatcaatgcattttttaataatattaaaaattgcgaaatttatcggacaaaattaaatgaattgctggaataaataattttaattaaatttcgaatttgataaaaaatttaattaaatttacaaaaaaataaatttaaaaaaatttaacctcttcgtagctgatcatttccatgccgtcaaacagctcggaatgtttacgcaaatacttaaaaatgaagaaaaattatactaaataagaatttgttatttaaaatgattttagaatttttaaaattctaaaattaatttttaataatttaaaataataattaatttttccgcttttgccttcgtcgtgtaatatttgttgccactttttttcttgctaaacatgaagcaatgcgaattttcccgtgctcgctccatcgccaaacaagctgtccgccattcctgtataattaaaaaaaattgaacaaatccaaaaaataattttggtaaaataaataataaaaaaacattaaatgacgaaatataaattaatttatatacgaaattatatttttttaaacaaaaaaaatgtcataattaattttaagataaacgaattaaaaattcaatgctttcaaatttagattgtttttaataatttaattttactcgaattccacgtaagatttaattcaaaattttttttttaatatttaattatactcgaattttatttaaaatttaatttaaataaatatttttgataattattgttcaagttgcattttaatttaattaatataccttttttcatgatttttttcatttaaaatttattaaaaatatatttttgttaactaattatactcggttttcatcaaaatttttaaaatatatttttttaataattaaattattctcaaattcatttaaaatgtaattaatttttgaagtgtatttttttcatatttgttttttttgcctgtaattccggcgaaggaatcagtccggccatgttgacgttgccggtggccgtggcggcaccggcgccgacattgttgccaattagtgccgacgctgttggcattgttccaccctttttggcatgcctttggggcatgacggcacccgtatggttggccaatgccgcagccgaagtggaggccacctaatttaagggggggggatgtgaatcaatcaaactaattaaataatcaattaactaggtaattaattaattagataattaattaatgttaaaattaaatatatctgtaaacataaaacattttaaaaatatataaatatttttattttaattaaaaaatttgcattttaaattcaccgcatttgccactccgcacccggaagcactgcttgtacatcggccagcagaagaagagtgccattttgaggagccgccaagcgcagggaaatggcacacaaagcgggctaacaaataatttaaacataattttaaaaaatggataaaataccaaggaattgaaaaaaacaaaggaccatagccagtaaatttcaaatttgcgggttccgctgcgggattggaattcaaaaatttgcgggacgggatcccgcagggattaatcccgcatttccctaaatggagggattttggactgaaaatcccgcaaaatcctgcgcgggatctcgttccgctccgggctctaatttcaatgaaaagaattttaaaaaattaaatgccaaagaattggaaaaagcccgatttttggattcaattaaaaataaaaatttaaattaaaattaacaatttctcaccctgccaccagttgtggtcatccttggagatcacttgcagaatgtcgccagttcggaacggcacgcccgcacttgggcacgggatcaggtcatcctgggccgggtcgtagtcaaatctttgatcgtttttgaaattgtgaaaattttgctcaaaaatggcacaaaattcaacaaccttcaatgcaaatataataacataaattgtaaaaatgttttcaagcccaccatctcgcatcatttgcattaaaatttgaatttaaaaaaaaagaagaaattttagaaaaattttctaagaaattttagaaaaaacggggagcagttcgttttccgtcgtcgtttcctccccataaaaaattaaaattttcaaacagaaattttccaaaattgttaggaaatttcttaataagaaaatttcaagaaaaaacaatttttttttaaacttttagcgatttttaataaactactaagttttttcaaaaattttcaaaaaaattgcaaaaaaaattaaaataatggaaaactcagaattattatttttaaaaatgatcagaagctcaccaaattttgcagagatacgtaatggaacagtataaatgttatacaaatttttatagaatttttcacccgagcaaaaattgtttttttgtattgtgagaaaacgaatgtaacggccaacaattttaacgttaaaatagttggctaatttttttttaattttaaaatactaaatttaaaaaattgagtgtttgttttacgcactgggccttgcagaaaatttcgcaggccggcggcgcggagcggtaggaaggcacaattttgaaggtgaccgccccgcgcgcgtcacgcaacagccgctggagctgttcaacattccgattggccacctttaaccgtttatatttttaattttttgaaattaaagaaatttatttaaaaaatttttaaattaaattttttgatttcgctttaaatttttgtaaaattaaatgttgaagaaatgtcactctttttgacaatgagtttaattgttatttctttttctttttcatataaaatatggaaacaataattaattaaatattccctaacccccgaaatatttgaaataaaaattttcaaattaagaaattcttcaaaaaaatctattttttgaagaaaatttcattggtaaaatttttaaaattttttcagctttttgtaaaaatttttgaaaaaatgagcaaatctaataaatagcataaaactcgaaaaaaaatcgctagaaaaaatttttcaaatttttttttttttttgaaattttcttcaaaaaaatttttttaaattttttttaaaaatctcgaagggagggggggggaagacctgctcccgtaaataagaccatttttttaaataatattattaataattattattttttattataattattccatttttctttccccctaccgatactccgttgatctccaggatttcgtcgtccacgtgcagcgtgccctgccgatggatcagtccgccgtgcattattcggcccacataacatcggccatcctccgtgatctgttttgaaaaaaaactcagaaataaaaaactaataaatttttgaaaaaatcgctagaaaatttcaaaaatttttttattgaacttttcacataaatttttttttttttttttgaaaaattcctttaaaaatttgtgttaagtcaatccgagtgcccgaccaccttgagcgtgatgcccatcggctcttccgtgtccttgctgaactggacgagccggacacggctgaccgcgcacagcagcaagtcgtcatcatcgccgggcaatggcgcgctggtggtggccatgtgggaggatgagcagcactcatcctgctcctcctcatgctcagcaagtgttgcaattcgggtgggcctaaaaatttggggaaaatttgagaaattaaaaaaaaataaattcattttttgattattgaaagaaaaaaaattgtttaaaaaatgaaaagaaatattcttttttttaaaaattctagttttttaaatatatttcggcttttcaaaacttgtcaagaattttattgaaagaaataggaaataatatttttagattaaaaacaaaattaaaattatttaattaatataaaggaatgcaaactaaaaatatttattttttaatcataaaattctattcgataaaattcgtattaagtcccaataatcttaaatatttatacatatatactaatggagacaaaatttgttttaattaattaatttttttgttttttggacct

SEQ ID NO: 11850 - DNA, 2307 bp, Heterodera glycines
  misc_feature (86)..(86): n is a, c, g, or t
  misc_feature (98)..(98): n is a, c, g, or t
  misc_feature (1870)..(1870): n is a, c, g, or t
taactcgaatacggtttcgggattcgaatttggtcgaaatggatgtcagcttcgtgatcagcgagcccaaaaattccctagaaatnttttatatgatntaaaaaataaattctattttttatggtctgcaaaatacataagtaccgaaaaagcaatggacagcagaactgttccaaaaaaaaaccgtgctggcatattttaatataaaacccagcaaaaggggtgatttcaacaaaaagcttgccaaaattttactcaggagaattatgtttgaaactgtttgtattagcgctagaatcggtctacgtcagttgggccctcaccattgggcccccacgtttgggccccagcatatttttccactataacttttttctttgtaacccaaatccaataaacttggtatcattcgaaagcttaacatgcttagaagctttttctaagctattgcttcgcgattagacaattaccaaaaaagttatacatgaaaattgcaaaaaagttgaaatttttgaaatttttttcttaaaaactttttttaaagccaaaaatctttagtgtgtatatattttttgcatttttatgggcttttaccgttattttttgagatattcattttttgtgcctaaccgaattttatgcttataaataattcagggtccaactcgcccggaccgaaagtgatcaattggacaaagtctgtgcactgtatgtgaggcaatagaacacaaccgacgaactttggggtgcgacggcactctaagtcggaccttttcccaacaaaatcaaaggaaaataaaaatttaaataattaggggacactcggaaaagtgatcggcacttcagtgggcgaaagagtaccccctttctaagcgcaggccacctgagcattggccatctgtgctgtttccatacgtgtccaatgggttgggcaaatcgatcccttgaaaacgcgtggcaaatattttctgtactgaagcgcaaaaaaagtcagcgctggattgaaataggcacgtcgaacaaaactcgactcgggcagatcatcttccaattgtgcgtcggaaggggtggatttggccaactcattggccacgtatggccgtgacacggcgagaagcggctgcgcaactcaaatttatgccggtacgccgctaccgcagcacctgactagacggagaacaggtgaaactatggttacagtaatacaaaaagttactgtattttagcaaaatacgatccccaaacgctctgtgatggtttcacttggcttttgctctggctttttcatgctttgtgaagaggcgaatacgaattggtggtgcccatccatggaaaatggatggtgcgacacattttgccaaattaacaggcatatttttaaatttaatttttttccaatattttaggcgaaatttaaaatattaaaccaaaaattaaaaaatgaaaggtgagaatattttcgggttttagcttaaaaaatattcagtaattttcaccagaaatactttgttaataattgtacaaaatttcaaatttttgcgattttggtccaatttttttaagaaaaaattataggtttactttctgcgattcatttagaagtcaaaattaagcagtacaaaaactaattaaattaggaaattggaacgtcaaaaatctgtctgccgggggaatcaaactgctttcttaattttcagcccattaggaagggggcattaagggaagcggagggtccctaatggagggaaattttatttttcaattttttaaaaattaaatgggcaaaaatttttttccaaattttcgccaaaattatgtttgttcattttgggttttttgaaataggggggggggggactgattcgggggngggggggggggtgaactgctctaatatttttaataccagcaacaaatttgcctattttattttgcagttgttggcttttccggccttgcatttgactttttacaagcgctacgccgaccgtccgtttgctgtttgtgccgccattcaccgacgtcagccagtacttgcacgagttggaaattataataaatatttgaaaaaaagaatgaaagagtatctgacaataataataaagtgagagagagagagagagagaggcaagtagagtagagaagagaacagagtgtgacagacgaatgagagagtggaggagaggctagtagagcctgagagaaatagtgcttcatagacgttattgaagagagaatagaggaggagtgaaaaatagagcggaaaagagaaagaggaatttaattcgctattaattcagtttatag

SEQ ID NO: 11851 - DNA, 2842 bp, Heterodera glycines
ttttatttaaccatttttttttgaatttttaaacattcttttaatttaaagattggcattgcctgcactggtgtggctctatgcgctggtttacttggccgctgcggtgtccgacttttacaaacgccaacaaaaattggtgggacaccgattagagcttttttgtaaaagggctttttattttggcccgttttttcgcggagcgcttttttctaaatcggatttaaagccattaaattttatgacagtcttcagatcactgcactcctttgcttgtctgcgttttcatttggcttttgctctggctttttcatgctttgtgaagaggcgaatacgaattggtggtgcccatccatggaaagtggatggtgcgacacattttgccaaattaggtaataggcataatttttaattaaatttaactgttttttatctgctttcagcaattcggcgtctgcattgacggcggacgactttcaaaaaatatttggcaattaaacgattggtctcctcaatttcctgtcaaatggcgttagcgaacgacattttcgagccttaccgaaatgccaagtgcgtgttgaaatgtttaaatcgaaaagccaatatgcttgttggcattatttttttcataaaatttttaggaaaccggaaatggaattttgaatacaaaaactaatcaaaagtttttctatgcttttttcgtgtatctgctttttttaattttcggcgggaaacgaactgttttttttattttctgccgatcggagtgggctttagaggaggatctctgatggagggcgaattttatttttcaattctttttttaaaaatcggcaaaaaatatttccgtaaattttagccaaaattgtgtttgttagtgttgggtttttttgaaaaaattccgaacggaaacgatagggggggggggctgatgatcaatgatcgcttttcaaaaaactccgtttttccaaaaaaaaagtcagatttatacagtgcattaaatttgcgacctttttcaggtcattgaattcgtttgcttttgtgcggttccgaacggcattggcactttcgtttgagcttgtacgaattggtggtgtgtccatccatgggatgtgatggttgaaaggcaagttttttaattttggactgttttttaattgaaatgtttttattttatctgcttgcagcaatatcgacattctgctgacggcggttgactcaaaaaatatttggcacttaaacgattggtctcctccatttactgcaaatggcgttggcgaagacattttcgagccttaccaaattgccaagtgcgagttgaaattgtttgaattgaaaatcaatgtctgggccgccgaaacgccattcggaaattcactctgtaaatttcattgcttcccggcggtgtttcgtcggcaagcttttgccatctttttgttgccctcccacgcccgtgacatggtcaattcaatgtagccgtccgttctgtttgtgtcgaattacgtggaccattttctctaccagcagcagcaaattcactttgccaagtgggaattgaaattgagaaaaatcgaagcatatttatacgttaccaaacatttgaatttttacatgcagtttttaaaaaaataccgatttgcctcttcaactttacagtggttggctttcccggccttgtcgacgatttgtctgcctttcagcgctatgccgaccgtttgctgtttgtcccgttcaccgacttcggccagcagttgcacgacttggagaatgtaataaatatggcacagaatttagtgggcgaaaaattcaaatttctcatggttattttggtcatcaaaaagattttcacgtcgtaagtgttaacgacgttcgaaactttctcacccattcgctttttaccgttcctctctttccctcccatgctctcctctctctctctctcgcttttctttgtccacctctccactatctttctttctctctctccttgtttattccctctctcgcctatttctccttcctttccttttccctttccctctccttttctttattcaaaatttgaattaaattatgcatttattttcaaagtcaattcaaatgaatggctatttgttatgagacggaatgatgcaattcttctctttacaaaaggatgtggatttacgaatatcattcattaaaaaaatgtgtttacatcttcatcagtttacccaaaacgaaatttttacaatttttttttgcgattttaatttggtcttttattttttcctttttttctatttcctttcttctctgtgtttttccttttttgtataacatcgttcctcaccattcccctggaactgatcaaaggctcaatgatcgtttttccaatgcttattttaaaattttttcgaattttcatttttttaaattgttttttattttgtttttgatagacctaaatcaatactaaatcgacatcctaagttttgctgtaattttccaaatcgttttacttttttaccgttctccctctctctctacctgtatcctttttcttatttatagaaatgcccgattccgactcagactcacagctagataccgattcccaatcgcattttgaatatgcgacagaatgcggctgccataatgaacacatggtcgcaacagaattgatgtggagacaccacaacatgtttgacggatgggttcgttacattgcaacccacgacgcaattcgcctgcgttggttgtgccaaaattgcaacagcagattctacgagacttacaaattttctcgaagtgggaagaaaaagaaggtgggcttttatcaaaaaccgaatgaaaactccat

SEQ ID NO: 11852 - DNA, 1147 bp, Heterodera glycines
cagcattctaatcactgtggactcaattctcctgcatttctatcactgaggactcaacccaccagcatttcaatcacgtgggactcaacccaacagcattctaatcactgggactcaacccaccagcatttcaatcactgggactcaattctcctgcatttcaatcactgggactcaacccaccagcatttcaatcactgggactcaattctcctgaatttcaatcactgggactcaacccaccagcatttcaatcactgggactcaacccaccagcatttcaatcactgggactcaacccaccagcatttcaatcactgggactcaacccaacagcatttcaatcactggcactcaacccaccaacatttcaatcaatgggactcaaccgtacgggggccttcggccccactcaccaaatttttgcgccaaaggtactcactcggccgcttcgcggcctcgaacgggatattaaaatttaattaaatgatgtttaaatacaaattcttctaaaagttttttgggcgtcgaataaaaaaaactaaaattcactttttctcagaaatgtgatttcggggtagcgaccaaattttgttctgatttcttaaaattcttcaaaaattggtaattttgtggcgtaatgtcactccttaaaaatcctttgttttcttaaaaaatggctcaaaatcacaaaatttggacaatttttggacaaaatcttttaacaaaatacactcaaattttcaaaaattttcccggcggcgcctatcggcaccgtcgaccttccgccccgcttgtacacaaaaagtctttgaaaataattgattaaatggttacacaagcaattttaagctattttgcaaaagttctgattttttatcccaaaatctgattttttgggctcgatgttctgatttttaaaaattttcgatccacaccttgatataaaccgagaattacgtaaaaaatcactcaatttactaaatatgcaataacaacgacaaatctaagttgaccaaataattatgagcacaacaataattccataatccaaattgatcgatcatttctcaacaattcattcattcacttctgctgctgatcacttgggccggaagttgcgtcgagaagcctaaaaatcgaaaaa

SEQ ID NO: 11853 - DNA, 1291 bp, Heterodera glycines
aatatttatacaataaaacatggtataatatgggaagtgatgcgagagaaattcgcatatctctccgtttctttctgctactctcttttcttttacattgctatttactctcattttttcgcactccctcattctcccacacacacgcacgcgtccaacagactactgctgcacagcaacacgcgtctgttcactgtctgcccctcccatctgccgctgcccgcatagacagacagtcatacagtgcactttttcccaccatccctccctctaacctctacatcctaggaggagaaatcttttaccttctttttctgtgctatttcttttgccttcttcttcttcttaactatttattttcgtctcttttctttatattctcttctttttcaaaacaatttcttttcatctcttttcaaattcatttttaacgcaaaactcaaacaaaacgccacaccaattcaaacagtgacacatacagagaatcaactttattatataagattgtaaaaatttgaatgttttttgttaatcattctgatttttagatatggtatgtagagtaatgtttaaaattaaaacaggactttttgtcaaggatcctgtcgggttcacctggaattcggattctggtccgggttttaacattccgcgttcaacttatccttatcaataaaatgaccaggttttccgcccgaaattcatttgctgtcgaaatcaggcacagatagtaagaaaagatgaaataacttactgtcgaaatcactcattcgaaaccaatcactgtcgaaaagacatagcaccggcgggggtgggatcccaaggattttcaaccccatcccctgttttcctatacgcgaaaaatgggattgcagaagcagcaaaccaagttaaaaatatatttttcgttcgttccaggccattttaaattttggaaaaaatatgcatgtgaattaattattacacgccctattaataataatctaaatataatatttacaaatgttcccacaattagaaagacaaacaaatcattaacaaattatcgacatttgtttatgtgttttctgcgtttattatttttaggtccaaaaattcataatttgaatttaatttataatttaacaaataattataaaaagaatttttaatttttatggtgccaaactttattgtcgccactcatttatcaaataatccataaaatgcgcgttggcaatgtcatcaaattttcgtcccttcaagcgtagaaggtatttctgttcaaaatgtcaaatgctgaaaaattacg

SEQ ID NO: 11854 - DNA, 3410 bp, Heterodera glycines
atcagccaccgatttgccttttacgtcaacgaacacttcaaaacccgcaaattgacattggcatttattcgaatttgtagcaaaattggagaaaatggcacgaagcaaatggaaattgtcaatttacgtggaaaatcaatgtcaattccgcaaattcaattgccatgcaaagtcatcggattcgagtgcatcattatccagtaaaattggcgattattcacaagtttagacaacatttcacgtttttagtttcatcaaccaaaatgccatcgcttttctccaccgttttcggcaactttttgccgactgtcaaatttatctgcccctttgtacgtcggatgaccgcattttggagtttattctttacaacatttggccaattctcaacaaaaacattcatggcatggatttgtctgccagaattttccgccgtttacgacaaattcacaccgtcaattctcaacgactgtccatcgcttcgcgttatcatgccaattatgacggtttcttcgccgattttctgccgatgacagtgcaatggcgtcggatggacaagcgatggccaaatggcttttcactccacttcaaaacaatgtgccaaagatgttcaactgctcgttgcacttgaatgatgggattttgccgtcgaatattgaaccgttcaaagcggtgcttcatttcgtatttctttaatcaattttcccaaatttcaggcttttgccagtgcttcttcctccgtcaatttcattgtcgtcatttgttttcagttgtcttttgctgattccgttgtgccatttgatctgacaaatgaattgactcgggaacaattggcgttgaaaaggattaacaatagccatcgttttcttctaatccgttgtccaattgcgcgagacgaaagcaaatggacaaaatgggaaaaggaagcgattgtctggcgattttgtgatcaatgggatcgaattagcactaatacttattatgagaatgccatcggggatgggtcagtgaatgatttttaataaaaattcaatttttgcgtttatgtttagacttcttaacgcaactcccggcccaagtgatcagcagaaatgaatgaatgatttgctgagaaatggtcgatcaattttaattgctgtgtaggacatgatttgacgtttataaaattgttctttttgttacaatgatcactgatcacaaattatgttatacaatatatgtgcatattgcctttaggatatttagtgattttctgaaacagcgtttgttgttttcttaaaaactggctcaaaatcacaaataaattgttaaaatgttctgatttttgaccccaaaacctgattttttggcccgatgttctgattttgaaaaattttcgatccgcgccctgtctaatacacaccctaagtattattaaaagtcaaagaccatttatagaatagttttctaagaatttccaatggaaatgtattttttgactttaatttttaagtagttaatcatgtggtttttgggatggattgtttaaatgttaaaattttttcaataaaaatcaaaaatttgcgatgagcgacgaagtgaacaaactcaacagattatcgctgaactttaaaatttgattgcaacatattgctgataaaatttgatttaataattgcaactataattttttaattaaaatgtctttgtttttaagccgaattttttattttttgattaatgatgtcatttttttcaagagtttgtgatgcgatctctgttttattaacagtgctgctggcctattctggtattacttaaaagtttttgatagttgaatcgttttatatgatggtccgcaaaagcacacataaacaaacttctttccatggtaattcgtaataaattttttacaaaatgcttaaaaaaataaagctccaaaaaaagctttttattttctataataagcttaatcaatattctttttttttttttgcaaaatttgtataaattatttttcattgtatattatacaatatttctttaaacattatattgtcttctattttattgtgcgtcatttagtcatgccaccaatgcaaatgaattaatcccctgattttatcttttttataaaatgcaaatgtgtaggaaattattcatttaaaataaatttttatttaaaaatattattaataaaatttatttagcagaatggtcttttccacacttttggcattctgtttggtgtcctcatttgactccgcttctgccaaagcccaatccgttaacaattcggtgcgaaatgatgaaatcatagaaaaaggtccaaccagcagcaaaaatgggctgttgaacatgtgcatggacagcggactgatcagcaacggaaaggccggagatgaggcggagatggatggtttggttgagctgttgactgagctggacgagcatgacagcgtaatccaagcagcattggccaacccgacaaaggtggtttctgtgaccagaaaattcgtggtgatagcaataccgtaattagtgagtgataaataatgacatggtctaatagcatatgagcagggtgcagctttttagttgtatatttatgcagcttgttttgatgagaaacacacgaaaaaacatgtgtttatccgggaattcattttaacatcactattcggcacacggaataattatcactttttttgctattttccccattatttagttaactctcatgtttttgaatttgtaactaaaaatctgcacccaaacttacctattcgtcattggaaagataataaagatatgagtgagaattagagctcgacctgtacctggatccaggcctatatttttcctggatccaggtacaggacaggccatttttggaatacaggtacaggccagggatggcattccgaggccccaaagttttcggaaatcggaattccaggggtcaaaaattttttgaaaatcggaattccgaggccccaaagttttcggaaatcggaattccaggggtcaaaaattttttgaaaatcggaattccgaggccctaaattttttcggaaatcggaattccaagcccaaaaatgtcggaaatcggaagtctgaaatttttcaaaaaataaaaaattttctaaatattttaataagctaaattttttaattcataaccaagtaaaaggtgatttcaaaaatgtttttggtatatttgaatattttgcttgaaaaattattcaatgattttatcaaaatctattttatgtcattttacattattttagaacatttttgggaaaaatagtaactatttacacgtttttttgcggcgcatttttttcaaaaaccttttggaaacatggaggagggtccggggtgccgataggcgtcgccgtgaaaattttagtgatttttaatgcgatttg

SEQ ID NO: 11855 - DNA, 1366 bp, Heterodera glycines
ggattaaaagaatttttatcatatatttattcagactttgcgcagcaacgcaaagcgtccaagagaagaaaagtcaacgaaaccaccaccaaaactgcggcagatcaaaggcttggagggtgcagcaaaacaaagaaatgttcgattcgacccgcgcttttccgcttcctgcgggcaatttgacgaattcagatttcaccaagattactcctttattaacgaacttcggaagacggacatccaggtcaggaatgtgcttttcgttttgttttcatcagatgaaatttggacggaaaagaaacaaaaatatttacacccataagaaaagtttatttatttttttgttacaggaactgaaaaaggcttttcgacgcgcaaaaagggaaggaaactccgccctttccgacagaattcggtgtaatttgcttcgtttggagaatcaacaaaaggttctttaatcacggttacctattttataatttttatttattctaggctgaaatggagagacaaaaaatggagaacattcgattagaattgaggagggggaacattgaacgaatgaaccgaggagagcgcccgatttacctcaacaacggtcaataataattacccattgattctgggcaatttaaaaaaaaatcccgtttagccgaattgatggcccgtgcaaattgcgagaataatgtcgtagcgccaaattcatagaaaaagaaaagagggagagagggtaatgtgaagacgattattgactcttccttctgatccaaacaaaataatattgttcgagttgaaaaaagtataaattttgggtataagaagttgcccccacaaagagaaacgaaaaacgcactctcctttaaatgtgcctcatccaaatcgtttgcttaaaaaaaatcggcaattgtgtagaattgtggtcccgaccaaaaataaacttaaaatttttattttattgtttcctggggtggaaaagtacgctgatcacgaatatgaactcggattttacaaaagccatcctttgtctatgatttttcatcaagtatcacaaaaaaaataatcatccatttcgaccaatttcgaatcccggacccgaattcgaacaaaagtggaaatttaattttcaccaaaatcagtttttattgtcctaaaatcaattccagcgaatgaaatggttatgaatcattattttctattccatacaatatatttgattagttttgtgcaataaatgtgaattttgatgagagttttcgacttttgttcgaattcaagtccggagtacgaaattggtcgaaattcttccaacaattaagaaaaaactcatccaagtttcattgccttttcaccgatcgaaattttcttt

SEQ ID NO: 11856 - DNA, 2726 bp, Heterodera glycines
taaggacatttttattttgtaagatttggaccctccaaataaggataaatcttataaataaggacagatccgaaccctgttttaaggcatttagagtcagcaaaaaaaaagtcatttgacttaaattcccagcccaactatcagatacgaaatagagtatttttgtttgttcgaattcgggtccggggttaggaattgggtaaatacgagttaagattcgtaatcagcatcattcgaaaaccccttaaaatagggtacgagccaaaatgaaaaataaaatatattttttaaaaaattagggaccacaattctttaccattgccgtagttttttaattttcatatacctaaactacataaaaagcagagccaaaaaattctaactcagattcaaagttcgaaattgacctaaaagtatgttacagagaccaaaaaccattttggttttttttttgagtccaagtagaaaaaggtgtacaaatcgtagaaaaggtttcttattttactagtattacagattcagctctccaaattaaaactataaatcttagagcattgtttactttaaaatgtccgacgaaatcaaagaactgaaggccattacgctgcaaattctgaagaatcagacgttgatgatcgctcatttagtcaatcaggcacgccaaaataaaccgcagcaacacgtccaaccgccgctgatgttgaagcaggtcaagacggagccgtgtgagcctccgtcgacggtgtcaaagcgaaaggcgccgtcggccgtggagcagccattgaaggaaatcagtttcatcaacaaaaacaacggcggatgcgctacggtcaataaacgtcgcaggatgagcgcaccgaacaccgctgggatggccaccaaacagaacaacaccaaagttagtcgactgacaaatggtcgcaatgtgtcacgttttacactgactaagtgaaaagattacaaaataacgatttgagttttaagttctgcaaaatttgcgatgccgtggtggacgagaatagtctcgtgagtcacatttggtgcgtctttgaattgtcaatgtttaaaatgttaattagttctattcagggagcacattctgaaaaagatgatgaaagagaaggcggacttgtccaatgcgtacagtttcgtttgcgacgtcaacggatgcgtcttccgtaccaacaagtaattcaaacgggcaaaaacaatgagggagaagaggaaagggtgcaaaaactattcaataggagatacacaatcaaaaaagaatcgagttggtatttgggttatcgaaatttttgttgatgcgactgtttgccttcgtcctatttccgccccaattcagaagggtgtgtgtattatgagaatccatttggtttatgttcgtaataatttgcttgacttaggttggaagcggccggtggccatgccatcaaacacccggaagtggagcgtaacaaggtacaataagcacttctcactggttgtgttcggtgtcttcatctgtcgttgtttttgccttctttacgtctcatttttcaggttgtgttggacaatcgtgaaaattcggagccgctctttctcgccactctcgcgcaatgctacgacagaatgagcgactcggagaaggacgaggtgagtccaatgctttgtgtctgtgacgacgaaaagggactttgttttcatctatccacaaataaaaaaaccctatattacaatatttaaaaattggacgaaaagttgttggaacagcaattttctctaaaaatgtttgaaggtgtttcgcaagcgctatgattgaagaagcacatccgaagtggaattcgatattgcgatgatttttgattttaacactgtctacttgtttttcctcatatttggctattttcccatttaattgtcatcaattgtgctccaatttctgtttgtgttaaattatatgtctgtacatttgaaactgaggaagtgcaacaaataattgagcgagtttaaaaaatgattaaaaaaagaatggttatttcgttgttagggtttcttttttgatgtcattggtccgaccgttgcattgggtcgtcgctggctgagcggtcgcttatcattccgccagagtcaatgccctccaaccaataggtcaaaagggtgccgactccctgtgggaagaatagaggcaattttctgttttccgccacaaattttccctccacggtaccgtattccctccgaggtttcctctgttctaccgtcccccccccccattttacttcaattctcactcctcccctcggaatgcaccgaaactctggaaactgttccgacagaagttggtagcttttcagtgccatctgaatgcggtcctgctgtcccgagttctccattttggcggccaaagtaacggtcgaaccgaacacacagtaacgaggggcggtgatgccgacgacacccaaaacgaaatgtttgttcggattgaaaaagaatggggttgattcctggcaagagaaacaattccgggtcccatttttgggccacgaatttggaagttaaaatcaaagaatttgtttgtttacccgtaaaaacactgcccgagttgaacccccagcggcagtgcaaatgttggcccggtctgtgcggaatttcgtagtcgaacaaaaactgacaaaaaacattcggtaattccatgccataattcgcccaaatgaattatgctttctacttaatgggccact

SEQ ID NO: 11857 - DNA, 3071 bp, Heterodera glycines
ctctcatcaacgccggtcatctcgccgtctttcttgccattgacgtgccacgtgtcccgttcgtccacaattgtagcacttcgtagcgcttcctcctcgtccgccgcgtgtgaatgtcgttccagtgaattgtttccaacttgtgctgcgccaattttcatcgcgtcgcggtgccggtccaatgtcctccgttgccaatcgcttgcgttcaaaaggtcggccgacagtcctgaaaatgggaagaggggtgttagacctgttttctgtaatagaaccactcggttcatcccaccaatttctccacgtttcgcccgttggttgtctcgttgtcgcgcttgtcgaagcagccgccgaagttccagtcgcccaatcgccaacaactctgtactcaccatccaaaagctgaccaaacctatctcttctgaactctccggagcgcaacaactgaatgtaactctgtccaactatttgtgtcaacgccgaagctctctctataaatctctgccaaacttcgccaacactcaagaccgagaaatcccctatcaaaaatagaccatgtcgtgcgcgactcagcgctaccgttgcacgctgactgtctgtcaaaaactcggaattctcagagagattgccctcacgataactagagctagttgtcactacaaccgtgatgtcagcctcctgcgcctgatattcgtccacacttaccactaaaatgttaagacctaagtcttcaaactcactcttaatacattctttctgtagcaaatacagacaagctgtccaacttcgctctaatatgcttgagtgcatttgccaaagtatttttctcaacagccaataaattctcaaaaatagttctcgcttgcgcacctaagtgcagtttaagtcggttcaatttgtccgattcagtccatgccgaaccaaaaacatccacatagtccctaaacttaatttcccagtcatcaaatgccgaagcgagttcaccacagaacactccaggctgtgtactggacgtattcatgtcagttagggcattcaggtcaccatctatatcatcttcttcccctgactcatttattgaaatgagtctcgactgattagtcatagagccatttgcaggatcgcctgtggtattatttgaattttgtacattagaggtactttgaagaatgccaaagctattaattgcattatgagttgggggtggggtcggcggaaagataggccttggcgaagtcaactgcttgcctaagcttaagattttctgagccccactgctgcgattcaattcatcgaattccatattttctctcaactcaagttcatttttccatgtgtcaaatttacgttccaatcccgtaactacttccccaagtgtgtcaaccctggccgctgttgtgccaaaacccgtattcacatcggcttcgatgtcactaacccggcccactacttgagtcactttcctatttagagccctcaggtttcgattgaccccttcttctaaaccaataacatcatcatggacccgagaaaggtcactgatttttgcctgcgcacttatatgtttgccttccataagccttttatcacagaccgcaaggtctgtgtactccatgcttttgtactgccgaagcaaacctaatttttgattcggatctccccttttttaattcactttttgttattcttcgttttatgtttgtttttgtttaatttaattaatagaggaaaaggaattcactttgtccgccaacagaagtcaaatgtccttccaatcaatcagctttgtccgttcacttggaatccgctgaagcgttttgtcaccactgatgtcgctcttcacctgtaattctccaaaatgattgattgaaatccaaaacaaaacaatgctcttaaacgccttcagttgtaccaagagggtataactggtccggaatttacacaccaaatcaattaaataccaattattttttaaattttaagggccataaaagcgcattagtgtataacgaacgaataattaaaagcgtaacgaagtttatttggttaatcaaatgaaagcatgttgtttgttaagcaaaacaaaaatgtttggccttcgtaatacaatttccactcatactcacagttttcacacaatgcgaaatgtgtcgcactttgggcagccgaagcgttgaatacagttgatggtccgcaccacactcaaatctcaatttcactcaggtgtcgccgattctctgaaattgggaaattgccaaattattaatgattgccctattttatttatgtatgcgtaagtaccaacatttcccatttgtcttacacaataactgataattggaatttttccccctttttaaaactaaaactcattcgttatgaatttttgatcattaattgattttttttaagaacgggccatagaagcatagatagcgcaaaaaaatgtcactaagtttgataaccaaagatgaaagcaacaccaacattattaaaagtagtgaaaaattctggcttcgatttgttatgtcaaaaaaatcactcatcccaatttcaaggaccataagaccaattcattcgcatttctcatcctaattttctcctaccgtactccaaaagtcgttctgatcaccgacgcactgcctttgttgatcaacaaaattcgttgattgtgctgatcactgctgtgccgattgctgtcccgtcactgatcaccggcgtccaatgtctcacgcagtcgaacaccaaatccgtagaaatcgccgaagcgggagaagacaccttcgatgtgcctaacaatttaaaaatcatattaatgtgtctttcaattaaccaaatttgctgaaaatgtgatcaatttataatatcagattttagaatgcccacagcatactgtaaatgtctaacatgaacgactaagaaggaaattccaagactgtgcttaaattgccaagttaaacaaggaaaaactcaaaatttttgctcccctcagttcaaaaaagcaactttttttttttcttttgaaagggtttacaccgtcattttaagtgtccaattccccagcattaaat

SEQ ID NO: 11858 - DNA, 944 bp, Heterodera glycines
ggggtttttgcattttgctgactgtataaaatgtaactcgcccggtgggactagaacccacgacacaagcagtctgtgccgtgctctaaccgactgagctatgggcgctcctttcggggttttcccatgttctttatcccactttctcccacactccgcttcctttggcatcacaggacttttttatattgtatatgtatttgcaataatatgctgtcaaattaaataataatctttttttgaaagttttaatttagaaatatctcatctttaaaatgaagtcattgctttacttattcttcccaataatttgttcagtagaataaaatttaataaaataataaaatgttaattattttctattaagtagatttttcttaaagaaatcaatgggacctgctcttcaggaggaagagcaaaattatagggacttcaagccggaaagtaaggccttcatgcattgggtcgaccaagccagagggcttgtagacacaattgaaggggccttgggcctctcagagtaatcactttaacgtttatcgatgtaagcagataattggagaaggaataaatgagtaatgaaagaacaacgatgaatataataaggtgaacacaaaaactgatgggggttaaaataaaattaaataaggaggacaagaacgatttcgtcagtgattttcgtcagcggataatttcgtcagtgaacattttcgtcagtgtactatttttatttattttgctgttttccatttttttcgtcagtgttccaattcgtcagtgaacattttcgtcagtgactatttcaggctcaattttttatatatattactttctttgtatatttttaatagctgagaatttattttattcaaaaatgggcttaagcaccataatatataaaaaaagattatttttcaccacaaaaaacttaaatatttaaatgc

SEQ ID NO: 11859 - DNA, 4063 bp, Heterodera glycines
  misc_feature (9)..(9): n is a, c, g, or t
ctcctacantctttttcccatatttatttcacaaaaaactaataactcgatttgttttgagtgttttatcaacgaaaaatgaacaaggaaactgcaatccacaatactaacgaataagttagaccaatgaacaaatggtatatcgtgatcaaattccaaattcgaattccaaaattaaattatatcttcggtaggcgcatcaagatcctaaagtgggacaatgaccgaaaaaaagagacaatagttaccctatacgacggcggcgctcgcgggtcccgcatcccaccaccacctccaccattgacaccccggaccgttgtttcattcattggttccatgcgtcgccatcctccagtgttcatcggagggcgagaaacgccagctgtacaattaaaatatattaattaatgggtctgatcaaaattacactagtatacaattgaacattaacatacagtagcgagaaggcccaccaactcggtcggctccgtaatttcctccaccccatgaagaagtaccgcgttgaaatgctggtgaaaaataaacataaagaatcactaatattacaactcacgaatcctctcattcgttgattccatgtgaggagaaacatgttgtgagtctgtgccgctttcgatcagttggcgcgactcggcacgcgtttttggctgttcaaaaagctgcggactgtggggacgatttgggtcagtaatgaaattgttgtaataaagagcctgcaaaaagaaagaagaaaagttaaacgaacgcaatggtatggctcacctcatttcgcactttgtccacctcctcattgtacttggaatggatgtgtttgtgcacaaagtcgggccctttaaatttcttcccggagagaggacaaagccatttctcgggacccaattgttgcgtattcgcattaacgaacagctcaaccgctctgtgaaagaagcttagttttccacaacttatttgccagtctttcacttgtctgcgtcctttttgtcaagtttctgcaagtcccgttcactcagtggagtgcaccgcttaaaaagtccgttctcaagacgagcgttgaagccttcaatatgtccatccaccgcactttttgacaattgaggagcccttttggtactttcatttgccggtggaatgcgacgaacgtggaacaaaccgagactgagaacaagaactcaaagttactggtggccaatagaaacaaatggacagtccgttttgtagttgcttaccgactcggcattcggtcctcttgcgggtaatggacggcaccgtaaaagtccacagaatggacaatccgcaaataaaacaggagacggtcgagaatctaaaagcaaacaaaatgtccaattttgagtagaacaccaaagcaaaatgcaccttaagaagcgaccggtcttcctcaaattgcaaagaaatctccgacgacacaattggcccatcgacggaagcagccctttccaagaggacttccttaaatagaatcacgttttggattgttttttaaatgtcattcacttcttcaacactcgcttcctccaccatataatcggcaatccctgccaaaatggggttgcggcttttcagcacagcttcgtccaagcctggcaatttgttctgtgatttaatctctgcccagaacttaccatcgactccgttaaattcgcccatgtcgaagctccgtccgccttcgtcttcaccatcctccgcctcttcccggtaaagtccctcccgcacatccaacaaaaagacaagccgagcagcttggcgaagcgtattggacgcaattggacggtgagagtcaatgggagaagtgaacgctgagagagtggcgacggatgggacaaagtcaccgctgacgcgaattcgacgctttaggtcacggttgacttgggtgcccaaatcggaagtcatcaactcaaagttgagaaataataaatcaaattaacacgcgaatattttgccataaaaacgcattgactctagtttaacattaaaatttgctatctttactcaaattgtttcctattttagaagagtgccaataaaaacatcgacgatctgaaggagggcgcagttgtcacgcagaaattggtgaaggcgaagagtgcgtacgaggaaatggtaacgaaggcggaggcattgctgaccaaggcaaacaaatgacggatgaagacgcgtccattgagatggaagccatgtgatgaatgtgcttattagtcacatttaaatgttttctttcctcatgaataataaatatacgctaaaatgagatttttctctttgcactgactcattttttaaacggtgtgttaatttttatgtcagcaaagttaacgaataaattacaaaattcaaagtgacaaaaagttaaataaaagtaaatatacggttaaataaaatcggctgatctttttttcgcgtcttcaagccattcgtttgcgtctttctatttcatcgcaaatgtcagacacaactaaaaattcaaagtgaaaagataaaaaactacaaaaattacatttgcaatcggtcgatagttcgtcagtattgacatccttgaacattggatacagaatttttattttttctgtgaattctacgttgtcgaaaattctgatgggaatggaaaaatgggcacatatttctgaattttcaaaatatgttcaataactaaatggttaaataatataccgtttttcgcccaatcgataaccatttcgggagcatcttttgataatgtaccaagtcgttgacaaatgccgcggaatgacatttgcttaaataattgttaatttacaaaaatttttttacagcttttcgccttactgcctcccggcgaattatctcatttcgaatccaccaaaattgtctgtgccatagaaaaccatcaaaagcataggaaacccttatgatggcccaaagaatgtcaaacggaagaaaagaaacaagctcgaaaagcaactcgggtggaattttacgctttttaggattcatttttgaactaaaaagagcgaatagagaaatgagatggactttctcattataaatgaaatttgattacaaccaaggggagaaataaagaaaggtcatgggaacagtgcataaaatggttaattcctataacaatctctttgttggtctgttaactactaataaaagaatcacctcaaagcgtttactatccggaccaccgccgagtaccattggttggatttgtggatgagagggaaccgtaggcgccatcatccgttgcggtggagtagcagatgggaacatttgccgcggtgccatacgaagagacatcggagcaggacgaggcgtattaaaacgcatcattgtgtccggcggcgccatccgtggaggcattggagaagtagttaattcctataacaatctctttgttggtctgttaactactaataaaagaatcacctcaaagaattcaccggctttacgtttactacccgcaccaccgccgcgtccgccgccttttcgacccgtaccaccgccgcgtccgccgcctgctgacgagcaaccaacccttggaaaaattgacaatgaaacaagcttggaatttgtaaaagccgatcccatctccctcctcacacctgttatcttccaacaattccttgttgctgaattgtgacatggtgccaccagttgttgctggtaccattggttggatttgtggatgagagggaaccgtaggcgccatcatccgttgcggtggagtagcagatgggaacatttgccacggttccagacgaagagacatcggagcaggacgaggcgtattaaaacgcatcattgtgtccggcggcgccatccgtggaggcattggagaagtatgaggctgatgaattgcaggccgagggggcggaggaggcggcggcgtgtgcaaaaagttgacagtacccgacggagagggtggaagaagacatggcggtgagaagtttcggttgccttgtggaggaagtggaggcgaatgaaaaggccgaggagctggaggaggtggcggtgggggaatgggcgaagtaccctaaaaaca

SEQ ID NO: 11860 - DNA, 3322 bp, Heterodera glycines
taaattatgctcaatgctttatgtgctcatcattctatatcaaaacaaagcaaaaaaaaattttgaccaaaaaaagtgaaaaaaataaatccgcactcagaaaagaaaaattaaattttttgttttcatagagatttttttctgctaaaaagatattattgtaattcattcaaaagaagttcttcaaaatttccaagaaaggtttttaatgaatctaatttttcgaaaaaaattcaattaaattttgtaattaattcatttttttaaattccgggaggggggacgaactgctctcgttgggagagacataagccagaaaagtggaaagttacctgcacgccttgcggatgtaccgttcggcctgaaattacagggcaacaaatgtaaatggcattagtacggaggaatccaccgccgcagctgacacacctcgtccacgcggttgttgacgatcagccaccgcggactctccggcagcacacagatcagacagatgctcaccgtgtgcagcgcggcagtgatcaactgaaaaaagcggaaaataatggaatgaaaaacgcaatgggtcaagaaaatttttttggttttaggactttttataattatttaattagtgtgattagttttaatttttttaaatccccccccccatctcgcattgttttgggggcacttcattttccccccgaaaaatttaaaaaaaaaaattttcaaacctagaaatttttcataaaaaaattcttaggaattttcttagtacgaaaatttcaagaaaaaaatttttttagaaattttataatgaactaccaagttttttcaaaaattttctaaaaaatcgctgaaaaatttcttaaaaattttttttccttgaaattttcgtactaagaaaattcctaagacgacctgttccgcattgtttttccttaatttttttttattaaaaaactgaaaatttttggttttctaacttttttaggagttttttcaaaaaaaaaacattgggattgtcacaaaaaaatttttagcagaaaaacatcgccatgagcatcccttctccctcaaacactgttgtttttacctgaatgttctgccacgagttgcaaaagtaggcgatcagtgccaacgttgcgtagccgaccgcccacggcgcctgcagcaaactgccgaccattgcacgatagcgagtccctgggagaatcatggggatgggttggaaaaaatgaaacaaatgaaaaatagtaataaaatggaaataattaatacttaattacccgtgatttccatgcacagcacatacgcggccaggtcagcagctgaaaaggggacagtagcgatggtttgtttaattattgtaatcacacttattttttatggaaattggtaaatccgagggaccaaaaggccgcaagaaaagtccaaaaaaaaatttctaaaatttttagttcctagccttttcattaattttgctttagacaattccaagaaaagttgaaaaaatcctttttgatacattttgaaaaaatgcattttattaaaaaatttgaattcttcagaaaaccgcaaaaatttgttttttggactttttaaatatttttttccggcaaaatttctgtggctaaattttgtctaactccgaacattcttttaaaatgcgtcggatttcgaatgattcaaattttagaaaaacaaattacaatacaatgctaaaaatatttttggaaattcggtgaatttgtatttttcaggaaatttccatcctaactgaaaggactgaccctcgttgcacaccgcgccgcagaagcggatgaacaggaacatggggaagtaggtggagtagggcagcagcagaccgaacatggaggacagaatgccgaagccgatcaccgtcggcttgcgcccgaaacggtcggaggcgaagccgcccagcagacagccgaacaggaagccgaacgagtagaacaggtgggcatgggcacgcttgaagttgtcgtcgcacaccaaattccactccgtcacgatggtggaccgcatcacgtcctggtcgtagaacctgggaggaggggacagcagtttaaaattacacaatatttggatgaaaatttcgaaaatttccacggcggacgcgactgtcggcaccaggggtgttcgaaaatcacaaaaaaaaaatttgaaaaccgaaaacgaaacaaaaaaattttgacggacgaaaacgaaacatgaaaacgaaaaaataccattttcgtacgaaacgaaacgaaaaaaccgaaaaatttttgaacttatttcaatcataattaagaaacattaaactttaaaattgtatcctttaactgagggcatgtaggtcctagtaagtggaaaagcggatgtggctctaggacaggggtgtgaccgaaaaattttcaaaataacaatttttgggaagaaattatcaaatcgtacatttcagtgaaatcgggctgaaaaccccagaatttaacaattttttacggtttatttttttaagaaaagttggggaatgggaggtgggtccggcagcgccgggaaaatttttgaaatttgagtgcaatttcatagcagattaataattaaaatcggtaaaaaatgataaaaaaaaataggtaaaataaagttgcgggcatgcggactcgaacaataatgcacagcacaacataaacctgctgttttcacaactaaactacaatacttcaataaaaagagcttattattttcttatcaaaaagtcattcttaagggtgtaaatattttcgtctttttcgtaaaattttgctctaacgaaaacgaaacgaaaaacaaaatttttaaaaccgaaaacgaaacgaaaaacaaaatttttaaaaccgaaaacgaaacgaaaaacaaaatttttaaaaccgaaaacgacacgaaacatttcgtccagccctggtcggcaccggcaaaccatttctttccttctcactctctctgtctctctcctccgcactccagcgatggctccctctctctccctgtttctataccgctcactctttatattaaaaaagacgatcacattcgctctctctctttctcctctgtttctatgcttctcactccccctctctctctctctctccaaatatgtttctccccctttctgcattccctctgtttctgtgcttcttacgctctttttttataaagagaaaaaaataataatttttgcgttcttattcatattttcgctgcctctctctctcgttcgctctctgtttctctctctctcttagtttctctatgcgcctctctctctctcaccattcagtgcattttcgaatgt

SEQ ID NO: 11861 - DNA, 1187 bp, Heterodera glycines
ttgcgtcgcagacagttgcgccgcggatatttgcgcctctccatttgcgcggcgacatttacgccgcccagcaaaaatggacttttgcgccgcgctttcaaaaatattattatcattaaaattcaactattatcaataagtttactaaaaatataagccaacgaaatattaattgaaaattgcaaaaaattactagtcacaaagattgacattcaattttatttaaccattaaaatcttaacattgaataggttcatccaagatataaaaaatgaagaagaatactaactaacaaaaaaccgaaaatatgaattttctttaaaaaaacccaattatttttttgcttaaaaaagaatgaatttaattcttttgtaattaatttgctcaataagttgtttacatcgatttaaatttaatttcaatcaaattttcgcccctattttaccattttcgccttatttcacaatttttatgtcctcctaaagtccgccgcttaatgatcaggcaatacaaaggcttgttatcgcatatggtcccaatgaaaattatataaatttttttaatactaatttttgtcaatttaatttaagtttttgaaaagaattttttgtttctagactagaaatttttgtcaaacaatttttaaatgtatttaaatttaacaattcttccattatgtaaattttgcaaacgttttttgctttcggtttttttataatttctttaatattaagaaaataatttttttttatatcacagtaatttcatctcttattattacgttcattccagcgattttttgagagtaaattggtagcagttcatgtaccgttaccaaattatgatattgttttatttttcattggtaaattaattaaaattattgtttatattttaagaaattttatttatgcattagttcaaattagggttgcacccccaaccgtcggggttggaaaagtcggggttcggggttgtcggggtcagcaaggtcggggtcggggtcggggttgacaaaatcgttcggggtcgggtcggggttcggggttttttccaatttttcgtattttaaaaaaaatatatataaaagcaaaaaaatccatgataattttagtcttaatcatcattaacatgattttcatgatcagagagggagattttgatcattcttttgcttttcatgacat

SEQ ID NO: 11862 - DNA, 1765 bp, Heterodera glycines
  misc_feature (61)..(61): n is a, c, g, or t
  misc_feature (105)..(105): n is a, c, g, or t
  misc_feature (113)..(113): n is a, c, g, or t
  misc_feature (120)..(120): n is a, c, g, or t
gaattattttaaatttgaaaataatgttattgtttttttcatagaatgtgcaagtttgatntaagttgccgggtttttttttttgtaaattacgaattgagtttntaaattantttgtanaataatttattaaattaattctgattaataaacaacaatttttcatgatttttgcgtttttatataatattaaatgagacgatccattaactaaagtataatcttttaataagataaaaaatcaaatatttataacaatttttaaatttgtttttggttttatcaggtttttcatactgctaatttattattatgtaattttttatttcatatcgtgccatcccactcgtgccaagaaaaaaaatttgtttagtaaatgtaaattaaattatttttttataaactcacgttgcgacgtccgatgatctgataaaatttagtcaaattttaaaatttttaacacattttattttatatttatatattatatgactctttacctataaacttgacaataatggttttttgttgttacttcaggatgcggagcaaaagattattctttttttaaatattaaaataatttgcttcgaataatttagagaaattgcgtaaataaatgcaataatttgttcatttttggtatatgttggctttgctctatcttttaatttattttttaattagtagtttataaggtaagaattttttatatacagtttttgttgaaaattcaaattgctaatttcattatgtttatttaggatatttgtggaaaacttaatacactattttatgctttttaaaaatgtattatgttgtcgtttagacgctttttcgccggatttctcacgttctcgtaactaattcacggttctctgctgccaagatttataatgcttattatgcaattttgtttgaatatatttgaagaaagaatttttgtaactttttaaaaaaataatttttgtttcttactttttgtgttaaaaaaataatttatttattattggattatttaattcatttattattaaaaaaaaaatttttgaatgattttttaagtagggcggataattatactattatatattaaaacagatatttgtatttaaatttaattttgtattatttatatgattaaaagaattattcggcgaagcactggaaaaagaatatggatgaaatgttgaaagtggatttatggagtaaaattgctgggtttatagtcgttttttttgtgcaggaaatggataaattggacaattcttgtgggtgggaaacaaatcagctgatcagataattatgggattaaaagaattatttttataaataattttaaaaagattcaaataaatactaaaattgtttttaatttttatcaaattttatacatttaaattgtcaccatgattaatatttatgtcgcgactacgcgaattcgaaaaattaatttaaaaaataaaaaacattaccaaaaacaaaatatttaaatatattttaaattagacagataaatattaattaattaaatgtgaaagaaaagaaggaataaatgaaggaaaaaatattaatcatattagtcacaatttttctatccgaaaaattgtcaaatgttaaattttaattatgaataatcggaatgttaaaacaaatatcaaactttaaagaaatgttaaaatgagacaaaatgtaaatgatattaaagaattgtaaaatgttaggggatcgagaaatgctaaagtggcacaaaactgaaaaatga

SEQ ID NO: 11863 - DNA, 1144 bp, Heterodera glycines
  misc_feature (1084)..(1084): n is a, c, g, or t
tgaagaacaagtaaacaaaaaatagtagtttaatttaaatatgtaaaatgttttgttttttttattctacttgttaacaaaatgtttaaatgagaattccctttttttgtaatttcttatatatttttatttaattcgcatagtaatcaaaaaaattatatgagtaaaatgagtaaataaacttgttgttaatcttttcttatttaaaaaaaatgttcagattttttcatcatatttgtattatataaaataatttgtactgtacatttaattaaattatataatgaaacttttgtgtaatttttatattatgcgtgctctcgccataaaaatcattgttacggttggactttatatcgtccaatttatatcataattgcaactactagtaaaattctcgttattactttaagaagtttatttttaattaaggcatttttaatttaattatatcattaatccgaataatttgcgctaatattaattgattttaattcagttaatagatgtatttttaagatcattattttttaaatttcattttttatgctccgcctgcccgttcgtgccgccgactgttgtgccgatccgtgcaccgcccgttcaatgccatgcccattccgtgccgcatcgcccgctcaatgcacccatgccgtgagaatattttcatattaattgtataaaaaattcgactaaaaaagtaatattaaataaattactatattttaattaaataataaaaaaactttataaacaagcaacgattacccaaaaaataataatcttaagccgaaataaatatgtttataaaggattatttgcacagccaaatgaagaaatttgtgtttattttctgtttgttcattatttcaactttaattactgatcaatatagttaaacttatactattgcaaaaatgcctgtgtaccagggatgggccaaattgaaaaataaaaagcgaaatgcgaaaagcgaaatttgcgaaactgaaaatgcgaaatgaaaaaaaagcgaaatgcgaaaagctaaaatatgcgaaaatgcgaaaggcgaaatgcgaaagcgaaattttttctacaactntttaatagttaaaatcataaagcaaaaatcattttttaaattttatattagccaatttat

SEQ ID NO: 11864 - DNA, 968 bp, Heterodera glycines
  misc_feature (8)..(9): n is a, c, g, or t
tgcatgcnnctgcaggtgcccggaccaacaaaagttggcaattaggaagaaaagtcttaacatccgacaaatttttagcattatcaaaaaggctgctcaactgtcacgggcgctgcttagcattttcgaagatgggaccaaagcggaccaaatcgaaaaggtattggcacattacgcgcgagtgctgcgagtgtccgcccatttccaaaactgactctgaatgcttaatctcttttttaattttgccaatttctcccattccgtgccaattcccccccccccccctaaaggcctattcgaatgtcgccgatgcggagatttttgacgcaaagattgaattggataaagtgaaaggcgaaatggagcagtacttaaaggcgaggacagcaattgcatgggtaaaaagagagggaaaagcaaagaaaaaaaaactaacgctggacagaatgccaaactgagtttggagcaacggcatttgatcagcgcgtcgaaagaggcgctcgaaaacggcactttttcgctggcatcgctaaacgacccgaactcgccgaactttgtgcggtatttaaacgcgaaacgaatgaacattcaccagaacagccatttcggaacggacattgaagtaaaaaaacaaaacgaagatttgagggacaaacaccggcggatttaggcaaatgccaccgtcgaagttcgacttcggcccaaccccaacttcaacgggttggtcaccagctcggacgcctccacagtgcatgtgccaactcccatttacaacagaggtgccaattccattcattccgagggaatgtttttgcgatggattgcccttttctctcccattttctccgctaattacagtcatggtcatatgtttaacaacactcaagattttctaccaaatttgatttaaattgattataaaatctcaatatgactatattgcgtaaacatgttttatatttcttgta

SEQ ID NO: 11865 - DNA, 3342 bp, Heterodera glycines
  misc_feature (3327)..(3327): n is a, c, g, or t
aggagtgatctgatcacttggtgttgctaccttttttgatcagcatccaaagttatgcttacctgaatttttttagatttttttaatgctgtgaaaaaaaatatgggtagtgttgttaaacatatgaccaccccaaaaagggagtgcagttggtaaaatggtttgtaactaataaggatagtgaatggtatcattataaagcccacaaaaaatgctacaagaaatataaaacatatatacacaatatagtcatattgagattttataatcaatttaaatcaaatttggtagaaaattttgagtgttgttaaacatatgaccatgactgtatgtcattttaatttacttcttcttctgtttacttcccgcagatgcccaattgttggagcaaattcattggtcggacattgaccagcagtaccggcggaaccgtgagcagctcaaagacctcaattttcagaagttctgctccgagtcgggctttttgcgctattttccgtccgccccgtggctttgggaggtgtttaaagcgtcaaaatgtgccgattattccaatttttgcccaaggaccgttcctcggagttggacctgttcgactgtcggaacacggaatggtacgtcaacgcggccaccgcgtcgcgtaatttggtcattttgctggacacttccggctcaatgctcggccaacgcttcgaaatcgcacggcagacaatcgaagcgattctcggcactctttcggacaatgacttcttcaacattatcaatgcacgtgctccgccccaatcattaattgctgcccataatccgcttctcctccttaagttttctaagcaggccatccttttggaggagtgcgacggcaaaaaattggtgcaggcgacgctaaggaacaaaaagttgcttctctcgcggctgtcaaatgtcagctcagagggaaaagcggactacgaaatggcactgcacaaggcattcatggcactgatgaacgtgagagccgaagagattattaaagccaaactgagagcttagataaatgattgaatgttgcttaagctaagctaacggtacccctcagcaaatattaatttgttgctaattgcaatttctaatttacttaacttttgccttggactgcttatgcacataacttccttaaatacccttaattaactaattaattgctttttaatgcctttctcattgccctcctaccgctcaattgtctttttgctttccaccgcttttcgcttgctcagttgccggatgaaagtgtgcgtcttcgaagcaaagaggaagcggcgcgtgaagcggcgcgaagggaagcggcggattcgcctgagtcggagagagccgcggaaggaatgcgccattttgtgttggaggacaacgttttaacagtgccggaacgctttatggaggcggttggtccctttgctgctttgctttgctttacctccgatcactttttccgctgctattcttctgatctttttccgctttgcttttcctctaatcactttttccgctttgcttttcctctgatcactttccactttgcttttcctctgatcacgttttccgctttgcttttcctctgatcacttttcccgctttgcttttcctctgatcacgttttccgctttgcttttcctctgatcacttttcccgctttgcttttcctctgatcacgttttccgctttgcttttcctctgatcacttttcccgctttgcttttcctctgatcacttttcccgctttgcttttcctctgatcacttttcccgctttgcttttcctctgatcacttttcccgctttgcttttcctctgatcacttttcccgctttgcttttcctctgatcacttttcccgctttgcttttcctctgatcacttttctcttccctttctcttttccataatcatttttcaattaaatatcaatctcttttttcctgttcaagattagcaaatatgcgggaagtgaccagcagatgggatgccaggatatgatcatgctgataactgatggagcacccggctttttccgcgaaacattcgaattgttcaatccggaaaagcgggtaaaaagggcgaagccaacaaaagtccaaaaaatgccatttcaaaattcaggtccgtttcttttcgtttgtcgttggagaagaggcaaaggattttgagcaggtgcttatcccttatattcggccaaatttgaatttgaaaaaggtccgatggatggcatgtgcaaaccgcggatttatggcacatatcagttcaatggccgacgttcaggaggtgagacaggcgaaaatatatgggaaaagagagagagagagagagagagagaaggtaattaattacatttgatcaaggcaattaaaaatgaaaaaacaaaggaatgggcaacaaaaatacaaacttttcggggatgaaacattcaaatgcattcaaacgtttatccacttaccccatagaaagtgcagcaatacgttcgcattttgtcccgcaccgtttcgcgacaaaaggccgctttcaccgaggacagtccgttttggagtggggcaacccgcgaaagaatggtcagtcggtgaagaagggagacataaagcggggggaaagggagggaaaagcgtgtccttagtagcaatggattggtaactttacgttaacaatttcgccaaatctctccaacagagcgacgacttcatcgtttctgtttcctttcccgtcgtccttcccgacggccaatttatgggcgtttcctccgtcactgtgccactctttgaactgtcccaattggcccatccgtcgcgcgtcggtgcgcggagtcattttgtgctgttggacggcagcggatacgctctgattcacccccaactgaggccgatggtaagcgaaggaaggaagaagcaattatggcattttgagaatatttggctaaggaagagacgggggagctgaaggccggctttaacagcatctcatggcacgaggcggaagcgcaacggacgcattcgccggtaaggcaaattcggacgaaaatgccataaaacggagcagatgctttgccattcagcaccaccaaaagcgatccttcagctgctcaacaggcgaaatagaaccaaaaaagcaacacactctcttcgcggtggacaaaatggtaattgaggaggaaaagcataggaaaagcatgaaaggagaaatgcgggaaggaaggaatggcatttgacaaaaggacgacacttttctttcgtgatgcgacatttgcgccgcccagcaaaatcgacatttgcgccgcttttaaaaaattttaatttcaactagantatttaatcaaatta

SEQ ID NO: 11866 - DNA, 5811 bp, Heterodera glycines
cattatttccacaactttggatggcgtttaatttcaataaattattcatttgttttatgcgattaaagattttacaaatttaatatataattctttaattttttacttatattcaaataaaatttaaatcccgaatcccgtaataaaaattaggaattattttctctcatgtgaggctttttttcattttattctaaaattatttaattttaattaagcattcacaaatgattgaaataattattctttatgtattattttattcaatcatcatgcggctttgccaccgaataactgcaaagaaaactactttcatccaaatcttcgtcaagactcttggtggaatgacgctgactatttttgcccattccttggacaccatcgagaatgtgaaggcgaagatccaagacaaggaaggcatcccaccggatcaacatcgtctcattttttgcggtgggtttttagtgaaaatagttaaaaaacggcatttgtaattgttaaaaagaattactaaatcgaaaattttgaaactacaaattttatttgtttttattgtaataataaggaatgtaagtaagaattactaaaacatgaaaattagcgaaaactaatgcacttttcaggaaaaacgctcaaggatggtcaaactattgccgactacaacatccagaaggagtccactctttacctgcgcttgagtctgataggaggagcgcggacgaggcggcagcaagcacaagaggtggcttatgggcactgtcttttgttcgcctgacggcgggcgctttgctcgcctgatggcgggcgctttgctcgcctgacggcgggcgctttgctcgcctgacggcgggcgctttgctcgcctgatggcgggcgctttgctcgccagacggcgggcgctttgctcgcctgatggcgggcgctttgctcgcctgatggcgggcgctttgctcgccagacggcgggcgcttgctcgcccgacggcgggcgctttgctcgcctgacggcgggcgctttgctcgcctgacggcgggcgcttgctcgcccgacggcgggcgctttgctcgcctgacggcgggcgctttgctcgcctgacggcgggcgcttgctcgcccgacggcgggcgctttgctcgcctgacggcgggcgctttgctcgcctgacggcgggcgctttgctcgcctgacggcgggcgctttgctcgcctgacgtcgggcgctttgctcgccggatggcgggctctttgctcgcctgacggcgggctctttgctcgcctgatggcgggcgctttgctcgcctgatggcgggctctttgctcgccgaaagaccagagcggcctaataataataataattaaaaacccagcaatgctcgcatcgccacagggagcaatgtgaacgcgattttgaggacgaagggaaggaattctacgagatagcatcccttcgactgtacgacatctgtaactgcctgcgttgtgaaaaaatctgccatttctggaagataagatttttcggcgacggatctgagtatttactggaaacagatgtactcgagcatgtaattttattaatcttattttgaaaaaattgacataccattaaggctggcgagtccattcttttgatcatggaaacaatcaataatcgcgccagaattgagggccacatagacgtccatttggcgcgtaaaatgtaaatatggctattttaaaatcttttttaattttaattttaaattttaaaaattttctaccagtttcgaattttttcaacagtttttcttaacgctgtattttctacaacattttatttataaaagtacaaaaaatttttgtatttacgaatattaacgttaaaaagaagattgttccgaccaaaaacgagttattgtggatattctcacaaaaatgaaaactgttaaaatattcaaataaatataagccctagtcataatgataaatacgatcaattttagtattgttcaaaataataacggctccctaaaaattcacggttttgacgaatcgacaaatgacagcgtcaacattgcggatattttccctgttgtgcctatcgcaaaacacacaaggatggatcttccgtcttcaagcggtaccgtggagttgttcgaccgagggttggcattctctgtacaggaacgatacggtctacaaacggctgcgacattgcgacaaaaggacaaccagtttctcacaacatcacatgccttcgcccccactgaaatttctgctgatgctctttttaaatctgtcgttgctacggcaactgtgcaaccacaacaaaaatcaccaccatcatcatcattatcatcggcatccccacaacaacaacaacaacaacaatcatcatttttggcatcggcaccaccaccgccacaacatcgtcctcaccaatttattgattgtgaaggaaggctcacaacacacctaataatagatgagggcgaagagttagaagaacagcaacaccaaaaccaacaatattcacctatatctgacaatccatttgagggtgtctcgcaatcgggcaccgagatccaaatcgcaggcttaatgacttctattttaaaggtgtttttttaaaatcaataaaaaactaagtttttaccaaaaaatgataacccacgggaaattgtaatttttgtaattttgcgtttttcggaaaagaatggaatttctttctggttatgaaatttttgaaaattttgtttgagattttggtttccgggtctattaaaaacctcaattaaatgattgtcaaaaataatacaattagttaaaattaatcataaaatttaacattctgacgtttcccacaaaagtttcaaaaatacgcaaaatcctcaatgaacttatcaaaaaacacaaaatgatgataaaaatcctattgtttagcgtatcccctctacttccggctcatcaacctcatcaaagtctggacatgaaattcggaagcatgtccgagagttgtacgcagaattgggcgagaaaaatgagcagcaacgcgagagagccaaaaacgccattgagacaaaaaatgaaggagggcggaagcgatcaactgccgagacagacaaaataaaaaaaaaagtcatccaacatcttaaatataaacattctcatgagtgttcgttatgcaattctattcacgctgcttatcaaaaataaaattaataaaaatgtcaattttttaaaaaatcgcaaataaatcataaaatccataaaaaatacaaaaaatcagaaactgcaaaaactcagaaaatgcaaacaagtcgtaaattatgagaaaaaaagaaagattaaaaaatcaaaattcccaagggtaacaaattaaatgttttttaacaatttaaattttattcatttttttatttcaaatagaaaataaaataatcgatcaaacgaacgggagggaggtgaagggggggggggggggtatctcatcattttccccatagacccccgtccaaatattctctttcttggcgcagtagttcgtcccagttccaagtgtatgtgtccggctcctgtcgtttgttgctgccgcctgcacctttcgattgctccaatctctcctcacagattttcttcatctcatcggtcctcttcttccatgttttggggtcttttttttctgcttcctccctctcccacagaagtcttcgttccttccattggtgccgaaactccttcaacgttgggattttttttgtttttgccgctgcggcatttggcccatttcatcaaaatccggtaccgcccacattggcaaaacatcatcagacccttgattttgttgcattgacatttcttaatgggaaaaaaatgttaaatcaaaaataaatagcataaactaatgtttgaaggcaaaattatatatcgctaatgaaaatttagagtttcttaaatagtcgctttttgcattgtaatgctgacgcaaccctaatttagttcaaattcagcaaacgaaattagtaaatgaccttcaaacttgcaaaactttttggtcttttgtgcagtaaggctcaaatattacactaaaaatcatgcgattctattagtaaggaaaatgtttcgtttttttttgcaaaaaaagttgcgattttattagatatgccgaaataacgaataaaaaatttctctatttctttctgtaagaaatggactaaaaaatatttctttttcaggtctaaacaaatgacttactgcagttactctaatttcattgtacaacattttgatattaaatttataattccctatctttttttgataactttttatctccgaaaaattggcatcggatatattctctgcttcttgacatttaaatatatctgtttctttgatgccaatttctagtttctgcatagataaggcctggtttctatattcacccataataagaccgggtaatttttgaattttttcgagcatttctaagaatgaaaaatataaattttcgattccaggcgcactaaatgctgttatgtagaaatttttcacccgtttaaaaatcatatttgcaaaaatttcgagattatttgatcgtttaagtatttttccagaaattttccaatttctcgtaattttgttttttataaaattaatttcttggtctattgtcgacatttgggattatagttacttctagcgttatgacatcatccaaaggatagaaaaacgaatataattcttcttttaataggacatgttggaacaaagcctcagctgtgttttcgctagggcatttaagagggcaataaaatgattcaaaaccaaaagaaagcttcaaaatgcttctgaatttttcctgttcctctttataaatttcatcgattaacgatgtgagtattagtttaaatttttgctcaacattaacaaaaaatggattaacaaaataaaacttggttttgtgttttttaaagccaaattttaagtccttatggaaatatgtctcaattatggcacaattttccattttggtatatcattatttttttgttcttatatacccatatgctcccaaacaattgtttggagcctattttcataatttaacatttggctctgcaccctccgggactcgaaatgtaatcttcgggcttccgttaatgaattttgcgattgttcctcgagctttgttgcctggtcaaaagttttgcatctctcgaaatcacgccacgtagattcggctttttctgactccaaattgattttgtccaggattgtgaagatttcccaaattgaatcggacattttaagatataattctcgaatatcattagcgtaaggagccttttctctagattttattgcacgattaagtgtttcgcgagaagatttggcaaaatcgcttacttcatccgttagcgcagctacatcccgccatgctctttctgtctctttttttgcagcttccaataatatggaattagctttttctgatttttcagaattcatttttatttaattggtatttttttcttgatcctatttatagtttacaaacaataaattcatctctaaattcagtttggagtctcggatttttcttagcatcatcaactatttcttgttgcacccaaaaagcattttgcccccgcagaaaaattatgatattttatgtcctcttcgatttcaatcaatatagtgtcaggatgatgattgtgtcggcgcatcattgtaaagaacccttccttttcaaagccccagccctggcacccatgtgaattaagttcacataggaggcaaagtttgaacttggtcattttatgtttgtaatagcg

SEQ ID NO: 11867 - DNA, 3155 bp, Heterodera glycines
taatgacagtgccgattgacaacagcattctgcacaaatatcttcgtctgttcatttatctggaaataacttacattttttcaataatcaattagtgcaaatcaaatttaaatattcttttacttcggaaattttgttgctttttggcgagaaaaaaactcaaagactgccgaaactcggatggttgggtagccaaaattaaacggaaggcaaaggataaattccgagagaaatttttctggtgttaaaaatgcgctgatcaccaatctgaactattttgaaaaacattgatttggtctatgatttttgatcaagtacttgattttttcaaaattttatatgagttttttacgcccaactaattttaagtttaaaaaaatcaagtacttgatgaaaaatcataaacaaaatcagtgatttcttgtattcatgaatttggacgcctagtacaagagccgaaatttcacttgaaaaatacaaatgccacacgatgaaccttcatcatcttaacattgtagttgattaaaaatgcctaccatcttcgccattccgattcacacgtgatatgataattttaaatagtaatttcagggcacgctaaactgttttcaagaaaaattaataaatttcaaaatgtacacatacgtgacaatttcaatcatctcattaaaaaataggaatgtaaaacgatagcatttatcgcaatttttaaaatttggtgcaaacattctgactgtcaattaaacataaactccatcgggaaagcgtttgcgttctcaggacggcgtgccaactgcgtcattggttcacttcaaaattaattaaattaatacaacatcaattaacatttttaaaaaatgccataaaacttacggacgcccgaagacgctctgtcgtggcgatgtacagaaaccggatcagtaaccaatggaagtcaccaatgcaacggcgatgaaacaaaaagcaaagctcttcacttgagaagcaccgcttttagcactttcgtcgacttaatcattaactgaaaatatagtattaaaattagataaattatccagtcgaagtgggagtttgtaaaaaggcaattcttaaattggctgttcttatatgtgagctctgtacaacggaatttctcacaacaaaaaattcgaattaaaaattttagtcttttcaaaaaaattattcttgtaaaagtttcaattgaaaagttaaaaaaaatcgtatgcaactccgttgaacgatccgtatattgtacgaactgtcattgaccaatcataattatcggttacaaaatgtgtaacatttaattttgaaaacacaaacgctcacaatcagaggcatacaaaacggcgaaaactgcggaaaatgggaatttgccggacatgcgcagtgccgcgtaatggccagaaattgggccagatacatgcccattcatgtgatgatgttgttgtagagaatgacgaagtcaccgaaccatcgacggttaaattcgcatccgccgatgtcgctggcgtaaggcgaacaactgaaactgttacagaaattatcgcttttggcagctctttgagtgagaatcttccaacaggtccattcttaaaatgcaggcccataacatgaaaaaattttttggaatggcacccgaagaacatttgtttgctgttcgggacaaaaataattttttctgttgttttttgaaaaatttcagcgctgggcgaacaaatgagaatttgtagtggttttcgccaaaaaaatgacacatttttgcctttttggggtaaaattttcaaaaatactggtctaattgggccgagtaaaatttttggaaatttttaccctctctttatgggtcggggtcacttcggcgcggccacttcggcgcgaggttttttcggcgcgagctttttcggcgcggccacttcggcgccctatataaaatggctttttcggcgccaatgtttaaaaatcccaaaatttcaaaaaaattttaatttgcctttcattgtgcatataacttatgccattttctttcaaagtaacgtgctaatgcagtggtaagcattggtgcataattgtggtcccaaattaacttttatattttggtttaaaatcaccaattggtgggttttcgagggtgttgatcacaatctgaccataggcttgcctaattcagaaccccggactcaaatttcgaatatttatattgaatttgacttacaaattccaaactgaccagtattcgatggtacacaacactgcaaaacaatttttttttaactttttctcaaaattagtgtttttgtagttcacagcaggaaattttttgcttttgatatggttttctaaagattttgaaaaattttttgaaaatttttttcggcgccgaaaaagccattttatatagggcgccgaaatggccgcgccgaagtggccgcgccgaaaaagcccgcgccgaaaaaacctcgcgccgaaatacccgcgccgaagtggccgccgcgccgaagtgggcggttccctgtttgagtgtatgcaaatgcaaaaatgactacctattctggggactcgtccattaaaaatagactaaatgcaccgcgcgcgctaaaattgccgcgttaaccccgccctgccgcctcccttactcatgttaaatgaccaaaaaacacgcgcacttgaaatgtccacgacacaccctactaatgcttcgtttggccggataagaaaaggcaacctgtgctacgcactgtatgaaatacctaatgcgcaatttggatacaaaaaagagatagctatttttgggcacgttacgatttttctgtctgtgtccaacaccctactaatgcttcgtttggccggataagaaaaggcaacctgtgctacgcactgtatgaaatacctaatgcgcaatttggatacaaaaaagagatagctatttttgggcacgttacgatttttctgtcggtgtccaacaccctactaatgcttcgtttggccggataagagaaggcaacctgtgctacgcactgtatgaaatacctaatgcgcaatttggatacaaaaaagagatagccatttttgggcacgttacgatttttctgtctgtgtccaacaccctactaatattggttggccggataagaaaaggcaacctgtgctacgca

SEQ ID NO: 11868 - DNA, 1709 bp, Heterodera glycines
actagagtagagcgggaccgggaccaaaacacggacaactgagtacaactgagtacaactgagtaccgaggtcccggttttgaccgggaccagtcccgggttttttcccggttttcccagccaaaaattcccggtttttcaacccgaaaaggtcccggtcccgggtttgcccaaaattcccggtcccgctctactctaattcgcacttttgtcactttgacccagcaccaatccccctaaaagaataatgacagtgtaaatgtgaatcactttcgtttcttcttttactttttttttctctcgacttttgttgccgctgttttcccctttacgggagattatcaagtcgaattgaaagttaaacttggaataaataagatgaagggaaggaatttttttttgactgaaaacataacgccaaaagaattctatggaacattgatgaatacttgtacctctccaaataccgtaccagatgttttcgacagtgattggttttaacagtggttgatttcgacagtacttttaattgattttctacataatttatctaatgaattaatattaatatactttttgcatatacaaaattataattgaagtactgatttttgtcaaaagatttattgcattcacttttcgtatacaaatatctcctgctggactctacagtcaaaaaatataacgatacttttaatagaacaactttttttaaacaaactttactgtcgaaatcaatcaattcgaaaccaaaattaccagaatccttgatcagtttttgtattttttattttaatattgatatcatttgtcataataacgcattttttggaaagttgaaattttttttttgaattattgggggcccaaacgtgccggcctaaacgtgacggcccaactgagatgtactgcctgtccccctccccccgcccgctatttcagtttcagcccccctgactatgctctgctgctctctcattctctcatcctcttctctctctctctcttccccactctttttttattccctcccgaattttacgtgatctcaatccgcaatcgcgcagattgtaattttatgccgtcttttttctgttcattttccttgtttcagtgttttgccattttctaaatttatttcattcgttcgttcgtgttcattcatccccccccccagctgattcgtacttttgcttcatttaggaagttttttaaaaacagaaaaaaatatatttaaaaaaaacatttatttttctatcatttttgtgtactattttcaatctttaaccaataaaataacaaaattcgcaaatgattattaatgttggtttaaaagctacacaatcttttggctttattcggtagctttaagtgttctcaattttatttgttcattttgatgatccaatcatttatcaaatgatttgtgttgattgtgcaacaaaaacagctgagaaataaatgcgaatgtgtgattgattgggtacggtattccaaaattacagtatgcggcattctaaagctgcctctcccactcgccatggtacagtaattattttaaaatgcttctgatacagtaattcagacgggaattgggcgcagtttgacgcgggtgccgttgggatgcagttgaaagagttgaaattcaactgaaaaaatggaaatttaattttaaaaaattttaaacatttataggaaaatggcaaaaa

SEQ ID NO: 11869 - DNA, 3722 bp, Heterodera glycines
aacaattattaattttgatattaaaattattaataaaattatgattaaatgattttaaaggaatatgaagggaacaattattaaatttgttattgttacgccccaaagtccgaataggaataaaataaatatttatttaaaaagaagggacagggcgaacggggtcaaatatcgattgggagcaaagggaacaaataaatggagaagaagcaaaagaatgatggggaagggtcaacatcgcgggtatttatgggcggaaaagtgggcgtgacataacgaagggagaagggaaatacaaatgaaacaaagggtcaaaatgggcaccggacaattgggtcccaaccctaacatctccccccttgaaaagtgccgggcctccgtccatcatccgcatcctcagatcggcgttcttatgccttgtgtccacagtcggaagcttctcgaagatcatctttcgtttgatctcgtcggccatcgctgccgtgcttcccgatagatccaccggatgaggctctcttcagaccaaacccgtcaagaagaaaattcaaattttcatcttcatccggcttgtacggttgtacaccttttgccgggaattctccagtcgtgccgtccaaaaattgaacgtcgtaagtgccttcttttcggctgatcacacgtccggcacgccatggctcatcacccaagctggcgatcacattcgctcccacagcgaagaaattcttctttttgccacgtccgtcttttctgaagaatttcttctttttcttttggctcgctccgttctctttggaagcctcagttcggaatttgtccttcagaccatttctgatggagtccgacaatccaagtctgtccatcatgtccaatccgagcaaattcttggatccgtctttggaaacaaagaaatgtccatagcatgagcggtctccgaacgaaaaagttgtctttcctttgccaacgaatggacgagttgtgccatcgtggtactgagcacgttcttgacaacggctcaatttcaaagctccgatttggcgcacagtgtcctcacaaagaacagttccctcagtgcctaaatcagcaatgaaatccactttggtgccattcacatcaatcggtacatcgattattccattcttcctctggttctcagatttaaccaggaaaactcttccaacgcggacgttgttcgccgctttttcattctttcctccattcttcttcaaccatgcctggtgcttggcacacatcctttccaagtggccactcttcttgcactttcggcaaacggttttttcatgtcgacaattcctcgacgaatggctcaaaccgcatcgccaacatacgcgttgcgatcgattgctgctccgtgttcctgtcgaaatgctgctcgcattcgacgaaagatcagttcgttcgtttcttttttgccttcaatttggtcgccatcaagtttcgtgagcccatcggttgttgttcgaggacctttgcttcagcgatggtcgactggtacatttggaggtcttcgacgactccatcatactcgaccaggtcaccatccgctgcaagcttcgaaaggattcgctttctcagctcggcatccttcggtgatttcagtgccgtcaaaagcatgaggcaagaaaattgctcttcgttgagcttttcaaactgaaaatcacgcaagagtcgcttatgtctgttgataaaaggacgaaagctttcatcttcgcttttcgaggccctcagacattcatagcgatcaatccaaatggattgtggccggctgaaggcaatctttaggcgctcctctgtttggctgtagtcaaaatcgatgactttcttcggcagacatgacttgctgtactggctgaaagccacttcactcagcttcgtcatgagcagcttgacctttgcttcgtctgccagttgcggtgccgcacagtcgagggcaaaattgaagcgttccaaccaatcggaaatgcttctatcgtctgatggctcaaaacagtcgatggtcggaagcgttggcaaagcatgcgcatttgcggctggcgcaccattttgatttgccaataattgctggattgccgcagtgagttgttggattgcgtcgcccatcttaaccacagctcgtggactttcccctcagctcgagagtactcgttttaaatgacgtgtcgttcaccactcaattgttagcagcgccaagctactaaacagagtgggtgcgcgtggatgaactgaaatgtgtcgccaagacacaaaatcagcggcgcaaaatttctcaccactaacagtgtcaaactgttagcaggttcaacaaaaagttgttattatcgcctagataatagcaaatgcaggcagtcttcagcgatgacacagcaaaactcggttgctgtcaaacctcttcctccacaatcagatcaataagcccacagtcaaaagtctgcacgggcgtcgccaattgttacgccccaaagtccgaagaggaataaaataaatatttatttaaaaagaagggacagggcgaacggggtcaaatatcgattgggagcaaagggaacaaataaatggagaagaagcaaaagaatgatggggaagggtcaacatcgcgggtatttatgggcggaaaagtgggcgtgacataacgaagggagaagggaaatacaagtgaaacaaagggtcaaaatgggcaccggacaattgggtcccaaccctaacagttattaaatgttatttattatagtccgtatcaaccctttaattcgataattagatcttggtcccggcggtttggccagtaaattacaatgcctctggcttaataattttttattcattgtctgcgtattatgtattatgtacagtttcgttgcattaaaatagggacaaatccccaattttcgtttgtttgaactagagcccgggcgcccgccgggctttagctgggcacgataaattttcaaaaaacaccgggctcgggccgctcgccaaacgggctttttttagctgggccgcccgggcccgatcatatttaccaggctaaatgggcttaaatttcgcccgcgaaactgctcccatttgaaaaattaagtaattattttgcaaaatgtctttagttcaaagttttaagattacttaaggtttcttttgaaattaacaatttcaactgtttaaaaatttttagatttttctttgcggcgcctacatatgtataggcaccgtcagattcaaaatccgcctaaaatattcaaaatttgcctaaaatcagctatttttggtgaaaatcttttaaatggatgcaaaacttaaaaattttcctgtcgaccctaaaattggcttaaaattgcaaaatttagtcatttttttgaaaaaattcagaaattaaaaattcttccccggcggcgcctacctgcattaagtttatttattattttattattattaaatattttttaaaatattaaactataatcagaactggggtttttatgtgccaaaaaatttttaaaaatataaagaatttttctcgaaaaatttgttaaaataatgcttcaaattatttgtatgatttgaaattcataataaacaaatgcttttgacttaatttcccgatgagttttttgtttaattaatattttccacccaattaaattatttttaaattttcagcaatttgtcaagaaaaatgtgaaagtttttttttgttgctttaataagaa

SEQ ID NO: 11870 - DNA, 2014 bp, Heterodera glycines
  misc_feature (177)..(177): n is a, c, g, or t
  misc_feature (215)..(215): n is a, c, g, or t
  misc_feature (289)..(289): n is a, c, g, or t
gctcgctctcttccctattcccccattcggtccctcctgctgctttgttgtggcgcgtttccgtcccatagtgacggtccgtcgcgccaaagtgccgagaaggtgtcaaccccccccccccccccccccccctccaccctgtgcacgcccagccccataacttccgtaaatctcgtnccctcctgctctttggtccgggattggcaccacatttnctagtccataagcaaagcacacaaaaagtgttgctgctctcgtatatttcgaaaccctttccatctactacctnactgcaggctgaaaaattaattataattttcgtatttcttcggggctcaatttgtcaccccctctctgagaaaggaacatttccactagcttggtactgcctgaaaaataaataataataatttacgctcccaagggttctattttcacaccccgccccactcgaaaggtgcgagcgtgggctctaatagaaggataaggaggcttcattaaaagaaatacggtaaatttggggttttttagccaaaagaaaatggccgatgttgaaatgcaagaacagagtgtgccacttaaaaatgccgagcaacaacaaccaacacaacaacaacaaatgaccacggaagggacggaaacaacagcaacaacaactacagtaacgacgacagtaaccgcgccgggcactggtgtcgccgttccccaacaaggggaagaagccccgccggcatcgaaaagcaaggagaaaaaggggggaggatggttcgcaaaaaaggtattgtaaattgttttgttcgaacttgctgaatatgctccgaccagcaaatatttacttctaattacacaaatacaactcatacgttagttagctgaaatgcgtagagttatgattaggggccaattattttcatttttgcctattgtacgctactgctttttatatttaattgatgctgaatattaatcatgtatgtaggtaaaataaattaaatttattttttcatgaattatttaattttgtttgcttaattgaattgctttgcctttttgaagtggtttgtgcccaaaaatgggcgccttttcatggtttagctagtgtccgggattttgaaccagggttgacgatgaaccaggactacaatgaaaacgcgtagtttttcggtactccaatttcggtattttccaaaataaaacctgggttcgggagtcctgccggtcccttatgggctggcattttccttataccagcgatcagttactactgtttgcttacagtaataatacgcttttaagaagacgcaaaagtcgccgcatgatggtggtgatgaggaatccgaaaaattggttagcagtgacaagaaagcgaaaaacctagcagcagcagcagcaggagacggaggtggtggtgatgagaaagaggctgcagcagcagagacaaacaatgtgaaggatgaagccaagaaaatgaagaaggacagcagcaacggcacaaagcagcagcagcaacgtgccaaatgcccgttcagtctgtgccgtggtgcgcgaaaggtggaggaggtcggccatgccgagcagcatacgacggcgtcgcaatggggcgaacgggagccgacgccgacgacgacctttcgctttgaccttgtccaacgcgattcggccaagctgcaggaagtgagtgggtggacgaaacccaactcgtactaggccaatcggcatcaaagcaaagccgaattcggaaaaattttggattatggttacagtacttctcttccctattttaaaattttatccccgaaaaagtgaaccaatttctaagacaatcgacctgggagttcatgacatttttggagagccggatgctgtgcactcaatgaatggtgtttggaaaatgtcgcttactgtttttcttacggtaattcacactactccactgttttcatcactattatgactggaatgggtcatttcggcgcccagtttcgacgccaaatccagttttttgactgtactt

SEQ ID NO: 11871 - DNA, 2307 bp, Heterodera glycines
gggatgggatggaagaatcgaagacacgggcaataaaagtgaaaattaattgatttttaattttaagctaaaattccaaatttttgaaattcgtaaccgtcggtgccctcttaatttcaccaaaatttttgcttttaaatacagagcgaaaaattatttgtgaccaattgtaccgcagtttcaatctttgctggtaaaatgcaaatgtcaaaataattttcttttcttgaaaaaactatttttagctcttgacagtttaagccccgttttttaaatttctaataaattggtttttgagctcgctgatcagtgatcacgaatccagcatctctctaacccgaactcgaataaaagccaaaatttcatttattgcctaaaatcgaattataatatgtaggagggatgcaagttatagttgctaaaaagtgccaaaataattagcccaaaatagttgctaaaaatagataaataggtgctaaaaacttttaaatttaggggtgtaaaatcgaaaattttcttcaaaaagcaaaaatattatgccaaaccatgaatgaatgagatacataattttcaaaatcaaaaattatcgttaatagaataaattaattaattcatttcttaggggtgcatttttgaaaattttcgggtcgattcataggagtatattttttgaaaaaattttatagtgttttttatttgctaaaaataaaaaactagaaaatagttgctaataactcaaaaagggtgctagtgcatttcgtaaaaaccgccacccatgagcgtttcgtaaaaccgccaaatgggtattttgttaaagcccccacccatgcgcgtttcgtaaatccgccaatgggttcgaaacaaaaaattataataaataaaaattcataacttggcccaagttcaaccaaattaatattttatggtattttttaatagctttaagtgttctctatcagaatataattttaaaaatttgttatcttatgtataaaaaagttatcgtcataaaatttcgaaaagtcttatgtcagaattttgtgtacagaacttttttgaaattcaattaaattttctgaaatttaaaggtaaatagagaattcttagagctatcgaatatataaattaatttggctcaattgcattttatagatttaaaacattgtgtttataattatatatgcttgaccattgcaaaaaacctagaatgttcaatgatttataaatttttttatacttaagataaaaattttgtaatattatattctgaaagaatacacccatagctattaaaaaataccatgaaatattaatttggttgaacttgggccaagttatgaatttttatttgttacatattttttgtttcgaatccattggcggatggatttacgaaacgcgcatgggtggcggtttttacgaaatgcactagcacccttagcaattgcactgacctttggcccattttcccggccaccgttgccaatgacaactttctttctatcgggattcccttcaataaaaaaaggaaaacatgcttcagttctaagaaataaaggaccattccaaaaataattttcttaaagattttcttggctctatcttttttgtttttccgttttctcaaaaatataaatcttttttttgcatatgtgtgagcatccgcgcgaaggacagcgccaaatgaagagaatgtgagtaaatatagttccaggctatttttggcaacctgagttttttctgggcctgatttttgtatagaaaatagaaggcccatttttcaaaacgagctctaatcctccatttgcatgaaaaaataacaaagttttggtttcgggattccgaaatttttcgatgggattttctgaataatctgaaaaacccaatcaccataaagctagacatagactcgaatacgatggcaaattttttttcaaaatccactacagtaaattatgtgccgatgtttgctacgacgtgctcgccttctttgggcctgtaatgctcgggctcggaattgcgctggtcagcggcaaattcaacgcggtggccgaccatttgttgagacgaaaactgtggacagttggccacattcaaattcgccgtgccaaggacggcattgattggatgttggacattgtcaaggattaccaagacgcgcagaaagccgtcacatttcccgtcgccgtgtcaccacttccgcttggcataacagatttcaaaagcatccaaataaagtggaatattttagtgcattcatatgagaaacaaatatgactgtgaccagaaaaaataaagtgttccaaa

SEQ ID NO: 11872 - DNA, 2322 bp, Heterodera glycines
tggatgttgcacaagggacggacgtcacaacattatcagtctgttttcgctcacatcctgctctcgtccgctgtacggaggccggcttttacaaaccgcacgccgagcagttgacaccaggacgcgacgactccgagcgggcgctcatgaccgaccaaacggcattcaaattgccgaaaaagggagtccccctcattttagtccatcagaacacgcccgcgcaacgcgacgaagtctccacttcttcggccaatcctggccagaccgacacggcgatgagagccctctggcgtttggcgcgggccttccccggaacactcatccgctgcatctgcttctacgccgcgcaagccctggagatcgaacggttggtggcccaacaagaaatcccggacattttagtgacaacagcggacgcgacacagggccacgagtcgtcacttgccgtcctcgtcacaacatgctccgtcttcgacagtggagcagactctcagcctttctgggctgatgccgcgcgggtggacgtcgccatctctcgcgccagccatggaatgatcatcattggcgatttgctgctgctcaaccggacggagacatggcggcgctacctggaccaagcgacaacggaaacgacagtggtcggcccggagtacttcgacttcgagcagttcaacaaccccgacaactactacgacaaggacggacagctgatctcagccaacggcggtgcggtacggtcagagcatttctacagcaagtacggtaaaaatgtgtggtacaacaactccggtgagtcaaggggggcggagaacagatatcaaccttatcttcctcaaggtggcactcgggaacgcactcgtggcaaagcctcaacttctggcgcgcgcagatgaatgaaagccaagctgtacgacttcagccatggtcggcaactgcgcatggacctgctttcattcccttcccctcacgttttaccattttccttttgttttgactctctctttctcactctctctcgtcatccatttcttaaaattatcattcattttgtctttatttccgaactgttaatggcctttctttctcccaattcaaatttctcaaaaatgcgtcggtttcctcacactttctctgacccattctctctcttctctcatcatgcttttacatctcgttcccaaaccggaatgacccctggttgcttttctccgatttcccatgccatccatctgagatgaaggtggaccactgctcattattgtaatgcgcagcttggccgtggaagttcggattggagagatgaagggcgaagccgagagtttggtccattcattcactttcacttcatttttcatttaaggatcggggacgatcctaaggaaaggggggagttgtaaggattattcgacgcatttccctcatttaattattccttattggccattatcaattcaatcacatttatccattttcacacgtttttccttttctcattgtaatgtttctccgcccattctcttcgtatttctctttccccagtgatcagttagtcagtagttgtgatggaacagacttcaattattattccgatttctcgcttcgtttaaatccaacatcgaatgaataaacacatctttaacagtcaatgagtcgtttgggggttcggggcttggtcaaaggcgccttggcttttccccattccctcccaaactccatccgggataaacggtgcatagttggtctgggggcacagtgcgcatccctcactataataatttaagaaaattttgtaataaaatttctgtaaattatcaaatattgttgatttatttgaattaataggaagcgagtttagcatagatcaagaaagaaatttcaagatgcataagtgtttaaattgtgaaattgccaatttggcattaaagaaaattaaattcgcagaaaatatggaaaattgttaaaatgtaattaaataaatcctaataatcaattgtaacaaatattttatcttttaatattacaatgtttcttttattcagtctttttaaatctaaatttgttatagaagaaaatatcattaaaaaaatcatttttcttggttttttttttgttaaattttctcaacgatcactttttttgctatgcatttaattgtattatcaatagcttattcctatcaaaatcaccgagttttaatatttttattttaatatttaaaaaaatgatttatttttatggaattgccctttttgtattgtctttttgtacacattgaaaaattaaactaccgttcacgccgtagaatcacaaatctttcattca

SEQ ID NO: 11873 - DNA, 1458 bp, Heterodera glycines
cgcagaatgttgaccagctcaattggctgaggctccgtttggagcgcgcattggcacttttgttgcccgaatttggccccttccgttgtctgccggccacgggccaagccgaggaccaaaccaatgttggacgacaattgcacagcgcaatccggtaggaatgtaatgccaaaaatttgggggggggtccaagatttgtaatttttgggtttttggcatttattgcgttttctccaacaaaattcggtgctacaaaatggccaacatgtacacaaactctagaggaaaaattggcatcgctttcaaataaaaaaattttggaacttttttggcattaaaattgaaaataatgatacaaatgacctttaggccctttaagcccattgaaatttttttttaattttcatgccaaaatctcaaaaaattactcaattgccgctttaaacccgctttttgtccagccatggcatggacaatttgctgctgtttccgctccaaccgcagtgccgcacccgccctttgctcgcggccatccgaaaagccattggcgcaatggcaaaccaaacgcaatgccaacaaaaacaagcggaactgacgagtgggttcgtctgtgccaggcaattcgttgtccgcaattcgcccgtctcattttcgctgctcatcgcggacgaccaaattgcgtggacccactgttttgtgcaagtattgtacacatttaccatgccactttttaatggggataggtgctaaaatcgacggaaattattattattttttaatttaaatgaattttgcatgcttttatcagccgacggagtaagagaaaacagaaatttagaagtgggaagtgaactggtatttttgaaaattgagacaattttcttacaactaattgctttcgttcaaatttttttacaatttccaccagcgacgtccatcgattgccaaatttgataaaatttgagtttttctcatttgtggcttacaattaaaacgtaattattagcatttaaaaacaaaaaaagcaggcataaaaagccaatttttcagtattgggtggagcgaattctgcccctgttcgccgattatggtgccatcattttcacggccgtccgcccaacgcccgtcgagcagctcgaacccgccgcacgccgtgtgatgcatgcgctttatcggcattcgccgttggccaccccctggcgctgtgccgtccattacgcgtgggatcaaccgtttggccattgggtggaccggttggcattgatgaggtgaccctgactgagttttaatagggtacggtgcagtggagtttggaactcggaaaaaatttttaagaaatttcaagaaagtttttgaaaaaattatcaataatttcaggaaattttctgaaaaattactatgtttttcaaattcctaaaacatagcctgaaactttttttttaaaaaatttctttaaat

SEQ ID NO: 11874 - DNA, 4244 bp, Heterodera glycines
ttatattttctagggaacatgtttcgcgcatttggcgcatagccagaaattatcaaaaaatgatgtaccgaaatgcaaaagactgtgttttttacatctgttacacatctcgtaatgacaggggcagtaatgacaacacttaattttatgtggacagttcattttttcaatttaattttatttttggttgctatttatagaaggggtatataaagggagtgaaaggaccatttgattggtacattgtatcaaaaaatgcaaaaaccgataatcgtaaatataattgctctcgctaatctcggtaccgggattaaactaaacgctctgatgatcaccgaatgcgaatttaaatataaccctagaaaattcaatgccgcggttatcaaatgtataagccccatcaaagccacggcattattatgggaatccgggaaaatgatatgtctggggacgaaaagtctgatagactgtgaaaatgctattaaaaattttatagaaataattaagggctcggggtgtccgggggcttcttacaccggacacacggttgaaaatattgtttcgacctttaaattcggacgtgaaattgaactgaacgagtttcgaaaaaatcgtcgtgcattttatgaaccggaaatattttgcggtttaaatttcaagcggggtaaaagcatgactgctttaattttctggaccggtaaagtcgtaattacgggaacaaaaaacaattctgaaattgacgaaatgtaccattatatgctgccctatctgaaaatggctcaaaagaatttaaagagacgataaaaattttaatttattgggacggtcccccaatttatggttctgttgtgtatttattaattatcgattactacttgcggcatcagcatcggcggggagggtgggggtagtgtaattatcgattaatttgcgcggcggcacatcgacggagcggatgagagtggcggtctcattatcgattttttttttgcgcggcggcgacatcgatggggagggtagggcggtgtcattatcgattttttttttgcgcggcggcgacatcgatggggagggtagggcggtgtcattatcgattaatttgcgcggcgatgcatcggcggggagggatgggttgggcaaaaaaaagcacccgtgcggttttgggaaatcggatttgggtgggcggcaacttcaaagtggtccaatagattttggttctgggcggtaactttaaagtggtccaataggtttgggttctgggcggcaccttcaaagggctgcacccctcccataggctttgggttcgtgcggggcggcaacatcaaagggctgcgcccctcccataggcatgggttcgtgcggggcggcaacatcaaagggctgcgcccctcccataggcatgggttcgtgcggggcggcaacatcaaagggctgcgcccctcccataggcacgggtccctgggcggcaacatcaaagggctgcgcccctcccataggcatgggttcgtgcgggaaacacccgtgcgaaaccgttcgcttttggtactttatactactgagggcaaatattcacaaactctattattaaaaagaaggcagctttcatgcaaaataatgattttcaatgaaaaaaaattctcatttatttctgaaaaataatttttggtgccaataatttgtataaaaatgatcaatatgacagtaattgagccattgatttttagccactcaatttattagctaagtgaagaatctacttatgaaaatgggttttattttatagccctaagagtttagaatataaaatttcaaaaatttcgtctagtatgaaccaagttatggccaaaaaacacaagcaaccaggttttcaaacatttttggccctaactttttagaaaattaattaaatttttgaaatttgacaggctactagagaaaactaatgctatcgaatgatatcacgagcagttaattttgttggttccaagaaagttttaaacagaatttctggtgatcgaaattattttaattctaattaaaaaaaaattttagttataaattattttattttttattttcttgctatcattcgaaatacgaaatataagtctaattggtaaaatcaatgttttaagcatataaatcccagaaaatctcattctttatcattttcaccctcacaattaatacatttcgaggcgttcgggggtaaaattagcctttgccggccctctttctttctcattttttttttgaaaaatatcacaaaaaatgcctcaggaaatagactaaatttgaacatatacatttgaatttttaatatttacaggaccctcactaaattttaaaggaggatttacaggacttttcttgaaaaaatctcgttttttagaatacagtcttgtaacaggagacataaattcaaaattccgaccacaaaaattattaatattgttgattaagttgattgttactgctaataaattcacaaatggtaaaatcaatatacgaatttgtttttgttcgatcgttttcatacgacattttcggcactttccctttggtcccaatcagttttaattctgctcaattagtggcagcatcgtcatgcttttccgtgcaaagaaccgattgcacatccaaaataacaatttccggacggtcagcaccgttcactgaaatgccggcagacgcgaatgatttgcccgggtaaaggtgcacattgttgggcaatgtgaacaactgttgctgatcagcagtgccattgtcagtggcaagcggaacgatgccccaatgatttgccaattttgactgacaaaaatatatattatatatattagttgtgaactcctagggacaccgcaaagtacaataaaacaaataattaaaatatactcagaatttttataatttattttttattttaattgaactttgactcaaattaatacaattaaaaatgaaaatgtcaccgttttcggcactttcacatggaatttgacttggtccaccagcttaaagcaagtgttcgtaaattccaacgagtaatcgctgcatgtgtccgtgctgttggtcaatttgagttgaactgtgatcggatttttttgtgacagcggaggaggcatttgttgattggagagcggaagacacataaaaatccattaaattgttaatatcttaggtatgcagaaaatttataaaatattattaaattttagagaaagtcataaataattattaattttggcttagtatttttaaaatttcttaataattataaacatttattatttaaaacgatgtttaaaatcggttttaatttttcaattaaaatgtcatacatttactccgatttaaagcctaacaattgggtaattttgattttacagaaacaaaattgaaatattttattagtattttgttgcagtttttgttaattgaatagatatacaaaaattaaatatgctcaccttttatgcgattgattgtaagatggttgtgacaaattttttgattgaattttttgcaaaatgatgacaatttttgagtgagcgagaaaagagaaaagtcttttcgctgatgaatcggtgattcatccatcacatcgatttgtcgtcagttatttttttcaattttttaattattttatttgtttctttgctcctccgcctgtcgttttttatcccattaaatgagaatgactcatttcatttgaagatgttgttgaagaaatgtgctgacagtgctttctcctaacagtctgcttaaaaaattaaaagtttcaaaaatcattgacgtattatttattatcactgacttttttttaaactgatgtattttcactgtgtgtttttaactgatgtattttcactgtgtattttacgctgatgtattttccacggacgtattttcattgcgtctttttcactgatgtattttccacggacgtattttcactgtgtgtttttaactgatgtattttcactgcgtatttttcactattttctattgacgtattgtcactgacgtattcttaactgatgtattttcactgatgcattttcactgcgtttttcacttatgtattttcactgagtatttttcactgatgtattttccacggacgtattttcactggtgggtttttaactgatgtattttcactgagttttttcattgtattttctattgacgtattaccataggagtatttttaactgatgtattttcactgagttttttca

SEQ ID NO: 11875 - DNA, 1976 bp, Heterodera glycines
ttttttatattaatttaatttatcaagcaaaccaaaggcacattagtgctcttacatggtaccaaaaaaacaaacaaagaaaattgaacaagaaaaaatacaaaatgaatttagtaagaaaaaagaaaaaaaaataaaatattatattgtgtaaatatggcacagaatattcctagtcagatcacattgcttttcgaaaacccctgaattcctttgccttattaatagggatgggaatttaagtcaaatgactttttttgctgactttttatatttttggatttttatgacttttttggtgacttttttcaccttttaaggcaaaatgacagtgaaaaagttagaaccaaaaaaactctggcgctaaacgactccgaccgtcatttttatgtataaatgtaagcaaaaataccctaattttctaatgtatgaagaatgttgattcttcagtttgtgattttttgttccttcgaaattttaatataattatacagaaaatcccaaaatatataaaaatatgtaaatgaaagtccagctttttgaatgaaaatacaaaaaaaaaaaatatatatatataataaatatatttcctggtgtcatgacaactcgtacaaaaggcaactcgtatacacagcggcccaattttgggctccaagtacaattatgctggatttttcgtcttagtggtctgtgagttagtcaccaaaaggggggtcccaggttcaagtcctccctatgttgtgtgttaatttcaatttcttcttttaaagaagaaggcagaaatattttttattaataaaagttttcgtgtcaaaaaaaaattattttcaataagagttagttacgtacagcatcgataatttttatgaaattttttagcctataactttgtcaatactagatcaaataaaaccattttatgctcattttgaagggaaaattctagagaatattgttagttttatttgatttggccttaattgcgcacttggctaaaaaagaattaaagtattgaaatgtttgccatgggaaaaaattttttcctgtgggtaactttttttgaaattttgtataggcccatattttgtccccctctatcgaatcacagtttattttttagctgtctagtttttaactcgagatcggctcttctatttttacaaggaaaaatcccaaaaaaattttaagttttgcaaagttttggcgttctgattactaaataaataataaacctatttgcactgagagcccaaaattgggccgctgtgtataattgcttaagttaggccggtgtttaggcctaagctttcggctaggcctacgcttaggcttgattgggtctaggcttatgattagcttaagctttattttgtaaaatatgagttgccttttgtacaagttgccattgagccattttccgattatacaaaacatgcagaagccataaaaatctcatccctacttattttatttattaagtaattaatttttctctattttcagtaaatttatgagttcaaagcgcaaattacaggtttcttatttaaaagattggccattaaaaaattgacgaaacccaactcgtacttggccaacacgtactgccccaactcgtactgtttgacaaaaaaatcgtcataactcttgcaaagtcgactaaattaaactttcttggtgccattcgataactcttaaagttctccatctacatgaagcaaaatattagaaaattttattgcttttcaaaatttatgaccaaaaatggtaaaaaaaattttgttaattttttcaaattttttattctttaattttttcacatttcaattaattgtctcccccattggttcatttccaaaaggtaataagcggctaagagagagaggcgtgcgttgttccaacggccgcgccggcggcggggcgcggggtcgcgcaagaattcggcacaaattaagatagcattatttacaaagaaaaaa

SEQ ID NO: 11876 - DNA, 1894 bp, Heterodera glycines
caaataaggacgacttcaatcacaatcagacgcaatgaaaataatggtccatttgccggggtactattcaaatggtgcttggaaaacgtttttgttcgaaaatattccggatccacctgcacacattcacaatttcggagcaatctttgtcaggtctgaaataaattaattttaaatttcaagcataaatttccaatcttttttcagattcattgaccaaaccgctataatatttttgcaccgaattataagcggaatattgaacacggaaatcgttttggatctcggaaatatttaccaaagcgttgccgcgtaatttgcttctttttgggcactgctcaaggacagaatgattggcttaatcttaaatgaagagtcttgcagttttctccgccaaagcatcgcacctacggcacttctttcatgccttaaactgcacattattgagggcaccgaattaatcccggagttttctcgcaatgacattggggaaacaactaacgaaaatgaaattaatcgatggcttgtgaagcatctcacaaatacttctactccaaaaatttacaaatgtcaaactgaagatatcgctttcaacgtttccgcgtttaagacggtattatgaattaaataatatattatctttatttttaaatatcgctataggagttaaacccaacttttctttttaaatttaaaaatagaaaattatttttaagggaaaaattcatgcacctgttgatttaaattttattggagtccaaaatgacgagtggagcagaatttgttttttaacagatggtacgcatttcacgttatttattaattgaaaacaattttaaagcaaatttgcgctagttaaaaagtgacagattttgaattttatcaaaaacctaagggggggggggggtttgtgttttgcaaaatttttttgagataaaaaatcgtgaaacactttttactagccataattgtgctgttaatgcttaatattatcattagtgtaaataaacaaaaaaaaaagtttgaccaaaaaagtgaaaaaatttttaaaaaggcccttctttaaagtggcgctaatttttctaatttgcaattagttataaagcataataatatttgaaggattataagaaagtattatgttttttaagtacttttttgtatataaacccaggcgttattattataaattattatttttatccaatttaattttactattaaataaattcagcttttgctttcgccgctgacctgaagtgcctgtctcgaaaaacgatctttttcataatgtatttatttttattccaacacatttaaaaaagattaaacaatcatttaaaaaactactttagtttcgggtcagattccggctcacttatatagattgaattcatttcaaaattaaatgagcgttttattgctatgtattcactctccgaccattcgttttctttacaactgattgagtctcttcgcaatacccaaagtccattcggattgaaatggttttcaaaacgacgaaacgtcatccttttctcgtgttcgcgcgttgtcccattctaatgggttcccagtgaaattaaatgtaaaactaaaatcaaaacagacggcataactgacgggcaattccgcattgataaacacctaaaggcgcaaaaattttaaaaacagtcaaattttgaaaatatcatttttaaatcttccaattgcctttcaatgttggaaagacaataacatttgagcactttgggacgtccatcgtcgcgcggagtgtgaagccacttggacaatgcctggttttgtgatgcccgggggccatcatacgacggactctcgggaaaaatattgcggcaataaatgactctgagattggcacagccccgagaatgga

SEQ ID NO: 11877 - DNA, 3226 bp, Heterodera glycines
  misc_feature (39)..(39): n is a, c, g, or t
  misc_feature (56)..(57): n is a, c, g, or t
  misc_feature (66)..(66): n is a, c, g, or t
aaatttattttaaaccaataaaaagctaatgtatataanttcaaatattaaagcannttaaaaaanttaaataaaaaattaattatttatttactattttcagaagtgtttttatgcttttatataaagtaagaaataacggtcaaatttaattttattaggtttattagaggtcagaaattcatataaaagtttatttgaatagattttaaatgatagacaaataggcatttttatatgggtttttacaatataaaggttcgtagtaatattttaataaaattctattaatttaattttaatcccaattttttgtaaattataggaattttaatttttcaccgttttatttttcactttgacagatataatccaacaccttgtcatgcatgaaatatcccaataaatatttcctttctaattttattaataattatttaattaatattattatccatttttcgtcttcatcacattcgacacttttgttcttctgctgttgtttctgcttttccttgttttttcttctctgaatttttttttgtatttgtgccaaaatgattaattggaaaatgaacacctcaaactttaataaaagaagcgttttttaggtgccgtggacttcctcccttgaggaatgctttaaattcataaataaaaaatgattttaattaaaaaatattaaaaattgccaaaattcaaaaaaaaacctttgcacaagcacagtttgcttgacttaattgtccgcatcctgttgaacaaagcccaacacacagcgtaatttcatcgttccaaacgcattcttgcaaagtgtccaatggcagcaataaaagcagcaaagccaacagcagaaattgtttggacattttgattgtttaaattatatttgtttgatcaattagaagtgattgggatggaatggaaaagtgttttgctggaaaattttgtgaaaattctcaaaaatttaattggaaaaatcccaaatttggttggaagataaagataaaattttaaaaaataataattttgttatttattcggtctttattatactagaaaattttaaaaaattctcaaaaatttgattagaaaataccaagttattggcgctacttgcaaagagggcctttttgaattctatcaaaaacaaaaggggggacccttttgttttgcaaaatttttttgagataaaaatccatgaaaatttgttatccgagggttttagaggtcgctgatcacgaatctgacatctaattcgaggtcttggacccaaagaaccccagggaataatttttcatgactaaatattaaaaaattttgcaaacaaaagggtccccccttttgtttttgctttttgataatttcaaaagggtactctttttaaatagcgccgcactttttgtgttgtatattttcccaacctcttttttcattttgtttttttttttttgctactttttcaaattgtctccattccttttattgtataaatttattctaattagctatgaatgatgaatatatttgctgagaaaagctcgtcattagagactcctttgaataatttttgtgtggttttttgtggacttaattctataactttttccaaaagaagcagggagatgaaaacatttattaataaaacggttaaaaaatgagaatcaggataaaacgagcaaatcagctgcctttttaatttatcctttaaaataaataatttatttgtgaatttcatgcaaatggactgtctaatcggccgcttgtgttcacaaaaactgcctttatttgcgtgtaattccaaagggacgcttcgccattctcacgcccataccttaagacatgaaaagtgattaattaaacgaccttaattagagaacccggactgattgaagcctccgaatgggacattcgggtgcgtgtcgttgtacgtgttgatgtacacatttccggcgttcatccgagcggcgaattggtgggccctggccaaatccctgaagggaaaaagggcaaatttgacacaacaataatcaagtaaagaaaaatgcgtcattagtcactgcacagactttgtaaaaatgccaccggccaagccgaactccgtgtcattggccatttgaagtgcctccttggaattagcactgattatttccaaaagtaatccaatccttcgtttttcacctgctcatcgtcaaacggaatgataagcaaaaccgggccgaatatttcttgttggtaaacagtcattttcggggtgatatttgtgaggacgcacggggacagaaaatagccatgctcaaggcctggaaagtgtgaaatgtgcaggcagattcacccaatttaatattcggacttagtccaaatggcccctttttactggggtgattaacgacctaattagtccaaatggtgtgttttaatgaccctgtattgtggtgacccgttcgccacccgtcaacaatttcgcgccatcttcgtcgacggcggttcgtatgaattggcgcactttgtccatgtgctgttcagaaatgcaggcgcccacgtgggtggactcgttgagcgggtcctaaaaacagagaatgccaaaacaaacatttgcaattgtcaactaatggctgctgcagttttctatctgcctctcccaacctttggccatgacaattttggcatttctctcccaatttcttccccccccccccaaatgcccaccccaatgcgcatgttctccgtctgatgcacaatttggtgggtgaactgctccaacactttgcgctgcaccaacactttggacgcgttgctgcacacttggccctggctgagaaagttggccaacaacgccccgtgcacggccatctccacgtccgtgtcttcaaacacaatacacgcgcttttgccgcccaattccagtgtgcacggctaaagccaaaacgtgacttccaaagatttaacagacaaagcatttcaattttcatttaagccacaaatgggaaaattgggtaagatgaaaacgaaaaaatgacacaaatttggtttatgtcattatgtttaccagtaaagaaaaaaaacctttaaattgtcagtggcacacgcgcgggcgatgcttttgccggtgccgacacttccggtgaaggaaatctgtggaagaaaatgggttttcgatttactaaaaagcctttttactctttctcgctcgttaccttttttatcagtcggttttcacaaattttcg

SEQ ID NO: 11878 - DNA, 720 bp, Heterodera glycines
tggcgctagttataaagtgatagattctgaattttatcaaaaaccataggggggacccttttgttttgtaaatttttttttggataaaaatcgtgaatatacattttattcaccataattgtgctgttaatacttaatattcatcattatgtgtaaaaaaaacaaaaaaaaaatttgaccaaaaaaaagttgaaaaaattttcaaaagtttcctctttgcaactagcgccaaatgcccattcggccttaaaagcgcaccattccgcggttcgtacactgtgaattcgccttcgcctcggcttttcgtcagtcccgtccgcgcaccggcgacaaaatgaagcctttccaaaatgtcgggtggaatcgaaaagcgcttcatcgttttaaagcggaaaaaagggcaatggtaaagaattgatgtcccgacgaaaaaaaaatgtttaaaaattcgcagctattttttctaggcttaaaaaatgcgctgatcacgaatctgaactcagattttgaaaatcattgatttttatctatgattttttttcaaaattttaaattatttaaaaaaaagttagcaacgaatttgggcttaaaaatattctgatcacgaatctaagctctgattatgcattaaccggtacttgtgtggtttacctgacagatttcacatacattttcaaacgcatataaaagtattaattaagaattgtttttttaagccat

SEQ ID NO: 11879 - DNA, 3248 bp, Heterodera glycines
ggccaaaaatgaatcgtccttcgtccgcctatatatagggaacgattcgaagaaaatgctcacattttgcgtctgttagtatttttatcattattttctatttgccaattgcatcaaagcatcgttctgctgctccttcatcgaccacatcaaacggaagaagtcatcacacggagtcatcatggagaagatcgtctacttaaagctgttccaaattgtgctcactttgaccatcttttggcaactcatttcacttcaccaattctgtggcactttgccgacccaaaagtgctgtcgctgttttttgttgccaccaattcattttaaatttatgttttcagactttcctctgtcacatccgtgcgggcaattgtgaacgctacacgctcatcggaatggactcagaaactggcgaattcggctcaatgtacaacaaattgcacaaccaactgtggatgatttgcaccaatggccgaccaatcgaagaacagcaacaccaattcatggacgaattggccgcgaaattgcctcccgctggacgccattgcattccgataacagtcaatcagcaaagttgatgcaaattgtgctcactttggcattcttcaacagctccaatggacagtcaaccaatgcaccgcaataccaatactttcacttcttggtcgagaaattgccacccgccggacgtcattgcattccgataacggtcaattagcaaaaagctatcataacgatgaaagcaaatttcatttgtttttcagatttcgccttttgaatggattggcaaagacataaacgccctcaacaatgacactttgttatatttctccacccaactgttcttctcattggtgtcgcttggcgttcttggctatggcatcatacacaaaataaatgttaaattaaaaacctccattcttcagatttgtcgtgtccaaaaatgcctttcttttcgtcacaccccgttatctttttgctgccagttcaatttctgctgattgttatcatcgccgctgtgttcatcattgtcagccaatgctgtggtggcggttccaagaaaaaacaacaggagcagcagcaggaggaacaagcgcaaacgcaacgtggcaaccagcaaagtgatcaattgaatgaatcggaacacaattttactcttttctcatttcagagaagaacaatgacggaattataacgaaatggatgaaggaacgtcagaagtgatcagcggaatgagtgatcaaaatgactaaatttggaattgttgcatggaaattgttgctttgatataaatgcgtccatttatttaatgaagattcttcttttaatatgagatcatttctctgtacttttaaaaacattttgcacaaaatttcagtcttttaaaaaattcaattattggccacattcgctcctttcatcaaacacaaaaagttcactcacacttttgcgccccgcccggcgccgggggcaacaagtaacagaaacaaatttctgccccccccccccgcccggccatccggtttttgtgtgcattagctgcgcaatgtgtcgtccgtccgccctgcacacctcgccgccgccgccccccgaacgctccactctctaaaaatagggaccctaggaaaatcctccagcaacagcaccaccgatcagcttctagcagcccccgcggggccgatcggacggccaaaagaatgtgttctctctctctctctctctctctctctgtgtatgtttacatggaaaagcgtcagcgatcggaggaccgatgggcccctggggggagacatggtggacactgtgtctgctgtccactactcaattaccaccaccacctcaaccacccaccaaacatgtgaagatgctgatcgcgatcagcgatcagaaacagagaccgccgtcgggagtctcgagagtgcggacgaagacagagtgatcagaacagataggaagttagcgaacgccgcgccagcccagcagcgcgggggccggatgagggccgaggagaagcttccggccgggtcacattgtcgcttgatcaacccattaggatgtttgatctaagctctaggcactgatcagtagcagaagtctaaaggaggagtcattccgggctataattttcgatttattatgcttaatctcgaaatcatccggcactatgatcccggatgggcacttcgagaatgcccgatcatatttttcacaatttccaatttgaattaaaaaaaattcataatttttgattcgaaaaaaattcattaaatttctacacactcccaagtacctatttgatcattttgtggtcaatttttggtgtgtattagtgtccctccctcacccaactcatgacaattggcttggtcagtctcgagaatgggacggacccccggggggattatctgttcgagaaatgacggcgatttgcgcaccttttgtcatccattagctatcaatcagtcagtcgttagtcaactgctgccggaaataggctgctggacatagcgcaaaaaagttgtggtcactgcactgatcagacaaaaaaaaattggaaaaaattttgtccggattttttcgatcagaaaatgtgcagcaatactaacatttcgagatatattttctttaaaattactaattatgaatatgtaaattttcaaaaatcgattaatttctgtacaatttaagaaaaattaaaataaatttaaaatagttaaaaaaaattatttttaaaattttcggaatcgaaattattaaaaattgaaatctctagaaaatttaacaaattttcaaatacaattctattcaccataaaattaatgtggacatgtattttagcttttaaaaaaattttcagaaaaacggaatgtcagtaaatttgccaccccctcctccggcaccccctggctttgttggcggattttcaacacacccgtacaacaccagcactaacaacaattccatggagataccagagccgttgtccttcaggcctaggccaagcctgagctcgtaaattttcctggcttgccaattttttgatttttttttgtttgctagcgccacctcctgcacgtccgacggcttttccacgtttgacgaagcaagcttgccttctgcggcaggtggtccgggacaactgcaacggatgcatgcagtacagttgggtgctggtggtggggtacatgcgcaggcggccgctgcacatagggtgcatcacggcacaccgcgtgtgccggaggatccgg

SEQ ID NO: 11880 - DNA, 1858 bp, Heterodera glycines
  misc_feature (1816)..(1816): n is a, c, g, or t
  misc_feature (1846)..(1846): n is a, c, g, or t
caattttgagaagctgttgcccttggcctcctctcttttagaggccgatttgggccagctaaataaattattggcctgataaattgaattatcagccatatgaccatatagagtcctgaaaacaggacttttaatatggaaaatgcaacaaagcttatgctcatgaatgataagcaaagtccccctgctaacattgatgaaataaatgggtaacaggttggattcgctaaatgttcaatgcaaaaatagcattcgaaactgctggacataaaatgtcctttttgaacacgtgtttggaatccatccaaaaatgaccttggcattaatagtcatttaggaggatttcctttggaagctcataagagaggttctttacattctcatgaatgtaacagttctctgcacagcagagctcaactttattaatttcctttgggatctttgctttaacgcgtttgttaaagcaaagaagattgcactcagtgcattgattggtttgataagcatttgtttctgttccccccttaatgggaagagggaacaaacatgccaaaattacagtaaacgcccattatttgcaaaatatggcgcactgtacaaaattgagggattgcccctctttgccttccttcatgaaagtaaggtgagctctgatcctcaaaacaaagtaatgatactttgagttggatcatgggtgctatgtcattatttaaaaaccatcattatgtgcgttatttaaaaaaccatcaaaataaaaaattttgctttctaaaaagaccaaatttttaatccttgatatcattcgataggtctaagtgttctttatgagcctgcaaaatttcaaaaaatttcgttaagtttaaaaaaagatggccaaaaatgttcgaaaatcaaggtttttcgagttcctcgagctataacttttttgaaacttaacgaaattttttgaaattctgcagactgatagagaacacttagggctatcaaatgatatcaagaattaaaaatttggtttctttcgagcaaagttataaataatttttcgacaaaaatttacataatgatggttttttaaataacgcccattatgatggtttttaagtaacgaccctgcaccatccagagttgcatttatatttaatccagttattttgaaattaattttagcacaaaaaggattcgttttaaaacgcatttgtttttgacgtaccatcacgattttgcgttttcaaggacaacctttccacacaaaaatgagctcatatggtaatcgtcatgatcgaaattcatagtactattattttttctgctaatagagaaactaaatacggctcataattagccaaccgaacgtttaaaggttttttaatactatcaaatgatataaacaagctcaatttgttcgtcaatgagacaatataaatgaaaacatagaacatccaattcaacaatcatatataaatgggaaatgcgcctttcactcttcacattttcttaattttcatcatcgttttccagtttttcgcgcaaaacatcgatcagtttgtccattgtgacaagcttaattaaaaacacattgtttactttccaattcccaatcgaacctcctctcctttgtctttggccgggatgtaacgcaattttaccgaatttttagcaatttcttccggcccgaggataagcatccaccggatttgttgagtctcacaaaatttaatttgttgtaaaaattttacgttggccttataacctaaataaccaaaatgtttatgtaagacaatcagggtggccatttcaaaggcaaagtccgaactanaagggaaatgacagacatttaaatgagttngctaaagacgac

SEQ ID NO: 11881 - DNA, 1449 bp, Heterodera glycines
  misc_feature (21)..(21): n is a, c, g, or t
tataaaaaaaacaaaatatantcttctataaataatgttttttaaataaaagaaagtaattttttttaataaaaaacaattaaataaaatataataatatttcttcaggaaatgaaacaaatgtttgccaaggagagaaaatataaatttattattaaaagagaaaatgtaaaatgatttataaaatagcaaataataaaaaataataaaccgaaataattcaatttatgtaaattaattaataattatacaaaaaatagaaaaaaaattagtcagcactttttcataggttttaaaaatgcactttttttgcttaatatccaaattataattacataaatttaaaaagtaatacatatataaattaaaacataaatgcgatttaaaataaaataaaataaatgatgagatggaaaagtacaaaaattaattagcaacggacaacaattccgaaagccggaggagatctctagtcaagagtttaaataaaaataaaaagacaaaatttaattgtgaaatttaataaaaaggaacataattaatttttaaaataaacaacagcaaaaaattaaacatttattaattaaaaaagaatgttaaaaaagcgaattaaaccatgaaaatgaaaacaattattgttatttaataaatgagcaaaaaaataaactcaaatatcagctaaaaatggataaaaaacaattttaatttctaaaaaaataaaataaaatttcggcattaattttgttctaaatgaattcacaaaaaatgaacaattacaacgaaggagaacattattcaagacataaataaaataaataatttaataataaaaagcataatatgtttttgctataaatatatgaagtaggacgggtccgtatattttggcaaaaatttgaccgggttttaacgggtcatgaaaaacgggtatgggtccgggctcagcatttcatcaggaccaacctgctgatgctggaaaaattcataatttaatatttatttatttatttgagcgaaccgcaaggcatagttgcacttatagcggaaaacaaagtaatgaataccattagaaaaatatgatatggtcaatacggctacccgacttttggggatttgcaacttgggtacccgacatttggggacccgacatttggggacccgacatttggggacccgacttttggggacccgacatttggggacccgacttttggggatcccgtcatttggggacccgacttttggtgacccgacacttagggaacccgacatttggggacccgaaatttggggatcgaatgtcttttggggacccgacatttggggattttattaaaacaaaaaaaaatatttaaaaatttatctcaaattagacaaatttacgactgctttagccagagttaattcaaatgcaagaaaagacaaaacaatatttttaaataactctgt

SEQ ID NO: 11882 - DNA, 3658 bp, Heterodera glycines
atacaaaagaaaaatagttcaaatagcatagaaaaaatcttctaacagagaaaaaaatagtatggaaccagagaaaaagagataaaacgggagaaaatggagaatgagaagcattcaaataccacagaaagaaagacacacgctgtggcattctctgcctaaacgcggcgcggttcgattcgtcacacgcgcgcgcgcgtacgctcacaattgccgggcggtgattggcggcggcacttcggcagcgatgggccggccgcttccgttaaccattcgcctgccggacggacgggacggcggggagtgtccacaaatgtcccccgccccctccccccacacattcccctggggggagggcattctttgcgcttcgccattttcttgaaggtcagtggtccgtcctccgagcgaccgacccattcattcatccatcattagcaaaattctgcccccccccctcctatccccccgcgagggagggacggagacgggtcaataatgccttgccgctaccccctactgcccccgggaccccggaggacggcgaagcggagatggtttaatgccatgccgcttcccctactgcccccccagctcccggcggacggagacgggtgaatccctcaccgctaccccctactgcgcctcgggtctcgggacgggagacggacgggtcaatgactcacctcgtaccctagcccccagcagcccaggcggatgggtcatcatcatcctcctcctcctcttccccctccgcccgactcattttatccattcacatttgagcctggcacatcggacaccaaacacacacacacccaaacgctcaatcatcccctcattctcgacccccttcctaaattctcgacccccgtgagaccccgtcctctttgcatcacaaaagcaatggggcaggggtttaatgttttgccttccataaacattttgttaggcattgaattttaaaatttttcgagtcttaatgcactaatttaataagtatttaaaagttacgaaattttatttacttttttttaaattttatcgatattctcgaattatttaattgattaaaattcctttgattcgctgaacccatttattaattctcgagtcccagtttattttagtactcccattctcgagcaaaagctaaataataccagtaaatggagtgttcgattctttactcccgggatttgattggaattaaattttgtttaatctcttattttctctgctcaattttaatgaaaatccttggctttttcgacagccaagtttagctgcaaccgatctgattaaaaggcacaaaaatgatcaaaaataatgctgatcaccattccatgtcctttaaaagctccattgttgtcatttgttgttgtttttggggtttgtatacttagagcaaagaaatccaattccttccgatcactttggtcagatctctggctgtgtgttgaacacgatctgccgatatatcgcgctcttcgcacttcaagcaatgatcaaataaatgatcaattagtggtgagcatggaccggaccaggacaagggcagaatttaaatggaaaccggaaattttgagcaattcgggatcagattcggggtcggtgaagccagaatgggctttttccaggtcctgttccgggttcatttatctaaaaataccttgatcaggatcaagatctcgggaaaatcctgacaagattctgttcatgcccgatcaataattttcaaggacacctgctaaattttgtcctgattttttttttgcaaaagtaacataatccaagtgtccgggaaacaagttcttagtccaggccagatgtgtccaacccatgactctttgtctaaagtagtatggaatttaaaaaaaatccggtcctaatagctttatttaattaatcataattagtggccttttcccctccccctccaactcatttactaattatcataatttaaaagaattgttgtgctttaagtattcatatttattattatctcacccttttccaacccatccacccaatccattaattaattgattttgcccgttgggtaaaattgtgcaaatgggggcgcgggatgggctgtgtaatgtgtgtgaccctctctcattttcccccgtttccatcgttggttggcgcattatttgggcttgaatgccttcgaggctgggttttattccaccccccccccccactaattacccttccgtgccccagggtccgttcacacatttaatgatcaaaaatttgtgggattattattttggtaattttccgatgaggattagccatagctgagcatatttaattcattcatcagagcttccatgtgtcctggtttttaagcgttgcccttatttagagaggccgaatctttaggaattaaaaatttttgggattaaatcttatatttgaggcctattttcgttaatttttaaaaaatgggagctgaattatctcaaataaatttggttatataaaatcgaaagtttgactattgagccgtttttttaagtcaaaccttggcattttgatgtcaaaattttcaatagttttaattttaaaatttaattctgtatatggaattatttataatttatggattaaataaaacttcgaacagcttaaatttcattcctaaataaacaatccaatttttctatggttttcatcactttgcaatttgatttcccagagatttttgtccttaaaactaagaacaattttaccgtaaatatgatccagaacacagaagaagtgtaccttaatttttcaggtttaggggtaaaaaaaaattactaaaaacgtaatttaaaaaacaactattttcctaaaaaaaaatccaagaaaatcaaacatggccaaggttcaatatttttttacaacgttcacccaagctctaatttccactcaaaactttcataattgggggcccaacattttttgagctatacaaccaaaagtggcctccgtcccggccaaaataaaacaatgggccgcagttaaatttgttgtggcgttttgtatagtcggccaatattcaatttcatccgcgcttttccaccggcggaagaagccgggcgcggtgcgtaaataattcatggcccttctccaccggcaagttggggaggggaggcacaaaattcttacttattttggccacaactcgaaccgccttggccccaagttaattattagtcattcaacagtctatttatggatttttaaaggctctatttcatgggaaaatggcaatcagaaactaaaattcccatgctaacaattttcgggagtcataattatggtaccaaaaaattttgcggacatcggattacgtcaaagcctagaccacacaaaaaaaaccccatggcttttctcgtctcgaaactcgaggggccaatcaagacttttctcgaaactataaaaacaagatcacgactggacccaagataagtaagacctccaacccaaaattttctcgaaaccaaggccaagactgatcagtcccccacaaaaataaaaggaagatcgggtcccaagattcaagatcatgatcacaaaaaaccaagacttttctcgagttgtgaccctagtccaagactctcgaacaccattattatttttgtttccatatattattcct

SEQ ID NO: 11883 - DNA, 1502 bp, Heterodera glycines
  misc_feature (1423)..(1423): n is a, c, g, or t
  misc_feature (1475)..(1475): n is a, c, g, or t
tcaaaattatattgtgtgcacaataagaaaaaaattccaattttttatttatttgcctggcattctatgtaatttgatttttatttatttattggcattttgtgacgaaaaaggggaaaaacaaagttcccacggcgacttatgctaaaatgccggggttttagcacatgctgaattgaaattatgtatattcacatctagccattttttaatgctctccgaatcaaatcaaataaatgatttttaaatgagggtcggggcttaaccctagtattttgaaagaattttcagactaccaaaattcccaatctccaagaaaatttagaaatttttttcaatttttctaagccttttcatcaaatttttaaatttcttcctttttttctctaccgtatattctctaattatcgccccgtctctattaatcaccccgtctccaattatccctcctttctgaggaggttgaaaaataatctcccccggggcgataattatagaatatacggtaaatgttttccccatccctttttgaattttcttcctttttctatttactgtatattgaaataatgtacagtaaccgtaatggactctacagtatgtaaatatattttctttgaacatcatttatttccaattgtcaaagcactatttaacaatatatggtccattattgagtcccaaaattcttcgtttcatgggcacaaacattgttggcttcggagttaccacccattggcagcaaaatcccaccgcaagccaaaagcaaacagaacgccaaaggacgcgcgaaaataaatatttagggaaaatgcgaaaattcaatgagccgcgcatttagtctgtctgctgaacaaatagtaataaaataatggaataaattgcatttaaaaaattgtttatggaagagaaagcaagctgatggatgccaaaaatttccggtatttcgcaaaaaatttaggaaatcaagaatcagaggcttaaaataaaaaccaaaatttcaaggttcaaaaaatggtaatttaccgtagaaattgaaaaaatatcgtaccttttttgtaaaccttgagattaaaaagatgtgatcagacagatcaacaatcacttcttagatcagcgatgataacaacagatcagtcattctatcaaagcccttaattgattaggtcgagtttttaaggcgcgaaaggtgacctgatcaaatggatccaaatcattgaaagcgtttaaaaggtgattgatcagaccaattctcgaacccaatcaattcaaagcatatttctcgaaaaagcctcctaaactggacccttctacagattaaacgcaaatgattaaattgtaattttaatttaatttaattttttttttaaatttaaaattattatttttaatttccacgaaaatttcaaaatttctccggctnaaaaatcaatgcaaataataaaaaattattttttaaatttcatggaaatttncaaaattatccaacatttaaattgatc

SEQ ID NO: 11884 - DNA, 3707 bp, Heterodera glycines
cttttcttttccaccaaccgatcgatgaaactggagtcgtagaagaacgctgctgcttttgcagctgtgccacgtcaccattgtccacgggagttgcgtccctcggcggcgccactgccttcacaacttcagcaggcggcgctgtcttctcaactgtttcctcatcttgcttgaattgatatttctcgacgatcacgtccacgtaaagaagttccatagaggcgagtgcataagccaaatcgtcgtcgtcggcgagggtaacccagtcgctctctgcattaagtgttgtgcaacaataccgaacatgacatgaattaaaatttacaagcaaaaaaacaaccccaactactaatttgaaaaaagtaagtgattagtgggaaccccaccgatgtcattcgtccccaataccacatgacctattttccgttacacttaagctacataatttattgttataaaaccttggtcgcggtatttgagtttgatggcattcgcatccttaatatcgaaataacgctgcatcttcgttaccaagtcattcaggctaatgtcgttactgtgatggatccaattcttcctaatatccgacccgaaacgagccttcagcgtggtcttattcattgtatcggaataaattctaaaaacttttcagtatttaatattccaacagaaattgtaaattattagaattcaattgtcattatgtaattatgggaaacaagttgattgtcgttgattagtgaattaattgggctggtaaaccaaaaaatgaggagcgaaagaaaagttttaaaaacgaggcgattgacgtgtcgtgtcacaacagagacaaattggcgttttgttctttaattgattcaaataaaatcaaatagtatttcaactccaactagaaaagtacaccagcatttttaatctgtttatcgacaaaattaagagcattttacaccgaagtcacactaaccacaatcagcacaacatttaattaagaaattaaaaatgaaacaatataattgatattgtaaaagtaaaaagatcgaaaaaatatcgagaataccaaccattgcaagcatttaattccataaatcgaaattaaaaaataataaaggtttttccatgattgactgcattaaattcaaaagcgtcgtgtgccaccattgctcacaatcagtaacgcgtcgctccccactgctgctgctgtggtggcggcacgccgccaggaactgcggttgaaggctgaccccagccacccccttaaaaagaaattgttttcacagtttcaaatgaagaaacaaccaattgcgtcctgttgtggtttatctccgtaggcgccactggccgcgggaccaccgccggccgcgccgccacctccccatgcgcccgcttgctgcggtccccaggaagcacctccttgctggccccatccttgcgccgctgcgccccactgcccctgctcagcagctgcagtacccgccgcaggaagcggcccagcgggcgcttgtggtggtgcaccgccccacgaagcggctgctggaggtccttgtccatagccgccataccctcctccataaccacctgtaaaaaggatattttaatctagtaaaacatatgccaatttgaaatggtccttttgtggcgatgtccgaagccttaccccattggggcgggggtggcccccagcccggctgaggcgggccgtagccgccaccgtactgtgcgtaggcaggcgggggtggaccgtaaccaccgccacgtcccccgtactgcggtggcacacctgaaaccaatgaaccagcaaataaatgcaatgacgcttgggtctggaaaacctcgtgaacgcatccctcgctccattctgtctctgtcgtgctgttgtgccttttgcatttcttcgcggctaagcgcctttttaacgtcacaacgataaccgccgatcatatgagacttgaggagtacgcatctgaaattttttcacattttgacgggatttctcatgactaactcacttatctacagggtcgtaatcgtcgaatgtgacaaaagcgaaaccgcgcgctttgttagtgtttttgtcctgtattatctccacctataattttcaatatgcgaagtaaactcgcgaataggaatgaaaactgacctttgcgacggggccaaactcagtaaaataatgcatgaacgattcttcgtcgtgttcatctcggacacccgaaacgtaaagccgtttagtggacacattggactcggcttttgctgattgttcacgaggaacctgatatgagaagaaaattggcagattccaatggaatgataatgaatgaaatacggatttagtaataaagaaaaagggcattctttcatcataaatgaaaaactgaccgctcgtttcgggtcaacgactttgccgtcgattgtgtgtggacgcgcggacatcgccgcatcaacctcaaggaacataatacctcaaaataaacaattcgctaaacactagaacctcgtcggctgtttgaaacgaaacaaaaccaaagccgcgcgaccgctttgtttgtgcgtcacgcatcacaatgcaatcgacgagcattccgaattgggaatagaaagcatgcagtgactcgtcggttgtatttagtgacagactaaaacgacaaaacagtatgtaacaatcataaaacattttattgacagacccgccaatgaacagttttcggaactgctccggctcgagacttcccgacttgccgctccgctggtgcgatcggtcgatgccattttccttcaattatcaaaggaacccggggatttaaattgtcaatgaaataaaaattaccgttaaatacgattaattattttaaagcgtgagagtcttcatcaaaagtgtttctcgaaattcgttaccattcaaaccaaaatcattttcccatttcgatggcgactcccccgcttaagtgttgttatcccacctcaactaacccatgtttaacttacttccttcttaacctcaaccattttgtcaggccgttgctgaactctgaagaatcaatacctaaccaaagagtagtaactatggaccaaatagtaactgagtttttatctaaattgggaatggcaaaactatatgctaattgtaagtgaaacttttaagaaaacctgcacaaaacacaacaattataaattaattattgtaatgacaaattcaggtcagagacgaaactttaacgggaaatgagcgaagctaaccactaccgctaacagctaaaaatgggtggtgaaacatatcgtaattatgtaggacgaatgaactgaactcccttctaactggacgaacctagaacaaatgtaaaagtacgattagccaaaggccaacacaaataaaaacattaaaacaaacctcccaaaatgaaggccatagaaagtcggcaagaaaggcaaccaatgagaagcaccgattgcactgactcgcaattaataatgacagtatgagtgaacagaacacccgtttagggagggtaattgttaaaagtaaaaaacctaaatttgtgatcgtactttttaggggaatccggcgatgataaaagcaaaagtaatgaaatttcagtattcaatcaatgacagataaagatgttaaaaaataatactaaagataaatctcgtttttatctgacaatagcaataacggagtctacaaaaaaaacatttgggtcctaaaa

SEQ ID NO: 11885 - DNA, 3048 bp, Heterodera glycines
gtttttggaagcgaccaacacaaagcgatgggagccgagcaaagccattccatttatgttcgaccagtcgttaggtggacaagaatttcttaaattcagaaaaacgcaaaaatttgttgttgtttttttagctaaggtcgacaaacaatcggttcgaaaagcgatcgtcgaaattcagtcgaagacctgcttgaagttcaaagaagtgaaggtcaaacccacgggttcgcatctgtactacaccaaaatcgccaatccgacgttgtgagttcggctccgccccttccttggccaaatccttcctttttagctgtgggctcagttacgtcggccgggtgcagccggccaaccccatttacctcagttttatgtgcggaaaccccgctggggtggccgtccacgagacaatgcacgccctgggcttccaacacgagcagctccgcttcgaccgcgaccagttcatcaccatccaatgggaaaatgtgaatccgcagcagttggacttcttcaccatgtcggacgttaccaaattctcaaggtgatcccccgcagagtccgtgggagaggccaaaggcattcccaaatgaatgcttattcgaatcgtagctacggaatcaaatacgactacggctccatcatgcaatatgcgagcacaattgcttcaagtgccccgggcaaaaagacaatggtggccaaattgaagccgaccgaaaatgaacggctaatgggacagcgggaaggactgtccctttcggacgtggaagcggtgaagaaaatgtactgccaaccgagtgagagggaaagggcggcacacggacaaactaatcaatcaactaattacgcccaaatttgggcctttgttgctcaatttaaattaatcatctaaatatccctactgtaaccagcaacaattatttgttaaggttgtgacgacaaaataatcttttgtggcatttgggcgacgatgaatttgtgtgagttcagttgaaaatgattatctcaaaatattttatgctttcacatttggcgattattgcttaaggcgacccgcgaatgtggcggagagcggtggtgcacgcgtggattgtggaaaactgccaaaaatcatgcaataaatgcggggagaaagtgcaatcggtcaaagggcaggcggccattttaaagttggccaattgacgcggaaagcgacacaaaataacttttgaatggcattcattgcctttgttctcactccgtttggtgcttttgcttttcccttttttctttttcatatccaacattcgcaattgtctcttttgctcctttcgccccctcccctcctctccgtgttttcctttctctcttcctccttttcttccatcattccgtcctttctcaattccttgccaattgttctgttttcttttccatctttcgccgttacttttgccttcgcctcctttttgaccttaaatggaatggcaatgcttttgaaatgcattttaaattgaacggacaaagtgtcggagaaggacaacgacccaaacaattgctgaggcgacgaaaagtgtggcaatgaaaatgcgattgggctgaggctttttgtgctcaatgatagttcgagtcgtataataagaaaagactccaaatgaacgaaatatttccaaaaagggagcaaatttcctgaaaaatgatttccgacgcaataaaaatgccaaatttcccactttttgtcgaagaaagcgccgaaagactgcactaaaaggaaaccatttttacgaatgttttttgactttttgtcaaaggacttgtgcaaatgaagaaggcgattttcagtgtgaagtccaaatagcccaactgagccctgtcgtattcgaagtggaggaaaatgcaaaggagcagcagaaaatgggcgaggcaataggccttaagccaaacggaaagggacgggtcgtacttttggacaggcaattgcacctgaattagtgaagggttgggagggattagcacagggaacgaaaaataatgagaagccaaatacaaatgggagaagaaaagccatttgaatggaaattcaccgggggaactccgaaagagtggtcatccaacgaagtccagtggaagaagtggcgaatctgaggacaaaaggctgagcaaatcggaaaagtacacagattgccctgctaaacgcacttttgttccagggaaccaacccggagggaagaaaagcgccttcactttgtccgtccatttggggaacactttttgccccttttcgtcctttaagcgccatttgtcgcacaacaattccttgagagtgtgaaactaaaaacgaacgaaaactgattagaagcacaattggaagccgacaattcaggcctggagccacagctgatcaaagcttcgctcgggacggatcagcccgtagaccgggggctcttccttgcgctcggcctcgaaagtgcggaacatccggtcccaaatgatcaaaacaccttccgaatattaaaacagcagttagtacaagtgcttttttcaccgaccaccaaagttacggtcgatacagtatgcctggaaagggaatactcattaatttgctgctggagagagtggcaaagtgcggacattgcgtccgtggtgcacgcggtggtgggacggagtgttgaacacaaagccaagggggccgagagaaccgagcagggaagtgtgcatccaaaactggaagatttcggagaaatagcgatggacgaggaaaatggacggagggatgagaaaggcctgcattggaaggacaatggaagtgattagcagaccaatgaacgaatatgcatgaataatgaatgacacgggcgaacacctgcaaaatatcatacgccgccagtcccgcgtcctgtggaaaaacgtttaacggtaatagcacccgagcgtcggactttgtcagcccgatggacctgaatcgcagcttggcgaagagcggttgagaagttgtaatactcgcttgagtggtgaatggtgtgaaagcccctaaaaaaagccgaattctgtgcagagagaaagtgagttcagtcg

SEQ ID NO: 11886 - DNA, 2454 bp, Heterodera glycines
ccaatgcctgattaaaattcgtaataacgacaaccacttctgccttttctacgcactgcaggcaacaatggtcgccaaaacgtgcaattggcctcgctggaagtttttcgactatgtgaacgacagaaaaggacagcagggacaactccatcatgatgcggttgagctcatgcagcaggttaatgcaccaatggatttggttggctacgacgcggacacatttgtgcctcacgtcgttgactactggaacaacacgcagcgacaacaccgctttgctgtgttcatctttggatcgttgggacagtataagccactctacaagtacattgacaacacctacgacacaccattgctgctatatttcaatgaggaccatttcgatggtgtgcagaagcagggcggtctgttcggtcaaccgtactgtttggagtgtgaacgaccttacgataaaatgtcaaggcacaacaaatcttgtaaggcgcattgtgtgatgtgctcacgtgttggaccgcagtttccgtgtcagccaacggatggattcgtcaaggaatgctctaaatgctataaaaggttccgaaactacgactgctaccagcatcatcttcattccaacttttgtatgcggtcaaagatgtgcaaagattgcggtgctgtttgggatgtagcagataacaaaagaaatggcagaaaggggcatgtgtgtggcgagaattattgtgggctatgcaacaactaccacaacactgagcggggatgctacattcaacccattgagccgaaacaacatactccctatcgtattgttgcgtttgacgtggagacaatgcagcatacgttcattggggaatctgaacaacggaaccatttgcctaattttattgctgcgaaagtaatatgcccgggatgcatcgagaatggagactggcaaagaggaacaaaagggtgtgaggtgtgcgggccaaacagaacggtcgccttttgccaacgccgcttcacagaaacaacagtcgacaagcaagtggtcgcagacaatcctttggaggaatttgtcgattggttagtcttccaactcccgctgaagtacgacacttatgtttattcgcactttggtggccgcttcgatatggtgttggttttccgtgaacttttccggcggggattcaatccgagcatgttgaggaagggcaataagctgtatgaaatgaaagtgggcaagcagaagaaacgcaatccaaacgtggtgttccgagactcgtataatttgatgccctgcgctttggctgaacttgtcccatccttcggcttggatgtcgaagacaagccattcttcccgcacatggcaaaccaaccggataactacggaaagcagatataccccacgcctgaagactacttggccgatgggatgatgccggataaacgacaaaaattcaacgtctggtatgaacaacatcagcataaacccttcctcctcgacgaggcgttggcaagctactgcacaaacgacgttgaaattttaaaggcagcgctggtagcgtttcggatggaattctttgatgtgtctcggagggaagaaggcattgtagcggaaagggcacacgaaggaattaaacggcgaaattttggggtgcacccaaagagacgaacttcagcgcaccgacacatccaatcactgaattcgcgacctaacaacaaaattcactaaactgccaacatctccaaaacttatggctggaacatctcaatcgctgtccacaaaacagcaaaagcctatggaaaaccataaaagaccttggcaacgaaagcaaagtgcataacaccattttgattttcaacaacaagcaagccctatttcgacaactctaaatcggcctctcttctcaatgaattagtagcgaaccgtcttttcgtaattctttttattttacttacattagtgaagaaaactgagttctgtacaaaatggcataagtaatgtaaaggcaaatttaaacacttctttgttttgtttttattgggtgtattcggagtcaatgaatttggcgattgtgttcagttggatgttggaagtgccttcataaatagtccctgaaattggcaaaaattaaggaatttgccttgttattaaagaccgattttgcagtccctgtagtatttttcaatgggaaattctttggtgaaaccaactccgcccattagttcgatgcatttgctcgtcactttcgtggccacattcgaagagaataatttggaaattgccgcttcttttatgtaaggcaaattcgattccttcagacgcgcggcattgtacacaagcaaacgggtggcctcaatatcgcatgccaagtcggcaagttggtgttggacagcctaaagaatcccatccgtaattcaaaatgtttttatcgcctaagtaacgatggaagtcgatgatccgttgtccaaattgttttc

SEQ ID NO: 11887 - DNA, 2026 bp, Heterodera glycines
ttcccccccccccggcgatgtcgtcattttgcacccgttcaatttaacacgccaaaaaacaattcattagcaatcgattcatttattcattgatgtattttattaaacatgtagctttttttcatatgtacatattttacaagtttttgtaatttcatttttcccaaatttcagtctcccgcactgaattttaacgcccatacgccctcctcatccaccgaactgtccgcctcggccgaccagcagcagtaccaaagatggcctggtaaaaggagattcccatttttggcacttttccgtccgaatttttcattttttttccacccaatattttacattagatcgctcttttttctgaatcaagcattgatcctttcaggcgatcgatctggcccatcgccggcaccgcccgcttcgtcggcttccggcgccatccctccgccggtgctcgtctcaccgcattactctctgcctccgcacattcaacagcaataccaggtcagtcctccgggatttcggggcgttcaaaaatgtgctacaaaaagttttccaattttaaatgtgccggtgattaactttttgcgtttcccttccagcaacatcatttgggtgctccaggtggtggcggtggaggctttttctacgcgcatcaacagctgacaccgcccgtggcccctggccaacactcgccgggccagcaacggcactacgcaccgccgccgccacaaatgctccatcccggcatgatgtatcaccaccatcagcagcagcaacaggcacaacagcagcagcagcacatggcatcgccttatcaccagcagcaacaacaatacggagcagtacagcatcagcaacatcaacaggcaatggcagcggcggcggcggcgtattgggcacggacaaacggacagcagcaacaacaacaacaacaaatgccaaccccaccggcacaggttggacggacgggatgggatggaaatgacggcaaatctcaaaaacgagatataatttccctgtcgttcccccactcattttcttttgttcaggatgttggtggtggtgccgtgcctggcgcgtccacctcggctcggcacacgccgcagccttcgtcagtgccaccgcccaatccatcgcccgtcgcttctgccggcccaccgcagcagccggtggttcagtccagtccatctgtaacagctgcgacttcgtcggctccgggcaccgcgtacgatgaatgcggcatggccgacgtcggtactaccgactcggcgcagcgaccacggtcacggcaacagcagcagcaacaacaacaggctgtacatctacaacaacaacaacaaccgccgcaacaccacccgaacgctccgccgcagcaggcgatgatgctcacaccgcaggcggccgctgcccatttgcgttacgcgtccgccgtgccgccttcgcccggcatgatgatgatggtcggcccaccagggggaggaccaccgctgtcccatgggctgcccccgcaacagcagcaacaacatgcgtacgcaccgccgatgggcccgccgccgcatccctcgccgcacatggcgatgccgccgatgcaccaccatcattacgcgacggcgcaagggatgccgcctccgttcccgggtctgtcgtccggcagttttcccccacaattcataggtgtgcgagagggagggagggggccgggtaagaaaaaatggggggggggactttgaaatatgcattttcgagttggtcgtccgcttatctccccgcttccttcaggtcatcctccccctcatcctggcatgtatttccatcccggcgctccgctcggctccgccggtgccgtccaccatccctccgcttccgccgccattgggcaccccggtcctccaccgcctgcgtccggcggcggtggcctcgtcaatgggcgtgaagcaggcccagcgggaggcggtcgaaaagttggtgatgcaactggcaaacaccaagcaagcagttgaccgccgaagttggtgcacgagcgacgcct

SEQ ID NO: 11888 - DNA, 1269 bp, Heterodera glycines
catgggcatgaagcaggcccagcgggaggcggtcgaaaagttggtgatgcaactggcaaacaccaagcagcagtgaccgccgagttggtgcacgagcgacgcctgttcttcgagaagttggtgctgctcaacgaacagcagggcgaagtgctcagcggaccgccgcaggtgtccaagtcgacggtggacttgttctcgttgtacttcgcggtcaaaaagaagggcggctttgaaaaggtgagcgagcgccaacctccgcaattaattagttggttattccaatgtcgaaatttctaaattaaagacacgcgttaattggcaagcctgaccagacaaaagggaagaatcctctgacatattttatttattttttcctaattttttcgaatgtttttttctcaaaatttaattccgcgggtaaaaaagaaattgtttagtatactagtaaatgagcatggttaagggttttaggccaaatttgaaaaaatcagaaaattactagtaaagatttaggtaattctaagtaacttgaaaatttggcgctaaaaaagcccttaaaagtgctcacaatcagcagatttttaattaaaaaaatgtcatttgagaggtgaaatttccctcttccgatatggccataattgggcaaaatgggaacacatcaacactaaaatttccaaaaattaggcaggatttcgtgtcaaaagataccatttgaatgactacattctccgccttttgcagaccatcaaggacaaagtgtggaagcacatgtgcgtggaggccaacgcggacatgcaggagtcgtcggcggccggctttcagttgcgcaagcattaccagaagtacttgctgaagttggagtgcatggagacgggacagaacgccaaggagttggtggagtttgcggagaagcagaagaagaagaaaaaggagaaggagccgagcagcggcggcgggggcagcgcaagcgccgcggggccctctacgccgtcctccgccaaagacgagcagcagcaacagcacggcggcactgggaggccacggggcgagcaaagccgggacggaacgaatgcagcaacaacggcgccacagaggggaggagggacaggcacggcaagcagtacagcggcggcgacaacggcaacaacgcagcaaaacgctgcgggaggggcaccaccacaacaacagcagttcagcggagcgccaggaacagcgcaaggtaaagcaaaacagtagtaccagaaatggggacacatagttcactgaact

SEQ ID NO: 11889 - DNA, 1415 bp, Heterodera glycines
accaactctttacgttcagccagtaactcattttaaaggggtcccaaatctcatttttaagaaaacttaatttttactagcaattatttagtaaatgaaatacatttgcttttattgtcgaattatgggaacattgcatttttagagtgatttaattggatttctaagcaattaaaaagctgaattattttagccagccacaataaagtcgaacaatggaaaggcggagatgccgatgagtttcagctcaagttccacttcgactttgcattcgcagccattcaaaactttggtttgtcatttcttttgttcattttggcattctgtttggactgacttttaggctttaccttccgatgttgagcttttagcagcgaaaaagcaagcaacaaaagcgcatgagaacagttatttgggggctgttcttcgcggtgagaaaaagatgaaacgatttgtgaggagttgtgggggacaggttggcattctcatggcgaaacattaaaaatggaaggtgaactgcacactttgccaccatccttttaaggtgtgggaggactcatccatggccgagtgggacccaaatgattttcgaattttttgtggtgaccttggtaacgaagtttctgacgaattacttgccaaggtacttgtttttggtttaactctactacaattaataattacatttttaaaaattatattttttaaatcatgatgggcaagatcacgaaagattctccaatcgaactttttccccttttttgttccttttttgaatcgtatgtagcgggataattaatcatatttttggttaaatttttgcttaaatgtaatatatgaagtggacatttacaaactttcaggcttttcggaaatacccaagcttccagaaagcgaaggtggtccgtgacagcaggacgaacaaatccaaaggctttgggttcgtctccttcaaacaccaagacgtaatttctgggaaaaagatgtttatttgccacttcattggttaaggactttattcgtgcaatgaaagaaatggacgggaaatacgtcgggaacagaccaataaaattacgaaagagcaattggaaggaacgcaatttggacatcgtcaaaaagaaaaacaaggccaagaagaagctcggattgttgtgattttagtggaaaattgtaaaaggaattgcgaggggaaaagaacaaattggtggttttaacttgacacttttaagcgatcgtccgcatttgaaatccagtcttcctcaattttaatgaaattttttaattacttttctaaaagttcattgcttttaaacagggtggccaagtgtgcttatttcagcattacgtgcttattttgtgcttatttttgggttagaaaataaaaatgaaaattttgaatgacagttttgacttat

SEQ ID NO: 11890 - DNA, 1365 bp, Heterodera glycines
cttctctcgagttctttgttatgaccatttgacgtgtctttttggtcgttggacatccattcggttgtgttttgatgaacatattcgggatgcgtgaaaaaagctcgccgctcgttttgccttgacttcgtccccttctgccgattctccccggcccatagccactttccctttctctgtccatcaaatccgtcgatgtcctccatcggcttccgttgacatcgttttccaccgtcgccttttgctctctgttcatttccgtgttgggacttccgtttgagaaacaatggccaattgtcgtgggccaatcggtgggacattccgtcggagggggcggcggtttgctggacggaggcggcagccgtcgcgcggaggcggacggcgccagtgtccgtcgccatttgtatggcgcttcagcgatttcgctctctgccactgccaattcctcgtataaatcgttggatgggacgaagtcggcggaggaacgccacacaaagtcgggggagaagtggcgatttgggggaaaacggagggccaccgactgacgcggcggcgtggcaaaagtcggcgaacggacagagacatttgacctaacaaaaaaagggggatgggcgaaggattgccatggcacggcttacccgactttgttgtcggattcggcaacagcaaactgacggaaggaccattcgttggcattttgagcggaggggacgctggacacagtttcggtggacgaacgacacgaaaaattggcatcggaggacggcgaagagaggaagttgaagtggggctggggacgaacggagtggggcggcacggcactcggcggagtatttcggcggagagcgctaaatgggaattggaattgccaatcggtcgtatcaaaatcagttctgacggcccaattttggattaacattcaaaatcgggaaaatgaaactgctgctaaatccaatgttagccttagctttgttgatttatgactgcgaatgtacaaattcaatttggcaacgacaattcccccgggcccattcaatttgtttcctttctctgtgcttttccttgctttgtccattggccattttcatggaaaaatggagagaatttcgcccatcgcccgcctaattctgcaacagtgccgggttgggttgaagctgagtatcggacgcattgtaaatatttaattattttggaacgtccattcattcgctcatttccttccactcaattgcctttctttttagggctgatggatgggaaatggtgggaaaagtggacagtcagaaaagggagtgagtgaggaagactgatgggaggaagagaagcaaaagtattgggggaagaggaaggacagtgcatcagata

SEQ ID NO: 11891 - DNA, 3666 bp, Heterodera glycines
cgcagtcgcttgtgctccttcccatcctccacgatggattcgtctatctctgtaatttggtgctccgtctcgtcaatacgccgttctatccaatggatttctttgcgcaaatgtctgtccctttcctccaccgttttgaactgcacaacaatgattaaatgcactgctcgcactttcccggtccctcacctgttcacgatggccctgcttggcatacaattcgcgacacttttgctcgccaatgcgaatgtccgagcccagctgactctcctcctctagcaactgttcaaattggggctgcaactgttccaattggccctccttctccgcgatgtcgcgtttcagttgttgcagcgaatgttccgcaatttcgcgcccgcttctctcacggtctacgtcttcggccaagtccctaatggccaactccaactgcgtcttgcgctccataaggtccgtctgctccttgagcagggtggcacgctcttccttcacgcctttgtaatgcgtctccaatcgacggatttgcatctccgcctcttggattgacattttggcttggatcagcttcgtctccaccttaagtgcttcgttttatttgtattgctggacagttgcaaattgccgacttcgttttgctgtgcgtttattcgctctctatgcgaagtcagtttctcgtttttgctcctcgcctctttgatttccaaatcgtaaattgtgtactcaattgcccttaatattcagtagtaaatcctcaccatacaccgcaatcgcaccttcgcattttgtcccacttttggtactccttcaagtcctctttctcctcctccaattttttcaaccgttcattaatataaccgagcaattgaacactcttctcaattttcgtctgagtttcatgcaatattttggtgctttcatcctttttctcatcaaaaacgcgtgtcccggccacctttaataaaaatgcaattaatccaatgtcatcgtgtaaagcacgcacctccttaatgagcttaagtctgtacggatcagacgcggttgctaattcagtgattttcccctgcttgacaatgtaatagggatttgagcgcgaaaatccggcagattccatcagattgacaatctttataattcgagtttataaaattcaaattttcatggatcaaattcggctcacctcagtccgtgtcactggtttgttgtcgatgaaaaattggtccttcttctggccgacctgtcgcattatccgaacttcgtcactgtcagttggtattcgtctgtccgtgttgtcaaagacaatttcgacctttgcaattggagctctgcttccgaccccctcatgcaaaaaggcatttttgtcctgcagagtcaatgaggaaaaatcgttgctcagcacaaattgaattgcagtaaaaaagttgcttttgccgctcccatttcggcccacaacaacattgtgtttgggtgaaaaattgcgaactgttgtcaactctttgtaactgcgaaaaccagtgatattcacttctttgatgtacatttttgtatattctgttagaaaataattaaaatttatgtaaataatttgataggttcactgcggtaatagttaagatggttgccctttaaaaagtcattcaaaacaagtttctaggggtttccgagtcgctgatcacgattctggcatccatttcgctcaatttcgaacctcgaacccgaattcgaacaaaaagtcgaaacttcaaatttcgctttttttcgtctaaaaactagagtgcagcgggaccgggacctggacacggacaactgagtaccaaggtcccggttttttcccggttttcccagccaaaaagtcccggtttttcaaccagaaaaggtcccggtcccggttaagcctaaaattcccggtcccgcttttttcgcttttaaaaacgctttttttcgccgggaaaaatttgtgattttagtacgatttgttaacagatttttgtccaaaaaatgaccaaattttgccataaattttatatttttttgtaaaatagtgacattaggccataaaattttaaaattatgagtttgtttaagaaatcagaacaaattttggtcgctaccccaaaatcagaacatttctgacaaatcagaacttttttattttatcagatttggacccttcaaatcagaacatttctgataaatcagaacagatcgcatccctggtttaatttaataaaaatgaatggcgaagttcgtagaccaaataaaattgtcaggtgcctatgttcattttttaaaattctttttatttggattttaattattttgacaggtataagccaattgatccgatggtacagccagtgacagcggaagacagcattccggagtatatgaacgtgttggggatggtcttttcgatgatgggtcttatgatgagagtacggaataagcatttaattacttttctacaaagaattccaaattctttaattaactcattgtttatttatttagctcaaatggtgttcttgggtggctcttatttgctcttgcgttagttttgccaatatgcgcgcgtccgatgacactaaacaggtggtcagctcgttcatgctcagcatttcggccgtggtaattttccagctttgatgcatgattcttattgttagacctacacattcaattccaattcaggtgatgtcctatctgcagaatccaacgccaattgtgccgccatgggcgtaaaaaataaatgcattgaattgttcagttcaaattatgttattctatcggtttcatttacatctcttattatttgcctgaaatacccgttgttcagcccaaaaatggattttttggttccgtgtcaaattgagttaaccctcataaaatatctaaaaaaacgtgtcctttaattctttgtatttgccttattgatgttgagtcggagtcctgaaatggaagaagaacgtttgcccattgtttcgatggtaattgtcgcggacaaaagtcgtgcgccggccaatttcattacggtgttttccgattatttctttaatttttcatttccccgtttttccaacagctaacgaaaacttacgacgacggaagtgacgccgatttatggaaggatgggttcggtttcgggttgttcaaccgttccgttcgttatatcgctgtaagccgacacatcgccgaaacgccggtttgtccgtctgtctgctgcttaaattgtgtgctttttagcccagcggtttggaagtgttgactgacgtggccgtcatttcggacaaagaagcagttccgtccagcttcgtctgcttggacttcaccgttgacaccagtgcgtcggtcgccttccatagttcttccttcactttttttgccctttagaagaacgcgccctgaagaagaaatatttgtgcgcccgcttcactcctcggactgatgcaattgacgcggtgaccaatttgattgttttggcgcggtcgcggaggccccccaaaggatacactttggccgggttggtttttcaattaactatttacttcaactaatagtagtaattagctgttctccccatctttacgtttgccttttcagtgacattgacggcatggccatttgtttccgagtgtccataatccccgaaagttatggacgacttacgca

SEQ ID NO: 11892 - DNA, 4325 bp, Heterodera glycines
ttgttggcaccgcacagcgaaatcaaatggtcagaaatgtcagcttggcaattccgtccgacccagcatggacattgcccaaatcaccgacatgtcggatttgatcctgaatttattaattttttcgctattttaaatatttctatgcaaatataaaaggaaagcatttcccacaaccatattattgaaaagaccggtgaatgaaatagaacctgcggtccgccgtgcgttttgtttgttggattgaaatgcgggccggcggaagtgcacccgttggacaaatcgccgtaggctaaacagataaataactttagactgcaagcattaatttaattaccatggacatggaagccgtgaagaccaggctcaagaccactgatttcgccctgaactgacacgggcgaaccttccttgtcctggaaatatacaaagttatacttactaaaaaatattaggaaattttaatgacttgagtgaaagtaatcatccctttcacggatgggtccgcatcaccgacgagcacgcagacagcctttttcggatcagccatttttcaggaattcggtaaaaattaacaattaaaacttaaaaaacttatttaaagaaaaccaagacagtaaaaaaacattgatttgaatcattgtacaattttgctttataacatgaactaagcaaagttaaaacggcgctacaaaaaagtagcggccattcaagatccaaagggttgtactttctttatttaaatgtaagcattatcttgttttctgatattattatgtaccttattcagaactttatggttaattgattggactcggtctttgatcatgaatttgacataattaaaccaattcctttcatggacggtaaaaaaggaaaaaagcggcaaaaaataattggcgtaataaacaaaatgccaatgcatttaaaaagaatacaaagtctttttctttgatcaaattcctaatcagtggtcaaagcttccaattccacttcaaataagttaaatcgtgtgtttttagaaataattaaataaaaaataatatttataaaatttacgaaaatttcagtgtcttattttcgttgtttagtttgatcacatttgatcacctataactcgcttcattccccactaaactgaacaattttggtatcaatcgaatactaaatacctaaccacaatacatatatattgtatacaagaaaaatctataaattagacatttaaaatgacaaaaataatttaaaggaatactacaaatagcagacaattcaaaggatccatcacttctcaacaattcatttgcgctaatcactttggtcggaagtgccatcgataagactaaaaccaaaaaatggaaatttacaatttaattgtgttttttactgacttgtctccgatttcttcagtattaattgcaatgtgaaacatattcaattggccccatattccaactcaatcgcttcattctcccattttatccatttgttctcatctcgggaaattggacgacggacaagcaaaaaatgtttgtttttaacgggcgaagctcggtttagcactcgaagccgaaggcaaagcccgaagccctattttactcgaagtcgaagttcgaaactcaaaaaccccgaagttttcgaagccgaagtttcgcccgacccttcttcggatttccttgcgcgaatcgcgacttctcttcacccttatcgcatcgccaatctcacaagtctcttctcttcttcctcttccttttcctcctcttcttccaatacctttcaatttctctgtcgtttgtattcttcgccaatctttcgtccttggcctcttttcctcttttcgtcttctcccgacaatctttctctctcatcatagtattttgttttgctttttgggattaatccgttaaagaatctcatattttgaggatttctctcgacattcttcgatggccaaatgaatttcaattttaaagagcaattaaaaatctctcacaattttttattccgtatttttgattagttgatcaatgccttcttccgttttgctaatcacttcccattggactccgcttggcctctcgttggcccatcgtttggtgccttcttcggcggctaatcacaacaacaaattggtcgtactttgtccatactctgccaggggagtgccgcgttctttgttggaagaggcggagcgcggcactgtgcaaattgaattcggacagcacgggaacgaacgatcagtggccaaattggtccaacagcatcaggtggcacggggcaacacaaaaatgatgcaatcagttgagaatgaatgcttctataggccaattatacaaaaaatctgtcttggattggaccagatcaatcattgtgtaaaaatacttcattcctgcccagattcgtgccgtatttctgttgctcgccgacgacgagtgccaaccgccaaactccgaggcaattgcgacacgcacgcgtgccctgctgcgtccgctatgcgctctgctcgaatgcctgcggcaatgtgactctccgccaacgctttgcgttgttgcggacggacaaatgcgtgacaatgaactcttggaatgcttttagtcgtctaaattgcctttaattgtttagtgttttgtgactcaattagccgtaatctcttggggcatttaagtttaattttggtccaaatcattatcttcgttcggcacattcccggctgatcaattaaacatccaatgctaacatcccacgctttgattgtaaattatttgtttaattttcagttcgattcgttcgccgaaggacatccgcagccgcgcgcggtcgtccaatgcgccagcgaagcgtccgcgcggttttcttccgtttgtgcgcttttgcacgcgttcgctgtcaggtgcggatacaaaattagagaggggattttttttgtaaattgccctctaatgatccaaaatgcctcaaaactttttgccattcaaatggtcgctgtggcattccgcctccctttttatcgaagtattggcatttgtaaaaaaataattaattaatgacagtatccttctttaacagttaccgtctgaacatgcaaattatactgatcgaagaacgcttggacagtgcgcataaaagggacaaagcggcagaatttgtgatggaaaaggcggagaaagagggcgaaaaggcgccaatccattcgtttaaaatgagcggacattgtgacggagaggccgtagaaaaggaggaggaggagtacggtagcaaacaggtggaataccgtagtttagcaatatgtaagcgacatagaagaaaatttaggagagatagtctaacaatggaagtatgtgcattaatgaaggtttatgggcaggcacagtattaaataattgtggaggagttacggtagtataagtaaaacaagacgcatagatactgtatttgaattcatttgcctggactacagtagtatcctgcccaatcagctgatcccttgtgctccgtacgctcgtctgttgctcttcggcacgccctctgccattcaaagtgcgcaattggctcagctccgtgcgctcgtccccggcgcgcaactggccgtggccaactgtcggcctggcctggacacggacgaagcggtggaggaggaaattgttgccctgggggcaagccatctggtatttgtccatggggcaggtgagacggggaaatggcatttcacagaaaataaattaatgacataattgccagacggagaaacgcgcgacgcatgggaagcgggcggaccggcgaatttgcgggagaatgtgcgcgtcaacctgttcaggtaaagccctggttgaatccatttaaattttgtccattttcagcccgtggctgctctccaacatttgtgaccgttttggcattgtgttcatcgaatttgatggggagggcaaaaactgttgcaattcggtaaatgtttttgtttgttcgagactctcgaattttctaattttcgaacattttttttaagaatgggaaagtgccgacaaatgctgacgctttacaaatgagtcgctacgcggtggtgcgccactttggtgaaaagctttgccaaatgaaagtccacttggaataataagaaaatgagggcaaagaaaaatgaatccatttatcatacagtaatatggaatttacaaaaaaagcaaaatgatactgtaaccaacaatttatagaaaaaataaaaaaattacatttgttgccacatttgacattatgcacaaaaaacaattagcattcagtgaaaaaaaatgaaagaaaaaaataggaaaaagaaagagagagaagagagagat

SEQ ID NO: 11893 - DNA, 3075 bp, Heterodera glycines
  misc_feature (28)..(28): n is a, c, g, or t
  misc_feature (49)..(50): n is a, c, g, or t
  misc_feature (131)..(131): n is a, c, g, or t
  misc_feature (184)..(184): n is a, c, g, or t
  misc_feature (3063)..(3063): n is a, c, g, or t
atagtatgggattagtgtaataatattnatgtataaaaaaaagctattnntgattattcatttgagatactttgtaataatttatcaccaaaaagatagcctccttaaaatgtcggtggtgggccttatcnccgaaatggaaatttttttatttgcataaaaaaatcattttttcgaatttttntaagccgattttcggtttcggttaaatcggccgtgacctatcttttaaatagattttttaaattttttgtttttttaattagctcttcttcaattcatttaataatcacttttattaacaggcgaagttgaaaatgaaaattcccgtttttattgagtaattattgccaagaacgttcccggatcgcttctttatcaagaaaaacttcacatgattagccatgttcaactaccacaaaaaaagagtttagccatttctattgaatccttttcaaattttttttaattttggccatttccttggcgtttcgtctctgctgcggctcctctcacatttatgggcgcaacgcgtgtcgttctgtccaccgcggccaacgaaagtgttgcccagttgttgttgttgttgttgttgttgttgttgaaagcatttgaccctcccatttgtcgttgctgaggcttaaaaaggcgtggaaaatgctgacgcaacgcattttgatagtcggagctaaaaacggcaccaaaaattggcaaatataaagattaattagtgagcaatcagaatttttttgagttttttatttggccttaattggttttgtaaaattcatgttttttcatacggtaattgcatttaatttataattttttttcgacctataaatgtacaaaaccggcgcattggcggccatcgcaatcgctgaaaacatcgaagagagaaaagtgatgtaagcaaaattggcaattttccaaagagacgaaatgatacgaatcacaatcgcaaaaaaatagccaaaactgatgatgaaaatgagcatggacagagaggtgagtattttcattgtgaaagtgccattccctgaaatttgtaaaacaatttgcaattttaatgatgattaaatgttgtgccttttacattttgttcggtttctgcgcacaatgacccaaatgatcgcatagcaaaggatgcacaaagtgaccacaacgagcgacacaacaaacaaaattgtcccaattccgccttggtacgaatcggaggggttcaagcagatgacagtgctaaaattgtatgaactttcatacagtcagaatgcttaaaacagaaaatgtctcgattatgaccgagagtctcgaggcgctcctcgccccaatgatttaaccctaaaagtttaatttgactttttcttacggtgagtcagccgtcaattgcggtaaagcggtgtagcagaagtacacaatgcaaccggcgtacagaatgcacagtgttagcagggagcccaaatagttgaactctttgttatggcgtgtgtgcctacagtaggaaaaagccattggacagtaatcgggaactttccggcacacttttctcaaaaaaatatttaaattgttcttccatttttggcacttaccatgcgggaatgagcacactcaatagccggtcaaaagcaattgccaaggttgagaccataaacaaattgccaaaaaacattgggaccaattcccaccagaagcatatttggactggcattaagctgtgattgaagacggagatgctcatgaatggcataaaaatgaccagacagaaagcattgaatgcgatcaaaaagttgcacgacccttgcaaatcgctgaatttgttggttttcaatcaaaatgagtattttaaatggttcattcttactaagtgttcactgctacatacagtaagcttgcattgaacagaatgccaatgatggcaatgagaaatcgtatgactatcaatgccacaaatgccaaagggacgccgtcgcgttgaaaaatggcgtaattcttaaaaaaataaaatgtaattaaaatttactttaataactgttggcttacattgtttcttgatgagtcatttaagtacaaatccgaaatcattgttatataaacttgattttttgcctgaacttaaaatgtttattgtgaaaatgtgcttttttaaacgagttaattatttttgtttaaacataattctcaaaagcaggcataagatatttgtaaaactttatcaaaaaattttcaaaaatttttttcctttatactccattttttaatgtaaagactcaatgcaaaagagagaaaaaattgggctaacaaacaatttaatgagccaattaattgttaattaagcatttgagcttttgatttctcatgactcacagaagaaattcatgtaccaactttttttattactacgctaattaaaattttacgcttaatgccttagcgaagagttctgaaactctgaatatttattcggatttaacgaattaacaaagcattaaaagtaaaaatgtttaaaatttttagcaactgacaatgcctttgtcaattctcactttgcgccgtctttttttcaccatgtaacaaatcacaaaaaaaaagtacaaattttttcccatgcctttggcaccggcggaccgaaaattcaattaaaatttaggaattagaaacattgcattgtttgaatttttgacattaaaatccacacgattttcaaaaatttcggtggtgggcagacccttcgccgcacacaaaatttaccgcggtgaacagagaaaaaaaagtctccacaacgcttaaaaatttcttagactttttttcacataaattaaaaagggttattattttcaattcaataaatgctttcattaaaaaatgttaatttattaattggaaaaactaaattttcgcacggcaaaagacacaaataaaaaataaataaaattttatgtctgtgttagtcataaaagaaaaggcatatacataattaaaggcgtaatagaaaagaaatgtaatattccttgagaaaattcattcgcaataacacttaaggtgtaatataagttttgtaccaanatttttaaaata

SEQ ID NO: 11894 - DNA, 2648 bp, Heterodera glycines
  misc_feature (28)..(28): n is a, c, g, or t
  misc_feature (70)..(70): n is a, c, g, or t
aacccatgtaatgtttgaatgattaatnagttgcgctaacccacctaggtctctctctgtgtttttgggnttttcataaataattaatgagccagttaaagcccaatttgctggaattaacacaccggccgatttttcggccgaaaggtcacactgccaacgaaatttttattttcactaatattttcttgcttttttcaatttaaaaaactttgcgcgtcctttttcatttttcaattggttctacccaaaaggtttgcctataaattgggctgtgatggctcagaaaggcattaccaatcggcttcttcttctgctcacttccctcctaatttggtaaattaaatattcaatcgctttccctcattttggctttaatttgtccattttcagtgcttccctttgtccaaatgaccctcattagcaaatgttcgcttctcctccttttcgtcgcgcccttttcccatgcgtttttctccggctttgagtgagttcattacaaattttgtaatccgatgatcattgtcattgcttttctaatcatttggtcccctcaagggtttctcccaacgcggcacgtctccgtcggcagtgcggttgcggcgggtgccctcctccgcccagcggcggtggctctgtccaactcggcatcagctgcgactcgccgcgccctccaccgccccctccgtgctgcggttgtcagtcgtcttgcggctgcggtggcggcggtggcggcggatgtgagaattttcaaatttaaaactgagtagtgccaatctgatccggacaatttttgccattaggaaaattctcggcattttaaggtacagacggttttgtttagctttggaatttttccttttcgatttttacatttgttgcataaattaaattaattttcgattttttaaggtggcggcggttgcggcggcggtgccattaaacttacaattggctgcgactccccacgccctccgcctccccctccgtgctgcggttgcgggtgcggctgcggcggcggatgtgagttcatttggtgacaaattaagacaaactgaattaattggcatatttgcacaataattatacaataattctttcaatgaaaatccaaaaattacttttcattgctttcacatcgctttctcaaccaagaactctgactttgtgattttggctttttttggggtatattcgaattcgattgaccacgacattcctcgggggtcaattccctaatttaaatttgctattattattaaggtggtggtggcggttatggtgcaaatggcggcggcggctgcggcggttccattaagctgacaattggctgcgaaggcccaaaagccccgccaccgccccctccgtgctgcggttgcgggtgcggttgcggcgggtgccctcctccccccagcggcggtggctctgtccaactcggcatcagctgcgactcccctccgccccctccgtcctgcggctgtcagccctcgggcggctgcggttgcaatcgccgcaagcgcatggcttttctgcgccgcgccgttgctcagcgctctgttggccgtcattaagtgcaaaatgaagcttaattaggcactgcttattgatgacgtcaattgctgacccgaatgatccatttaattattaatattttagcatagaaatgattttaatttttagtgactcaatcgaatttagtattagtttttggaaaacaatccttttcaaatgtttatttaatgaataaattaatcactacaaattcggcgaaggttaaaagctattaaatttctttaaattgaaaaatttcttatttgatggatgcaattaagaactgtcatatttaagctaattggaaattaattttattcaaaaattctaataaaataaataatttctggcgatggtcattagaacggttaatattaatatttccacgagaaaaaaatccaaaagcctttccaataaattccgatgttttgagtcttttttctctctaaaatttatgaaacgaagatttgttcggaaatgactcattaaaatttaatggaaaaatgttcggattcattttgcatttacggaattgaattcgccgcctttcaatgactttttaaggtcattccgttaggctggcaccaaatggcgacaaataaaacaaaatgaatgcattgaatgaccttcaaaactcatgaatttaattgcaaaatcagccacaaatgaaaaaaatgcaattaaatgtacaattaggcaaattgttgggtttaattatttggcagaaaaattggccaagcaatgaaaaggtgcaaaaatagcaaaagagaacttgcaaaaaatattgccatctctgggcaagcctattattactagagatcgacttttgaggcatatgccttttttctgcgcactagtttcgatatattaaacataaataacgcattttccacttggtttgaggcttctaggttgacttttattatgcctttttttgcctttttcgggattttcgtgccttaaatgcattttttggcatttttcccttttggtgcctttttggcgttttttccgaaacattccataaaaatgaaataaaattgggaaaatacacccctaagaaatgacttgaaaaattttcagaaaatacaccccct

SEQ ID NO: 11895 - DNA, 1983 bp, Heterodera glycines
ccatccgaaaacttggcatttgagaggtgttttcggcaaacttcggcaatttcctggttggcaattttctgctgacttttgctttcataacatccaattagctcatatgaccttaattaggggttaatttaattttaatttccatttttttaactttttgcaatttgtctctgtcggcacttttccacacgcttccattttgtcttttatttccattttttcgtcgtaattttttggcaattgtccaattttgtactttcttaggtattgtttacaggcaatgccgaatagtgcggcggaaacgttcagcgaaaattgggcaatttcagctggaaaatcaatttggacgcaatttgtgccgaaatgcttcacagtagaatcccgtggagtgaacagattcggctaaaaaatttttaatttaatttaatttgagggaaatgattacagcagatgaagttccgacatttgggtttgtttttgtatgggtttccaaggtggtcagttcagatgaattttcaatttcagactagaaaaaggcattatttttaaatttttaaaaaatgaaaacgattacaacgcgtggtgtttcagttttgaatggagttacaattttcagctttgtttttggcggagttgcccgagtggttgtggaagtttgaattccccgagtggtcaattttcgacttttttcttcggtagcctacaaaattaaaatttttattaaaaaaaattcttaatacattcaaatctcagttgttttgtagccatgggttctattccccccgtagccaaccatttttttcattcaaaatattcaaatttatttttttaagtttcactttaccatcgttttgcaagtgttcacgtcatttgttccaatggcacaatgaatttcaaatgcgacaattccaagcgctgcgccgtcgaaatcattcaaaaaaacaccgaacggaagagcattttggaactcgtccaatttagcggaagaggaactcattaacgctaatgactcgatcaatttaaattaaatgcttagaacaactgtaccctttgtgatgtcaatgtccaaaaagtcggagccgtgcacaaaaaatttagagcctatttccacggataaatcctttctaaaattaaatttgctttttaattttaaattaaatcactcacccaaaagaggacttaaggatcagcccgttttccttctgttcgatcattagcgcgtgccatcccttcgtgccgtctgtgccaacacatctttcagccaattgcttatttccatttcgccttttgaacacttttcccactttccatccaaaattatcggccattttgctcttgtagcaaatcagcagactaattaatgcgggaacattaattaattatcaccaaaattatttgcaaattactttttggctttctttcccattctgatcattccgtttccattcaattcgcactttttccatttgtcctcggcaattctaaagaaacagaaagcatttgaaaattgatttgaattcatttaattacccttcaccgatggcatttgtcgccagaacaacaaaaaagaacgaaaagcaaattaaattcattttgattttgggaaaggaataaatttgctgaaaatgggtaaatgattagtaaattagtgggtttattggctttgcaatcgcttaaaaagccaaaaaagccaatagaaacggtgactcatcgtttattggctttatctttctgctgatcggaattttgtccattccatattcacaaatcagtgcagtgtttgggagagaagcgaatgccttttttcattttatgtagacaaaacggacaattttatccactttcacattgaatcatcatcataaaaatatttagaaagatttgtgcataattattgtataaagtaaagtaaagtaaaaatatttttaaaatggacgatttattagtaatttcaaaaattattttaagtccaattaaatttaa

SEQ ID NO: 11896 - DNA, 3688 bp, Heterodera glycines
  misc_feature (3607)..(3607): n is a, c, g, or t
  misc_feature (3635)..(3635): n is a, c, g, or t
ttcaaaaaaaccccgaacggaaagagcattttggaacttgggccaatttaggaggaagagggaattcattaacaattaagactcgatcattaaatttaaatttgtgtcgaactgtaccctttgtgatgttaatgtccaaaaaagtcggagcctggaataaaaaaattcggggtccatttccacggggtaaatcatttctaaaattaaatttgtttttaatttaaaattaaatcactcacccaaaagaggacttaaggatcagaccattttgcccgttttccttctgttcgatcattagcgcgtgccatcccttcgtgccgtctgtgccaacacatctttcagccaattgcttattcaaattgcgccttttgaacacttttcccactttccatccaaaattatcggccaatttgctctggtagcagatcagcagactaattaatgagggaaaattaattaattatcaccaaaattatttgcaaattactttttaacgtcctttcccattctgatcattccgttcaattcgcactttttccatttgtcctcggcaattctaaagaaacagaaagcatttgaaaattgatttgcattcatttaattacccttcaccgatggcatttgtcgccagaacaacaaaaaagagcgaaaagcaaattaaattcattttgattttgggaaaggaataaatttgctgaaaatgggtaaaatgattggtaaattagtgggtttagctggctttgcaaacgcttaaaaagccaaaaaagccaatagaaacggtgactcatcgtttattggctttatctttctgctgatcggaattttgtccattccatattcacaaatcagtgcagtgtttgggagagaagcgattcaaatgcctttttttcattttatgtggacaaaacggacaattttatccactttcacattgaaccatcgctaccacaaaaatatttaggaagaatttatgcataattattatataaagtaaaataaaatgatttaaaaaaaatcgtttatttattaaaatatactatcagatttgtgatataaagtataaaatatttctaaataaatggtcgatttattagtagggatgcgatttttagtcaaatgcttaaaattctgcgcacttattgcagagataagcacgaaaaacacattttaattaaattaattttttttcagaaattatggaaaaataacaaaatttgacccaaataaaattatattaaaagatggataaaaaattttaaattatacaattaagctttttgaaaaaatcgagttgataaaatatttaatttgtttattttagtcggcgttcgatcaaaattttttcagatcagagcagaatttttttagataaacttttgtggtcaaaatcagaaaaaaacactacaaaaaaggagcgtaaggtgatttcaaaggacataaggagacaatttttgaatttaaaggacttttcaaaagggagccggaaaatgcgacaccgagagaaagtttttcatttcaagaaaatgcgacactaagaaaatgcgacaccaaacttagatttttaaaaatattttaaagtcttgaaaatgagcatcaaaaccaaaaaagacttgttaattgtgggtaagttgattttgtaaggtaataaaggaaaagcatcttgaagcaccagaattagcttatgagtctttaaaaattttcatttgcttagaaagagtttcttttcatcaagagcttttgagtggccaactttatatatttttattgcgaaaattcattttaatttttttgaacaaaagaaataaaaaaacgatgctgtatagttttaagggctgccactgatcaatgtttcattttttacgggtgtatttaaaatgttcaggtcaattcatatatatttcctggactgtggtggcccgaaacgcacgaaaaacatgtttttagcttggttagaagcttctaggatggatttctatatccatatttcgcgatttatgtccatattttggcatttttccaaaaacctattagaacggcccccaacagctaaattggccgttttgacccctaaagacctacaatcaggtccaaaagttttacaccaaaaaatattttagtgaaaaacccgattttcttaaaaaaaggaatggtggcaataatgttttgtttatgccaaaagaaacgccaattagtgcactaattaattcccaaaacttccccgataactctcttagttgacaagaaaattttttcatgacccgaacaaccccctttttggcggtgcaaaagtaatgcaccaaaagatgtatgcacgattaattcaattttttatgagattttgatgctgatcaaacagtcttttggaccaacatgatcagaacacttcttcatggtgatctggaaagtcaaaaatagcttgaaatcggaaaaattttcaaaaaaaattctaggggattgaaaaagttttctggaagtttttgggaatttattagtgcattaattggcgtttcatttggcaacatttttgagaaaatcgagtttttcactaaaatattttttggtgtaatactttttcacttgactgtaaaaaatttccgaaacggacattttttagcaaaatttttaaaaaatattgattaaatttagatttttcttaaaaaattggttaatttatgtcaaaaataaacaaaaaagcgaaaatttcgcttttcaggttgatttttcgctaaaatgagcaaattttaatctgtatcatgtatatatcttctaaaatgatttttaatacaatatgcagccatttttgaaagttctactttgcgtttagctgatttgaagattttgagaattcataccttaaatttggaaaaatttatgtccatatttttgccattttatgtccatacccgctcccatccgatgaaagcataaatttagcgcgctatggccctcagccaaagaaatgaatttgcttagaaataaaaaattttaaaaaatttgttcctgaaaaagtctgattagtattgttcacgcttttcgaaattcccatttccatcccactcaacattaagttggttgcttttatgtcaatttagatgaccttaaaacaaaaagcatcggcggagcaccgcgaaaaagcaaaaacaatttaagaaagagttggaagaggcggcgaagggaaccgacaattgggcgtgcacggctaccatgaggctgcgcatgtagcctacatctggctgcacaaaaacaatggggactggttttacgatgtcggttcagtgacgggtcttatgattaagctaaaagagaaatttgcaggccgtgctcgatagccccacagagggcacaacaacgtattatgagggcattaattgcacgatcgagcaatttcaatgccggttggagcggaagctggccggcgtggctgccgagtgctttttttgcgaacacacgcagtacgacgcaggaatgggaagaatttgaaggagaacagggtgaagagggacatgatgatgagggtgaggaaaaggcggaagatgatgatgagtagggtcgggatttctagtgaaaaaactttttttgctcaattgttttgaagaaaggagctcanaaaacccatttctacattaaaatttttncgcttggacgtcacttttcgtcactagaaatcactattttagcgtttcgtcac

SEQ ID NO: 11897 - DNA, 1130 bp, Heterodera glycines
  misc_feature (46)..(47): n is a, c, g, or t
  misc_feature (53)..(53): n is a, c, g, or t
  misc_feature (57)..(57): n is a, c, g, or t
  misc_feature (59)..(59): n is a, c, g, or t
  misc_feature (66)..(67): n is a, c, g, or t
  misc_feature (71)..(71): n is a, c, g, or t
  misc_feature (73)..(73): n is a, c, g, or t
  misc_feature (88)..(88): n is a, c, g, or t
  misc_feature (90)..(90): n is a, c, g, or t
  misc_feature (92)..(92): n is a, c, g, or t
  misc_feature (101)..(101): n is a, c, g, or t
  misc_feature (112)..(113): n is a, c, g, or t
  misc_feature (122)..(123): n is a, c, g, or t
  misc_feature (125)..(125): n is a, c, g, or t
  misc_feature (127)..(129): n is a, c, g, or t
  misc_feature (133)..(135): n is a, c, g, or t
  misc_feature (137)..(138): n is a, c, g, or t
  misc_feature (140)..(144): n is a, c, g, or t
  misc_feature (147)..(147): n is a, c, g, or t
  misc_feature (150)..(150): n is a, c, g, or t
  misc_feature (162)..(162): n is a, c, g, or t
  misc_feature (164)..(167): n is a, c, g, or t
  misc_feature (170)..(170): n is a, c, g, or t
  misc_feature (175)..(175): n is a, c, g, or t
  misc_feature (177)..(178): n is a, c, g, or t
  misc_feature (184)..(185): n is a, c, g, or t
  misc_feature (189)..(189): n is a, c, g, or t
  misc_feature (195)..(197): n is a, c, g, or t
  misc_feature (200)..(201): n is a, c, g, or t
  misc_feature (204)..(205): n is a, c, g, or t
  misc_feature (208)..(208): n is a, c, g, or t
tttttatttctagcatttgtacgtaataagtcgtttttttgaaaanncccatncaananggagagnncggncncccctttaaaaaagngnancgaagggcncaaaaaacgcnngcgccggcnncnannnacannnannannnnnaanagncctctaaaaaangnnnnggncgaananngaacannggcncgcggnnncannaanncangcaataattaatccgttcattagaaaaattccaaatttacacggggcggtttcaagacgttctctcaattgcattaacttgccaacctttaataatataacccttcttgttgatctcgtattataaaatccaaaatatttgacaaactttttcaaaaacccatgcatattttcatggaataaatgaatataatttttagaatctttttgctaccaaaaaataaaaatcctttatactaacggtgtttataagttacagctccaatttcattataagaattgcatttcggaaatttgaaccgactctcaaaatgattaagtttgtttcttcacagtttgggtttggaatcagttcaaagcaaacaattcataatgttctataagctttctgtttcccagtaacaattacgaatgtataggaatttaattgtctggagttccgaaaaagtttaaacttgcacagagtacggctccatgtgatttttatttctagcatttgtacgtaataagtcgattgctttaaaattcccattcaatatggagagttcgttttccaaatcaaaaaagtgtatcgaatggctcaaaaaacgcttgcgcctgcttctatttacatttattatttttaatagtcctttaaaaaatgttttggtcgaatattgaacattggctcgctgtttcataaattcatgcaataattaatccgttaatgagaaaaattccaaatttacacggggcggtttcaagacgttctctcaattgcattaacttgccaacctttaataatataacccttcttgttgatctcgtattataaaatccaaaatatttgacaaactttttcaaaaacccatgcatattttcatggaataaatgaatataaatttcaatctttttgctaccaaaaataaaaaatctttatacta

SEQ ID NO: 11898 - DNA, 3254 bp, Heterodera glycines
  misc_feature (31)..(31): n is a, c, g, or t
  misc_feature (94)..(94): n is a, c, g, or t
  misc_feature (175)..(175): n is a, c, g, or t
agatatttgttataaatcgaaaaatcccatntagtcacgatgaacggcaacctaaatgcttttccgaagacaatcctcaaaacgattcgccccngaacgaggaaaatggaaatatacaagaaaatacgccgccgaacgatcagtaatccacgagcgatgtgagccttaaaccatngcataagttggggggagaggttgagcccaaaatgtcgcttccgaaacatcgcagccaaaaccggttatggtgaattactgatttttcaaaaaaagttttccaaaaggtcgctgaaaatttttttcgctaggacaaaaaatcgcttgatagttattgatgtgatgaaaaattatagcattttttgccaatgcttataaaaaaactaaaaaggttacgtatgctaaaatttttaaaaattgaataaaattttttatttatttcgaggttattctagaaccagaaaaattagagaattgaataaatcatggtttatacggcttgcttaaggcctacaagcggattttaagactaactgctttctattatcctacaaaatttcaaaaaatttcaattgtttcaagaagttatgaccaaaaatgttcatgaaaatttgcttttttgagtttctcaagtcataacttttttgagttaaggtccatttataaatttattaaataaacaacatcaaatgaaacataatttaaaataattaaaacatattttaaacttaacttaactaaatctttgattttaatatccgggcaaaaatggacaacaaaaatgatattattgcaaattttctgacacgaaaaatagataaattcatgccaatttcaaacgttttaaattttcctcaagtgtttccgtgtggcacattgctgccgtttcttcgtgcgcattcgaatagagttcagacgatctattaaatatatttaaaatgataataaagttattttaaaaatctttgcgcacaaatatcgttcgcccgagcttggcaacacagtgacgatcagtttattggcattttgtttttgccgcgctatttgcagagaggcgaaaacattggcaccgctggaaatgcctaaatagaaattaaatattttaaaatatttttatttaatttgaatttaccacacaaaaggccctcctccgcggccatccgtcgtgccattgcaattgcgtcatccgagtgaacttgcacaattccgccgccgtttttgtacatgtgcgtatccaacacggcgggcactgtgcccgtgccgaggccttgaattcgatgctttgctccttcgggacggcatccactgagcacggcactctccgccggctcaacggcgtaaaactgcaatatttgtgaatgcaattttgctatccgaataattaaatgtttgaattttgcaccaatataatccctatataaaacccatatctgattactagggatgggatttttatgtgctaaaaatcctgaaatatgtaataaaatatgtgctaaaaaatgccaaaatatgtgctaaaatatgtgttaaaaattggaaaaatcaagtgtctttttgcataaaaattcccaaaaatctcattctttatcatttttcgcccatacaacgcaaatcaaatacatttcaaagtgtttggggtaaaattgatctttttttgattaatcatttttataaattgaaagttccagcagagaattttgaaatccaatgacgaattaatgaattcgattttgttactttctacattcgaaaaaaaattttaaaaatttgaaaattctataagaattgtgaaaaagttgatttttacggtgtatttttcaattttcttgtattttcattgcaaatttttctcaaaaatgccaaaaccccgaaatatgtgccatatgtttttatgtgccaaaatgccaaaatatgtgtttttatgtttttataagtcgctctaaatcgaaaattgttcggagaaaatgttatttttgggcttctctcgccataactaagccgcagaaaaaatatgtaaaaacataaaaatcccatccctactgattacaattctttgtattacattgagtagatttatgggataaaaattaataaataatttttttaaatgttatttgataaatgcatttatagtttttctataagaaccgttatgcttggattcttttcacgcaaataacgcccaacgcctgtcatcttaataatgaaaaaacaacaaataatttattaaaatattttcatttattaccgttcctccggtgccaattccaaatacgcaaatgtccacttttccctgcgtttgatgccaaatttcaggccccgttgtccgatagtgaatttcggggttcgcctcattgcaaaactttaataaatttaattgaccaaattaataatttaatatttaaattttaaaacttgtgcctgcatgggaatgaaagaattgggaatttctcgtgccaattgttccgctcgctctacggcgccagtaaagcccaattttgggtctgtcagcaccaattcggcaccaagcgcacgcagcactgttctctaataaagtaataagaaataacacggcacttttgttgtcgggggtccccgaaaaaattccaatgggggggcttttttagagtttggaattagttgaaaaaatccaaaacccattgaagaagttttccacgacttgtgataaaacaaaaattgcaaaaccaaaggtcccccattgaattttttgggaggccatcagcagcaaaagtgccatttacactttaaccgaaaaaatttttataaattaaaaattaaatagagtattttctcactcgttcaattgtatatgacgaggacatcacagcaatgaaacgatagccacgaatggccgccatcgaggcgagtgcttcaattaattgacggatttattaatcattaacacaaattgattgctgattaattaatctttcatattaattaggaaaatagatattaattaatcattagcataaactggttgattattaataatcgttagcactaaaaggttatgatcacttaatgattgtgaaattgataattaattcattagaacaattaggtcaatgattaattaattattattgtgaccaatgcccgtgtttcctgccgtttgttcaattattgtgctgatccccggcttaattcggccttctttttccgctgcgtcgatcatagcgacgccaattctgtccttcactgagcccgaggggtttagccattccaattttactgct

SEQ ID NO: 11899 - DNA, 2096 bp, Heterodera glycines
attttcacaacactttgttagtcgcaataaacaccaggaagtgctgaaactgctcgaggattgccgtgaattgctcagcgaaacggagggtaccaaaatcaaatttcgctattaattttgttatttgttagtgtcatttcagcgtttttaccctttaagaggacaatgtacgcctctctgaacaggtcaacgttttgaaggaggaaattcgccgaatggaacggtgtaagaaaagagtcgaacatttgggcaacggcgtttgtccggagtacttcaaaaacattggtgactctcccattgggggcgccacgttttaacttttaaattccattttcagtgcttaaatttctggccccaccgaaagtgcgtgatgaacgtgtccaattgctgcccgtcctgcagacgattctccacttggacgccgtcgaattggaacaaatccgacgcttttgtactgcacaaacgccagatgagacggatgacggagaagaggagcaagacaatgaaacaaagagaaaagagattggggaagaaaacgacggggggtggacggcgtggattgggtggaagtgaaattggaagtgaaagtgacggagcccggaagtccagcaaaaattttttttcctctgaatgtttctctgttcagcactttctagtcgtgttctgttcttacatttttcatcaaaattccgggctccggtgatgacgaatagtcggggagatgggtgctaatggacggagtgcgaaagtattaaaaatgaatgggaagatgtgataaatattatttctatttatttttatctgctttgtcttcatcaattgactaacttacaattagtctgtttattgtacattatcatggaaaggctgtgttcaatcattaatttctttcttctatttcaattcaatttgtgtccgatttcaaaattccgagaaaactaattccaaatcaattgtttttagactgaggacttccattttctcgtgatcataattatcatgattttggatgtaaacttacatttttctgaaaaatttttatgttggtgttttttcaactgattagttaattttgcagccctaatcatgatttgttataacggtgcaatgccctgtgttctttcacttaaaaatgtatgtggtaaataaatattagactttgacaattcttttcaggtttcactggggtttataaccaactgcctatcaattcttggaccgcaaccaaaaaagacaaattaggcattgttcgaacatgaaaaatactgtacaaaaagtcggattgccagttttgttaataaaagtgcagttgaatcctcgcatgtatctgcttatacctaatctattttatattttatttgaaattactcattttcatttagagtaagtatttgtttcctcctcctcccactttttgccatgactgtccaacaacagcagcagccgtcctccactgccccccatgtgccgtcctcctccgcctcgtcgtccgttgccactgcaccgaaacgccaattccggccattggccgagtacagaaaggcactcgaagagttctcggcagagcgccagcagcagcgtgaagtgagtggggggggggggagggcgttggttgatgtggggacgagtcagcgaaacacgaccattcgacaaaacggtagcggactacttcagtctactcaaagtcaaataaagcaatgacgtggtaaaaatctacgtctcactcttcacctgcttggccatccgcgcccttcatttggaagtagcacgaagactactctgttgaagcattcctccgagcctttcggatattcacgggcagaagaggcataccatcacttatcatgtccgaccaaggtacaaacttcatgtctggagcaatagtcatcagagataactggaccgacgcgttagtgccggagtacatgcaacaactaatggctccaagcggaatcccgttggattttcaacacagcccacgccacttgaaaaggcgagatttgggaaatacttgtcggcatcaccaaatacgaactacaaaggacagtcagcagagaacttctcacattgtacaaggtcagcacactgctctgtga

SEQ ID NO: 11900 - DNA, 2438 bp, Heterodera glycines
ggtcagtcagctgaccccattcagaaccaaaagcggacaaaaaaaacaatgccaaatttcaaaagtttcaggttacaacggtgacggaaaacggaatgcgaataacgggtaaaaatggacgagaaaaaaaagggatgggaattgttatcaaaccgaataaattaaggcgctgatgaggaggaagaagcggaaaaggacgcgccaattcgagtggagagcaatttcattgtcagcgtaagcattgcggaaaataattgagtaattagaaaaagggtatttttaaaggtcgatgaaatggacgaaccattggcattgaaattggagagacaaaaccgaacggagaaaaaggaagcgatcggagagaatccaaagtgggggagcggagattatcgaccgagattataaatgaattcgaatttgcagcaaaacacaacgccaaattgacgaggcgcacaccgaaagttcggaagagacagagaagcagacgaaggccaaagaaagcgaagcgcaagaaaaacaatgagaaaaagccacactttctttgttttgcccttatttgatcggaaagggcataattaaacggaaatgctttaataaaatcaaattatgcaaatgccatctgaaaaatgagagggcgctgatctgaaataaggggggggcatgccccattttgagggcatttgaatgggattggagggaagggcgagcgacggattgccgagttggatcgaacccaaaaaaagtattaatggggaatgatagaaaaataaacaaattaaatgtatcatatttttatggccatacaaaaatttaagaacatttaaaagcatgaaaactgttcaaacttcgataagccaaaccacgcttgatatcatcggatagcccaaagatttctctattagttattttccaataaatttattattttaaagttagggacaaaaacttcgagtcttggttttttgcttatactttttgtgattgacaagatagtagaggatgatttgtagaactaccacttcaatgatgccaacagtgttaattcattaatttgatttatttgagtaaagaaaattaaaaaataattaaattaaatatttctatcactgatacttttttaagttcgattctttatcaaaaggaggtcgaacgggcatttttgaaggcttttaattgcgaaggaaaagcataacaattctcccgtggtctttgcttatttgtcaattggaataaattgcaaaatgtccttaaaattcggtcatttgtcctttcattcgttggccctttcgtcggccaatgaatttaatacgacggacttttggaggtctcttcgtcaatttgttttcgcatataaacacagaataaaaggcacaaagttggcccactcatccaaattaatgtcccaaaacagcaaaaacaggggcaattggcaatgggcggagacatttccaacgccggaggcaatgaattgcctaagggacactttcactttggaattttaactttagctttattgcatttgataatttatatttttggattattttgacaagaagataaaccgcaatattaaattcccttgggtggccttttggccttttcgctgggcattagccacagaagaaaggattattaagccgaagaagttgattgtgggcagagaagcgaaaggctgtgtctgccgtcctctgcgtgtctgccctgcctcgggcatttcgtccgtccgttgtctttggcattttgcgccagctgatgcgctcacaggcgcctgagtgttttcagccgccgccaccgccgccccccgggggacggacatttggccacaaagtcgggggaagtgcttgcggcggcggcggcggtggcggggcttcgcccatgtcacccatttccgttttccttttccattttcatttggtgccattcatttttagcaaaacgaaaaaagcgggaaaaaatcaaccaaatcaaattccatggccatcaataagcagggaatggaattcatttttaaatggtttatttatttttgccctccaattgcattaattcccctctctttccccccaaagtgccgtcctttccctttctttccttttttatttattcagtttttcgtccttttataatttaatttaaaaagcactgaattatttatgccacttttcgagaatatttttgcacagtaagacctcaaaaattgaaggaatgggaaaagagacgcgtcagatgaggccaaggcaatgaaacacaaatggtgccgttctcttctgccggtgtctccgccacctttcgcccattggcacgcgaaatgggcaagtccaattaatttggcaaatttaaaatatattttaatttaattagtttctttttgttttttagttgcttgtcgcgactgccttttgcatttggctttttctcatcgttttggttgtggtgca

SEQ ID NO: 11901 - DNA, 1938 bp, Heterodera glycines
aaatcagaatgttctgatcttatagaattacaatgaaaaatcagaaagttctgattttgttttaattacaaagcaagaatcagaaagttctgaacttgtataattacaatgacaaaatcagaatattcggattttgctttaagaacaaagatagaaaatcagatgttctggtcttatagaattgcaataaaaaatcagatgttctgatcttatagaattacaatgaaaaatcataatgttctgattttgttttaattacaaagcaagaaatcagaaagttctgatcttatacaattacaacgaaaaatcagaatgttctaatcatgcatatataattacaatgacaaaatcagaatattcggattttgctttaagaacaaagatagaaaatcagatgttctggtcttatagaattgcaataaaaaatcagaatgttctgatcttatagaattacactgaaaaatcagaaagttctgattttgttttaattacaaagcaagaaatcagaaagttctgaacttgtataattacaatgacaaaatcagaatatgctgattttgctttaataacaaagatagaaaatcagatgttctggtttttccttaaatcagaaattctgatcttgtacaattacaatgataaaatcagaatgttctgatcttatagaattacaatgaaaaatcataatgttctgattttgttttaattacaaagcaagaaatcagaaagttctggtcttatagaattgcaataaaaaatcagaatgttctgattgctgttaaaagcccacataatgacattaaacactggtgttacaacagcggttattaccagggttcgcagatctgaggctttagcctcattttgtggttttttgataggccaatgaggctaaattttcaaaatgaggctttttgtggttttttgttaaattttccaaaaaaccttttttaatgaaaatctgctaaaaatatggtcaaaattctcaatttttcccccggcggcgcctatcggcaccgccggaccctaaaaatcctttattttcttaaaatttttgcttaaaattgcaaaatttggccatttttgtgggcaaattctgttaacaaatcacattaaaaattacaaaatttttcccggcaaaagcatcccaaatgtgctgctctaacggcacactcagctccaaaatggtgccccttctgtcaaaaatttgctttttagaacggagaaattcgagcacggaatggtcaatgtaagtgaaaggggggtaattaagtgctttaatccgccgaggggtgctgccccaactctgctgatttatcatcatcattttgttgccaattttcactgaaaatctgttaaaaaaatgatccgcagtgtcccaaaaaatttattttgttttgtcataaaaataggtcatttttggtgaaaatctgttaacaaattgcactaaaattttcaaaaaaaaattttcctgcggcgcctcttccggttcattggtcccgatttttaaataaaattctaaaaaaaatacatttataaggctaattcagccgctgagtacgaatctgaccaacttttcaaccagtttcgagtcccgaacccaaacattaaaaaaaaattcaaaaatttcaatttcatcaaatacacctaagcattgataaggtaataataatatattctgtaatagatccaaattttatcaaacgatgccccaaatgtgttttttccgaagttttcaaaatgatttaatttattattcacgtcttaagttatgtaccattatatcgacggcaccaataaaccaccggaaagattgccgatttttgacccccaaagctgattttgaaaaatttcagttggcaaccctagctttaatacacacaagattttaaaaagcaactatatatgaaggtcatcaaagcgaattttgttgggcag

SEQ ID NO: 11902 - DNA, 1824 bp, Heterodera glycines
catttcatggttgggtgccactttcacatgagatgttaatttgtgggtataaaatttgatttgaaaaaaacaaaatgccaaaaacgccaccaatttaggtaagtgatagtcgcaccatgggtcacataatttatgtagactgggtaattatctatatgggattattacatgtattcattttataggtagttgttatttaattggtcagtgtttccgtaaatcaatgtgccaatttgagtaaatttatggccaatgatgatgatgccattttgattccaaatagaacagtcgaacattaattttgcccatgggaaacactgagtggtattgcagagtgatcagcaggcagacaaagaaacaacacacactctgatcagagctaatcaaaatttttgggctttttctcgattttggattacaaattttgaatccgaatccaagaaaaagtgaaactaattgtgtctatgcaaaacattttttgtcttggtcagtcacaaaaagcactgcgatcaatgcgtgaaggaaatgatcacctctgatcagtcctcactggccccgattgatcagccttttctccaatatttgccctcgattgatcaaaaaaaaaaatctcacttacgcccattctctatctgatcaccattttccaatcgtctgtgcttgctgatcagcgtcagatcagtccctcaatgttgggcggtgtgatgtacggcaagtccttggcatgcttctgctcctcctgctgtggccgatattcgccgtggattttgcgtcgatcgcgtgcccgcttttgcacaaagaaaatggcaatgccggcgaccgcgcaaccaatctgtggggccacaaattttggaaacattcattataaaattaaataaaaattaatgatatgatatgatttaatttaataaattttgatcaaaaatggcaacaaaaggaaagggcaaatccaatttaggtgtcccctctattggcaatcttaaaattaaaaattttttaattttcaagtttaaatttgttagaggtttttttccaataaaaaaaccataaaaattttctttgaaaattattaaaaaaattgaaaataatgctgtaaaatgacaactctaaaaatatagaaaataaaaaatttcggctttctttaatgatttcacttcggttgaaaattaaattttcaaaatttaaaaattctcaaatttaaaaaaattgaataattatgattttatttttgttttcacagttttgaatgcctaatttttctttccctgaatcagcagtctcccgggtcccgactttttcctaaaaacctaaaaaataagatttttcgggagggaggggggggggggcgagaacacccgttcctcagttgtcccggtcctaatagggtaaaaatgaaattttccaccgtaaaactcagtaccaaggttgccgtgacgaccaaaatgatggtgtaaacagaaatgccgacgtcctcctcgtgtgatggcgaaatggttgttgcttttgttgttgtcgacgaattttgcgacaataatttttcccaactttcaagggtactgttttcaaccattttttttgatgatgcctccttttttgaacaaactttgattacaaaaatgggattttagtataagtgaaagaataatggaaaaatgaatacaaattgtgtacagtatattgagtaatgaatgaatagtactactgtaatatgccagagatgggacagaatttagagagcaaatattaacatttttttgtggcagttaaattcgggttttcaataaatttttgaaacctcggaatttgttttaagaaattttaggc

SEQ ID NO: 11903 - DNA, 1580 bp, Heterodera glycines
  misc_feature (176)..(176): n is a, c, g, or t
  misc_feature (207)..(207): n is a, c, g, or t
caatccgtcagtgggcaatccgtcaataggttattcataagcaaatttattttataagacacaaatttatttaaaaaccatggtacaattatttaagtcgctaaaaatgttgattaatattttgtaatattttataaaatttatgaaataatctttttaaagaatttggtcaattntagcaatgtaagtatatttattaaatacacnaatcatttcgcaaagatttttgatcattgctcaaaaaaattggacgaattgtccactaaacggggatgtccattactgacggattattccagtgacggtttgtccggactgcggaccccccgccgcccggcgtggagcgtcaaagtttttgttcaaaaatatcactgtgcatgaatgaattgaatgggtgtggaagtgatggattcaatgaatccaaaaaaaaaaaatggcgccggacaccgacaaaatgcggggagacattcattttcattcatcattcattcatcattgagctgctcttctgtgaatatgaatgaatgctgtttggggtgctttaatcgcactcgatagatcactcgggccgtaaatgcgacggcggcggctgtgatctccgtgctttttgtatggggaaaaatttgaataggacgaaaaaaaaattggtttttttaaaaacaaaacaaaatgatttttgcttgattctaatttgggtacatatatatcccacaggggtcttaattaacatttttatttaattggttagtcattaaaattcagtatgaaattttgaatgctgcgaatagagcagaggcatattaaatacggacaaaatgatcagttagaaaataacccctcacaatgggatgccaaaaaaatggacggagaagaacacaagtggcaattgatcagaaaagcctcaaagagcacaaaatgatcagtaaaaagcaagagagcattgtttagaaaaggcggcttaattgtgagtggtaggatgagaggcgttgaattcggggagtgatcagggaaaagcaagtgaccattgaccaaaaaagcctcaaggagcacaaagtgaccagcagaaaagcaattgatcattttgggagagagagagacattgaatgcaaaaagtgatcagagaaaaaccaatgatcactgatcagaaaaggcataattctaagtgggagagaggcgctgaattcggggagtgatcaggtgaccattgatcagaaatgcctcaaggagtatgaaatgatcagtcaagatgcaagaaagcattgatcagaaaaggcttaattgtaagtgatcagcacgcattgaattcggggagtgatcgggcagaagcatgtgtagtgaatgaccagtagagtgatcagcaccaaatgacgcctccgggggtgcgcagcactaagtgaattgaagtggcgcaaaaattttgccggctgttgaaaaatgatgacgcattataaaataaataacacttgagagagacggcaaatacaggaagaaaacacggatgacgacgaccactcgaaaaatatttcgcagattttgaggggtgtccgtccgtccgtccatcggacggggtgggggggggg

SEQ ID NO: 11904 - DNA, 1023 bp, Heterodera glycines
  misc_feature (1019)..(1019): n is a, c, g, or t
atggggcgattgtgtgacttacgtcacttgccaaaaatggaattctttatttaccgcatttaatttaaaaaataaaacttaccccgtgggaaaagcccgcaaaacatcccgtaattatctaattaaatcgaacatcatcaaatgcaaaataacatattcaacaaaatgctttttaattacttggacaatgctgaacagtcgcaatgtgtcctcgtcttcttttctgtctttccgggggataaaccaattaatcagtcccatgggagctgaaaatcattttcgttgtaatttgcttaaatgtattggtgattttcttcgcattttcttacagcattcgaatggctgtgaacgattattttcgaccattttttgctgcgttttttcaatcggactgatgggtactgtaagcacgcgggcatttgtcatcggtattacagtagccttcgatgtttcgtttttgctgtctattaaaaataaaattgcaaaaattactgaaaatgcatactttttttgatccatcgaatgagttttggtcgcaaaatgaacaaataaattaacattgcactaaatccgactccaatgcttattaacagagccaaccaaaagggaatgtgttcaagatgaagcactaaaagataattaagaaaatttaatttaaaaatatttgttttgaattagaaaaatgacaaaaatcaccttttgaaccttcaaaaacaaccataaaagtgtaaaaagtgaagcaaagaaaatagaaaattggcatcgttcgaaggccacatttgaacgggtttttctttaatgaaattaattaaatgccttaattaatcacattgtccaaattaacccttctaagcacagcaaaatcgatgcacatgtaaataattgaggaaattgagccggaaagaattggcgaaacgacccaagaagcagcaactttggacacctgtagaaaaaaggaattccataattcggttgcacttttaaaggcttggccaggtatttattttttggagaaaaanggga

SEQ ID NO: 11905 - DNA, 1923 bp, Heterodera glycines
ctatgatttaatacttatcaatgttttaccattttttccgtttttgttttcatccattttaatatttgatttccttatgtgggccttttcatcattcattcatttctgattttgcctaaatcaccatgctccaatggattccggcatttcccttcatcagcagagtgaagcccaatgttgagccgataatggcatgcgtggaagagattggaagccgaaaaatagtggccaaaagtaaccagcaggcacagccttagaaaaactttttgtaaaaaggacaaaatggccgctaatttaaaatgacaaattttgaaaattataaacaaaagcgaggaaaaattggttagcataatattttgtacggtaattcctagttaaaaattttttttctgtgagtttcggggtcgtttgattatgatctgacacctttcgactcaaaaccatgaaaacgaattaagacaacaagccaacatttgaaatctggcctttttgttcgacttcggttcggaaattctgaatcaatcgaaatgaatgtcatattattgagaaatgaccccaaaaaccattgaatgccatcccttcaaaatatgtcattttcaaacaagcgccaaaaatgcatgtgactgacccccgaggattgccacctgtccgaccagcaaatcctgcggcgctcctcggtacaattcaatctcgacaatacctttccgtacagtgtccacaacgttgtagccttagcaaacgcaaaagaaaataaaataaattccaaaataattattgaatttgttttatttttaatgaagagattgtccaaaaagctaatttcattcaaaattaatttttaaaacaacataaaaggtcaatgaattctttttgtacaaaattaatttgaaatttcattacccactaaaactgcgccggccgtttccataatcgtcgccattatctaaattattttaaatattttattttcaattcactttttattttacatttgcttttcgcagcgtcaacacttttgagccaaccaaagtgccaaatgcatttgccacgtcgttggcgcccatgccaaagccgagcaaaaatgagcacataaagccggcgatgactgtccacagaaattggtgctgaatttttggaaattaaattaaaaaattatatttatttttatttacttgaaaatcattgagcgataatattggaactgttgtcattaatagcaaaatttacaaataaaaaaatgaaaagaaataaacaattaaaagcgatacgaggaaaaaagactcaattaaaatatgaaaaatgtgaaaaaattaataattaaggaatttcgtcttttatcaacaaaaaggaaaatccaaaatcaatcaaaaaaaaaagactgcacttaattgacactcaattagcgatacttttgtcggtttcatcattataaatacaaatttgtgaatgattaaaaataacattgttttccattgatcagaaatcgttacaaatcaaacagtcggccaaaatagggaacaatcacaattttatacaatagaatggtgtaaataataacaaattgtgtaattgttcctttccgtcgttgacgcaattgggaggacgagttttaaaggaaattgacaaatttaataatcaaaacgagtgcgttaattattaaataaaaattgaaaatttatgggttaaaaaagcgaaaatataataatattgaaaacttaaaatgttgtgattggagtttttcagaactgtcgatgaaattgaaaaatataattttttccttttgtttactctttctttcgctttttgttactaattttgatagtttggaacgctttcattttgaagcaaaggcaatgaatgacaaatcaaatgaaaacgaacgaaagtttatgggggtctacataaacaattccaattccgctg

SEQ ID NO: 11906 - DNA, 2842 bp, Heterodera glycines
acgaattgccggacggacgtttcgtggacccaaaaacgggtcgtgttttcaaatacgaccatttgcgaaaggaggcggccgatgcgcagccgtcggggcccaaggaaattgacgaaaaattggagccatggcgaaaggcactgcaaaaagtttgctttttggtactttctccaatttaggacactttttgacgaattttagtattatttaatgagaaaaaattgcggaaaacccaacgcgaatgatttgtccagttcatccacaatcaatctcaattgtttgtttgctttttgaggagttggacgagtacatttacgagcatttccatctgaccggcgtcgccactgttttcacgccgttgcagcaccaaaaagagccgaaactcattctatgcattgagtcccatcagttccagccaaaaaactattggtttgcatcaatgtaaaatatctgttgaattttcaaattgctttaggaacggtcgttggcgttccgaatggcattttcccaactttgacggctcttcaaaaacggcggggactctccaaaaatgcacgggcaaattgcgtttgcaggtgcactattatgaagacggaaatgtgcagctgatttcggagaaagaggcgacggtggaagtgaaaatgacggtgagtcacagcacaaaacgatggatcaaatgaaataatgggtaaaacaaaccgcaaaattagggggagggaagcagggtctaattagcgttttaattgggtcaaagccgaggctaatgaaggcgaacgcgtcgcctttctgcgcgttcggtgtgctatggcctcgtaaagtgttttctgactttgataagccgaagtgactttattttctttgtgttggcctccggtctagaacagtcggacaattaatgtcgaaaaaaggaaaaaagcacccaattgtttagaatgaccgggagacgagtgcccgtgaactgttgcgggcaatttgcgaagcggagtcagcttatcaggttggcacggtgttagggtagttgctgctcccttttcaatttaatggattcgtttccataaatttcaaaattcaatctaaaaagacgagttttgttatttttcttgcccaatccccccgtttagacctccatccaggagtcccaagtgcaaatggagagcaccttcaaggcgcttcgccgtcagttgcccgtcactcgctccaagctgaactggctgaacttccactccttccgcatcactcaacaggacatgaaacagccgccgacgcccaccgtcgctgtccaacaacagtcccagtgaaaaacaacaaatgaacggactgacggacggatgaatgacaccgcaactaattggagagagacactttcgcgtcctcaccactcatttgtttagttgtactcattcgttcttcatttcattaggcttattgggtgcgggcatttattaaccgtttggaaatggtgctttgcgattccttccattaaatttgtccaaatttggtttccaattaaccctaaatttggtgttaatgctccgtcgtgccctgcctaattattcgctcatttgcagaaaaacatttacttatttctacagtaattggtgtactaaatcataatctgcttgtgtctgtttcatctccttcttcatttgtccgtgtgctttttcttcgttttgtgcccttcgtgaacattcgccatccaaaaattaaggcaagtgaaggcatttaaccgttcccaagtcgacttttacacttacaaattgaattttaattatttgttttgcagaatttggcgctatctcacaccacctctccgactgatcagtgatcagctttgtcattccctgctgctcgtattgactcatctccgccgtttgcgattgatttttgatggattttccctttcttttctgtttgtaaaacataccctcccccactcttcagcataaattatttaaactgagaacaacaaatgcagaaatacaaatttgatgtgtcaccccaaaattggacaattcgtcccaaattattgcccatttcagtatcgatgccataaacaaataaacgcgaaatatgcacaaattgcaaaacatacatatggaatacgtcctataagcttcaaaccaagctaaaaacatgttttcgtgtatttttaggcttttcacagttcagaaaaaacgaatgtccatataaatacaaaccctattcatcacacattttcaaagtacatccttgaaaaatttgaagcgaagaaagcccaaatccaagaacgtacttgaatcaaagcatgacgaattcctacactgttatggccttttgttcctggacaaattttggcacatttaattaaagcatacaaaatgtcatttggtgattttaaaagccgtatattctacattctatgtacatacttctgagtcttttttaatttgattcttgctgtttatttaattgtgccattatcgacaattggtttattgcctgggactgaattttacgttttttaataggcgtattttctgtcctaaaacagaagcattatttttcagtttcgtttctcgttttacacatatactaaaaatcttaacatatttactgcatataatttttaataatgaagagacgttttgaaaaaattccaccaaatcgaacaacttcgacttctaaaagtaaatttgtattgattaatttaaatttgctaatttttggatctttctctgttaagtatgcctaataacatttagatatacctatatatgtatatatacatatatacataccggcgctacttaaaaagaggtccattttgaatatcatttcaacttttttttgcccaaaattattt

SEQ ID NO: 11907 - DNA, 905 bp, Heterodera glycines
cgcaaattggcacggaacgggggtcggcacaggcccgactgatgatgaccaccaagtcgcgcaaggtatcccctcttaggggcgggaccggagggtgcaacggtgcgggggggggggggggaagaactgcttcggtgttcggattccggcaaccctgagaatttgagttgagcttttcgagtcgcatggatccagaaaggaacagatttttggaaacccaaaaggatttaggttccgtaaatcagacaaataataaactcaatttatacaatgtgcaggtgcgttacgggtggtatgacaagggggcacctgacgaattcaagatggcccgagagggtgacccggacttcaagttcaccgacccggacgaaaggtggaaaattggaaaaaaaaacatacaaagtttttgtttccgaggaccaacgaaagaattttatgaagcccaaggagatagaaaaattaaatgcaatttttcagaagataaagggatcactattttgacatgttttaaggatttgcttcaacgagcgcaaagcgtgggcgggcgattttgtgatttgtgttggacagaacaatctgtgcaaatggctgtgaaggagaagcaatggccacattttgaagaaacgttaaatttccaagaaaaacgaatttatttttcattttcacattaattttaaattaattatccagtaataacattctttacaattttcttctgattccataaaatcaaacgaatatgccaattccgaacccattacgacttttcgaatcaggccgggtaggattaccgggattaaaatccacgttttgccgggagtttaatcccgacaaaggggtggttcaaatgaaaattattttttaaacttgttggaattaatgtgattttcccatgatataagaaa

SEQ ID NO: 11908 - DNA, 1462 bp, Heterodera glycines
ttttgagggtaatcaatcatttcggtagacagctgtcacattttattcaaaaaccgtgcaaaaaatcgtttggatattccttattttcgaaagtcatcaatcatttttttttttgacaggtttgcaaaattacgggccatattgcgaaatagttggaaccaaaaataatggagacatttaaataagaagccaatcaatcacattttattgacagttgacctaatttaggggagatattgcgaaataatttgaacaaaaagtcacgtgcagatttcgaaataatggaagagaaataaaaacccatcaatcaattttggttgaaaggtgacctacttttgaaaaagttttttaatttatttattcattttcgattttacttttaaataatcaattttattgtgcaattcaataattattcatgtcattgtttgctgctaatatcaattaattcacacttcttccaaattccgttatcgattttttttttcgcggcggcggcatcgcggcgcgaggcgagcggggaggaaatgcaaaaaaaacccgcactgttttggcacattttcaaaaaatgaatttttaatttcaggattagagaaaccgtcataaaaaaaactcaggatttgagaaattaaaaccgcccaaaaggtttgggatcaaaaagatttaaatttgcaaaagaaaaattgaatttcctccacctgtcacttttggtgacaggtggatgattgatgaccttcccgcggcgctgcgcggcgcggagtgaaaaaacacccgcacggatttgggtaaattaaaatccacaaggcggcaacatcaaaagacttcacccctcctataggcttgggattgtgcgggaaaatgtccccgggcggcaacatcaaagggctgcgcccctcccataggcatgggtttgtgcgggaaacacccgtgcgcaaccgtgcgctttcggggtcatatactactaacgtcaacgggtatcgaactcataacaaaaaatacagctagttttgaagcactaaccactagagaccggacgggatcgggatcccgcgggatttcttcgggatcccgcgggattaaattcgggatcccgacctcgggatccgtcccgagcgattttttaaattcatcgggattgattgggatcgggatttcatcgggatcccgaaccgagatccctcccgaccattttaccaatcccgcgggatcccgcgggattgaagtcacaataatttttcaaaaaatctccattttttaaattaagatcttgaattttaaattaaaaaatattgtcattagctaatttttctttaaaaaaatcccttaaaaatcccaaaaaatttttacaggtctccaaaattccactaaaattttcaaaatttgacgcaaaagttggccattttgtgacttttattccttcataaaaataattatttttttttaatttctaaaacattattct

SEQ ID NO: 11909 - DNA, 1781 bp, Heterodera glycines
ttgagtcccaatgtttagaatgccgcagatttgagtcccagagattggaatgccggagatttgagtcccagtgtttggaatgccggagaattgagtcccagagattggagaaaagccaagaaaatgatgcgagggcgcgaagcggccgagccagtcgattttatcattcataattctataacacaatcgtactgcctagcgggggatgcgccgaaggcgctgaccccgctagtccttatataaaaagtttggtgtttgtgtgtgtgtgtgtatgtgtccgtttttgaatttgtgtggcgatttgtttagtttttgcgttaaaaatgtatttgaaaaaagtagagcgagggaaaggtgggaaaatagtgcactgtctgactgtctttctacgcgggcagcggcgggtgagaggggcatacagtgaacagacgcgtgctgctgtgcagcagcagtctgttggacgcgtgcgtgtgtgtggggagaaggagggagtggggaaaaaaagagtaaattgcaatggaaaagaaaagagagtaaaagaaaggaaagggagagataatgggaaatttgtctcgcatcccttccttatttataacccatcttttattatataaaataattaataaaataatgagcacatttttgtgtttgtttgagtggaaaatccggtacatgaaggttctgttattgtgtgtaagaaaaaatttgtggttttgctgttatcattatttttttgtctaaattttcgtttttgttaattgatttgattttgatgtgaaagcttttgttttgcttatgtaaacgataatgattaaaaaaatacattagaattcgtttgaatgaaaaaggtttgttacttaaaaaagttttttgtacttttccttgcttataatatgaaaagaatctgatttggtttttgatatttgttttgaataaaaagcatgttatgatagtaataaaaaatgaaagaaaaatcctttgatggatagaaaaagcaatataaatgctacatctcatgttttgcctgtgttcgagtggaatatttatatgcaattgggatattgacgtgccacttgcgggatcaaatttaggtggaaagttttaaacaggtcagttttaatttgaatttatggggtgggggcaataattatacaccatagtgttttgatttatgggttatatttcaatttctggattccttttaaatagttctgtattccgttgctgaggttgagttccggtgattgaaatgtcggagaactgagtcccggtaattgtgttgctgaaggattgatgagattgagtccagtgatttgaattcgggagaattgagtcccagtgacttgaatgtggtggattgagtcccagtgattgaaattctggtggattgagtcccgttgattggaatgttggtgggttgagtcccagtgattggaatgttggtggattgagtcccagtgattggaatgttggtgggttgagtcccagtgattgaaatgctggattgagtcacgttgattggaatgttggtggattgagttccagtgattggaatgttggtgggttgagtcccgttgattgaaatgctggtggtttgagtcccagtgattgaatgctggtggattgagtcccagtgattggaatgttggtgggttgactcccagtgcttgaaatgctggtggattgagtcccgttgattggaatgttggtggattgagtcccagtgattggaatgttggtgggttgagtccccagtgattggaatgttggtggattgagtc

SEQ ID NO: 11910 - DNA, 362 bp, Heterodera glycines
ggtttgggtcccttggattgaagggttgttgggtggactcccatggattgaaatgtggttgggttacgtcccatcgattaaaattttgtggaatgaatgcccgagaatgcaaaatccccccgtacgaggccgcgaagcggccgagcgagtacctttggcgcagaaatgaaacgcaggagaatagagtcccagtgattgaaatgctggagggttaagtgttggcgattgaaatattggtggattgagtcccgttgattggaatgttggtgggttgtccccagtgattgaaatgctggattgagtcacgttgattggaatgttagtggattgagtccccagtgattgaaatgctggagggttaa

SEQ ID NO: 11911 - DNA, 4349 bp, Heterodera glycines
  misc_feature (6)..(6): n is a, c, g, or t
aaaacngggcttaaatctcgccagtgaaactgctccagatttgaaaaaaataaataatttttttggcgaaatgtcttttatttagaatttgaagatggattttcagaattttttaaaatttatacgatgtaaactattaaaagatcataaaatccacctaaaatattcaaaattaaatataatatagcaattttttggttgaaaatacggtacttatacagtttaacccacattaatttttcttttttatttttaatgataaaaatgtgtttccaggaaaatccttattctattaaaaaaaaatttttcgaattttttaatcaaatcaaaaattttgaaaaaagcccggttctggcaggcgctcggtcaaaattttggactgggcttttaatgcatataatttataaacctaggttataatgtgcatacaattttttttgtggctctaatttcataattttgatcaacggacgacacccaactcgtactaggccaacttgtactgctccaactcgtactgtttttcgacaaaaaaaaccgtcacaacatttgtcaaagtcgaccaaattaaacattcttggtattagtcgatatcactaacagtttttctctatctatatacctgcaaaatacaagaaaattttattgcttttcaaaaaagtaatgaccaaaatcaaaaaaaaaaaaaattctcgtccataacttttttcaaacttgatcaaatttgctgaaacttggcatgtagatagagaactttaagggctattgaatgataccaataatattttttaatttagtcgactttgacggtttttttgttgaaaacagtacgagttggggcagtacaagttgggttcttcctaatcttagaactaagtttaaacctaaagcttaggcctagtctaagcctttgtacgcgttgtcgtgacactgaagctgtggccacacctctttgaataagttgatccattcgtcgacgtcaatgtcaattggtggattgtggtgaaaacaaatgcaacgcaatcgcttcgggcgtccatctttgcgcggaatgtgcaaccattcggtcaccgcttttcgagcaatcgcattttgccaatcttcataggggaacaaattgctggtttccactgatgcaatgccaagatcggagagaattgtgggcgaaatgtggaacaacatgtcaatgctgccacagccaatcaattccaggtggcgaatgtttggcacaaaaatgggcaacatttgttggaccagaaaatgccaatccggccgggaaaccactcgctgtacggaggcaggcagatccatatccaaacgcaaattgatgcctttgtcaaaaatgtgccgattggaacggagaaattcacagacaggagagcaaatgttgctgaaaagcgggagcggataatgtttaggctaatagtacggatggtacttaacaaaatttactaatgataattagggttgtaaatactatgattttccaaattttaagaaaggggctcaaaaatagcatttctacgttaaattttttgatttggtgaaggtctttagtgcaaggcagtttttaaagcatattttagtgcatatttgggcatttttcgagttttttgggcatatttgaaggatttctcggctttttagggttatttggcattttttagtgcattcaacttacaaacctactaatgattattggcactgatatcaaaaactataaaaacacattataggttttttccgatctgatttttcgaatttttgttcgaatcaaggattctgggttcaaatttggtcgaaatcaatgtcagaatccgaatttccgaccctgaaaagccataaaataattttatttcggaaaaaattttcattttttcgaaaagggttgggggagggggtaccatctgtactattattacccatttcaattgcttatatgcttttttgtttttgaataccgaatgtgaaggtccttaaagtgaattttgctgggcagcggacggtcgggcaatggaaattcttccgatttgcgttcgacaattattttcggttcgccgaagcccttgaaaattgtagcaacagtttttaaatgattttgatttctattcgaattcggaattagtcaaaatgagtcagattcgtgatcagcgacctcgaaaacaaccggaatttcaaaaaaattttttttttaaaaattccaattttatcaaaaatttcggaattccgatgattgtccaaaatgtttttggaaatcgtaattccgaccccaaaaatgtcggaattccgtgccatctctgtgggtaatatcaactaaattattacccaaattgttattcttctccaaattgtcaaatcgcttttgccatcaaaatgcgtgtccaccagtgcatcaaaatgaggcgaaatcagtgccaatttgagaccaagttgagcatggtcaaaaaacggcagaatgtccatcaaaacgtcgttacaaatccaactgaaacattaattttttaaattttccaaaacaatagggatatcactggtaaaaatgattttgggtttaaaaataagggcaaattccatctctaggtaatactgtcaatggtcgaaaacttgaattttcgtacttttgttcgaatccgggttcggtttgggcacttccgtgttttgctacctccgcctcgaaaaaattaaaaaattcattaggttaggttaggactaggtttagggttgcttcgacctgggctctcatattttacaaactaaagcctaagccgatcgtgatcaatgtgaccgtgaaagtcgcaatatgaattttttaaatctttcgaggggggtgggggtagcaaaaccgaaatgcttattttcttaatttttaatccaaaaaaaagaattgactcacattttcctcaaagttcttttcattttcatgcccaataatatggcagtcacaaatgaaccgtgcgattgttttgttgttattttacaatgtcagaaggaatgagaagggaaaggataaacaccaaagtgtcgtacataaaaaaagaataacatttaagaaaaaataacgtaaataattaaattctgggaaaagaaagtacagcaaaagtacaagaataaaatataatatttagtttcctagtccattagaaaatttgccgagtcaaaaaaaaacaacctttttgtggtgcaaaagtaatgcataaatattgaatcgaccaaatcttaaatttaaaaggaataattttggaactgcgctgcctaacggcggtgcttaaaatccataacgtatgatgagtagggatggtaattatatgcacataaaatcgcaaaatatgcgcataaaaagtgaaaaatatgcacataaatttttccaaattgagggcaaattttcaaattttaatatttatttattttgaagaaaattgagcaaaaaaaggagaattttctattttctgactatttttggcataaaaaagagggagaaaagggcgttggctttggaaaatagctgataaaaaggagaggcgagcagacgatgagtgagataaaaatagtggtaaaaatggacaactgctgcattgggagagtcataaaggggacacaaagtgttcgcacagcatcgaatatttccttcattttaggcgtcattcttccccattgcacggctttcttcggtttaattacccaagtttgaggtacttggcgtatttaatcataattcatgtggtaaaaaatgcatttaaaaataaaaaaattcttgaatttgcttctgaattttttaattttaaatagaaaattcctttttctgaaattcacaataacaatttggcgaagaaattcattgaaatttttataaagcattttgattaaaaatgttggcgggtttgacaaatttgtacaccgactattggatctcagcagcaatgagaaataacaaacagaaaagagggagaaaagggcgttggctttggaaaatagctgataaaaaggagaggcgagcagacgatgagtgagataaaaatagtggcaaaaatggacaactgctgcattgggagagtcataaaggggacacaaagtgttcgcacagcatcgaatatttccttcattttaggcgccattttcccccactgcacctctttcttcggtttaattacccaagtttgaggtacttggcgtatcctgcccataatatctgtggcatggaataaattttggaactgcgctgcctaacggcggtgcttaaagtgcgctaaaaatgatcaaatgattatcaatttttatttttcttaattccaaagtgaattcgaaacgcaaaaatttaatcataattcatgtggtaaaaaatgcatttaaaa

SEQ ID NO: 11912 - DNA, 1497 bp, Heterodera glycines
tagggctaatatttatagttgctaaaaactgccaaaataattaatttttagtttctaaaaaagctccaaaatagttgctaaaaataggtaaataattgctaaaaagttccgaatttaggggtgtaaaatcgtaaattttcttcaaaaagcaaaaatattttgccaaatcattaaggatatacataatttcataattaaaaattatcgtcaagaaaaaaacatataaattttgaaggtgaatttttgagaaatttttcatttctcaggggtgtttttaaaaaaaaaaatttcgggtcgatctttggatgtattttttgaaaaattaaaaaatggtaaatctgcgatttgtctgtactaagatttacttaatgaattttgatgagtaactaaaatcacatttctacatagaagcgaaatcgtctgcatttactgtagttagtattatttaaaaaaacaagtgttttttaacttcataccaaaaaatttaaatgcgcaatttcactttctaaatttcaatttttaacatccattttctttttttttcaaattattttatattttttaatgataatacataaacattttaatttttatttgagttattaaaaagcgcaatataactaaattattaaaaatacataagcttaagaaggcacaaaaggacagattaataaatattaaaaagtgagaaaaatcattttcacatatttctttaaaaatatttataaaaaataatatatattcgtaaatggaaaaaaatgataatttcgaattagtaaaatttacaatggtaaaatacaaaattttaaataaagaataatttacaaacaattaattttttttatattaaataatagaaagaaggtaatgataattaagcgaatatgcatgttaaaagttttaaaataagcaagtttatttattgagggatattcaccataaaatagaaaaaaagataatacataaaatgaagtaaaaataattaaacagcagttatttatgtttagataattttaaaaggaacaataatctaaaataatctcctctacgaaggaaagcctttacttctgaacagcacaagaccatgtttttatgaaatgaaattgaaaaaatcgcaatcgtcgtggggtgggtcgtaacgaagggggggggggtgttcaaaatagaaaaaaaaggtcttcgcgcctgggaaaaataggggccgacgtaagaaaaatttgtcctggcgcacccccccccccctgcgccaaacgtccgacgtatgggggtctgactggcgcaccccttgttattgtatggtcgagtgtgcggcggttttttaacgcaatactcgatattcaaggctaaacgattttcgcgcattatacaagaagaaaacttttttggcactgaagtgtctattttcactgggactcagttgccccagcgcctatatgacaccggttcgaatttataccttgttgtttacacttacctgatcaagggctttcgaatgat

SEQ ID NO: 11913 - DNA, 2359 bp, Heterodera glycines
ccacggctcccaacttctggaatgagtttcgggaagcgcaacagcggacgaccttttcttctggttgtaggccggggttttcgaattttaatccgagtttcggttttttccatgttcaaaaactcagacggactctgcgttatgatcgcccaaattttgccaaacatggtagcactgttgcggcttcgcctcttcgtcagtgtccacgtttactcctccatgttcagccgtttctttcaaagaattgaatataaacgtgccgaagagaccggagaaagtgtgttgtacaagtttcatctgccaaatgagagccataaaagggataaaaaagcagcacaaaacaacaaccagatatcgtcggttgaactggaattggtccgggtttttggtccacaactgatagacacaatccagaaattgcaagaaaactggcgatttctcattgtcgtcaccattcaaaaccccgcctctgtccgagaatttatgtccaaactcatcccattggcgttgaacaaacataacggggggggggtgttcaaaatagaaaaaaaaaggtcttcgcgcctgggaaaaataggggccgacgtaagaaaaatttgtcctggcgcacccccccccccctgcgccaaacgtccgacgtatgggggtctgactggcgcaccccttgttattgtatggtcgagtgtgcggcggttttttagcgcaatactcgatattcaaggctaaacgattttcgcgcattatacaagaagaaaacttttttggtactgaagtgtctattttcactgggactcagttgtcccagtgcctagatgacatcggttcgaatttataccttgttttttagacttagctgatcaagggctttcgaatgataccaaatttgttcgaatttgaccgttttaaagggtcaagggcacccttttcacacaatttttcgagttttaaaccggttcaaaaaccggttttttggcatttccgcaactcgaggcatatttttccgtgcatagctcctcgagacgaatcgattggtatatcatttgacccctttttcacggggcgttcactacagtttatcccaaatttttaccggcggtaccggtactaaacaaaccggtaccggtactttgatttttgaaaaaaccggtaccgctcaaccctactcaaaagttgtagtcaaaaaccatgtgctcgtacgaaaacggcctggcccgacaaatctttaccattgccaattatggcatttatttgtccctgttcgaacccattttacgaagatttgcatttattgcacaaaatcgctttttaggtgttttcggggtcataaaacccgagtttttcgattttttgttcgaatccggattcggggttcgatcattgccatggcattaagcagtggatgaccttaaatgtacgaaaaaatgtttttagcttgttttcaagtttctagggcatattttgtcgaaaatttttctcctttctagcaaatttttgttgttgttatccattttttggctcgacaatttcttccccgtaaaaaccgcagccaagcggactcgaaacccagaccccgtttttgtgacccctagggtaataatcaagaacggatttatatgtgctaaaaaacgccaaatatgtacatatatgtgccaaaaagccccaaaatatgtgctaaaaaccccagaaaacctaaatatgtgccaaaaattgaaaaactgctcaaaaataagtgaatttctcaaaacagtctcgtttttttatcaattccgctagcacaatgctaatcaaaagcattataattagggcggggaattatatggatataaaatcgcaaaatatggccataaaatattgaccaaaaatcgcgaaatatggacataaaatggcaaaaatatggatataaatttttcaaattgagggtataatttcccaaaatttctttaaatttgttaatataaagtaaagaccttcaaaaatggataaatatggtattgaaaatcattttagaagaaaaaaacacgataaagttaaaatttactcatttttagcgaaaaatcaaccagaaaagtgaaattttatcttttttgcttatttttgacataaacttattaatttttaagaaaatttaaatttattcaatattcccgagaaaatttgacgaaaaaatgattttttttggaaaattttccggtttggtctaaaaatagtttaaatgatcaaattgaatattttttggggacattttgccaaaatttgattgccaaaaaaggaactttgtaaaaaaaaattcaaaatatctcaaaaaatcgccaaaatatgtgtcaaaaacgatgaccaaaaccccaaaatatgtttttat

SEQ ID NO: 11914 - DNA, 920 bp, Heterodera glycines
  misc_feature (53)..(53): n is a, c, g, or t
  misc_feature (61)..(62): n is a, c, g, or t
  misc_feature (73)..(74): n is a, c, g, or t
  misc_feature (93)..(93): n is a, c, g, or t
  misc_feature (96)..(97): n is a, c, g, or t
  misc_feature (104)..(104): n is a, c, g, or t
  misc_feature (110)..(110): n is a, c, g, or t
  misc_feature (113)..(113): n is a, c, g, or t
  misc_feature (115)..(115): n is a, c, g, or t
  misc_feature (119)..(119): n is a, c, g, or t
  misc_feature (127)..(127): n is a, c, g, or t
  misc_feature (140)..(140): n is a, c, g, or t
  misc_feature (142)..(142): n is a, c, g, or t
  misc_feature (151)..(151): n is a, c, g, or t
  misc_feature (184)..(184): n is a, c, g, or t
  misc_feature (191)..(193): n is a, c, g, or t
  misc_feature (196)..(196): n is a, c, g, or t
  misc_feature (199)..(199): n is a, c, g, or t
  misc_feature (209)..(209): n is a, c, g, or t
  misc_feature (211)..(211): n is a, c, g, or t
  misc_feature (215)..(215): n is a, c, g, or t
  misc_feature (220)..(221): n is a, c, g, or t
  misc_feature (233)..(233): n is a, c, g, or t
  misc_feature (235)..(235): n is a, c, g, or t
  misc_feature (251)..(251): n is a, c, g, or t
  misc_feature (254)..(254): n is a, c, g, or t
  misc_feature (268)..(268): n is a, c, g, or t
  misc_feature (271)..(271): n is a, c, g, or t
  misc_feature (284)..(285): n is a, c, g, or t
  misc_feature (296)..(296): n is a, c, g, or t
taatgaaggaatggcttgagtggtactgtactgatccctacaagggacattanaataatgnnaaagataaagnntacccctttagaattaaantgnntattagnataatnatngntatnattttttnttattttttgttnantgatttttntggaaaatttgaattgaaaattataaaaattgntgaaatnnnggngantggggtaagnanaaanattgnnaaagagagaagnantttgagtagaaaaggntgnattttttgataganggnaaaataaaaattnntaaaattttantatttaaattttaaataggggccaaatgttcgctcaattcccatgacattcgttgtgactcatccgtcgccatttattcattcattcatccaacagtccccaaattctcttaaattttacacaaaaaacattccaattattggttaaagattttttgaacataaaaaatgattgggagaaagtgacattttttatgtaaagtttagtaatgggaaaaataaaagcgatcgatcggagagaaaggaaagtttttacgataaaagtgcttaaagcaaagtaatgacttttcatagctaagctcttacgcccattcttccactaattaattaattaattattaatttcgaagcaaatatcgacaaattggggggggggcggagatgaacagatgcaatttcgatttgttcaaagtgtaaaatgtgaaaagtctctccagcgaaactgctgctgatcgttggaatcgacgaaatttggaagaaacgcggggaaagaacgcttttaggggtcaaatgaattgtgaattgcagcgtttgtaaatggggcgattgggggggggggagcgaaggtgggcgagggatttggaatggtccatatagggggggggggggatgacgagtgacgaac

SEQ ID NO: 11915 - DNA, 2874 bp, Heterodera glycines
  misc_feature (7)..(8): n is a, c, g, or t
  misc_feature (17)..(18): n is a, c, g, or t
cttgcanntgcctgcannggtcttttttaaaaaagaaaaaaatatatttaaataatcaataattattaatttatattgtttattattattgtataacaaaaacctgtggcttgaacatgtcaattcctatttgtgatttatttaaaatgacagtaataatgggcggaagacataaaacggagtttttgcggcagaaactcacgccgaaaaagacaatttaaaataataaattgggcgaatggcaaaagaaatgaaaattaaagttaggggcccattttggagtcattcgcacgtgacaaaatatttgaatcattcattgataaatgggctgagatttatatttactaagtaaaatagcaaaaggaatgaatgaattaattaattaattaatggagggaaaagtcagcgcccatcccaaaattgggggcctttccgcgcacttttgaattggcattagcagcagaagaacatcccttgggttgttgttgttgtcgttgttgtacagtgactgttgagcttaatgactgcaaattgaccaaattgtcgaaaaattcactcgtcgaaaaaaagaaaagaaaggaaaagcagcgagaagaagcgacaaatacacgcaaagaagaagcaatggaagttaatgtgaggcaattccatttttggagaagggtggcggtgatcaaagaatgggagaaggggggcacaaatggagggggggttataatagggagtttcttaaatcccccaaggggtaggaaaacaaaaagtgttgtaacgcatatacctaaattcataacttggctcatttcaaccaaattaatattttaatttaatttaacattaaaatgttatattttgccatgtcaatgcatgtataattatagtcattttaaaattttaaagttattaaaatgtaattgatccaaacttattttatatattcgatattccaaagaattgtttaacttaataattaaaaaaaattaattgattttcaaaaaatatggccaaaaaattctgattaatgcttatttgaattatgtatatatatttttatattttttgtaaagaaatttaaataattatatattaatttgcaataaaatgttgaataatttcttaaatactaaaaactggtcgcaatcgcttttctgtgcttttattatgcaataaaggcatcatcttgccaaatgtcaatgggcgagaagccgacgacggtgaataaggcggggggggggacccatttttggacaaaattacgctgtgagcataaaactagtagcgaagcagttgaatgccatcgatttgacataaattagcaaattaaacagcaaatgaacgattatgtcgaaggtgagcagtcgaaattccccgttaattgcctcaattatttaattgctttactttttcggtcgactcgccggccgtcgcatttggtggtgtccgagtggcgaaggtttggtttcgaattgccgtaattaaattatgcctatgttttggcatacatcaattaattaataattaatgccaggttatttggcttattgtccccagcccacggacttcgaccagtacacttactgttgtctgtactaccatttgggtgttgaccgaccttcgtgctgtcgcttcccatttcataccggtaatgggcaagtcattttgccagctttgaagttttaagtaaaaattttaaaaattatcccccccccccccttgtgaaatgccctcaggcaaaaagacataagagaattcagcatcaattagcgatgcattaattgtaattcattcaggtgtgatcattgcactgtttgtttcgagtgttgtcgcctttttgggtaattacggtcaatttacattttatctaatttcattttagttaattaattattatttttagttctattgtttctaatgtgttggttttgcccaatttgtccgttggccaaaaaattgagggaaagaaaagaagaggaggctgaaaatagtggagaaatggacgaataaatgaagagaaaagagggaagagagaaaaaaagagaaatgatcgaaaaatgaccaattgacgatcagaagaagaacagaaaatgagaaaataaagtgccggttttgatattccgaattaattagttattgtttgttttttcattttcaccaaaattcaaattattttttaaaatattttaaattattattttttgatttttgtcaatttttcataaaaagccattcaaaggaatgaaagcaatcggcggatgagtggccacagaattgtgggacaatgacaacgaaacaaaacaaaacaaaagggcgtcgtcacaaaggtcgcgcgccaattcattcttcgcttatcgatgaattcattccgcgatcaatcaagctgctaattgacacactccgaagtgaccaaaaatattccgagaaaagcgccctttttcattttaaatttattcatttttaaagtaattaaatgacgaataaaccgcagttcatccataatccaaacatttctcattagtgagtgatggttcgaattcgaattcggcactcactgctcatttaaatgacgaacaatcgaaaaatatttacaaattaactattaatgtgttagtttccattttggtgtgtctccgcacacattgctaattaatttcattaacggaaacgacgaaacggtgaattgagagacagaacagacactctttgaaggtgatggttcagcgacggcggttcatttcaatgatcaatttcttgggtttggttttatttttaattgcatttgcccattgattttccttttttcttttttctgctgatcttttggcttttcctttttagcatttcctccaaatgaccgtctcttataatcagagacattat

SEQ ID NO: 11916 - DNA, 3146 bp, Heterodera glycines
  misc_feature (2128)..(2128): n is a, c, g, or t
aatagtctttgtttgtgttaacccaagtttttagctgaaaatacttcggtgtgccgagctgaatttaccgttatcgacctcaatgttctgaacggaaacatttcccttttcaattggtctccgtttttctcgttttcctattttttccttttttcgcaaatcgaccttcggaaaccgactcattctgcctatattcacttgatttctccaataaacccgagtcgcgcccagatttctattcacccagtgaaatgtgttatcacaatccctcgcttgatttgtttttgcgatttccctccccccccccccccatttttgacttcattcgctaaatccgtccgggttgggccggctttcccccccccccccccttttcctcccaaaatgtcgtcgctttttcactttctcattttactggacattcgcttttgttttccctccgtttttgttctcgtaattcgtttcatacacttcgattcgttttatttttacatttgtttgtccaatcgaagaataaaaaataataaaatattttaatatttattttaaaagtttcgccgaggcaaaaaaataataaaacaaattatatagccaaaagtattctttcgtttgccattttcttttcatttaaaatgattagtaatattttactttatttcaatagatataattggtgatttctattgctaatttcatccaaacttattatcagatgatcagcaatgaattcggactcaaaactgttttgcattttcacaacaaaaacattttttctcataattttgcttttggttggtctgtctcattctttcccttattcaatcacaactctcttcccctatccatcgccctctttttttctccaaatctatattcatttttttctaccttttctctcgccgtcccctcctttcccctcctcttttatccacccttttttcttcatactcttgtctctctctctctctctccctcccccctccaagtttatacttttcgtactgtatctgtgttgaacgttttttcaggtaatcgttggccatcgaacatctgcttctttaattccggtaccacggagttcggcgcccactgatcaagcagtaagaccggcacaccaaaatgaaagacatttaaatcgatttaaaacaaaaaatggtccaaatgagtggtgccattgacttgtctattgatgtgatcgctttttgtctttttgtcactccttcgaatgatcgctttgatcggctgacattaagcgggagggaagaaaccccaagcaatgggcagaaaggcaatgccaatttcttaatgaaccatcgttcctcagctcaacaatttgtattaaaggcttcgtaatgataggggggaacaaatttgcttctttatctctgcttgattagtcgtggcgctgtgctcgtggtttgtcaattggtctgttgtgtttgtttatttgttttctcttctttggcatttcgtctgtttgtctgcttctctacctttccctttatttgcttttttctctgctagtctctccttttccttcccatttgtccgttcttttatctttcgtctgtttgtctgcttctctacctttccttttctctcactttctctgctatttcactgctcttcttccctcttcctttcctcttttccgttcttttgtcttacgtctggttctctacctcccttttctcttcttttctttgccttttttctatgtatctatctatctcactttccctttcatcctgcctttcctttccctctttctctgctcgtctactatctctcttcctttctctctcttccatccactctctcctaacattgcttttctgatatttattcctcttcctctgatcagatccgtgtcatccgcgccttccaatcaggcgtcgatcgccagcccgattctcacacacttagtggaccaagtgctgcccgactgcgcgagatcagccgacaactcaaattacagcacgagagggagggacggagtgagtgggcagaatactgtaaaatacagtaaaacgagaaaaaaaggaataaggatttcggatatgcaaaaagcaaaagtaatgaagcgtaagcatgttttaactcacatcccgaaaatgatctgtactanaaaagatttgtgtgtgtggttaagaggtttttgtaagatagaaaagggaaaaggattggaggttcgagtccgccccacgacattaatatttttattttttattcaaaacattaaaaaattaccatttttaaaattgttttggaggttttaaaaaattaccattttttaaaattgttttgaaggtttttttgccaacgaaattggggaatatctttgtatcattcgaaagttcttaatgatgaaaagctttttcaaaacaaattctaagcaattgaatgcatcagaaaaaagataaagcgtttaaaatttgttttttgaatatttttttaatcgacccattttaaaattaatcaacctatcattagatgcaaaaaattttaaaggaaaggccgtttttagttcagacaattgccatcttaattaatatgagcctaattaacaatagttttttcttctattagttttcggttgcaagttgaatattgatttttgtaactctgttcgctgttcctaattatctgctcatgatggtattaaaatcccagaaagattattcagaatagcattttcattatttgggggtaatttttgaaaatttaaagttacatttctcagggtgttgaaatttttccaaaatttgccaaaactctaaaacacaaaaacggcgaaatatgcatttattctcgaaaacctccaaaatatgcattgttttaatgaaaaaagctatttcgagcctttcttcattgcatatgcacagaaaaatctgcaaaatcatacaacgcacagccctagtgataattaaaataaaattttctccgtcacgattatcgtgaattttacgggttttcacagtcactattcacgggttttcttcgtcacggcccacctcctcatacttgtccttatccgtcccccctctcagctctccgttctcggtccgcttctcacaatgagacgccgtacactccgcggggctctcagccattggtggcaccgtcgacggaggcaatcagtgcag

SEQ ID NO: 11917 - DNA, 592 bp, Heterodera glycines
cgtacctcctcccctccccccccctccttttctccccctcccactgtcttgttctctctatttccctctcccttctccacactttcttacccttgcgcactttttactttttctgatcgacccactcgtaggccattacttttgagaatgcggcgcacaaccacaaaaagtaagaataatttttttaaccgtatagccaagaattggaacaaattaccaattgttccaattcaggcagataaggcaaatcaattcagggcattgctaaaagctatgtatgagttctaagggatttattgacatttgcattgacattcattccattttattttattttactttacatttcatattgttgtatttttttttttgacattatttattttgatttttttttatgcgccacataagagcactaatgtgcctgtggtttgctcaataaatataaaagttgttctctctatttccctctcccttctccacactttcttacccttgcgctctcttttttgatcctgaactcctttccttcacattgctttccttctttttcacccatataatttattatcatttatcatttcttccctct

SEQ ID NO: 11918 - DNA, 3715 bp, Heterodera glycines
actgcctgttattttttgtttgaagtaaatctttctaaatctacttaagggaaggaatttttgaaaatgtttcaaaaataggtaaaagataaatctgcttgatttttggaaagaaaattcaaaaaaacttcactttttgtcttctttggctatggagttttgtcaattcccgcatcatccacatcttgtgaacgaatttttagccgtttttcaccgctggtttatgattatcgtcgtaatcgcttaaacgactttttcgtcgtttgaatttataacgacgttttttcgttaaaaaagtcgttttgtcgttcactaacctggatccaggcctggatttttcctgggtccaggtcatttttcggcaacctggatttttcctggacctggattttcctggatttttgtccaggaaatccaggtcagtttggaaatccaggtccaggcatgaaaaacctggatttcctggataaatttttttcgtctttttatggcgaaatgtattaaaaatggttgtaaatcaaaatttatatttttttaaattttcacatgtaattaaaattctttctttgttttttattttagcattaatgaattctttaatttggactatagggttattcgaaaaaagtaaaaatggcaacgtcgggatttgcttagtgtgcaaggagcaaaacagacaaaagtctgaattttcaatcaacgacagctcaacgaagagcctaattgtccatctcaattcgtcgcaacacaaaggatcggaatacgacaaaaaattccagcaacttgagacagaatggaaaaacgcaaaacagaaaaaacataaggagcagccaaaaatcgctgacgtgatgaacattacttcatcaggtaaaaacggccattaatttaattcattatcagtcattaggaacgatttccattgccgacaaaaaataatgcattgcattgtctgtaacaacatttcatttaaatcaattgaccatcctacgtttcatgctcttatgcaacaggaggttaaatctgaaagccattataggtgtttccgaatccattggtataaaaaataaataacatttcctaattaaggaaagaagttttgccaaaaatttacgaacgcgttcaggccaaaattaggagtgatttggaacagtgcacagtgttgtcgttcacaagtgactgttgggccggcacttccgataattttattaggtatttttgttttaatattttaactatttttatttagcctgacaccgcatggcatcgacaaaaactggttttacaaagagcggattttggcagttacaaatcttcctggggagcacaccggtttagcaattgcgatgaaactccgtagcattttggaacaatggcgcctcgaaggagaaaatgtgcattgttttgtgactgattccgcaaaaaatatgtgtcgggtataaattatcctacaaaaattttataataacataaaaattttaaggcctttaaagaagttgacgaaaatggcagtgcaattctcccctttttgaatgcaaattgtgccgcccatttactaaatttggttgtgaaagaagggctaagtgccgaccttgatattgaaaagcttttcgttaaatgccgtaaaatcgttggccatttcaaaaagagcaacaaagcactcggaaaattgcacgaaattcaagaatttcttgaaattcccgagcattgcttgttacaggtatgtataatgttattagatattggtaattcttaaagagtgtatttttcaggaagtttcgacacgttggaattctggtctgatgatgattgaacgactttacgagcaaaaaaaggcaatcaacgaatatgcataccaaaactgtgactttggtctcactttaacaagcgacgaatggtcaattttagaagaacttattgcgggtattcttttaaagcaaaattggtagaaaaaataaataaaaaacaccttagttttgaaacctgccgaagtgatgaccaaaggattatctaaatcgcctatttcggtggtgattccatatgcaagagttatgcatgacgagctttacgaaatgaaacttttttcaaaaaagttgaccaagttcgaacaattatgtaccattcgttacgtacagacatcatataagcattttctattcactttatgccagaaaaaagtcattaaacacaaaatttttgtgggcaaaaaaatacgaaaatctgagtaaattcgaaaaaaaatccctagtgggctggaaaaaatttttcgtagaagtagggccattttgtagagaattttgtgctctttctgaccatcatatttgtcttctacgaaaaatttttacggctgatatggaaatggctggtatggaaacggcggtatggaaatggcggtatggaaacggcggtatggaaatggcggtatggaaacggcagtatggaaatgggtcgatcccaaaatagtgattactagtgatgaatagtggcgttaaaacgaagaatttccgagctaaaaatgttttcgtgcatttcagtcgaaacaaagccgcagaaaaaataattaaaaaactaaaaatccgttccctactaatcacactgtaaggccgcgaatggaaagactgattcttgagaccgttttgttttcatgactttcgaacaaaacttttctcccaaaaaagtggggagcataggcagtatttttcgacttcagggtttgaaattggtgcaaatgaatgtcaattcgtgatcagcagctatcctgaaaacccttgagggtaatactatcgatggtgccccccccatttttggaagaatttttttttgttctgaaatgtcgtggaaacatatttacggggggttttcagggtcgatcgatgatcgcgaatctgacatccattttgccctatttcaaagaaaattcaaaattttgaaaattcacttttagttcaccctctaaatccactccctagttcactaagttattgctcatgaactgtacataaatgttgaagaattttttaagtcattgaattcacagcctttcttccatctctcttttattatttcgcgaatttttgtgtgaaatggactctacaaaaccgatcgtgtttttgaaggtcagcctaaaaggaaagccggcaacagttgtagggcgagtcggtgagttgtaagctcttctgtatgaatgattaaaaatggcttatcaaaaattctgggtgattgtttgtattttttcagatacgattacgtccgttttgtcagaagcttttgcctctaaaattggtgacattgattcgaacctgcgtggccatgtgacgctcccaactgccgatgtgcccgttgtaggatggtaggaaatgttcgtacttgtcaaaaaaaatttaatttgttagggtggatgacgtgtcagtcgctttgctcaatgccgaaccatatgtctttgcacaacgttttggcgtcgtggcggataatcacatgatcgcgtaagtttttgaattaagttaattttctgtgcgacatactgtaaatttaagcttttgcgaacgcaaggtcgatggcgtctttggagccgacttactcaaacgcatgggcattttgaacgaggaacagattgacgccattccgctcgcttctggagatgttcctgaggaataaatgatcgtttttgaccgcaaaaaaagttgtgaagttttcagttagggggtcaaaaatcgaaatt

SEQ ID NO: 11919 - DNA, 1771 bp, Heterodera glycines
ttaaattttattttaattaaattgtttttttgctggcctaatttttgtcattaaaaaaagcttcaagactgagtttaatcatgattatcccgtgattgattttttaaaattttatttattgtaatttctttttaaatttaaaataatttttctcttttggcataatttttgtcattaaaaaagcgaacattttatcttataaatttttttctcttgaaaattacaacaaaaatgggtcatctcaccacccttttcttcatcgtccaatcctcttttctggcattagcaaacatttatttatttcttctccgattggggctcgtttttgcagcgatttacgacgccaaaaattggatccgtccgtctgttgcagaatttttttcggcaccgatgggaaaatgccattttttgctttggcatcccaaaaagtttcgacaaacattggcaatggcaccggcacacaacagtttactgacgaaattaataccgccccattaaattaaatttgaaggtccaaaaaagtattttaggatcgaatttagaatttacaaaattaaatgccaaaaatgacattaaatttaaaaattaccgggaaaattctcattaaatcttggtgttattatacaagtctttcatttttagctcagctggctatttcgagagtaaattattattttttattatcatttttaatttttaaatttttattttagttgtttaaaatcaaaaatatttaaaaaaaattaattaatttactttttttataattaactttcatttaaatttcactttttaaatattaatttccgtattttcaattttcttggcatttttgccttttgttgttggagatgctcaaattgatcattagcaatagatcactcgtccatccactttcacaaatttccaattcacacaatgccctccaacccgtcgatttaaagggtgcttcatctttgggcttttcctcacaaatcactcattagccccccggggggaaaagccttggccatggattctttggccattggcaatccgccgatgacacaagtcaacaacaatgcaccacaacacattgtgtgtagaagacaggcgccaaccgcacgaatttctgctaacattgatggatcatttgcttcttggcctcacccctccctcctaaatttgatttaaaaaaatttagggccaaaacttttcgaaaatttatttaatggatcatttgcttccccttggtctcactcgcccctaaatttgatttaaaaaaaacttataaggccaaaaattcttgaaaatttacctctccatctctttgcatctttaaataagaaattccagaaatttttctataatttatttaatataaacaccacaccttattaaaatttaagtttgcttccttcaaaatttccaataaaaaaattgaaaaaatatatttttaaattagttttttgacactcaattctttcgtatacttaactaaaatattcattcccaatatttaattattgaatatttttaaaaaatttttcctaaccctctattgaaatgcgaaaatttaaaatttgaaaatatttaagcaaaattaccggaagaaattttcgtataaaaaattccatgttatgaccataattttcttctactcccaaaattttcagttcattcatttttcttggccatttctcaatttttcatttaatgactctgtccccactcattaaaaatttattttcccaaaaaccataaaaagaaacaaaattgcgaaattgtccca

SEQ ID NO: 11920 - DNA, 3199 bp, Heterodera glycines
  misc_feature (3069)..(3069): n is a, c, g, or t
  misc_feature (3088)..(3088): n is a, c, g, or t
  misc_feature (3090)..(3090): n is a, c, g, or t
  misc_feature (3092)..(3093): n is a, c, g, or t
  misc_feature (3098)..(3099): n is a, c, g, or t
  misc_feature (3138)..(3138): n is a, c, g, or t
  misc_feature (3142)..(3142): n is a, c, g, or t
  misc_feature (3148)..(3149): n is a, c, g, or t
gaagaagatcagcgtatcggcacgtcactcggttgacccatgttcaggcggtcatccccgcggggttgccggtcgaacgcatctgagccaaagggagggacgacgtaaaggggaaactggacagtgacaggagagccgacctcatccaattcccgctgtgtctcctcttcgatcaaacggatttccatcagtgtcagtccgtaccagcggtccatccaacagaacaactcgcgatggaatttgcagaaaaggcgggggtattgctaaagggatgcacaaattggaaagtgtactcggaaatttttacactgccaatgccgattttgaataaattttaatagcccaaaaactcaaattgagtaaaaaccgttcagaaaacgcgtcactaatttatatttttcgctcaccttttgcacaaaagtctcgaccagtttttggaagccgaaccacttgaagttgatagtgaccagtttgtaagcgcacatcaccggctcgcagttggtctgccacgactgcaacaacggacctcggcctgtcctctccgagtggaacgtcgagggttttgtgtcttcacgaatgtcggctgcatttataaactctttgtcgttcgcgatgtcaatgcgcacgacttcgcgtttacttagcatatccgtcgtcagacagagcgcctaaaaatgggtaaaatgccaaaataacaaattgaagcattattacgttttcagtggtgccgcggtcgttcagatgaatagtttcaatccgaatgaaaaagctgtccttcatgaagtccgggttggtcagctcggttttacagtacggatacgcattccacgcgtgttcatggaccgacatcgaaccctttggcataatcgccctcagaagagacggcacttttcttgaaaacgctggattagttgccgtacattttgccacttcccctcccccaaactcacgaatcgaaatggtaaattttatgcgtatattgtccggaagagaactggccattgaacagactctcaccttcaaaaggttcgttgcgcaacacctgaacaccttctccgccgcccgtctccttaaaagtcgtataaattgttcacactcctcctccgccgacggccatcggttgacaagcggttcaagagcttgaaaccgttgtttgttgcctacacttttctgtgcgcggcgttctctgctgggtgcttgaacgccacaacattcgcatttgtaaatattgccaattttttccggcactaaaaatagaaatttaaaatttttttaattgtgtatctgtgatcagcgaaaccattgggactgactcagccaggggctgatccctgcgaattttcttagggttttcaaggccaacgacagaatgtgcctaagtctaggcgactgggaattgtctttgatcacttttactgtgtttgtttgggttgatcaaaatgtttttttttctaattgtacaaatgccaagattcactatctaattaaaaagacctccccccaaaaaaatttctcattaaatgccaacaaaaaaaatataaatcaaaaattcctaaaatttacaattaaatgtgccatatttgtttcagatttaaattaaagtgatgattttgtttttacactaatattaataaattttgattgtttgcttctgtaagtgccaattttcgagaatgccaacctgcgtattccgtgttcaaccaaacacattactttcggtaattggacacatattgtgtttaataatatttaattttttcatttaaaaattgatttattaagctgtggtacaccatcggttgcactttgctcaactcctggttactgtacctggcctttgtacggtatcgactgtacaccgacatgcaatggtgagcagtgagtagtgatcagagaaattatttttggactgggttaattttaaatttaaatcaaactttacctaaaataaagaaatattaagacaaatatataaataatatatctaaggaatttaaatggaaataaaaaaaaataataaatttaatttaattttctaaaagatgaaaatgccattaatttattgcttacttcaaaaattattagcttagaacccacaaatttgtggattaaaatatattttttgcacatttgaggcctgccggcgcatttcctcgcgtttggctcaccgcttacatatcattgctcggcacttgcattccaattttggcactatttttggtgtttggccttatgaaaacggtgttttgaatttttcaaaaactttattttaatttgaaaaatcaccacacagggcaatttggccggtgacaatgatcggttgggtgcacgtccaaaacggaccattgagctgatcaaaggcggcatgggcaacaccgctgtacggcaccggaattcgaatggtaaagcaaaaatgccaatgccaaggaaatgagtttaatacagagacactcgagagccgagaaaaagccgactcgaaaactaagacagagaaatcgaattgtaattgaggattttaagttcgctatgtccgttataaaaatgcgaaattacggaatatttcagccattcttttttttccaaaatgccaaatttgattttctttgaaataccaaagtttgaataattttgtttaagcatatcgcctgtgccattgtttgcgttcggcatggcttcatgcgccgccggcaccccagtgtttgcatgtgctgcttgcactgctccaactgttcgtccagcaagcaatgcttgcgcaactctaccgatggggcttcatcaactcgggtgattgaatgtttaatatcttttttaaaaataaatttaattatttctaaatttttgtggatttaaaatagatttataattaaataaataaatttatttatctaatgattaatttaaggtaaaataactttattatatatcattaaattttatatgtttaaaattaaaattaattaatttttaatcttttaattgatttagggttaatttttaatctttatggattttttaaattgaattacagaaataacaattatttttttaattagtgatttaattttttanaaatttcaaacattattanantnntagtnnatgcttattttttaaatattactttatttatcaaattanattnaatttnnattttgagttatataaatgtaaaaaaattactttttttttgagtctaaat

SEQ ID NO: 11921 - DNA, 3202 bp, Heterodera glycines
  misc_feature (3131)..(3131): n is a, c, g, or t
  misc_feature (3150)..(3150): n is a, c, g, or t
  misc_feature (3188)..(3188): n is a, c, g, or t
ggccggaaaaattttggaattttgaatcagatttgtttatagaatttgtcaaaaaatgatcaaaatcttggtttaatttggcggtttcggctgttaaaaaaaaaattaattttaagttgaaatatttcctattaattaaatttcaattgaaataatgtaaagaaaatattaaaggattcccgtttcgttggggaattgaacccaagcgaaaaataatgaaaggccgaaggtttagccaccagaccacatttaattttgatatttccaaaaataatgttctttggttttaagagattaaggaagcagagaaagagatttatgatgttttctcgcgtaaatttaaatatttttctgactgctcaaaagttcaatctttaggtgtgtattttcgcctctcgtcccaaaaaacgagaggtgagaggcgagagtcccaaaaatgacgagagttggcgagagttgtcccacccctgttatttatatattgtattagcatgatataaccttattttgtattttatgctgatcatttccaattctatatttaaaccagttttacaaatcttaatcatcttaatcaaggtacgttttttgattaactcgttcataaattagaggtctaaattcaaaaaatgtaaaaaaacttacagaaaaaaactaaagcgcaatctacaagaaaaaaaaattttctttatataatttaaaaaacgtttgtgtggatctttttcttaattgttgattcattaaaaataaggtgcaaaatacctaatgttattttttttcttggatggcagaaagagacagacagagccaacaattcccaaaaaatcaaagaacataagaaacaatattcttgctatttttataatatggattttattctttttaatttttcgttcatttttactaacaaatttatcaactacatgagctaaaattccaatattttattagatgtcaaaaggccataattattttatgttttaaagaagtggatcaaaaattttttttgttcttttatattaatttccttctgccaacttcttataaaataaccaatgtaaaaagtataattcatttatttccaataattatttggtgaattaaattcgatagtatcaaatgcattaaattaaaaaaagataatgaattgtttaagcataattcaatatttatttaattaaaaacgatacgctaaagaaaacgcaaatttaaattgtaaaaatggatttaatacaaaatattaaaaaaaacaaggcaaatagacaatattaaatagtatacttagataaaaagcaatcatgaagttcgagaaatgttagatgccatttacatttattttgtcaagagaagtcaacaggagcggcatagacaggtcaagtaatatagaaaacaagcatggcagagtgaaatctatacgctgaatatgagacatgaaataataataaaaataaatcggagatttaaattaaatatgcatcaaaaattaacatagttaatttataataaaaaaaagataattaaattaaagatataaaaaaacaattaaataaatacagtaaatagttttaaataatgaatgataaatcttaatagtacttaaaacattttaaattaaatcgtgaacaaatttctttaattaacaacattgagcattattagcacatacaatttagaaataaaaaagaggtcgcttctgaccgtaaaaaactttacaataattatctcggaaagtcatacgaatttcgaagctaaatttttcttgataatataaatttactaataatattataaaaaagtcaattaaatgaaagatataaacgaaacaatcgaaataaataaaggaaataatttcaaactataatattacatttactattctatattaatgtcagataaaatcttgaagcataaaatctatgcatatgcaagaagaattttataattattccgacaacatctaattaataaatgataaaaagataatgccgctacaaaaaataatcaagataaaattaaaagaaaatagaatttgatattaaaataaatttaatataattctttgaatataaataatattatggacaacaatcataacccaattattaaaatttaaacaataaaaatgtattagattacaaacaaataaatataaataatattaaaaaatattaaacaaaaattttaattaattattggtattaaatttcaattaagaaaatcgggaaataataactccaagtaatattattcaacctttgtaagtttcattgaaaaataagaataaaatataactaaaaataaaaaacccaaaaaatgattaaagttttcaattaatgaaaaacagtcagctatgggaaattgcttgctataagcacgactctagtgacgattggctctaacaatttgttttttgtaaaaaataaaattagaatccaataatttttgcaaataaaagaaaaaatccgtttttgtatccaaaatttatgaaatgtttcttcttgatttttaagagagtcttcatagccaaatagcaaaagtcaataaaacctaacaataagaaaattcaaagcttttaaactttgtctcaccacgtatatcataaaattgttaaaatgaaaagcaacaaaaagataacaatataaattggtggaattggttgcacaaaaagataaaattagttaaaaaatggtggaaaatcatttcattcatgaaaaatacacatataaaaaaaaaatttctataaaaaaattgtattaaatttagtgaactatttcaaatacataaagataaacaaaattcctaattatttctaaatttagatcaaatataacattgaaatccaatttgaatatttatattacaataaaaagacaataaaaaacaacaactaaactataaaaatatctaataaaaaaatcctggattaatggccacaatggtcaaaataattaaaaaagattaaatagatcaaaagactttattattatattttgaaaagatttaagctgggttttggcaatttaaacaaaaaacatttactcaaattgtcttttattttttaagaatgtttttaattgaaaataaaaattaaatatataattactcaaataatttacatttaaatgaactanataaattattaggaattanacaattaattggacgaatggtaaatataaagtaattanaaaactaatttaat

SEQ ID NO: 11922 - DNA, 1932 bp, Heterodera glycines
tttaatgtataaatagaataaaaccttcaaaaagcaaaccatacttcacttatttattttatttaaaaggcaatataaaaatataagcaactataatttgaaacaaaatttttaaataaaaataagattttctaatttttaaccaagagaaatcccagcgctatttggatcgccgagtcatcccaagtaattataaaaaatcattttgaattttggatattcacacaagatttggactattatataacaataaaaagagaataaaaaatacaacaactaaatataaaaattttttaatagaaacataaagcatctattaatgtcacaatataataaatattaaaaatagataaataactgtattattatatttatgagaatatagaagcttaagctttacaattcaattaaagaaatattttcttaaagtgtctttcattctttttaagaattgttcataatgagacaaacaaaaaagctttaataaacttaacaaaaaagaaaaacatttaaacttaaaagcaaaaaaaaaaatgtaaaaataatttcaataaattcagtaaaactttaaatcacatgggacaactctcgccaactctcgtcatttttgggactctcgcctctcacctctcgttttttgggacgagaggcgaaaatacacacctaaagattgaacttttgagcagtcagaaaaatatttaaatttacgcgagaaaacatcataaatctctttctctgcttccttaatctcttaaaaccaaagaacattatttttggaaatatcaaaattaaatgtggtctggtggctaaaccttcggcctttcattatttttcgcttgggttcaattccccaacgaaacgggaattctttaatattttctttacattatttcaattgaaatttaattaataggaaatatttcaacttaaaaattattatttttttaacagccgaaaccgcaaatttaaccaagactttgatcattttttgacaaattctattaacaaatctgactcaaaatttcaaaatttttccggcccccgctcccaatgttccaaaatttttttgaaaaagtagcaccacaaaaagagcgatttaaaaacaaaaaatttaagagatttcaatttattaaaacaatagaaaaataccattaaattaaaaaataccaatcatttacatagagaaacatttaaaagaatttaaattatcattaatctatgcattttaatgaaaattttttcaaaaaattttctcggaaaattccttggtccggggtcccgtcttttcttgcggtcccggtcccgtaaatatatttcatgaaaatatttatataatatttttaatctataagcttttattttcaagaaaaaattttgaagatttttttagatttcccagacccgtttggaccccgacccggtttaaaaactaggatcctgacccggcttttccagacctggcaatactcggacccggtatttgcccagatacccgggcctgtaactctaatttaatatacgattttgaaattttttggagtaaaaaataaggctacagaaaaattgaaaaacaataaattattaaatagtttaaagatttttccagataacgataaatttttaaacaaaaatttttattgagaaaaaatattaaatattgggatttttttgaaaattttttcaattcttaggggtattttctgaaaattttttcgggtcaaaaacataaactgatttatagaaattatttttaagttttgaaacaaatttacttattttaatgttttgattttctgtattgattgattttggtatattatatttaattttaatgtttaatttaatttaattattatatttaagatatttgattatcagaagtccttaatatcaaattttaaaatgagcatcacactgagacgagtgaaagat

SEQ ID NO: 11923 - DNA, 1472 bp, Heterodera glycines
  misc_feature (508)..(508): n is a, c, g, or t
cagaagtctgatttttgcaaaatttaaaatctattaccttttaaaacccaaaatcgaattataaagaaaaataacaatattatttatatatttgaaaaaataaacatgaaacattttttttgtctgatgctcacttaaatatttcgaccactgatttgacgaattaaaatgttttgtaaacgatgtctgacgttaaactggtcgatttatacgaacaagtctggagagctacatatgttcgaacacaagagggaataagtgccggtcggggtcgctttcgcgtggccgtcttttgagtgggtgcatattagagaattcattactctatatattttaccaaaatttattttgatcttatttttctttcggattttgatcatgacactgtattaaggattctcatttatggaagatcttctatggcggattgagcccatcaaatgaaagccctgggcttcattttgttaatttgaattttcagatttttaaattgttttctgacttaatntagaacattatcaatttccccgttgatatttcccgaaactatgagattcgaccttatattgttcccgaattttgttattttttgttaaatttttgaattttataaaattttatttattttttccatttgatgcacattcgaacaaactgacaaattattatagaacgtacaagccgcaagaaagaaaaacaaaaaaaagttaagaaaattatttgaattcgggttcgggattcgaaataagtcgaaatggatattcggcactatccgccaagttcagtcttaaataggcactcacgcgaaaacgacccccagccacgcgaaattattcaataaaacgccaaaaacgcaaatgcaatgggcgaaaactttatataaaggacgaagtcttactgagaaatatttagtaaataaaaattatatgttttattcaacaaaattaactaaatttgtatttcgataaagagagaaaaatatatataatctttgttgttttcctttttttaagttgatttttttttaaatttttctttcggtatctgttctcattcttgataaaaataatttctggtccccatgttgtactgatcaattggcgtaaaatggcggctttaaacttttatttttacccattttttattttcattgtcgcagttcaatgacagttgttaatttgactaaatatgttttgtgcaaaaatatttgtaaacaaaaaggaccgtcatttagttgttcaaatggggcacataaattgcaaaggtggcctttttaaatcctcaaggtgatttctatggaaaatatgcttttaaaggatgctaattattgtttgtaaagaatggtagattttttcagcgttttttttaatatgaaagatggcgtcataaattacataaatttaaagataaaccgtaacaaatttctttatgaaaagttacaaagtcatatattttcatgaaaattttatgga

SEQ ID NO: 11924 - DNA, 4067 bp, Heterodera glycines
  misc_feature (26)..(26): n is a, c, g, or t
gattcgggacaaaaaaaagtaaaatntttctattcgcttcttccctagttgtacgaaaaaaaatttaattgctcttgacagcttataaagtaagcgcttagcaaacatttattgttaattgctttcgggataaagccgaaaattgccagcggggacggaaagtgggtttaattagtcgtatatggattgtaaatgggatttacaaatttaaaaaaaagtaaaataaatataaatgattttaaaaaagtcatttagataattagttgatcacattaatccaaaatcatataatattagaagtgcaaaaattattgcatattatgcacagataaagtaaatattatgaaatcatgagtgtaattatacaataattgcatgtgttaagcttgtgcacctcagaatttgcgcactattaattatagttaaagcgtaaaaaagataatggattttttattaaataatatttttcaaaaattatttttccaaaatttgggatatttaatgtaaattgattaagaaaatttttaaaattttcttgaatttgcctcttctcatatccagaaagatgcgctgctttatttgtgaattttgtctcctccccccccccccccctttccgcttgaccggcaaaataatttgtgccggcaaattcatgtcggcacaattatttgtccattagtgatggatgacccctcaattttgttacagaaaatcctaagaaaattgctttttcgtgttcacatttttaaaagcgaaaaatttatttggtggcagagaaaatttattttaattgaaattaattaattaattttttaaattccaaataatgacaaaatgtcaaaaaataaataaataaacggaaaaggaaacaaattgacaatgaccaattggccaaaaataaaaatgagacaggtcaggggattaattggattgacattatctcgctgaagaacagatgtgcggaatctcggccccactcttggctgtggggattatgtcaatcttcgtcatttattgtgcccttggggccaccaattgaaaacaaaacgaagtgagttttggccctttggcctttaaattctgatgcataaatttggagattcgtatcaatatgctcatcggttattatcagataattaaaagaaaaatgaagtcaattaaacaaaaaaataaatgataattgaaaaattttcacaaaaaattcacaaaaaataatttctttttattcaatttaccatttcactgttattcaaattgcttaattaagctacaataattacggcccccatttatagtgtcatttcggaggcttttggtttaacaaaggaaacgcgcacctttgattaatgtcctcggctcattcaggcgggggaggacaaggaaaagcggaccgagacagggaccgcccccgcggggccaaatcatatgggcaaatatttgttgggggaagggacacggcagaggcaagaaaagccggctattactgcttatgccgaatgaaaatagaaatgtttacgggaaaagccagcgacgggcctaggaaattagggttttcgatgtctagggggttcccgcggaaaaaatagatttcaacaattttttttacatgtgccctatccgggccgcaaaaagtatccttgaacgtttgttttaccgtcctttagaaaatagttgcctaactcgcgacatttttggggataggacctccgacttttgacttattccgaaaattttttggacccgaaattctgtgctggcgggatcttgaaacaaaagtcatggatggattatgatgatggcactcatttcgtattaattacaccatctcgaaatccgattaagatgaaagggcgaacatttatttatttatttctttttgctgtgctccgatcgtaaaaggggggggggtgggaatagggagggagatgagctgtgattgtgagcattttctgctgctgatcggagagatacgaatcgcgggatgaggatgagctgtgaaaaagatgaatgtgaatgcataatgtatacgattgtcattcctctaacaattagcacttaaccacttagaaaaaattgaattgaaataaaaaaatattttctgtaagaaaaaattgaattgaaatgaaaaaaaatttttttgtatatttttataattaaatttggtaattagagaaaaaatattaaatacataaggatccttaattgctctaaaaaactcacatttgaattaaaaaaagggatggtgagaagttgtgaaaaagatgaatgacaatgtgtacgattatcattttagcaattcaacttttagccattttgcaaaaaattgaaatttaattttgtatatttttataatgaaatttggtaatgtaggaatagagaaaatccattaatatacataatgatccttaattgctctaaataataataacaagaaaaacaactcttcttaagatataaaaaaagacgggaggaataatgaatattttttttttcgaattttgctagaaattttaaaaaaatggaaaaatgataaaaaaaaaattaaaattatgccacgaaatgatttttgaaaaatatgtaaatcttttggtgagaaaatggcggtgtggaggagaactctgctgaattgagtcaagtgttttgagccaacacacttctgtgccccccgcaaagtgggggcctcctaaaactgaattatgccgagacaaaatgaccattcgatggacaaactttcaatgtcaatgtcaattgacgtttccgccaattaacgcaaatcaatcaaaatttgaaaatgattgcgtgatgaaaggttgaatttattttttagtttaaattttgggattatattaaaaaaatttttgtttggccagggtccaacacctacgatgtatgaccattaattaaaaaataaaataagtttgaaaattattgcgtgaaagggttggatttcatttaaatttgacatttcatttaaattcaaaaatgttaggcgtgtccaatttaggtaattggccaccaattaacacaataaattaattttgaaacgattgcgtgaaagatttggattatctttgaaattttaaatttaaatttggcatttatattaattccaaaaatttgtttggccaatccatatttacgataattggccaccaattattattattattatttcaaagcgaatgcgcattatttaggcgaccaaaagccgacccattgacatacaaacaatgcctgtacaaataataaattatttaaaaatgcaaaatgttgttgtctggaagcaccaacagcaggacaaatagtggtgtgcgaacaaaaattaatttgggaatttttgcattttcaaattaaattttttgtttttcgatttccaaagttttagatttattttaaatttttagttctattaaaattcattttttaactctattttacacttctctttcgaagaaaatcattccaaaattatgcacacagtagagatttcttaaaacggatttgtggggataaaaaaaaccaaaaataaaaaaggggtttgccaaatttggtgacaggctaatactttttcgcaaacctatcagggatatgtgccgacccaattcaaaaaattcaggcaatcggaaatcggcattccgacacatccctgattcctattattttttgtttgttttttaatggtaaattatttaaacataaaatttattggggcctctaaaaatgggtgaacaaaggaaaacatacatacataagtcaatttgtcatcatcatctttttctatccccggcggggagggcacacaaaagatttttgggacaaaaaaatgatgaattaggcgtgccgccggcagtaaatacgaagcactcgccaggggggtgacacagaaggatttaggcaaaatgatgttgtcacgcgagtaaacattagcagaagggattttctagcagcagaagcaggcagcatgaaagcaaaatttaaatggcaaaaaaaaacagtaagaatgccaatataattttaatttcgaatgaaagcattgccgaagctcggagaaaaaaatatataaattt

SEQ ID NO: 11925 - DNA, 4281 bp, Heterodera glycines
  misc_feature (46)..(46): n is a, c, g, or t
  misc_feature (52)..(52): n is a, c, g, or t
  misc_feature (56)..(56): n is a, c, g, or t
  misc_feature (58)..(58): n is a, c, g, or t
  misc_feature (62)..(62): n is a, c, g, or t
  misc_feature (68)..(68): n is a, c, g, or t
  misc_feature (71)..(72): n is a, c, g, or t
  misc_feature (88)..(88): n is a, c, g, or t
  misc_feature (108)..(108): n is a, c, g, or t
  misc_feature (117)..(117): n is a, c, g, or t
  misc_feature (123)..(123): n is a, c, g, or t
  misc_feature (129)..(130): n is a, c, g, or t
  misc_feature (142)..(142): n is a, c, g, or t
  misc_feature (148)..(148): n is a, c, g, or t
  misc_feature (150)..(150): n is a, c, g, or t
  misc_feature (153)..(153): n is a, c, g, or t
  misc_feature (157)..(157): n is a, c, g, or t
  misc_feature (169)..(169): n is a, c, g, or t
  misc_feature (171)..(171): n is a, c, g, or t
  misc_feature (179)..(179): n is a, c, g, or t
  misc_feature (182)..(182): n is a, c, g, or t
  misc_feature (190)..(192): n is a, c, g, or t
  misc_feature (195)..(195): n is a, c, g, or t
  misc_feature (197)..(197): n is a, c, g, or t
  misc_feature (203)..(204): n is a, c, g, or t
  misc_feature (217)..(219): n is a, c, g, or t
  misc_feature (223)..(223): n is a, c, g, or t
  misc_feature (231)..(231): n is a, c, g, or t
  misc_feature (242)..(243): n is a, c, g, or t
  misc_feature (245)..(245): n is a, c, g, or t
  misc_feature (249)..(251): n is a, c, g, or t
  misc_feature (253)..(253): n is a, c, g, or t
  misc_feature (261)..(262): n is a, c, g, or t
  misc_feature (266)..(267): n is a, c, g, or t
  misc_feature (269)..(269): n is a, c, g, or t
  misc_feature (277)..(278): n is a, c, g, or t
  misc_feature (282)..(283): n is a, c, g, or t
  misc_feature (293)..(294): n is a, c, g, or t
  misc_feature (308)..(308): n is a, c, g, or t
  misc_feature (312)..(312): n is a, c, g, or t
  misc_feature (346)..(346): n is a, c, g, or t
agttttcaatgttagaattggcaaagttaaaattttctccatggtngaaatnggtnantgtngtaatnagnnattgtttaaattagangaaatttatgtaaattaatntttatattngggttnggggtnnaaaatgggtggnggattngntgnaaanaaagtggtggananattaaggntgntaaatttnnnganangaggannaagaatgagaatnnngagnagaattantggatatttgnngntgannnanaaattgtnnaagnnangttttgtnnaagnnaagaattgtnnaaaagagtaaaaanttangaattataaaagtataaaaaagtaataaaaaganggaaaatgggtatattttagggttttaggggtggattaattaaaattagaataagtttaggggtggtatgtgattggaattagatacatagactcagcttcacacattgaaaaaaataattttattaaacattcaataaaattcattacgggacatggacaattgaatcatcaaaattttcaaatccttcaattttcctgcatatccctcaatttgagagtgccggcggaattggaaaatgtggtgccgaacgatttcgtcctcccatgctgtaaatgaatctttttattgagtttaaacggtttaattgattaaagaattctgcctgaaggcgctatcgaagtcgatagcggactcaacaaatattgaacaagctgctcacgtggactcacagtggttggccatgtaagagttgatggtgccggtgagccggtgccgaactctaggggtagccgcatagcttgttccgagttgatagtcgaaattattgtcccgagtgcagctaaaaatttaaatttttggaaactaaacgcataaatttaaacaaacaatggttgccgatgggtgaaaaattgagtcgattatctcaaaatgcgtcaacaccatccaacatctggcgctgtgtcaagccgatatatgttcgagagaagtaaaggaagaacattggcattccaggagaagacggccaagataattgagaaaaaatcgatttgtgcatcttcagcgatttcctgagtggtgtgtgaatctaaatcctgaatagtttggaaataaattttttgcggcgcttcaaacatacctttcaaccatagacaatctcacccaaaattggtttttccgcgctcaaaggtcattgttgaaagttcagcctcgttcaaagtctgttgttcaacattgtcggaagttatcacggcatgcagttcgtcaatctccactccaaaatttacggcctcctcagttgggtttgaaatgctgacaaacaaagcttcttccgacttttttgtagactttcaagtttattacgaatcatttgttcaattaatgaatagcaaaatctgaagacaaaaaaagcacatatttttaatcaaatttggagatttttcttattcgggtgggtctagggttaggcaaggggctatataaatgtcgtattggtattcagcgaccctgaaaaccctaaaatagacccgttttccggctttttatgagctttttagacttttggacacttcgtgggtttttactcttttggacaattcgtggcttggacaaaacgtggcttggacaattcgtggcttggacaattcgtggcttggacaatttgtgggggcgcctatataggtcataaaatttgaatctagttgaagggtatttcttcccttcaagaaaatgaaaaacaaaaaaaggtatgccaaagttgacttttctctacttgagacagataatctcgactacttacagaccagcttaaacgtcattaatttcaatattggaagtatttgaaaatttatgaaaatatatgtagattctaatttgttttctttctttttttggcatttcagtcgcaaagtttgatatttcggtccgcaaatgtagcactacgctatttttatgccattattatgctataagaacgatattatgtgtaatagtcatattgaaaacaaagttaaccccatttattcaatgctttattttctcatgagaataatcatagaaactgaaatacaatcagttaaattaatcataaaacttcggtttcgtcacccccctcccctccttaatttataaatctgattttttcatctctaaattctcatcgaatcactcgcaagctttcataaatcccttcccgaataagtcatcctttatatgcttaaattatttaaaatataaatcatcattttgatttttctaataggtaaattaagaaaataaaagccaaattctggcaaacaaattcgctgttgttctttcaaatgcgctttgttcagtcggtggtgccaatatttctattacggagtcaatcaaatgctgtgaaagtgatctttataataaggggatttaaaaaagaagttaaactcgataaagagatcatcaaaataaatccttttaacaaatttagctgaactcaagctattaaaaattctttgaaaaaactaattaattaattgagatttggtcgtttttataattattttcaacggcttttattcggccctacaaaacagcgacgtttttttgctgtccaacgggtgttttggcgcccggcgcttcgtggaaatgatggcactgatcgaatttgcgttcaattcggttgccaaacaccgccaaatgttcatttacgtttcaaaggtgttggacccgcactttgacaaagtgatgccacccgtattggccaaagtgagcgccaaagggcccgtggaaacgcaccaaaaaatgccatttgcctaatcatttatttgtgatttattatttttataattgccaaaatttaattatttttaaaaatcgataaaaaaattcttctccatttgttttgtcgctcgctcgtctcatcatttagtttaaattattcaaaaaaaaataataaattcaaaaacactgtagggatatttgccattttgttgttcacaacagcaagaagtacggaatcggataactggtaatcacaccggaaactgtgacccggaaataggggaatcagtgtccccgtacggtgagaaatgtatgaaagttttaaatttaacacagataaataactgattaagattcttctaatttaactaaattttccaaattatgaccaaaaaggacaaaatttacctaaaaatggaaaaatgacttaaaagttaaaaaaagtgaatatatttttattttttatctttttcatttaatttctttttaaatttttgaaatctttgaaattattatttttagatgaggcgttaaggaaaaaatcgaggctcatatttttgtataagattttagggtttttgattttataactattctaattgaaaacaaaaatttgtaaaaatatttttcactaagatattagcgattttttagacttattcattatgtaaatttatttcaacggttttacttttttatttagttcatttctccatttttgctcatcggtcatttttactattttttgttctcgttgattccctaaaccattcatccgtttggccgtgtgcatattgtagcggcattaatttcccattttagcctggccaaacccctcaaacggttaccatggcttttccatttaatttaattggcattaaatcaaaacatctttttattaccgaaaaagcgtaattattcatgtaaaatcgtaaagtagatttatttcgcttttctcattaattttccgaagaaaaatccattaagcattcatttgatgagcatttttggcgtcttctcatttgcccatcctctcccaaataaatcaccaattgaattattatttttatttaattcaccaggatttaattgatttttattgaatttttattcaccaatttttcatttattcaatttttcacttatcttttattgtaaaattataattttccaacctaacgaatacaaaaatattttccttatatattttttcgaataatttaaccaacaacagatgaagccaaactctgtgcaccaaatccgccgttattccttcaaatgcgccgtgtgcagtcggtcgtgccaatatttttattacggcgtcaaatgttgcgaaggtaattaaataaaacgcaaattttaaaatgaaaaataagttacagtacaaaacaaagctttacaaggggacaaacagaaaaaaaacattgaaattcaattaaaaaaatattttaatatgaaattaaataaaaaatcagaatgacaaaactaccaccttaattgggtaagggatttggtag

SEQ ID NO: 11926 - DNA, 3190 bp, Heterodera glycines
  misc_feature (51)..(51): n is a, c, g, or t
  misc_feature (96)..(96): n is a, c, g, or t
  misc_feature (144)..(144): n is a, c, g, or t
  misc_feature (164)..(164): n is a, c, g, or t
  misc_feature (167)..(167): n is a, c, g, or t
  misc_feature (169)..(169): n is a, c, g, or t
  misc_feature (182)..(183): n is a, c, g, or t
  misc_feature (190)..(190): n is a, c, g, or t
  misc_feature (256)..(256): n is a, c, g, or t
  misc_feature (260)..(260): n is a, c, g, or t
  misc_feature (325)..(325): n is a, c, g, or t
  misc_feature (335)..(335): n is a, c, g, or t
  misc_feature (394)..(394): n is a, c, g, or t
  misc_feature (462)..(462): n is a, c, g, or t
atataatttttgttaaaactttctcaattttaccaaacttccctgggttgngtgatattttaattgggaaaagtctaccccttttttgaaaaaggnaaaaaaatgatggaaaaggattaaggggttttagtaattgatgaatangatttaattaatagtgattntgnantggtaagtaaatnnggaggtnaagaaaaattgaaagaattgatagtaaaaatgtaaaaaatggatataaattaattattaggatgtngggnaatttgttttttgtttgttaaggagatataaatatatgtgataatggagagatggtagtgttgtnagtagtgttngggttagattagttaggaaaaataattatggtgtagggaagaggtgttattaaaagtgnaaataaaaattatttttaaatagaaaaataataaatatttaattaaatgtatatttttagttttatgntaaagggtttttttcgcaaacttccttgttaaagcgttagtaaatactcattggtgccggctgctgctgcggctggacaaaaaaaagtttaagacaaacattaaaataaattgcaaaccccagcgaagaaacgaagaaatgcgtccaaatccatgaaaattttttgtagaaaatttgtaagctaaaatcaaaaccgaaataagaagagaattttatgtgaaaaaaggaaaacatatgtatgagaatgattgttaaaatgatctaatctggccatttttatgcaaaactgctaccaaaaacttttattcaaaaaacaaacaaatttttttttgaaaaatcgcaaaaaatttcgttttatgacttcaaagtgcgtgcaacattttcttaactaaattcaataaaatcaaaattttctggcatcgccttcggcaccatggcgcccaaagttctaccattttcgaggggtcataattagggattccaattatatggaaatccatatttttttcctggactgtgggaggcctgaaacgcactcaaattttttcgattgaaaattttgagtctaattccaaaaaaaaacaattatttcagaaacaattgtgaggaaggggaaatatacaaacccagcttgaaattacttttaaaatgatttgctttacacacacatatatatatatatagtgtgtgtgtgtgtgtgtgtacctgatccatcaaaatccccgccagattcttaattgctccaataatcccaatctccaacgatgttgtgccaaccggttcagtcggtgccttgccagtgccaagcgaaacaaaacactccagctcatactggggttcctgaaaatgtaaaaattgaaaaaaaactaaataaaactggtcaactgctgcatacattgtgttgttttgccaatgcattttccttgcttatttcatccaacagttccaggcttggaatgtttgcgagcagacctcaaaatcattattttatatcaatagtgaatgggaggggggaagtttgggtgcaaaaacggtattactttttagcagggatgggccaaattgaaaaataaaaagcaaaatttgcgaaaaaccggtgccggtacatttatttttgaaaaaaccggtgccggtacatttatttttgaaaaaaccggtgccggtacatttatttttgaaaaaaccggtgccggtacatttatttttgaaaaaaccggtgccggtacatttatttttgaaaaaaccggtgccggtacatttatttttgaaaaaaccggtgccggtacatttatttttgaaaaaaccggtgccggtaccgctctacccttagtcataaccttgttcaaactgtatgaaattttttgaaattttggtctatcgaatgatatcaagaatgtttaatttggttaacaatgacaaaagttatggacagtttttttgttgaaaattttcatttgatggtttttttatataacgacatagcaccaagccaattagttaaaaagcattactaacgatttcataaccattttgaaggcaaattagcaagcagctctcggcttgagaatcagaattataagaattatactctgttgagtacgctgttaaaattttgactgccaccactttggtgtctacgcttttgaacaaaagtgttgaagaagcgacgaagatgaatatgatgaagcggagggagaacattatcagcaggacataaattggcaaatattaattctccaaaatttatgtttgaatattttgtcgaaaattttattatttattatttaatttattattctccttatatattgttttattcaactgtttatcggagaaatatattcaaaacataatgtggcgccggatgttgttctgcgaatttttctagcgcataattttaaccgggaaaatgatggcgcatttgattcaattatttatttgcatatcaataataatgctttctatacatatattacgtcaacataataaattttttaaattataaaatatataaattgaatttttaaggaattattaaacaattgtataaaattcaccttaagaatttaagtatgtaaactaattattagttcatttcacgtgatcacagcgaagagatttaccgctaataaatgccaatgactatcgatgattggcactcagccaagaaacttgtcattctcacagttataaaaaaaatcgctcaaattctgaatcatcaaaaaagcgacgaaaaagggatgcaagccaaatgcctcattgatggcagctgcattcgctggcgatgctcctcgcgttggcattctgtgccggcgacataaggggcggatcttcagtaaaaaaagtcgcaaattgccgtcgaattcaagcgaaattgtccgagaaactaaaagaggaaaaacggctcccggaaaatgggtacttatcctttttgtgaaattttttgaccagtaaactactgtattgtcgtcggcaataggtttctttgtcccctcccccccccatttttcgaaaaataattgaacatttttaaaaatgtgtgtaaaacctgggaattatcgaaaatctgacacccatttctataaattccataaaattaacctagaaaaaatattataaaaaaaatttcagggggtcacaaaaatgattggcacctgaaatgcatcagtaaaaatgtgtcagtgatacaaatattttaaaataaattctacatataacttatgtatgt

SEQ ID NO: 11927 - DNA, 3684 bp, Heterodera glycines
atttttcgaaatcacccaaaaaaaattgaaggtcttaaaaaatagcgatttttttttcataaaaatttcttattaaatattgcatctttgttaatttgaatccatacaattgcatataatagagttcgacatttcgaaaaaaagcagcctgaacctgggttccacattggacctggattcctggagaaaaatcaggttccggaaaaattcaggttgccgaaaaatggcctggacttgtgcccaggaaaacccaaggcgttggatccagggccaggtcgaactctacctataataatttaattccttttttctaacgctccgtccaaaaaaaaaccaacctttttcaatgccatcgccgccattcccgtcatcgtcgtgccattgttgttcaacaccaattatttggtcatggtgcaacaaatggcgtcgtccgtccatcagacggagtccaacggcgccattgccagcgccgcatttgagcgacaaaaagcgttttaaaaatgggaaacgactgccgccggcggcgccgccccggcgctcgtccaaagagcagaaaaaacgcgtcaaaaaacggctgccgctgtttccgccgccgccatcaaacgggacgggaagacggagcagtaacagaacggacagcaacagcaggaagagaagggagagaaagagacgccgggagggaaggcaaaaggtgggagaacaacagctggaaaatgtggcatggcaaacggtatttagcatggaatgatgaaaacaatttatggcacttttttcaattttgggtaagggatttaattttttttttaaatctagagttccaggctcactgataaaggacatgttacgttttttgattaaaaattttatgaaaaccaaaagggtcttccccatttgtttttctatcgtgccccctataagttaaaaagtgcattttcgcatttattttcggatgcaattaattgcatttaaaaattggtgagattttctgatgataaaaaaaaatttacaaaaataattgctcgttggatgaatgaactaaagcgaagaatttgtccatcaaaaagtggtaatttgcttgcatttttgcattttcacggacctatttgggccagaatttttgcagtttcttatgatgatgcaggaacagagaaactgcgacgaaatccctcctgtttattcggggaaaacacaaaatcaaaattttcagcaaaaaaatgccacgggtattccgagtaatattcaaattacggagacatttgaaatgcttttttttacccaaaaatggatgacaaagcaaaagcagttgacgaccgtcgcctgagccgcaatttcgacgcgacaaaacgccggcggtgcgccgtgccaaagtggtggtgggtgttgtcctcctcctcctcccccaatttggcgttgtcggcgacggcactccgtcgttgacccgccggagcggacaatggcgcggaggagggcgcaacggttgcggaaaaagtgcgcaaacgaagcgacggatggtgacgcatttatggggactttttatgatggcaatgcatttttgccgctttttacattgttttcagttcctaaattggcatataattataaaattcgatattttttttttgtataaaaatttgtcatattcaaatttgtagcagtatgcactcaaaaaatgtaggcaaaacagtcgaacagctgagtggtgccaataattttttttatacgttttattggcattacgccaagagaaagaaaattaaaaaaaattttgaaaaaatgattttattgctgacagaggcagccgatggatgcaccattaccattttaagcttttttggctccggcgataaaagttattatcagaaaaaaagatcaattaaaaatgcaagcaaaaatttgtcaattttatgcttttttcctcttactttaaacccccgttttagcagggagaccattaaagtatgcaaaaatcacaactaattgattgtaagcccattaagtgattgatgtaagtttagtgtaatttttttggcattaaaaaaataatcaataacaaaaaacgacaaacaaaacaataataaaaatgaaaagtgcaacgataagcccaaaatggtgatcgatcagccgaaaatccgactcaaaaagcgcattccaacagccattttttgatcacttcttccgccgccattagttgtctgttgttgatcaactttagctgctgctgctgttgtcggtattcgctgctcaacaatgcgtgccatttctctgttccgtgtgtgaatgttgtcgtaacggagtcggatcaccgtgttcttctcggccggcgccaaacgcttccgttttgggatatacctaaacagtgccgatttgaatttgtaaaagggatattctgtagagataaagaaaaatgtggggttgcctcccccaaatacgaaatttttttcgtcccgagtcttacaacttccgttttatctaaactgtgccgatttgaatttgtaattttttaatttcatatatatatgtaaatcgggctattttgattcatttccggcaaattagctccgctcaaattgggatactattacaaaaatagccaggattgcctccccaatccaaaattatttttttatacgaatcttgaaacaacctcatatttttgaaagccaacacgacccgacatttttgtacacgactcggcacttttctagtgccaaatccgtgcccgaagctggtaatagtaaataattaagacttcgttcgttttattgcataacccccaaaaacgcactgttcaaatgcgccgtgccaatcgtcgccgccgggcgaatggaacacgtgctgcagaatggccatcgcttggaccagggtcagcattgggttaccaccgcgcaggaactcgggcgggatgggaaagcgtcggcatggcagttgctcttcttcgctgaccaacagcgatgccttcaccggaatgcgcggctcacgtgccctgtccacaatggcaccgatcacgtaacaggcgtcgggatcaatatgctgtgaagggggaggggagggagtaattagtggaaaaagagagagagagatgaaaaaagagaaagatggaagagagagatgaaagaacgagagcgagaaagagatgaaaagcaaagagagaaataagacagacagatagacggacggaagaaagaaagagacaaagagaaatgggaagagagagagagagagagaaaacaaaaaaaaatgcaataataacatgggcagagtaaaatgccaaaaaacgcactgtcaatgagtccttggagtgcgggctcaggtagacaattttgtctgcgctgcgcaactccgggaacaactccgtgtacgactcggtgtgcagttcgccggtgacgcatcgcgtgctgtccagcgtgttcaatcgcatacgacaaagtgcgtgcacttccgcaacagcaccagcgtcggcaccgccggtgccgtcgtcggcggatgatgttgaggggaagttacacaaatggatgggccatggcatttgccggtcacggttggcagacaacaacatttgtaggtgaagcatcgtcagattgaggccacgtttggtgtgcagagtctgtttgtgtggtgagggaactatgaaaagcattgtcgatggagttgatgttccgggtgtcatacgcccttctccccgac

SEQ ID NO: 11928 - DNA, 1001 bp, Heterodera glycines
aaatgatttaatcggacaatactgaaagaaattatacccaattcaaatcttaggaaattttttgataagtttctagaaaaaaaaatttgaaaaaactttttcagcaaatttttcaaaaaattttccttgaaattttcttctaaaaaatcacaataaatgttttaaagaatttttttgggggaaggggaatgaattgtatccgatttccctgtacatcaccaacccgtggagatgaatgggattgtaaaggctttggttttgcgtgttgctgttctttgctcatcgccctttttctcctcctcttcgtccctctgttccttttcctcctcctcttccactgttcttcttccttcctcctcctcttcctccaattcctcttccaattcgtcttcctcttcttccatttttggcatcgccgtgccatcgccaccaccgcttctcatcaattgcatttgcgcctttttctgctccgttttcagccgcattttgttacgtttgaccaaaaaagtcaaataggagagtcgttccttggcactgtgcagctcaagcaaacggtgccaatctgacaaaaatgccaaagaatatccggtgataaaaatgacactgggaggggctaattgccaatttttcctggaaaaattttaatttcgggaagggtgaatgcccgaaataaatccctaaaaattgctgattgtaagcggttagcccatccgtccccgaaatgagcgtattgtctgcctatgtaattgatgctcaagactctcgataccggtgccgaatcttcgaaaaaatgtctattccaaaaaaaacatgcaatttgttttctctccaaaaatgttaccgcgctcttccaactgagttggcagataagtggtcacacgcggaataaactgaaaaaaatagataatgatgagttaaaaaaggggggtgctaatccgacgaaattgtggtcgcgccgaaaaaaaagattcgacctgaagctgggcacaaagccgttcaaa

SEQ ID NO: 11929 - DNA, 4387 bp, Heterodera glycines
tggaatttgtcagccaagaattgatggacaaacgcaacgtcttggagatgaaagtgcgtgcaaataacagaaacaaattcgattgggacacacttatcaaatacaacatgcaggtgctgtattcttttgttttgtattatattagcagaccagacattaatgaagggggacgtgggaatcttgaggtgaccactgttttatgcattcatttcatcccgaaatggcccttgctaattgtaagtaattgtttgtttcgtttcagaattgcaaggcttggctgagtccgtacgatgtctattggaagtgccgatacaaatgaactacggaattgtttttgttctttattaattcaaaataaaagtttgttttacaagtacgttgaatctttcattgtgtttccattttcacttcattttttcatttttattttttgcatttttcacttttaattcgtcattttcgatttatcttatggcttttctgtgatgcaaatttttggggaggaagagctcctttccgtcccattcaaatacgtcgtcctttttgccgtcggttgtcctttggtcgcttttttgctttgtttgtttctcagcatattcctccattatgagcaggtaacaaacagctaattgaacgtaatgctttcctgtttttccccttttaggctgtgtggacgcattgcgaagtaataaattatataaataacttcgcattttgtgggttctttaaaatgtctctcttcctttccggttcctaattggcttccctctttgtcggctgctgtttccacttttgcgcctgaacgttacatttggcggctgttcatcggactccatggaactccgaggtttcaattctccccccccccctccattttcgtgcttctctcttttccctcagattggtcgctgcgttcgccttcaagtgatcgcttttgctcttcggcctccgaatgttccatttttttcctccttcagaaactttctggtcacttccagcctttggcctttcccctttcgtccatggtatcgttgggcttccaaattcgcttgttcgttgaatttggccgaaattctgtcactgattttgctctcgtcggtttcttcaacggaggaccattgtgagttttgttttctgatgaccgctggtcagttgtcctttctttaacagtccttcacgccctttgtttctccgggttcactttcttcgctcatttttacatgtttgtcaggttcagcccgtgttggttttgaatttcttatcaatttcattatttaagtatttggcttttcgacttctccggaagacggcggtccagcaaattggtaattttgggcagattacattcaacccggccttttcaagaaggggcattcctgtgttcatgagtttgggatgaaacttaatgcgtagcttaccgcggttagttttgtaaaatctttggactccgaggcttctctattagcaagcacaattttgaaaaaaaactcaaatcaaagtcttgattttcaaacaatttcgtcatgatatatttcatgttaatagagaaacctctgggctaccaaataatatcaaatatattggaataaggcaattttgaaaggtctgatagccaaaaaactgggatggcgcccattcaccttcgcttgggatttagtaaatccatttgcccttcctttttgtgtttgctttttcatcccttccctcttttgttagggtgaactgtccttccaatacaaagtgttgtgctgcgtcggttctgtgctttcgctgcttttcgtcctttatttttactaccgtcacaatcgcttctgcgagcccggcgtttacactcttttcgcgctcagcgagtacagtctgattctgttcaacattctcttccactccacgctttactacgacttccattcccgcgcactcactttgaacaccgcggcactctcttccgtcgcggggtacgatttgttgccgttgtacagcgagaaaaggacgtgacgaaagggaggacaaatggtaatgatgaccatctttcactgctgtatattatttgttttttttgttcattttcgcatctttcccaaatatttggccagtaattccttttgagatatatcactgtgatagtgagatgttttttaaaacttttaactctctctggtctatacatatgtatatttattaatattcgtgatttgtcttgtaaattctgcaatttataatatgtatagcaaatatttaaaatgtcaattttgcttttgtcgctccattaattattttaaacaattcaatcgttgcgtcttattcagggttcgtaagttttttttcaaaaaaaggacaaacgatgctaaaacaaagattttgaccccaaaaataagattttttgaaaaaatggctttttacattgtggaaacagctaaaaagcattattggatgttgtaaacacaaaggtaaaatcaatttgaggcgcgcttttcttaaaaaaacttttggatatagggggccggcggtgccgataggcgccgtcgggaaaaatttttgaaattgggagttttggtagcatttatatcagcgaaataaataattatgcacaaaaaatttaaaaagtttggggaagcctgaaaataatggacaatcttagaaaaaggacattttagctttctaagatccggcccctccaaaaaaggacaaatctttaaaaaaaaggacacttacgaaccctggtcttattagttattgcaattttgtgccaaaatatgtgtcggaggggaggggctcttttgggaaggattatgccctaggcattcaagcactcccggggcgagtggggggaagtgaggcgttgtgatgagtcaactaatccccgcggaaacattcggacgaatgggtgggagagtaaagggggccgaggaagtggaaggcaattgcttactcttttgaaaaagtcccgaaatggccaaacggagtgtgtgaatcgtttgagttaggatcactcgcaaaaatcgattgattggcgattattttgtcctttggccattcttccgccggctttctcttcgattggcttccatttctctcgtttttcccttcctttctctttgtattcccttgggcaatgaattcgttgaaatggtacagatggattggatgcttttcctcccaattcaatttgtgttcatcggatgaattcctttcgttccttagcttgattaggcttcatcttcttccccctcattttcccttttattttccgatggttttcccacaattcttcgcttttccttcccaaattcccccgcttctcatcgttctcttcgttctgttgcttcacctccataataattccccgcaaattgttggggcggtggcgacgaaacgcgcggccaatgggcgagaagaaattgggcgaggacaccgccgaaagggccgggcggaagagacggagggggagggggagcatttgcgtgagttttcaaaggcatcgccaaatcagtgaaagtgccctttggcattcattgctcaatcattatccattctctcacatcgctttccttccgccgtctactgattaattactttctctctctctcttttttatttttaattagaatttctcaatattttatcgatggaatcgaatgggcaaatgcgccgggggaagggggagtaagcattttattatttgcgcagcagatagacgtgggcaacgacggacagtttatgtacaagacgaaggggggggggggtggggtcgagcagcgattgcttctcccataatccctcacagtctctcctccgcccgcttctgcttttcccttccatttccccctcctccgcccattcttttcatttccccatttaattttctggccatggatttgactcgccccactgatcaattggcaaatgaccggtcaaactcttcggaggccccacaacagcagccatttgttgtaaatgtggtggcttctcgccccagaagtaaaactgaccccaaaaattacgacccgaagcctttgatcgtcccgccgggtgctgccgctgatcagcgaggcccccgtcggctttccccggtcccgtgcctttgtatggcgcgcaattcgtcgcccaccggtgcctccccctctcaactcgtctaccaaccgcggactgtcccttctccgtccgcgagtctctccccaactgatcaaaaggggtggggcacgctgaagaattcgtcggatccgtcgacaataaatgtgccgataaagacgagtgtttgcacggcaacggtgaaaacggcgaatgtttgtggcagagaaatcggcacagtcggccatcggcaccaactgcagcagagccaatcgaagtaaagacaagcggcggagctgaatgtcggcgacagttcgaa

SEQ ID NO: 11930 - DNA, 1434 bp, Heterodera glycines
  misc_feature (56)..(56): n is a, c, g, or t
atttttacgaatagagggggggggggttggttcatcctccaaggattctttttggnttaatttgactgttaaaaggcctcctgaagagatgcccttctcgtcggcaccgtttgttggccttcgtttgccattccgtcgtcttcgcctttctcagcggacgtggacacagaactgcgacggctcagccaattctgaagtttagcaataaaaaaatcggccaatgaattcagttttccattctgatcactgatcggttcatttaatgaacgggtgtggacattagagggttttttcgcattaaagcataaaaattcatcaaagggatgatgagtgagggattcctagtaggttaattagtatagtcattagcattgtcaattactcacttggcactgctcctggtgaatgttcagcccgactttctgcgcgtatcccttcccacagccgtcgcatttgtatctgtgaaaatggaattaaaaaataattgtttatttccaatttcgaatttacggcttttcgccggtgtgcactcgcaaatggacctgcatgttgccctggttggtgaaggatttgtcgcaaaaattgcatctaaataatctgttttttttttttgcattttaaaattgcttcccctttttctctgccactctctcccacctgaacggtctttcgcccgtgtggagtcgcgtgtgcacatacagcgaactcgcgtacgcgtaacgcttcccgcaaaacttgcacacaaaatcattggcggaggcgatcgtcgaagtagcggaagcggataattttcggatagtctgttgctgctgttggctaaccgaatttggcacggtgttgtgccgttcctgtctctgctgttgctgctcctcctcccgattttgctgttggctttccgttgccatttgtgccgtggcacgtggcgatcgcggcggctgagagaacggacggtggggtagcggaagcggagccatgccggaagaagcaacaaaagaagcgggaggctggtggtgctgaaccgctgaggagggcgacggaactgaagccatcgtcagcggcggaggagaagccacgggctgggaggacggaagaggcgcaaacggaagtgaagcggatgaagcggatgaggaacaggcggaaaagactgtggcggacggggaagagaccgtcggcaaaggcacggaacggtcgcaggaatagcggtgatcagcggaaagcgagcgatcagaaataggttggccagaggagtgacgatgatcagcgggaagagaatgatcggataaactctgatcatatgtattctggtggtcagcaggagaagagtgatcagagaaattctgatcaggcggatgaccagcaggaggagagtgatcggagaaaggctgatcggactcaaattggacaacctaaaaaccaatttataataatctaaaa

SEQ ID NO: 11931 - DNA, 1818 bp, Heterodera glycines
tcgtggctttgcaattcccttggctggcaaacgctttcggacagaatttgcactgatagggccgctcgccggtgtgcgtccgcaaatggacctgtgaaggggggctgaggttggcagtgtggagaagtgatcatagaaagggattagacaaatcagactgccaagcgagggagaaggctttcttttaatcagtgcctccgtcctatcattatcccaattaacccaaccgatatccggtcaaacccccggatcaatcgatatcgcataggctccggccataaatcctctgccctgatcaatcgatatctccgatcagttccgctccttcccatccttccgcttgcctgtaggctccccgcgtaagcaaatgatttgccgcagaagcggcagctgtgtttgcgttcgttctgctcgtgcacctgcttgacgtgcagcttcaggtagttctttagagtgaacgttttcggacaatgttggcatttgaacattttttcgccgtgtgtttttttgtgagtgtaaagcgctgacggggaagacaaatccttgtcacagtgggggcatttgtagttgcgaatgccgaggtgggccgacttttcgtgcaccgtttttgtgccgtactgagcgaatgttttgtcgcagaatttgcatttgtatctgatcaggagaaacgaattgcaactgatcaatcagcaaagtgatcaaaagacttaagcgaatcattggaatttgctaatgccttcctaattgttcaaatcgttcgcacttacggcctttcgccggtgtgcgtccgttcgtggacttgaagcgtcgctttttgggcgaagcgtttgtcgcagaaatggcacaaaaagggcttctcacctgtaaattcaaaatgccacttttttccattcgttttttaaaaatgccaattttgtgccaataattgttggccctttctccccccccccctttttttttgcccacctgtgtggcagcgtttgtgcgattcaagaatggacaggtagggaaacgctttgccgcacacgtcgcacttgtgccgtttctccaccggcactttatcccttcgcggcaccgtcccctccggcgtcgtcgtggccgttccgcccggcctccgtctgatcccccgacgctcatctctcccctggttcatctccgtctcttcgtcgtgcccttccacgtccaccaattcgtcatcctcctcctcctcataacattcttcaaacatttcctcctccccctcaaattcgtcttcgtctctctgtgcagagacattttggcaggaatttgttgaagaggcgctgaacagagctgaacaactctgaaaatgtgcataaaattaaaaaaacaaaaattaaaattaaaaggggggagggggagacgaagcagcacttgccagggaggtgatcatctgctgagaaagcgcctgttcaggcgaatgcgaaacggtcgagaaatcgccggacgaagttgaggcggaagaggacggcgcacagtcggtcacgcccaactcggcgccactcgacggagtgccaaccgacgatgggccacctccgatgagcgtgccgatcgcatttctgccgccgtttccgtttgtgttgccattacgccggcgatggcactgctcgtcaatggaaccgagcaaatgacggggatttgaaagaacgtcgtgcatttgctgggaatgtggaggagggtggacaacgaccatccgacgagagggaaagcgccgccagcgaaataagcgactgaaaattattttagagtgaaaattattgaaattggaaaaataaaattaataaaaaatataattaaaaa

SEQ ID NO: 11932 - DNA, 794 bp, Heterodera glycines
gaaaagtagaagcggatgatcaagagggattttgaatgggagagggggggggggaaggggcgattctgtgggctgaggttgggtggatggggaggatcttcggcggatgaatgggcaagggacagagagggaggggagaggggaaggggaaaagggggagggaatggtcactcctcgcccccccccccgccctctcaaatgctttgtttgttttcttttttctcccctcaggggtcacacagcttcttcatccacacaaatggacgcaaaaaatgagaaacgcgcgagcgatttgcggggaacaatcattcgcacaacgaacaaacgatggatgaatgctcttggggagggaggaggaggggatgagaaaagaaggaggggcaagacgaagaggataagagagcgagggagagagagtgggagagagatagggggagggaagagagatagagaggggagaagagagagagagaacggaataccaaaagaaagtgaggatgaagaagaagagagtgagagggggggggagtgatgaggaaaagtcaaagtaaaatgcagaggaaaggaaaaaagacatgaaaattagaggaaaaaagaaaagttggcatttccgttttgaaaatgagcaaaaagagaaggcaattaacaattaatttaaaaaatggcaaagaaagaaacaaaagcagcggcagaatgattggccgcatttattcttttgatggcaaagaatgggcttccgattgaacaaactatggtatttttaaaattatatttaatttaaattcatttaaaat

SEQ ID NO: 11933 - DNA, 932 bp, Heterodera glycines
tttggcccccccgttttgcgccagggtcaggtttttaaattttgtctatgtttgaataaatgaaaatatgtattcgtcagttttctgagttgctaatcacgaatattgtattcattttgacaattgcgaagcccggctatttaaatgaaatacaatttttgaacatattagatcaggccttctatctgttttgttttatcaaatgttttaatatggtgggtccaaatctgagaaaatgatttaccagattcaaaaccgtagctgtacctgtttcaaaaaatggcctgtacctatttttttctgtacatacctaagtacaggaaaataaatgtacaggaaaaatccaggttgccgaaaaatggcctgtgcctgtacctggatccaggaaaaatacagggctggatccaggtacatgttgatctctaatctacacccataaaacacagtcaaaatcgggaagtttcaaaaaaaaaattctagggggttgtgaattttttgaaaatttaaaaaacccattggaaggtaaaagtttttcacttttttttgtaaaatttttgatcaaatttttaccttttttaatttttggcttcgcgccaaaacgtgggcgccaaaacgatcctggcgccaaaacgtgggcgccaaatcgtcggcgccaaaacgacccagtccccaacatacaccaaactttttatataaggattacattcaaaaaatgagataaaaatgtaaatcaaaattaattcaagtattcgcttcaataaaaattataagttaaaacagtcattcaaattttacatcttctattttcaaatccaacaataagcagcaaataagcacataatgctgaaataagcacattttagctttctaagatccgaccccccaaaataagcacaaatcttagaaataagcacacttggccactctgatat

SEQ ID NO: 11934 - DNA, 3107 bp, Heterodera glycines
cttgttatgggggcgtaaaatgaaaacttcacaataggagtcggccaaaaaaagtgagtgacggttaaaattgtcaaatcattttttcatctcttttttatgacgtgtaaattgtaataaaactgatttaaatccccaattcgattcctattatcacatgcatatatatatatatatatatatatatgacatatccaacttttttttctaacttaaatttgtaacagatacatataaagtaattaaaaaccaaaaatgttgaccggcatggtcaaggagcacatggcgcgccagcacttgcgccgtgagcagcaggaaaagctgaagaatgaggcaattgtggcggcccacgagctgaccgaggcgctggtggaccatctgaaccacaggttttgcaaaatccatcctacggcattgccgactcgtccaattattttccggactttaatatcctgagaaaataaaagtcggtgtttctggctatttgtaatcgctgatttctaattggcattcactttggcctatttaaaaatgtgaacaggaagtctaattcaaattggctattctcagatggtgggcttccatttttggaaaaaaaaaccaaatttttcctgagaaaatatttttcgggttttcatggtcgagaataagaatccggcatcgctttccgggttcgatttaggccgagaaggtggtcggtttaagattcttcgaccccgaaaacccgcaaaatagtgtagtttacctcgagaaaaaaaattatttttcaaaaagtggacccaccccaccatctaaaggtttaccttcaaagtttccgtttgcattttttaaaattaaaatggattaaaactagcaaaaacgaatctcaatcatttgcaacaccaaaaatgtcatgtttaatatggtgtttcgccttcttgttcgaatagggtacgggatttaggaataagcacaaaaattaccgatttgtggaataattttttgatttttgtaaaaacaattatttttcagggtgtcccatgcctacaatttgcagaaacggttggatgtcgagtgtaaaaagttggagacacaaagtgcggcgttggcacggcacgcggacgcatgggtggcactggtcggagacatgaaccaggcactgaaggtacacaccggcaaaggcgctgaatatttaaacgctaatgccaagggagggctaaggcccagcaaatttaagcgaaacaaatatgttttattttttaatttaaaaatgttagaattatggctaaataaatgaaatatttttaaaattcgctccctttttattggcaaaaaattctttttttttcaaaaaaaatttttttcggaaactggccaagacacagttaaaaagtgtaatgaaaacttgcataaaacgcattaataacttgaaataaacaaaatctttaaaatttcatgattggcccgattttcatttacgccaaaattcgattagaaatgaaaaaatgcaaacaaaatttttctggctattcacctgcctcaacccctgtcgaattttttaaatttattgttttggtctggccaatttcttgcttgctaaatatggcgagttttcatttgtattttcactttctaagaccatatttgaaagtgccagaaacaaaaaattaacaaaaaggggtgggggaaggtaaaatttgaactattaaaaaaaacattttaaaaatccaaaaaattttcctgcccgctcctaaaaatccttatttgtcttgcaaagatttgcccaaatcgcaaaatttgttcatttttggataaaaaatatttaaacaaattcatttaaaatcacaatttttcccatggcgcgtgtccgcaccaccggactccctcttgtcgcccagtattttttttttgaaaaagtgggctacaaaaaaagtcggtgttcaattttttggtgggagtttttttttttgctacaaatataaaaaatgatggaaatttttctccttttttgattctcaaaagtctaaagctttgtgccttttctcaggaggttggcgacgtggacaactgggcacgagcaattgaggccgatgtgacacaatgtgccgccactttggaacgcgtttatcggacccggggcggcgctgggcatggaccggcggtgggcgcgggaggtaaaaattattggattggaaaatttttattagaaaaatcatttgatcaccaacattcagccccacctgaaaattaaaaaaatatttttcctttcgagttttttctcgttaaaataaatttaacgagtcgattcaaatgttttttattaaaaaaaacaattataattacaaaaaaatttagaaacaaaatttttttttcagtttcttcaaatcagtgagcaaaattttttttggttttaaactagtattttcaacaaatttgcattaaaaagagagctgtctggtacccctttcaagatgcctttaagtgcattttttttgaaaatttaatttctttctgattttatataacattgaaaagcgagaaaatatcgccaaaacataaaaacgccataaaaaaattacttgaaaaattttttttatttctttataatattttttgaattgggctcataaaattttaccgttctacatacaattaactattttatagtgcaaattcttgaccagtaaattttaagattaattacagacataaatatcatttttaggcaacacttcggctccacctacggcataaaaacaaacggacgtacgaatagaaggagggcggtggaactttgaccgcaattaaaaaaaaattttgtttttttatttttgtgtaattttttgggtaagggtaatcgattccaaaaaatttcttcaaattggcatgtgggaatgcgatcttcgccattccttcctcggcgaagcaattgttttttctttcatctggccaatcttgctgatccggcccgtctttagcactttcccagtgatgcagacacccggctgcactggggttcccgtggccaatgagataaaggcgagcgcagccggggcggatgccgaagatccttttcgcttggtcctcgatggcggcatggacagatgaactttgatttgatcgaaaaa

SEQ ID NO: 11935 - DNA, 3125 bp, Heterodera glycines
ctctttttctttcctccgttcggaggattttgccgaattccgtgcaaattttgacgcattgcagcagaaattggatgcggtcgaccgagaagaatgcgaaaataaaatgcaaaatgggataacgattaggcacagatgtttggatggagaagcgatgggcggagagccgcgaaaattgctggaccggaacggatggatcagcttcagggccacgtccgcactgcattttcaacgaagggccgagctgaacaggagagccaaggaggaaaagtgagtggcaccaaagggactgcctgaaatttgaccttttaagcgtgtttacatacttaagactgaaaaaacgcgaagcattgttggctgaatcggaaattggtcgctgtgaactgctcgcccatgatgacttccagcgggacgtgctaagcccgtacaaccatcaaggcatcgcctttctttattgtgccaatgcgcgacgcgccacgagccgacgcgtcgaagaggcgtcgcgcattttctgcacggggccatacgttttgcaacgccaattttaccacggcaaagacacatcgctgggagcctttttgcttaagtaaaacgatgcacagattgggactggaacagccataaccaataattcagctgctgcttcaactcggacttcaaatgcaaaggctgtgaacggccaatgttggaccatttccggcgcattgtgcacggcaacacgcgcattgaggtggtgacgcggaatgtggccagcgggggcggcggcggcactttccgtaacagttcctcgtcctccttggccaacgcggcggtggccaccgtcggtccattcgtcagcgggggactcgcggccgcaattccgtcgtcctcgtcgggtggtggcgacgacgagctgaacaggacaatgccactggacgagttgccctcctccatccccaacaacaactgttccgccatcatttgttggctccgttgcaatgcgtccgctttttgtttttatggcaaaaattgctctgtcatattttaagttgttctgcaaattcgtcgattgccaaaatgacggacgaaatgttccatttgagttttgctaaatttgtcgattatttggccaatgggtcccattgggtcgggttttttttgcttattgtcttcccatatttgtccattcatcgctctttgccaggtgtccccctttccttcgtccatcgacttggccgagtgtcaccactgcacctttcactgccattcccacttttttgcccttgacaattttgtcgcgcgtttctccgtcaacccggtcctttcctccctttcttttcccatttaatcgtccgttttcatacgtccctttttggctcagatttacccattgaatgttctctttgctccaattccgtgctctgtcgactcgacgacaattactgaatcgacgcaacagaaaagtgtcatcaaacaaaataatgaatgtgtgtaatttcacaaatttaagcactttccgaaattgccttgcgctgcactttggacgagaagggcggcgggaatggcactcaaatggtgccggacgtcggctcggtgattgcccatgcgttggcccaaccgtccgagtcgcggcacccgccgggccgtgaaaaggaaaagggctctttcggttcgctgggcgctttcagcgcgacagcgaacaatggaagcaaattcgccgactttgtggaaattgtttacgcggaagagaattggcagtacacagtgaaggtgccaaatcataattggcacatccaattaagtgtccaatttcgcctttaggtctatttcccggaacaatttgagcgttttcgttccctgactttctgtgatggtgaagaaaggtttgtttttgaattcagattgtgttttgttatgttatttttatgcttttagctttatcaattccatctccacttcgtcgccatggtttttctcattttttattataattttccattttatttttaatttaaaaggtatccccaaggaggaaaaagtggcgccgttttttcccgcactgacgacgaacgctttgtgctgaaaacgttaaaccgtttcgagttggacgcgttcaaacaaagcgcactcaaatacatcgattacatttcgatggcactgatggagggcaaactgaccgcgctttgcaaagtctaattagtggacatcaaattaattggcgtagggtttaatttagatttttggtgctttttccgtaaattgcactaacaaacagacgggccaatcggtgaagagtgatctgatcgtcatggaatttctgttctacaggaaggacatcaaacagatttgggacctcaaagggtcactaaggaatcggtcggtcgacgtcttttgaatggcatttgtttccaccgacttttcttcacattgccctctttttaggctcgcctccacaaaaaatgacaacaacggcgcctcttccgtgctattggacgagaactacattcagaacatgtggcggaaccaaatttatattacaactcattcgaagacggcactgaggcaagccaagcaaatgccaaaataatcgaactctaatacactaactgtgacgaccaatttcagtcaggcgatcatcaacgacagccacttcctggccgaccagggcatcatggactacagtctgttggccggaatatgtcggggggaggaggacgaagtgatcgtcggcatcgtggactatatggtgggcattttcatgccaatttcatttctaatttgtgcccatcatccgcatgtcagaggacattcactttcgacaaaaaagtcgaaagtgccatcaaaaatgccattcctctaaccaattcgtccactgtcatttcgcctgagcaatactgccgaagattttacgaagccatcgacgggtttattcccgacttttacttttctatctccctaaccgtaacacctttaattttcaggtatttcgcggttgcgcccgaccaatggaccagcgaatcagtttttacttagaacagaatagaatgaatagaagagtattataatgacatctctttccttcccattcctttttcccattctctaaagattccaatggccttttcgaacttatttccccactccat

SEQ ID NO: 11936 - DNA, 2354 bp, Heterodera glycines
aatattaagcattacaaataatatcttcagacaatattattttattttatattatctttattcacttagaaaaaccttcaattaaatttatttattttatagaaaatgatggttaatggagttttctgtttttgtctggtaattgtcttacttcaattaggtaatcgttggtaatttaattatttaatcagggaaagggtttttaggtgttcgaaaccgtaaaataggtaccgaaataagtgccaaaaaagtggcaaaatatgtgctaaaatcgcgaaaaaccctaatttttgttgaaaaaacatgtcgaaaacccaaatgttcaaaatgactaacaatttttttttagtttttcctcgtcggcgcctaaatttctgtgcttttgactttgaaaatttttagtcacatttgctaacagagttttttttgttgtattttctttaggaatttttcgaggattgcgagaattatgaaaaataaatgcttgaaccaaaatatgattttaagtatcaatactataaacaggttctgttttggttttataactcgctctatttacaaaaatagggcgcagaaaatgggttttttcttgaattttttactctaattagccaatttatgattttttaaatctcaaacattctaaaactttctaatcgaattatttaatttctaaaatcctggctggccctttcaataataaaaaatcaaattttacaaagtgggtatttcagtgcctagcgaagatggttgtagtgttgctgaaagttcaacttcgagtaatgagacggacaacgttagcgaagaaacaaagccaattaaaaatttttggtaaataattttaaaaaattaaattaattattattatataaaaaatgatttccaaataatttggctatttgaaaaatataaagttttaatcgggtaaaattttaaaaaatacaaaaaaaaataaatataaaaattttcatttaagaaactgaacatttgaatccaagaaagcgaaaaaaaccagatcttcaagatacggttaattacgtgaataaaattaaggtcaataaaatattatttttatttaaattaataaattaaattggcattttatttaatcaaaattgaattctataaattaaattgacatctttaggagcatttttgtgataataaaaatgtctacaaacagtttctggacatactgaaaaagcataaaaatgaccataaagaattactttggcaagttggccaactatttcatggccatggtgatctgatcgacgaatttattgactatttatctgtgatggacgggaatgatcaaattcgccaaaaaaccgatgattaaaatgatttttcaaatttttctgtttaaaaaaagaatatccattcgttttttatgttgttgtttatttgttgctttatatatggtaaatctttggttttagtcttgttattttcaaaatttttgtgatttatcccaaaaatccaaaaatgctcaaaatttccaaaaaaccacaacaagtctaattttgagaatttagccttaattgcctctacattttgatttgtttataaaaattaaaatctgatagataattttgagttttgtgaattttttaagaaagttaactggaaggccaaaaacaatactgaaaaattttaaaaatattaaattgattttgaaaattttaattatttttgtgggtttttccgaaaaactaaaatttccaaaatcataaaaagtctcattttgaaaatttagctttatttgcctctaaaaaccacaaaataaggctaaagcctcgcatttgagagttctgtttttgaatgtgtataaattgaaatgtaataaataacactattaagggcatttaaaagtcaaaaagtaaaactttcaactcgtttaaaaaaatgtgaaataaattattacgtaacaaatcaattagaatttagaaacaaaagactattttataagtttttttgtatttattcagcagttgtgtcaattgacaatctttttatgcttgtaatcgctcatatcatctgtaaattttcgtttctgtccagacagtttactcatttctaaatttaaaattagttataatttgaatgttgtattttaatttgttttattgatttcgttaataactgattaagaaataattaattaaaaatgattgtttgccgctatacccaataaatgcacttaattgattttaatccttagtttaatattttaattaaaatcttctttttgttttctctaaacctccttttttcatgtgagcaagaaaaccttttcattttttaactaaattttcttggatgatactagagaccggacgggatcttgatcc

SEQ ID NO: 11937 - DNA, 1890 bp, Heterodera glycines
  misc_feature (1866)..(1866): n is a, c, g, or t
agttgtccggtctatagagggtacttttatgataaattatgtatgtttatttaatttatttatttctttcaccaaaaaaattttaaaaaattatttataattaatttcccgttatgcgctttatttttattttttatccataatttttaatacgcacttgtgtccatcagtttaggctgttgctcctttggcagccaactataaacgctttcggctgcctctgatgccacccgctttatgtcataattagccggcggcggtggcggcgccgctttgatgttcacaagcttttttggctgtttgtccgccggaagccagcagtacaccttggaaatagcaattgaactcggcaatgagccgtcatactcttccgccggcgcttcattttccattggtggcattggtttcacttaatttttaatggatttttaaattttctacaattaactatgaaaaatattggaagaataaattataattcatctcaattaagaaatattaaatataaaattttaccgaattgaaataaaattgccaagcaaagagtgatcagcataattaatcggaaatatgagaataaatttttgtgataacttttcaaaaattaattgctttttatatgggaaatataccttggggataattaattaattgacgtcatttgtttatggatgaaaaataaaatattaatattatccataaacaggaagcatatattatatccggtttttgccaattgattttcatacgaattatgaattattattagggatgtcaattttatgtaaatacatatttttttcctggcttctccatgtgctaaatagtaggaaaaacactttcttttttgtgtttgcgaacaaaagttgggacttttatttacttatttttacatatttcggggttttatacattttttacatatttcgagattttatacatatttggtacatatttggactttttcttacatattttcattttttttacatattttgaggatttttttatgaaaattttgaagatcctcaaaaaaaagccaaaatttcgacaaatttttatatttttttatacatattttgagaatttttgaaaattttttcgaaatttcttgtgaaaaaataaaaaaactttttttttttaaatgcaccctaaaaaatatcaaaaataattttttagatgttaaaaggtgattctaaacctatttaggttattttctgccattttgtgccaacttatacatattttcgtacatattttggatttttatacattttcttacatatttcgtgatttttttacatatttatgtacatattttgaccaatttttgtacatatttttgacatccctaattattattatttttttttgttaatttccatttatgtatgataatagaaaattaaattaaccaaaaggacttccgagagccttttccaaatcaaacttgatcagcagcactaaatacatttccttagtaccgtacccaatcatggcaattcatcgcaattagtacaaagttaattcatacaatgggatttagtttataacgaaaaactgcaattttgaaaatgaatttttgccaaaaatggaaaattttctaaaaatcaatgatagttgtaaaactgtcaaaaaatttttaaaatttttcaaataaaaaataattagcctagccttttttcccatttttccaaatgtatgtaaaattggttatcgcatcgatacaaaattgttttttttaccagaaaaatgagtcaacaataattgatacttttaataataccgtatttgctctaattatcccccaatctccaaatagtccccagtctagggaggggtttgaagaataatccctctatcttnaatccccagtctccattatcccca

SEQ ID NO: 11938 - DNA, 2298 bp, Heterodera glycines
tagagcaaatacggtaatcatttttcggaatcgactattcggaatcgactatatttaacatataaaggaatgaaccgaaaaaaaaacaggaaatcccagaatttttggttcttaaaaattttattcgcatttaatacagagtaaaattttcatgttttcgataaaagcagctgtttgtttcaaagtcggtttaaatacgtaaacatactgaaagccatcaatcctgcaatatgagatcatttatccgtttttaggccaaaaattgacgcattttccgaaagtcgatcattgcccacagaaagccaacaaacaattttcatgacacgaatttttttacaaaaattaaattaccgaaaatttaaaaattaaacacgcccaaatttcatttatgaaatgatcgtaaaataaatgtaaacgaaaatttatacaaataggaaagtacagaatacagataaaaaagaatttttttacagatagtataatatccataaagaacctgaggtatatatatgatgacatttaaaaaaggttgtggtaaagctaataaaaaaatgactacaaaagctaacataaaaaagagactaacaatgataaataactaaataaatccccaaaaaaacaacaacacactctcatctgtgtcctctcaaaatgccaccaatttaagctgacattggcattggctcggccactggcggacgttcttttaagaaattaattttaaaattatttttatgaatgaaggtttttgaatttttatttttttcacgcattgatccgaagaaagaggcacataaaatgctcaaaaatttatttatttttatagttttttcgacatttttctgtcttatgttttgctattttaggcttaggtttataatgtatagttattgtgtttctgatatcagcagtttttgattttgagttttttttaagaatgtgtgaatttatatgtcttatggcaaatattggaaattttagtgttttttccctcaaaaattgtacgtaatttatttatttttaaattttttattaaataatggctattttttttattttgacataaactatttttcaataaaaaaaactgttagtttttcaaaaatttatctttaattgtttaccttctccactaacatgttggccgaaaatgtcatcattgaaatcaagcttcacatcctcatgaactgttataaattttttttataatatattaaaattaataaatttgcaatggatttatttttattaaatataaatttccaatattattaattataagttttacttaattcaattaattttattaacaccaaattttattgtcataaaatctcaatttttgttatatgggagaaaaaatatataaaaaatatttgatagaaatatcattttaaaacttaaaatacaacaattccaaatattaatatgagttaataaattcatattcattatataatttaattagctctattaatataattataaatcatgagttaatgaaattactcttgcacactccgtcctgagattttggatgcacaatatcgccacctgttttaattaattataaaataaattatttaaaaaaataaacaattaattacgatcttttggcaatgaatgtttatggccatctgcttcatccatttcagtttttgtttcaccatgattcaattttgcaacttctccaattttcaatttctcttaattaaacaaattaaaatttaatttttcggaatttttcttcgataaaagtcaaatcttgcgttaaaagtgaaaaaagtcacaaaaaagtcaaaaaatcccaaaaagtataaaaaagtaaaaaaagtcacaaaaaatgttacccccttcatgtcaatgcatttctaaaacattcgaatgcatataacttcaatttttgaaatctaatgaataattataaagtttatttatatttaaattaccctcttcatatttgtggattccttcaccattaagcgcttaatttgacggattaatttttgtttaagaactctattaaatttataattaacattcacaatttttaattatctgttttttctcccgtgtttttattttggtggcaatttatatttttttgaaaatgttcaaaaagctttccttttttaaattatttctgacagaaataaaaaaacgttaattcttaaaacataaaaattattattattattaaatcatttatgccgacatttttcagcgtccaatggtccagcatttatatgatctaaaaaaataatttaaataaattacatttcttatttttatgctgta

SEQ ID NO: 11939 - DNA, 3885 bp, Heterodera glycines
  misc_feature (10)..(10): n is a, c, g, or t
  misc_feature (36)..(36): n is a, c, g, or t
gtcaaggtgnatgtcatatttcgctttgtacattcnaatgaatgctctcttttcatcttcgcttttcacttctgctggccatcctgacgcttccacttttattttcaaaaacatccgaacgtaacctttgaacagttggttgtcaaactgttcataatgataggccctgtagaatcccgttactctatagcccaacactaatgccttccgcagctcgatcgaggtgaaagtcctcaacaatgcccttttttcctcggcgtggttacacttctttacatcttttgccattacaaaatttttcttcgccctactagcacaataccaacaattggggaagagtaacatgccatcaatatgtgccggaagtataggaaaaagcaattccttcggaggaacgaccctcactttcaacagtccgtcgtagggaacatcatcgggcgatgtccaattcacttcaaaattcctgctcaccacaatttttgggacgccaacaggatatggggtgtcttaatcaaggaaataaacagaaaaataatcaattttaccataatttatgaattggtagagacttatgatatcaaacattgatatctcaatttcatctgttgcctttgcgtacaggcaaaaaggcattgttcgccctcccgcataagcgtccctcggattgattgggcctttgtcggacaccccatcgaaaaacttcttcatcgctctgttccgctttaaatcaactttcacatcacattcctaaaaaaattttctaagaaaaatttttttattttttgtacccaaacttcctccactctgaagtttttacaagtttccctcaaaaattccattcgcatttgtgttcttctgaaattttcttccatagtccgaccatttgttccaattgtccatggtaaaaaacatctcgggcaaccgtgaaaagcacaccccttaatgattgaacattaaattgcaatataccgttttttcaaacctgaaattcaattatttttttctccattccaattacacaatccactttcagtcctccaaattcaacctcacctccgttacacgcgtgcctagctttgacccccttgctttgagctaaccactcgaagtacttcaccgcaattttactctgattctcagccctctcgtacccccccccctccggcataatcggaatatgttccgccctcaagaactttgactggaatatcttcatcacaacccctgctattgtcacgctgtctttcaccacgtccatgtcaccagtaatgccaaaaaaaagctgtctgaacttcaaaattgccgccatcaatatttcaacgtcattttcgcaatacactttcagctgttccccttaaatttgcaaacaataaaataggaatgtttatttttgtttacctaattcaaattctgtctcataattttcgtggtaccattttacgaatttctcatactcctcctccttcatagcaccgggacaatagtcatcaaaaggcggcaagtgcggcaattttttcccaaagttttcattcttgttgtacttgtgaggaaagtacaacttggccgggatactcagccccaaggtcttcggcaaatcggccaatttattttggcttagcatccagaaatcccgaaagcatactctgccagcctttatctgataaatcttcagatccgccatcagtacatctgtttcgatccttctttcggtcagcttccgcagaataaaatgcgaatcgaacctccccgcgtagtgtgcgaatgcaacagtcccgaccctttcatttccattaaccaatcaacaaaacttcccattgggtcctcttaaccgggaccgggaccttttctggttgaaaaccgggactttttggctgggaaaaccggggaaaaatcgggactagcccggtcccggtcaaaaccgggaccttggtactcagttgtactcagttgtccgtgtccaggtcccggtcccgctgcactctaattaaaactaatataattatttgtagaaagttgcaaagacatcgaaaacaaatgccaaaacggaggatatccccacccaaaccattgcaaccaatgcctttgcccggagggatacgggggagaaaaatgcgaaattgtcgaaaatggtaaacaattaaaatgataaaaatatttaatatttcagatggaaaatgcaaaagtgatgggccaactgaaattgaagccgattggcaaattcgaacgttcaagccaaagctgagctgcacgaaaaaggatgattcatgcgcatgccattggcaaataaaggcaatttatagcaaatatttaaaaaaaaattaaaaagaaaccaaataacaaataaaattaaataaaaaacattttatagccaaaggatggcaaaaaagtgatcaccaaactgaaatggctgaacgaaaaggtgctcagctgtggcaacccctgcggcacttatcgagtcgaaataaaataccgaaaagacaaaagagcgcggggtaatttaatttaaataatttttaaagtattttatttttgtaaaggtgcatttgtttgctgttctgcccaaattgaagaagatgaaacaaagaattggattgaagcggatgcacccgacgaggacattctcatttcggcttatatcaatccgtcgaattttgagcaattgacggaattgttcgaattgacttatgaaacgggtaagggcacataataattattattttatgttaatattgctttaaatttcttagatggtgctaaaattttgccagcgagcgattgtcccgacggtgtgaattggaaccgggagagatcacccggagtggtgtttttttgcgagcatcaagatacaggagagagtgtcgagtgctgcactaagggacacaaatgcccattaaaggccaactcggcatacggatgtcaactaattgtggtaaaaaccagtgggattttaaacagtgtgccgaaaataggtgccaacaggcgcagccgtaaaaaattgaaaatttggccatatttttaatagttagatttattaagctgaacggccaataccgcgaaatcagaggcgtaaatgaaagcagaatgttttgtaagttcttaaataattttaaaaattaattaattaattcttaaataaaatactttgtaataaataaaaattaattgtttaattgcttaaatttctttttaaagaggcgagaaggagagacgaaaagcttttggggttattggaaggacaaaagcaaagacccaattcgcattggcgattttcagtgcttggactacaaacaaggcggcattaaaaatccaccaaacaaaacggtgattgattaccctttgcgcttcaaaagtgccaacccaaacgaataatggtgccgaaagatgaatcaactgcggagaatggatgtgatgcatgggcgggggtttttatttaaaagcttttatttttataaaaattatatattttttaaatgtattcattcaacttttgttttgtattttgcatttatttatattgtagataaaaattatttatatcgtagctctacgtcccagttcggcacttctggtgaatttaagagtgccaaaatatttttaacatcgtcaatcgcaagaattaaaccaaatttttgtttgtggttaaatgcctcatttgaaatttcgtattttttttttgagaaaaagatatactcgaacaattttttagctttttcatttagttttcaacacattcttttttttggggtcttagcatatatttgagctttttaagaaatattaagtatcaaaaaatctctctttttaattgtttttaaattagaaaatggaggaaatcatttggcataagtaattgctaaaatattagagagaaagaaaaatgaataa

SEQ ID NO: 11940 - DNA, 1336 bp, Heterodera glycines
  misc_feature (15)..(15): n is a, c, g, or t
agtggtgttttttgncgagcatcaagatacaggagagagtgtcgagtgctgcactaagggacacaaatgcccattaaaggccaactcggcatacggatgtcactaaattgtgataaaaaccagtgggattttaaacagtgtgcgaaaaataggccaacaggcgcagccgtagaaaattgaaaatttggccatatttttaatagttagatttattaagctgaacggccaatacagcgaaattagaggcgtaaatgaaagcacttacttcttttttgaatgttttgtaagttcttaaataatttgaaaagttaattaattaattcttaaataaaatactttgtaataaataaaaattaattgtttaattgcttaaatttctttttaaagaggcgagaagtagagacgaaaagcttttggggttattggaaggacaaaagcaaagacccaattcgcattggcgattttcagtacttggactacaaacaaggcggcattaaaaatccaccaaacaaaacggtaattgattaccctttgcgcttcaaaagtgccaacccaaacgaataatggtgccaaaagatgaatcaactgcggagaatggatgtgatgcatagggcgggtgtttttatttaaaagcttttatttttataaaaattatatattttttaaatgtattcattcaacttttgttttgtattttgcatttatttatttatattgtagataaaaattatatatatcgtagctctacgatcccagttcggcagttctggtgaatttaagagtgccaaaatatttttaaaattgtcaatcgcaagaattaaactaaatttttatttgtggttaaatgcctcatttgaaatttcttattttttagagaaaaagatatcctcgaataattttttggctttttcatttagttttcaacacatttctttttttcggtttgagcatatatttgagctttttaagaaatattaagtatcaaaatatctttttttattgtttttaaattaaaaaatgtaggaaatcatttggcataagtaattgctaaaatattagagagaaagaaaaatgaataagtttggcaaatcaaaaaagaactcaaaaattagtgaagagaaataaaattacaaatgggaaaagcaattttgaagaaattaatctgaattaaaagcggaaatgaattaatttcaattctttttaataatgagatagagaagaagaagcttccccgagaggaagattaatggatcaattgtggcaacaattgatcctatatgatcgaacaaagtggagagctggagagggcaggtagttcagctggtagaacactggt

SEQ ID NO: 11941 - DNA, 1657 bp, Heterodera glycines
  misc_feature (33)..(33): n is a, c, g, or t
  misc_feature (79)..(79): n is a, c, g, or t
  misc_feature (133)..(133): n is a, c, g, or t
ttcaaatacgttgagcagctgaaccggcaccancccaattgtcctacagggtgctgttcccgatggaacttcggttgcnccaatgtggtaagtttaattaatttgggtgaagcatcacatggagccacaaacnccatgcaaatcgtaaccgacagaattatagagacaaattgaggatttcttttttcatttactctgtctaaaaatttttttcaaaagtttatgtttctttaaaagattatttcttcttccttacctccaagggtttgatttgcttttaaaaattctcttcagaaagatgcttgcgcccacagtgaccacatttacgacttggtcgccgtcgtggtccattgtggttccacgccgaaccgaggccattacattacgctggtcaaatcccattcgtattggctcctcttcgacgatgacattgtcgatgtaagcgatggatttttaattaaaagctaacccccaataatttgctccttaaagaagttggacgagtcatccattgaggactttttcgggctttcggacagcaacgcacaaaagaactccgagtccgcgtacattttgttctaccagcaaagggcaaatactcgttgaatttgtcccacccatttcaatttgttgcgaatgggcattttgtaggaacaaataattttaattgttgcatcgattgtttctcctccgttttgtccccttcttccagtgaattttttgttaattgttttgtccgtttttcctattctatctgtagttttacgattaatccgcgttagtctctcacaaatttctaaaaatgtttttttttacttcgctcataattttttgtatttttgttgttcttcgcaatgttttgttctctgtgtattctttgccatcaaatgaatcatataatttttatttaacccactctcttaattaatgttttaaatataaaattttgtttaaagtatctcttaaatttgcatttttctccgtttcttttactaatttgcccccaaggtgtctgtctgtccaattgtctctctgtgcatggaaggtgacgacggccccggcgtttacatcgaatatccattcgaagaaacggggggcgaaggggacgagaatcggataaggggcaattggtcgtccaagttggattacctgctcaggtggcaccattttgacatttgcataaaattctccccgtttaaagtgccttcggctacactttcgctatcggcaatctctggcgctttccctatcagtgcagcatccacggcgggttggttgacaaaaggccgcagtctgatcggttcacgatcagctaaaatgccaaaaagggggataaaatgaattttgtgattattttatttgctgacaaatgaactaatactggctaaaattcatcaaaattcggaaattaaaaaattgccgtgttggctttttcttcggttgacccactgaatggttagtacggcatttccccttcggcttcaattttagagtgttttttgggaattgtgccgtccgttttttctctgttgactgatctgatctttttatttttacctaatctccaattgcctttcagagtcccctttttcgtcccttacattgtccctttttctgctcattgccttgcctattttgtttcattgaaaatcccttt

SEQ ID NO: 11942 - DNA, 1947 bp, Heterodera glycines
ctgctcattgccttgcctatttgtttcattgtaaatcccttttctatataattttcattacatttctcttttaggaactgtcccttggccaattcatcagtttgtgtcccctctccgcttggaaaatgtcgccgctgtttaaaggtcggttgtttgtccatcctttagtcaatcggataacatttttgtcccatcttttcattttccaatggttttttgtacattctaaggcatcggtgtctccatggtgttcatttcgtgcatcatctccatttactacaacatgatcacttcgtgggccttctattacatgatcaattcgctcaaatttccgctgccgtgggcaacttgtgggaacagttggaacaccgagagtgagtcggttcttttggcattattttacactctgttttcgatgagttttctcccacagattgctccgtttggaataagggcgctgttgagacgtgtcgactgctcagcggcgtcattttggcgaacggaagctgtgccaattttggcgagaatttggcgaccgaatttggcaaaggcaacgacagcgcagtcaccgcgttcaccgacggtccgaaggcgggcggagtgatgccgagcgtggaatatttccagtgttacaccaccgtttgaaatgcttgccatttaaaaattgctccccattaaagcaaccaagttctgatgctctcttccggcatcgtcgacttccaaaccgtcaattggcaattggcaatgtgtgaaatttcaaaaatggacaaatgggtgtcacattgttgttgtcccgcttttccagctgtctgctcatttcttggcttttcgtctttctgtgctctttcaaagggatcaaaacgagtggcaaagttgtctatttcatcgtcatctttccctacattgtcctcgttgcgctgttcatccgtttcatcactctccccggctctgtcgatgggctttttcattacatgcgacccgactgggctatcctcacggatttaactgtaaattttaaatttacttttgattttttttcactcctccgttcaaatcaagggccaaagagttcttttgattctgcaaattttttcccatgttttttcgctctcaaaagacgaccaattacgatggataaaaactggctttgtttttatttatttttttagtcaatttggtcatagacgagacttgtgagtccgtctttttgggattgttcggtttgtctaaatctatacgcgcccccccccctttttaggcgtggggcgatgccgccattcaggtgttctactcgctgtccacttgcaccggcggcttcataatgttgtccagctacaatcgcttccacaacaacattttctccgacctttgggtgctttgttttcattcgtttcccattaatttctgccgattgtttgccctctcagatcatcggtttggtggactttgtcacttccgtgctcatttcgtccctcgtcttctccaccatcggcttcatctgccacgagatgggcatcccttttgaacagttccatctccaagagggaattcaggtaaaaacaatggggaagaaacaacaaattttgtgataaaacagcactgatggaataaatgtaattgtccatcatttgctcattgtcaggtggtgttcgttttctttgtggaagccctctccaaattgccagtcgctcaaatttattcattgctttttttcacgatggtcgccttcgtcgtttttgacactgaagtaagtcagtaaatgggaggatgggccttacatttctgttttggttttacgtttaatgccattatgcctttcagttgtttatcgtcgagacaattgtaagtgggcacttccattttttgactgggtctggcattgtccaaattggcatttccgtgccaattatggaatctttatctttgctcttttcaggtcagctcaat

SEQ ID NO: 11943 - DNA, 1675 bp, Heterodera glycines
  misc_feature (17)..(17): n is a, c, g, or t
  misc_feature (29)..(29): n is a, c, g, or t
  misc_feature (44)..(44): n is a, c, g, or t
  misc_feature (79)..(79): n is a, c, g, or t
  misc_feature (1022)..(1022): n is a, c, g, or t
  misc_feature (1176)..(1176): n is a, c, g, or t
ttaggtcagctcaattngcgatcagttcncccgaacgacttcgnaagtccagtgatgattcattttttacatttatttntctcattcctttccctcatttctttcttaaggaaaccatcgccatgtgctcacttttacactttttgccttctttctgttgggtcttccgctgtgcacagcggtagaaaacaatacaattacctacaatcattttgtttttgccgattaaaataaatttctttttttaggctggcatttattggatcgttttgtttgaacgcttttccgccacttggcctttgatcatcatcggcttcttcgaggtcatgactgtgtgttgggtgtacggtcagtcatttgcttttttcattaaataaccattgaacggttcatttttctcgtttcaggtgtcgacaactttcttgacaatgtcaaatggatggtgagaaacactccaaagagagaaattatatgccgttgggtgcaattttcgatactttcgaatttacggcatttcaaatttattttatacaattttccgattaacctaaaaaaaaatttgacggctaataatgccttaatttcttccctttattttagattggtttttaccctccgttttaccttttgtggaagatcctctggaagttcctttgtcccattttgcttttggtatctttgcccattaattaatttgttaatcgttcctttgcccctcccccttcccccgaaggcgcttctgtcgttggtttggctgcaacacaacccgttgcagtacaactccttcctcttcccccgctggtcccttctgctcggctgggccatctctctgtctcccgtcttcatcattctgttcatgttcttctaccaatttgcctctattagcggtcccttttcaaaagtaattggctacagtacaattttttgctatttacagtacctaatatagtaattgttcaatgcgaatgcccttccgttaagcgtctcagagagctgttgtgcccgacggatgactggggacncgcgttggcggtgcaccgtgccgaattgtaccccatgcaaattccggaggcacaaaagctgatggcaccgccgagcagctgcgtgtatcggaacgcaacggttcattcattgaccatgaaatggaattaccatcaatttgttgaccctcccccnctttttaagaatggcgactccgtggaacaattcatggaccggtacagtcgacccatcggaaagggcgtgtacccgcagcaggaattcgacaaaatcatcgccagaaaaccgttggcagaaaaggagacaatcatttgatggccagcgaatgacccgccaatcactagtcaatcatttcatcgatttcaaattgaggccattcattattagaagaccgttctctttcatttgtttattgagtatttccatttccatattttccatctctgccgtgcctttctctctctccccctttttctgttcattttccattctttgcctacctctttgactgttcctttttacgtgcacaataatgttatttttaatttcctatcccatttcaattaattacgtcatcaatgtgcatgtgaatgagtcacttttcggagagattcattcattccattccttttctcttcattaggtatttgtttctttccttttcttcctttttttg

SEQ ID NO: 11944 - DNA, 829 bp, Heterodera glycines
  misc_feature (688)..(688): n is a, c, g, or t
  misc_feature (781)..(781): n is a, c, g, or t
aaaatgattgcttggaactgatttctggtggcacaacaacggctatttatgcgccattttgggggcggagttttcgccgcaaacgccgacaatccgtccgcccatcgttcgtacgtccgtccctccgtcagttcgtccgttagccgaaggtccgccccaattgcccaacagcagaaattggctttagcattgtgccaaaagtggtgaatcatccattcgttttgtccattttgtccatttgtccaccaatttttgtacacttccgcccattcgctgctcattttgttagcatcggtttttctgttttcacagtttttctgctgttaatgatgattcattcatcatccaaccacataatttgtccatcaaaagcagtgaaaacgtaaaaaattaactgtgctttcccaacgataaacggaaatggcagcaaaaaatgaaaaagaaaaagcgaataaattaacaaaacgattttataaaaataatttatatacaatatgaaataatgttttatgtaacggtaataaaagtcatgaatttccgcttcagatatgcacaaattacatgatttagtaacgataaaaagccgtaaataaatttgttagtcatttactgttttttatcgatcgttaaaaattgggcatagcagaaaattaattgccataatgtttgacaatcatttaatttgaanttttggtttttatagagtatcaaacgaaaatttcaccgaaattttccaaaaattttactaaatttttcataaaaaccagaaaattacgaattnttttaatgaaaagtctgctaaaaaactggtaaaattctcaattttccc

SEQ ID NO: 11945 - DNA, 2203 bp, Heterodera glycines
acacaaaatttaagcattaaaaacatataaaagttggcagctttttcttatccctactaataaatgtctaaaagttctcatctttcactactaattggtccgagtttatctgatcgcgaccaccttccaccatttatttatcttttcgtattcaaaagtcagtttttttctgatcacaatttgatggacaaaatgaatgaatcgtcacaaaaaaagtaaaagcgatgttggattattagacccttaacacttaaatttacaaacaagttccccgggggctttgtcaacatcaccggactttgccccttcccaccccttacgaaaaattattttttggcgtttttgagtcggaattttactcaattttttattcaaaagttttttccgtcttttacaaaattaagaataatataagaaataaattttttgcctaattttgtctagctttttcttatccctactaataaatgtctaaaatctgctaatgtttttcactactaattgatccgagttcaactgatcatctccttacactttatcatttctgtaattattatttttgttctccctcaattccaattccaattttattatgattttattttcatttgcctttttaataaaacataaaataatttttgttttgtaaatattatattttgaattaacatatttatcattccgttttttctgatcacgatttgatggacaaaatgaatgaatcatcacaaaaaaagaaggaaaagcgatggaaaagcagcagaaattccgatgtaaattaaatgcagaaaatgaattatcagatcagtaacagaaaataattggagagaattaatgaattttgattgattaattaattaattgatatggaaaataaaaacgaaaattaataaaaatttattaacagttttcaaggatagaaggacttcgataaatttattaaggcattgaattattagagcgaggcacaggataatcccatgccggattttgcggaatctcaacccgtaatcccgattttttgcgaattgtttgattttgcgtgattaatcccgcaaattcggcctggaaaaagagccaacctaaatgacccgggaaaggatacgagaaccgagaccccaaaaaacccgagaaatttctcgacccgggaatcgagaaccgagaaatgttaaagaaattaatttaaagatattttttaagatcataaacacataaaaaaggggtagctcaaacggaatttttgcgtggagtctcaacatcaaagtgacggccttttttgcttttaaaaacgcttttttcgcactttttccaatgccagggttcggattaaaaatttttgaaaataataacatcaacgccaaaaaataagattttaaggtaaaaccaaataccgcaaaaaattcaccaacgttagaaaaaaaattatgacttctgcttttgtccaatctttaacggtcgagaaaaacagtaaaaaaaaatttaaattatagctttttaaacccgagttgggatcccgcaaaattgggcatggcgtcgtccctgccgggctctaataatccaattccatccttaaaatatctgttaagaatttttattaattttcgtttttattttccatatcaattaattaattaatcaaaattcattatttctctccaattattttctgttactgatctgataattcattttctgcatttaatttacatcggaatttctgctgcttttccatcgcttttccttctttttttgtgatgattcattcattttgtctatcaaattgtgatcagaaaaaactgacttttgaatacgaaaagataaatatgtaaaattaaaaaatataatactcacaaaacaattttatctttaagaaaatggcaaatgatgaaaataataaaaagaaataataaaattggaattgagtgagaacaataataatatttacagaatgattttaaaaaaggtgtaatgagatgatcaaattaattcgtatgaattagtagtgaaagatgagcaatagatatttattaatagggataagaaaaagctaaataaaattaggcaaaaaatttattgcatttgcagggaggaaaccaaatttggaatcattcaagaagaaataaacaaaatataattcttaaatttgtgaagactggaaaaatttttgaattaaaaaaaaattgaataaatcccgactcaaaaa

SEQ ID NO: 11946 - DNA, 1523 bp, Heterodera glycines
  misc_feature (51)..(54): n is a, c, g, or t
  misc_feature (59)..(59): n is a, c, g, or t
  misc_feature (66)..(66): n is a, c, g, or t
  misc_feature (72)..(72): n is a, c, g, or t
  misc_feature (77)..(77): n is a, c, g, or t
  misc_feature (1504)..(1504): n is a, c, g, or t
tgattggtctgatacatgaattgtgcatttatttttatcttttgggggatnnnnaaatnaaagaancacctngcgtncgcattttttttcaatttgtgttgatttttttataatttcaaaaaattaactcacttgattactaggtcgctatcttctatgtagctttcctcagtttttagcacttaattatatatttttccatttcaactgttcgttattgatctccaattataaaaggagaacgaataaaataatgcttcacttatttataaaatatttatttctgatttacttttttttgtaaaactttaattgatttatggttattaataaaaaattttgataattttttaggaattatttattgaataaaggctttagttgttagaattttttaatagttgaaatatttatttctttttattgctatttttattaatttattcaaaatatttaatttatttaagaatgattacaaaataatggttgtaaattttgttctttatttaatcgaatggaaacttgatccattaatccaaatatttcactcaggagaatatttattaaaaatttgtaaacttcaagccatttgataaaaaaatatataaattatgttaaaatattatcaaaataaaacttttggtctttaataattatatcataatatcctaatttgtaagtaaatttcctttttaaattttggattttaattttattttggtgtttttaaataaaaaaacagaaaataattaatatagaaacatgaaaagaaatttttagttaaaaatatgaaagattgtcgcttgcaacttataaatttataaaatatagtagccactacaatgtttaagatgttttcaattaatacaatttattgtttatctaaagtaattataaaattaatgcttcatttaaatatcaatatcgcttgcttaattgaataattatttttactgttttattaattaagtaaaaacctaagaatccgttccctatttattaaatacattttcaaatccaattcgataataatgggaaatttttaataaaatatatttcataaaattttaaaagttttatattttttagatttatttatatatatttttctcatgaactctcgttgtttttgtttgactcatcgagtgtaatctttattttgaatttaaatacatatctttaacataagaattaaagatcaatattattttttctaattgcaactactatatggattttatagaaattgtaaaggcattatgccgatatatttacaacctttaattattgaaatttttaattataaatataaaataatgaattttaagaatttgacctagcattcaattttattgcttaaaaataaaaatatttttcaaaataagaacacaataaacccttttgatatttattatattcattgttgaagaaaaaaccttttttcaaattaaaattaattttatttcatagatgataattttattgaatattttttagggttttnaaatcactttaccatactt

SEQ ID NO: 11947 - DNA, 1461 bp, Heterodera glycines
ggatcatgcgcggacttcttctgtagcccgtagtctcgccccactacttgctccgtcttcgcatgctcccttttgcgaaagtaggcttaattttgaattttgtcgaaaattaaatttcggttttttgttcgagtcagggttcggtgttcgaatttggtcaaatggatgtcataaccgtgttcagcaacctcaaaaccccttaataatatgttttcttttatttataaattttgagtttttgttcgaatttgggttcggggttcggaattttgcaaattaaaggtcatattcgtgttcagcgccacaatttaccctagaaaaattatttataatgtcttttgtgtgctttttatagtgcggtcacttgagtcccagctgagtttggcactccattttcggcacttttcatcctggaaaagggcaagcgcgcccctaattctatttttccaacccatttcaaacctttttacatcgattctgaccgtttttaagcatttttgagtttggggcctatgatcaatatttaccttgaagttttcttagaaaaagtttccggcaccgtaggcaattcgcccgcacacagacaattcatcagtcaaatatccagcattttcgttggatcccaacaacatcactcacgcaacggcacattctcaaacacaaccgttgaaactggcaaatgatgaatggcattttaaaattacaaaaaagaaaaaagttcgtacaattgcatcgttggagtccgccagttttcatttgttaccgaatttttatactcgaaacagtttggtccatgattgtgtcaggttcaataaggtaacaggcaggaattatctggaaataagacaggaattatacaacaataaattcgtccaggtttttgaccgtaggtttttttacatttacccccttccctcaaaaaaaaaacattttttcctgttgctccgagtgagatgtcaaaattgcatgaaatacaatgaaattcttcagcatttttggcaactttaatttctttgaactcagaataagagtcaagaaattttaaaaagattctgaggttttccccaaaagcctcaaaaatcctcaaaactaagatttgtgcttatttcagcgttacgtgctttttttgtgcttatttttggatttgaaaataaaaaatgaaaaatttaaatgactattttgatttttcatttttttctgaagcgaatatttgaattaatttcatttaaaaaaaaaattacattttatttcattttttgagtgaaattcacaaaatgccaccaaaacgtaaacatgtttatttggaaagctacgcaaaagaattccggcatataaagaaaagtcgaaaaggcgaagaatttggccctttgtgtcgtctgcatattttttcataaaaatgggctcaaaatctcaaaattggtcatttttttggtgaaaatctggtaacaaatcacatacaaa

SEQ ID NO: 11948 - DNA, 756 bp, Heterodera glycines
gtaatattgtgtaatatctgttgtaaaactgttccaaatggtgttagccgacttgggcaggcgaattcggaatgccattggcaaacttggccaagcgacggtcatcaatgaggacgaactcaacgctatgcttaaggttggatggactggccaaagtttatgagatctgcacattccaggccttgggcttgctaaccgctggaaatcaaaattaatttcatccaattttagtggattttttgaaaatttacccctttggggttagccgagtcaaaaaatttctcttttaatcgcttcattctcctgttttttctttcaaatcaacaaaatttgtataaatttagcgtaaattctttagtttttcataaaaaacactccgttccatggacagggagacaatataaaaaatttaaacgtttttttttgttgaaaactgaaagtatattacctcctttgttcaggaagtctgttccgcgctaattgagtcggatgtaaatgttcggttcgtttttcaaaatttaaattgcataattttactatgcccatgcaaaattatgattcgaacatttttgcctttaccaaaaaaagggaaaaaatttgacagataattttttgggacgtatttatgtctctgttaggcagcaaactaacggcgtagccaccactcattgtccttattttttttaaattgagtaaacaaattgtagtaccaaagaattggttttacgagtgcattacgttccgcgccccgaaatt

SEQ ID NO: 11949 - DNA, 2737 bp, Heterodera glycines
  misc_feature (45)..(45): n is a, c, g, or t
ttttaattagccaagaaatttcacctgtctgagctggccaatgcnttgtgccaacttcccaatttccaaattgcacaatgtgtttttggcatttaaccaagcgcgccattttgaagaaaaggtaaaaaattattgtcatcagcagagatgagattttttggaaataaaaaattgccaaagggtagccaaatacagaggaaaaacctcatcccgatgactctttaggttagagccctaaattgtatgttttcatttttcatggtttaaaatgattttgcactgtctcaaaatttaatggtttaaatttttgagtgcttaaattcatttttaaaaaattttcatccatattttgggatttttaccatattataaaccattttcgggtattttttatatataaacatttactctaatgagcatttacatataattaattataaatatgtgcatttccgttaattcgtaggaatttgctctccgttgcttggatcacatcgatcagaatgcgtactcattgctcaaatccgatgcttttcttaaaattggcacaaattacctctgtgaaattctggcccgtgatcagcttcaggctgaagaaatcacaatttggaatgcggtaaattaaacatttggtgattttggcactatttcgaatttttgccaaactataggctcttcgctgggcggacgaacaatgccgtcaaatgggcaaggagtgttcggcggagaatcgtcgtgccatgcttgggccggcacttttccaaattcgttttccgttgatccaattggaagaatttccaagaaacattggtaattaattaaaatttatcatcacatataaatattttcattttatattaattggaacagacaggtcggcactgcgttttattaaagaaaaattctttggcatttttcacaatgtctttttacaaacccaaaactgaccaatcctttcaaaagttttccggctgcaccgtttgatctcaaaaatctcataatttaaacaatttatcgcggctaatcactgatcgatatcattgtagcattaatgccatttcaatttattccccattaatcccctccaaatttaattctttttttcccttcaaattttaaaatttaattgctccttctgctgcagctgtttctggtgtgttgacaagtgacgagttgctcggtgtgctgcttcaccttgcccttccttcagttgcctgttcgcagcctccgctttacccactgagttttccggccaaacagcgaaattataatggtaaattcagtagtctgaaaaagccaagttccgacaggcgccaggccaaaaagtttggacctgaaaaagggcttttgtcccgttaagctcatcccggcccattttccaagtccgggtcctgggctttactgttcatttcaaaatttgtctttatttttaaatgagaaatgcattgaaaacttttctatcgcggaaattctttgtttttaattccataattactttggatttattaagaataagcaaaaacgcaatcgctttaagtgagcggaacagttactctgaaaatcgacaaattatctgaatttggaaaaacgactgacaacaccgaacggcacagtaatgccgtgatcatcagggaaatcccgtggaaaatttcggcatcatttgacacaagcgatatttcctgtccccatcatcgtgtgagaagctttgtagacttttggctccattgtgatgtggaagagaacaataaaggtagacgaataaagagaaaaaattttatttggaaaattcgaattttcgggcccgcatagaattggttcattaaatttttggaaattgagattacgagaatactttcatttcggttaatctcggaatccggatgggagtgaggagagacacaaacttaacgattagtaaatcgcattattccctttaatttttttcgacattctttggaaaattccttatcataaatgcaatgaaataaaatatagctctaagaatttgaaaattttctcaaaatttatacaccaaaaaatttttctcgctaaaatttgatttaaaaagaaaatatttaaaattttgcattaaaacatggaaatgtatctcatttgcgactgaaccagtgaataaaattatttcctgatcctgaccaagtaaagcgcttttctatggtaattttgttatcccttttccaagaaacactgtgccattctacaataatctatcaaacaataattaagcgaagtggcgctacgaatgtacggcaaaattgcgaattgtggcacaaaataagtcaaaaaaagattacactttacaagaaatgcacaacatctttcacacttcttccgacagaaagaaaatattccgtggcttaatgtttatggtgtgaaaaacacacgagcaattaattagcaaactaattaaggaattggtacaagtggctaatgagttggacaacgaggaggacacattgacattagaagccgacattcagatcaccaattaaccaagagatgaaaacaaaatatcatgtttgttttatcatttgataaggtaataaacaacatttgcgctattttcttattccattctttcattttttctcatttgttaatgcacataaaccagtgccctactggcattaaaagtgatttgttttaatttatttttaaaattgaaatagcttcgctatttgcactgtctctagagggcgctccgttccaatatcttttt

SEQ ID NO: 11950 - DNA, 2178 bp, Heterodera glycines
ttccataattacttggattttattaagaataagcaaaaacgcaaatcgctttaagtgagcggaacagtttactcggaaaatcggcaaattatctgaatttggaaaaacgactgacaacaccgaacggcacagttatgccgtgatcatcagggaaatcccgtggaaaatttcggcatcatttgacacaagcgatatttcctgtccccatcatcgtgtgagaagctttgtagacttttggctccattgtgatgtggaagagaacaataaaggtagacgaataaagagaaaaaattttatttggaaaattcaaatttgcgggcccgttagaattgggattaaatttttggtaatagtttatttagagtagctgagattacgattaatactttcatttcggttaatcttgaaacccggatgggaggggggaggggcacaaactcaactattagcaaattggattaatactagagttgagcgggaccgggtcgggaattcccggtttattcaggtcccggtcccgatcccggtttttggaaaaacagaaatcccggtcccggttttgctagtcccggtcccggcgggactaaattaattaatatttggtcattttttgacaaattctgttaacaaagctcactcaaaattttgttatcccttttccaagaaacactgtgccattctacaataatctatcaaacaataattaagcgaagtggcgctacgaatgtacggcaaaattgcgaattgtggcacaaaataagtcaaaaaaagattacactttacaagaaatgcacaacatctttcacacttcttccgacagaaagaaaatattccgtggcttaatgtttatggtgtgaaaaacacacgagcaattaattagcaaactaattaaggaattggtacaagtggctaatgagttggacaacgaggaggacacattgacattggaagccgacattcagatcaccaattaaccaagagatgaaaacaaaatatcatgtttgttttatcatttgataaggtaataaacaacatttgcgctattttcttattccatgaaataaatgttaaattcatgatcagtgaccccgacctctagaaactcataagaactcggagaaatgtcttctcgaagaaagaaatcgtgccgcctagaacaaaaaagtgccctaaatctaatgattaacaaattcatacattaagcaatggcttttctcctagaaaacaatatttcttcgactgattttattttaaaataattttaagctcggcccaatatttggccattcaagtgccatccttccaattaaattcatgtggaaaagacccttttcgttccgttggtgcacatactccttatgtaaatgtgcgtgcattaattggataaaaaatgccgcaggcacataaagcatatgcatccatagactaaaacaaaatacgaatgattaattttttgtttttattgcatttttgttaataattttgggtaaaatgccaaaataggcaaaaataggttctttcaaaattttttaggcttttaggctccaaaaataaaagcctagaaaatagacactaataactcgaaaagtagcttaacaacagcccaaaaaagcatgtttttcgtgcgtttcaggaaaattgactcaaaatcccaaagtttagcgaatttagtgattaattttcgtcagtttgagtcaagaatgaataatagtgtgaaataattgaagtaaatttgtttgaaatggttgatttaaaatattataaaataagaaactaaaaaaaataataatttttaaatatattaacttggaataaaataaaattgaatttttataaattcccggtagtcccggttcccggacaaaaatcgaggtcccggcttctcaggtcctggcaagcccggtcccggtttagcccaaaattcccgctcccgctagcggctaatgagaacactttaagtgagtgaactattttcttttttgtatttgggaacgaaatttgggacttatttatatattttcaatgattattgcaaatatttaattaattattcaaaaaatcacaacaaattatatataaaatttggaattagaatttggataggaccgatataaagatagcgtaaatattttggcttaactttcggattattcttacgatgaatttgctgaccaattc

SEQ ID NO: 11951 - DNA, 890 bp, Heterodera glycines
cattcgaaagaacggcgaattgggcggagagagagagaaaatggggggacgaaaattgcattgggagggaggcgaggggggaggcagagagtggggggggggacaatttaaaattatttattaattggacgggggagagaaaaattagggaaattaagggaatgcctaaaggggagagagagagaaagagagagaaaatcagagaaggaaagggaaaagcggacaaagtgaagccacaaagaccaaacggagttggccaatggcattgccaaagtgacggacggattggcacttggcaaatgttttgggtttttgcaatgtaaaatcgaaaatgggggaaagtgagcagcgaatcatcgccataatccttccgttacattttttattatttgcggtgcgttcgcttcgaacgctgaacaaacgccgacagaatgaataaatgaatgaatgaattgtggtgatgaataatatgcatttcaatgagcgtaataacctttcaatttatctttcatttgtaaaaaacgattgccaattccaatgggacgaaggaaaaaaaagaaaaatgggagggaaaagcgagaaaatgttaaataaaacaaaagaaattgaaaagttgcggggattaattagctgacttaatggactcacaaattattatttggaaatgaatggacaatgaacggaattgcggacgaacagcagcagacggagggaaggaaagaaggcgacccttctccgatcagtggcagtgggggcgatcgaagcgaaagcggcggagggagcggcagagaaagcaccgaccgatggacgtccttttcttggcccaattttgtgcccttttgcttccaatttccctttttggcaacttttttcgctaattgcaggtgcct

SEQ ID NO: 11952 - DNA, 3723 bp, Heterodera glycines
cagctaattagcctttctacacacttattattaccgcaagcgacagcaccaacgagaaaatgcaataaggcgagagaatggcagagaaaaagaggaacgaataataaaattaagtcagccgaagaaaggaagcggataagaaaaggagagtgaggagtaaacaatgatatggcgagaaggaagacgaatgtccgcctttctctatcgtcctcttttccttatccttttctttctctgtttccctcccactttctttcccctccgctctctctgactctcccctctttcttttcctctctctctttctaccccttttctctcaatctgtgtcgttttttccttctttttctctctcttccggccacaaactcctttatccgcttttcctctttccgccatgtctccctcccatctcctctccgctccgtcccactcgtcgtgctttcactctttcatccgttccctcataacccatcactccttggcctcgtaagaagggactcctcctccttcccccccccccgcaatttatccgtcgacgataaaaccatctggcaaaacacatttcaatttgtaattaattttgtatgcatatccgttacattttttgatcatttaaacgtgtccactttttaatttgtcctttttttgtctccctttcggcctttcaatgaattcggttggctgtcctccgtccctgccgtccaccgctgctttttcctcctccgcttctccctgtcccccctcctccgtaatgccgtcgtccgtgagcagttcggcggagcagcaacagacagtgttggtcagactgacgaaggaatgccaaacattgtgggaggacaacaaagacacacaggtgaaaagggcaaaggggagaaaatgaaaattaaatttggtaatgccatctaatgccaaaccaacctgtgccatttcctttctcaaagggtcgcttcgtcaacgatgtggcagagttgcatcgggtgcaactggcgattagtcagctggaagcggaacaacggcatgaccacctgaagcacttgcaacagcaaatgtctctgggagggagcgtaagggggggggggggaagtgatcggaaaaaaccgatcggaaaaaagtatgggaaatgaattccgaccaatggccgttcacctgaattcggtaccaatgactaacaaaatttaggatagaaatgcagcgccgggccggtcatttgtacgaacagttgaccgaatgccgtgccaatttagtaagtgccaaatatacccactcaaaccaattttccatttccttccaaatttacaggtccatcgcctcaacgacggcgtcaaactaatcgcaattatgcaaacgcatttgatctctgagcgactgttggagtggaaaaacagccaaaagttggcacaaattggcgtttcttttgagcagcgcgaacaaattttggacgaaattcaaagcgagtgagtcacaagaacagacaaagaattctttggtcaaaaatgccaatgtcttcgcattgtccaaggttcgaagtgctggcggagaacaattggactttgcgcgcgtgcgcatgttggcaattggacttgttgaaaaggtcgccacggctgaacgatacggttgcccacggcttcaaaacccacttattattatgccaattccattcgcagactgtgcaaacgcacatttccaatctgaactacattttggaaacactcaccaaattgctggtccgttttttactacatttttatttttatttatttgttggcaatggcatttttctctctcatctgctttcccctccactctctctctcctctctttctcctctccttctcctctccatccccccctctctcttctctctccttctcttctctccttatcttcctctctctctctctctgccccttttttctctttcctctgtcccattctctctctgcctctctactctctcttatctctccgttctatttccctttgtccttcccttaccattccctcctcctccatattcagtgtatgttggtcactcaatcttttgtggtcgctgttcagcctgatccggtgctgaaaacgcagcataaatttgttgcggaggtttgggggggggggggagagaaaccgaccaaagcttctgctgttgcatctgtctgttaattcttttgctaaggtgcggcttctgatcggagaaagacttggcatcaaacaacaattggtaagttcggtaaacagcggaagaaaggagaaagggagggcacggcacagacaacagtgaaatgccaacgtaaagcattttctgattggcaccgaatgggtccttttttgacaattgcttattagtcactcctttatgaaatgattattagccttctcatcctcctcttcctccttttgcttttctttcctttttcagatcaacacaaatgtcactgtgaaggtcaaccgaatggaaagtgatcggaacagttcattaattcgaaactgatcagatcattgccgaagaggaggccaaattgctgtccacgggccaactgaatgagaaggacatcaaaacggtcggctcaatttccaatgactttgagaagctaatgttggacgagaggggacacatggcctccaaattcaacaattcggtgcccaattcaatcatttgaatgtcttccaaattcgatttgtcagaagttgtctcgaattgcgcatcggaaacccccggccaaaggctctttacagtccaaccaatccgcggcagacggccaccgaccagaaatacgcgctgttgtttcacattacgccctttcagctgggcaacttgggcaagttcgacgtgtggacgctgtccttgcccataatggtcagaatcagcaaatggaaattgttcattttctccatttctggtcaccgttcacgggtcccaggactgcgatgctcaggcggtcatcctttggcaggtgagtcatccacccgggcattttgccaaattaaaacaatttgtttgaatttcagcgggcgttttcttccgttgtgagtgctctctttttttgtgcattttaccatttcatttcaaatgcttagaatcggaccaatgcatccgacgacgttttggtggtgtcatggaccgatttgaggtcacctgaatcgcatgggattaacattttgcacattattccctaatattttgttattatttctgatccaatcattgatgatcagaatatttgtttgatttaaataggtgatttgctcatatttacaagtgattgtctatcccccctttcttttaaatgcttttcccttttaaatccaaaattccatccttagccaagtgcttcgtcacaaattctctctgttcaccggcgcccaccgttcgtttttttgatcaatttgccacaattccctccccttaaagggcccctcaacgaaagtgacttggcctatttgggtgacaaattgggcatttacaaccaaacggacaacaaaccgatcactttccaacgcttcgcaaaagtatcagctcaaaaggggcgggcggatttgcttaatacgcaattaaagctgattatcattcgaatgtcccttcactttgccttccttagcaaaatttgtgggacgaagtgaacttctctttctgggaatggttctttctgatcatgcagctgatcaaacagaaattgctaaaattctgggacgaaggtcagaaaatgttaaaaaccaagaaaa

SEQ ID NO: 11953 - DNA, 3042 bp, Heterodera glycines
attttctcaaaaacaataattttaaactagagttaagcctttaccaacatggaagaaattcccagcaaaacggtgtacctttgaagaaggggtcccggcatgtcagaaaggcgttccgtgggaaaatttaaaaatttttggcccaattttgcaagaaattttatctcaaaaatgtcaatctaataatttttgagagcctgtgggatttgtaaatttttcaaataaatacagaattttttctcagaaatacaaaatgattttttatttgctagtaaaaattaaaaattctcaacttgttttacaaaaaaaatgacttgaaatttttttgagtttgaccagaacagtacgacatggggaccataataattcttaccaagaatcgataaacaattcaactaaaccgatagacacaaccgagggaaaattggattgttaaaagattttgttaaatgcccattttctcagattttgagcagaaatttaagaaaattctaagggaattttggggctcggaaaaatgggcttttgaatgaaaatacataaaaacaaaaagagcaaaacattttacttggtggggaaccgaacatatgtaagttgctaacatccccatctcggaaaacaaatgccggggaggcagggttgggcttaaccttattttaaactatagttttatttttttgaaaaaaactaaatactaaatttaacaaaaaaatattaccactcgaaagctaaatgaaatttggactacacttcatacagcacactgaccaattgaatgagcgtagtcaatggcatattgttccaatgtgtgcagctgatcagtgtcactgatcacttccagcacatatttgttgacattgatgctcccctttgacaccggcgcttttttggtcccaatttgcaccgaatgttgtaagcgatcagccaatttggtgccattctgatcaatgccatttttgtcatggacgacaccattgcattcaatgctgctgtgagcattgccattcaaaaatgcagccatttttttaaattgctgtaagcaaataaatattacctataactgtaacatgaacaataaagaataaaattgcaaaatagcaatccaaaaaagtatttcaatgatcacaaaaaaaaataattcaatactaaaacagagtcttaaggctgattgataataatacgatttaattgtttgtttttttttggaaaaaaatttgacgaaacataactactgcattcggttttagggctttttggaaaaactttttaaactttgaaaattttttacaaattgacaggctttagggaatctagagctatcgaccgataggagtggtgccaaaatttttgatgagatttactcctgtattaattcagcaagttcttatttgtgcgattccttaaaataatttcgcataccaatttttaatttttttttttttgtctaattaaataaaataatgggaacaataaatttttctatcgcttatacaatcacaataagatggaaaaaaataatttgcagttgctaaacacaacaacaattgggttcggtgttatcacgtaccatgccatgccattttttggttgggaatggttggggggggggggtcattagaatggggcgacaattaatttttatctcaaacaatgcatttcattaaagaaaaaaagaaaacaaaaaatagtaaaatgccttcattaattcataaaaaacgataaaaattttataaactgcctcgataaataattttgcttaaaatccggagaaatttgcgatcattaaacaaaatgtgcattttcaccgatcagtggacattaaaatgaccattttcaatgaattatcattcattcatcaacaaagtccccatgtttctatttacaaaaataaataaatagatcatttatttagtgataagtgagagtcattatcaaacaagtcactcatcagctcatcagcccttcactcgctcactgatttgtcagcgaaattgccctaattaatccagaagagggtgggagcaaaggaagggacggacaatcaaagcaacaaatgattatgatttgtgtaaatagaagggcattctttgagctaatgtgagtgctaagaccaaagttcttgggaagagatgagatgataatgggaattagcagagtagaaaagtggtactgggacaattgagtccggccattctaaagaactaggacccgattttaagttgcttaaacggaaaaataggcactaaacaagtgccaaaatcccggaaaaaccccctcaaataggtgagaaaatagcgacaaatttaggtcattttgaggttcggcgtttccgataggcatcgcctaagtttttttgagtttattatgaaaattgcgaaaatagatgctaaaacgccaaaataggtttttagctgacaaatccccttagattttttgttatatttttaggcgtttataaaaatgtgtggagaaaatgtttttttcatgcttttgacaaacactttcgagttctaaaaatcaggcgctaaaatgtgctttttttgcattaaatcgaatatttttgtaatccgaaactcgtgataacagcgataaacattaagaaaaattaattaatttgataaaaatctagggaaataattacattttcttatagttttttttaaatctataatttattattaaaatgtattaattaaaaaatattttttaattctaaacattttcttttctttggattaaaaatgaaacattttcaacaaaattgcacaatttagcacctcagtaaaaatgttttgtacatatttaaaaagaaaaacgttaaaagtgaaaatggccattgggcaatcatttcaccgcatttattcgcccgtcgtccgtccgtcacaccgtcatggtgatgaaatgataattgataaggattggttgggctttgcttgtgctgcttctcaaacaattaattaccaactaactcattacatgcacatcagattaattatttatacgccgccaaccaatcgcattttcatttccttgaatttctat

SEQ ID NO: 11954 - DNA, 1797 bp, Heterodera glycines
  misc_feature (32)..(32): n is a, c, g, or t
cgacgaaatcatttggcagcacgacgaaaatntgggaaaactgtcgacgaaatttgcccattatggcgccagcggggggaagacggatcattagcaggggagggagtccgaaaatattctctgccgcccaattggagagaatagaatgtacataaatcgcagtcataaaacggggagacatatcaaaaatggtgctattagattttgtttcgtgccagagtacggtttaaatggcatgcatatgaatttcagcgggttttttccatttttaatacaatttaaaacattttatttgtttttaaattaaggtattagtaaggttgtaaattatatggacttaaaacattttcaaaaaatcttctattagaatggtccactctattaaagctaccctttgaccctgaagactgaaaattttgctcaattcaattttaggaattttttcttgagaatattactaaaaaaattcagtagaaaattggaaaatttatttgaaaaaaatccaaatgttctcgatttttacttgtttttttctgaaataatcaagaaacgcaagaatttttcaaaaataccaaatattggaaaagtttgcgaaaacaaaaagtaaagatagaaagagcacaaatttacagaaaattgatcgaacttgattcaattacattgggtctaatcatttccataacgcatttcaaaaagatttggcaatggaaagcccaacactttgaagtcccagtaaaacatccgcacaagaaattccatcaaaaatgggctttcataaatgcgcttcttcacaaatttgtacgcggccgatcccgaagtgtgatggccaagcttcaaacccgcttgggctcggacgaattcaatcgtttcatggcttaggcttggaatattggccaaaaatgccacgaattggtctgtgaaattttgttcatcctcagtttttgccaaacttttatatttaattaacgtgaaattgattctctggaacgggcatagcctaaaaataaaaatgaatataaattatttttcgggattttcgagactttttgacctcaacagaaggaacacattcccatggacacggggagtacaaggggtacgtatcagggatggggctttcgctttcgcgcttttttcagtactttcgctttcgcgttttgcattttggcgcgaaacgcgaattacacgcctaagaatgagggatgaaattcccctaaaattttcaaaatttgacctatatcccggccccgccagcacccttcccaaatataactttgtaagtttcctcgaaaaatatatgataattcgctaattatctgaaaatcaatagatttttgcatatgattttcagaaagaaaattcgttaatttattaatttaaacgttaaattaaattaatttctgctattattattatttcatttctgtttaaaaaattttttgccctttaaattacaatgtgacacaaaattataggttcaccttttgtctattagaacattctaaatactcaaatcggcgttgaacgtgtaattccaagtcagagagcccgaaaatattcaccaaaacataccaattttgtgggaaaaaatgtgagtcctccgctgtgagcacaaatgaaaggttggacaaagaatgatctaacattttttcatattccgtcatgacaaaacatgtcaaatttggcccacagccattgcaatattgtcgtccaccagtgtgttcagaattatacaatggttttctgcaagaacataaaaattgaactcgaatacgaaaaaatattattgaaaaaaat

SEQ ID NO: 11955 - DNA, 1314 bp, Heterodera glycines
acgtcatttcaatatatgtcatttcaatactaagtcgtttcgattctcagttaaaatgcgtccattttcgatatttttattggatttgacatacctattaacatttcttttatgttttctcatttcattccctttttaacttttgaatttcttcatttattgctatgtctgatataagacccaaacttcggaaaatccaagaaacccattcaacatcgaagcgcattcggcaaacgagctcttcacctgatgacagcggcttacaacctgcgattcagttggagctaaacgatgatctggatgttgcttcgacacatagcggcagaagtgtgagcccggacgaaaacgaaggacaaatggtcgtgttccagagaggagcaacaaccagaaacggattagcgttgtggtacaaaggtcgtcaaaaattgatgatttctttaatgaaaaggattaaggtttccgttacgtgcaaagcaataataacaaatttttccggtgtgataaatatgacaacaaagttggcgggtttttctgcgaatgtggaacaacgacgttcttttttcggttaacataaagcagtcacgaaaggacgttataattgagcgacaaacgaatcgaaacgacttagtattgaaatgacatatttgaaacgacttagtattgaaatgacatatattgaaacgacttagtattgaaatgacatatattgaaacgaattagtattgaaatgacacattttcactgagtattgaaatgacatatattgaaacggggaccagagcgtttgggcccccgtttttgggttaggtgaaatttcaaaatttacgcgaaaatcgctgaatttttgtgctcactttgtaagtgagttcgcatttgtccgtaacgttcagctgagcggcgtgggtttggtcagcccgcagccatggattgctgcaaaaagcaaagttacgacaattgagaaaaatcaaagatttactggttttttggcattttattcctaccaagattcttatatgaactgtctggttttgttgttgcataataagacaaaaaaaggtgggaaactaaccatttttaacgaggtcttgggaatgtgtaagcatttccaatttttgatattttgtatttcagagggattaaaaggatttgtaaacgccaaatccaactttggtgggaaatcttgcgaaatatttgaagtgaatgaacacattttgttccagtgttttctgtgtcaggctgttccccgattttttatgggttaatttttcatttccccagctccgatcaaattttggaggtcattgatgtgagtga

SEQ ID NO: 11956 - DNA, 2613 bp, Heterodera glycines
tatatgggttacggggttcgaaacaacgcgggatacaggttaaaaatacgtaaaccccggtggccgttaaaaccgtgttagtccaacaaaaaaacgcgggttatgggatccgtaaaagccgtgcacaggcctttggcccatgtctgatctctactgggaatcatttgttttccgaatatttcctaatgacgtcatttcgcgagagcctatgaaaatggcagaaacctaaattgattggtaatagcgtaatttgggggtgccaaaatttaaaaataatttgtaatctctgagcaaatttggcggaagactaaaacgaaatgaatattattcaaatcaacagttatacaaccaaaacgacaaagcaacacaactttttaatagagaccggcgcaggacaggatcctgcgcaggattttgcaggatcccagtccgcaatcctgcatattttggaaaatacaggatttgcaggattaatcctgccggatcctgtcctgtaaaaaattttgaattccaatcctgcaacaggacccgcaaatttgaaatttccggtctctactttttaatatacctaatgatggccttgttatgtaattatgagtgaatttggcgaaaaaataaacaaaacgaaatttcgatcactttttcccgatcacattttgctcatcactctgattcttcaacttctcaaatgctgctcgtcaatgtttgctgcttttgatcaatgccgtcgtcattaaagggttcatatccgtcctcggcaccgtctccgttctcggcacattccccgtcggcattgtccatggcattctgtttccgctgcttgtcaaaaaaggcacagcgcgagggttggaagcaaaaggtggccaacaaagagacgaaaagcatctcgacacagagcacaaagcaaatgtaaactgaaaggaccacaaatgaatggtaattgtgccactttttccatggtgttctactcacattgtgccaccgccgaagagggcaatttggcgggatcatgcgatatgctcggcaccatgtcgagaatgccgaagatgtcggcgacgaacttttgcacggaccaaaagagttggcagaagtcgacgatacggaagagcagcaaaaaactgaaaaatttcgttttttgaaataaaattgttgaaaaatgtgacgtgccgatattcgtgcaacatcgaagcaccaagcggcacaattacgtaagagctgtaggagccaatgaacatggaaatcatgccagcaaaattggatatttggaagtacatgtgtttacgactgctcagttcctgagtgacagaatgccaaattaggaaacatttaaaaaatgtaattgtgaaatagttgatgttcaccataaacacggtgatgttcaaaatttcgagcataattcgtacaatcggcgattggaacacgagcacttcaaagcggtggaaattttgcctgaatttgcaaaaaaaaaaaaaaaattattttttcatttccgagggcttcttagatcagagaatgttgggagcacttttccgatcaatttcaaacattctctgaacgttccgatcactttcaaaatatttggtctattctctgatcagtaatccattccaatgtccatataaaacgcactctgtcggcagaaaatcctcgaagcggatcaaccaacaagcaaacggataaattctgatcgaaattcgctcgcctttggccatcagtttttcgcacatcgatttgcgagaaccgtgcagctgaaattggcaccaaattgaaaaccaattagcattaatgagttaaactgaccgtgttcataaaacagacgagcacaaaaatgcagatcatgtaatagacgagcgcaattgcgtacaggaaaagtgccgccctcggcagaaccatgccggtgaagccacaaacgacgatcacctgaagagaggggggaggggatagtaattagggtaattaaatagtcaattgcccaccggaggcattaacaccacccagtacagttcggaacgtattttctcgtcactgatcaaagtgctgacgaaaatcagatggagtaggcttaagcagatgacaatgccggtcattgcagcagcgccggtcatcatccaatgcgaaaggtcaacaatcgctgaaaatgggggaaaatttgaatttcaccgactctcattcgaattcgggacttttgaattagtcgaaatggacgacttttcattcgaattcgggtcagggctttattagtcgaaatggacgactttttgttcgaattttcaggtccgggcttttgaattagtcgaaatgagttggcattattcgagtgaccagcagggatagttgttccacacttttaaaaacaggaatcgagaaaaaatgatcaatttttctaactctttggatttcaccgactcttttttcgcgcgaccataaggaagttgtctacaacttataaaaaataggaatcttttcggttctagtgcagaatacgcgtcccatggacttttacgcgtcccatggacttttacgcgtcccatggttttttacgcgtcccattgaatttttacgcgtcccatcatctcttacgcgtcccattgaatttttacgcgtccccataat

SEQ ID NO: 11957 - DNA, 429 bp, Heterodera glycines
ccgcgatgcgcaatccgcgaccgcgggattttaaatccgcgatccgcggaatttgtgactccgcggcaattttggataaaatgaagcgattgttttatatataaaattatgaaaaaaagagatttatagaaaattcgataatttttcccaaaaaatcacttcgaaattccaatttttccacagtcagagcagaccaaaatctttaattttctttgaaattgattctaaataacaaataggtcattttttagacaaaacctttagcaagttgcactcaaattttcaaaatttttcctggcggcgcctataggcacctcctgaacccccttgttccccaaaggttttttagaaaaagggcgccgaaaaaagcggtttgaaaagcaaaaaaaaaatcatagggtttgcatgactggaacccctttgcaaatt

SEQ ID NO: 11958 - DNA, 2804 bp, Heterodera glycines
  misc_feature (51)..(51): n is a, c, g, or t
ctcatcaacgactttgaactcgcgcatcaaatagtgcctcatgtaaaattncggtcacacagtccaccaacagcccattgtaattctcgggatagccggaacttggccaatactcaaagaatttctccttgggatcgttcggctgacggattaccattgcaatgattgctaaagcacacacattcattagccaaagtgatcaatttgttctttggacttacagcagtcgtgcacccaaagcattcgccagaaatcggctgctgtgttggccaatggcatttgtgtggcgatgtaagcattccgtgaactaaaagacaggaaaatgaaaatgaaagtttgaatttggtagctttctttgctcaccgatatccgtccagccaacttgcgtttacgtagtcggcaccgtccacacaatgcgaccgtggcagttccacccgattgaaatcccacggcaccacggcacggttcatgtttttgctcacattgaacgccgcattggccgcatttgcacggaaacatttgggcggtttcagcgacaacagagtcgaaaaaggacataaattaatttggtttttgcatttcggcacttacattgaattcgatgtcgatgcctgagtattcctgcatgtgctggggccgggacagcgtctgcacgtgttggtgcctggaaagttttccatgccaaataaatttttagaaatatttggtgaaaacatacaattttgagcttggtatctccgtagagccggactgtgccgcgtccaacaccgcgtcatggatgaaaatgtattggtcgtccgtctgcaccatgtacgagcgttgtgcccgaatggaacgcacacagccgtaaatgtccaccgtgttttcgtaccgtaaccgttccaacatacagtcgatgacaataaatgcacccgtacgaccaatgcccgcgctgaaagtgccaaaattagcaatgaaactattttgacgtcaaattatgtagattcatttaagaaataagggaaaatatggcaattctcgaaatgccaaagaaattcagaaacaaaatctatcatttgccattagggcactaaaattaatttaacttttaaatgcgtgtcaaaaacggcttttggcatttcgtcccctcccttcgcccgttcccttcggcattcacctgcaatgtgtgatgatgggaccggcgtcgatgggattcagagctttgacccgcttgaggaacatcagaaagggcgtcggatgagtgggcactccgtggtccggccaagccgtgaattgacagtgctgaatgtttcgcggggcgtcgtggtgccgtcgcgtgttctccagcctcatggttcgcaagcagtaatgggccaactcggtggtgtccacgagggtcacctttttggcaaacaattgtaaaagtaattggcgggcaatggcacatttaaaccagggaaaatgtccaatttagaaaacgctttttgttaatcagtaagctaattatcgggaacatgttcaaccactaatagtaatgcgaccatgtcagtcagatttattccaactttttgttcagtaattggccaattttgcctttttacccccttcccaattttactttgtaacttccgtaaatggaagtgcctttccctggccaatattggtcgcatttggtccggcaccgctcctccagccgcgtgagcataacaatgaccatcgaccgctcctcccaaaccatccgccaaaagtccgcaaatgtttccggcagtgggccttgggtggcgatgtacgcttttggccggtcgtaactatatgttttattaacatatttaattttaaattgtgagggtgtgccgtacccgtcaatgtaattggcattgatgtaatccgtgcccggcaattcctcctccgcgtcgtcctccggcggcaacacaacgcgcgaatggtcgtaggcgacaacgttggcataactaattgaaagtcggcatttttggtgattaatattcactgataaaatagtgcaccgattcttgtgtttgttcacttcggtggccgagttctcccaagtgaaatgttgccccgtgtcaatgctttcaaactccttaaatccaaaaccgctttattggccttgcttttcccttgctacttggataaagccctggttgctgttcaacttctgtcggtcgatatgtgtggcaaattcggccaatggaattggtgccattagtgtggccaaatgcgctgacattcgttccgtgccgcccgtcgtcgcatggtgctgcacgagctgcccattcagaccgtacagattggcattactcatggcgagcagcggccccccggagggtgccagcagtgccgggtgctgctgctggtcgtgcgcgtaaagaacaccaccagagtcgagcagttcgggcgaccgctaattggccaaatttgtctgttactccgcgaaagcaatgtgttttcccacctcatacgacgagttcatcaccggtctgccttcgttgtccatgcccagcaacaatttgctcgtttcgtttggcagtgttccgttagttgcgcttccgttgcccgtcgcatttgtcgtttttgatggaaaatcgcgtgccgccagcccaccgactttgttgcggacggaatttgacgatgatttggtatgtttgcagcgcaaccaccacagaaaaagcatgccgatgaggacggcaaacagaaacagaataatgccaaactgaaattaagaataaaagtcatttttaattttaattttaaaaataatagaattattacggccaaaagagtgaacattatgccgcctcgttgca

SEQ ID NO: 11959 - DNA, 2786 bp, Heterodera glycines
  misc_feature (2766)..(2766): n is a, c, g, or t
tcatattccttttcaatttccaatgagaaataaacaatctaatttcgcgaatttacaagtccgtccccgagagtgaaggtcagttcatcgcggtaaagccgttgcatttcgttggacggaatttgagcggcgatgtaaacgccgtccaccggcacgtgccttcggccacgcgtgtcaccggcgggccgataatcggatgacggcactctgaatgaatgcttttttgataataatgctttaaagaaatcgctttccaatggataatgaaatcactttgtgttgtgatgaattcgatggtgcctatgctgattgtctgctgatattgttccaagttgtgctgaccttcgtcttcgtttgtgatgattttgcaccatcgtttcattgttttgcttgttttccccatattttctgttccctttttcttcctccgccttttcactgtcgcttttggcacttcgtaccgtaatctgctggaggaaggccattttaatatttttgaaattgcgcgtcgcaaattgaagttgtgcgcggtcggcatgtgttacgtcctccttggaaaagttgcctggcacaacgatcagccaatagtgactgatcggaccgtattcctcgctaaaggatttactttttgatgaatcttgtcttggggttggcacctggcacagctcagcctgaattgtgccgtgtttggcccgtccgattggagaaattcgggtggctccacaaagggtgggccacgagggtccgtttggacggacaattcgcgcggccaatacaatcggccgtcgccaggcgaaaaaacgcccacttggaaagtgtaattcatatggggacgaaggttggacagactgaaccgaaatgatcagcagaatattaattaccaaatgaattttcactgacaaaagttccctctccgtgccattgacccttttttcgtattgaggcgacaccatggatttctcgatcaattcctggtccaaatagctcttctggcccatctgtttgatgaagaagccgattggcattggtccgtcgtaatcccagcggattttcacggattgactcgttttataatccaatcgaagattttggacaataaaagttggcgtcagtgggccctgaatggtcaccggggggtcggagcaggggccaagacgctaaaagggagggacaattaataaaattagaaaaaatggccaaagatactcgatgtttcatggccaacacgcaaaaagcgtatgatttatgtgaaagcaatctgaaaaagaaggaatttggttgaaaaaaggtaatgataaaaaccaaacacttttgttaaatcacggagatagaaattttgatcatagttattagcaaggaatggattattatgctttaaatcgagccctcctcctcacttcgaaagggtctcccattttggcatatttgcgggggaggggggagtcgacctttcatagaattcgatcaagtcagtaagcgaagttgccaacttttttaaacaatttgtcatcagttttgtatcactttgtgaactcaaaatttgacttaaaactatcaaaaacgtaatatatctgtcaacaaatttaaatctatttcctagttattagcaatttgctggccaatttatattaatgatcaacttatcggtgattaaatcagataattcgttaaattacaaaattttctccttgaaattgcccatttcacatggggtgggtccgattttgactatcgacccccttgaacataagtttcatctttttgttagttggagtgtctgctgctgtttgtatttgatcaactaactatcccggtcatttcccgatcactaattagctagctaattagcttatcccccacctgtgaacttccaaatgccgcgccttcgggtccatcaccggctgagtccgccacttgtccatttggtgttcccgaactgcacttggctcctgcatgtacttcaccatgaatccgtccggtgctccaccaacatcgctgtcggagtcgtcgaagtcccattggaccacaacggaactgttagaaatggtctgcactcggatattcctgggcggtccaatcgcagctgaaattgactcattaattaattatggaccaaaaaaattaattaatttaataattaatataaatttgtttattaaaatggaagttcactcaaataacaggacaaatagtttgagtaaaaatctctgctgctggcgatggccaatcatcgccaaaatcgccaaatgtcccaccattcccccccccccccttttttttgcgttttcattacaattttgattcttttctttggcattgtccatttccatttttagcagcgattcaatcactgcggtcagcacacttttctgctgcgaattgcttccgttgcttctgccatttaaattgttcccaaacaatccgaccattttaaatggtcgcaaattagagaatgggaacaatgttttaggaggaaatggcacctaattagtggttaattagatactaataaagcgcaaattgtaaaacaattcattaaaaaaatttaatttttgctatttttaacaaaaaaggacaaatatcaaaaaacaaattcagaatatcattgtattgagtttttttttggctgaaaatgccaatggttagctgaattgccacagtctttaaaggtgctaagtgttgggccactcaaaagaattcggacggattcccaaaccatcagcagaagaaacagcaaattggcttagtgcggtgtaagaaaagtgnggaggaaattgagaagaaag

SEQ ID NO: 11960 - DNA, 1055 bp, Heterodera glycines
  misc_feature (9)..(9): n is a, c, g, or t
  misc_feature (11)..(12): n is a, c, g, or t
  misc_feature (943)..(943): n is a, c, g, or t
  misc_feature (963)..(963): n is a, c, g, or t
gcatgcctngnncaggtcaccattcattttgtcccataattacgtggtgtcgagacaattgagaatggctaatgataattatgatgaagatgaggtccacgtctgcgccactcgttgtttgatgagcatccaattcaagaacacttggaacaccacacaacaacaaaaaacaaacagtttccggttgtttcaggagatcagcaaaaaggacaaacagcgaaagggcagcagaacggatgccccgaccttgcgcagcgcaccacgccaccaccaccaccaccactctcgacgggcaaccggacggaccaccgactggtgagcggatattgcgtgtcgagaatttgatgttgtgtttggccaattaacggcgtgttgacgatgatatcttaattgatggaatttatatgtctaatagaaatgacattttagccaacagaaacccaacaaccatgtggctcagttggtttgcgggttgcaaacaaagaaaaaataaaattaaaaaatgcaaatttttaaaattttaattaataaaaaatgcattgtcaatcaatccagcaaatcattaatgaatgaaagcttttcatttatttggttgtacaaatgatcaccgtccgggaaaagcaacaggatgtccagcaattaaacaatgctttttctttttatttcttttcatttcgtttcttttcttctccccgagtcgggcccacatttttatgcttctcaattttttttctctcccaattttattccacaacaataaaacattcattgtttgtttgtacacaaaattttctgctctggctcaagactctcgagcgaagagaccaatctcgcgcgggctcaattagttgacggcgagtcgtttccgagtccagcgcacagctgctgctgcactactgcgcgagattttgtacaccatccggcttccaccatcagctggtgngggggggggggaaagccttngagaatcttgattttggataattttaaattttggtgtagaaaactattttggcaatgttttcacattttccacaagaatttttgtaattctc

SEQ ID NO: 11961 - DNA, 2819 bp, Heterodera glycines
aatgtagtaaacagggaacggatttatatgtttttacatattttttttgcgcatatgctatcgcatgaaaagctcaaaaatagcatttttacctgttttcctttcaatcagagcgagtttttagcacatataaaaacatattttgggcttttggcgaataaaaacatattttggggtttcggtagtttttggcacatattttggcgattttgggatttttagaggcttttgtgtaaaattttatgaaggcgcgacaaaatgaaagtgccaaatgtaaaaagaaaatagaacaattctcaatgaaaaatgaaatttaaatgggaagcgatcagcagaagagcccggattttgtgaaaaatcaaaaaattgtgaaaatgccaacgaatttttcttcctaaaaattcttcccattttttgctcaaattcttgccgaagaccttcaaattcgttttaaaattttaaaattttcatcaattcgacctgattatccaaaactatctcccaatagaaatcaaccaattcattttcactttctttccaaaaacttttccaataatcattcaatattatgagaacatcaaataaaatgagaggatatcgcccatactgaagaaatattggcttcaccaatggtgccaattgtttcggcactttcggaattttagcataataaattattataattatttttgacaaataaaaattcaaaaataagataaaactcaaacaaacctttaatataaagtcggaataaatattcatataaaatttccaaatatttgcgatatttttggcatttttctcatccaaattcagttaattgatgcgcaattttgtcacattgtcaattctcttcatcaaaaacaaaaagctaagacgggcttcatatttttgcgtcaaatattcgttcattttctcaatatttgagtattctttcggcatcttaaaaaattcgccgaatttgtcgttaatcctttaacaaattccgtaaatagagcatcatcagtccaaaatttaaatttatttaattttcattgaatttaattctcacccatgtctttttatcatcgaattttgaattgataattaattatccaatgtttgtcatcattttatttcattggcttcccgtggatagtcttttttcgccctttcttccgcttttttaaacttttcctccaaattttgttcaagtttttgttggattattccttcagcactttcatttgttttataattattcgctgcttcaattgccaattgaaaaatcatttcattaattgacacttttggttcattttccaattttatttcataatttaagctcttctcattcaacaatttttgttcgaaataataaatgaaaagtttctttaatttgtattcaatatgtttactataatttggtttaaaataaaattgcgaaattttgacgagacaatgcaccgcatgaattattggtccttcaatttcaattcgttctttaaatacaaattttggcttaactgttggaattcctacgtattctctgagcaaatattcatataaaatgtccaaatatttacgatatttttggcattctgtccgcttatattctttaaatccatctgctattttgtcacattgccaagtacttcgcatataatacattatgccaaggtatgcctcatatttttgcattgaatattcactgatttggatttctttatctctcctttgagaaatgcaattagcattttgtcgtctccgtaattaaaatgattagacaaactaattactctaatttattaactcactgctggcatagcatttgaaatatgaattaaaaaataattaataaataataagaaaaggtattacaaaaaaagaaaagaacattatgttttcccttaaaaaataaaaattaaaacgatttaatttttagtttcaacttatttagataaaaaattatttaaaaatattttttattcgatatagttagtttttaataaaaaggggattgcttaatgaataacgtaattatgaaaatgaaaaatggaaagtaacacagccttataaacggagcaaaaaattgttttgaaattatgatcatcagtaggattacccaaatctattttttacttaaataatttgttattattatagcatacaattacaccggattacagtagtgacgtcacccaagccaaaaggtattggcttggtcccaaacctattgcaagggtgcaggccagggatgtgccgagccagacaaaatccgattccgattaaatcgccgattccgattatggccaaaaatccgatacgggtttaaaaccgattacgattatggcccaaaatccgattaattgcgattccgattttttttaataattttttcccaaaaattttatttataatcaaaatcataaattttaagattgtgatgcaaaaataaaagtttgtccacattctcaggcaataaacgttttctcagatctgtcacaatcaacccagcggtggagaaaagccgttcgctttcagtcgatgtagctggggctgagaaatattttttgatagcttagtcaaaagaggccatttcaattcgtttgcgccagaccaataagaaattggatcttcattgatatttatttttctggctcggagatattcattgacttcaacctgtataaaaaatagtttgttatttaatttctggtttatttagttcgcctctgatttttgtcgggcgttcaaaacggcgggacttggaattggcgaggccaacaaaaaattatccaaattcatttcttgttcaaattcagtgaacaattgtttga

SEQ ID NO: 11962 - DNA, 1422 bp, Heterodera glycines
cgagtctgtatcgtttcggcgccgccgtttcggcgccgccggttcggcgccgccgtttcggcgcgagggtcgtttcggcgccaagccaaaattaaaaaatcatggatcagttggaaattttgagcgatttaaattttcaaaaattaaaaattttagcaaaaatgtagaataacaataaactaacaaaagaaaatttaacaaaaattcatttgtttaccgtacttactcgtttagaaccccacccctctaaattagaagcccccccccaaaaaatatttgtttgccaaaacgagtttaaatttcctgcctatttgacacttaaatgtggaccaattatgttacaaaaaaggtctaaaataaagaaaaatctggagaattttatactttttatttgaattccctattttcaataaaaatgattttgaaattcaggaccaaagggggaggacatgatttttgagtgcgaaaaattttcaccaaaatcttccaaaatttttttaagaagttatttaagccgctgatcagtgatcacgaaaatataatcagaaggatcttaagattcgttaagacctaagaattcatccgtatcagttgattctgaagggatggcgctggtcaggttcggatcctttcgatataattttttgtgcattttgggtcttgtaaactttattgtgaatttttaaccattttcgtctgcttcaaaagttgcagggccttaaaaatcagaaattttttttggcgccgaaacgaccctggcgccgaaacggcggcgccgaaacgaccctggcgccgaaacggcggcgccgaaacgaccctggcgccgaaacggcgtcgccgaaacggcggcgccgaatcggcggcgccgaaacgacccgttccccaaataaacataagcataaatcggcataataacaaattattgtagcgattgttttttttgaatattcaaattttaaagaaaaattataattattcgtttaagaatccagttttccccgtcggagctgacaaaaaaatttattgccgacggcgcctctcggcactagaaaataaaaaatcatagggtttgaatgctggaactccgaactccttcaaaaagttggacacttgcccaccccctcccttgcgcgaaaccgcgggatttttctgtccgcgcccagccaattcagatgcctataaatttattgcttagatatgttttaaacaagtttgcaaggattttcgggggtcgctgatcacaaatccggcatccatgtcgaccgactcagaatcccggaccctaattcgaacgaaaagtcgaaaactaaaattttcgaattttacatttttagtctaaaatcagggttcgcagatgaaaattttcaaaagcctcatttggcaagcaaaaaagcctcattttgtgtcaaaaagcctcatttt

SEQ ID NO: 11963 - DNA, 2354 bp, Heterodera glycines
aaaaaatgataaaatatgttatcaatttaaaaaaaactatgaggaatcatattgtctttataggaacggctcgagtatacaaaaaaaaaattgaaaataatctagtttctgtagagggattgaatcaggggaaagaagtaaggaaagtcaaggagactagccactaggccatttgcacacttaggagttttacttttaaagaatatattaattattattttttatttttccctttgactccaattttcttcaataatttttcactcagaccccccattcttaccagtgcttgtttttcacggttcccggttgccctaccgggaccgggaccgggacctgagcttttcaaaacccgggaccgggaaccgggaccgggacctcggatgaccgggaattcccggcccggtcccggtcccggtcccgtggcactctacttaatattcatcattatgtgtaaaaaaaacaaaaaaaaattttgaccaaaaaaaaggtgaaaaaaatttcaaaagtttcctctttgcaactagcgcctaaaattcttatgtcgctgtgcccaagcagattctgttagttttagtgccaccgttttcggaccaaattttcgagtttcgcacttttggctcaaaagcgatttaaacacaaggaaacgcctgaaagctaccaattttgcaataaaagataatttaggtaaaccgtttttagacggaatgaaagcttttgtttgtatttcttggttgcttaaataatacatacattaaaggattttttacaaatatgcttttttcccacaagaaaaaataatgaaatgatccaaaacagcgggggaaaattgtgtgtgaaggaggggacggtgaacagaaggaacatcattagtactgtaattagcgcaagattaaattcattatgaataacttcttctcaaacggattcacacccctaaaaatcgaatttttgaattcaccccccggggccgaagcaaagggttggtacgcccttgagagagaatcgaaaaaagaaaaattgctgaacatctttcaatttggacactttgcttatacataattttgacactccaacaacttcaagggctcaaaagacattcaaacaaaagcaaagttttttaatcattaaaaaaatattcggaataaattttccgtaggaatttaattaaagttaacaatttttcatatcaaatttcacaaatttgttaattgcctgacggcgcctttggtcccccggaccaacctccatccatttatcaactttttttaaaaatttacgcaaaaaagtgacatacatatgatcatttttggacaaaatctgataagaaacgaccaaacattttcaaaaatttatcgaatagcaatttgaaaaaatgatgcgcattatgaaaaattgtccttttatattagagttgtgagcaatctcctaaaacaaaatttcatcaccatttcctggctataaaagagccaattttctgtttttttttattattctcacatatcttatttggcgacactattgcctattctttactatggtggctttcaccattattcctcatctgctgctcttcactgtcttcatgtccatcatcctggtgatcctctctcaatgttgcggctgtacgccttcaaagaagaagcaaactgcgacgtcaacgaagaagaagaccacgacgactacatccgaagcgatgaaaggaaagaaggaagagaagccggccaaaacatccgagacggacaaggcagcgcagaagaagccaactgtgacgtcaacaaaggcatcggaggaagaggcagaagaagaccacgacgactacatccgatccgacgaaaggaaagaaggaagagaagccggccaaaacatccgagacggacaaggcagcgcagaagaagaccacgacgactacatccgatccgacgaaaggaaagaaggaagagaagccggccaaaacatccgagacggacaaggcagcgcagaagaagccaactgtgacgtcaacaaaggcgtcggaggaagaggcgcagaagaagaccacgacgactacatccgatccgacgaaaggaaagaaggaagagaagccggccaaaacatccgagacggacaaggcagcgcagaagaagaccacgacgactacatccgatccgacgaaaggaaagaaggaagagaagccggccaaaacatccgagacggacaaggcagcgcagaagaagccaactgtgacgtcaacaaaggcatcggaggaagaggcgcagaagaagaccacgacgactacatccgatccgacgaaaggaaagaaggaagagaagccggccaaaacatccgatacggacaaggcagcgcagaagaag

SEQ ID NO: 11964 - DNA, 2687 bp, Heterodera glycines
ctaaaatgagagattttttctctgcactctacaaaattgtattttggatttctttcaccctcgtctataaaaacaccaaactttgcagaaggagagcactttcttttttttccgaaattgggtacttttccgtattagggcctaagactccctcatccatgcccaactcatccatacccaactcatccatgcccaactcatccatacccaactcatccatatacccaactcatccatacccaactcatccatatacccaactcatccatacccaactcatccatatacccaactcatccatacccaactcatccaaacccaactcatccatatacccaactcatccatacccaactcatccatatacccaactcatccatacccaactcatccatatacccaactcatccatgcccaactcatccatacccaactcatccatatacccaactcatccatacccaactcatccatacccaactcatccatatacccaactcatccatacccaactcatccatatacccaactcatccatgcccaactcatccatacccaactcatccatatacccaactcatccatacccaactcatccatatacccaactcatccatacccaactcatccatatacccaactcatccatgcccaactcatccatacccaactcatccatatacccaactcatccatacccaactcatccatatacccaactcatccatacccaactcgtccaaacccaactcatccacacccaactcatccatacccaactcatccatacacaacatccaaacccaactcatccatgctgattgtactattgccatcattgatttgtgtttgcccaaaaccagtaaattgtttacgttttatttttagcaatggaaaacgatgcattaatggaagaagatggtgagcagaatcaagaggatgagatgacattggaagactgttggaacatttgttggctcgattcagaacgatgcattgcgcataaaccaccgaagcggaagtaaataacactcaatcagtgttttcatttacttcctttggttaagagcacaaaactgcaaaaagaatccttattgcatccatcggcttggtttggagaagtttgacaaattattgaagactcaacaaacgtccaaagtgctggtacgccgtgaagagtcaaagcaaccgtgtgggttaaataacgccggcaacttttgctatgtgaatagctttctccaggtgtttcttgaaattgattaccttttaaatcatttcctaattttagatttggtttaacgatctcaaatttcgtcaatgcgtttacaactggcgttcctccacgaattggattatgccgcagaatgccaaattgaacattcagacggttatgaactgtctccagcaattattcctcacaatgcaattcactccatttgtaagtatttattctgcagcttgttcacactgcaaatttaaaggaagttaccgacgccaatgactttatcaagttgcttcggttggacaatcaacagcaggacgttcaggaattccatacactctttttcggaacgattgaacgcactctcgaggcgcatccgaacggccgaccagtccttgatgtcatccgccaactttttcaggttttaggaatttcctttctaatctgattatgcgtactcaatatgactgtcttattttagagtcgcatcagtcaaacaatttcctgtgcaaactgcttgcggaccagtgaaacggtcggtgaataccgttctctacagattggcattgatggccatagcactctcatctcggctatccaagctttttttgcgccagaaccgttagttttcacatttgacaactgaaaaagtaaatcgtattttgatgtctaaatataattttagactgagagactttcggtgtgaccagtgccgggagactaattgtgtgactcggtccagcagattcactcagcttcccgaattgctcattgttcagcttaaccgttatgttctagcaaggtccattgttatgcttgttttttaaacctgtctaaatttagcaatggaaaccttcgcaaattacaaaacgccgtgcattacccacgccttttgaccgaacttggaggcgagggaatcccggactatgagctgtgtgctgtgatgattcatgaagggaagagcactaattcaggacattactacgacgtcattcgtgacccggtcatcgaccgttggtttacctacaatgacgaagtacggattgtgtggtcttattatcccattttacgattgtgccccatacagacggtgaatcaaaagcgcacagctcccggctatttgggcagactgactcagaaaccacgcgcgagtgctgacacgacggggtgttatgcgctgatctaccgaagggtgggcagtggcttgagggggccggtgcaattgccgccagagaatattgtgacggaagcaaagaaaagggtcggttgatagtgagatcatttgtgggttttaagaaatgttcatttagatggaggcggaattcgcacaacaagacaaggaggacgacttggcatttaaaaagtggaaaaagcatatcaacgaaaggaatcatttgttgcagcaactctggaaggagcttgaggtctccccacctgtccatttgtatcgaattgaccactcact

SEQ ID NO: 11965 - DNA, 2752 bp, Heterodera glycines
atgctaagagaggaaattcatgaactccctccgttttcatgtaacatgtaacatgtaacatattttgaagcgtgcgcgaagcaccgaggccacgaagtgttctaatgagcccgataaatttagaaatgggcgcgaagcgcccatcttagggcgtaaagctgcctacaaccccttaataacttttcaaaaatcattgcatttcattatgttaatacatgttacatgttagatgctaagagaggaaattcatgaactccctccgttttcatgtaacatgtaacatgtaacatattttgaagcgtgcgcgaagcaccgaggccacgaagtgttctaatgagcccgataaatttagaaatgggcgcgaagcgcccatcttagggcgtaaacctgcctacaaccccttaataatatttcaaaaattcattgctttcattagttaatacatgttacatgttacatgctcagagaggaaattcatgaactccctccgttttcatgtaacatgtaacatgtaacatattctaatttgctacataatacatgtcaacagaaattgcctatgaatagattttaatttcatttttcttaattaaagtcaaaattaattatttgttacatgttacatgtaaacataacttccttgggtccaccactataaatatactggaaactttcattttttgttcattcaatcctacaattgttacatgttacatgtcacatgtaaattataatccatataatattttttcctttgttcattcaagtctaatttgtttacatattagatgtcaacagaaattccctatgaatagattttaatttcatttttgttcattaaagtcaaaattaattatttgttacatgttacatgtaaacataacttccttgggtccaccactataaatatactggaaactttcattttttgttcattcaatcctacaattgttacatgttacatgtcacatgtaaattaaaatccatataatattttttccaattttgttcattcaagtctaatttgctacataatacatgtcaacagaaattgcctatgaatagattttaatttcatttttgttcattaaagtcaaaattaattatttgttacatgttacatgtaaacataacttccttgggtccaccactataaatatactggaaactttcattttttgttcattcaattcttcaattgttacatgttacctaaatgtaacatataaacacaaattccctatgaatagactttaatttaattttcacgttttcaatttttaaagattgcttttattatatggaatccgtttcatcttctttaaagtcaaccgagggccagacccagcagtaagcacgccggcgtcttccatcggaagtaaaaaaagaggcaggccctcgaaagccggagcgaagccaatcttggctacgcaagaaagtgtgtctttcattgacacacctcgaattgccgtcactcaaagtgaccagggttcgccgtgcaagaaaaaagggaaggttgacgaccaccaacccatgtttgctaatgaagcaattgcttctacgcccattaccacacaaaaataccgtggagggcgacctgccaaaaaaattggaggcccaggccgaggcagactcagtgattccatgagcaaaagctcaaaaatggatatcaatcttgaaaatgccccaattccggcaacctcgcacattgtgtctgaaaaaattgacttcagcactgtgccaattaatttcgccacatcgcgaaattttgcctgtaaaatttggagatgggcagcaattggcctttatgagcgtgatggcgaaacagcacttggcccacgctctggcccaagattcattgagacctgttggaacagaccaaatgaatggctaaatgacagctttattgttgcctatttagcttacattgcaagcatttcacaacgaaaaacagtagttgtggattctttggcatcgagaactgatgtttctcgattttccaacgtgaagaattacactttcggctatgatccgaatgctgttcctgaagttgtgcttatgccgcttcacttcccaaatcattggactctcatcgtctacgatgttgcacatggtgcatacttccttgactcgctgcatatgagcagcttgagtgatgagagaatggcactcatccagtcaataattgctgagatagtgcccgggaatgcgtcattcgctgttgaatacgtgcagcaattgacaaagcaaaatgatggtaacagctgcgggtacttcgtgtgcctgtatgctgaatcctggctgatgaacaaccgtacatttgttctgccggatttgaacatcaattatgagaagaagcgcattttatggcacataaatgagctttatggctcagatattgtgccgtttcatccaagggaaggtgtttcaacatctttcgctgttgtgtctcatcacaatggggatgtagcgcaaacttcctccaaggtcataatgccaatggaagtggatgattcaccagtgcttccttcctcggaagatactgctgttcttgcgcaagcaccagtgatcggcgaaaatcaagctgacacacccacggtgttgttgcggacacaattgtccagcaagaaccaatcgcgcaggctgatgatgtaattttcatcagacctaagacgccaccaaggcgatccatgcgcgtcaaaaaggctttcagctcctgttagccgttcgcctcaccggcgccgaacgcccc

SEQ ID NO: 11966 - DNA, 3992 bp, Heterodera glycines
  misc_feature (3896)..(3896): n is a, c, g, or t
  misc_feature (3951)..(3951): n is a, c, g, or t
aatttaagttttatgcatttcattaaaaaatgttgtacctatgccaaaacccttccttttaaatttcattagccttcttattttattaaaaaaaataggcaaaaaacttaattcccttctaatgattgtgcattttagctaaatatgaaaaacattacccttttgccacaccaatagcgcgatggtcacgtacagtatgaatgtgatgatgcagacgagcatgttgtagttgtagatcaggttgaccggtgtgcacgtgtcgctgagttgacccgtgacaggcctaattaattgtaataaaatcaattaattaaatttcgaaataaattaattactctgtcggattttcaattgcatatagcaacacacgcacagccaaataaatgcccgggacacagctgagcaccgtgtgaatggcaaagtaggcggggccctcaattttattacggctaaatttgtttaatttgtattttaattgaaagttaatttaatttatagaaataaaaaaagagagggacggagagataaagtgagaaaatagagaagggctagagactatggcaaaataagagcagagatccgagaacagactgactgttagagaacaacgtgatattgttcggttaagccccgcctctgtttgggagagtaacaaattggtataaaaaaggaaaggtcgaatagtaaaaattgaaatttattattaatagcttacacaaaatttgagagaaattctctctgataaagagagattttaaagttttaattttgccaacatatcgcttacaaatcaggcaccagcacggacaacagtcggtccaccgccgtgccaatcatcgtgaaaattgcggcattgtagccgaagattgattgaagctgaaagacagcactggtaaaataggggatgaaattgcgcccgctgaatatggtgaacaggaaaatgtaatggccgctctggtgcaggaactcgaaaaaggagttcagtgccaacaaaaggtggctgcacccgtgcagcgatctgtcaaagcgaaaaaagtgtgaaaatttgattttgacacatttttggtaaattaacaaaaaatttcactaattttggggtaggttttgagttttgtacttcaaatttataaatatttgtaggctggtagtccttattagagtccgaaaatttcaaattttctgatccctctccgggattaaaacttaattttgcgggatgatatcccaagggattgatcccacaaaatcccgtcctgttccaggcttcagactttgtgctaacgtactttcatgcaaaattatagccattctacctacaagaatgaacaatttaaaaatgaactttcttgaaacctctttacccgtaattagagggattaaattttaatgtaaaaatcaaaaaatttaagcgcttttgataattcgattcgcattttactaattgtaagaatctttgtaaaaaatttcaagtaatcttaattgctgggaagagttacaaaagttttgaattcttcttacaaaaaaaaaaccaatcaaactttttgtggaaagtgaaaattaaaaaaaatgagaaaatttaataaatttgaattatacattcaaattggctaacagagaaccaactcacttatgttttatggtcaaatagaccagaaacaggctcatgcagttgccggacacagcacaaagcgcaattagcagtgccattgtgacgagtccgccactgagtccggcatttttgtatgtgtagtaaaactgaatttaattttaatgcttgaaaaattttcaatcattttttaccaaattgccaagaatggaagaatttggagaaagttggtccaaatccattgctctttttaaatgtgtgaattatatgggtgatataatgagtttaaaagttgctttgaaagttgcgtgccaattgtaatatctataaaagggttggttgactatttgtgtcaatgtttagttgaattgcccattaattgattttaaatggaaagaccaattaaatttagacaaactttatgacaaacttagcatgcctattatttgaaaatttgaattttacttctagtgttgcgtgcaaaaaaaggtgataaaaaattgagcggatttttaatgagatatgaaagtgagattttgtcatccaattaagggggattaagtttttaaattatgcagcgaaatgaaaatttaatgagataggcaaaaacgtaaattcactcgatgccgaattgcaaatcatcgaagtgcatcaaaacttctaattcctagaattgttacaccaactttattaaattggcaaaatatttgcaattgaatttcaattaattttttttaaataaaatattcctcactttttacataaaccataaaacaaaagataacaaatctctttcttaatttctcaattttgtaaaattgataatttaaaaaacaaaaacaaagatagcatctaattaccattattattttttgaatttcaattttttgcctcattttggcacgacaatgccgtgctaggcccttccttccttattttcacacgccaaatgacatgcaatgccaacaaccaaaaaaacagtttggcgcactgccgatcaacacaacaaagaggcaattagcggctaattgacaatgtttggggaattcatttggaatggatggagaaggcttagcattataattatttcccgccttataaagccaatttcatattctgaacaggtgaaaaggttgatgaagttgaagtgcctaaattgcccaaatgtgcccaatgtgtcaaaaaactatccgaattaatggcaaattaattttattactttatatgcgcaacaaaagaccatctgccaaatgccaaaactaatttaggttgacttttgtggccaacctttgagccaattgctttttgtgctctgtaaataccataggttacttcacgtgccaaaaaagttacttaacgtgccaaaaattgagaatttaatgtataaaaatagtaacaattttttcggcatcaaaaaccattagaacatttaggcttacgcgttattagtagggatgggatttttatgtgctaaaaatcctgaaatatgtaataaaatatgtgctaaaaaatgctgaaatatgtgctaaaaaccccaaaaatgccaaaatatgtgctaaaatatgtgttaaaaattggaaaaatcaagtgtttttttgcataaaaattcccaaaaatctcattctttatcatttttcgcccatacaacgcaaatcaaatacatttcaaagtgtttggggtaaaattgatctttttttgattaatcatttttataaattgaaagttccagcagagaactttgaaatccaataacgaattaatgaattcgattttgttactttctacattcgaaaaaaattttaaaaatttgaaaattctataagaattgtgaaaaaagttgatttttaggggtgtatttttcaattttcttgtatttttattgcaaatttttctcaaaaatgcctaaatatgtgccaaaaccccgaaatatgtgccatatgtttttatgtgccaaaatgccaaaatatgtgtttttatgtttttataagtcgctctaaatcgaaaattgtacggagaaaatgttatttttgggcttctctcgccataactaagccgcagaaaaaatatgtaaaaacataaaaatcccatccctagttattagggatattatttgtaaattttggagtttatctctcaacaattcggacaaagatttcttccccggtaaattattaatgccaatttggtgaatgtaataattatgtgaaaaattgaattactaattgatttaaatattgaattactaattgatttcaaggtcattccgtgtttttcattcattttccctggntgcagtttccctcacccccacccctctcccccagactcttgatcacttcattagntaatttattatttaatttgattttttaagaagcaaaaaaaa

SEQ ID NO: 11967 - DNA, 665 bp, Heterodera glycines
gggggaaatttgaaaatttgagtgtaatttattaacagattttcaacaaaaaatgctgatttttgggattactattgtaaagcataattcgactatttccataaccaatttcttttctgctgttgttccgcccctttgccttttcccttcacacttgtctatttaaactgatgactttctacactcggggatcagttggccaaccagtgcattatccgtcgaccattatattttaaggctattccaataaagcactgaccattctccgccgatttattattggtccggacgtggacggatttgggcttgggacccgggaggttgggagtccagggcccggattttcacccatcaattcccgcttctctttccctcttccattcctctggcactacctccatggtccttaatgggcatctctcttaagctctgggttggacacccggccgttttactctatgctcaatgttcgaatttttaatttttttcctttgactccaattttcatcactaatttttcacccagacccccattcctaccagtgcttgtttttcccggttgccctaccgggaccgggaaataaattttcaaaatccgggaccgggaactggacctcggatgaccgggaattcctgacggggtcccggtcccgctgcactctaat

SEQ ID NO: 11968 - DNA, 1746 bp, Heterodera glycines
tttatatttaacttttaatcgtataattaaattcaatgacatcgatttatataattaaatttaattattttatcaattcctgagttttttgtggatcgacctaacaccgtcataatgagaaaagggtgtctgtaaaataaaaaattcgtaaaaaatcataatacgatgaaaaaatttatgggttttccgctattctacccctccccttttttaattagctaagggcggcggcagtcgccgatcgcaaagccttcgggacagcagtgccggaggctatgcccagccgccgggcattggcaattgttcagcgccgcaattgggcgaaatcactgcgctgtgtgaggacgaaattcggcaacgccaactgccgccacattttgtgttggaaaggcacaaattgcttcggtagtgttggcgttttgttcatttttttggagcgcaatttgaattttgctttgtcgagtgccaaattattttttttttttcaatttggcatccatttaaatgtaaatattaggctgaactcccgaaatttgttcaacgtttaagatatttgtaaaatttattttaaatatctctttttatagaaaaaaattgatttttagggctacgtgtttagaaattttgattttcataagaaattcttataaattctcaaaaattcaaaatatgtaaaaaaaaaatgcgtatactaacacccctgggtgttagagaaaaaaagataatgtttttctctggcactctctatttattggtacacatctcgttttttgaaacggtgtgtagataaggaaatcggcggacaaggagaaattttgagaaaaaaaataagttattattaattttttaaagcattttttcttgtggttgcgtggtctagtggctataccaccttttgcctttcattatttttcgtgtgggttcaattcccctaaaaaatatttcaatttaaaaattattattttttcttttttgtaaacagcctaaaaccgcaaatttaaccaaagttttgggtattttttgacaaaatcttttctcgacccgaaacccaacccaatatttttctcgacccgcggcaaccctgatgacaggtcctgaatttgctttacattttttaaatgcttttttacgaatattttatcgcatgataagagcatttttatcagatttcttttcaatcagagaaattttttagcaaataaaaaaagtattttggatttttgtctaataaatattttttttggtggtttttagcgaatattttgtggatttttttgctattcaaatatttaggcgcttttaacaaatttaaatccggggcctggcaaatggtttttggtgaggacaaattttcaaaaaaatataaaaaaattggtacttccttgttctgctgccccccccccttaaaaatttttaaaatttcatattttaggattttcaaggtcactactgatcacgtgaaggtatttgtttcgacatttgatgacatcatattcgtgatcagtgactttgaaaacccaaaaatatgaattctaaaatttttcggaggcggtggggggggggggaggagatttcgctgggccgtggctgtgagcaggtgattttgtggaagaaacgaaacacaatttgctgctgatcagagcagtgatcaagcccttgtgcctgattctgagctgatcaaaggattgatcaatgctttatctctgaattttatttttctcacgcgcatttctgatcagcgatcaa

SEQ ID NO: 11969 - DNA, 2244 bp, Heterodera glycines
ttaattacaaaaatagccactgaacaaatttcgggggtttggtaaaagacttttttccaccagtgtatgaaaaagtggaaaaagtgccaaaaatttgtattagagcacgttggacccaggcaaaaaatgtattttatgaaattttcagccatagaattaattatatattaaattaatttttatccactgcaaataaatatttataaataatttcagaataaaattggatgcttctagcaaattgctgcaattcccagaaacacggcctgacgacgaatgcctgatggtttggaactaaaaaatgccatgaaatttaatttgaaaaaaacccatttcattttttaggtacggtctgtgctttcggatatttatctgatccatcagaaatattgttttcatgtaagcataaaatagaatttgcctatttaaattaaatggaaataatataatttttgttaattttaattttcaaatattcaggctaccgtaaccaaatgtatgtgtgaacggtaagcgctttttttagattatgtgccacaacaaaaagccttagttgataaaaactatacatataaattaccaaaaataattgaaatcaatttttctgaaaaaaaaaaaaatcgggtttctcagagaaataaatatttttaaaaattttttccgaaaaaattaataaaaaatttcgatcaaaaataaaattccttttaatttgctatttgatcggacggggcttatatgtgatttctttcatcagcgatatccagcaatctagaatgttttgttctggaacttaaaaataccgtaccaaaactagtatggtaaagcaggattttctattcgggaaacctgtcccggtactggtccctataattttggcaccacatttttgtcaaaaattgatcaattttgccatcaaagtgattcagcttctaatcactgcacaatctgttaacattcagactgcgatttgagcgctcctgcggcatccaatgtgccaatttggagccgtttggactgccgttgcaccgcgaattgttgtggagcgactttcgcgggcggttgagcgccgcacaacggacgaaaagccatccgtttggcattgcggcgcaaattgcgatgctaatgattacattgataatcatcccggcccaattaattgaccgaaggcatttctgctttaggtggtggtgttgagcattaattattttaattgcctagcattttactttatttttttattccggtaaaatggatttttggtttgcaaatttttattatgatttgctagagctcagacttgaaaaatttcaaaaaaagtttttaaaaatgtgtgagactttttcatgtatgaatttcttgatactgtattgtatgatacagtagtacctttcttgtgtatattgtaaatatttccattaacatattttatataaagatctatgtatagagaaataattcttcttttttattatactagcccgaaagcgcgctttcggcgcgcacttgggctagttataaaaatgaaattctctcaataaactattacaaaacaaagtaaaaaattttcttgtattttgatttttgttaaaataaagccacagtttaaaattttttaaataaaaatttaaaatccaagatcctcaaaatttaaaacctgttttacaatagaaatttaaaaaattctgcgttctagttcaagcttagtttaattttattttctggctcactctctttctctttttttttaaatcttttttgtttgtaatttcaattttaaattgcttttgattttagcttcggcattaagctttctaactatactcgcgttgagatcgcaccaaagcgataggtatcaaaggggacttccgtgatggttaaaaggcacaatttacgctaccacccctatatgatataattgattcttggaacttttacaaaaagatattgatctaatattaaaaaatgcttaccaaaaattctagcttaaaccactaaaaagggttttttggtgattaaaaatatttgttaagatttcagacaacattgacttcaatatattcatatttcatatacatattattatcgtatattttatttttatctttgtttagcttttcaaataatttagtcggttaaatttctttaaaacaaatatttttcactttatgatctctattttttggatgcaatctaacttttaacccttcccatgatctcgttcttgaaaaaccaacgtataactgt

SEQ ID NO: 11970 - DNA, 1078 bp, Heterodera glycines
tataccataggtgccatcaccgacacacgaatattttcgcttcttgccaaatgacaaataacttcttaagtgaaagttttaccgttaccaccagcgccattaataaaaaaataatgctggtctttttttattgtgcaatttttcaaaaaccgtatcaactattaatttttgctcatttgtcaattttgcataacaacaaacttgaatttaaaaaaaatttggatgtaatatcgctaaatcgttggtttaaaataacagatttgagacattaaaatgtaagaatacatttactgtgtttggtatgaaaaaagtaaataaaaacaactacatatttcatcataaaatcacctatagaatagatttacattcctatgtttctctctctttgcctcctttcctctctctctctctctctcgttttttctctttttatcgctcctctgtatttttattctcaccttccttttttttcccatttttccaaaccaaaattggcataacggctataagcgcaaattcaaatggcgtaaacatcgcggacatacagacacacagaaattgtcaaaattatatatagataaattgtgaaatgaattaatcatattttatagagctcgacctggacctggatccaggcctggatttttcctggatccagttccaggtccaggccatttttcggtaacttggatttttcctatacctggatttttttgtgctttccgttacccgactatcaccgcccactccccgagaattgcttttccagcggtctgggagcaccccgaactaaaaagcacgaaagaattcaaaatcatcagtgtttacactttaaaagcatagaaacatttagcaacaatagttccgattaagatttataggacatttaataaattgcagaaaaaagtggaaatgggaaaactgacaggaaaaaaaggacagtccttgaaataatcggaagcccttaaaaaatgttaaaaaagagagaaaaatgaaacatttcctaaagaagcaatggaagaacacccgaagccatcgattatcagatttgatcagatcagatcagtagcattctcat

SEQ ID NO: 11971 - DNA, 3600 bp, Heterodera glycines
aatacaagatcatttgagtcatttttagacgaaaaatgcgaaattcgaaaatttgaattttcgactttttgtttgaatccgggttcgggattcgaaattggccgaaatggatgccggattcgtgttcagcgaccccaaaaacccctggaaacttgttttaagggcaaaaaaatttttgaaaattttttttccaaaaagggaggggggacaaactacagtattacctgtggttgttcaagttgtgtttccttaatgcttcatttcattgaatcatattttttctttcaatttcacaatgattctttttcgacatggctcacgacacggaataaaaatgcaatccttattgggtcgactcgtactgacccaattcgagctttttgccagggggcggtagacactaacacgctagacagttcatatacttataacacatgaacaatgcgaattgggtagtgcaaatggtctttgtatgacaaatcgtggtcatgaaaaatcaataaattctctgtctgtctttctttgctttgtttctgcatgtgttccttcatttatttgtctgtctgtctgctgctgaatgaatgaatgagttcatgcaaatgctggggatgtaaaacaatgtgtcttactgactgacccctgcctcttctcattcattcatttgtgaggtcattccgtcacaaatgaatatttttggagataaaaattgtattctcatttattgtttctaaagccaacagtcaattctgcttttctttgactaaacattttaatgttgaattgaaaacaaaacatacctaacagatacttaacaattctagactaactccccccccctcccttatgtatggtttttcatctgctggttcactaaattgtaaatttgctaaaatttgggctgcaattttcgtctcaggtcgaaacccaaaaactcggctttggccggacaatgttagacggcgcaagcccggccatagccttaaatatgttttgttcgatttataaatttagtcctttcatgaatgatcaaataatgacttatcgatcttccaaatatttttctcaatcttccagatattttctccaagttcttctgttgtttttattcgatggccttctttccctacacaattatacatgcgcaagctgatgtatgtttaaaataaatatttttgcatctttgtgttcaataaataaataaataaatttaatgatatctttcaagttttacctgtacctatttttttgaaaattatttattttcagaaaatccaatcggcccttttccttttcccccactaatccttttttgcccactgctaatgaagataaccaaaattataaacaaacttcccctcgaactcaacaatgaactacttcattttgttcccgagtttttttgccgaagtgttttggttcgctccaatttttcatttttttgtttggtccaacggagtaaaagagcaaaacattggaaacacaaagtacaaaaaatgggaaaaaggcagatgaaatgccgataaactgctgctaaatgtaattaaatgtgcgattcgtttaaggaaatcgatgcgcgtgaggagcagaccacgtacggattcggggacaccatttaccgcccattaatcccgcggcttggaaatcatcgcgtgttgacttcctttgtcggtgaaatatccggtgctggccagtattttcgttacgacgacgacagcggccgtttctgtgtggtgtcaatcaacacgcatgaagctaacgtaattataaatcaaatgtgattaatcgatgacttttttcaacaaaaaactgaattttaattatatatttcattcagccccttggtagttacaaaaatggaaaatgagtacacataccaacaaaataaaatgtcctctctacagaatttcgaaatgcttttcgtagtcaaattcatgttagcgttccccgaaatctccatcccctctgctgaagtggtgtaaattggcaaatgggcaccatcgtagtcaatacttaagaatcatttttcttattcgatattcagagagagatggtccgcactttctttcacgacaacgaggctgggttcaccaaaaaatattatttctgcgaactccaattttttgctatcaatgaattggtaaatgggatttcggcgtttttcgcaaagcatcatttgtccattttgaccaattccgtacaccggatccgaactcgaacaaaaagtcgaaattcaaatttttctaatttcagaaattgaaaaatttaaattttcgactttttgttcgatttcggacccggtcttcggaattttaatcttcaggatttagaatcacagaatgaaacaaaataattgtgttgaattaaattgaaatattcctttttcagccttgggacattgccgtgttgaagttctacgcagaaaccatgggaaatatttgggaccccctttttacgtacttggacgaagtcatcacttcggtgagcctatcatttacagcaaataattggcattattttataatggacaaataagcaaagtgtacaattctttattttccaaaataatcaatcagtcctatttaacatttagctcgagaatggtgacatgccggcgtacattatcgaatcgtcgccaagtaattcggccaattctctcgaggacctcccgtcggttgaggcaccgcaatcggatgattagttggagtgacaaacacttttctggcatctctgttccttcatcaaaaatgtcctttgttgttgttatgggcataataaacaatgaattctattgacattagcttctaccctcgtggatttttccctctgctcgggttcaattaggtttgctcttaaaataagtttttgtacttattttagcgttttatgtttattttcgttcttatttcgcgatttttgagaaatttattaacaaaaatgcaataaaaacaaaaaatacacccataagaatcgacaaaaaaaatttggggaaaatacacttaaaaattttcaaaaaaatacacccctgagaatggaccctaaaatcctgaaaattctaaatgtacttcatttctaactgcaaccagtaaataaaattgtttgacttaattttaactaatttacattgagaaaacagcaattttaacaaattttgagaaaacagcaattttaacaaatttcaccccatacatttgaaatttttcatgcttattttcgcacttacttcgcgcttttttcgcccttatttaagcacttattttgaactttttcgcgcttaaaaatctgagccctattcataagaagttttaaaattttttttaaaaactgctcaattttataagtttacaatttcttaaatttgaatatttctatttttataaacagggctgtaagaaataggtatgcacgaaaaatgaccaaaaatgcaaataaagtcataaaacatgcacaaaaatcgaaaaatatgcataaaaaacttgaaaattaggggtggaaattaaaaaacatgcacaaaaatcgaaaaatatgcacaaaaaacttgaaaattagggatggaaattaatttaaaaaattttttcatcataaattttatcggttgttttt

SEQ ID NO: 11972 - DNA, 2719 bp, Heterodera glycines
tttaatgtgcttgaaggaaaacaaaccgatatttagagacaaacaattgcaccccaaaatgttcgccggaaaatttccatgcgtttatcaattttctactaaattttcaaatattttgttcaaagatgacaactatcctgctttttgagtagattttttaatgggttaacaaagtggaggttggctggtccggcgggccgaaggcaccgccagcaggaaaaaaacacaaatttggatgaaatttgcgatttattcagaagtatttggcattctgtcctttgatattttcgatgcaatgcgagtcccacgggatcccgcacaaaaaatcaaatttgcatatcccgttgcgagattgcaactcaaaatttttttttttacctgctgaaggatcccgcgggattaatcccgcaattcccaaaaaaaaatcggaattgggatcccgcaaaatcacgcgcgggatcccgtcccacgtcggtctctactttgattgaatagtaggaaaaaaattttttttgtgcgaacaaaagttatgattacctctatattttttaacaaattttcggatttttctatatttcatatatacatacatatgtacatatttttctgcatcttttagacttttcgctcttattcgtacatatttcgcaatttttgaggaattttttaaagaattttttggaaatgcccaaattctgacctttcgctattttttcgtaatatttttaaatttaaaaacattaaaatatttaataagttcatttacaattgtatttaatcaaaattaataagatttgattaattttgctacttaaaaatcgttaataaataattttttatttgcctatttgtgcctattcgtttgttttatgcctattttgcagtttttgtgtttaaaattccgcccatgttaacaattcacattttaaaatttaccatttgatgataatgccttttggcatcggcgaaccaaaaaaataaataaaatttgaattgttaaatttaataactttttcacatttccccccctgcttttcgagcaccattcaccaatgcctaattatttattggcactttccatttcaaatgacatggcaaacatcatagaaagcaataggtaacttttaacaattattaattaatcactcactgcaaatggtctcgtctcactgataattttatgtaactgtttttatgggcacttaatttttgccccgggggtcatttgtttgatattatttattggcttttctcgggcacaccgtaacacatttgggcagcagttttattgccttttgctactagatttttgcctaattgggtcctaattatttgcctgtttttggtcttgtgtttgtttggcatcgtttgctcccgtgccaagccaattcctacatatgttttttatgtgatgccaataaaatgagtttgttattcagcaggggaatttgatcagagtcaaaatgaaaaatgctttgcaagaaaatgaatcgagaaaattttatttccatttttaaaaagcaataaaattaaaaataaaattgacctaaaaacactcaaaataaacaaattttgggctcaacatttgttataaatttgttaaaaaccacaaaatgtcgagcctctgttagaaaactgtctctataaataaattggtttgtttaatttagattttggcattttcagcaaaaattaattaattgtttttgtcagtccctccaccaacaaaaaataacattcatttattccaattttatccgttcccatttttctgtccctctcctttcactctttctatgaccatcggtcatcgtccgtttaatcaccgttttattgttatcaatcagcgaaagggagaagcactaactgacagagagagagagagaaaagcggtttatgttccgtgtcgtttttctttgatgttgccgccgggggccctttttgccaatgtttgactaccggatgaaatggccgggggagggggcgaaagtggcggtcaaaaagccattggaatttaccgcaatttttgtttttatgattatgtttgtgatcttcttagtattatgtactgtgcaatataatttagtcaagtaaaaaaaaagttcagcgaaaaatggcacgacattttgatttaaaaaacggtttttaatttccagaatttgttttttaatactaaagacagttatcttaattttaaatttaaaaaattataattattataatgttttataaaccaaaaagaagtcaaaactccaggttctatttaatttttaaatttacattagaaaaatgaacaaaaaattcaaacaatattttttaagccgaaaaataaataaattttctccacgttattcttaatttctaattaaaaaagaaaaattgaattaaaattaaaattacgcttttttaaatcacaaaaaatccagattttttgccattttcctccaaacttttcatttggatgggaccactaaacaattgttgttcatcgtccaccaccacagcaccacttgcagtttcttctgctgctgtgcttgcttcttccgctgatgatgtgcgacggacgattgacaatttacgacttgccaatttgtctcggcaaattgggcccccttttgcccgaggcggcggcggcactttgtcgtcaacggagataaattggccaccgcctcggtggacgacgaaggacgaaggacatgaccccccgggggaggggggg

SEQ ID NO: 11973 - DNA, 1891 bp, Heterodera glycines
aaatatacaatatttaaggctttaaatcagcaatttaaaacaatttagattttttccattttccctttcactgacatttttacaaccgcaaaaaaatttcttttatccaattggctttcttctttgatccgttcactaacacacaatgaataacgaataatgaaatgacatttggaagggtcaaaagggagggcacaaaaaagcaattgcaacagaaaaatttacactttgtcggcactttgaaaaagcaattttccggcggataattagggagaaacctcggaaaattggggcatttttcaatttattaagaaaatatcaccgttttctgaggtctctttattataagaattcaacaacaaacatttgaggatgtgtggatttgggggtgggtgggcccgtgttccgtaacattcgtttgggtctgatcactgatcattgggctgatcatttagcaacatgaattggtctttatggcccggaccaaaaaaggtggactccaaaaaggcccttaaatagaaataggttataaaaaggcccaattttcagagatttaaatttgtcagaaaaattaaaatacaaaaaactcggggcctagccgttatcaacgcattgtcgccagggggccatgatcactgatcagaccatcactttcattcatgatcactttaaactgtgccattgttactgtctttgccatcgcctcctccattttcgtgccgttgtcgttgttggtgttggcactcatcagctacttctggcgttatgcccgtgcagcttttgttgttggcgttgtgccgcgcggcaaccgcacagattgcatcgggcgcaaaaaacaatgtggcggcaccgccgccgccaccggaagagacgggcggctgttgtaatgacggcggtgccgtcgcgtgagacagccccggcggcgcaacaaaactcatcggcggaaaagcagcggacaaaaatggatggggatgatgatgccctgggggggggtaattaatttgaattcaaataaagcaattaatggattatttgtagctctaagagcccactacttttttcaacggaatttttttgaaattgtagacaaacagaaaacatttggagctattgaagtcatttgagataggctaatttggttgcttatttccacttagttatttatgtggtattgaggtgtccattttcaccgggactaagttgtcccagagcttattcgacttcacctgattttttagacttaactcgtcaagagctttcgaattataccaaatttataattttttaaatgttatatggttgatttttggtgcaatttttcgtgatttaaaccggttttttgatttttcagcacctagggactaatttttatgatgattagaggtcattagagattgattgcaattaattttccccatttttatttttaattatgtagattttttgttttatcctaaatttctgtgaccaccttccatttgatggggcaaaatgattccgccgcctggccctgccataaataaaagtgccggcggcggagggaaaacgccggccggcatcagctgaggcggtggcgtgggcttccgcttaaacctgtgaaaatatttttggaaatttttggaaattttcattttgtttcttgccttttccggcgtcgtaaaaaactgccattgtcgaacatgctttcggcattcgggtccaaataccaataattgccttgacttagacatttaaaatttaattgccattttttttgagaaaacctttgcccggatttcccggctctctgggcagctttcggaagcagtcgttcagcgacagattatgcctaattgaattttgccagcctaagggctgaaagccggcttttaattaggtaattagggaaata

SEQ ID NO: 11974 - DNA, 3299 bp, Heterodera glycines
attgactaccgtaagaataaatttaattttggtagcaccaaatagtgttatttgagtaggtggtaagctcgtcgactgctattgctacgactgttattcttaaatttataaatttccaagactttaagcttttaatgtctccaactttttattgataaattatttcagattttcaagatttgcaaaatgtctggtgttcaagacgaacacgatttgtcaacgccatcgccgccggtaagacaacactcaaattgtgcgttatgtcgagagtgtttagggtcacgaaacagtcaacgaattgccgccaccaccaccacctccgctatctcttcatcaattgatggcgccgcaggacaatgatacacctcatccttctccgacgtcgcatcttggtatgacagcgatgccaatggctccggtggtcgttggcgacgcgcaggctccgtcaaatgaaaacgaaatttcgcaaatggatgtcactcagtgtttgggcgccagtccctctactttcgttcggccttctgtttctggtgtgcaaccgcaggtgcaaccaaccggggtaattaagagattatgcttaattaaaaacctcaatacaaacttttgtttagtggtctaaatttttagtatgacgcattttagtaccaaggagcctgaaatttcagaaacttgcactttaaaatttcattctttcttgtcgacctccgtacataaatccaattttaaactatttattcattatttaagtttatatttgaaataatgaatcaaagatagtgctgataaagttattcgcatggttttaatggtcaatattgtgaaaaatttgaaaattaaaattatttaaaaggcattaaagacgcaagcaaaaatatcaatcatatgaaatccaacgttctttattaaacgaacaagtatataaagttttttccgaaaaaaattatcgtaattttatcaagaataaagaattaaagccggcaatcaaagattcataatataaagcatgctttctcccgagtatattgtctataaatacattaaaatttgattagttttaataattaaacgattcgattcctttcgtcaatgggtgaattcgaacggagccacttgaagagcacggcgacaattctgaacagatttcagtctctgtactaaagtgtccgagttccactgggactcaatcattcaacataaaaggctttaaaaatttatataaaacttataaatagggttcgcaaaaaaaggcaccaaaaatcgcgaaaaaggcactataataggaccaaaaaattgaaaaaaaaggcatgaaaaggcacgaaaatcccgaaaaaggcatgaaaaaaggcatttaaaattgttttattaaggatttttagggagaaaaatattttttgagaaaatttttaagttcttaggggtgtattttctgaaatttttctggtcatttcttaggggtgtattttcccggttttattgcatttttaatggaatttttcggaacaaaacacaaaaaaggcaccaaaacggcaaaatgccaaaaattgctaaactttttaaaaaaataatttaaaaccgaaaaaaatcaagtagttgacaaaaaatattagataaaaatcaatgattttcaaaatctgagctcagattcgtgatcagcttatttttaagcctagaaaaaatacccgacaaatttttaacatttttttcgtcggacaccaattcttaatattgccaaaaaggacgctaaaaatatgcatacatttaaaaattcataaaaaaatttttttttttgcttttattttaaagaaaggagctcaaaaaagcatttctgcattgaaattttcgattctgaagtcactatgcgtcattaaaaaatcagactttgacgcttctcactagggttataaattatatggactaaaaaatgccaaatatggacataaaatatggactaaaaaagcccgaaatatggactaaaaacctcaaaaatggccaaatatggaccaaaatattgatttaaaaatgccaaaatatgtgttgtaaaccctcaaaaatacgaaaaaacgtatgtatatttaatatttgttaaaacagacttaaaaatacactaaaaacagccaaaaaatgggtttaacacttaaaaaatgccgatttttattaaattctagcttcacaattgcgaatcaaatgcaacccaaaatttttataataacctcattctgttttcagcgaaaattttcggaagtggacaaaataactaaaaaaatttccgaaattttgaaaaaaaaaattttttttagggggtgtatttttaaaaacttccaaaaaagtcgatctttaggggtgtatttttcgcttttttgcatttttcttttgaaaatttgccaaaaatggccaaaatatggactaaaaacgcaaaaatggcgaaatatggatttattcccaaaaacccccaaaatatggatttatatggactaaaaaccttcaccaaatcaaaaaattttaacgcagaaatgctatttttgagcccctttcttcatagcatatgcgcagaaaaaatatgttaatccatataatttataaccctacttctcaccaaaataattaaaaaattttggcgttatgtcaccattttctcactattttattaacttttcgagatttttcatcactaaaagtcgcggccctagtcattaaaaatctgtcgaaaaataatccccccgtctccattaaaggccctgtctccaattatgtccccctttctgaagaggttgaaaaataatccccccggggccttaattagagaaaatacggtaattgaaattggcttttccttttcatccctttttcttccgctgaatccgttccgttcttttaatttctcattttcttccaaatttgtccattgtccgccgtttcgccccttttttcagttcccccctctcctcccactcccccttttttcatgcttttgtccttggctcccccaaattcggcgcccggtaaatgcgtcagtggaaaatgcgtcagtgaaaattttatattcataaaaacaagtttattgcttgcgttttcggggggcacggaccacgattcaggcatccatttcggccaatttcgaaccccggacccgaattcgaacaaaaagtcgaaacttcaaattttcgaatttagcatttttggctgaaaaacggcataaatgatctcttattgcaggattagggcttttagtgtgtttttttcgtgtatttaaacctatttttaagaaaaaactaaatttcgaaaattttgacttttcgact

SEQ ID NO: 11975 - DNA, 1611 bp, Heterodera glycines
ccgcttttccacctactaggatctcctttcactgagttaaagaatacaattttaaagttatatgtttcttaattatgattgaaataagttcaaaaaaatttcggttttttcgttccgtttcgtacgaaaacggttattttttcgttttcgtgttttgtccgtcaaacttttttcgttttcggttctcaaaatatttttttcgttttcgtatcgaattcgcattttcgtttcgttttcgtatacgaaatttttttttttgttgtgattttcgcacagccctgctccggcggtagaggggggggggggggggggcttcgtaatcgggtcctttccctctgctgatcggttgagcctccgtgcgccttacaatagtaaaagggaaacggaaggaacggggagggtgtcggttcgagtccgctccacaacattaatatatttatttatttccctccaaaaaattaaaaaatgaattttttttttaaattgtttttgccaaccaaattggacaaaatcggtatctatcgaaagctcttggaaagaaatagcacgccgaaatgagaggtgtgtgtttttctgtgcgctctccatttattggttcatctctcgcttcttgaattttaagtcaattttatgcctaataaatatattaataacaaacaatcgaaaacaaaaaaaaaagcaagaaaaagagtcaacgagcaatgtatgaatgaatagaacagcacgtcaagcaagggaaggtcagttgtcacagcgttgttggcacgttaacattggcatcattcttcgacattggcattggcacgcgcgacccgtgctgcaacagctgagcaggcaacggaaacgcgtcagaacgctccaaccacggctcgaccggccctggaagaaaacatggatataatttatatatgcatataccgtatttcttgaaacagagctcccggggctctatttttcaacccctctcaaaagggggccttatttcagagggctctaacaacaatagtcagggggggggtattataaaaaatacggtaatccgagttgcacagtgctttttgggactcgaccaggacctgaaccaaggccgggtttttccctggatccacgtccaagtcatttttcgacaacctgggtttttcgtgggccaggtttttgtccggtaaatgcagggccaacatgaaacccaggcctagatttttccaaaatttcgggctcctgtgtgagtcatgccagctcattcattgtcaaacaactcatgtccggttggtattttaggacaaagccttaattggaatatcgccacctttcatgacattttctcgatccacggcggcaccagtgttcatgaacgggttgcaaatggtgaacggagagtgccatgccttcttctcacggagctgtcgcaacacattcgatgggatacgctcctgtaagtcatggaaattttttgttgcatccagtatttaaactggtggaacggcaaacccgaaacaggaattaaaaaataaaattcggaattttttaattaactttttgtcggtcgaaatggagacgaaacgatttatggagggaatgaacgaatgaactgcttgctcactcccttttgtg

SEQ ID NO: 11976 - DNA, 1369 bp, Heterodera glycines
  misc_feature (126)..(126): n is a, c, g, or t
  misc_feature (178)..(178): n is a, c, g, or t
agagaaaagggacgagcagagcaggggatgaaaatgaatgatgatgaattactagtcgggggatgggacaggaaggcgttgaggacacctgtgaaacgatgatgaatgaatgaacgaaatggcagnccgaaggtgccgccgccgcactccttcgagaaaaaaaatcgaaaaaattaanagagaagtagtcttgagcaaattttttgtgtatgtttgtgccaagttacgtaaattttggcatttatgcaaggttttttttcataagtcatttgctctgtccccttaaaaattggtgaaaattcaaatgagtcccctaattagttttgttttataaactatattcaatctaagtgcctgaatttttgaatttttcggagtgcctacagatctgttcaccgcccatatatcaataaaaaaataattatttatttgttgaaaaattgagagcccaaaatctcagagatttgcttgtgcatatcgcgtgtcctttttgccattttaaactgcattttcaaaacatatcccgtgcgcatcattttttctaaatccggggttctatgcctagtctgctgggggcctaatgaatcaatgggttgaggggcaccgccactttagcaaaaagtcatcatcattttgccgatgttttcaatgaatgaatgtgtgggtgtgttggttggtggtggtcatcgcaaaaaaggaggaaaaagaacgaggtcacgcggtggctgctctaatggaagaaagtataagtcgcgcagattggctggcttttctgcgcaaagcctttcttaagtgacgagtgagaaaaaggaaataataattaattaaaaaatcttaatagatttttagtaagttcctctcgaaatggtatttttttttttgatggtcagtttaacgcccaaattttccattcacattatctcatgaaaaaaaacctcaaaaaaccgatttttctgcctgttttggcaccgcgcgccttaaaattcatacacttggcatgggaatatagcatagagagctttcaaaaaaattttctgattccttaaattgacagacaaagaaaaaaaaagatatgaaatataagtgctggggttttgccagttttttttttttgaaaattttgccggatttttgtcacaggcctttaaactttgagtgccgggtttttgagtttggccattgcgtcccctcgccggaccctctttaaataatcgtaataaagtaactaaaatttccgcgatttttttttttgaatcatttatgtacatagatataaaaaggggatgtgttggtacatggaaaaagaaaattgacataaaaaggctcctgcaacgggagaaggccgcggcgggggggggggggggggggg

SEQ ID NO: 11977 - DNA, 2099 bp, Heterodera glycines
gtcccaacacgtccgtctgtctccgtccgtccgtccgcatcattctcatggaccattataacttatgtaggtgtacatatatgtgtaggtacatttatggcgcatcgcccgcgggcgggccgggacgaggacacggcgacgatcactctcacaattgccgcagaagacagacacaaattgatcaatgtgcctgcctccgatattccgacataatcaacccctccagcgcacattcattcatttgtgtgaacgccggagggtgagggggcgggggaatgagtgaatgactgggcctaagcttgtggggtctgtctatttatagcatttgatggatgatgcgacggcgacgcaaaatttgaatgtagcgaaagtgcaccaccgtcgtgtggccattgttttcgcgcgggttggggacaaaattttcagcccgggagggtaccatttaagcgcgtactaaatgatggggaaaattttggcggggaaatgtacacttggggtcaattcagcgcagagattgtccatttaagcgcaggtccaatgctcatgaacagagagagtactgttttaaattttcttaaaatgtaaaagaataaaaatcggtttccttttgaatttgtttttcttaaaaaaattttcgaaatgcaattttttttattttagccaatttcattgaatgtcccaaaaaaaaaataattttaaacacattttggcaaaatgaatcttttggcaaattttggagacaacgaacgacttttgctccaaaaatgggaacaaaggcgattaatcttgtccaaaattttctcaacaaaatggagaaatagggagtgagacagagctaggggggggggcagtgaatggaacgcgacgacgacgaccttccccattttatttattatatccaaattgccatataaaagaataaatggcggacagttgagcaatgcagtgaacagtaaaaatcaacggttttaagaaatataaattttcaaaaaaaaaaatttaaatgattgaataaggggaggttcaaaaaattttttattgtggatgaaaggggggagggtgatttatttcatttaaatttttccctcattttaggtaaggcaattcattgaggtattgagcccccgggggctttagtgtttttcacaaaatattggtgttttaaaattttaattttgcataattctcccaacccaaccccaacaatgtaaaagtgcataggtaaatgcaccccccccccccttccccaaaaaaaatacatatacaaagtgccgcactccaccatacataattattgtccggagaattggcgagggggaagggggcacaaaagtggagaaagtacagcgacagtcacagagcccaacaacaacaagcagcgcaataaagcgatttgatcagattccagttcagctgcttgctgtttaatagagagaaaaaggcgactttggggggggggggggggagggcagcaaaaaatggacgaaacgaaaaatgaataaagggaagtaagaaaggaagaaagaaaatgattttcgagggggggggggaatggtcgtaaaaatgcgaatggtaatggtttaaaaatcaccaaaaagcgatgacgaagaagtatgcatgtattctgagagggcggaagggagggatgaggaaggaagatagagatgggggaagtggaagaatttgccgccccccttccatgacggcgtcgtccccgacggcgcggcaacaaccacgaccatttgttggaggacgatgatggcggaggggggaccgggcggggggaggttgcgcacccatctttgggggcaaaggctgatttggggaccggcggcaaggatatttgagcgacgccgtatgagcgacagcgaattcaacgcgcaattaactttttccagtgttaattatgtaaatccaacaaattttgtatcaaaaattgcaaaaacttagactttttgtagtttaagctttaatttttgtgagttaacttaattattatggtatacatattgtatttgattagactataaaaaagttaattgtccaagatgagctcggcactcaaatgtcgccgaccccccggctcatttgtgagctga

SEQ ID NO: 11978 - DNA, 377 bp, Heterodera glycines
ggaggggggtaaatgttaacataaaaaatcgtgagctttgcccctttgagatgaaattatttctgcaacacaaattttgtggacaatcaaaaagaaaatttaatgccgacaaagtaatatgaaaatgcgagaaatgcctgatgaggagaggcgtgaattcgggcttgaaacattatttgaggtgaatctaattagtacccaattagacaatttgcagtctcgattcttggtagaaaattaagtaatgttttggccatttgttttgggaaagttattgtgagataattagcatatttaaaaattggaaaaacaaagagcaaaattttaaatccataataataaattaattaaataaaagtcattaaaatgagctcatc

SEQ ID NO: 11979 - DNA, 4011 bp, Heterodera glycines
  misc_feature (16)..(16): n is a, c, g, or t
  misc_feature (26)..(26): n is a, c, g, or t
  misc_feature (1790)..(1790): n is a, c, g, or t
  misc_feature (1881)..(1881): n is a, c, g, or t
  misc_feature (1985)..(1985): n is a, c, g, or t
aaaaattgccatattntggggttttntggggcattaacttcactggtccttaaaaaatcttcaaaaatgcaaaatgtcggctgatagtgctaaaaaatctaattatgtaccaaatatgcataaattctcgaaatatgtaaaaaaaaagtcccaatttttgttcgcaagaataaaaaagaaagtgtttttcctactattcaaagcatgcagatccttgaaaaaaagtatttatataaaattgacagccctaatgattatatttgttcgaaaatttttatttttaatttaaaaaaatttatttatattaaaattttgtccagaaaatgcggtgtacacaaacagaaaatgaccaagttgatgaaccagttcaaaaaaggagcaaagtgccaaaagataattggcggtgccattgagtgatctaaaaaatataaaattataatttcgatcaaataataattcatcatttcatactttgttttgactgtgataaaaatcacagaaaaattgaagatgattccaaatgttgtaatgattccataaatcagtgcgcatccaatcagagaccagctgggattggcatctttgaaggccaataaaactgaaaatatattgtaaaattaaataatattttaccaattaattaccgcatcattgtcgaagttgtccaaattggccataattaagggtcaaaaagaatcgttattttattttaagttttaaaatcaacaactgtttttaataccgaagttaacgcttttgaaactcccgcatttcttttcatgacgcacgaaaagtaatcatcgtttaatgaactaataattattgatacaatgattggtagacaatttaaaatttgcgcttgacagaatccatcattttaattgcgagaaatatgtcacgaacaaaatcaattttaaaatgaaatgtgtcacaaactttggagaaatcaataacggctgtttaataccaaatgtttttttaatactcattttataacacacgacacatttttagtttgacaaatatggtaagaaaaaattgcgcattttaccatggaatttctcatcaaaattttgttttaacgaattttcatatgaaaccaattaatttgtgggaaaaatcgaaaaattatgactgtaaactgtgcgaagcatttgtattgcgtgacctttttgtgtaaattattattttttaatgaattcattagaatattaaattttaaaattttttaaatagtataagaaaagatatggttattaattccaaaaatcttaagtgaaagttttgtgcataacttttttaaaattcaatgaaattttccgaaattttaaatgtaattagagaattcttcggctttagaatatataaatgaattttggctcaattattttaaatgtttataattatatacagggtgtttcaaaagtgattgaacacacatatttattcatcttttagggatgtgcgagagtctcggttctcgattcccgactcgggaaatttcccgggtttttcgcttcccggtctcgggtttttagtctcggaaaccgagaaatttttacactgttaaggatgaccattgtggggagtgagtcgccggcaaagtgggaaaagaggaaaattatatgaaattttaacatattttcttaacaaaattcataaaaaatctccaaacatttccacaaaattcccttaagatttcaaaatctgacctaaaaattgcctattttaatgaaatcttaagcaaaataggaaaatttccaatttttctcccgcgggcctatcgcggnaaagggggtgaactccgtctcagcaaagttcaaaaatctatcttttttctttgttgataaaactcaacaaaatattataattcgaaagctntaaatgattcgaagattcgacattttctgtaattattcttaggctaatagagccttttaaaggctttcgaatgatacaagattgttggatttggtcaacaactntaaaaagttatattgactcaattttgttcggatgtagttggtccgttccggtctatcagtaccgctggaccccaaaaacttatacattttttgtgtaaaatctactaaatctcattaaaaaaatccaattttttaccggcggcgccgattaaaaacgaaaatttggtcacttttagacaaaatctgttaaccaatcacactcaaatttccaaaaaatttccccatttccccggcggagcctatcggcaccgccggatccttccgcaaaagttttatggaaaaagcgcacctcaaaaaagcggttgaaatccggtctttatgcatatgggttccaatccacgaatttttcggttcacgtatcagtgatccgtggatcatggtccgaggatccgatcctgataagataatcgagacattgggggatttaagaacaaataatatgcctaataatgcggcatcaattcactaccatttaataatgggctgatacggaagagtatcttatgaatgacatcattcaccattgtgtagcgcctaatggaggcacattttgcaatggaataacttgatttggatttgaaattcgtttgaacacatatggaaacaccgtttggaatgcctgccgatactccgtactaaaaaatgaaaaattaaattaattattttttaataatttttcaattaaaaaaacctggtaaaatacaaaatgggtccgtttgacgctgcgccaatgttcaaaggaattgaagtgattgcatgtaaaaaccacgcagtgatcggagacgaaattttgggaattaaaagaatgtaacaaattaatgcaaagaaatagccgctaatattaacagtgataatgcaaaaaattgcgcgaaaagtgcgacgattgaacgaatcggcggacggaaaacctataaaaatcaattaattaggtaattaatagcaatgttgcacaagtgaatcattgttttaaaaagagaattaactcaaaaattgcaaaaattagaaaacttatcaaattttaagaaaaaagatgccgaaatttttttgccaatggcacaaaaaatcctggtctgcttttatgaccattttccggagaaatgcttaatgaaagactgatttacctgaagcttttatacgtacggcaattccaagaagcagataaataatgcaagtaattgaagtaatcaaaaaacttaatttgtcaaaaataggtgcgctctaaaaagcagagaaatatttaattattatcggatcaggatcacacaagaacctttaaaaaatcaaaatatgatccggtggtcatctgatcaccatcccctagttgcattttggtacaccggaaccagagaagcaaaaaccatagaccaccagaaagaattgttaacaatgccaaatacagtcgcttttgaagattatcgtgactgaaaattactgtaattaacgataggaattattaatttttatacaattccgaaaaagcaattccaatcagtcgatcaatgccagtgaaaaacatcgtcggaacaattgcccctgaatttaaatgtatttaaaatatttgctccgtgcaaataccaagtccaatcacaggaatgaataaaatcattgctgccaagcggtactcaatgaaattttgtccagaaaaagcgttgtacacaaacagaaaatgaccaagctgatgaaccagctcaaaaaaggagtaaagtgccaaaaggaaattaacggtgccacggaatgaccttaattagggttcattttgaaatattaatatataatttaaaattccatggtttcatcgacattaatttcacactttgttaaatatgttgcagcaatgacagaggaattaaaaatgatgccaaatgtggtgatgattccataagtcagtgcgcaaccaatcatagaccagctgggagggacatctttgaaggtcaaataaaactaaaataaataaaaattttaaattaatttaattaatgataagaacgtattgttcattgtaccattcattttgaaaattttctaa

SEQ ID NO: 11980 - DNA, 5846 bp, Heterodera glycines
  misc_feature (2857)..(2857): n is a, c, g, or t
  misc_feature (3698)..(3698): n is a, c, g, or t
  misc_feature (5449)..(5450): n is a, c, g, or t
  misc_feature (5478)..(5486): n is a, c, g, or t
  misc_feature (5493)..(5494): n is a, c, g, or t
  misc_feature (5525)..(5525): n is a, c, g, or t
  misc_feature (5532)..(5535): n is a, c, g, or t
  misc_feature (5537)..(5542): n is a, c, g, or t
  misc_feature (5572)..(5572): n is a, c, g, or t
  misc_feature (5610)..(5611): n is a, c, g, or t
  misc_feature (5622)..(5622): n is a, c, g, or t
cttactgtataccaaaatcaaatacaaaaaatataaaactttaaaaagccaaaatttcctgaggataccaaccattgttaaaggcagcatgagttaaaaaaatttttttttgaaaaatacagaaaaacaaaaaaataaattgcgacctaactgaaaacccaatttttcttatatgaaaattacccctttcccaacataatccttcaccgttccacctccaaaaatgaaaacaatttggcggtaagcaatgcgatgaataatcatattattatgataatagttgctaatgatgatgaagccaaaaaaagttgcagcacattaatgttattagcgcgaatgggagacagccaattgagcgtgggggtgccaacacaaagtcatacgctgatggatgacagtgctcaagtgacagctattgtcccatttaagcgcaatgtattatgccaaatgcttggccaaacaatgcccgccaaatcagtgccaaaccccgagtgtcgctggcttggcacttatgtcactcagtaccaagccctggcccggcgctgagttggcactaccctaaagcgcaacagcagcagcaaaagaagaagcattatgcccaaaaatgacgacgataatgatgatgaattgctgcagctgctgctgatgcttcacagtgcaattgcctctccaccggcgcgcgggtgcccgttaatcagcccgaggggaaatccgcgctgcgcctgcgccgcttttgacgcggaaccggtccgtatcctcgtcagtcgtcatttggtggcctatttttcgccccaaggcgaagcgggccgctaaattttcgcgcgcggtaaaagtcattaaattagccgctccgttctgtggcccgtgatcaaagcgcagccggcggctggcgagcgacaagtgaatccgatcggagacggcgcgcaatttgcccctggggaacctcgacgcgccccattagtgcctcggggctctatcggcggttaaaaagtgaaagcgccgccttgccgtacaacaaaattattaatgatccatgcatgtgagaacgatgcaatcaattagcatgctttcggctgatcttaaaggtctacgacagaaatgcgaccccacccccctcgggtcggggtcactttggcgcgggccattttggcgccgcgaactttaaagtgttataacttttttcttatccaaccaaataaaataattttgataccattaaataggcctaagtgttctttattagcctgcaaaatattagaaaaaaaaattctgtttgacaaaagagccaaaatggccagaaaaagtcagttttttgaggttttttggccataacttttttatgttttcaattaaattttttgaaattttgcaggctattagggactatcaagcgctttaaaatgatatcaagcttatttaatttgaatgagaaataaaaatgttatagcgtttggcgccaaaatggctggcgccaaagtggccggttcccacccccctccccacccgaatggccagatgggggcaaatttttaaaaattggctaaatgggggcatcgttcgctggtggcaccgattggcaaacctgaggaaatttttaattttagatgaattgtttagataaaaggtgtaattaagtaagggtttatataggttaaataagaaattactcattttattttatacattttttgcaagtaaaaattcaatttattatgatatttttttcataaaaagaaagattttagattgtacttaaaggtcgaataataataataataaaagtcaaaatttggaaaattagaaaaaaacaaattcaacgattttttaatgagggaaggtttcatttttgtgttccatgaatgcccttccaaaacagcgaccaattattcaaaagaaagttttttttttgtggatggatggaacaggtttgatcccctgccggacaatgaataacaattgtgtccgattcgatcgcttttttgtggcgtttggcgtccgtccgccaatcggtcgggcgtcaatttgaataaaaatgggggcgggcgagggtcagtgagaaaatgtacaaaattgcttttaatgatgggctttttgtatagcattgagcagagagagtcaataattcattcatttatccgcgccgtccctcggtggacaatgcgtgccaatgccatcaaaaaagcaaaaacgtaaaattttaacgagaaaattgtttattttattagttagccctggaaaacaatgataattttaagataatctcttaattcttaagtgatttatagtattgaaaatccaatatcaaagatattgaaatttatatgccgttggaaatgaaattcttttttttatttaaataaataaaaatggtcaaaagaaaaatgccaaactcaaattttgagagtgcaatatttttctttctttttttgtaattataaaaatactgcctttttcaaggttgccaaatgctcaaactttttaaaaaaaaaatttcattgcatagatagacactatcttaacaagagcttctacatacataaagcttccaacaagcagtaaatttataaattttactgcttttgaaaacagaaatagattgaaataatgggccctaaacggaaggggactgactccccaccgcgtttggcaacctcgtgtcttttttggccacaaaagtgcaccacactgtttttgacagatgcttaatgtgtgcaaaattatgcggaattgcctcaggcaaacattgggggggggggggggagtaaagccatgaattattatttgtcacaagccattgttgttgcgtttattgtatggacttcttcgctttgatcaaacactcggagagggggggggngggggtaggctgaagtgggcggaacgccacgacaatatttacatatggtcatcaaaagccaaaacaaaaagccaatgaagcttaataattttgagtgggctgaggagtaaagtggcgtcagtttaaggaaaagcattgatcaatcagctagccgatggttatgcctttgtcgaattgatcagacagctagctactggtctatattttgccatgcttagcatgagaaaaaagccaacggcgctatgtttttctattggatcagccaaatttgtcctatgccttgttttcgatcagccagccgctccaaaaaagcaaaagcattcagtataagtgtcgtcagtcattcagtcacttcttgtggattacatacatagccgtcccattgatcgaacaaaacgaccaaaacatacacatacactcgttacattcattcctcgtgggcgctattgtacgattattatgaagtgtgccgttgaagtgccgctggtcccgcattaatttgtgtttgtgagggatggggcatattcttttgttattagatggtataagggacaattttcaaatgaatttccgccgggcatttgtcggattatgccaccagcagaagaaagaattaataacacagagattacggatcacggcatttataaatgcttccgtataattacggcttatccgtcttgtttagaatttgatcaggtccacctcgtttagcaccttcccaatttatggttttgaaatgaaatccatctgtcagtgtcttcatttgaatgcatttgccgggtggcacattacaataattaagcgcttaattgaggctggaggggagaattaatttttnctacggcgtcactaaaaatttcagggttttttgctttaaagttttcacctaactgaacttttttaaatgctggggcaacaaatcttggtaaattttggttcccttttggcggtaatttaaaaaaaaaaactgcccaatggaaaaaggtggggagggtcccggttttcaaaagctttacggaatgggaaaacagggtcaaagggggggggaaaaaaacaaaatttttgaaacaaaacccaaaaagggggaaaaaacccccccccaaaaaatttcaaaaaaatttttttttttcccctttttttttttgggtttgaaaagggggggcaaaatctctttttaaaattttttttgggtgggggggagtggggggggagaaaaaaaaaaaaaccccccccaaaaaaaattttataaaaaacaaaacaacccccccccccccgccggagaaaaaaatttttttttttttagaaaaaaaaaaaacccaccccccccccccctttttttttttcctaaattattttttttttttattaatgggggggggggggaaaaagaggggggggattttaacaaaaacacccccccctcctctcccccccccccccccccccccccccccccccccccccccgggggggggtggggggggggggggggccccccccccccccccccccccccccccccccctcccccccccccccccccccccccccccccccccccccggggggggggggggggggggggggggggggtttttataaataaaaaaaaaaaaaaaaaaaataatatatatttgtgtgtgggtgtgggggggggggggcgccccccccccccccccaccaccaaaaaaaaaaaaaaaaggtttgggggtgtggtggggggtgggggggggggagaaaaaaaaatttattaaacaacacaaaaactcccccccgccccccccccccccccccggcgggtggggggggggggggaaacaaaaaaaaaaaaaatattattatttttttttttttttttttttttttttttttcgcgggggggggagggggggggagggagaaaggagataattttttttttttttttttttattaaaaaaaaaaaaaagggggggggttttttttttttttttttttttttttttttttattaaaaaaaaaaaaaacaaacaccccccccccccacttctttttttaaaaaaaaaaaaaaaacatattttttttttttttttttttttttggggggggaaggtgtttttttttttttttttaaaggggggggggggggaaaaaaacaaaaaaaaccccaccccccccccccccgcgggggtggggttttttgtttttcctccccccccccccccccccccggcccgaaaaaaaaaaaaaataaaatatatttttctctcgccccccccccccccccccccgcgggggggggggggagaaaaaaaaattttttttttttttttttttaaaaaaaaaaaaaaatttttttttttttttttttgtgggggggggggggggggggggggccccccctccaaaaaaaaaaaaaccccctttttttttttttcgcccccccccgccgcgggggggttttttctccccccctttttttttatttttttcgagaaaaaaactccgccccccccccctttttttgggatatccccaagagtgtttttaaaaaaaaaaccccccccagagaggggggggttattttttcctccccttctaccccacttnngtttttttctaacgcaattcttctgcannnnnnnnncctttannttttatacagacgactggataaacaagatgnggtatannnntnnnnnngttttccttttcttttacttttttcttttncgtaatttaaaatgtcgaagacgccccccccaaacaanntatataaagancacaattctttacttttagaaccttcccccctcccgtcgggtatcaaatgcaaatgcaccaaattgaacgaactaatgatcatcagccaatgtgagcgaaggtgggaacgacgacgtcaacgacgagcgcaaaatgaatgacatggaagaaggttttttgtaaatttaaaaaataaataaataaagcaattttaattagataaaaatataattatggttattta

SEQ ID NO: 11981 - DNA, 3842 bp, Heterodera glycines
ttctcccgccgcttccgccccttccggttgctcttccgttcgttcctccggcaccgctcccgcgtccgctgcgacaggtgcttcctcaacctccgatttgggctcctcctccccggccggcttctcctcttcctccgccttctcggccggctcggcctccgatttctcctccggcacttcgtccacagtttcggccgccaccgctgacactttccgttccgcgtccgtcccatcctcgcccttgtcccagctggtcatgcgcttccatctgtcaataagtgatccgtcagcgggaaaggcagcagtgatcgattatcattccgagaaaagcgatcaatcaaccaaatcaaattcaggtttttcaattaacaaattgccgttcatttcactggcatttcctcttacctccctgaataatttgttggcatttccctcccctccgattggtttaacccgatcattcttcccgatcactttgtttcccattggcatgccattttcactaattcccactgatcaatgatcaattgtccgttcgttttcccacgccatttcctcctcccctcccttcaccgatcacctcgactcttcctcctccctttcacgcatccgtgcatcgaagctctcctgccgctgtttctcctcctcttctttcgctgcttctccctcatcttccacttcgactgcttttcttaaataattcatctctttttccacttcgtttccgatcactgatcagcttaaacttttgcgcttactttggcgatttcggtgactttggcgtccgtggcgtccgagggcttctcggcgattttgttctgatacttcttccacttctgccgcttttgactgacaacacttcgtcttcgaaagtgctgaacacaatgataaagacaggacaatagcagaaattttgttcatttgggcatcaatttgtccaaatcccaaaaaattgctcgattgaaaaaatcggtaaatgttagcaatggctcacgttttcttagtcgacgcggcacttttcggcgtcgttggcaccggcgaaactgccacaggtgaaactgaatgattgcgatgaaaaaatgatcaaatggatgacaaatggtcaaaaagtgtcggccatttgtccctctcaccgacactcggcgcctttctgctgcccgtaacactcgccacgtcttccggcacttcttccgcctgttctacctccacctccacttgctgtacttcgtccaattcgttcggcgtgcgcggccgtcccctgggcggtgcctaaaggtcgattaaaaatttaaaattaatgccgaaaagacagcacggattatattggcacaaattgactctgtgggataatttggcattcttcggctaaagcgccaagtaattgtgaacttttttactttattaagcctattttggacaaaatgactaaaagtgcgtccacctgcagttcaaacttttgctgttcgtcctccgttttcggctcgtcgccttccgtctcagcgggcgtttcctcgggcgcctccgtttccgactccgccggaagcgcctcctcatccaccgccggtggctccgcttcggccgcctcctccgcgggcggcgcttcttcttcagccgcttctccgcctccgacgttctccacgggcacttcaacggccccctcctcgtcttgcgcttccgctgcttccgcttctggttgttccgtctccgcttcttccgccttttccgcctcctccgcgggcggtgcctcggccgcctcttcgtcgtacacatcgaccgggatttcggccgctgcgctgtcttcttccttttcaggcgcctcattttcttcgccttccttctgttgctgctgaaaggggtaaaacatgcgcaatcaatagacagaacagcacagaacggcacaaaattgtgccgagggaattcgaattcaaattaaaaatgatggctatttctataattcattttgaaatatttattaaattgtcctccttcgccgcatgccataattttttacgcagcatgaatcatttttggttctattcaaattatagcacaaattacaaatgatgtcaattaaattttaattgaatggcagaaagtcacggcacttttttctttaattgtgcctaaatgagactccccccccccttcaaaaaaggacctcaatgtcgtcgatgccttccatcgatgtggtcattgggtcttcgtttgttatgtcgggcacctgtgatcagcaacagagaacaaattggaagcaaattgaaaaaaaggaaaaaatcaattttgacacaaaaaagaaacgggaaacaattgccaaaaataatgcgcagctcagaaaagagaacacttgtcaagatcaggacaaaataaacaaagcttttcgctgatcgaatccctcgagagcgaatcgtcgagaggaaaaacccttttgtgtcgctcttctctcactatgtcccactatctctctttgtgtgatcagtttctctctgcttctttgtcagagagaaccatccgatcactcttgttctctctctcactttctctctcatcctctccctcttcaggttgccttccctctctctctctcgctctctctctctcacacacactttactaagaatctgaacagagcaaagggtatcccacccggggataaagcaaaagaggaaaagccgagaagttgctattaattttgagagaaagggggggagggagagagaagggaatagagaaaacgagaaagggacagagagaaagaaacagagagataatcggagagaaataaattcgagtgaaatgggaggagttcaaaaaatacttgaatttatctaaaaaattttcccttaccaaatcttcagttttgtcctctgccgccgcttccttttcgacactttcattcgctgctgcttctgaatgaatcaatcattgtaattcagcgccctcttcttcccttctgtcactgatctttcctctgatcgcttttgtgtcccttgaagggctggccgtgattgaatttccaatcacggaaatccgtgagccgtgatcacggggctttaaaaaaaaatccgtgacccgtgatacgagatcacggccagccctggtcccttcccttttcccctcccaaaaattatcccagcagagctttgacatggggatgagtagctgatgaggggcacgaaaatggcctttttcgattttaggtacatttctgatttttgtttggtttctctaaagaagccccctcccccactgttgtacaaaggcaactcgtacatttgcttagattaggccttggttttaggcttcggcttaggcttaagctttaggctaggcttaggcttgcttgggcctaggcttaggcttaaggttaggctttattgtaaaatataagttgccttttgtacgagttgtttttttgtacgcgttggcttttgtacaagctgccatttgatcaccccccccccccccctctctcctcctctccctccaccttctccgcctccctctgcctcggcttcaccctcgtccagtttgatgcccttcttcaccagcgtggcctcctcttcctccgccccttcgcctgtgccgtcgtccatcttctgcacctccaattccacttctccctccgcgactccgttagtcagcgccatttgcgagggaataaacaaatgggaagaaagatgagccccaaaaaggaaaaatgatcagaagcagtggggagaggaaagtgatcggaaagacagacaatggcaaaatgagttgggaacaccgaacaatgggcggtgggggaggggggggggatggattagccttgtgatgggataaatgaagggggaggggggggg

SEQ ID NO: 11982 - DNA, 1359 bp, Heterodera glycines
  misc_feature (82)..(82): n is a, c, g, or t
tcatcactaattttcacttattgtcagaccccaattcttaccagtgcttgtttttccggttcccggttaccctaccgggacntgagattttcaaaacccgggacctcggatgaccgggaatttccggcccggtcccgcttcactctagccaaaacttaaataaaaaaatcaaaataaataaagtaaaacaataattagttaaatttggcatgcagattttttcggaatatacattctttaacttttcactaagttaccagttttatctcttgttttaagttttaactaatttttggcccattaaattgactaatgctttggaaaaaccaatcattttttaggtggttttacttgtaaagcgcaatttgctcaccatgatttcgtcgttattaagtgccatttctctcatttatgccttccttccctttcactaaacatttcaggaaaaaaagttaaacgtcatgaagtaaattcagtttttctctattaacagagataaataaatagtacgccaaaatgagagatgtttttttctctgcactctctatttattggcacacatctcgttttttgaaacggtgtgttcactcgagagtcagtcagttgatcgatcactgttgaagggagttcatgttgctgcaccggaatgaagcgatcgccatgtcataccgccgcttttaactttcattgacccgggcgaatttggagtcgggattagggaggctgaaggtccagggcccggttccagttaaaaataaaattaattcattatattggactttattattttgaattggcccagaggggattactcgcaaggtgatctcgattgcttgctaaatccaaaatttttgcggtccaaataaaagcaaatgttggcacaatgaatggatgaattccgtatgttttgtttttattttgagaaaatacatggaataaaaagcaaaatatgtaaacctccaataaatcctgaattcgagaacaaaaaaacaacaacacagaatgatctttttgagaataaatcaaaaaaaaagtcaatcgaataaaaaaacacaaaaataatttgcaaaaattgaaaatttggcccgtcttctgcttttgttcgttcgttggttcgaatgtccattgtcccaccgcccgtttgtccgttcattttttgtgccatcaccgacttttgtcgattttcgttaaatttgtcttttgctcagagaaggcggcgttgtcggggggcagcaattgatgaacggcggtgagctcatcggccgcgacttggctttcagagatgaaaaaggcggagaaagcgaacagcaaaaagacgacaccgccgatgaaagtcactgaaattgggaaaagggtaaa

SEQ ID NO: 11983 - DNA, 2140 bp, Heterodera glycines
tttccatccatgttggggatgaggaaatatataaaaagataaactttgtataagtatttattatcatggaagtcgtcagaataatatcaaaagacttcgtataaacaatattgcaataatttaagttcgttttatttttcagtcaacaacacggccgagagaaattttgatacatcaaagacaacctaaaatacacagcggtgagagccctagcgaaggctggactataaaattgcacaacaaatatacctactgtacgagttatgttttatacgagtcagatatgagtttttcctatggcaaggttgtgaaattcctcccaaaaagtttcttacggaaaataagcagcaaattttaataaaaataaatacttttcaattcatgcaatgaatttcctgaatctataaattgatccactagaaaagtgttagtagaaaataaaaaataattggagcccatattttcgtcataaattgagtcccgaaagttaaatagcatggcaaaacttataaatatttgtcgatttattgcctattttccatccatgtttgggatgaggaaatatataaaaagataaactttgtataagtatttattatcatggaagtcgtcagaataatatcaaaagacttcgtataaacaatattgcaataatttaagttcgttttatttttcagtcaacaacacggccgagagaaattttgatacatcaaagacaacctaaaatacaccgcggtgagagccctagcgaaggctggactataaaattgcacaacaaatatacctactgttcgagttatgttttatacgagtcagatatgagtttttcctatggcaaggttgtgaaattcctcccaaaactttcttacggaaaataagcagcaaattttaataaaaataaatacttttcaattcatgcaatgaatttcctgaatctataaattgatccactagaaaagtgttagtagaaaataaaaaataattggagcccatattttcgtcataaattgagtcccgaaagataaatagcatggcaaaacttgaaaatatttgtcgatttattgcctattttccatccatgtttgggatgaggaaatatataaaaagataaactttgtataagtatttattatcatggaagtcgtcagaataatatcaaaagacttcgtataaacaatattgcaataatttaagttcgttttatttttcagtcaacaacacggccgagagaaattttgatacatcaaagacaacctaaaatacaccgcggtgagagccctagcgaaggctggactataaaattgcacaacaaatatacctactgttcgagttatgttttatacgagtcagatatgagtttttcctatggcaaggttgtgaaattcctcccaaaaactttcttacggaaaataagcagcaaattttaataaaaataaatacttttcaattcatgcaatgaatttcctgaatctataaattgatccactagaaaagcgttagtagaaaataaaaaataattggagcccatattttcgtcataaattgagtcccgaaagataaatagcatggcaaaaattgaaaatatttgtcgatttattgcctattttccatccatgtttggaataaggaaatatataaaaagataaactttgtataagtatttattatcatggaagtcgtcagaataatagcaaaagacttcgtataaacaatattgcaataatttaagttcgttttatttttcagtcaacaacacggccgagagaaattttgatacatcaaagacaacctaaaatacaccgcggtgagagccctagcgaaggctggacaataaaattgcacaacaaatatacctactgttcgagttatgttttatacgagtcagatatgagtttttcctatggcaaggttgtgaaattcctcccaaaaactttcttacggaaaataagcagcaaattttaataaaaataaatacttttcaattcatgcaaagaatttcctgaatctataaattgatccactaggaaagcgtcagtcgaaaataaaaaataattggagcccatattttcgtcataaattgattcccgaaagtaaatagcatggcaaaacttttaaatatttgtcgatttattgcctattt

SEQ ID NO: 11984 - DNA, 2312 bp, Heterodera glycines
  misc_feature (20)..(20): n is a, c, g, or t
ttaatcctaacccatacacnttcttgccaaaagattcacactatcattaaatgtttaccaaatttattcaaaacacaatcagaaatcggtagaaacaatagtgatttttcgaaagatattaacaaattgcatagattttagaccaaaagttattggatttagatttgcgacgagaataatccagatacttgagtaaatggtaaaatgaaattggaaaaatagcaaataatgaagttgtttcccgtaagcctttcactttcgctccatttgctccgatttgcccccactgctgctgctgctcccacgcatgaaccgtttggatggaatgtgtccattcagcgacggacgcgaactgtgggcgtatttccaacaattgttgcagtaataggccaggcaaatcatttccgcacagaaacgcgtcccgcttgtacagccgcacttctcacatggcatgttgctggccaggaatggcttaaattccacctggaggggtaaattatttttgaatatgtttccatcaaaaattgttcattacaaagacctttcgttcgaatgtcccaaaactgagcacaacatcatgcgctgcaatcgcccgtacgtaggtctccttagagtcgaaaacgacgcaagccgcacccttagggtagtaatggagccggtcaagctcgatggcacaatatgcaacaggaccttggttttaatttcggtaacgttccaattacgaatactcaccgattgcttcttggatgccatacgcaagcatcgctaaaatgagttaattcgatgaacaaacaattagcacacaaatgtgacattaaccaccaaccagcagtgcatgtacgcggaatgcctccaacaaatacggagtaacgccggaattttcgccatccgacgatgccaacgtgtgtcgtgtccttcatctcccacactttcacttccaccttaaacgataataaagagatggaaagtgaggaatgaaccggatgctgcgtctgctcaggcccaagcatgtagacgtagaaaaagagacgaccgttggagacgaaggagagacggagcattcggaagacggactcctcctcttcaaacaccacaaaagcataacctaagcaatcccaatatgtatctggtaaccgttgctttgtcatttaccattcggagggcgatcttgctgcgccgtcttcttcggccagtcgatgatactcttcccgaatcgggcaaagttcaattccaaaacatctaaagccgaccaatttgttaatataagaaatgctctgcaaatccccacttactcgtcgtcatattagcaggaataccacccaaaaagactttcaacgagaagttcagcggctgcggttttcttatgcgcgtcgtcccggaattgctcgagaaagattctgaaaaattttatcaattttcattcgagatactaacccgtcgtaaagtcatggccaaaaaagtattggtggttgcgttcgcgagttgcgccagtgttatcgatgttcgaactgatgcccataggaggggcagagagaggagccgcggggacaattgtcgaacgcagcccaaagtcatcggagttcgtactgatgcccacgggaggggcagagagaggagccgcggggagaattgtcgaacgcagcccaaaagcatcggagttagaagccatgcccataggaggggcagaaagagaagcggcagagctgaatgccgaacacagatcggacaatgaatagacagtgttggggaccaacggctgtggtgccaaggcaccagcatttccagaactacgcagaaactgaacgtcttcgttagtgtttatgtgttcaaaaatgtcgaaaagatccatttctatttagtaaattcgctaaaaaaatataattaataatgaatagtcatatttattagagttcgatttggacatgggctcaggctgaaccccaattaataatttgcatagtgtgttagtttaacacaccgtttcagtttttgcctcccagttccaaaaagatttgaatttttgtctcagtggtctatgtgttagtcaccaaaaaacaattcgagtccgttgtgcaacattaatattttttattttttttgtgcataaaattaaaaaatgacgacttttgggaattatttttggagggttttcacaaccaaattgtacaatcggctctagtgcactttatgagtccaatcgacttttatgagtacaatcaattgaaaatactcggtttttatacaataactttgttcatgttcgagctaaacctatctttttggtatcattcgaaagtacaaagtctaacgaa

SEQ ID NO: 11985 - DNA, 3043 bp, Heterodera glycines
ttcataatttagttcaaagttaatacataaatcaacaccatcgatagtattaccggccggtatcgcccacccctgggcgacgaccttttagatagaaccggcgcaatttgttaacagattttgtgcaaaaataatcgaattttgtgatgttgaccaatttttaagatcttaagaagttttatggtctgggcgacagcgataggttacgcagtggaaaaaaatcaaatttgttacaaaaattgctaatttcaaaatgaaaaaacaaaaaaataaaactttagcataaaatgtttaaaaactcaaatttttttaaatttgcaaaattaatttattaaattttattagcacaaatatgttaatgcttaaatcgccggcatggcgtccggcacagctgcttagagaaaagacactgcttgtgtggaaaatttccgtgagccaatgaacgtgagaacgaagaaaaaagcagagagagagagagagaaagaaagaaaataagaatgaaaagaaaattagtatttttggcgtatcttttaagtactgtactttcaaaatcattacagcatcttatttgttagtctaggtcattttcctaaaaactgacaatttcaatttttcttgaaatttttgtttgaatgagtaaaattttgaaaaatttctgtatgaatgaaatttcttgaaatgttctttctttataattaagattctcgaaatgttccaggtagttgcgttttttgacaattttggtgcccaaaaacgtcccaccctcattattacattgtgacttttttgtactattgaataatttaggtaatcgataaataaataaataaaccattgccccatattttttctttcaggtattggaacgcgacatgaatccgcggctcgatggcatgtgtattagtgcatctcgttcagatgccagtgatttcctcccatcatatttttttaaacatatttttgtaaaatgcgatgattccaaatttgttgtttacaaaaaggcatggaatgtatcaattgtgaaacgtcagctagggttttgcccacacttcctcgtcacattcgtttctccttcaagtttcggatgttgatgcggcattggacgttggcgcggcactttgcaacggttttgcaccgcctgatggagagtgtctcggcgagttcgccgcgaaaaaattctgcacttgctcttcattcaactcagttgatgctccaaactttttcgcaagatcctcaattacatcctaaacagtttctcttttttggttaaaaatgtaaatgacataactttttgctctattacgattctctccgttcgttttttgcattcttggagcaacgcccttttggctttttcatattcagccaacaattttggtccatgataacctgactaattaaataattgaggaaatgcgataaaaaaactcgatcaccgtaatgttccatttcggtaggcctggcaacataccattctctacaattttctccatctccttaaaaagaaaaattctcaacctgaatactattattttttacttcgcttattcggttaatgtctgtctcagacccagtgttgttgcttttaagtaattgttcctcagctattttaccactcatgtgaatacaaatccgcttcattaaatcctcaagcgtctcgattttattcaaggtggtggttctgtgccaatccacctgaacttttttttattgaaattaaaagacaaaatattagatcaccactccgccttgcgccgtaaaacgcataccagttactgcccatccaagcgcgtgacaaacggtggcttgcgccgcctcgtgtaaaactgaaaaaacttacaaaatcaaatggaggatcatcaaaataatacaaattaattttttttagataactaaatttcacgtattatttcgatgtctttcgctgtcctggctggccaatgagctggcaacgacggtgatgacatttataaaaaattcaaatgtaaaaacaattcaatgctaaaaagggggattgaggtcggggacggacggtaagagcctgcagatttgaattttggcactcaaaccaggcattagtaagcagattttccacacgattcgagaatcttatctaagaaatttgttgtattttggcaggagatatttgtatgtgtatacacggcgagtcaattttgggctccaagtacaaataagtttattatttacggactgggtcagtttagtctggccggtttagtctggccgttttagtctggccggtttagtcagagggtcggtttagtctggcctgtttagtcagagggtcgttttagtctggcaagccgttttcgcccataattcttacaaatgttttttgtcaattataaataaggaaaaacttaaaatatctatgtttagctacaatataaatgaatatcccaattagaaaataaaaagaaagcgaaaccttcagtttggcaccgcctttttatagcttcaggcaaagtaaaccctaatttttttttcattcaacgggcttttgcttgtttatatccaactgttttccgcttcatcaacacaattcgatatgagaaaagtcaattgatgcagacatcgcacgatgcctcgctggtgaagtccctcctcaaaaaacgcgaaaatatcgtgccgttgatacgaattcttcgactcttacagggttacaataccatcaacaacattaaccctgctcaccaaaatgatcaaaattaccatgccaatgttaatcccgataatatcattaattttctcgttggtatttctcgaaattatgaaatatgcccgtattcatttttcaatgttttgttattttttcgttggtaatgcattgataaatctgttatggtgttaattttaaagaattttcgggaaacaaatcagaattggatcaatgtaggacaaaaacagcttgccagactaaaacgaccctctgactaaaccggccagactaaaccgaccctctgactaaaccggccagactaaaacggccagactaaaacggccagactaaactggccagact

SEQ ID NO: 11986 - DNA, 1828 bp, Heterodera glycines
  misc_feature (1533)..(1533): n is a, c, g, or t
  misc_feature (1798)..(1798): n is a, c, g, or t
  misc_feature (1803)..(1803): n is a, c, g, or t
  misc_feature (1821)..(1821): n is a, c, g, or t
atccaaattgtgctatcgttcaattcttttactgaacgatttgcgcgtgtcggcagagaaaaacacactcattccggccgactcccaaatattggtcgatgcttcaatcgaatcatccccaaacccaaaaaattcattttgcattgatcgccctgacataagtcttattaagaagggactgtcagtcattaatagtgtctcgcctgcgggccagaaacaaataaaagtggcagtggtcaacccaaccatggaaccaaaatggatttggaaaggaacacatttggcatttgccaatgaattgttatgtgaccgaaatggacttttgaaggaaaatagcacaaaagaaattcttacgttaaattctgaacgaaagaaaatggaaattgacccaacgtttgtagttgacttttctaaggcaatggtcaaagacaaagatttggaaaagctgaaggcattaatcgaagaattttcagatgtttttagcaaattcaggtacgatcttggacttttcacagccgctgagcatcacatcacaaccacaactgaggaaccaataacatctgcgccaagacgaatgccgtacaaatacaaagaggaattgaagaagcacattaatcagcttttagaagcaggagtcatggttgagtctgacaccccatgggtaactccaattgtcattgtacagaagaaggacggtggaattcgtccttgtttagactttcgcaaactcaacgaagttacggtgcccgacaagtaccctctcccacgccttgatagcatcatggaaagggttggaaattgccaattttacagctctcttgacttggccagtggctattttcaaattaaattgagtgaagaaacgtcaagaaaatgtggaattataactgaagacaaagtgtaccaaatgattacgatgccatttgggctgaaaaatgcaactgcagcattttcaagggccatggctatcgttttgtctggattggaggatacttcattggcctacgttgatgatgtgcttattttcacgaaaagcccaaacttttcagaacacctgacggcggtaaggaaagttttggagcgttttcggctttataatctgaaacttagcccgatttggcgtttcgcatttcgctttttggcgcgaaaagcgacttttgcacccctaagaattggattaaattcccataaaatttttcaaaatttttttgcgacaaaattattgggatgccaatgtttgtcatgagaatctccaaatcattggccacaaaagtctcattgtccattataagagaaatttttctgctggtattttttcataatttactttactaattcttcctaaaaaggctgttgttcgtctgtttttgctaaacatccgattttgctggacaataattcggctgacaatttttactacgaaatttcaattggaaataagaaatggtaagagaattatttatttttgaatataaaattaatcataaatattaaaattttatttatttgttattgttatttctttattattanaattttcagttgggtcatcagcatcggattcgtactcaaaaaacagaaagaattgaaaggaagaatgggaaatggcgcttttgcgtatgtaagcaatggcgaactttggataaacggcgaagggaaaggaacaaatgccgaacattgctacggtgttggcgataccgtaggaattggcgttacttctgccactcggcagatcattatcaccaaaaatgggctttcgttttgggttggaaaataaatatataaattaaactaattncttanatactctaattgcctatntttattt

SEQ ID NO: 11987 - DNA, 2436 bp, Heterodera glycines
  misc_feature (50)..(50): n is a, c, g, or t
  misc_feature (108)..(108): n is a, c, g, or t
ctaaaattttgatcactcccatccaccctggaggggtgatctgctcacangatggggaggaggggggtccggcgatgacaacaggcgctaccggggaaaatatttggnggaaatttaattaaatttcaataagttataaaaattcagaaaatttactcttttttaattcatccaatttattattccgtatgtaaaagcaatgtgaagaggaagaaagtaagaacaaaacgaatgtttcttctcctccgtcccctcaaatttgctttatctcaccaaaatacaatatttttgtactttgcttttcatttttttcaataaatttgaatttattaacggtggcttactgtatgtttctgtgtgtactattttgaaaatgcttcgccgagttctcatatctcaataaaactaaattattaattatttttaattgagtatttcacaaaaaattgttattgctcaatgttccgaaaacctgtgtttaaaaatctagtaaataaacagaattaaaaaaaaaaaaaaaatttagtgattgaatttttatgttttcaaatctattcttcattaattcgtcttggatttcgattatgttagaaaattgctagagcagacccaactcccctgggaatactaaaattttaatcactcccgatcaccctggaggggtggtttgattgatcactgtggtgcaattgactttttaatcagcatcgaaagttgtactagtatgaattgtgcaaattttatgaagtgcacaaaaaaaatatgtcctaaaaaatcagtacttataattttaaaacagcaaattaggccaattttttgggcaaaatttcattatttttttcaaaactttccaatttgtctgaaatcccgtaagccttttaaatattttttatatgagatttccgccaaaaaatcctttagtctttttttgggggggggggggctttccgcgcacgtttgggctgcgcggggtgccggacaaaccgttcttcccctaccatcacatccacgcgcgcaacctggatgttgagctgccggccggcacgctgccaccacctgctgcctacgacccggacaggatgcgccccgagcaacgcgagcggttcatggagtggtacgcgcacgagctgcgccggcccgggcgccagccctttttgctccgccgcgagctgctccgctactgttggaatggtaggggcgggggggggggggggggggtgagcacaacaaacacatacggctatacccatttatgcatttagatgtgaaaattttgcgcaccgcctgcctgcgcttccgcgagctggtgggggagtgtgcggacggcatggaaccctttctggccgcaacaacaattgccagcctggccatggctgtgttccgccagcaccacctccgccccaacacgatggtgcacacgccggagggcggattcctgcgcggacgccgagcatcggtggagtctcggcgcttcttcacgctgctggccgccgtacggcccgacctgggcccgcttcgcactgcccgctggtccatcggcgaagctgttgtgggggacagcgggcgctcctaccaccgccgccgccgcgacaacaacagcaccaacagctgtgccggcgccgacgatgacggattccggctcgactgcgtggcctaccgtcatccaccactgcgaccgttgtgcatcgagttcaacggctgctacatgcacggtgggacacctacacacacacacacttacaataatgttttaatttctgagctcaattaaggttgtcgggagtgctaccccgaccggcacatgctgttggcggggggacgcagcgcggagttgctgtgggcgcgcacccagcaacgggcctgggagctcgccgagctgcacgggatggaggtgctgtcggtgtgggagtgccagttccggcgcactctgcgcaccaacacccgcctccgaaagctgtacaaggagaggtgcgtggatgtgccgggcccgctcgacttgcgcaagcatgctctgtttggcggccgtgtggagcccttttggctgttgcacaaatgcgctcccgacgaagagattgtgtacattgacattgtatgtttttttgaatgacattattttcatctgaatttatcaaaatgtttgtctctccaaggtgtctctgtacccgtactgcatgaaggcgcgccccttccccatcggcatacacgtgtggaccggagagcagctgtggcaggcgggcgcccatgcgtttgaaggtatttgtagctgctgctgctgctgctgctttggtccatattggaaaacagcattttcagcttctgctccacctccagcagggctttgtcctcctactgctctgccatggcgccgcccggaggacaacccgttccgcggcttactgttctgccgcgtgctgccgccgacagcggaggagctgg

SEQ ID NO: 11988 - DNA, 3030 bp, Heterodera glycines
aatacgaaaaaacctggattttcctgtacaaaattttagaatttattatttcaagtgatcgatgttttttcaatttttcaaaaatgatcaaattatttaaatagacataattattgtaaattagatattttaagatgttcctaagcaataattgattttttaaacctttgtttgattttaaaagaagttccaaaaattaatatattttaaaaaatattaaacggtcaaaatcatcgtataaaacttaaaataaacattttattttttcaagtatttatttatattaagtccgtgtaattattccataaaaacacaaattttcagaatacgtcaatataaaatggaatttgtattatttttaaacaaaaaccttaaaaattaaatattttattttcatttgagtaaaggaatgctatcgagcaacattattaaaagttgccctttgacttaaaagaaaaatttttttattgagtgatcaccatttgactatactggtacataactcggacttattggtcctagttatttgttttaaattttaaattctaatgaagaaaaattctaatgttggctcttttttatttgactaaaaattgtttatattaaaaaaaaatatattttattctattcatttaatgaaatcaaatagatgtgataattatcatcaatacatattatttggaaaattctcatttttattgctcaaattttctttgtttttaaattaaatacattttatttattccagcagctaaaattgtgtttatattagagctgatgtggctgtcaagtaatatttattttttcatttaaattaatatgaaaagacaattttattatttcttttttttacaaaactattgttattttctttcatttttcatataatctttttatatatatatctagtgaaaagatattttttctatatattgaaatgacatttttttaaataaagccaaaattatataacatttatttcaatgcccttttaatgaaaatttcaaaactaattagctaattctttttgcctgcaattatttttattttatttagatataattttcacttcagcagctatttaccatttcttatcatgatggtatatttttttattttgaactccttgatacgatattcgggtactcttcgttttgttctaagccatatttaaagtttgattacaaaatatttataatttattaaaattttaaagttattaattaaattaagagaggtttttgtttgactcggtgtgaaaaacttaagctgagagcttacatcatcgcccaattgtatgtcgtcctccatatgctcttcaatcttgtccagcataagttccggacattcaagcaccgattcggcatctctaagctccgactgaatttgctccccaaattccccaaggacacacggcggctaaataattataaaaagttttgaagtaatttttgtcatgcttatacagaaaaaaaattgctaccactataaaaaacaattacaatgttgtcctcgccaatgtatgcaatgccggggcccagccccgcgtccaccaaacatccatcccacttaactaggtagaagaaatagtcgaatttgcaaagttgataaataatcaatggataaaatagttgttaaatattagttactttccaggattttttggataatcccgtcctacttatccccataaaattcctcatatagtattgtgttggtattttttaaattatttatccactcaagcaagtgatttccgcgacagctggtagatttacgattttgtttggcgatttttttttgtatgttcgatttggggacagattttttggaaggagttttaaagggggcgatttgcggtcgttttgatttcgcaacggactagaaaaacatgaaattaaattaaaagcaaaaagcgcagtgtaggtatatatttttaaagaaattaatttcctaatggcgtattttcagaaaattttaggccgatttttaaggggtgtatcttaagaagattgggcagaaaaggcaaaatatttactaacattgacaaaactttaaaaacttaaaaaatttaatcgattactcagacctatcattaactcaaaacattcatcaagaaaatttaaagtatacaaatctatatttttctaatctatttaacagtctcgcgggcagccggcgccaattgaggcgcctagccttaatgtgcgccaatcaaggcgcacaaggctatataactggccgcgagattttgatatagaaattgccataaccatttattaacttaattaaaaatattaatcacatgcagtcggcgccaacgaaggcctctagccttagcgcgcgccaattgaggcgcgcaaggctatataaactgcctgcgaaattttggaggctaataaatggttatggtaattaaaattttaaaaaacaataaaaaagtgaatatgttgagtcatagatttttaaaaaagtaaaataatagggaaaaggaaactcaaattttaagaaaaaacatttttttcagataacatagcgaataggtaggcaatcaccaaaaaggcaaaaaaaaaatggggaatatgagtttaattgggttcgtaaaatatggacaaaaattgcgagatggcatgaaatttccgttaataaaaattaaattatcgaccttctagtgattttaatttatttaaaaaatgattttaaataaggattattttataaaaactgaaaacgaatggtttttaggaatacataaggaaaaaatatatgtatagagtaatgatgcaattgacagaagcatcccttggttgcgcagtggggttgtgagtgtgaagcaaaagtgaacagcagaaaaaagacggaacgattggcggtgattgtcaaattggagggagggggggggggggggttggctgtcaattactgcgcgattcgtttggaagggacagagacgtgcagtaattgaacagagagagcattgattggtaaattcccgcgaaggaaataaacatttttttggttgtaaggaat

SEQ ID NO: 11989 - DNA, 1430 bp, Heterodera glycines
ttgcactataaaaaacaaaataaatttaattaaaataatcaactaaaatcattagtaacaaattcacaaaggagcaataaaaaaattgattcaataaagaagtgttaaaaaataccataaaacacgtaaaaaatatatattcataaagtcttaatggctgcctgcaaatatatgatagattatagtatatatgtaaatttgaactcatacaaatactttaacaaaatttataatatattataatacgaaaattggcaattaaaatgttttaagaatccactgaaaatcgacgacacatctacacgaaaactagtgatatttttttgaatcaaagctgtatgaattaaattaattttttttgaatcataaataaatttagtcttaaatcaaccgaatatcgaaaatacacatattaaatgataaaaaaaaattatataatcaaaaagaaaaatattactttaaatatgattgcaaaaacttttgcattcaatgctaaagtatttgaaacttttataaataaaaatcaaaacatgctgagtgaagcataatagtatttcatttgcacttaatattaaagccacattgaatttatgtaaagaaaatgaatttcttatgtaatacaaaatgttcaataataatttatttatttatattgattatgtttaattgaaacatttaccaatttttaaaacgaagttttatattaaatacaataacttactaaagcaaattgaccgaaataaattttataaagggtgcaaaagccaataatataaaccgttaaatgacattagcaatatattaaaggttgaaaaaattttaaaaaatgcttaatactatataagtactaaaagtgataaaatattgtattattttcactatgcaaacagcaagactgattaaatcagtataagattattgcattttataataaaattaaaaaaagagatgtaccgttcaaaataagagattcataatagaaagtttatgaccaatctaaaaaagatgactgatgataattttaatctggaatttatatgcaagaactataagaaaaatgtttaattacacaaaaaattagaagaaaaaattaaaaacaaatattagttttcattaaagtgtagaaattaagtactgcgtaaaaataataattttaaatttaaaaggaaagttattacgatttctttgagatatatgtatgaataaaatataaacttaatcaatccgattattatttgagatagacaaaaaattctttaactaaataaaaatgaaaattaatttcattacatattcgcaacacataaattgaaaataaaaagattatatcatttaattcatatttattactaaatgtcagaacatgcatgaaaaaaaaattgaaaaatatgtgaaacgagagaatgaaacacttttttgttagaatgaaa

SEQ ID NO: 11990 - DNA, 3194 bp, Heterodera glycines
  misc_feature (81)..(81): n is a, c, g, or t
tgcttttcgatgaccaaggcagaatttacactgaggataggcagaaatgcatgctttttggtaaaatattcaaacaaaatnttatgcaaagaaattataccatgaattacgcaattaataacaaaatagatagcctaatagatatcgaattaaatgctgccttggtctggaaagcacttaggaagttaccaaacagaaactcgacatctccagacgggttaccttatatattgattaagcaatgcgcagatttattggcacctatcataagtgaactctttcgaataatcttagattatggggaaatcccaaacttatggcgtacatcttttatcattccaatttataaaaaggagacaaatcgaatccaaataattaccgtcccatctctctgacatgtactttatgtagggtttttgaacgactattagcatggaacattgttaaacatcttgagaaaaataaaattttaactgatgaacaatttgggttttaaatccaggtcgaccaccacacaattgttggtctccctggattatttttataaatcaatagaaaatggacaaaatattgatataatttttatagattttgaaaaagcatttgattcggtgccaataaatttgttaattgttaaacttcagaacataggtatctgtggaaaaattttgaagtttctccaaaattttcttatatgcaggtcatatcaagttaaaattggagaaaacttttccgaaagctttagaacttattcgggggttccacagggcagtgttcttgggcctcttcttttcttggtttttataaatgaccttactaattatataccagctgcagtcggaattaaattgtatgccgatgatgttaaactttacatttcgcatgataatgacacgaaaagggatttactctctttagcgttggctaacttagccaagtggtctaaagacaatggcatagccattgcgcatgagaaatgcgcagcattatatttaggaaaaaataattctagacatgagtataaaattggcgagaaagtaattttaagcgtagattgtgtccgtgatctgggggttttcgttgatcaaaagctctcatttaacaatcatatttcaaaaattttaaaggcggcctattacaaggcatatcaaattttaaaaatattaaaaacaaggaatatcaataccttaatcctagcatataaaagctatataaggcctcacctcgaatacgcaagcgaagtttggaatatctcctcaaaagaacagagtaaaagaatggaaacggttcaaaaatttttcacaagaatcgtatacaaaaaatgtggcctcaaggctgcatcatatgaaaaaagacttgagatttgcaaattggagaaattaagtaatcgaaggtcgctcactgatatgaatatgactttcaaaataattagaggcttaactcatttagacccaaaaaaatatttcgaattttcaacaagatcgcaacgaaaaacatttaggattcaaaataaaagattcagtaataaatctcggaataacttttttattcgtacaattaatccgtggaattgcttacccaaaacagctatggaaatcggaactttagctaaatttaaaaattttgtgaaagaattttattcagaaaataagtcctgagtggtaattcatccctttttattttttattttatgtatttttactgtattgaccatatcatatttttctaattgtattcattactttgttttccgctataagtgcaactatgttgccttgcggtttgttcaaataaataaaaaaaaattgccaataaatcaacaaaaagtttttgaatagactaatccctttagtgaagtttcaatagcaaatgcacattaaaaagaatggtaagggttaaaattggtgtagatagaatttgactagtcgagatctttgaaaatgcatgaaatttatggggaaacgaatgaagaacttaaatttacgaaaatattgggtgaaatttcagtagaaaattagtagatttgtcttttttctaaaattgaaaaatccactagtaagcttacttgcaaatcaatttgatgggttcatgatttgaaatttaaaattttcgtttccatataatttttttttggtcggagatggaatgcttttatctcttttttattttatttttttaaataatcgtctaattaatttattatttttgacaccgatttgaattgtataattaaaattaaatatttttcatgtttggcacatattttagccttttttgagttttagcacatattttggggatttttggcgcatatatatgtacagatttggcgttttttagcatccctgctaattagataatttttatggcattttgtgcctttttcaagaaaataaccattttaaaaatttatttacatatttttgtacatatttttggcagccctactaatatgaatgatgctttttggcaaaagatcagtccgcggaagagtgtgtccaagtgtggcacccgtgcgaccgactggtggaacgacattcagtgtgaccgtgccaacctcgccggcgttgtgtgccaaaagaatgccgtctaaagttttcagcagaaaaacagaagaaatcactaaaatgattatacacaaattttttgatcggctgaattttgagtttaaaatgaattcgccagaagaaagtgccgaacaaatgagtgaatgaaagactttggttttcttatttctaagtaatatgaaaaaaattggacaaaatcttccttattttagctttaaatatttattgtctgccattgtaatatttataaatttttctttaattaaaataaattttagaacaaaatttaagaatagtttatgggcacaaaattatgctctaaatccttttagttaattcaagaaactttcaaattaattgacggacaaataatcaaaatgaactccaaaatgatctcattgactcattttcattgtttgtgtgagccgggcaatccgggcatagaaatcacactgtccgtgccaggcacatttcgttgggagtgatctccttaatagatcgcataattaatgaattattgtctcttattagttttacccttgggggcgtcaaatggcactttggctatgccaatgccaaactcggcacatttcgagtcaatttcactgatttgctgatcggactggg

SEQ ID NO: 11991 - DNA, 1365 bp, Heterodera glycines
tcggcttcgtccgtgccatgttcgtcattgccgcctctgcttcttcccatgccagcaacaacagcgaatggcaggcattgagtgcccagtttggtcagcaaatcagtgaaattgactcgaaatgtgccgagtttggcattggcattgccaaagtgccatttgacggccccaagggtaaaaaaaaattagagaataattcattaattatgcgatctcttaaggtgatcactcctaacgaaatgtgcctggcacggacagtgtgatttctatgcccggattgaccggctcacacaaacaatgaaaatgagtcaatgagataattttggagttcattttgttatttgtccgtcaattagttgttggatttgtaatttagcaaaaataaataattattaaaccgcttaattggaatacattttgcatagacttatttaattgaaaatacgattattaaatcattggcatttatttgccggcattttctgcttgcaaattcatttatcgcccactctttccaacttcgttcgccaacgaattgaacataatttgttggctaagcccaacaaattaaattggaaaataaaatggctaatttcgaagaatggcattgttttgtcggcattatttgtaaagcaaaaggaaatgagtgggcgaaataatttttggcccaaattcaattgcaaaaacggaaatgcgtgggttttgcaaaggtataaaagggcaagaaattttaatatttcgacaattatgcaaataaaattattttgccattcctttgattttccgccgctaaattcaccaaatttccaaaatttaaaaatgcttttctccttcggcagtttctccagcgaagaagcggaggccatcgttgtcggagtgttccctccgctcagataatccgagaggaaattcaactcaaaatggaagtgtttgtgctgcttataacgaaagaagaagcggagagatggcaaagcaaagcaaagaaagacgaagaaaatgacgaactttcaaaagaatttgatttgttttccaaatgttttttttataaatttgattttttggtttgagttaaaaacaaatttatttctatgcattaaaattaattccgttatcagaaaatgtgcgagaattgttgggcaacaaagaagtaataaacaataaccacaactgtgtggcagcgtttgcattccgaggccccaaaaatttttgggaatcagattccaaggctcaaaaattttttggaaatcggaattccatgccgtccctgctgtgtggccattacattcgggttttgtttcgaaaattattatttatttttacttttcaatggtagcaagcgcgtcaggatcagtcagctggggacaa

SEQ ID NO: 11992 - DNA, 2166 bp, Heterodera glycines
ttaaaaagatcataaaatccacctaaaatattcaaaattagatcgaacatagcataaaatgaagtctcggcggtgccgataggcgttggcattaaatacttcttgaaatacaaacacttattcagaaaatttttcaagtttgtcgctttttactgaaaaatatttcatttcgggagcggtgggaattttccccttctggctacggacatacgtatgcaggggtaacagaacaaaatgacgctaggacaaaatgacgccgctagaaattaaaaaaaaatttcaaaataattttttcaaggaaaaatatgaaaatttcaaaaataattgatgattgaaaaattttcatgtatttaaatgtcgttaaatttttggatgctcataaaaaaaagatatgaaaaataaaattaaaaaataatttgttaattaagacatttttaatgataaatttttttaagcacgagtaattattttttgtatttcttattgaaaataacgatttaattgggtactcaattaataaataatttatttggcaattaccgcggttagcactccctgcttgagcaatggcacaaagttggacagcaaatccttggtgctgaccaaatttcgcaacactgcaatgccattcaaatacgcctcgtgggctcgccatgagccggtggaccctttcatcaaattgttgcaactgaccaaaatgcgatccaatttagcaaatatcaaatgctaaaaaggggaaaataattaataaaatggaaaaaatatttgaaagaaaagaatttcaattgtaataaatggcaaaaaatttaatttctctcaaaaataaaaattaaaaaaaaatttaatataaattttaaacgaaaagtattgcttaatatcgtaaaataaaatattaaaaaaatttaaaagccaaaattgagatatgattttaatgatttttaaattttaccgtccgcttttgtgttgcgctggcactgatttccgcgtataacattggcaaaatgcgatgcaaattggcagtcaattgttgcacaatgtccgcatttccactggacaaaaggtccacaaatgggcccaacaacaatggcacagatgccgaaattgacgaagagtttttggcattttttgttcccattggcgcaattttgcgttgtgcaacaatttcgtgaaagcctgaggcaattatgctgcgcacttcgtcgtccgagtcgcggcaaaactgctccaaaatgggcaacagtcgcccgctgaacacgtccgcctcctcgccaaacaccgcgacgaaacactgtaaaagtggtacggtataatagtataaatcttacaataattttatgacaggaataagaattagaagcagttcgtacaattaaaaaaaacttagcctaggaaatctaagtacggtagaatctgccaatttgtacgaaacaccaagctttaattaagcaactgcattgtttttaaccaaattaactgttttttaaattaacttctaaaatattatattatcaaaccggaaaattgtaggcacacattcttcggcatgccacgcacaattgctgaagtttttgttgttgcgcattgcccgcaactgctggcggtgtgccattttcaactgatgctgtaggaaagagtcggtataattcaattttttatttaaaaaatgggtgcgtcaatcgcccctcgcccccgaaaaaaaaatctcaaacaaaaattatcaaagaaaaaattcctagaaaataaattattttgggatttttaatgaatttgttaagaaaatttgatcatttaagaaattcgccggcgactcatccccccagaacttttacacccccctccccttcggtgcaaagggtcccccattttgaggccctttccgtgcgaaggggcggggggggggggcgtcgggtacaccccaaaacgtcgccgcaaacaaaagaaaattttttcaaaatttcaagaaaattcaaagtattttagcttttttgagtataaaactaaatttgctgaatttccaggaaaaatgaaaaactttaaaaaaaatttgttcgaaccgagctaggaactaaaggttacccgacatttgcggacgacgacatttgctgataaccgacatttgcggacgacgtttttaatcatcatccgcaaatgtcggttttaaaaatc

SEQ ID NO: 11993 - DNA, 4033 bp, Heterodera glycines
  misc_feature (3997)..(3997): n is a, c, g, or t
  misc_feature (4006)..(4006): n is a, c, g, or t
cccccccccccctaaatacgggcctgtttctacctttgctaaagtgtggaagacattgggccatggagctcagaatggcctcccgtacggatgggtcttcgtccttgaacagttggatgatgaaaggcaatggcaaagtgcaacaatcggtggaattgctaaaaatttgaaactaacaacggattggtcactgagaaatttattctgatacgaccgttaataaatttttaatatagtttttgcagcactgacttcaaaaatgctttgaattggaataattggttgtttaacgttagaaatttttttttgtcgtcacaaaaaaatttcaatagcctacggtagcccagccgaatttgaaaaaaatttactatgtaagaaaattgaaggaaatagttgtttttctgaaaattgagcttttaagtaacatctaggtctccaaaaaacttcaaaacgatttttttaaatattttcttgtttaaaaaacaaattttgcggcaacgctatgtcccgaaaaaattttgggtgcgggggggggggggtgtacggcggtgcggcaggcatcgcggagaaaaaaaattgaaattttgcgtgcaatatattacctaatagatttgtcaaaaagaaacagaatttaaattttatccggttttttttcataattttgctgcttttccccttagtcgccactccctttccttcccgcgaatttcttaaattcttttacattcaatttttaaatttaaattttttacggctaatattgattatgtattcgttagatgctctttccactaactcacatttcattggccaccagcagtatgaccatgtttccggaacccgcttgtgcaacggctaatggaaccacctaaaattaagattgtaataaattaggtataagcgaaaaattttatggcacaaagcttgagaatttctttggcattatgccttcggggacaaaatctcgccgcagaaatttcaaaaaaaagaaaaatttaaacttagaaatttttcaagaaaaaaaattcttagaaaatttttcataagagaattaaaaggagaaaaaatgtttgaacattttattataaattactggtttttttgaaaaattttcaaagaaaaacttaacaaataatttttttttgaaattgtaaagtggatttccgatcacttccccgtttggtctctggtctcttctccgctaaatccttttccgagatttcccgagcattttatcatttcatttcatcatttctccatcctttcccatttcgatcagttccatccttccccatttcgatccgtcatttgtattttccattcatttcacatttcacaagcaaaggtttaattacccaagtttgagatggaacaataaaggatttctggataatatttggactacagcgatcctgggaagggccccccacgtttcactggtagcaccggatggttccaaactcaaagtttggaacagctcataaggatgggtaagtttgaaccattgcgcaattttttttaaatttggtgaaatcccgttagggagtcagaaaagacggccgtctataaataaaaagagaaaatttgagaaggaatacctctaaaagagaagagacgtctataaataaaaagagaaaatttgagaaggaatacctctaaaaaaagagaagagacgtctataaacaaattagaagcgctagtgatcagggatgaaaagcccaagtgatcagaaaatgaaaagcccaagtgatcagaaaatgaaaagcacaagtgatcagaaaatgaaaagcacaagtgatcagaaattatgagccctacagatcacaaattaatgagacaaactgatcagaaattgaatgtaagggcgaaacgggctaaaatacagatgtatgtggcgaatattagtgccaaaaggaaaccgccagaacttacttacagtaagaaagaaatacagtaattttatggggactgaattaactaaacagagcagaaaaatttgaatttgggcgccctcagcggagaattagcatttttgctcataataacgatttaatctccacagctccaacagacgcgacattttgccccccccctttcccatttttccccattttctcctttgaattgtgttgatactgccctccctctgtttatgcagaatttgcaattggatgatgggcgttattcgttggccattgaacactcatcagagtgcaaagaaacaaatcttttcatttgttgacattaatattttttttcattttgttttcatctctaagaacaatttagtgaaggacaaatttatttacaaatttatttttgagtttcgaatcacttctccgagttcgaaaaggtattaatacttaattaatgatttaaataagtttatgtttggcgttaagttaaaatttatatagctattttttctcctcaaaaatcgccgaaatcgaccattaaatttgtctcttttctctatttttttaattgtttttgttcgttgtgcgctatttttatataaaagtttattttgccattttcctatgagatttaacaaatttataagcgctttgctggtggcgtagaagcattttcggcaactgtgaactttgcggtgctaaaccaaggccacctgccacctaacactaacaaatatgtgaacccccccaacaaacagccaaggggcggccgagacagggttcagtggtcgttactgtggacatgccaccattagaaatgaattacatataagtaaaataggttaaatggcaaaaataaaccaaaaaaaagaaataaaagcaattagacagacaacgaataaaataattataaaaatgaagaaaaacacagattttttttttttttttttggtcgttttcgagagtgagaaatagggcgtcggaaatttttttgttttcgtttttgtgtttgttttcgtatttggtttttttttctctcttcattatcggcagtaattatatggctgtaagtttttcgtaagtttggcattcgacaaaaaaaaacgaagggtcaaaatcgattcatttctaattgattcccattcccatctcagtgccgttgaccaacaaaaatagaggaaatgaggcgaaatgtggacaatgacagtggtgcaaacaatggcgcgaacatcagcagcaacccgaaaattgcccgggatgcggaaattgctcatgttgtggacactggaaatggcgcaaatgacgcgtttggcgacggaatggacattgggcactgcccaaactgctcgtggcattgtaatgtgtgcagtaagtgaatttttctgttttgcattcaatttcgttcaaacatttcttttaagtctgtcattaccgcctaatttatttaatttactatcaaaaaccacaaaacggtcaaatttttctctatttttcctgttatcaatttaatcaatgtttttgggctgatattccactaattaattcactttactaacatttttttcttctcctctattttttcgtcaaaaaaacattgccgccaaaagttcaattctctatcgaaactggcgggcggaagtttttccgcgatttgattttctggacccgtagaaaaagactgtaagggttaaccgaccgttacccgcattaatcaagattgagaataattagtgacttttggactacatatcaaaatccgtttctggggaaaggcgcgcctgtttcactaattccgtgttaattaatttgaaaataaatgcgagacaaaaggttttgaaaacagttagagatgagttaagcccattttgcaaatgtgacaatttaattgtataaaatcaagaatttagaacccagaaaatgcattttctgtccaaaattccgttgttaaatttgttgttaaatgtccagttttatagtcctttgaccacaccaaaaccgaaagcacagtacgacacaaaattcaaaattccttttttagttctgatgggcctcatttgtgtgatcatttgccagtagatcanaaggcatgngaatggaaacatggcacaggaaacgaa

SEQ ID NO: 11994 - DNA, 3661 bp, Heterodera glycines
  misc_feature (3493)..(3493): n is a, c, g, or t
  misc_feature (3572)..(3572): n is a, c, g, or t
cggcgatgtgacgagggaaataattgtgattgattctatgagagacggagacgaagaggcgaagtctaatcactaatcatcaaccaaagtgaggacgggaaagggggagacaacaaaagtgagggcgaaaggggccaaaaaacggaagagagaggacacgtgatttgtgatttgaggggagtgcacccatcccatcgcggaacgacgacgtctttcaatgggcaaatgtttaattgttgtgtctatttattatgtgattgcgatcacaataacgctgcgggcattcctttctccgtcacactccaattgttcaattattgtccaatttcctccccttttgctcacgtgtccctccctctttcgcccctctcaaaattttcaaattttattttattttctttaatttgattattttttttttgattgtctacgtgtttggtggatttatctggttttgatcatccgaattttttagtttccgccggccgtcgcccattttcactcatttccctcctcctcttttgcgggttgtcctcctctttctcccttttctgctcctttttctcttttttctgttcctctttcccttctcccccctttttctgctgctgctctctccgtttcagttcatctctcatccacattttgcctcgttttgtccgtgcctttggcgaatacgggtcgaatggttgccaatggtcgcatttgcgttgtccgagacttcaccgtcccatttccgatcagttcgactcgctttaaaactttgctctttctgttgctgatcacttttttcctctttgcggctgaatttgcctttgtttctctgcccttttgctctgtctctctgccactctctcgtttacctgcgttcatttgccattctctgcctcttttccgtctccaattgttcctgcagtgtttgcactgtcttcttcagtctctctcctctgtttttctcttcctccaactttctttccattaaatgcctttttaatttgaattttgccctttcttttctcactttgttcccatttgtcttttgtgcttttcgtctcccaatgcttctctttccgtttccaatgctttttctaattcccttttttcgctttccaatttttccattaaaatttcttcgggaatttttctgaaggaattcgcacggtcaaattgacaaagaagtgaagggtttcgttttcggatggccaattcgatgtctgaaatttgcaaaacggttttattgtaaaagggcaattaaaattaataattaatttgtgtaattttaaactgaattcaccggcaatccaaagctgtcgctgcaattggtcaaagtgcgcaaattcgaaaatgccaccgaaagttaccaaatgccacccgaacaatcccttctcatgaccctcctcactttcttcatttgtgtactgtatttattatgtacagtatgcattttttgttttccattttttacctttacaaatgcgtctctttgaaatttcactgtgattttctccgtcgatttgctcggattttcttgacattttttttggccaattgcctgaggccacaaatgcaattgtcctggcaccaaaacacacctcaacaagagcagcaaaaaagtccaaaattattctccttctgtcatttacccaccaaaatgtgtgccatttgccttttccccccaacggatgacaaaatgccgcaaaagttttccgctttttttgctgccattttaataatttgtcggtgggcggacttttcgaattttttggccatgaggcgatttgacgggtgaacaaaaagccctgttttgtgaacagcagctggtcaaattgaaaacaaacaataaagtacggcacctttctgatcagctgaagaacgtaacggccaaacaatcggtcgacgatcgattcgaactgacgccggaggggcaaaaacgcacaaatactccgaatgaacagacggaaggtgacgaagtcttcttcatcggcattttgaactgctccaactccgtctgctgattggtctccaattccgagctgagcatcctcttccgaatgaagcgaagggaaaggacgggacggaaaaatctgccaaaaatgggacacaaaaaaggacagacagaacggaaacgaagcgaacgaactctttggcattacatttggtctcggatttggcacatttggcatagaatgaattgggactgagtgcgacgaatgaaacggaggagacgagccccggggcaatgccaaaacagttggttgccagcaaagagaaggaaaacactgagagaagcataggaaaagcaatcgaattaaaaggctatcgaattgaaaaacaaatttaaggggttgagaaattaccgaaaaagtcgctgaaaatggacggaagagacgagcgaatcgacctcaatttcggtcggtgatgcttttggtgactcattcagcgaattttcatagcatttggcggccattctttcggccaaattcaaaagcgaatcaaaagactgatcaacaactcaaatcaaaagccaaagccaaccaaatcactgacccaaaaatgaggcgaattggcagctgatgacagctgctgctgttttgggttgggcacctccaaaatccaaaagaagaagcgatggcgaaaagtgaattaattaatcagtgtcaaaagaagcgatggcattaaaatggccatcgaattgagtaaattaaaatggcagtcaaagcattgctaaccgatgcgtttctcatttcaaaatataaactaattttcaaaaattgaaagtgcttttcctccgccgttggcttttcccatcagttttgtttaataggcggcggtgaatttgagggatttcctcccgtcgtcgtcgagactttcgtcccgcgctcgccccccccccccacacgcgcggggctatcggaagaagcgatctttgatttcccaaatgaatttaatgactcaaaaaatgaaaaatgaacttttatgggaaaattatacaattaatttaaaaaggaatattattaaatatatttttatttgttaaaatttgcacattttacgtgcgttttttccattaatgggaagggaaacaccgaagtaaataaacagcggcagaaatgtttggtaacaattaaataatcattcaatggatgcaaagaacaagaagaaagagaggaaaatgggccaattgatttgggaaaaagaaaaacccgaaaaatggggggggggagagaaatagtaaagaaaagtcattttgatcaaccaccagcttttatcgccttgcgctttgtattcaaacagtgcattgctttaccctcctactcctggtgatcagtcactctttttttgttctgatcagtcctccctctcccctcctcctcctcttctctcccctctttcctttctcattctgatcagttcctccttttgtgctttgatcactcccccctcccctctcttcctcttctcttcttccttttcttcacttttccttcttccnctgaatttctttctcacattttcttccataaaatattcaccaacctctacttcacccccctcatcttcatcatcatccncttttaaagggctaatccatcttcactttttctgccgtttctcccagtgagaatttcttctcttccgcgcccctttatccgctcctcca

SEQ ID NO: 11995 - DNA, 1187 bp, Heterodera glycines
tgttttgtgaacagcagctggtcaaattgaaaacaaacaataaagtacggcacctttctgatcagctgaagaacgtaacggccaaacaatcggtcgacgatcgattcgaactgacgccggaggggcaaaaacgcacaaatactccgaatgaacagacgaaaggtgacgaagtcttcttcatcggcattttgaactgctccaactccgtctgctgattggtctccaattccgagctgagcatcctcttccgaatgaagcgaagggaaaggacgggacggaaaaatctgccaaaaatgggacacaaaaaaggacagacagaacggaaacgaagcgaacgaactctttggcattacatttggtctcggatttggcacatttggcatagaatgaattgggactgagtgcgacgaatgaaacggaggagacgagccccggggcaatgccaaaacagttggttgccagcaaagagaaggaaaacactgagagaagcataggaaaagcaatcgaattaaaaggctatcgaattgaaaaacaaatttaaggggttgagaaattaccgaaaaagtcgctgaaaatggacggaagagacgagcgaatcgacctcaatttcggtcggcgatgcttttggtgactcattcagcgaattttcatagcatttggcggccattctttcggccaaattcaaaagcgaatcaaaagactgatcaacaactcaaatcaaaagccaaagccaaccaaatcactgacccaaaaatgaggcgaattggcagctgatgacagctgctgctgttttgggttgggcacctccaaaatccaaaagaagaagcgatggcgaaaagtcaattaattaatcagtgtcaaaagaagcgatggcattaaaatggccatcgaattgagtaaattaaaatggcagtcaaagcattgctaaccgatgcgtttttcatttcaaaatataaactaattttcaaaaattgaaagtgcttttcctccgccgttggcttttcccatcagttttgtttaataggcggcggtgaatttgagggatttcctcccgtcgtcgtcgagactttcgtcccgcgttcgccccccccccccccacccccacacgcgcggggctatcggaagaagcgatctttgatttcccaaaatgaatttaatgactcaaaaaatgaaaaatgaacttttat

SEQ ID NO: 11996 - DNA, 2807 bp, Heterodera glycines
ccccccccccctctcaatgggccccacaataacaacagtttttacacccctcccctataaaattgtctttgtctttggccccacttaaccataccactgctggaggaggaggagaaaaagtgccacaggggctgctggacaaaatcgggcagcctaaactcccttcccttccctccccccctcccgcccagtcaaagtgccaatgtcaacaatggcacacaatatgtgtgccccgtttaagagatgttgttattcatttgttgttgtacgtacattttacataaagcttccctgagcagaaacaatttacacccacctgttctaggacaaattgtaaaaaaacaaacaaaaaagcaaatccttaatccacaaggattatgcaaggtctctgcctcattttggcaatactttttattaaccttgaattgggcttttgctaaaacacccaaaaagggatgaggtccggattgggtttggatttgtatccgagaattattttcgaaatctaaatttaatatatcggatttaaaaagcaaaaattttcaccacccccccctttttatgtacctaaaatatatatttgtaaatgcttatttttttattttttaaataccaaaatgtctcgtctcactcgcggttatgtttttctaaagtcattttcggcacagtttcccaccacatcatgtttcgtaattttaatgtttctaagcagccctttttgtttctagcagacacgcaaatgctaatgtataaaaatttgtctgaaatggcaatttatttattttatttttttaataaatgccaaatttcccacccattcactcctcctcctcctctttttcctcctcctcctcccccaatggcatttgcggtacagtttccccacatttttgcttatgatttcatttcatgacagtagctggctggcctgctgcaaatatcgccttcttaattatacaaattgccaattttttttatatataaaattatatgcatacattttgtaaattaatttttctaaaatttctagaaaaatccaatacaaaaattagcttacctccccttccgctgtctgtccaacccctcatccgactacagtactcttttctctgtgaatgtccctggcaccctctgctgccacttcttctacagtcggcacatcattaaccccaccagcagcagcagcgcaaatgctgttttcgcccttccaattgatgcaacaaatttcggctgcatcatccgtcactgctcaacacatcgcttcgtcaatgtcgagcagttcgccaccaacggcagcaacaagcagtacaaaaacggaacaacaaacaacaaatacgatgacaatggaaacttgtgacaacaattacagcagtttgatgagcaacaacggaatgcagaaccaccaaccaattcatggtggggattttgggaagaaactggataatttatatgaaaaaactttataattagggggaactgttcagaaaatttggtgtttaattaggtgaacattcaactgactatggaaacattaacaaaaaaagggggggataaagccaaagttaattttgttaaaattacattctaatggatttttatcttttttgaatatgtaaaattaatttggcacaatctggcgacgccgtggaaatatcttaattttaattcttaaaaaactttattaatttttcaaatttatataaaatgcaattaccaaaaaattattgttgttaaccataataaaaatttggaatacaaattaaaaaaaaatttagctgctgaaaatccgttgcacactttgccactttcggcactgcttcagcactgtgagcagcaaaagcacttgacagacgcaattaacaaactgcaacaacagcagaaacagcagacacaaaaccaacaaaatggtcgaacgataacggcacaatgccaaagttcgccaaatccaaattcggcattcagcgcgccaaatggacaacaaaaatgttgcaacgaaactgctttgcaacatgacgaggaggagcaagacgaacaccacaatgacggtaaattttcaatacactttttccattttgaaaattttgtaaaaaaaatgaattttgacaattactaacgttttaaaaagaaaattaattttaaaataaaacaatttgatcctggacgagatcgggatcccgccgggattttcccgggattccgatcctcggctttttttgttgaaaaactagccgagatcaggatcccgaacacaaaatccgggcggcaaaaccgggatttgaataaccgattatttttttttcatatatttaattattattttttcatttgccactaatcttaatagatgaaaatgacgactcgacactgacttccgcatctgtgaatgggtccttctcgaccgagtccgcgagctgtgccgttgccgcggccgcgtcactttgctccaatgccaacacaacacaatcactggccgaagcggcgggccgcgcgagtgcgccaccgcttgacgatgagcacgtgaagcgaccgatgaagtgaatttaaaatatttaaaacaaaaacaaaaaattaagggttcaaattctgcgcgacaaaaaaaattttttgagttggacttggcccgtaaccagaacaaaattcggaggggcaattcgacagggggagggacaattgtgtctaatccaaacaaatattttgtgccataattttttttttcaaaattggccatttttaatagcgaaaatcacatttataggttaatgctagggttgagcggtaccggtaccggtaccggtactggccggtaa

SEQ ID NO: 11997 - DNA, 1570 bp, Heterodera glycines
attaccggtttttaccggtaccggtaccggtaccggttgaaaaagttggtaccggtaccggtaccggtttttgcagtaccggtcagtaccggtaccggtttttttgcaattaccgattaccgctcaactctagttaatgctaagcgattagaaaatttacaaaaaaaaagttatgccttgaaaacttgaaaatattaatattttgcgaaatttattggtgtttcatttttttagtggctgataaagctttcaaattgccatttctgtaaaattagggcgaatttgaaaaaaagttttccgaaaatttgacttataaattgacggattggtcctcttcggaaaactgaaaaaaaatttttttttttttgctattcgttaaattataaaattattaaaattttatgagtcataagaagtgaaaaaaagaacataatgtcatgatttatttgccttctttctacctttactatataaacaaaatgtttttttttttttttttgttaatatgggaattcattaaattaaacattacagtaatgtccttcttccattagccctacaatttactgtagctacaatgtcaaatatagcggcatgaattatttttgctagtgaacgttttgtgtaattttcagtgcctttatggtgtggtctcgtggaaagcgaaagcgcattgccacggagaatccaaaaatgcacaattcggccatttctcgtcagttgggccaagagtggaaattgctgagcgatgttgagaagcgaccgttcattgacgaggccaaacggctcagacagcttcacctgtacgaaaaatcattaataaattaattggcaaaataatttgttaattacttggtcaaaaaattacaggcaattaaatatattttaattaggggggcggggtcctcttccggtcccgatgtccccgatcttcgattcccttgttccccgacattgccatccccgccttttgtgtccatgacggctcggggaggaaccctaattaattgtttatgataaataaataataatgattcattcctaaataaatccaaattgctaattacatataattaatgaggcattcattggaatttgatttctctttttcagttaaattataatggaaaaataattttttttagcctccaacacccaaattacaaatatcgcccaaggcgcaaaaccaaacatcccattgctgttgacaacatttgccagccgcataataattgtgccaatttgacaacaaaaattggcactttcggaatggaaaaacaacaacaccaccaacaacactttccaccattgaaaatcccgaaaatgaatggtgaaatatgcaataaattcgagattgaaatgccttttaattttttgattatttacttaatatttaatagatgcttaataattattgattgatttttaattattttttaatattttcaagacccgttcccgacaatttcttcaatgcagtcctcccatgtgccgaatgctttcgcttcaatggcagctgctgctgcttttttgccccactcagcagcaaatccgctcgctttgctgagag

SEQ ID NO: 11998 - DNA, 2498 bp, Heterodera glycines
  misc_feature (9)..(9): n is a, c, g, or t
  misc_feature (32)..(32): n is a, c, g, or t
  misc_feature (1949)..(1949): n is a, c, g, or t
tgcgagagncagcaggaatggggattaacaantcggaatccttggattaggttcaatcggatgccaaacccaatgaactttgttttctgaccatgatatgatgacaatcagcgaagtaggcacataagtctggatgatatggtgaagcattgcccgttccactaaaaaaataagtaataattataattaattttaaaaattaccgtaaaacactgccgtctgacagctccaagttcctgaaaacccaattgtgaaaatttgcagaaaaatataagcaatatttaaaagttcaaacccgtcacataagacccattgcactcgccggtggtaattcggaccaattccatgtcttaaaaatgaattatgtcgcttgcagaaaattaaatggcacaaaaacaattaaatgattttttacccggcattttgatgcccatatttctgtcaattggcggatcaattcgtttggaccaccgcaagcgcagatggttttcgggataagcatctgaaaaagggggagggggggggggggaatttaattgaaaattatgttaaaaatacaaatttatttaaattaaataaaatttttaaaattattgaaattttttcaaatgatatttctaacagctcagaatacggagttcgcatgtttgggaatccaatgggtacttccacagatccatcatgcaaatggcaaccagcgaaatgcggcaatcgtaccaaatccttaaaaaacaaacaaattaaaatttaattaaatatttaaatattttgaaaagcattgattgactcccttttcaccttccatttgggtaaatccaaacaagaaagttgtcttctgttatttcttgaaatgaagcttgtctggcgttggcaaaataaatgtcggggtgccacaatttctgtcaaacaaaaactttctaaaaattttagggaacattttaaacaaccttaaaaacggctttatcccttatcagcaggggacctgatccgttgtgtttcaaccgttcgtctttccattccttcaattaatgaatttaaataataaattgattaatgataaattccttttttgtaacataattaaatatttaatgataattaattttgcttaatttaatcacctgataaaaataaacgtccaactgataatccattgtctgagcactgaaacttgaaatgccttcaatgaacattgacattgacacgttagtggcagtgcctttaaattttcaattaaaatttaaaaaaattcaaaataaaaattgaaaaaccgcacctaaatgttgggtgggagtcgcgtatttattgtaacgcctctcatcgtccaacagagaaataaattctaaaaaacaataattttatatattttagtttaatttaaattgtttttgttcaccttttgtcagtggcacaagtgttgtttctcgttttgttgttgtggtttttgccgtttttgttgtcatttcggctgtttgtgcagccaaagcattgaatgagagaagccaaagcgaaaattcaagcataatttgctatgaaaaataaaaaaaatatttatttggttttttgtttttattgggcattaaatcaaaaaaacgacgattaaaaaataataaaaaaaccaaaataggcaataaaaataaaattttattttggttcaatcgaaatcacattcaggaaatgctttttaagttaaattctttgttgagcattttcggtttttaattgaattttctgaaaaaaaaatttcagaaatcctaaaaatgtttgcatagaattggcaaagaaaggcattagtccaaaaaggatatccaaaccaatcttccaagaaaaaagaatgccaaaaatggaatccatgtgataacggatttcccccactcatcagaatgtcgcttaattgttagccttaacctgtgcttgtcgcccccccccacccaatttatccccccccnccccccacactttaatggcattttaccctcccaaaatgtgtcacttgcacatttcccacgtcccacgccaaaaagctaagtttttgacagattttcatccgaattctgaggcaaagaaacaaataaaattttggttttgttttatatttattttttgattaatttgagagcctcaaaagcgggacaaatcaccgcaaatgtgcgttcaaaatgcatttggcagagaattttttattgcttttgggggaattatcattaaaataaaaggtcgtcaagcaattagaagcgccaatttgtcacacatcttatttttgacgcatttggcctttttcattttgaaaaaatagttttttttttattaaatgtaatatgtaaaaatattagtcgacaaatgtctccaaattttggcgaaatttaatccaatcgaacttagttgccgtcatgtaaaaataattttactgaatgccatgagaaaattatgtaataattcccacgaattttgacggctttacaatacgaaaatattacgacagaaaataatttatggaa

SEQ ID NO: 11999 - DNA, 2208 bp, Heterodera glycines
aaaaccgaggcaagagaagaaaagaatatggaaatattaaattttgaggaaaaataagttcagttaaaaatttactttgacaagtggtcaataaataagaataataaattaaaaatggaaacgaacaacattaaaattaataaatatttaccaccattttttgaaaaatcaaataaaatatttgaaatttgaaaaatgataaaaattattattttgtttgtttaaaaaagcagaaaaacgggaaattcgggggtttaatccataaaacaccaaaaaagcaaaaaattgattaaattctgttcaacaaaaatccggggccataaaaatggaaaaatatgcacgaaaatccattcaaagcttcatctgtccccgccccttactcacaatatttaccactttttttacactttgcgcctgaggcaaattttgtgttccgtaaaaaatttttttttaaataatgcattttgttttaatggttaaataaaattttaaccaaattcggttattgtgaattaagctttttaaatgcttaaatataattaatgttttatttgttttaattgaaacaaaaaagtttgaaaaattattttttgttaattttttcatgtgaagatatgatgtttattcctcattactagggctgccaattttatgtaaatacatattttttcctggcttctccttgctctaaatagcaggaaaaacactttcttttttgtgtttgcgaacaaaaaccgggacttttatttacatatttttacatatttcgggattttcttacatattcatattttggatttttttcatatatattttcattttttttacatatttttgagtattttttacggaaatttttggaaatcctcaaaaaaaaatccaaaatttcggcaaatatttttgtacatattttcatttttttacatattttgaaaatttataaagaaaaaatagtttgaaatgttgcctaaaaataccaaaaaaagtaatttttatgtcattttgtggctatttcatattttacggggattttctttcccaaaaaataccataaaaaaaaatttatttacatatttggggtttttttgtacatattttgggatttttcttacatatttatgtacatatttggaccactttttatacatatttttggcagccctaacaatgacaaatttggcactttaaattcgtcacacatttttataaatttgtttgattgtccacaaaattttccgggcatttttgaattcatttttcattgagaatttgttctgtattcatttcccattttttacttttcaattttttcattttcatttttatttttattcttttttaaatattgaactaaaacttgcaatatatcaaaactaaaaatttcaaaaactccaaaaaatgtttatttgtaaataaaaaggacatttttcccgatttttagtgcttattttatgcatatttgggccttttacgggtttttaaaatatgcttttgcctatttgcgagaaaagcacgaaaaacgcattttgcgcttggtttggtgagtctacgtgtttacgatgactttttacaatgcctatttttgcctatattgaatttttaagaaaatttttcatttcttatgggtctatttttgaaagtttttgggtcgattcttaggaatatattttctgaaaatattttggtcgattcataggggtatatttttcggaaattttttggcccggttcttagggggtgcatttttttttgcatttttgttaataaattttggacaaaacgccaaaataaggcaaaaacttatttaaagggccaacatctaaaaaatggatttttaaggtgaacatccaaaataagtgtttctaaggtcgaatcagagcattaaaacgcaaaattctcgaacaaaataagtgtttttcgtgtatttctcgtccagttaaagctgcataaaaaataagtaaaaacttataaatcccgtccgtaggcgacatgtcgggggtcgggtcggggaatatgtcccaaaaaggtctcgggtcgggtcggggaggaaccctagtttaaactttctttttttataaatttcgtggtgccgatatgcttcgtcgacaattttttaaaaatcttttggtgcgatttgttaatggatttacaacctgaaaatggaaaggcatagaataaagagatagatagtttttaataaaaacctcc

SEQ ID NO: 12000 - DNA, 4656 bp, Heterodera glycines
  misc_feature (1259)..(1259): n is a, c, g, or t
tttctttttaaattgtttctgaaaacatattaaaatctttccaaaagtaaatctaaagcaacataaaaattgtagatacatggcgactataaaattcaaaagtgcagcagcagccttttcattccatggccaatacaatgacatcgaattcaattccattgaatcggagaaatgccaactgcgttttgtggacacaatagagacagtgagaattgtatatcgaaaataaaaacaaaacttttgtttgtaaaattattatgggcaaataaggcatcattcatgagcaggggtcggcctgggtgaccttcgtacgacgtacggtttgcctagggggtggggtcggtcaggcccgatttttattatggtccatttttcgctttacctccatcgacgatttttaaccaaaaattactccaaaaaatttaggtctcaaccaaaaatttacaaaatgacgcatttgcaggaagaagaagctgccaacattgggggccttttggcagaccaaatgcattctgagccaccgatttgttcggtttgtttggagcggatggaggaaaacaatgtgttcaccatcctttggtttggccattatctttcgtaattgatgacattagactttcagtaatcactcatttcatgcggaatgcattggccaatgggcagacaccacgtaaaaatcggcgaacaaaaacgaaaatttaaataattccttttaaaggtgtccaatttgtcgttatacacaaactccagaactggtcccggatcagaaatgtttcggtacgtacgaaccaaagcagaaaaaactgctcgaataatgacattgactgtttttatggcaccaaatgcatattttccgggacattttcatttgttttaaatggttccctttttgcacagattgcggtcgtaccactgacctttggatgtgtttgatttgtgggaatgtcggctgtgggcgttatgaggctgcccatgcccaccagtgagttgagtgttttctccacacattcttaggcatttccccacaaatgtttttcggcattacgaaaagacatcgcacatttttacgctccaagtgggcagcaaattggtgtgggactacccccggtgacaattacgttcattcgctgattgaaagtgcaacggaccgcaaaatgatcgaatacgacggggggcggagcggggggcgcgacggaggtgaaaaagggggggaaaattcggggggattgggaaaggggggatcagaaggacgaggaganaatcagtgccatccaattggagtacacgtgtttgctgaccagccaattggagaaccagcggatgcattacgaggagaagttgcgggaaacggagcaacgtttcagcgaaagcggaagactgacccaaaagaaagtcagtgtaaaaaaataataatttaaattcctaagttaaatagtttaaaaaaatagttttttttgatgcccttttcttattttcctcttccaacctgggtttttattcctgtagctaaactcactcgaggcggagctgtgcaccgtacggacggaacgcgacgaggcgcggacagaattggccacgacgagcacagctaaacagcaaatggagaagaagtgccaacagatgcagcagaagacacagaacttacaacgtgaattggaggaggagcgacagctgaactcactgctcagcaaggataaggaattgttgggcaagcaaaaggaggagttggagagagtccgaagacaggtcggaggaagtggagaaacgaggggaggggggagagactgtcaattcacttggaaattaaaaaaggtgaaatcaagtaaacgcattcctttccaatgcctattttatttgtcaataaacccaaactctaaaagagtatcaacttttttattctgataccaggaaattgccgggttggaagagcaactgcacgatttgatggcacactttgacacgcaggcgaaggtacaacgacaagtggagacgggagcagtttcaaaggaagagttggagagcagcactttgggactgagcaaggaaaatggaagtggggggaaaaagcagcggaggaataaaaagtgacgaccaacggagcacgagaatgatcagaagagagggcaattattgtaattaattttgtataaagagaaaaatatacaaaagtgagtgaataaatcgggacaatcagtccatgtgcaattgtccacctcggacaaaagagtaaatgccccatttagaaaatgaccgtattggggaaattagtgctcggtgtttgatgtgtcttctatctacgcatagcgcatcattgttttccctccaattctttcaataagcactcagcataatttgtcgtccatgccgtgccgacggttggctgggaatctaaggaagcgaggaaattgaacatttggaagggcagtgctttttccattagttctaccatatgctgagcccagtacagtcgatggtaccgtctgtcctccataatactgtagttatctctctgcggttcgtacaaaaatggctccgaatagtcgagtccacgcgcccgacctccccaatacatacagaaattctcaaaacgagtcgcatcggccggcacttggaagggacggcgcgaagtctgtgggacgcgaactaagaaaaacttcagaaaatgtcccttttacgggaggcaatggcggaaggaacggcgacggcgcaatgttcagttttgcatgtgttccatggtgcaatttttcactaaaaagcaatggcaattgggtggggaaactgccccgatgtgactgacagctccgtcttccattcattccgcttcggtttgtacggatgaaaaggtcttaggtcgggtgccaccaaacggtccctgtcaattggaggactttgccttcattttcatgttcctttgttttacttcaatcgcattgcgtttgtcggtgccaatgcgctgtaactcttcgacttgcgaagaatgccaatttccgggtgataccttcgaagggtttttccgcatttaaaacccttcttttgttcgctgataaatgctcgttactcacatgtcatagaagcgacaggcactggcatttctcccagactttttcacctcatcaaaacttaaatttggaggaccatcagagagggggggggggtcttcgcctgtccggcaattctcgtcaccttctcatcacaatgtcgctaaatgtcgcgtgcggactgtcgccgtacgaaccgagccaatgcgaatcgcgcacccgatctttgatctattaattagcgaatgaggggcagcggatgagaaaagacacctcacgattgagcgaatccattcgaattggatgggtggagaaaaatggaaatttcaattttaaatttcaaagtgatggctaacgcttctcacagaaagtgaaaggactctcacaaacggatcaatgggaacgccgtcggcggaggggaaacaaaaagatctttccttcgtcaacgaaaagcgaacaattggtgctcacatgtcgccacttcccaacggacggacagatcgaagtttatttactctccttcccaaaagcatggagaaaaagaacacagggaagagaagaatgatggaataatgggccaaatgaaaaagaaaagaaggaaagaacggaagaattaataagaaaggaatttcacaggtgggatgaaaagtttttttgctgaaaaatacaaagtgaaaaatggacaaaaccgaatttattcaaaaagaaatataaataaaaatttaatgtggagggcagactaaataaattacaatttaaatatcgcatagtagcataattagatatttaccaaggtgatttctgaagggaactgggcacccaaataaatttaaaacacaacagaataaactcgccgccgaacgttgccgttgaaaaatatggtcaaaataaatgaaaatcatttcttttgcttcatatcctttctaaaggtagggttggtctcttctacctatataaaaatatccagcacacggccatgaggaggcctgcgattggtagtggttagcgcaccattttttttgaaaaatgagtttccgaaaataaaaaccgattcgaaataaagaggttgcaatagcagcgctctataaatcaaaaatttacaaaaaaccaaagggcacaataaacctccgaagaagtgctcccaatggtcgaaaaggaaaacagcaaatattattatttttaaattgtgtgttagccgtcgcaagtactcaatgtttgtggatcgtttgttcccccttgtgaattctcaaaattcgctcatctatttgtcgaactttctacatttggtcggtgcctaatcccccctaatcattaattcgtatttaaattaattctgtcaacaatttcaaaatagaggaatgtgcaccgacaaatgcttatgaattcgtttgtgaaagttttttttccaaatattttttcacgtcgacgttttgtcccacgatgtttcggctggcgacatttttgggtgtaccgatttaaataggagcaaattgcaaataaacatggggatgcgtatgttcaaaaaaaacaatttttgttttcgaaagggtctaaccatagaattctgaattttccggggattttttattggtaaattggctcccaataaaatggagac

SEQ ID NO: 12001 - DNA, 1425 bp, Heterodera glycines
tggcctcctcaaagacactgaaactctcatccaaagatttggacggaattgaggtcgttaattaactgcacaaattgtaagcaataaacgcacaaatttggacagtcgccggaagagcgtcgcttggacactcccgacgcgcgcttcttggcatgttgccaagctcgtcagttgcccgacccatgccttaacaaatgctcattcaccgctttcactcgccaatccctccaggcaatgcctttgtcttttatcccaccgattgttcccccattggcactttctccccaattgaccccccaattgtctgattagaatatgtacttccgtgccgactcgtgcccaatgcaagcagctgccgacatgcaattctgtgctgcccaaggccgcgaccaccgcgagtgctgcacgcgcaacggagtcggctcgactttggccggtgccaagtaatgtttttacgtcctttttgctcatagttgtgccattttcttcatttcgtcagatgtctcactttttgcaaccaaatccccggcaatgtcacccaattggacatgagttacctcagctgctacgaccgctttgagaatatgaagggatgcttttggcacgacttgcagcgccgtatgagccgcgaacatcggagtcggaagtgaaaagggacgaaacgaaggaaaagcgaaggacaattgggaatggacggatcagtccgggaggagaggaagaaatcaacaaatggccaattcctcctcctcttcctccgatcactttgacaattttcgtcgtccgatttatttttgatcattattcacttgcctatcgtttttcttaccttaattttctttccctttccattccattttaaaatatcatttgcaattttgtccttttttgccaataacctaaataaagctgcgagttttttatttggcagtccaattgaaaattaatttgaagccgcttttcgtctcatttggacggcactctccgcgaaagggcagcggtggcggcggaggaggaggaagaaccggttttcttttcttcctttttttcttctttttctcctgctctcttctcccttctcctccttttctcctcctcctcttctgctccttcttctcttctctctttttccagtgatttttttccctcataaaacccatctctcagctgaatggcctcaaaagccaatttgtcctttccattggctaaatttgccgcttttgagctgcccatttgtcgctcagcaaaattaattttgcttgaggccatttttttcaaaatttcttaaatgaatgatgaaatttattccttccaattttttataattcatataaaaaattttttgtgtgtttgaaaatgccattggcaaatttagttcaaaatgcttaactcccctcaagatcttgaaatgccacgccgattttcacc

SEQ ID NO: 12002 - DNA, 2644 bp, Heterodera glycines
gtgttttttctcaaacacaataccatggggaacacaattacaactcaaaacacacggaaaataccctcgttcttcagcattacatccgatttttaaactgtattttttgtattttttttatcctctcaaaaatacatttacaatgggaacacaattacaacacaaatagattttgtatggatttgattccggtttttaaactgtgtttttatccactctttccaaaacacaattacaaatgagaacgctatacaactcaaaacacacggaaaatacacacagtgaatgcttttgattccgatttttaaactgtgttttttctcaaacacaataccttgggaacacaattacaactcaaaatacagtcgttctgcagtgtttttaaactgtttttttttgtatttttattcaaccctttccacaaacacaattacaaatgagaacgctatacaactcaaaacacacgaaaaatacacacagtgaatgcttttgattccgatttttaaactgtgttttttctcaaacacaataccttgggaacacaattacaactcaaaatacagtcgttctgcagtgtttttaaactgtttttttttgtatttttattccaccctttccacaaacacaattacaaatgagaacgctatacaactcaaaacacacggaaaatacacacagtgaatgcttttgattccgaattttaaactgtgttttttctcaaacacaataccttggaaacacaattacaactcaaaacacacggaaaatacacacagtgtatcttttggttccgaattttaaactgtgttttttctcaaacacaataccatgggaacacaattacaactcaaaacacacggaaaataccctcgttcttcagcattacatccgatttttaaactgtattttttgtattttttttatcctctcaaaaatacatttacaatgggaacacaattacaacacaaatagattttgtatggatttgattccggtttttaaactgtgtttttatccactctttccaaaacacaattacaaatgtggacgttatcccagtcatcctgcacggaaaattcacgcagtgaatgtttttgattccgatttttgactgtgttttttctcagactcaataccttgggaactcaattacaactctaaatacagtcggtgtgcagcgtttttaaactgttttttttttgtattcttattactccctttggacacacacattttcaaatgcgatccctatcctttcctcccctccccggatctctctcagccgagaccgcccctgttcccccattttgtccctatccttgtgttcattatttatgtcccgtttcgtcgtttgccttctccagctccttgagtaattccctttcgcgtcctctccccatttttcactttgttcgtcggattggatataaatgcatgggatgagtgagtgtccatttcccccccccccccccctcccgcctttttcgcttcgctttcccgatcggttgtttctcattgcttaattagccaataaagtgccaattttgggggaagaggtcattcagtggacagacagtatgcattgttatgagtgcatgttaagccaatacgaagcgtaacaaaacttattttatttgggtttcagtgactttgtcggtgaaaaggggcgagggggggggcggccacggcacagccaaaatgcccttccgccccttaatccacttattacttcgcttattaggcaagtcctctgacgcgggttcgcccgacaagaagacacaaagttatgatgataaggaggagtttgtgctgattccttcgttggcaaataattgccgaccattcgctaccgtattaccataccaaattgacaatttaatttccgccccccccaccaatccccaagaatagtcacaaaattagtttcttttaactcaatattcttaaaatattttattttgtttttaatttggcctttttgtttctttctcttccgccctctttactttgttaactttttctttacttttttcctttttcctctttctctgtctttgctttttccgccccattcttcaattttacaagcactgagagaatattgagacaagacaaaaagcttaaaagcgggacaacagagtgtggaaaggacactccgtcaacaagggatcattaaagatcattaaggatcattaatcaatggggagggcgcccaggggaaagggaaatggtaacggaaaagggaaaacggagagaacagcagaaaaagaaaaagaaggaaagagaaaactcagcccacaactcataagtgcattccaaaatcactgttcatcttttaaaatctgaccagaaatccgatatcgtttttccctcttccgccgtcggtttgacaatggcacttttgccaaatttctttttaattaaagggctctgatgcatttgccatacttttgtcaactcctccgctgaactgttcgtcctttcatttgcctcttctgctggatttcgccatttacccttcctaaaaatggtgtccaattaactttcttttttctctattgataattccatttggttccgcacctattcctttttccaagatcgagaatggcatggcaaaggtaattatcgtcgttcatttacc

SEQ ID NO: 12003 - DNA, 1770 bp, Heterodera glycines
ttcggtaggaattttgaaaaaacatcggcactctcccctcccccccactcgttttttatcccatgccctttttagcgttcccccttttaccccttacccctttttaccccccttttgcccctcccccccccattttaacacttcgccaacttatttttctcttttttattcattattctttcaaattaatgaactaatttcacttgagtggttgatcgtgcgcagaatgactacaagagattaacacataaataagaacagaacagaaaagtggcattttggtgggattatttaaagaattgaaaccacaccacgggggaggggagggattgtgccaatttataaaagaagaacgaagtgtggacggattggcgttagagaattgttggatttggcacggagggggatgccaataaaagcacaaaagcacaaaaaagaattggcggaaaatccatcgcattaacaattattttggcattttcttctttgtgaatattcaaaaaataaaaaattatactttcttagaaaaaatctttagaaattaagaagaaaaaaagtcaaatacttttaaaggatttttgaaattggccaaatgagagaggattaaagggaaaatagattaaaagtgaagacaatttgggatgatctgtacacatgaagcttgtgctatcacaagaaagataaaatgtattagaaaataataaaagcgcaataattgtaaatctgccgatcaatcaaaatcaatggcacggcatttccgaaaagggtttcggaagattttcaaaaagttttttcttaaaaagggaaatgctttttgacacggattttgatttttgtgcattttaagcggactcttttttcttccccttttctcttttccctcttttctaataattcccattaattttctgctgttctgttgccattttacttgctattttttcattccaatgtttaatttaactaattataattaattgccgtaattgcactttaaaagtggccattcatgattcacttttttatccgttaatgccttttcaatttccccatttgcaaattgcgttagcgactgaatgaatgcgaaaatcccaaatgaatcctcccaaatctcttttcgcactgatggaaaagagagcacacttaacgatcggcaaaggagcgtttcagtttggttgactggaggcgtttaaccgtccaacctctacccccccccccctccccccgcagttaaatgcgaaacttaaccttctagagattgcataaacatcctgacaaatgataagtcttgtatgccctcaatgaattccaattaaaaatttcacgaccgtaatattgcgattttcatgtctcgcataaacgtgtgaccgatcattggtatcggtacaacctgatcagtaacatccaaatgaccccattcaccattcggtgatgtcaatattcgcattctaaaatcaggcaaaaggtaacactttgacacgccaatgtagaattgactcgagcgtattttaaaatgaaaaagagagactatgactgtattactcttcactatctcgaaaacctttgacgatgatacttaaacatatgtaggtagtatactgaaacagtctatcatcattgctaattgaatcgatgctgatcgagtcaattatgtgaaatgccattatagtcttctttttttaataaagtccaaatgcgtctgatctgagtctctttttgcttttaattagtggtttggtaatagtttttccaattaaagtctggtgcgat

SEQ ID NO: 12004 - DNA, 1874 bp, Heterodera glycines
  misc_feature (41)..(41): n is a, c, g, or t
  misc_feature (55)..(55): n is a, c, g, or t
  misc_feature (88)..(88): n is a, c, g, or t
  misc_feature (141)..(141): n is a, c, g, or t
gagttattaaaatagtttcttaatcacaatgaaaataattngacagaagcgactngatgttttgctgatggtagtgaagaattattgngaaatgttcatgggccaaaaagttggatttaattattaattaacaaaaaatanttaaatttggaaatgactaattttgcgataattatttcatcagaaactttgaaaaattgctaattattgggaaatatttttaaaaatctacatttatgaaagtgaatttaaataatttaaatttaaataaatttatttccacaaattttgcacctccaaaagggccttaattgtgatgagaaaacgtgcaaagcgacgtgcaaattgccaaaacggaacagagaagtgccattgaaaagggaggacgaaaacccagcggaatatttctgttacccatacgaagcaattaagaaaatataattaattaattaattggaaaattaaattcagctgatttacgaccacgcaaattccattggttgtgccgttcattttgagaccaaacgcaaaacggagctacgcgccaaattggtgtgcataatgtgagttcatcttgaaacaaaaaatgccaaaaaaaaacggaaaaatgccattaaatttttaaggagcactgagcatggccacaagaaaatgctgcaccatcacaacgtattcaaagtgagtgccgacaaaattaatggccaattttggcactttctgttcaggtgggcccgtcgtgttcaaattgtgatcgaaatttcgaatgcgatgccaaaaacagattgtgcatgaagcgaagcaatccgagccaaaacggggcacaaatgccaacgatgggaaggggtaaaataaagcaaatggaagttaaataaatatatttaaaatggtaataaatggggcaaaagaaattaatcgggacaccgaaatggatttaaataaattcaaaaaagtaactccaaatattttttaatgaataattttaaattaattttcccccaatttttctcttttaaggcatggactaccaaatgagaaaatgaagcgagggaagaagaagcattggatagaaagaaagtggcaaattactgtacatttttttgaattactctcttacagtatcccctcccgcctttcagttttaaattactgtagatggatataatataccgtaacttttttttaaattttacacaaatatcaattgtgaatttgtgaatgggaggacatgaacgacatgaaactgaaaggacaagcgagcttttggcacaaagaaaagccatgacaattaaattcgatttaaaccgaccaatttaagggttgcccttgtaaacatgaaatttgattagaaatttgcctatcttaagagagaatggcaattcgacgtggaaattgcgacagatagaaaatgccgacacttttttcgactcgatacagagacgttcgagcagtacttgcagtttgaaagtagaagcattctccactcagcagctgacttgtcatttcgatcacatttgattttactttatttggcctaatttaaaatgccttttaattgctcgaaaaattgttgatgaagcgaattgcccggagggcggctaattttggcttattaaccttcgcttcggcaaaatttgccgctgccctccttttgaaaatttgagtataatttgttcagattttgcccaaaaattgtccgaattttgtaattttaagccaatttttaagaaaacaaagtatttttagggtccgaaattacgctttaaaatttcaattttttgaaattttaagaaaccttttcacgcctagtttctctccataaaagtcaaagtgaatgtagacaattgttgtgaaacaaagaagctacagtaactgtt

SEQ ID NO: 12005 - DNA, 2946 bp, Heterodera glycines
gcagagataaagcaaaaatgagggatagggagtgggatgggacggatacacattcatgtcacgatgatttaaattgaaataaatattttattgctttttgacccaaaagaaaatgggaaatgggaaacggatgtgcagcacacaaacaaatggccattttccaatgtcaaaagggttccaaaatggcacctatggttcatccaccagctgaaccagttcattaaaattgcagtacattaactatttttacagttatcattggggtgaaaaacttcaatttccccccccccccttttgttgttgttttgttagtgtttgagttgtgaaggggaagaaaatgagggacaattggacaatgatcgagcgaatgggtgggcctcatgcggcgcatctgttgttgaacaaatgagccatttgacaacccatcccccaggaatgtatcggaattgaatatagatgagcggaacacagtcaatcgagaggagggctggacataattacggattacagtaattggaaatcagttaaaaaggaggccggattcgcactctgcgcctcaaaatacccctagaaatatgttattagaatttttagttttaaaaaaaaatttgttcgggaccagtaaaagacatgattgccgaggaaagcgtggtttttccgggtgaactatgcacaatttttgaaaacaaaagttgcccaaagtaaaagaagtgccgggattgccaatgccaattaagaaactaatttcttttaaatttttatatggtcgaagaagaaattctttttcatttttttgtcgtcattaaaatcaggacaattgcgtgaatatgatgagatttaaatattttatatgctgcgccatatatcttcaacaaaaaatcaaaaaatcggctgtcatcaaaaacgagcaagcgccatacacacaaaaaatcacttctgcgccggacgaaatttccgttgactgcccacccaaccaccgccaccgctagcgccacctccaccaccaccaccaccaccacggcttgcatgcgacgaagaatacacaacagcctaaaaaagcaaaataagaaaataaaatttaaaaaaatggaagggagacaaatgaatggaatttaaacactttaacttcgatgaaaatttttatatctcaacgccataaagcaacaaaacccattaaaatgagaatataatgcatttaatagttaaaatacacaactgacgcaccccggaatagtgatggtgaacattgcgcggtcgctggggatgcggctgatgggaatgcggttgctgcgagtacggttgctgagggtacggaggatacggcttttgcggcagcggttgctgatgttgctgctgcggttgctgctgttgctgcacgagtgccggatggccagccgccacttggaactcatgagcgaatatttccaacagtgcgcgctgcttttttgctgaaaataatgaaaagtattatcgaataaagcatgtcttttgccgttttggccacaaaatgatggaaaaaacaattccaaaaacttataagtcgtaaacgcatctaataatataattaggtagtttccaattcggtgagggaggttggtggtgtacttttttttgtaaatgtatgagccacgacaatttttgtgtttaacggaaactcactgttcggacagaacagcgccgtatgctcctgcgagccgcactcctcacaacgtctgtcaatgatggatggcgaacgacgcacaaaattgttgttcacattcccagcacccgcaccaccaccaacgctcccaccagtgctaaccctgttgctgtaaaatgaaagaatgagggattgaaacagacaacatttttgctaacccatggtgatattgatggaaacgaccaccaccaccaccggtgccaccgcctccgccacccatttgatgatggggttgattttgatggtgctgttgctgatgatggtaattcacacgcccgtgatacggcatgctggtcatgaccactttcttggcctgattcggaagaaggggaggcggagcagcaccctaaaaaagaatggactcacaatcagagcagagaaaagaaaagcccccaaactcaccctggacatatcgcttttcctgttctggtggtaaggattgcgaggaggaacattctaaacagcagaagaaacgcataaacaggaaaggaataaggaactcaccttgaatgagtcggttttcttgatcggcgacgggggacgaggagaagccgcctaaaacgaatccgtagaaaaaaactgactgtgataaactcatcactttggcgtggtcttttttcttgaccggtgacgcagaacgcggtggagtggcattcttaaagtattcaagaaatagtggttgtaagaaatgaggcgctagttaaaaagtcacactgcaaacgggggggggggggtccatttaactttgttcgagtttggtcatagattcaaaattagtaaaatgaatgccagatttttgttcagcttaataaaattcaatgggtgtgagacaaattcaccttgacatagtcagtcttcttgaccggcgtcgaaggacgcggaggagtgacagccttaaaaaaattatacgacaaaagtgagaccgaccgatagactcactttggcaggctcttcaatcttcttgaccggtgacaaaggaggaggcggagaaacagccttaaagaaaacaatcgtataaatggaggacccaaaaaaggataaacgcactttgacctgctccgtttttttagtgtctactggagacggaaaacgaggagaaacaaccttaaaaaaagaattggaacaaattagattggataatgaccactatgcccaactgagttcaggtaggcgctaaggatatggaagagaaaatatgcacttaaaagataattgtttttgtgatttaaaattaatggagtgattaa

SEQ ID NO: 12006 - DNA, 3951 bp, Heterodera glycines
  misc_feature (3891)..(3891): n is a, c, g, or t
  misc_feature (3894)..(3894): n is a, c, g, or t
cgaaggaatgaaacgcggcgtgggacgacccgcggcgttaaaaacaaaggtgggaaagaaattgactcaccattcattgtcccctaacaacggaggggcccatcaactttattctgtaatttagcaatttgggcattaattaactaattatcctctaacttcgcattttcctttataattgattaattaatgcctacttttgattcttatcttcaatatttccctttctttatcatttcaaaaatggaaaatattttaaagagaacgaaccaaaacgaacctaatcaaagaaaatttaacagaagagaaacggagggaaagggaatttatttttgtttttttttaatttatttggttttgattcgtttcgtttcgtttttgggccacggaagtggcaaagagaaagaagagaattcaaacacagaaatggcctttaaaagggaaggaaaagtgaacagacatgggaaaacaattaatcatagaaaagggagagaaaatgacaaaaaaaattaaatcagtcgatggattaaaattgaaaagggaaagggaaaataggacaaatcggaggaaaaaaccattcgttgatcagaaagaaagaaaggggaagagggacatgaaaatgacaaaataaaagcaaaaaagaaaaaaaccaaaaacattttcagtcgaaaagcaaatcaaacggaacaaagatggaaggccgaggaagcgatcacagcacacaaagggaaacaaactgtgggaattcatcagagacgcactgaaagacccgcgcacgtgcccatccgtagtgaggtgaaaaaggggggaaagtgccaatggaagggagtgccaatgaccggccatcgtttgcctgcaggtgggaggacccgacggaaggcgtttttcgaatcgccgaatcggaacgattggcatttttgtggggtcaaaagaagaacaaccaaaagatgacttacgagaagctgagcagagcgatgaggtgactgactaatgaatggtgtcaatgacaacattcggactcaaactaatcatgccacccctttaaggacgtattatgagaagcaaatcctcgtgccggtgccgaagtcagggctttatcctaaggtgggcgagccttagccttatgctttttctattccttcttcattcaagaaattggtctacaaattcggcccaaccgcgcacgggtggcggaccgccgcgtccctcgcggtccaatcgcatttggcactgatcggcgcgcaaggcataaacatgtaaaactgaaagcgaaaggatgccgaaattcgggccaatggcccgccattctccggttcaatgatctcacaatgattggccaacagcagccaaatgagaaatgcttatttgacttttaacattcgacgataacacaaattactcccccccccccccccccgaaatttgattgattcacccgagtagtctttttggagcgggatttgactaattatatccttttcaccggttttataaaccgatccgatgccccgtccctttctctttgttctgttctctctaatttagaccaaattggccattcctttcccttcccttttaattgcgcaattcttgccctcttctcttctcttacgaaagactgaccttttttggtcgtttcataaaatagccgcagaatcagattctctttgcttaaatttatgtttttttaattcttatttatttccttcattaattaatacaagtacaatgtttttactttgattgtccggttcaggaaacaaaattttgcttcccatttctgtgcttactctctcagaatatttgtgattttctatagctatattcttttcctatttgtccatttgattcattcctttaaatgacccggttaattcataaattttatctttatataatttatctattgatttaaatatgtaaatgtctagtaaaatgtttaatacagaataaaaatgaaacaaaatacatttgagaatagtgaaggtgtcaaggcatatggtaagaattaagttgagaaatggttaatcaccataatagagtcagtcgatgtcattaaacattaattatagagaaaatgcaaatgtgacacattaaactagaggagttaataatatccgtgagatatttggtcaaaataggaaatatgttaactgtccatcaatcacataaagttgaatattaaagctgacaatgagaaaaaataaataaatttgaagatgagcgattatggcgtcggggagaggtcgaggatcgagtgccaaatggggctgttgtccaaattggacaccaacggctggacaagcatctgaacgcgaattttttcaaagtccctctggaaagagagcaagaaggtcattttgagcaatgccaaagtccattccgcaacggcggagacgcagtggaggttgtagccctgaagaacacaaaccaaataatgtttaagccagtcatgccacgacgtacgggaagaactccgtgtttccgattccatggtctcggagtggggaggtccggataataatggtggaaagtgatggaagccatcagcccaaaggaaaaggctaaagaaattgagcgcggtttagcagtgattgaggcaatcaacgaaggcgagaagactgaccagtgacgaagcaaagagaagcagcaattgcaatcacaaatcgaatgtaagcgatttgagggtcgttgtaaagcggactcattctgagagtgcaccacgactgaagaagcatgtacacacagccggatccgaagcagaggagggcgccgagcaaatggatttgaaaaactgcagtctcttgaacgttggcgacgatgaacatgccgaggccagccaacatcccaacgtaaaatgccaatcggttgaccgctctcagtctcagatccgaacttcggttgagctcaacgacgaggctgtacctgaaaataaattgggcatatttaatggcaaatgggaataaaaaacctaagaatgatgagaagcatcgaaaaaaaggagcaaatgttgagcaacattgagaaaatgcacgactcggggcgaaggtcaccagaggcagaaatgtaagggaagacggggtcaacatcaccacgccaaacggagaaaacgtaagtacagcctgaaggagttggaatggcattgaaaaaagtaatgacgacggatcaatttaaggaataaaaacaccgagcatagtcgcgaaacaaacagcgaaaagaatgggcaaatgaccagcaccaagcctaaaacaaagaatgagtgtccctttaaagtcaaattcaaaccaactttttccagtaaagaagtcgcatttttttttgttttttttagctgttgagtccaagaaataaagaaagaaaccaagattcgccttttgaaaaagtgacattaaaaagaaaaaatttttttaattgttttcattgcaagttactttgaaaaaagtccgagggttggagagctttttgaatattttgatcaatttcttaatagaaaaaatgaccaaactattttttttaaagttattttttgaaagctggtccggcggttcgacaggcaccgccgggaaaattttcaaaatttttgaatgaaatttgcgatgaagatggctttacttaaaatcaatatttgatggcatttacatattttaccagatgcttttcagtaatctcttaagcgttcgactgcacaattaccttttttacacttcaaatgcaattttctgggttcgttttatatatttttggtttgatttattaatgcccaattattcttaattacatagagttgcggttggggcgcattggccgttggaatttggctttacacgcagaaaaatgtctactcagtattggcgccaacgagttattcggatagtgccggaattggtgatnctnccgatggtagggctctaatgtagaagaaaatatttaacttttaaaagtcaatgaaag

SEQ ID NO: 12007 - DNA, 1410 bp, Heterodera glycines
ttaatttttcataatcttcaggagcatggccgaaatgctcccaaatcgcttttgccctcaggcttttaaagtttctatcgctttaagtcgttttttatcatctacttttaactatcgccgaaaatgtcccatttctgatatatcaatgataattagcgttaattaatggttaattgctttcattgcctgctgaatgaattgtacgccgtcttgtccatgctcaatttggtgtccgtctagcagccatttgacagtcggtggtgggtcgccgctgatttgcactgtccatttcagtggcattccttcctccacctcctcactgactaaccgttgcacaaaatcgggcgcaattgttttggctaatgaaattttaattttttaaaattcaatcgaaaaaattcgaaattttttgaaaacgaaaatttaattttgagactttaaaaatgggtgggaggtctgaaaattaaaaacaggactttagcttggtcgaagttccatatccatgttttccatattagcgcgtaaatattccgaaaaaattatttgttaggaaaaattttctcgatactattattttaattatttactaattttgtaaaaattttggaaaccataccctcaattaagaaaatgtatttgcatgttttttaagcatatttcttgattttttgtccatattttatggccatattcctcgattttatatctattttatgcctattctaattggggacgggacaaaatatcgccgataaaaaaacaactttttttcaaacctagaaatttttagtaagaaaatttcaagaaaaatattttttgaaaaacttttgaacgattttttcaaaaattttccaaaaaaaaaaaattttaaacgattttttgttaaaatttccttataaaaaatttcttaaggtttttttcttgaaaatttctaagtttgaaaaattttctttttaaatttctgcggcgatattttgtctcggcgatattttcggcggcgatattttggggtgcacccattctaattatattttaaaaatatatttaattataatgagttaaaaaaaattaataatactacggatggaatacaattttttggattttgttaaaatttaaaattaaattcatttttcaaaaaagtaaatttttacttttatttttttgtaaaatttttcttttttttaattgatttaattgcccacgtctcagcaacagttgggcacttgagctggccatgcccaacgcgttttcagctgtgcaacaatattttcccacatcgtccggccccgctttttcgaccaccaaatagtctcggccggcctcggaccaaaagtacacattgtcactctgcgccaacggttcaccgtatttggaccattcaatgcgcggctgaggggtgcctaaaaa

SEQ ID NO: 12008 - DNA, 1911 bp, Heterodera glycines
  misc_feature (25)..(25): n is a, c, g, or t
  misc_feature (70)..(70): n is a, c, g, or t
  misc_feature (95)..(96): n is a, c, g, or t
  misc_feature (122)..(122): n is a, c, g, or t
  misc_feature (152)..(152): n is a, c, g, or t
tttggttgtgtgggtgtgcgatgcngaatttgttgggcatccatcaccaattgtggggcatgtgcctacngcgagaaaaactttgtacataaatnnttgtttaaaaaattatatttttgttntaggattattttccatccataaaagcattncataatgatagctataattgttaaaaatttgcacagcttcccgcattgattcattgtgcatatcaaccggattaatattccagttaaattaacgaaatatttctaattatttagatactttatttattattttgcgaaaaatattttataaaataattaaaataaatttcgaaatgaagacaatttttaaatttttgcgggttgatggcgaatattggtagcatagcattaacagttaatttccttggctcttaaaacggcttaattatttgggccattcttatatcggcttaaaaaaagcaaaaatatcaccggctgtgataatttcaaaaaataacacgaatatattctaatattccaaaatttatatcttaaaataaaatccaattaaaaattattaattcaacatccttcacccttttatcaaattgctgctgctgctcgttgtgctgttttgtcccattcatcaacagttgtggccgtgtcgccaaggctgtagttgttgctgctgttgccttaattgatgatgccagtgccgtaatttgctgccatttgtgtccaccattttgttgcttctgattgtaaatggcataaaattgttgttgttgttgttgcgcttgcgcttgttgatttaatgagtttgttgctgctgcttttcctgctatttgttgttcgtctgtgcgcatgaacagttgttggttttgttgctgttgctgtggcggtgtgctcaaagcacgctttcgttgtgccttcaatttgaaacgtttttaaaagtaaaatcctaataacaaaacctcattaaaatatcaccaatttttattttgaatgctgccaaatttggtgtgcacaaacgttcccaaccgttctttcttccccccccccccccgttgcgtttttcctccccgataaatttaaaaaaaaaacagaaaattttcaataaaaaatgtaagaaattttttcaattttctactatttttttttgcaattattttagaatttcgaagtgcaccccttgaaaagttgtgtaaattttctgtatttagtcatcattgaataaaaatttataaattttcattttatttttgttttcaaaattcagtttttctgtacaattttgatggaaaatttgttcattaaggtaattaaattccacttttaattatacgtgtttattatttggaaaaaattaaagatttcgtggtttctaaaatttttcaaaattcattaaaattgcttacccaataccgttcatgctgtgagcgcaacagcgcctgaatgccaccggtgccggcgcccaggcgcgcgtcgccaagtgagcgccgttggcgtaatggtttcggaatcatagacttcaaattttaaataaaattattaattaaaaaaatttttttttaataataataattagtcactttgggccggatgtggacgagcgtttgcgcctccacccatccgcgactgttctcggcacaaaggcggtaataacctgcgcattccaatcgcgcaggtgcaaaacgaatggtgtaagtgtcgccaacatttgaaaacttaaatttttaataaattatgctaaaaaaaattaattaaaaattttccttgccatatttaaatgatgtgccaggaacggtcccggcatttcggcttggggggggggggacacccctgggcgacaacctttttttttttttgattttcattgctattattttgtagtttttaaatttcacgtgcgaaggaatctttggggggaggggggggg

SEQ ID NO: 12009 - DNA, 1975 bp, Heterodera glycines
cccctctcccctcacccacccctgggaccgttctatgatgaatgcatacacaactaaaaaatattctttttacatattcttaaaaattaaaatttaatcgaaaataaaaatattttaaaatttgagctaaaaataataatatttcacttttattaaaataataaataaaattaaaattgaataatttaattgcttatgcaatattccaacaattttttacctcaaaaaatccaggactggatttgacgggtcgatcattgaagaaccagcggattttgggcctcggattgcccaccatcagacagtccacctcagccaattcgccttcattgatggtcacttcggtttggaatgcgcggatgaattcgggcggattggcaaggctgctatagcctgaaattttttgaaaaatatatcactaagaccttaatttccgcaaaaacctaagccgggtgcactgagttccaacccctaccccgtttctttcccgcccgaaaatttctttaaaattttttcaaactcaaatttatcgagtaaattttttagaaacccttttatagaaattaagaaaataatttttcgaaaaatttttcttgcgttttttcgaaattttatgctgaatattaagtttttcagaatttttccaaaaaatcgccaaaatttttcagaatttttttcttgaaaattttcttataaaaaccttctaagattttttccttaaaacaattgttttagaatctttttataaaaaattatcggggagaaactacgcatatgggagggggacgatctgttccgacctaagcctgggtcctcaaaatcactgctccgtgccgactcggcacggtccgatttgctcagtgtgtacacaatgccacgcggtgacgaggccacactttggctgccccaactgcgctgatcagtatgccgccgttgctggtggtgatcagtgttgttattggcttccattgtttttgaagtgccaaaatcgccaaaattattgttttggtaaacggacgaagaatgctgctgttgaaacagctgaatgttattaatttattaaaaatccaaaaaatggaagcaaattttgctgagggaatgataactttttgtgatagaagtgccggaaagtttggcacatctaaggttttagaaaattgtctaaaattcttgttgtagggaaacaaaaagtttttgggattatgttccatttggcacaaaatggagaataaaagaccttttaaaaaattaaaaacttttacttataatttgaaattgtttgaacccatttttgaaatgccaaacttagattcgaattttaaagaaattttgtttttattgatttttttgtttatgtttgcctgcggcgaatcaaatccactggttggacttgttgtagctgttgtcgtgaatgttgtttttgaggttgtttctaaaaaattagatttaaaaaattaaaatgtaaaaggtttttaatgatttgaaaaaaatttcaaatttatatgaaaatatattattaaataattaatcaaaccaaatacaaaaatgaaagttttggggggcctaccatcaagtccaaccagtacattcaatgttgccgatgagtgtgcttggcccactttgttttgtgcttccaccgagtactggccagaatgtgcaagcgaaacacttaattaaacgataatatatattttttttaaacttcaaatattaaaaaaatatatatataaatatacgaaaatatataaattaatttgaaattaatcactattttcgatttatatcctttgagaatttaaatattcaatccatttgcatcaataggcttatagaaccggattacccagaaatttttttgtaatttcgaaaacaaaaagaattttagaaaattttatataagaattttaagaaaaaaaatttaaaaaattattactagaaatgttcaaaattctaatgatgaaatactattgttttt

SEQ ID NO: 12010 - DNA, 1890 bp, Heterodera glycines
  misc_feature (54)..(54): n is a, c, g, or t
  misc_feature (66)..(66): n is a, c, g, or t
  misc_feature (94)..(94): n is a, c, g, or t
  misc_feature (123)..(124): n is a, c, g, or t
  misc_feature (126)..(126): n is a, c, g, or t
  misc_feature (1776)..(1776): n is a, c, g, or t
  misc_feature (1811)..(1811): n is a, c, g, or t
  misc_feature (1880)..(1880): n is a, c, g, or t
cagacaaaatcaatttcttacggataaagggaggggagggaggaatgtgtgagnaatgatgggtancagtgtatggggaagggagggaaaagancaataaatgagcaaaaagcaaagtaaacnncnaacatttttatcgacatatttattttgttttattttccagtttattttacattttaaaagtttcatttgaattgtaaattgtagcctgctaaattatcacatcataccgcccaattgaataaaagaaaattctgaaatcttaaaaataatctattttcttttttttcagactttggctcaaattttgaagccattgtaaaaggtgacgcgtgaaaataataataatttgtggtgaagattgaattaaaaacttaaattttatacttaattgtatttttaaagaaaatgataataaaaataataattactttgtacataagaaaaattcttaatcattttccatagaaataaataggattaaattcagttgctgcaaacaaaactgatccagtaaaaatataaatttctgaaaatgcctataaaacagcttgtctaaattaaaaataacgaaaaaataaaataaattctaaagctgattattaaatgtttacaaaacggctgtaaataaatgacaattttgcctaattcattattttatataaagtttttaaagaaaaatatcatttactcttatgcaatacgacggaaacttaagcaaacaaataatacgcttaaatacaaaattataaataatgtatattctatgctactaattctgtaaacatctaaaaaaattttaaaaacatgcaaaattaaataatatattaaaaaaatttcatgtcctaatattctgccgaattaaaatgaatgaagaaaattttaaaaataaatctccattcatagccaatattattttgtgtttgtaattcattttggcaggagtttggtcgaaatttggcattatggtgattcctttgatcggattatagtcaaaaacctgaaaaatttattttaattaataaattaaattttgaatttaaacataagggtgaagattttaaaaagtagttcaagaaaaaattaaaagttatatataataaaattaaaattaaatcacgcaatttattatttatcccaagtaactcattaaacttgtctctataaaagaatggatacttacatcgtttttaatttaatttcaattatatgtatgagttctgccaaagtgaaagaaattaacacgaaaaataaaacaaaagactgaagaaaataatataaaaaacaaataaatttaatgaactgaataattaacaaaatatataatgattaacataagcagcttttggtaatacttcaaaacttgtttaacatattcgattcatttaaaaacaaaaaaaaatagaaaaaagaattgcataacatgaactcaggcatactgggtatggagcaagaagtaaaattaattatttcgagtcatggctcgtgttttgttgaattttaaaaaattaaattttaaaaaaatttcgagggacaagaacttaattgacaccctaattaagacacagattttttttatttgtttgataaattaataaaatcagataagtctaagttaaattataaataaatatgagaaaagcgtccgttttgtataatggaacaattttatgaaattattatttaaaatttcacagggtactaaacaaatggaagagatttttaaaatgtcgttcaatgaaagacagactaatgacacaaaaatttgaatanatacacaattgatgatattaagaggtgtaaattanagaaattgatgcttactaatattattcatttatgaatttaaaaaagtagtaacataaaataaaacttangaatataaaa

SEQ ID NO: 12011 - DNA, 2408 bp, Heterodera glycines
  misc_feature (2391)..(2391): n is a, c, g, or t
ggtaagtgagtgttcccagggacctttcagctcggcgttaggcctcgttttgtacgtcgaacggcacgcacagaaaaatggcaacaaaaccattaagttcgccaccatcgctgcccctgaattgcccaccatcatgcgcattcaacgacggcacatgtctgaagcgatggcaaacgaactgcactcgcagagcttggttcaaatgcagcttgtgaccatcaatcgtccgcaaggagtgctcatttcacagcactacttcctgcccatgggttttcctttcaaaaatggcgacgaaattttggcattcaatgccaaaataattgccaaggtcgacccgaaagccggatttatgcatatccttttgacagcaactccacatgggaacaaattggatttggagagcgagttatggcatgcgcagtcgctgcagaacgagctacaattcaccaagagctgcaacgattaactctcatcacggagctgatccgagtcgaagaactgcaggaaacgcaggtgaacatcacgttcaggcaccagctgaactccgtggccgaaatgatggacatgttgcaaatttgggaagaagacacggcaatcaactgccgcgtcgaccaaaatgacgaaaccaagccatgtgccctcggatttggcacaggtaagacgtttacggcggcaggaatcatgtctgccatcctgcgcgaggatccgtcggcacgcatcctggccatggcaccgcccaacattgccgtctgtaagctggtgctggaaatggagaaagcactgcgcattgagggacaacccgagccaatgatcgctctgttcagcggcgcgggaaaaatcaactatgctgaagagttgaggcgcatttctcagcacctcttagcagccgccgtggacactgaggaattccgtgagcatttggaaataccagacacccgaaaagtggacaaatacgtcgccgcgtgtgcgcgtaacccgagattggcccaagaaacgactgtggcccgcattctgaaagagcatgctgagcgccgcatctacttctgcacactttcatttgctgaacagacagctgaactctttgccggcatcactcatctcctggttgatgaggcaggtcaagccccgtaaacacaggtcttgtccctcgccttccgcttgccgcatctgcgaaaattgatgatcaccggcgaccacagacaattgagtgtgcacttgccgtcactcccgttcggagccagggaaaatttgggcctcgacacagtgatccagcccctcgactcatcggaatgtgtcgacgtcacaacgctcagcgtctcctaccgcccgcacccgtcaattgtccggtgtgttgacatagcattttaccgcccgcacggagaaaaattgacacccgggcgatcagctgaggaacgtgccatgctcacggggcaaaccgtcatcaaactcccggtaaaggacagcccaattgttttgattcaccagggagaagaagcggaaccggacgagttgtcacgttcgacctcaaatcgtgcgcagtctgacaccgcaatgttcctttggcggttggcaagggcagtgccacaggacaccatcattcgctgcatctgcctctacaccgcgcaaattgcctggcgccggttcatcgacgaggcagtgcgtgagacaactgtggttggtcctgactccgtccatgccattcgacaacccaactgccaatacgatgaccgtgggcgccttgtgctcaaaggggacggattggtgagatcagaggagttttacgcccggtggagaggtaatgagggccgacgatcaggtaatggtaattcccgctcgggagacagaagggagaataggtttaatccttattcagttcagggaagctcgcgcggaggcggcggcggcggcggtggcgataggcggtcaagacgacgatgaacgatggaggacaattcgctgagacggatggatgatcctcggcgctgacgtttgttttccctcccgtcccttccctcaattttgtacatttcatttccatttccttttgtttcttttcttttattcatttctaaaaatgtttcctctcaatttctctcttttgtatttggattccggctgccttttctctattccattctcaaatttggggcaccactcctatacagctctcacaaatcggcactttcttctttggcaccgattcatcgcactactccgagacggaatgagctctggttgatttcctccagcatccttaggccaagactgatcaaaattttgatcagctggtgctcaggtggttggattgggaaccgaagggcaaagccgttcttggactggcgcacaatgatcaacattcatcaaggatcgcggacgatcccatggaagggngggagctgtaagggatt

SEQ ID NO: 12012 - DNA, 1053 bp, Heterodera glycines
ttgcccaaaatttgttaacaaaaatgcaataaaaaggaaaaatacaccctaagaatcgacccgaaaattttcaaaaacacaccccctgagaaatgaaaaatttttcaaaaaatcatctccaaaattaagttaattattttattgacgataatttttgattttgaaaattatgtatctcattaatggtttggcataatatttttgctttttgaagagaattttcgattttacagcccctaaattgccccacgcgaaaagaccccgaccccttaattggcgtccttcggaaaacggcaaattgtgctaattgccacaaacagatttaattgagtaattaaaatcaaacattatttggcattaaaatcattacctttttcagttacatttaccattccgtcgtcgcatttcttcgtttggcaaaggcatcaatttccatttaattgtgtcgtcacataacaacaacaacaacaattacaacaatgtccaccgaattttgaatgtttatgtctatgcaattttgcccattttgcgccaaacattcgccatttgatcctttccgatggtgttaatttggacaaattgcttcacctcacttcgccgaaaatgctcttcgatcttaacattaactcaatcaattctggtcgtctttcccaaatgccattgattacggcactctcgtcagaaatcattgaattggtcaacaatttcaaggaggtgtgccacattttcgtaaaatattttagattaattgccaattcattttcgttgcccatttttaggcatttctccatgccatcacttctgccagctatgaaattcaatttactgtttatgcgccatttcaataggtgaatgaatggaccagcgaaatgctgacaatggagaaaggctttcgtggatatgtcagtgttgattggctaattaagcgatgcccaattggggggacgacggccgcgttaaaatgggaggacgaaaattggcaatcgtcaagaattggtgtcccaacgaaaaaaaatgttaaaaattcgcagatattttttctaggcttaaaaa

SEQ ID NO: 12013 - DNA, 2315 bp, Heterodera glycines
ttacgctttatggaaatcgcattgggtgagcgtcaacatctttttgcaataataatcaaattaaatttgcgcttaattaggccattgtcgccaccggcagaagaagaagaagaagcgggacaaagcgtcgaaaaaggggcgacttctgacaaatgagtgacggacaaaagaacaacaacaaaagcagtgatcactgatcagcagaagaaatgaattaattaattgggaaatgcgatcattttgtatcatgattaaaaggaattatgaagagtagttgtaaaatatgtgtacatgtaaataaatctgatgtataaaaaatgacaaaaataaatgggaaatcaagttttttagaatttgtgtaaaaaaaatcataaattagcatttttgcacaaaattcggtatccagagaattatattcatagatgaaacaaactgtgaagagcaattatcagctatcaatttacaggattttacgggattcccgctcccgtaagacttcggactccaactcccgtaaatcattttttaccgggctctagttttcactaatgtcagaagaaatgattagggaacggatttcaatgcagaaaaactgacaaaaagacacccaaaaaaggaaaaaaagggacgaattgaaaaaaggaggtaaaaatttcatgagcttagaattccattcaaaaacagacaatacttggtgtaaaaatctaagttaaagtccaaaatcccaaacaattaatcacctaaatgtattcaaacaaaaaaagcaacaaataaatatgagatgcaattatccgatcactttccattcgtaaatgatcgattaggatttctcatttgccaataattcttcactttttcttgcgctgtccgcttggcccggcactcattttcagaggactttttgcattctttttgtccgcctttggtggagacaatggcctaaacgaagtgcaatttgaattacttttaaacaaaagaaaatgctgcttccactcacccaatgcaagaagttccacaaagcgataagtcgacattgttcaatttgtccgtcttttcgtcctcccattgaattgtctccccaatttggcatcgcttcattacccatcgctcgtgccatttataaccgtattctttcttcgcattttcatcactgttttctttctccaatgtcagcatttcgttggtccgttcgttcgtcaattcaaatggcgcaaataatggcattgactcaagaagtttaattcgaattatgtaactggccgaagaaatggtggcacggagaaatgactataaaatgggaaacgaaaagcaaatggcatctaatccaaaatcttacaaaaaagtgaccacacctctttaaaattgtcgaccaattcagtggttttatacatataaccggaacaactcaattgctttggctggccatcgcttctcggcatttgcaaccatttggacaatgcttggccagcagttgcatttggcccttttgcatcagcaaccaccgcgggcaacaaatcatcggaatcgattgatttgacattgaggtcgtaaagatttgtcggcgaagtgtagcgaagcaaattttcaagatgacgagccttggcaaaattcaaatggcgaatgtttggcgcaaaaattggccaaattccacgggcaaaagcattccaaattggctggaaattcttggctttataggagaactgcggcacgtgcaaatccaaattgatgcctttgtcaaaaatttgctggttggcacggagaaatgtgatgacggaatggtcgatgtggctgaaaataggaatatttatgtccgttaatccatgttggaattgaattaccaaatccgaagatgcttaaaacgacttttgttggtcagcgaatggtcgggcaacgaaaatcgcacacttttgccatttctcttctcaacaaacaattttgcttttgttcctttcttgtcaattctaattggtctccaaattgtcagttcgcttttgccatcgaaatgtttgtccaccaacgcattgaaacgtggcgaaagaagtgccattttgagaccgagttgacgacgacgaaaaagcggcaaaatgtccatccaaatgtcgttgcaaatccaactgaaatgtggaaaaattgtattaaaaattgtaaatttttaaaaatttcttaccgtcggctcttcgttttcattgccacacggagacttcgccgatttccaaatgtcacaaatgagcccaacggtttctgttgttcagttgcagaaatgaggcggtgattggcggaggaaagttttttcttttttttgacgggtgccattt

SEQ ID NO: 12014 - DNA, 746 bp, Heterodera glycines
tttcgcaccgcgtggcgcgccctcttggcgggcggccaacaacactaaaaaattcactatagtaaaattggttaaaattaattccatcccgcgtttttggggtgcattacgttgcccaaccatttcctcccacatcttttcactcccaccccaagaaaattgaaaaaatatttaaaactgtaattttttttgtacccatctttgattcatacaaaaacaaacttacacaaatggcggtcgttgcgatggccaccaccaccaccagccccccgccaattaacacccttaaattttaggacgtcattcgtaaaaattcactatttctaaaacttacaggcatttcctcctcctccttttgctgctttggctggcacggcggcacgcagtccggcggctccccgttaacgatggggccgaggcgggcggcagcagccttttccaaaagccaaaaggccacgccaacggcaaacaactgaaatttttgaaaaaaataggtaaataaacagtgaaaaagaaaggagcattgtttcttcatatttttgttttttttttaatttgcattttgtaatagcaagttttgcatggaaaaaaaccacgagttttggttcacctatgttgataagcattaaacagtggtcgaattcagtgaaattgcggtccaaaatttagcatatatgccaaaaataccacaaaattaataaaatggtacacaatttttaggcatataaacgcaaatttatagggca

SEQ ID NO: 12015 - DNA, 1437 bp, Heterodera glycines
aatatgtgagtgagcaaaaacattttcaaaaaaaaaatcatagctttaattgaattgctaattgctatcaaattagtaattttggatacaaatttctaagtaaattagcccaattggctaagtgttttttctgcgccatagaattccttaattcaattttcaactttttttttagcaaattcccttcaaaacgcgcatcagtgagccgctcagaaatggacaaacggtgcacgcagtgggaaagatcaaaatgtacccaaaaaggtacgtaaaaatagaatagagaataaacaatatactgtataccgtaaccccgtcaaaatttgtgaataaaatacccaaaacggatttgcctggaagaattttatgccactgaatttcgaattcattcctactcctacaagaataccgaatattcaaatataatttggtatttttagagtggtcgtaaacttccaccagggtggcagcgattatgacgacatgccattgcatttgtccacccgttgggatgaaggtaaataaaggccacggatcaaacagatttttccgaagattttgacaaccgtaattatttttttccgaaatagccaaaaaaaaaaatccatcgagaatctcgaccctaaattgcattattccatctttgtcaggactcttttcgggcaatgtcgtgttcaacacgtacagccgtcggaattggtctgaaccggaggagcgagtttcaagtccatttccggctgatggagaattcgacattcgcattcgacttttgcctggaaaattccaggtccaaaaggatttaaatttgaaaattaaaatttaattctggcatttacttttgaaatcccttttttaaatgcaattttttgtaattttaaaattgaaaaaagctcggactaaaatttcacgagataacgaaattccagcttgaaacgagacgggggagaaagactccaaaaccgttagttgtgattcgagatcgagacttttgagagcactattagcgccttcctcgtttccttttttgcatccccgcttccgtccccgattatcatccacgtccttgaatacttaacattttttgtgaataaaattaacttcagtttttcctaattttgcttgtattattttcctaattttgcttccgaatttttaggtgtttggcaaccgtgtggaaattggcacatttaaacaaagggccccactgactggagtcagtttcacacatttggcattttcacagatttaattggccctaattacccgaaggtcaaccacatttcgattgtcggcgatttggagaatttgcgcctctttcactatggtggcacttccttcccgaacccatacaatgccattgcaaagcttgtgccgtacagcggttggacgtttccgctctcccgacaggttgttttatcgtgtttttaccctttgtcg

SEQ ID NO: 12016 - DNA, 2420 bp, Heterodera glycines
  misc_feature (43)..(43): n is a, c, g, or t
  misc_feature (62)..(62): n is a, c, g, or t
  misc_feature (97)..(97): n is a, c, g, or t
cacgtgtcaattcgttacagtgaaggcgcaattgtacggacgnccatgaatgcgttcagtgngggcgaggaggagcgcgacgggggcttcccattgnccaagggtgaaatgtcagtgtgtgggaaagtgaattactgtacaaaggcagtgagtaatgtataataccagggaaatgggggagggggtttagtgaaaatttgaaattttacacccctatttatagataaactttttatatcaatagcatgttttttactaaaatacaaataaatgtattcagatttgatactattgtcacctaaacctttttggttttgtgtttttaatcatctaaaccctttttattttgtattttacaaattttacatcatctaaacttttacccttttgtcatctaaacaattatggtgttttgtgtttttcatcatctaaattaacatttacgcttttatcatctaaaccctttttgctttgtgtttttagattatctaaacatttttgattttgtcgtttttactataaatatatgatgtactcatctaaaatctttttgttttgttttcatcatctaaacctttttttttgtgttttgcatcttttaaacttttacgcatttgtcatctaaacacttattgttttgtgttttacattatctgaaaccttttttgttttgtattttgcatcatctaaacttttatgcttttgtcatctaaaaactttttggtttgtgtttttaggtcatctaaacttttacgcatttgtcatctaacctttttgttttgtgtttttacatcatctgaaaccttttttattttatttttatcatctatgcctttatgatttagattatctaaacgtttctttcgtcttatatcatctaaaaaccctttttggtttgtgtttttagattatctaaacttttttgattttgtcttttttattaaaatatacataatgtactcatctaaaccctttatgttttgttttttcatcttctaaaccttgtattttgcttcatttaaatttgtacgcttttgtcatcgaaatactttttggtttgtgtttttacatcatctaaaccctttttttgtttgtgctttcgattatctaaacttttacgtttttgtctttttactaaaaatacttgacacatatactcatctaaaaaccttttttttctgggttttctatcatctattttattactatgttttttaactaaaaatacatgtctacagttattcttacttgacagtaggtttataaaaatgaaaattttcagaaattttcaataacataaaatttttaagaaaaatcttcatttttgtaaaacttgaaatcaaattcacgaaacggctgtgaaattttcagcttttgaaacattggacttttaaaataggtttataatgtataaattttatgaaattttgcaggaagagcattttcaaacttcattaaaaaataaaaaattatataatcctgccctgaagataaaactaacccaagccaaaaaatagtcataaaactcaaatgttaatttaacaaaaaaaaatccttctgatttttcagtttcgaccttaccattgtgcatgagcctgcgcatttcctagtgattttgaatgggaaaaaattctgcacggtatgccaaaggaagtgatcacaattagagactggaaatttcaaatttgcggatcccgctgcgggattggaatccaaaattttttgcgggacgggatcctgcgggattaatcccgcaaatcccgcatttataatttgcgggatcccgcgctggattgcgggattttggaaattttgaaaaaatttcaattaaatttcaaaaaatttccaaaaaagaaaaaatacctgacattttgaaaaagaaatttttaggggctggcgggatgcattaaaatgggcgactaagatttttcgaatggatcaaacggtaaaaagagatcgggaatcaaatctgttactggtccataaattagactattttttgcttttcaaaaccgcttttttcggagcaattttttcaaaaacctaggaacaaaggggcccggcggtgccgataggcgccgggaatttttttattgaaattttgtcaatttcttaactgttgtccaaaaataacgaaatgtcgcactttttgactcatttctacagcaggattaataagtaaaaaccgattcggcggtgccgataggcgtcgccgggaaattttttgcaaattctagatgaaacttgagatgaaaaatggatttaatttgattgaatttattataaatttattcaaaaattttgtcattctgttcattaaaattttcaaaaatcaatgaaatcccgcagaatcccgcacaaaaatttcaaatttgcggatcccgctgcgggattggaactcaaaattctttgcgggacgg

SEQ ID NO: 12017 - DNA, 4223 bp, Heterodera glycines
aaaaacctcatctgtgacgtcgttcaaaatgcctgtgtactgttcaccctcgacaaattcgaccaccacttgtgtgccctgcaaataaaaggtcaatcgcaaacaaaatccagcacatacaataagtttatttttgcagccggcaattgttggtgcttcttgctcgcgtttcccaacattgtcctttgtaacagatatcataatagttgtttaaaatgactcagattttaatctgaatatgaataaagtaaaagtcaggattaccgagcatttggcttctttaaccaatttcgaataaccccggatgcgaacccgaaaaagtaaatttcaaaattttactgtcccaaatcaaaattttaaaaacgatagaattgatttaaaacgactaaaaacgacaaattatgggcgagctgggtcggggtcattttggcgcagacaagtttaaagattgataactttttttaattcgaccaaataaaataatgttgatattaatcaataggtctaaatgttctttattagcctgcaaaatttcaaaaaattatattgggttttaaaaaaagatatggcgcgctgcgccaaaatggccaggaaaatgcaattttttgaggttttttggccataacttttttgtttctcagctaaattttttgaaactttgcaggttaataggcactatcaagccacttaaaatcataccaagattatttaattttgctgtgaaatcaaaatgatatagagtcttgcgccaaaatggcctgcgccaaagtggccggttcccggcgagcttgcagtttttcgtataaaaaacagttgaagtttacactctctaactgggactcagttatcaatagccaaaaataaatgtaaaactaaagttttattagcacctagtttctgtgtctttgttttttgattctaaaaaattgtgaaaaaatctatttttgcctattttggcttttttccccgaagaacgtacttttcggttttgtggtgatccccctgaaatattcaaataagtcatttctagggtaatttgtagcgctgatgacgaatatgacctttattttgcaaaatttagaacatcgaaccttattcgaacaaaaacctcgaaatttaatttcgaccaaattcaaatatgcaacaaaactttttggcacctacatatgtatttttccatttttaaaaaatcgtatccccaattatgaacggtacaactgagtacctagtaccggtttttaccggtaccggtactagtatcggttttcccagtcaaaaagtaccggtttttcaacccgaaaattaccagtaccagtttttttacaattaccaattaccttttaaatgttttggtctttttcatctcgttgttttctaaaatatttatttaaatatttctgcattttttaaatgactacccgacttttggggtttgcaacttgtggacccgacttttaaagacccgattcaaaattctgctacctcatcgcggtgagtccggaaacagagttcatttttaaaaattccaaatgtcgggttccctaagtgtcgggtccccaaatgtcgggttccctaatagtcgggtccccaaatgtcgggttccctaagagccgggtccccaaatgtcgggttccctaagagccgggtccccaaatgtcgggttccctaagagtcgggtccccaaatgtcgggttccctaagagtcgggtccccaaatgtcgggttccctaagagtcgggtccccaaatgccgggttccctaagagtcgggtccccaaatgccgggttccctaagagtcgggtccccaaatgttgggtcccaagttgcaaatccccaaaagtcccttaccacgttataaatataaatccgcacacttttatcatatgaatttatcgttaaaatattgtttcaattgaacaatgtttgggtcttgtgaatgtatttttggacttcgtctggctttcatcagaataacggctttcattactcattttcagacggacgtcactttcgttttctttcatttggtaattaaaggctaaacattaattagataatcctctaacaaatgtttaattcttctcacctcacaatttgctccgcaaattgcctcttctctttgtactcctccgtgtcgcccatttcgttaaaattccgtccaccgcctcgcttctccaaattcagagcatttatcgaagcacccttttccccaataaaagcgcgtgccccgcctcgtttctttccattcgctcgtccgtcaaaattgtgattgttcgtgaaaaagggcgacgaggagggggggttcaccctttgcacttccgaatcatcgttgccaaaattgtccaaagagccgagcagaagtgaccgccgaggatgcttaaggaagataatcccctgtcgaccccctctttccagagattttagcaaaaattttggttaacccccctccctttgttcatcggaaggacaaggcgttgtggagcccaataatttgcagaattaaaagggcctttggtgcctctgcaatttgctattataaaatgttgtatgcaggctctatttgagtttatcccccaaaaacatataacctgaaattcggttcgataatttttgatccggattattagaattttccattggtatttattaaactttttccttggcacggggttaatattgttggcatttcatttttggaagttccccgaggcaataagcaaatcgaatgaatgttgcccactcgaaaaatgagcgaccgccgccacgtttggccatccatccgccgccaaacggcacatcgtcaaattgacgcaagaaatatcgtccacccgctgtaagcaatggatttgttcgatttgttctccgtgttccacctcttttccacgctccgtcaatgtatccgccgccgtaaaagggcctggcaccaccgcgttttgtcccttccggcacgaaactgtccccgtcagatgaaaggtcactcatccgaaataaccgggcaccggcacgcttcagttctccagccaaattagcatcgaaatcgtcgttaattgtctgaatgccacctgaaaacggaacggactctgacaaatgaattggaaaagtgccaaaatcactcgacgaacctccaaaggcacgtccgccgcttctcttctcattcggcggtgggaaagcagcagaagcaaagagattgaaggcgcgcgcaccgccacgtttctgttggtcggacagaaaaggcgcgccgtcgtccgaaacggcacttacgaagtcaatgcacgacaaaaggagaagggctgaaacaaacggagaaatctctcaaaaagacaagtgtcgctttttcaggggtttcgtccgccactttcaaatgcctttggcactgtcttttccttggcattttccatttttctcttctcttatcatttccattattttgccatgtgactcgtccaattttcgcctttttctgtctcttcttaatcccttgtcatattttttacttcacaaaatgtgttcgtttgccttaaaaattccccagagaaatttgctccgccgttgctgatcagttttgtttgttgcaactgtttagcacgttccgccataattaattgtgccattggcccttctgccaaattcgctcgcttttccctccctttcctttgcttttctcccccgtcgcctttgacaattcccactcaattggccagaagcatcgctgattatgagcaaatgaagttttgcggacggaagtcggtcgagtggggcgaacgacgctttcgtttgttgacgttatttgccgttggctttgtccatttcggttgaagccaattttagtgcaaaaatttgttttgcgtaattctatcacaaaaagaggagaaaagggagaagaaatgccatcccattcaatcattcaattcgacaattctttaactgcgtcagttttgcgacaaagaaacgaaaaacgaatgaatgccaaagtcagtcaaaagcaactcacttggcattcacttattttggcccattccttcccattttgcttcaaaaaaaagagataaaataactcattttccgaagaaaaattaattggacatttaaacaagggaataatgcaaatgggaaggaaagaaataaaaaaataatgggcaaaaaataaaaacgaaattgccttttagcaaaaaaaggaccaacgaaagtgccggcaaatgaatgcatagaaattgattgggaaa

SEQ ID NO: 12018 - DNA, 1349 bp, Heterodera glycines
ttttaatatagaaaataaaataaattcgtaaacttcatttctgttagtcaatattgttcttttttcttaattatcattttttatgaatatctaaatatagcaatcaaattgttcgagaacgtggaaaattccaacggccaacggctgaaccactttttccttataaattttcaaaattttggcgcatttataattgagtttaattttctgaattaattgaaaatattcgctcattggggctaaaggagtccaaaaattcattttttttttaaatatttatataatatcttttgacaatttattgtttatgttttatgagtttttagcaattatttggaccattaaaaacatttgaaagaaaatgattggaaccgccaaaaattaaattaatcattgtaaataaattttatcggatgagaatcgttgtggagaaaaaaaaatcaaaaaatacacacgcattgaaaatgaaaataaattagagaataaattaattgttgttagagtttttcccgagatgttaaaataaatggcgttccgtagacaaagcagaaaacgaggacaacgactataattcaagtcattctaatgaagaaaaaagagctaaatgaatatttattaaaaataaaaagtggaaatccgactttaaatgatcaagaaattttggcaatttagaaaatctcattaacaactttaaaatattgaaaaaacgaaatatatttgtaaacttaattcctgttagtcaatattgttctttattcttattatcatttttttattttggtgcatttataattgaattaatttaaatgactttctcaaagaagattttctaaattattttaaaatttttcgctttttaggcctaaagaggtcaaaaattcattttttaacatttagataatattttttgacaatttgttgtttatgttttatgagtttttgcttttttggcaattatttgaaacataaaaacatttgaaaataaaatcatttggaacagtctaaaattaaattaatcattgtaaataaattttatctgatgagaatcgttgttgagcataaaaaatattcaaaaatacacgagcattgaaaatgaaaataaattagagaataaattaagtattgttagatgtgttcacgaggtgttcaattaaaatggcgccccgaaaacgaagaagaaaatgatgaccatgaagacaatcagcccaagaatcaaccaaggccgaccaaacaaaaagtggtggcagaaggaaaatggcgaattgcgacatcactgaaaataaaaatatattaatttacaaaattaaaaaattcactaaaagaaacaaatcattaacccgagtgggaaa

SEQ ID NO: 12019 - DNA, 2007 bp, Heterodera glycines
  misc_feature (86)..(86): n is a, c, g, or t
  misc_feature (1905)..(1905): n is a, c, g, or t
tcagctgcaatggcaatgctgaaaatgtgtaacagattaattcagaattagaattaattaatataacaataatttaacactgaatnttctgtttatttaactaatgttatataatttattaaactaattaaaatgcatttttaaataattatataaacaaattccacttcctacccacctgctgctgcgcttggtgtcttctttggccggacttttgttcaacggtttcagtactttctccaacgatggtccaccagcgatatcgctgtttttggtgttgttgtcgtcggcgctactttttgtctcatccgtttgtccaagcgaattgtccatcatttggtcacggcactgcaggaccacctgatttggcaaatgatcggctgcggtagcattgctgaaacttggtggcaaatttaattcataaaaagaattaattaattaagaaatattttttcaaaaatcacaaaattagcaattttggtgaaattttgagaaaagtgcttcaaaacaagacaagtgcgaaaagcaaaaaaaatcgtcgcccgggggaaatatccaccccccccccttaagccgaaatcatgggaccgtcactgcccaagtctctaaaaattgtttccgggcttgctcaaatggcatttactaattgaattgaactcataaaaatgagtttttatacatttatataaacaaactccgctgcctgccacctgctgcgcgtggtgtcctcactgtccgcacttttctccaacagtttcagctcctcctccaacgatggtccaacgttgctctttttggggttgatgtcgtcgccgccttcttcgtccaactgttcctccatcttctttgtctgcttcttcaactccgcagaaagtggtgtaaatccgagcggacatgaggcgtacgaagaggggccaacagtgctgacgttggtcagcggattttgaaaaaaaacgctgctgcatctgtgatgaatgccgttttttccttctctgcggcgtccctctctgcctcataacgaagggcttggcccttataaaactccttcgactccttctctttctccttctccttccgctcttcttcccttcccttccgctcttcgtcccttcccttccgctcttcttcctttgccttccgctcttcttccgtctcttttcgcgattcgtcaagttgaaaatcctgtaaaaaataatttatttaataaaatttaatgttaaattgtttaatattaagccaaaatatagtcagtctatccaatctcacacctttttcttgaggtcattttctaatttggccttttcttcggcaattagtgctttttgttcttctgttaggaaaagctgttcgtgtgcctttctattctcccttttctgcttttctagttgttctttaagcggttgttcatttgagtccatgttagagttaaataaaatatttttgtaaaagatctgcagaataaaaatttaaaaaattttcccacaaaaaaagaataaatggttatattttagtttagtggataaataatttgaaattttttatgacacttttccaataattaagacgtgtcaatgagagtgagttggggattaatgcataaattctcattgctttcggcaaacttgcactcaaatttttagcaaaaatcaccaaaatgaactattcaaatttgatttgacatacaaatctcaaaaagattatcggcatagacacgtaaaaattaatgtacgacaaaaaattggacattttaataaataatagaacgcataaaaattaaaggacgcgcaaaaattgggccttaaaaaataaaagaacgcaaaaaaattaatggacgcgcaaaaattgggccttaaaaaattttttaaaaacacaaaaaattaatggacaaactaatgcgaactctanatattataggctaaaagatgggacacgtaaaattaatgagacgcgcgtaaaaaccctacagtaaattaaaattacagatcaggtcactgcaattttctattt

SEQ ID NO: 12020 - DNA, 1387 bp, Heterodera glycines
attagtgtaaagaaattgtgggagagatagcaaacggaatggagatacaagaaatggcatggctggctttggttgaataactgtgaaagtagtagagaagcagagggtcattgcgacagagacgcagagaatttgagcgctgcggggcgcataaaaattggcaaaattaacaacctcggcggatgggactggaacactcgaaacctaactcattagaaaatatgaaggacgataaaaagctagaattgtgcgaggccaaaatttttggtaaaaaccgagaccgggactgacgggaccataaatgccgtgaccagcaatttcaaccgggaacatcaggcatcgctgcggaacttttcaaaaattaatcttaaattcaacagattttcaccaaaatgtttaatttatgccttttaaaaaattttgtttttaattacaattgtaggagaaagacaaatcaacatttttcctttaaagaatattgttttttaaaataacaacatttacataaaattttgtattaaaaaattttttggcgtgaaatttcacttggaatagggtaggccgggctcggttttttgaaaattcaatacccggtacccgacccggtaggtccgggtacccggatacaaaatcggaattttttaaatattaaattatagaagtagacagtttattctgtgtagttacttttaattaaacccaaccgaaagaaatattagaaaaaccataaaattttttgaaaaaatcgaactaacatcatctggtcatgcaacggaaatggaaatttaaaaatttacgaatttatttgttttttccactttcttagaagagtgtctgttcaaatttccaataatccggcaatttctctatcactcggtgaaggagttcctttcttcattttataataaatattcattttgcttattttttcttcattcgaataccgaattccatctaaaaataataaaatataaatataaaataaaaatttaaaaaaaaatcaaattttaattcaaattttaattgaatcacacttttgtcaatttcaattccaaattcttttttccatttaatgaatgttttttggtcaatgtccaattctttcgcaaattgcttctgttttccttttcttaaccttctgtaaatctcatcaattcgttcaataaattcttgctttttcttttcataataatttttatcatttttcttaattttctttaaattaaattctttttccatttataaattttcgttcgattgattcccaattttacagcaattttttgctcaattttattccaaatttttgtggaatatttcccccgtttcttcattccctcttttaatgccagaaatttatgaataatttcgcattttttctgatcat

SEQ ID NO: 12021 - DNA, 1435 bp, Heterodera glycines
atgcttatttgtgtttgaactcgaaaaggctctaaacacgcggaaaatcctttatcaattctaatgctttaaaatgtcgtgatttaaaaaaaataggcgacattcgatgctttttgtgccaaaaactcccgggccaacactaatattacaaaattattataattaaatcataaaaattaattatttgccttcatctgtttcttttaaatctaattcttgcagcatttccaatgggattattttgcttgggcatttaataaggagcgacgccttttgttcattctgtgtcatggacatttcatccatttcatttgtcaatttttcttaattaagcgaaattaatgaatcaatccattcactcatttcattacaaataatacttgctatttcggttatttagttatttagatttattgacaaagttttttcagactttttaatgtcttaatgacaatcccaaattaattaacttttaatgtttcgtttggcctccaacgaaccaaggcatcattaattagtgcatggttaattagtcgcccatggattgattaaaatatttacctaaggcccaaaagtgtggcgaaataattccccacttctcttcggcaaacgcaaaaacctttgtcaacattggcatcgccgtgtttttattcctttgaaagtgttttctgaattcatcactttcctcataaaattcttcgaaaaatatcatttccattcgctgtacaatcatttgccatttgctcgacagtttttgttccccaaattggtccctcaaataatccaaaagttgccttaatttgatcagcaaccctttcatggagtccaattctttatttgctttgaaactctcaagattccgtttgaataatttccaatattttccaagttttgccattttgtcctcatttttatcgtctgtcaattgctgctcaaaatagttaattattttcccgcataaaacggcgagcaaaaggtaatgtttgtttagcagtgccatttttaaagccaattctccctcaaacaaaaccatcccgcggtacgccgtccttagcatcgaagtgccaattatatctgaatttgtggtgtttttattgattgaatttcgtgtctttttagcacttaaatttataaattcattttataaaagtttgattggtgatacgatgccaggtaaaatgaaagcaattttatgatcaaacttttgaaaatttagaacaaaagtatttttgtcaatttttaaaaattcaagtgaatttaggcaaccaattacggcgataaatgctatcagaaaatttgtaaaattaaatttaatttttaaataacttttttttaaaaaggcttccaattttacttaaaatgtttcattgttcgcttcttgcggggggggggggggaatgctttccttaattccctagatcaaacaatattctca

SEQ ID NO: 12022 - DNA, 3721 bp, Heterodera glycines
  misc_feature (802)..(802): n is a, c, g, or t
  misc_feature (3623)..(3623): n is a, c, g, or t
  misc_feature (3643)..(3643): n is a, c, g, or t
tttctttataaaaattcctgattgtaagtttttttgttcatctttaggctgaacggcaacgaaaaaggcagcgtaaggagcagaaaagcggcgccaaatccggtgcaaagggtgtgcagcaaacggtcggacaatggccaattttgacggtcatcagcagcagaagcagcaaatggaacagtgtcggtgtctggcaatagaaaaatctgatcaaatcgcatggatatttaaaaaaaaaataatgacaaaattttcaataaaaattatttaaccgttaaaataaaaatgctacacggatttttacagatttagtccaaaaatgaaaaatataatggtacttttaattgttttccttttttaagccagtgttgaaccataaatgcgaaatcgaaaaatttaaagtttcgactttttttcgaattcgggcctgctggggttcgaaattgatcgaaatgggggctctattgcagttctcacgaccataactttttctataagcatccaaattaaacattcttggtatcattcgttagcccaacgagtcctctattagtctgctaaatttcaaaaaatttcattgtatttgaaaaaagctatgtccaaaaatgtttcgagaaccaatttttttttaattttctggtcataaattttttgaaaacaacgaattttttttgaaattaagcggactaatagaggatttgttgggatatcaaatgataccaaaaatgtttaatttggatgcttctagaaaaaagttatggtcaattaaagttgcaaaaaatttttatggtcatgtgactgnaacacagcggcccaattttgggctccaagtacaattatgctggatttttatttagtaatcagaacgccaaaactttgcaaaacttaaaatttttttgggattttcccttgtaaaaatagaagagccgatctcgagttaaaaactagacagctaaaaaataaactgtgattcgatagagggggacaaaatatgggcctatacaaaattttaagaaaatcgcaactttggaaaaaatttttcccagggcaaagttttttctttttctctcattttgacgcactatttccatgtctctaacatataagataacacatggttcatttttttgccaataaacaatttttttaaacttttgactaattaagaaatattcttcagaattctcccttcaaaatgagcataaaatggttttatttggtctattattgaaaaagttataagctaaaaaaaattcataaaatcacgggtaaaataaaatgtttaccttttattgttcctttggcgttctgtttttattatttttttatttatttgctttaaaaaaatgaaatttatacacaaacacagaggacttgaacctgagaccccccttttggtgactaactcactgaccactaagacgaaaaaaccaacttatttgcgcttggagcccaaaattgggtaatagtaccgatcagggatggcacggaattccgacttccgacttccgagttccgacttccgacatttttggggtcggaattccgacttccgacttccgaaaatttttggggcctcggaattccgacttccgaaatttttgatgaaaagtcggaatttttcggaatttttctgagttttttttttcaaaaaattagcaatttttgtacaatttatgttaataaattgcatagaaattttcaattttttttccgacggcacctatcggcaccgccggactcaaaaaaaaacttaattttcttgaaaatttgctcaaaatcgctaaattttccattttttggacaaaatttgttaacaatttacattaaaaattacaaaatttttcccggcggcgcatatcggcaccgccggacccttccttccccacagtttctcaaattctctttggataaagcgcgccgcaaaaaaagggtgtaactttcccaaaaaaaaatccaaaataatgtaaaattacttaaaatattttgatctttttaaaaaatatagaaataaactaaaaacagtttgaaattaccttttacatggttaaaaatttaaaaatttagcctattaaatattttttaaaaatttattatattttttttgataaattccgacttccgagttccgacttccgacatttttggggtcggaattccgacttccgacttccgaaaatttttggggcatcggaattccgacttccgacttccgaaaatttttagtgcctcggaactccatccctggtggggcgtacccatagtgctgccacctccgaaaaagcttacacaaaaaatcgacgttttgatgcagaaattttataaaattaaattatagaaattgcctgaattaatggcaaattttggcgtgaaggagtgaccttacatatcaatgtaaagttcatttttatcattaagtttatccaaagttttaaaatttttgaaaatttttttttataataatcccataagaagctttacattttaccctgtattatagggattttgcgaaaaggaaaataaatattagccacgagaacgagacgccctaaaaacacgagaatacgagacgagacgaataaatcccggctttacccctcgaaaacagaacatttttgtttctaactctgtaaacgaactgctctgaaatttcaaaaattccccactgcggcgcttgtggacaccgccgtgttccaaactctcatgaaattaaaatttacgaaatcgaacaattttatgaacttttttacagccataattacctcttgatacattttcgtgttgaaaaaatttatcgggaaatttttcatgaaataaatatgtgaaaagaatcgaaaattagaatatttcttacaatataaacctattgtttttgacaaaaattgctttcttccaagaaactacgataaattatttaattgggagcataacttactgtacaagagaaccattgcattttaatagattgtcttaatggcatgcaacggctatgtctgccatgggtgtaattaaaaacaatgacataaatagatcgtgcttataaattctaaaacattattctgaaaaaaatgggaggacaaggattaccgtaagaaagatagtaatttccatctgaaaactgaaaagccacgaaacgcaatatgtaatgaagaaagtcaccattacaagcagtacaaatttaaacagttttttcgtcacttcccaaagtttgcttctccaccgttggcgctgcccttcgctcggcacaatgccacgctccacatcaaaagcgctaccattttgtgccacatttggtgccgacgtcgctggcatttgagtggtcgtctcaacagattcagttgttccattagattcatgttggacttcaatttctgttatttctccaaacccactttgtaaagcggaagttgatccatttggcacattttcatttggcacacgcttaagtcgcctatgatacgaaatgggaacggttttaattgattaaaagaaccgcgtgaccaaaaagctattcaaatgaacatttaatttttgctgtttatttgcaaaataatccggcataagaaaataattcacaaaattttttttttttgaaaatggcatttttataaataaggaattanatattggatcaaattactangggatgcgatttctaggcacaaaaatcgcgaaacaggcaccctcaaaagtccgaaaaatctcaaaatagtaaagcttt

SEQ ID NO: 12023 - DNA, 4870 bp, Heterodera glycines
ataggaaacagccctcagtttgggcaagtcgcggtatggaggaacaacggcttgagactgaccacgacgatgcaagcgaggattgactggggggggggggggtggataaaatgaaaaagcattttgaaatttcaatttcaaatttacgatgggcaacggctcgagcaaagggccaatccaaagaatgacagccaacaaaagtgtgctggagaacaaagcatggagctaaagcaaatctgtcactctccaattttttgtgcttttcaatttggacctgcgttttcgcccctaacatttcgcagagcgacgaacgcgacagagaagcgccgaagggatagacggggaagaaggagctgagcaacgaactgaggcccaacgcgtacaactcctggttggcattcaccgcgtacttgtgacgcttggcaaagattttctccagcgaaatgacaaaaacgtaacagatgaggccgatggagagcacatttggccaaaccaaaggcagcaaatcccagcggggtactgtggggagtggcatactgtacagggaggggagaggaggggtactgtaatggtgggacaacgcaaagtggcaaaattgatttactgtctgaaaaaactttgaaaaattgtccatttgtttgctttactcacccatttggaacgtgttttatgattttgacactgtgcttttcttcaattttgaacagcactgagaatccgattgagaagatcacctttaaaatttaaatttaaaatttgcttaattttaaatggaatttaataaattgagttaatttttccttaccataatcagttccaagggaagcggcacgttaaaacgttttcggaagggcgggttcaaaaagtcgcggccaacgctcaaaaaaacgatgccgcacagcgaaatgccaacggtccacaaattggcatgccaaaatgaaagtgacaaatcgcgcaacatctgacaaagaaattcaatttctctacaatttttctccgtattattgtcataaaatttatcgaaatgtcttacgaaaatgaccattcccgggcctccgtacggtttcgatgccacgccaatcagttttggcacttgcgcgacgagcacgtgaaaagcggccgctgttgtaaagccactgaccagcggatcagagatgtaaacggtcagaaaagacagccgaaagacggccattgtaagctgaacattgtaaaattagttattcatatggagtgagtaacagaatataaattgattaggctgaattaattattcaaaaaaattgggcaattaggcagccattgagagggaccaagccaaaagagggaagggattgggactattaattaattaatacctgaaaaagtcccgctccaaaagtgattgcactggtcaccaccaatgggttcagatcagcgccagaaagtgccgtggtattctctgtgccatttgtagtcaaattgcttttgttatcggcaccattcaaatgcaatttcgccagagtattgccaaccatcatactggcaaccgcaaatgtgccttaaatgattttattccataaaaaaatataaaataaaaaattaaatatattaaaaatagagaaaatattcgcaccaattgaaacatgaaatgatgtgcccaaaaacagataaaacaaggccgcaaagaagcaagtgtaaaggccaacagccggcggaacgcccgccaaagttgtgtaagccatcgctaaagccatcacaattatattattttaaattgtactaccattaattatttttaaattaattaattgaatttttaccgcatccgccgcaaaaatggcagtttattaattgtaacattattggtaaataaaaacaaaatcaccttgtggcaccaccataatgccaattgtcactccagtgaccaaatcactgtgcaaattgctgcgcaaattgtattttggcagccatccgacgatcggaaataatttcgtcaccacctttttcgggcttgtggcacgaattttcgtcgttagcattctgcaaaatttctctttggctgtttcattttcggatgaattcgaatttgtggacataaaataaaaattttgcagaaaaatctgattaaatttggagactaattgagagggaattttttaaattatttggagaaagttatcggagagtaaacaaaaaaaagaaaggctaacgtcaggaatatttaaagaaggaaaagcgaaaagaaagcaattcaaagaaaagcgcaatttaaaaagagacaaaaataataatgaaaatgaagaagagaagggggcaaattagcagagaaaagaaagagtaaattaatggaagtttaagaaaatcagaggcataaaactaattaatgaagcaaatattaagattttggaataataaataagtaagtctttcttaagaatttcgttgggtgggaatgttttggcgtataaattactaactttataacataattatacttaatgactcaatcacatttcttgagcattctctcccccccccccgcgtcatccttcttctcatgctgattccgctgatctgctgattctctgctgatcgtcgtccgttgatttgttgtagtcttcgatggttggctgatcgctctgccaaagtttgttcgatttgtttgcgttttgcgctgtttcgccgtaccaattggcgttgcattacaaacaataaatgcggcgccacccgctaattacgttggaccaaatttgtgttaaatacccaaattgggaggggggaggaggctacgcacttcgcaccgattgatggattgaattgatcgaattgcgccgatcgcccgcgggtggaagaggggggtaattagcgtttggctattaaaagacaagtcctcggcactttattattattattggaaaattaaccataaatttattttaaaaaattttttggggtttctgtcttaaataattacaaaaaacatatcgttaatttgcttacaagttaaaaatcgaaaaccgaaattttatagcagtttttaaataagcatattctaagtaatttatatgaacagcaaaagagcaatgaagaaaagtgcttaaatgtttacatgaaaaatttatagacttattgtaatttacttatcattgagaaaattaaattatggaaaagggcaaatgttgtgattaatttccgcatgtttcgaccataaggcgacaaaaaaaaaagaacaaaatttgccaaatgacgaaggttgcgcagcaaaaaagtaaaacactcgaaataattgcagtgaaaagtcaaaaaatcatttgatttgattggcgaatgaacgaacgactcgagaaaaggcaattattaatcatccaaattgtcactttaaaagtccaaagacttggccattagtgaattcaaaaattcttttttgaagtgtcctccatccttttaattttaactcagacaaaaaaaaagttttttttcaatggcaacgacaaataatttaatttaatttaattttttaaaatcggagataaattcataacttaaatcaaataaaatttattgaagctatatattaaaaaaacttatcaacattaaaaaaaacagaattttaaaattttttaaacttgaaaaaatttatgaacactcactccatttaagagggtcgccaaaaatccaaaattaatattcttttttgttccattttttcatgttttttcacagaataattcatctctcagttttggatgatagcacgcttgagaaaagaagaaaaaatgaaaattaaataataaaaaaaaacaattttatggatacaatgactttgattatacaacaaattatgggaatttgaatgatctaacaatatgcaaaagatttatcaaagactaaaatttaaaatctaactttcttctaaaatttaaaaattaaacttggaaaattaaataggaaaatggaaacaaaaaatcggaaggtgcctattatatttaagagaataaattaattttaataaaaaaatcgaatcgaatatgtgattcttattttctaggatggtaaacgaaaccaaacgctttttaatcattttttaaatttttgttcattttttaattttaaaaatttatttttgtttcatcaatcgaaatccaagtcttctttttgccgcgttcattttccgcctttgtattgggacgagcgatagtcgggatggcacaatgagtgaatttgttggtgaaagagcagtggcagcagcctttgaaggtgcagctgtggcatcctccgcagcacgtcactccgtccggcgtgccgtcgccggtgcacactccgctggggtcgcaatggatctgatgaggggtaattgggtaattaagaggtaattaattaattattggaacattaattagtggagaaattattaatcaacccaagaaatcaattaaactcgccaatgccattccgatgccggaccgggcgaacagacacaacaaaacaaggcacaacttcgttttaatttttgtatttattatttaaatttaattacttctgaatctcggtaataaggagccctaaattatcactgatcacattatccattatgttcagataccaatttttatgattttattttagtttttctttttttctccgttggtttactcaataaaataaatggatttttttcaccattagcgaaagatgccatcaattttttcgcaatcatcagtccattttcattcgtaataaagctaatgctaaacgatttgtgatggccaaaaaacggttggctcggactttgcgatcgttttccccccgccgtccctcgcgagtgcggcgtttggcttttaatggacggacgaaccccagcggcagctcattaatattcagcagtcccccc

SEQ ID NO: 12024 - DNA, 1163 bp, Heterodera glycines
caattgtttttcggttaagtttaacattgtttttggttaagttttacaattgtttttcggttaagttttacaattgtttttcggataagttaataaaatacaattgtttttcggttacgttttacaattgtttttggttaagttttacaattgtttttcggataagttaataaaatgcaattgtttttcggttaagttttacaattgtttttcggataagttattaaaatacaattgtttttcggtttagttttacaattatttttcggctaagttaataaaatacaattgtttttcggttaagttttacaattgtttttcggataagttattaaaatacaattgtttttcggataagttttacaattgtttttcggttaagctttacaattatatttttcggttaagttttacaattgtttttcggttaagtttacaattgtttttcggataagttattaaaatacaattgtttttcggataagttttacaattatttttcggttaagctttacaattatatttttcggttaagttttacaattgtttttcggttaaattttacaattgtttttcggataagttaataaaatacaattgtttccggttacttactttgctatgaaatttctggaaaaaggccaaaataggtgctaaaattcggaaatgccaaaatagttgggtgccaacccccgttttaggtgtttttaggtgctaaaaagtcgctctaaatcaaaaatggttcagtgaaaatgtgatttttgtatcctctcatatttcaaggtatcattcaatagctttaaatgatatctatcagaacatgagttacaaaattatcccttaaatataaaaaaaaagttattttcacaaaatttcaaaaaaagaagtcagaaatttttgtccaaaactttttttaatcttatgaaattttctgaaattttaaagataaatagagaattcttacggttatcgaatatataaattaattttggctcaattgcactttaaagatttgaaaattttaaatgtttataattaaatatgaatgatcattgcaaaaaaaaacataggcgtgtttaatgctttataacgttttttatatttaaggaaaaaattttgtaaatcatattctgatagatatcatttaaagctattgaatgata

SEQ ID NO: 12025 - DNA, 3688 bp, Heterodera glycines
tttcaaaacgaaatttattcatttttgagtatttttcattattcatgatttattattattctctgcagttaaactcaataaaaattatcaccgaactaagaaatcagccatttgataaggattttttaataaatacacacaaaatgcaattgtgtctttcgattcatttttcgatttgccactttattttacagttccgtaactaatcattctgttaattaatcattcgattttctaattatttcctttttctccaatggtttctcccaaaatgaattcttttcgactttcgcgttgccaagcccttctttccgtcgctttggtcgttctcagtctgatcaccataatttcccttctcatcgcaattctcgtcacgcaaattgcgacaaaatatgagcaaaacccgaaggaatttgggacagatggtcagaaatgaaatggaaaatgtatttttgtaagtgaactgatttaagagatccgttcgtccatcttcgccaatatcaattcggataaaatagcggccaatttggaggcattcgctgagaagccgcacgtcacggggacagaagcaaacaaaaaggtggccgatctgataatggaaacatggaaggccaacggactcgagggtcagttgagggacaaaaagcaaaggcatttcgagaatcagtctcgaaaattcatataaaccacccgggagtcagtctcgaaaagccacattcgagaatcactctcgactctctctccatggccaaatgcccatctttcccctgttaagatgtccaccaaatcccttacgaagtattgctttcctaccccaaatacgactcgcctaaccacgtgtacgtgctgaacggcgacggctcagtcctgttcaagacggtcggacttagtcctgacttgaccggggcaagctttgggtctcacaatttaataattgactacggtattgcatttacagaatgacagtagccccgaggcgagcatccaatggttggcttattcgccggaggggacggtgcagggacagccgatttactgtaattacggaagggtggaggactttcagacgctggagaagcaattcggaattgccaatttgaacggtaacaattattattaatatttaaattgattttatataaatgatcaggcaaaattgcggtgatgcgttacggtagaatatttcgcggggatatggtccaccacgcgtaccagcggggggcggtcggatgcattttgtattcggacccggcggaaatcgccgcggaggggccaagtgaacaaataataaataataaaaaaatgaatatgtaataaaataaaaaataaataaaataatataatccatataaaaattagatgagacttttccgtccaaaatttggctgccgcccaacggagtgcagcgggggtcgacacagaaagtgcacggggacgcattgagcccattgctgccatccaaaaaagactttcacagggaaaggacaattgaagaggcaagcggcaaattaaaagcggaaattaaattcaaaaatacaacaaaaaaacaggtgaaaagggaccccgagacattgccgcaaattccggcaattccgctcagttacggcgacgcgtatgaaattctgtcgcgcgtggatgggccggaagtgccgaaagaatggcagggggcgctgaacttcacttaccgagtgggaccaggcctaaaaagcggacgaggccaaacggtgaaagtggaggtgcattccaagttggaagtgaggtaattagggggtaattacgaggaaaataaattggggaaaagtcaaggagaataatgaaaaatgaggaaaagccaaggaaacggaaaaaatatttttaagcgaggttagggttggtagaggtcaggaattttaactaagccaagtgcgaaagtgataacgtaaaacattgaaaatgaataaaaaatggaaaagaaaaacaatttattcacaaaaaatatttgtccaaaatattaattaaaatttggcattttgccaattaataaagtgaagaaatgatcaaacttttcattatgaagatgccattcccacattttccttgtaggcccattcaaaatgtgatcggatacatttggggcagtgaacggcccgacgagtgggtgatgctcggcaaccatttcgacgcgtgggttttcggcgccatcgacccgaacagcgggacggccgtgctggcggaggtggccaagggattggcccaaacggtgcgcaccaccgggtggaggccgaagcggacgattgttttctgcgcttgggacgcggaggagcccggactgatcgggtgggaagcactcactgattatgcataattaacaaaactgatcacacacattgacaaaactatatctagtatatattttaactttcactaatttttgatcatagatcgaccgaatttgtggaggaatttgcggatgttttacgcgagagagctgtcgtttatttgaacgtggataatatttccagcaatgtcacactgtgattgaaattgcttaattaatcaattattataatgattaagcaatattcatgctgtgccctcgctttaccaagcagcggtcgatgcgtccaaatcagtccaaaacccaaatggccaagggtcggtgtttggcccgtggattgagaattacccgtcgagaacgagttggctcccggatttccctcacatgggcatccccgggggaggcagcgaccaaaagtgagtgaattgtgtcgctttgatcactaatgagggcggagccgttggacaattaaaaaacagaaaatccaatttttttagatcttttctcgactttctgggcattcccgtgatgatgatcacttacattgaccccaaacgtggtcaatacccgctctatcacacgcgttacgaattgccatttgtcaacgaacacattttcgacaacaatcagttggcggtccgtttctcaaacatttttttttgcatatttcgaactcaattctttaaaattcaggtgcataaagccgtgggcgaatattgggcggaattggcacgtctttttgccgattcgccgcttttgccaatcagtgcgaccactttggcacatcgattattggccgactatttggaggggatcaaaaaagttgctaaattaaattcaatttgaatttcgttattatttattttattcagccaatcttggatttgagcagccaatttccgagtacgtgtggaccggcgaagacccaactggacaatctgatccaaaatgggcaccaatttatggcacaggcggaagagttcgaacggcacgcccaaggccaaagtgcgggtgccaatttggcccaattagcgtgggcaaatgaccgactgagaaagttggagcaatgttttgtgaacccggcgatgggactcgcgcgggaagaaccgctcaaaaggcacgtgctgttcgctacaggaaatgacaacagttacgcggccaccacactggcaaatgtttacaacaaagtaaataattattaaaattaacaaataattaattaatcttttattttgaaagattggccaatttcgcggtgcgaaaagcgacaacgaacgcacaaaacggggcaatgaattggccttggaattgaccgttgtgcagcaggcaattcgctgtgccgtcagcacacttagcaaaggcatttgataa

SEQ ID NO: 12026 - DNA, 1592 bp, Heterodera glycines
  misc_feature (1435)..(1435): n is a, c, g, or t
  misc_feature (1463)..(1463): n is a, c, g, or t
  misc_feature (1485)..(1485): n is a, c, g, or t
tggtaaaataatttgactgataattctttgaccatttatgaccaataactttttgttacttttggaataaaattttccccatttctattctgatacacaacacttaatgctagtgagtactacccatcattatgaatttagatgatgttgggccaagatacgagtttgtatgacatacattttttattttactacaaatctgccagcatttaagaaacgcccacttggcagtatttaagaaacgcccacttggcagtatttaagaaacgcccatagtggcagtttttaagaaacgacctagcacccatttgaaggtgcatttgcgcgtccacacgggcgagaagccatttgaggtgagttacggatctttggtttttaaaagtagataaaaaacaattttttgttttattaaatggatgaaaaaccgttcaagtttaaaaaagaaaaattattttctaaacttattttttaacaaatgaaatggagtaatatttaaactaaataaaaataataattaaatgattgaatttaacttattttttgattaaagtgcgaattttgtgagtggagatttgcggagaaaggaaatctgatcaagcaccgccgtacacactctggtgagaaaccgtacgaggtgagttacggatttgtgcgatttaaaaatgaagtaaaatattttatgaacgcctgtttaaagaaaaaaataataaataaatattattattatttttaaatgttttattaagtgcactgaatgtgggagaacatttgcgcagaagggagctttgcacattcatcggcgtacgcacaccggggaaaagccgtataaagtgagttgtggatttgcggttttttaaaaagatacactaatatgatttatttgtttttagttttataaataatttgaattttaataatatttattaatttctgatcaattcagtgcaccgaatgtggccgagcatttgctcagataagcaatttgcatgtgcatttgaacagaaaaaaaaagtgcggaaagaaatgatcaaatggaatttggaatttgatttcattttaattgttgttggttaagccatttttattgtcgttgttttgtttttgcgcattttccattatttgttttttcggatattttccgttcctttttatttttgttttgtaatttatcgtataaaatagcacacatattctcttcgattccattctgtttttttagaatatttttttttgaaaatgcacaattaatatttttaggaaaatttatttatttttttgcattttaattaataaaatttaaatgaaaatttggtcattagtaatttgatgaaattttgagctttgatttgtccattttgtcagcacatttgactgcattgcgacggtcgtttaatgctcattaaacttgggtctaaaaaacaattaataaaattanatttacaaaagtttaaaataataattanaattgtaccgatttggccgatncaatagacgaacctccggcgtcgttgcaaccgtttggatgcttttatgaagcgaatggattggagaaccaagaaaaattgtgtaaaacatcccaacggaaaccaaaa

SEQ ID NO: 12027 - DNA, 1068 bp, Heterodera glycines
cccctcgtttaccctgaatttttcattaattttagggtaactaattaaatattttaaaaaaatcaaagggatactgaagaactcatttttcctttaaaattggcctctgaattttcttacccaatctgagcacaattgacggttcttccttaaacgaatttaaattaattattttttaaatagttttattaattattttaattatttattttttgaaaattttttctcgcctggttgacaattcgtttttcggcccctattttttgttttttcgagtttaaaagatggattctcttctcgttctcctcatcattgtcaacgggtggcagcggacgaacgacgccaatgctaacgccaaaaacctttaaaaaattacaattttaattaatgcaattacctaattagtaaaataataattaagtaaaaaaaattatcatttattagttttacaagtaaaatgacaacaataattagtgtaaaaatattagtaaaaaaaaaatttctatttattttattagttgttatttgaataaaatatttttaatgaaaattttaaacaaaaatcaaaaatggattatttcttcaaaacaaattgtaaaaaataattacagtaacaaaaatgatgagcagtacacgaagcattacggtagggtacagtagttgttcacgtcggaaacgcacaccgacactcatcagcagggaactgagcccgaacagaacggaaattgagcacaatgaaaggtcgaagcagaagaagaagccttcctgaaaaggtgagaaaattatttgcaattagtaatttttaaaatttccattttaatctttgatcacttaatcgaaaatgattaataaattcattgagtgatcactgatcaatgtttagtttatgaaatgtctgatcgaatcgaaaactcatgcgagaagagccaaatgaatgatcagcacaggacatcaaaatcataaacacaagcattaattagttagtgtttattctgatcagagatcaaattgcggttcgattctcgagactgaatttattggtctcagacaatggattaacttgcgagt

SEQ ID NO: 12028 - DNA, 1595 bp, Heterodera glycines
  misc_feature (51)..(51): n is a, c, g, or t
gatcagatgaggccaagtgccacacgcgggtggccacacgcactcggccanccgagaaatttgaggccggtcggaatacggcaaaagcagcacttccatttctcgtggtcgggatcgaagtccatcagaaaagcttttgaaaatttaaataacccagaaattaaaattactaaaatcccttgagggattttatattgaagtttatttgtccaatggaaaagaagccttgggaaaaactaaaaaaatcaaatgtaaattagagaaaaaacaaaaatcaaaattttttgaaaattgaataacaaaaacttactaaatttgaaaatgcttttttatagttaattttgcctaaattaaaaaaaacaaattcaaattttagagggaataaacggcgcccccacaaagtgtccaagccacgaaatgtccaaaagagtaaaaacccacgaacaaaatttttcaaaatttataaaaacaaaatgagtctaatttcgaatttttagggttttcggggtcgctgaatacgaatatatacgaatataccctttatattaccccttgcctaaccttaggcccatctgaataataaaaaactcaaattcgagacttggacattttgtgggtcagcggaataaacaataaaattcttaaaaatttattcaaaaactaaagaaaaagaggaaaattatttttcgttaagcgaaactttcttagaaatgaattgattaaatttcctgtgagaattaaataagaaaaaatgaaaaagtgattttattatattggaaatatctggccaataaaaagcaaaaaatagccaatggaattttggccagccaaaaagtaaaacgacagcttaatgggctatcgtttaggcgttaagtgatttattagccaaaagaccgatcgttggccatcaaagcagaggcgagatgagtaattaatgggccgagaattaattggtttttcttttcctgtggcgtatttgtcgggaattttatttgaatttccgattaaaaattaaaaaaaacgtaaattagtaaaatagaaaaggtacttttgtagactgactgatatttttcgagtgaaaaatcaaagatcgacggtattttgattttcgaaatattgtaaatccgaaattccggaaaacttttttccattggcaaatgcgaatttccgaatcgaatatgattcttccataacatgtgctatcatttaaatttcccattcttcgcattcattttttttttgcaatttcagtgccaaatttcaattaaaattcatgccaaaagacactctcattaaatggtagtggaataaaataattttaaaaaatttaaaattaaaaaaaaattccttttcccaagccaattggccaataatttgttgtgacatatggcggcggaagggctttttgttcttctcacgagggaatgaatggataaatgaatggggatgaggaagtttagccccccggggggagggggtaaagccaaaggaatttttggatggaatttgggccaaaaagaaggtaaaatagcagaagaagaagcaaaccgcgaaaggcttcttttaaacagcatcatcacacaacacataaagca

SEQ ID NO: 12029 - DNA, 1539 bp, Heterodera glycines
  misc_feature (741)..(741): n is a, c, g, or t
aatgaaaaaagaaattctcaaaaagtttctttcgtggcaaaaaatttttaatttaaaaaattttttttaggtaatctattttggggttttttgatcttaaaaattccagtcctactcatttgcaactgcaatcagtgaataaaaattattttgctcaatttttggctgaaaattatgtcactattcgtcactattttggactttttggcactatttcagcatttttactcactattttagttaactatttcgagattttaagtcactaaaattcccatccctattcattatcatttcactttttttattgcgcacccccccccccccccagcaaatttgctgatggcgagtcgagagtgttggcgaaagtcgagaaaataaaatttaggacgcctggggggcatttgacccgccgagagagagagcagaaacaagcacaaaaccggtggaaagatgacaaactgctctgattggaagatgggaaagaaatgatattgggagtgatcaatttcgtcggtctctcgcccaatcattttcaatgccatttcattaattgatttgatcacttcgtttgtctgatcagaccggtggaacgcagacaatttgataccaaaaaaattattggtaaaaatattaaaatcaaattttcaatatttatttatttatcttttacgatcaacgggacggcaaagtgatcaacaaaaaatacaccacgggtcatgttgctattcgggtagcacncaagagtcaaattcactgaaattcgagaccagcaattcacttccgaagctcaagagccgagtccgataattaacccccatggcttaaaaagcccaataacaatgccgagagacgggaccccccaaaaaagccgagaaattttctagcaccgtttttgaaaactcatttctaatgttgttgtttttgttttcaatttggtgaccccattttcacgcggggaaaggaactcgtcttatcggttttgtcgtcgttgtcaatcgtcgtttttgcccctaccatcgccatcgacggaccatcaatcgtttcgttttcccatatttttccataagtttaaacagtcgccattttcgccgatttgatcatttctcctcccccattttcacattttaaaatgtttgctgtttgttggtgggatgttcacacaacgtgatcaaatcgtaagattaaattgtcaagaaatgtgagaatgtaaaatgggaatttgttgtacaaattgtcaggcgtgggaagaatgaatggaattctctgtttttggctacctatttttagtgtcggaattcgattaatttcctaattttgtaaaattcaaaaataaattaatttttgcattttttttttttactttttttggattttttatgcaatcggcaaatatttgttttttgacaattgaagaaaaattaattagaacatttgaaatttaaatctcttccttctttcctttagcatgagacagtaagcaaaatggagagaaatgaagagaaaaagataaaacggaacgccatttaaaattttttc

SEQ ID NO: 12030 - DNA, 2193 bp, Heterodera glycines
tattactggttgagcagaaaaagagatagccaattttccatatttttcccaaacaaacgcgccgagaaacaaattccagaacaattagtatcggcgtaattgttctgagaatgcggttggaattcctattactgttgagcagaaaaagagatagccaattttccaaatttttcccaaacaaacgcgccgagaaacaaattccagaacggcgtaattattctgagaatgcggttggaattcctattactgttgagcagaaaaagagatagccaattttccaaatttttcccaaacaaacgcgccgagaaacaaattccagaacggcgtaattattctgagaatgcggttggaattcctattactgttgagcagaaaaagagatagccaattttccaaatttttcccaaacaaacgcgccgagaaacaaattccagaacaattagtatcggcgtaattattctgagaatgcggttggaattcctattactgttgagcagaaaaagagatagccaattttccaaatttttcccaaacaaacgcgccgagaaacaaattccagaacggcgtaattattctgagaatgcggttggaattcctattactgttgagcagaaaaagagatagccaattttccaaatttttcccaaacaaacgcgccgagaaacaaattccagaacggcgtaattattctgagaatgcggttggaattcctattactgttgagcagaaaaagagatagccaattttccaaatttttcccaaacaaacgcgccgagaaacaaattccagaacaattagtatcggcgtaattattctgagaatgcggttggaattcctattactgttgagcagaaaaagagatagaagatgcggtttagttgcacagattgttgataaaccgtgccgtaaaatatggcaaagatcggtttatgatgaatcaccacaagcaatatcagcacgagataaagcttggaaaataaacgctgtcgttgagttgctgactgcgccaaaatttgttatgtccgaagataacaaattaaataagtttatttgccggagaaataaataaaataattaatgcagagaataaattggagaggtcaaattggtgggcacaataatcaactgaatgaggggaatgggagggggaagatggcgaagtggcgtggggtcatacacctaatcaataattacttccttctctaacaattactgttgagcagaaaaagagatagccaattttccaaatttttcccaaacaaacgcgccgagaaacaaattccagaacaattagtatcggcgtaattattctgagaatgcggttggaattcctattactgttgagcagaaaaagagatagccaattttccaaatttttcccaaacaaacgcgccgagaaacaaattccagaacaattagtatcggcgtaattgttctgagaatgcggttggaattcctattactgttgagcagaaaaagagatagccaattttccaaatttttcccaaacaaacgcgccgagaaacaaattccagaacggcgtaattattctgagaatgcggttggaattcctattactgttgagcagaaaaagagatagaagatgcggtttagttgcacagattgttgataaaccgtgccgtaaaatatggcaaagatcggtttatgatgaatcaccacaagcaatatcagcacgagataaagcttggaaaataaacgctgtcgttgagttgctgactgcgccaaaatttgttatgtccgaagataacaaattaaataagtttatttgccggagaaataaataaaataattaatgcagagaataaattggagaggtcaaattggtgggcacaataatcaactgaatgaggggaatgggagggggaagatggcgaagtgatgtgcggtcatacacctaatcagtaattacttccttctctaacgatactgttgagcagaaaagagatagtcaatttttcaacttttcccaacaaacgcgccgagaaacaaattccagaacaattagtatcggcgtaattattctgagaatgcagttgggattactattaatgatggacagaaaagagatagtccattttcctaattttttccccaacaaacggcggccgagaaaacaaatccagaaaattagtatcggagtaattggttctgagaatgaggttggaattccta

SEQ ID NO: 12031 - DNA, 4527 bp, Heterodera glycines
ctgtggcatcgcccgtctccgggagaagtctttgagaaacggctgctcatcaagtacattaggagaacggcaccgatccgatcaccggccacaaacttgacacttccaacgtttgtgttttgggtggagaattttcttgttatccatgcctaatttggcacttttgtcccttggacccgtgcctaatttctaccattgaaaccttttctggttaacttttctccacgtttctagttggtcgagctgaagcaggacccgggcattcgttctatgcaaaagtgagtccatttatagtgccgttatcagagataggattacagccggaagagcctccgaacttgaaaatattgtcggaaatattgggattctcaacgaatttcccgtttaacaataattgttacttaaccaaatcggttgaatttttcaaaattttttcattaattttttttgaaaatcaaaggattttattattatgactagggcccagattcttagttttttaactattttttctgcggctttatttcgatgagaaatgcacaaaaaacacattttaactcggaaattcttcgttttaacgccactattcttcactaggaatcactattttggagctttgccattaaaaaaaaattattttggaagttggcactaaatagttttttgccactattttggcatttttttggaaaatttcccaaaaattcaataaaaacgaacaatataccccaataatcgacctaaaaaaatcaaaaaatacacccctaagaatcgacctaaactttttcaaaaatacacctctaagaattggaaaattttctcaaaatttcttccccaaattttttttcttgctcaatatttgctaagaaaatattggaaaggaaatgttcctcatttgtgactgcaaacagtgaataaaattgtttgccttaattttaaattattttcaaattaaaaaacagctatttaaaaaattacacccctaaatttggaactttttcgccactattttgccactattttaaatttcgcgacatttagattgacgatttaataaaacaacgttttccattccattttaaggccgttggccaccgcctcgttaccttcgcttctcaccggccaaaacggcaccgacacttccaacgtttgtgttttttgtaatgaaaaaatttgacccaactttggatccgttcttaatttctaccattgaaaccttttctggttaacttttctccacgtttttagttggtcgagctgaagcaggacccgggcattcgttctatgcaaaagtgagtccatttatagtgccgttatcaaagataggattacagccggaagagcctccgaatttgaaaacattgtcgtaaattattgggattcttaacgaatttcccgtttaacaataattgttacttaaccaaatcggttgaatttttcaaaaattttttcattaatttttttttgaaaatccgaaaggattttattatttaagacacaaaattcgcgatatttggattgactatttgataaaacaggattttccattttaaggtcgattacttctggtggtggctcttttttggcgtttgcaaagctattagctgagtggaagtggatagtggtgtgttttgctttacaacttgccttctaattgacactaaatatgacttttccagattaataagaaatttcaaggaaacaaatgaaaattttcactaattggaaaacattttcaaaaaaaaaatcataatgaatcttggaaaatcgctaaattacgattattttatgaaaattttcctgtttttttatttttctggggggacgaagcgcgtgaaacgtcctgctctgtaaataaacatttaattgttttagattttgctgatcgttttgcaactcgtgttgggtgttcttgcggctgacatgtccaccgcgtcgtgcaattgggacgtgaaaatgctcataccattcttgtcgattttgacggggctggtagttatttttggttttatttgggcgatcgttcatgtgttggtgaactccaaatttgacgttgtattggcaaaaatggaagcgatgaaatcggatcagagggcagaacttcgtggagaaatgaaaggaattcgtggagaaatgaacggaattcgtgaaaatatgaacggtctgcgtggagaattaaacggtctgcgtggagaattcaacggatttcgtggagaaatcaacggaaagttcgaaattatgaaaatcgaattgcgtggagacatgaaaggtctgagtggagagatgaacgccatgaagtctgaactcaatggacggatcaatgttttgcaagcagagatgaatggaaaaagatgaggacattttgtatttcacaatattttgacagattttatctcagtcgtttttcttgttgtttagaatctcaatttatcatttacatcgtgtttattccgtaaatgagtatcaataattgaattaaaatttttatttatctattatacattcacattgtgttgttgtctgacaactgtttgtgtaactgaattattttacctgcatgagcattagtcctgaatgggagagccatggttatttattatgttttttaagatatcctttctatttgacaaatgtcccgttttgtgtgtgctatttctggaaatgagcccgaggtggctgtggcatcgcccgtctccggagaagtctttgagaaacggctgctcatcaagtacattgaggagaacggcaccgatccgatcaccggccacaaacttgacacttccaacgtttatgtttttgggtggagaattttcttgttatccatgcctaatttggcacttttgtcccttggacccgtgcctaatttctaccattgaaaccttttatggttaacttttctccacgtttttagttggtcgagctgaagcaggacccgggcattcgttctatgcaaaagtgagtccatttatagtgccgttatcaaagataggattacagccggaagagcctccgaatttgaaaatattgtcggaaattattgggattcttaacgaatttcccgtttaacaataattgttacttaaccaaatcggttgaatttttcaaaattttttcattaatttttttttgaaaatccgaaaggattttattatttaagacacaaaattcgcgatatttggattgactatttgataaaacaggattttccattttaaggtcgattacttctggtggtggctcttttttggcgtttgcaaagctattagctgagtggaagtggatagtggtgtgttttgctttacaacttgccttctaattgacactaaatatgacttttccagattaataagaaatttcaaggaaacaaatgaaaattttcactaattggaaaacattttcaaaaaaaaaatcataatgaatcttggaaaatcgctaaattacgattattttatgaaaattttcctgtttttttatttttctggggggacgaagcgcgtgaaacgtcctgctctgtaaatgaacacttaattgttttagattttgctgatcttgcaactcggcttgggtgttattgcggctgacatgtccaccgcgtcgtgcaattgggactggaaaattatcctgtctattgcagcgtttttcctcctgtcatgggtctctgttttggtattcattgctaactcagtgaaaggagaattgtccgcaaaaatagacggcgtgaagacagagctaagggacaaattagatgttgtgaaggcggagctcaacgagaaaatgaaggagatgaacgataaattcaacggagctcgtgtagaaatcaacggaaagttcgaaattatgaaaatcgaattgcgtggagacatgaaaggtctgagtggagagatgaacgccatgaagtctgagctcaatggacggatcgatgttttgaaagcagagatgaatggaaaaagatgaggacattttgtatttcacaatattttgacagattttatctcagtcgtttttcttgttgtttagaatctcaatttatcatttacatcgtgtgtattccgtaaatgagtatcagtatgactagtgatagtccaatttcgcagagcaagaacgccaacgacaacgtgctcgactccgttctcaacagaacctggcccgcctgttcgtccgcccagcactgaccaaagaacaactcaaggagttgaagaagaaatcctcttagacaaggcaattagccaattgcaatccttccaaaaacaattcccccaactttttaataaatagttctgcgaagacctccaacaaaacagcccattcgatcccactccttattcccaaatcgtcatttgatttcttcattactagggatgggatttttaagggtgaaaaagtccaaaataaggccgtaaataagggcgaaaaattcgcgaaaagggcgaaaataagatcgaaaaagtcaaatttagggtataatttttaaaattgctgttttttacatgaaataatttcagactaaggcaaacaattttattcatt

SEQ ID NO: 12032 - DNA, 979 bp, Heterodera glycines
  misc_feature (14)..(14): n is a, c, g, or t
  misc_feature (902)..(902): n is a, c, g, or t
agaacacaaaacancgcgctacacaaaacgacggacggcacagaagcgaaaggcgcgcgtgccgcccgagtgcgttcagctcccgtacagcacggcgttgatctcgcccatgatgtacacctcgcgcccgttgtacctcctggacaggtccttctccaactgaatgaaagggacgcaaaaattactacagattttggtatacaaattaaaaatgcaataaattaattaattccccgcaaaaatgtcatcaattttatttgagtattttttatttctttttgtttaataaatgcactttgtaatatataaaagtgcgcttttcggtgaatgaatagaaaaaaaacaacagtttacacaaagtaagagagaaagagcgaacactcacagcaaataacacattttgcccttctttttttcgcccgacaaaagcgtaaatatttacggccgcccgcgagttttgggtcaaaacaaaaacagacacaaattgattcgaaaaaaggagaaagggggaaataatcgaagcaggtcgtttccccctctcaaaaaaatatattattttttaaactacagcgattttttcaaaaaaaatccctgaaaaaatttccaaaatttttaaattgaaattttcttaagaaaaaagtaactaacaataaactttttaaaatgtctgttttctttccgaaatgtcacctcctcctgcagccctttggccgcctccaccactccgtccaaaagtttctgtgccgtccgaatttcctccgcgcattgcgtgtgccgtcgtgcgcacaactgctgctgctgctcgtattttgcctccaggcgacgcttttgctcaaaatgcgcgacaatttcgtccacaaacctgtggcggaggataaattgataaaagaaaagcaaatganagcattgaagatgccaatatttttgggagtgccgtcgccaccgggtgggcaggggccaaaactcactgaggcgacgt

SEQ ID NO: 12033 - DNA, 4237 bp, Heterodera glycines
ctctagagacaaggaaatggttgctaataattatacaaattcatttcctttctttattaattatatgccggcagagatgtcccaatggtaaattaaaaaaaaaattctgagaatatagtttttttaggggcgagtaaatgttggataaaatggaatactatcaattaattagacaaatcttgttcgaattcgcgtcttgagttttttacctggtccaactcgtccaaaaactctgtccgcacttccaaatgctccaaaaggggcagcgcctcctcccctcgggcaattccgtcgtccgccgcaacggcaccgccgccgacttttggctttacgccgtccccagtcttgtcattgatcagctcaatttcgcactcaacaacaccatttccatccagacaaaaatcaatctcatcatcgccaaagtcaatttcatcgtcctaaaaacggggaataaaatggtaattgtaagagtcgtccatcattaaaattgccaacatcggcggctgttatttgtccgtcatctgtcgggggagactgattgtggggtgctgcgccgaattgttcgacgagtacggcatttggtctctgtccgtggcgccattcgaaaacggacaattcgctgagcggccgttttgcgtcgccactgacaagcgaagggaggagaaagcgtgtgacggggaacattccttccaagtgtttgctgaatttggacaaacaaattgaaatgagtaaattggaatgccgtcccactcgacaaaagtgccgaaggcgtcgaaatacgtgacaattcggcccaattctgtgccgacggtggccaattccgtcggttccgttgcgcatgcgacggcgagcagttcggcccgcaagtccttcactttggcgggcagtgcccatttggccaattccttgtccaaatttcgtcgcacttccgccgcttgctttgcgtattccctttcctttcgttccgactccgaaaatggtatttttaattccaattttatttttcaaatcccagtttggcccacccttgacgtgttctcggccttggcaatttgtttgcgtagcgcgggaacctttagggaaaattaattattaatttccaaattttcaaagcattgcctcatattggacaaaacgttgcagaaaattggccgcctctgccaggcaaacgttgtccttttcgtacagtgaaatgatctcctaatggcaatggaaaaatattgtaagaattggcacaatctgatgaacggaccttccaatctttcatccgttgcgatgagtacatcccgaaaatgttcttcgtctccttttcagtgtcgcgcagaatgtccacaatttgtttgcaatggaaatagttgatgtctgaaaaaggggcaaaaattcattttaaaaacggattaatttcaaagggttaattcaaaacggtaattgaatttttcgtataattatgtattgtcattgaattcggaagagcacacattgtgcgttgctgagaatggccaagatctgctcgttctccggcatgtcctgaatggcatgtccaattttggcccgaatcgtctcgaccgaatcacgccaattcttgtggcaatggcgacgcgaaatgagccaatctgagggattgaaagaggagagagacgatacaattccaagacaaagaaacccatcccatggacgcaccaagaagcttattgctgtgaatgtcaatgggcaaatggtccatctgtttttcaaattaataaaatatataaaaaattaaaaataaattttaatgattggtggaaaaaattgactcatttagggctcgtttaatggaataaattttattcagaaagcgatgcataaatttaattttggtttttacaaaacaataaaacaacaaaaagcgttgaattgctgtataaataaatgtaaagcaaacaaggaccaattgcacgtcggaaacaaaaggaaaaagagagaggaagagactgaaaaagttaaatgttctgcaaaatggtctcgaccaatgccacggcattcgcagcggcgtaattctaaaagaatttaaccggtaattaaaaacaattcaagggttaattagtggaaaaccgccgcacctgccaaacttttccctgtttgctcgagccctgctgatagtccgagacgcccctcaccaaaagccacgagtccacgcgcgagccctcaatctgacggaaagggcgaatttgtgaaacattaaacggacagttaattaacggaaacaatggcactcaccgctgcgatcaccgcgtcgaagcccgcgtcaaaggcccgcaaatggtaatggaggcggaacctaacggttttgaaaggaattgtgaagtttattggcattcaatttgcccgtatttcccccgcacttttcgcgcagtctttcattgacgagtcgcacgtccctgctgccatccgtggcactttcgctgttcaaagaagtgtcggccgcgctttccttcgctttctcttccgaatcgtttgactcatcgccaacatttccaggagaaagcattggtccactaaaatgaatttgatcaaaaatcaatttatttttttgaaatacttcgatccaatgccatttgtgttgtccacgctcggaccattttgattgcctttgccaaaactaaaacgattcgtcggttttagcggtggcgttggcggtttctgttttttgttgctatcttcgtcttcgtccggccttttgtagaaggtgacctgcaaaacaattaacaaatgtctgatattgcaaattaaaattggcacaaatgcatgaaatggacggaccattgaaccaacgggacccaaatggtacaacggattggtgcgggactcattcggatgcgggaacaccaaaatattgccgttgttcgtcagctggagaatgacatcggatgtggcgggagggcgcgaaaagtccaactgttggtccctgtgtttgtcattcagtcggccgattagcgactgcgaattcgcatgccatgcgtccaaaaagcgcggtttattgctgaattgggaataaaaaacagtggggtaattaaacggacaattaattaattaattgcctacgcatttcgcacagccgcagccaatgcgttgacttttggcgacaaattatggacttcgaagcgtatttcttttgccttggggtcggattctgaatcagtaaaatgaaatttgtataaaattgtgccatgtacgtcttaccaatgttgtgtgcataaacatacgccccaattcgtccgtccgtcgaatgttcgtccatttcctcttgtgaaatgacaacatcgccaagtcgaatatgctttaacattcataaatgcattgttaaaggaagaaaaagcaaagcgaacggagaccatttcggggtcagtcaaatgcgcctgtccccccgccacgccgacaatgatcacatgttcaacgtgttggtatttgccgagcagacgtgtggtgatcgaaccggccgaagtggccgcctccctgtcggtgccgatcattgacagctgcaaaaccatggggggggggttgaaaaatcaagtgatcatggcattttggttgtgttacctttgtggcaacaatgcgatgtccggcgatttcacctgtgggagacaatgagtgaaaagccaatcagtacggacggaactgtacccaacaaataccttcagtgaaaatattcgaatcgcccgtgttcgaatacctaaaacacacaattccattcattgctggttaaaaaggggacgaaaaattgatgtacatcgaaaaatgtgaccaaaactaagggaatgtatgccttttatttttgcgatttttgcataaaaatgtctgccattcctccgttacttgtgctccgtgctgctgttctccacaattatgtccacgcacaatttctccgggaaaaggcaggtgatcagtgcaattttgggcggattctttgcaacaaaattgggttgaggcactaaaactgggccaaatgggcaaagacagctcccaattcgcttgtaccattgctggcctttcgtatccattcacccgactgatccggcactctttcaacaatcccatcactttccaattggtctaagaatgtttgcaattcgtccttaatttcgcatttcaatagaaaatgtatcaaaaatacaaaaagtgaattttaagtaccaaagtgcagcgtaaactgtacgccagaacttcttcctgcaccgaattggataagcatgctcaagcg

SEQ ID NO: 12034 - DNA, 2074 bp, Heterodera glycines
  misc_feature (84)..(84): n is a, c, g, or t
gatgatgacacgtaaaacgaagcataagacaaatgtttgcctatttattagtcatgggcaaatgcaaatattttttgaggcttncagaggagttgtctaagacaataatacaaaaacttgagagccgtcaaatgcattttctcggttacagtaacagtaaagataaatcagtgattactgttaccgttttttaaaaagaaaataagacgggcattttatcactacaattggcatttttaattatttttatttagaaagttcccttgtgagttgccgattaaattaccattaatattttaattgctaaatattttgatgattttttaaatccttatttaataattttagtgagttaatttgtgacatttttgaaatgagcaaagtttattttaaatacagtcatggtcataagtgttgtcccatcatgctttgaaaaaaataattgcgtataaaattgtcattttccaatttcaacagataagtagcataccattggatagcattttttatgggctttccaatgataccatatttgcatttgtgacataaacatttatttgatttattttaccatattcacaatttgatcaaaatataggtggtcaaaagtgttgtcccatttcatttttaaaatattgcttctctggatcagcattaaaaaaattcaggtaagcataactttggatgctgatcaaaaaaggtagcaacaccaagttgatcagatcactccttcatggtgatctgatcagcccattttggctgggaacgaggggtaaatttcaaaaaaaatttctagggggttgggaaaatttttctggaaattttgagtaggcccattttatagagcacaaaattctctacaatattcaaaaaaccgcatgtctctatgacttataccggctgaggtatgggcacttcaattttgacgtagtgtaaaatgcactattttcttaagaaatacagtactttttataggcaccaaaataaaagtcgacgtatctcagcgggcctaaatcgtagacccactattccaaaggcaattcggtagcaaattttgtgctctataaaatgggcctactcaaaatttccagaaaaattttcccaaccccctagaaattttttttgaaatttacccctcgttcccagccaaaatgggctgatcagatcaccatgaaggagtgatctgatcaacttggtgttgctaccttttttgatcagcatccaaagttatgcttacctgaatttttttagatttttttaatgctgatgaaaaaaaatatgggtagtgttcctaaacatatgaccaccccgaaatttgactatatggaagaaaacacaaatttttacaaaaaggaataaagcaaacgaggaatgtgtggtaccaatggatagcccagaaaaaatgctacaaaatgcattaaaaagattattgattatttttctttcaatccagagaagcaatattttcaaagaatttattcaaaaaaaagaggtgttcctaaacatatgaccatgactgtatatttgtttacattttaattaaaaaaaaaaaaaaaaaaaaatgtggtccaattttgaacgaaatagtgcacaaaaagggagggagggttagacgaaagtgcccatcatctttacgtccagttggtgcttcaaagcttcgtgaaaacaattttaattggggaagtttcgagaaacacccacgcccctaaatccagagttttccaagtgaaaaattcaccccaaattgtaaatgttgtggcgttccgtcatgacgctgtgtgtgtgttttaagcaaaaagaaaaatagagaagacacaacaaaacaaattcaaaaaaatggttataaatttggtctctttctctctcttccgtcgctctcatcaaatgccctgacgccctctgccgcgcgaggcgaaagtggcgaaattggcccaccgattttgctgagtgaggacggcactctgaagggggggggggggggaggatagaataagtgctcaaattcaacaatttttataccctaattttgaacgcagaattagaaaaaagtccaaattatcaaaagttccaaaaa

SEQ ID NO: 12035 - DNA, 2074 bp, Heterodera glycines
tttttcctaaaaatattagccctaaaaataagggttaaattttttgaaatttttttcaaaaaatcgcccttaataaattagcaatggaaattttttcaaagagaaatgagtccctgtactggggagttatcccctgcaaaaaaaattgggggagttctgatctcttttccaaaaaattctgggaattaatttttactaaaattataagcctaaaaaataagggtttaattattttgaatattttttcaataaatcgcccatttccggcactatgccaattttgggcgggacagacctaacggggagatataaagtatagggaatatcaaatctattcccgaaggattcatccttccgaaactgtctgactgttctaaaatttttactaatttaagcctaaaaaatttgtctgattattttaaatagtttttcaaaaaatcgcccttataaattgcattggatattttcaagacaatttagtcctgtactggggagtatccctgcaaaaattggtggggttctgatcgcttttccaaaaattacttggaattaaatttttactaaaattataagcctaaaaaataaggttaattattttgaatattttttcaaaaaatcgcccttataaattagcattggaatattttcaagagaattgagtcctgtactggggagtatccctgcaaaaattggtggggttctgatcgcttttccaaaaattacttggaattaaatttttactaaaattataagcctaaaaaataaggttaattattttgaatattttttcaataaatcgcccatttccggcactatgccaagtttgggcgggacagacctaacggggagatataaagtatagggaatatcaaatctattcccgaaggattcatcctcccgaaactgtctgactgttcgaaaaaattttttaatttaagcctaaaaaatttgtctgattattttaaatagtttttcaaaaaatcgcccttataaattgcattggatattttcaagacaatttagtcctgtactggggagtatccctgcaaaaattggtggggttctgatcgcttttccaaaaattacttggaattaaatttttactaaaattataagcctaaaaaataaggttaattattttgaatattttttcaaaaaatcgcccttataaattagcattggaatattttcaagagaattgagtcctgtactggggagtatccctgcaaaaattggtggggttctgatcgcttttccaaaaattacttggaattaaatttttactaaaattataagcctaaaaaataaggttaattattttgaatattttttcaataaatcgcccatttccggcactatgccaattttgggcgggacagacctaacggggagatataaagtatagggaatatcaaatctattcccgaaggattcatcttcccgaaactgtctgactgttcgaaaattttttttaaattaagcctaaaaaatttgtctaattattttaaatattttttcaaaaaatcgcccttataaattgcattggatattttcaagacaatttagtcctgtactggggagtatccctgcaaaaattggtggggttctgatcgcttttccaaaaattacttggaattaaatttttactaaaattataagcctaaaaaataaggttaattattttgaatattttttcaataaatcgcccatttccggcactattccaagtttgggcgggacagacctaacggggagatataaagtatagggaatatcaaatctattcccgaaggattcatcctcccgaaactgtctgactgttcgaaaaaattttttaatttaagcctaaaaaatttgtctgattattttaaatagtttttcaaaaaatcgcccttataaattgcattggatattttcaagacaatttagtcctgtactggggagtatccctgcaaaaattggtggggttctgatcgcttttccaaaaattacttggaatagatttttactaaaattataagcctaaaaaataaggttattatttttatttttttcaaaaaatcgcccatataaa

SEQ ID NO: 12036 - DNA, 1517 bp, Heterodera glycines
agcgcttttcggtttaggggcctagattcgaatttattaaaaaaacatcaaaggacgcgcagaattgtaaaattacgtgccaaaatgatattggggggcataaatgccacaatttgagctaacaataagatttcttcaagtgaatatggccaactttttttggcatcttagcgccagaggaactcgcataaaatctgcgcgtcctttgttgttgttgttgtttttaaattcaaatctaggcccaaagccgaaaagtaccgatttttttttaattaatcgggggggggcaatccggaggggggaaatgaagtgcactctaaaacttaggcctgagccattgtacgagttgccgttgttttgtgtacgaattgtgatgacaaaacgtcaaacaacacgttatcatcaacagtaaagcaatttttttaggaagacagtcaatcagtggaagacagtgcgagcactaacaataagcagtcgaagaaagggcggaaggcgaaaacggccggggcatcggaagtcggagggttgggactgcccgtgaaaggggtcacgacggcgtcattctcttcattgtatgacaaaatatccacgggatggttcaaaagttgaccaaggaagactgtgctattgtaaaacaattattccaaaacataatcccaatgtgtatggatggtactgtgattctttgtaatgacaaaaatatttaattgctcttacatcaagaatgtttaattaattaattatttattcgtaataaaaagatttggtgcgagaattctattcagtttttgtgccacacatcgctttattttgcacctaaaaatttgtattttttggctatgtttaaaaaaagagaccaaggcctgtatggtgaattggtaccgctatttctcatttcggatttactgttagttaaaaagcattttttaagcaattattatccattgttaatttatgcaaaaatattaaaaagaacaacaaaaaaaacaaaaaaaaaaatgtgtcgtcaaaggacgccccacaactgctcaaaagcacttgtcaatttggcacaacagagagctaaaaacaaaataaagaaaacaatttattgggccaccgatttattatgctcacccgcgcttaaaggataatttgaaattttgatgtcctcctccgtgtaatcggtgctaatctgcacaaaattggtgttttattatgggagaggtattaaattgcgatccagaaaggatcacgcacctttccatgtgctattccaccgaccacaattaccaccggctcttccgcttcgggctgtaccttctcggccatgttggacaccaaattggggcagttcagtgtgctcagaaatttacggcagcccaccggcaaatggttggtcaccgggtttttgaccacgctaaaaacaaaaataaaagaacaaatccagaaattttatttttcaccatacttcaacaattttgtgaagaatcagccgcccgaatttgcaattttgtgcaaaaagttgaactaaaaat

SEQ ID NO: 12037 - DNA, 1699 bp, Heterodera glycines
  misc_feature (1688)..(1688): n is a, c, g, or t
taagacacccagaaaaccattgggaagaagttttcacgacttattttgattaaaaaatagcaaaccaaggcccactctttggtgtttaataaaattcaattttttcggtgctctaagtgccgatatttctaataaaatataaacgtcaaacgacacacacccatcagtccacaaaatcggtcaaaagtgcgcggaagtcggcactgcgggctcacgctgaccagcacattctgtttggtgcggaaaaagacgcgcaaaagaccggcactgttcagcggactgtcctgcagcatcagcaaacactgtgccgaaatgggggaattaaatacataaaacaattagaggtcggaattgtaaaatgggtgggaccgggacttgaaaatcgaccgggcggggaccaggtgttttgtccaaaaaacaagaccgggagtcccggcaaaattgttgggaggccctggtcccgtccggtctccaaaacaatgccaaaatggggggggggcaacccttttttgcggaaagcacaacaacctggtgaagaatgtccggcctgaactgggccgggtccctgttctgtttgcgcagccaattcgcgtgtttgtcactgcacaacacgacgtgttcggcgccgacctacaaattaccaattgcttatttattgtatttatggcctaatttcacccattaacaaaaaaacaggctgtttttcagtgacagaaattaatttaatgacaaccccggcaatggtgaaagattattggtcccacaaaaaaaagaaaaaaataataaaaaaaaccatttttaggggttatttgatgcgctgagcacgaatatgatctttttttgacttttttcgaaccccaaaccctgattcgaacaattttttaattaattttttacttaaaaataaatttttataaaaagtcatctaaataaaagtctttcctgaggttttcaaagtcgctgatcacgaataagatatccatttcgaaccccggaccagaattcgaataaagtcgaaaatttaaatttttttaatttttactttatgtatgtttgaatctacataaaatgacttatttttgctgttaaaactacctgtgatttatttctgctagttttaatcaattttagaataagtgcgaaatcgaaaaattgaatattcgactttttgttcgtattcgggtcctggttcgaaattggtcgaaatggatgtcatattcgtgctcagcgcatcaaataacccctaaaaatggtttttttattattttttttcttttttttgtgggaccaataatcttcacaattgccgacaacccctacttttacaacatccaacgagaaaaaccatattttttgaggggagcacaaaaaagaacgccgccggacacacattttatcatatgcatggattttacccacaaattactagtaaaagaattattttttagacaaaaacagctataacacccccccccgggcaacaaaaattacacactttggccacttcgagactgcagtcctcaatcacaacgaacaaccgtttcccgccggcaccgtctgttgattgtttcaaccgttttgagcgcggggagtcgcgcgaaaagggagcagagggatgcttcatcggacgcttcttcggtttcatggcgcaacaattacgaattttgaacgcaacaaattctaatganaattttgtttt

SEQ ID NO: 12038 - DNA, 1558 bp, Heterodera glycines
aatccaagaaaaaagcaaatttctgcatttcgagaacaatttcaaggaaaaaaaacttgaattcgtcatttttcgtgtatattcaacagtaattttttgtctattgcttttatccaggcatttttctatacaaaaacttcagtgaactttaagctctcgattgataccaagaatgtaagttttgaccaagtaagaaaaaagttatggcttaagaaaccgaggttggtcattgattggacgcgcaaaagtcgattagatgcgtaaactgcattagagccgaaattttttatggacttctatcccacctttgacagccccttctcctcctctgcgtcgtagctcactttttaaaattttttgtaaaaataaagaaataaaagttgaccaatttacaataaatataaatatattttttaagatatttggtttgttattgaatttcaaaattcgaaaaaagcaattttattacgaaaaggcctcaaaaaacatcgccatctgagaggttttgagtcggctcaaaatctaattaaattggtaaaacttggagcaagagctcttccgccaatttcgccgccattatgtgggcaaggtcgggaaaaatttgcaatttttaatcaaatattttattaaaatcgaaaaattttcaaaaatttgctacaataatcgacaatcctaagaattcagatcagcgcatttttttaagcctagaaaaaatacctgccaaatttttgacatttttttcgtcgggacaccaattcttgaccattgccaaattaacgaaattttgattattagaaataaatttgggttggtagaaacctccaaagacgtgaagacgtttgaggccagttttggtctcaattttgcccagcaaattggtgaacgcattgttctcatgcaacttcttgtcaatgtccgacaaaacattgtgcgcttgggccgaaacataagtcattttaagtggaaagggtaaaaattgataagctaaaaagaatgaaatcagaaaaggtttaattttaagaatgaatgtaaaggaaaaacatttcacaacttcatgaaaattctattacttttccttcattttatattgggtaaaagaaactgcaatcaaaacaatcttatcgaatgacctcagaatgaatgaataaatgagcagataagaaagaacagaggaaggaaaactgcttgaggcatattgctgtttagacgccgttttaatgacaaaattataaaaaaaatattttttaaacaaatttggcataatgatttttatttcgaaaaaaagcgggttggtaccgtaccatacataatcctttagaatttgatgctgattttttttttgtatcggcaagattgctttgatgtggtggggtaaattaaataagaatgaaagactttttcagaaatataattcgaacattccacaaaaaaagcgggcttaaaaactaaaaatttgaattttcgagttttcgttcgaatttgggtccgagattctaaattagtcggaatggaggccggattcgtgatcagtgactccgaatacattaaatcggtgttt

SEQ ID NO: 12039 - DNA, 1959 bp, Heterodera glycines
agtatttctattggtaaaatcggaactttggtattattataattatttttatattgccttttctcgtcaactttcatctcccgttttttgagaattcggataacaattgatgaagcagcgtcagaaatggcaaaattaatttcactgcccttgttgagtgtttttgcctaaaagaaaacttgctattattttataatagattacatttctttaaattatgtttctggtcgtttttatgtgtcccatgccatattatgcgtcctatgacattttagggagcagcccccccccccccccccccgcatcgtttccgacgagaatttttttaaatttaacttattgttagaaattttcaagaaaaatcttggagttttccttaaaaacattcgaaaaacaaaaaatttctaagagttttatggtgaattaccctttcttcaaaaaaattttccaaaaagtcgctgcaaatttctcgaaatttttttcttatagtctcggcttgtaaaaaacatgaaaaaaattttttcgaattcgggttcgggctcaagaattggtcgaaatggatgtcatattggtgatgggctgcctcaaaactcccggatacttgtttctcaggattttttaagcaaaaattgaaaaaagcgaccacaaaataggacacaaactccaaccagcccactagtacccagggctcttatcggattttacaaaatcgaacataaagacaaaaaatcagatttttaacaattattttgctgcgagcttttccccaaaaacttttaaaagcagagggccggaggagccgatagacgcccctgtgaaatttttttttgaaatgttggctagttttttttttatgattttcgataaaatacatttccaatcccttcagtatttcttcacttttaccccaaattgcttacttcaatgatttgttgcgtcccattttggtcccaattccaacggacaatttgcgccaatggctccgaattcggcgacggattggaagaagaagcattgccaatgtccgcgatttgaaaagcataaccacaggtggtttgcatgatcgtaaattgactaaaatgtgtttataaatgaaaattaaaaaatgaaattacagagttgcaaatcggtttttttcattaaatgaaaaagttcctgcagttgggccaaacaattcgctgatcactttttcgtcaacaataataaattcgtcaaagatttccatgattatttctattgaaaattctaaaatattgttcttgtattttataaaatagcagttgatatttgtacaatttgacaaaaggtgacactaccactgtgggtgggtggtcggggttgtttcggcgccagcctaagtttttggactataatttttttcattgtcaacttaaacgtacaatcttgatatcattctaaagcttaacatattcagaagctatttcttattacttcgcgattagacaattaccaaaagagttataacatgaaaattgcaacaaaaaaaaaaaacaaaaattttggtttttttataacttttttacaggctagaatttttgctttttattgagaattttccgttttagtaccagtgagcccatccgataactaattgtaattgtctttttaatatcaaaaaatttaatccaaaggcaaagccctccctctaggacaagcagtctttgatgatagataagggaaaaaagatatgtcgtgctaagaaaaaaaaagacatgccaaattaaaattcttaacgaagtgccgcaaattagacgactatttgttgattaaggtaacaaatgtacaaaaaatgccttaatcttcatagaattatagagaagaagtttaagcgaaatcaaaaaaataaaacaattagaaaaaattttgagaatgccaatcaaagtccgtcggcgccacaatcaacattcacaaacactgaggaaaaaatgaaataccaaa

SEQ ID NO: 12040 - DNA, 2908 bp, Heterodera glycines
  misc_feature (91)..(91): n is a, c, g, or t
aataatcactttcaaattgtcgagtccgtagcgatcaatcaaaaggaaacggtcgatcagcggaatctcaacgcaattgatcagatgcgtntcgcagcacgacttcaacttggccacctgaaagcggagaagttcgtgtcgtacctaatatgttagcctaattaattcaaattaatttttcaaggattaatgccgtgagaaaaatttaacgaatatctggcgactgtgatcggcacggtcaaggaaactccgtccgaaaggtatccccacctgaaggtaatcggccaatttgagcagcatcagcacatttttggctgaaaattcggaaaatagaaaaaaagataaaagattttattacggttgggcagaaaaggtccgttcagataattgattgcctccaaaaactgcttgaattggtccatgtccacgcccaattcgtccaaagtgatcattcgctgctgcttctccttcatctccacgctgagcatgcgactgatcaccggggaaacggacgacagccaattggcggacacggaaatctgatcaaaatcattttatcagtgatctgccaaatttatcataatttaaataaagtggggctgaagatgccattgctatctctctctccttctgtttttcacctgtttgtcaccaattttcaccgtcaaatcgtcgtccgatgagctgatggaaggcaccggaaacgcacttaaaaatggaaaaaaatttaaaaaatggaacgccaaataaattagcgaccgggaaggactcggacttaactcggctcccgaaaatgccttggttaaagtatttctattgataaaatcggaagataatattagagagcggtattttgagaaaatacggatcaggaccaggactacggactaaaaacccgtatagtccgtactccgtactaaggccgtatcggcccaaaaaaatacggactacgggtccgtaaaaacccgtatacgggtccgacccgtacccgctctctagtaataactaataatacacaccgtttcaattttggcctcccagttccaaaaagatttgcatgtgtggctcacaaagggaggtggccaagtgtccgtgggatttcaaaatgaaacttggttaggtggatagagcaccaatgggttcttaagaaaaatggttttattttctgccaaatgagcacgagtgccgagttatgacgtgccaaagtttttagttttttataattaaagaaaaggaacaactatttcctttcttcaaaggaattgttagtgtagaggtaattcgttagtcaaaattttttttgggtcaaaagttcgaatcccctatgtgtaaattcattttgtaatttttatttttgctttttgtgagcaattcaattatcaaattttatttctttatcaaaatatttattttaattttattccattaaaaatcaaaaattgcattaaacataaatgtaatacatattctgtcaaattaaaaaatatttttttggcgaatatttttattgaatattttgcgcattaaaaaattttaaaaaaattaaaaataaaaattttttcataaaataaatttttataattgacttggcgtaaaagacaaaaataaaaaaactaatttatacgtaggggatccgaaccctaggctaaaagatgctgactagcgcactaccgctacaccactggacaccgtgctcttgtgcaaataggtatttcttttatttaatcattaaaaactttggccttttttatcttggcacaggggtccatttggcagaaattgaaaacatttttcttaagaacccatgggtgctctatctacccaaaaaatctcattccgaaatcccacggacacttggccacctccctttgttagttccgacgccaaatgtcatactctgagctaattgtaagcactcgtagccctcctggggatggtcccaggaggagggtaggaattattgtgaaacttttctttttcccctcctaaaattcttaataaatttgaaaatgaacatgtggcacgcatggttatgatgtgtaccattgatgatattaccgtgtgtcaaatgtagtcgttgtcaccacggcggcatctctacacaatcagctgagtgtcgtagagcgcaaatgccgaattgatgggcaaaccggcccagagcatgaacgagcggacgaacggagtgtacgggccaaaagcctaaaaaatcgtgattctcgaaccgaattcaaaaagctaaaattttcgctcctcctagcaacttttactcaattttgcggaccaattccggaaaaagtatggttcatatattacgaagaaagtcgatttttttgtcgacctcccatcacctcatttttgtgtacgtaccaaaattttatttaactttttctttgtaattttctaaacgaaaggaaaaaattcaagacgatcagcatgcaaaaaaaacggcagatgaggagaccagtaaaaaagggaattttataagcccaaatttgttgtttacaggctcgtatttagtgggagaaaaaaatcggaaaggggtttgggcggaatggagtagccatcacggaattttttaaatcattctctttactatcggcatagtcggaccacattttttccgagctttttgaaaaagacgtgccacaaaaaagcacaaccacacacacgaatttgctagaattttctttgtcacagacctcccaagtgaaggtatttggtcgaatcggcgtacaatgcggacatggtaaaggagccaaagacgagctgaaacagcgagacgggaaagaatgagtttttaaggaatgaacgcattcggaaaatactatgcctgaccctttcaaatttttgaaaaacaatagctaaacaattttccgaatttagccaacgccttaccgccccctccccc

SEQ ID NO: 12041 - DNA, 1369 bp, Heterodera glycines
tttaaaaaaacaaagagataatcgaagagtgacaaacaaaaaaagcaaaaaatggggtgaagctcgagaaaacgttcggtctcgagcatcaccattaaaaaccataagtaaaaaacaaacaaaaaataaacaaagaacaacatagaagagtggtgggactcgaaagatgagcataaattcattttttcaatcttttgaccgaggctgtcggtttgaatctcaggcccaataaaactagaaggtttaaattgtaagtagaagccttcaagtttgtggcaaaataccttagagatatgaacctaaatatataatttattaagcaatttgacagccaaagccataaatgttggcacacaatcacccccgccccccaaatggtaacgaatgatcaaagagatgatcagtgttgattatttttcatttgttgttgttgttgtgcgtgatcagatgaagttttatcgttgttgcctttctggtgccgtcttcgtctgatcaccgccaaagtccaggcacatgaaatcgtcaaattgttgctgtcgttggtgctgatccgcggcacagccagcttcggcattagctgcagtggaacttccatcattattgttgtggctgttgttgttggcacattggcgccgacttttctcctccgactcggccattatttcgtcgagtagtgagccgcgccgttccatcaaagagccgatgattggatttgtgttcccactgttttgctcagtgacggcattagctaccgatgaagtgccagcgccgctgccgatggggggcgaatgggaggaacgcttcggcggaattgggggcggtggcgtttgcgtggcaggacaattcagtgatggtacggtagcgggtacggtagaacatgttgtcctgctacattaaatttgtttatatgccaacaaagaaaaatttgagactttaaattcaatttttttttgtttgccaaatgttgtgccattcctaccaagagaaaagaacccgcgattttttcgttaacccggcagtttttgtccgccgcgatccgttatttttttctcaagtgtgcgcttcacccctaatttctattataactgaaagttcacgaaaaacataatttgcgaaagggtccggccatgtgaatcgacaaaagtttttccaaaaaagggctgaaaatttttttcaaattttttcttgaaattttcttggaaaaaaaatttctaagattttctttaattttctctaagtttgacaattttttaaaaatttttcgggggaacgagctgctcctggtggaggggggagtcggggtccggacaatccgtcagtggacaatccgtcagtggtcaatccgtcagtggacaatccgtcagtaaag

SEQ ID NO: 12042 - DNA, 1749 bp, Heterodera glycines
  misc_feature (62)..(62): n is a, c, g, or t
attttatttttggtgagttttacttgcatcattttctacatataaaataattattttttgancataaatctaaaaattataatttggcacaaaattcagaattattcagaaatgatcaagcggattgggaaattttgatagaattaaattgcgaatgaatcggtcactgatcagcagggctgcaaaaaatatgcaaatgcatatttttttcctggcttctccatgctctaaatagcaggaaaaacactttcttttttatgtttgcgtataaaaatcgggacttttatttgcatattttggatttttctgcatattttgccattttttgtacgtattttcagattttttgcatattttgccatttttcgtcaaatttttcagatttcactatctcttaggaaaaaatttcgaaaatgcctaaaattaaatccaaatctgaattgatgcgcgagtgggtcaacagtgagtttcactgccgaaaaccttgagaaatttttgatttacaattacaaaaacaaccgatataatttatgaggaataaaatttttatttattttgcacccctaatttaagattttttgtgcatattttgcgatttttgtgcatatttggcaattttatttgcatatttatgtgcatattctggtcatttttcgtgcttttttttgcagccctgctgatcgtgccggttgagtccgattaagcaatgtgacaactaaataacataaaccccacctgaactttgcccgactcgggaggaaattgcgacacgtaggacaagtccatgtttttgttccgaccatttgggtaaaggtaaaagccctccctgctgccgtccacctgaacgtcgagatggaaacgtacaacgagcggaggccatgaattttggataaacaaaaaattgggaaggatttccatcgaagatcaacccaatgaaaaagagatatccgcgacaattttaccaatgattggatgagtgatttgttctgcggaattgtctggtaaatctttccgtccggcgccacgtaaccaattgcccattggcccagccgagtgcagctcagtcggaacagataactaatggttttggaatttaagcacaattccaaaaaaataaaaaataataatttagaggtaaaaaatgactaaattaagcaaaaaattgatgccttttggttaaaaagatataatcagaacaagagaagaaaactcaaaagcaaaggagacaaaaacagagttaattcaaaaaagttttaacttgatttattttttcatttaaattttaaccaaaaattattaatatttaaatgcaaaaaattatgctttgctttgcattgttaaaacgcgggcaaatgcctttgctttgtgaccattcacaccttccgggctttccgctgaactgctgcaggcgctgcttgacctcctcgtaagtcataaatgccatgtaggcggggtgagtgactgccaaaagttgccaatttttgatgagcgaaggccacggatggaacagccttttgagaggaaaatgacagtcaaaagggggaaaatgcaccaaatttgaggtaatcgtgtttgaccaattcaaaatgccctaattattctgaaattggcaatttttcgtgaaaatctgttaacgtctggagaccccccccctccctcccccatggacttcaattttactgctaatgaatgatggtgtcgcccgtccatttttagcaacccaccaacaacaaacagcaacaacaacaa

SEQ ID NO: 12043 - DNA, 2498 bp, Heterodera glycines
  misc_feature (540)..(540): n is a, c, g, or t
aaaaagacaaaaatatttatttaaaaaacaaaatgattaaaaattttgaaaaatgactgaattttctctattcaccaataaaaatttgtaaaaataaaaaaaaatgaaataaataaatataataatttcttatttaatgtaaaaatccattattcaccgaatgaatgaagcgatgaaatgaaagcctactctaattagttgtcatgattttttttcattttaatacgtattttttggcaatgccatttttctgcgcgtataaccacggcaaacccatttttaacgtggcattttctgcgatgggcggctgagtaagtcaggaaaattcaatcccgtgatttaaaataaattccgtcatttaaaaaaaattttctgccccttctagtggataaattttgaaaaaatcaactgaaataaagggagccaatttttgggcattaattaaatattaggtcggccacttaatgagctttgcataacgaaattgtattttattttatcatcgtcatttttttcccttttcttccgcgttgtgatttntaatttttgtgtagggtttttcagttttaactttgctttaatatgtatcaacaacattttttttgtgcttatgtgtccgggctttttctttttttgggcaagagctcaaggttaattatcggaattcgtactgagcagcccaaacctttcccttatttccatttccagttttgtattatctttagctttgtattatctttacccctcatcccactcaaaatctctttccattgggcaagtccatccaatatgcccattctgcgattgtctgggtgggtcatcagtgtgctcatttgtcagtgctattatttgccttgagacaaaattttcccaattaactaattgcactgacccatccctctgagatgttattgattcaatttattcctgggtttgaatgcaaatttattatgtcagtgtttctgctgattattataaattttttccacaaaacgttagtagagaaaaattttattgatatatatatttagggctgcaaattttatgtaaataaatatttttttcctggcttctccttgctctaaatagcaggctttcttttttgtgtttgccaacaaaaaccgggacttttatttacatatttttacatatttcggggtttttatacatatttcgggattttcttacatatttgtacatattttagatttttttcatatatattttcattttttttacatattttgagtattttttacggaaatttttggaaatcctcaaaaaaaaatccaaaatttcggcaaatatttttgtacatattttcgtttttttacatattttgaaaatttataaagaaaaaataagtttgaaaatgttgcctaaaaataccaaaaaaaagtaatttttagtcattttgtgttgtgggggaccctatcttttgtcaatttcatttttttaaattgataaattaatttattatttaaaacggagtaatttgttaagccagaaaaaaaaattcggagttcttctcggtttatttccttttttgttcgggttaaatttggacaaataatgatgatgttgtattttcttttgaagactgaaaattctttcggctttgtgattacatgccgagaagaaggactggtattatatatgtatatgttgctgcccctcttgtatttttacccttggacagttcagtgccaaagatatttggccatttcagtcacggttctgtaattcttcagggattcgttgccgcaaaaattctagggttcttttattacaaaatgagagacaccgattgttatgtattttatcgggtttttggacctgggctatgaatgatattttgcttattatgttagtgtttttccttgtaaaaaatcatttttaacgtccatttaaaattgcttaaagacattaacatgtgaacacaaaatccatattgcattttgcaatagctaaaatgcccgtctttttggtttccatcacccctccaccggccaatcttcggcagcaattagcgctgtcagcaatgaaattttaattccttttctaaacaaccaatttaatttcccaaaaaattcacattttattgccaaaaaatttacccaaaaattcatattttatgccaaaatctccttttttaattgagaagaaattatcggtgtctttttacgctgtcggattttttgaaggtgctcaggatgttcaacaatgaaattctgtggagtgaaaaccaagcagaggcgggcgcgatacgcgagcatggtcagatgttcgtcgggggctttgaagtgacgccgggaacaagaatcggcggctttgagatggtgccgggtccattggttcgcggtcaactaatggcttttattaatgatctgaatgatcgatttcggaatgctacggattatgtggagctggcggtgtgggcgcaccacgaagtggttggatttttgggagatgagatgagagggagaagaggggaggag

SEQ ID NO: 12044 - DNA, 2053 bp, Heterodera glycines
atcgcccggctgtttatgaacttgattttgcggccggggatgcgatgcgcgccggtcacgcttgatgaggggtgtcgaccgtagtattaccgctgcttgaggcaaagggacttcgaaagctttgaagccgaaatacatagattgatcaatctcagggaggaaataattaagaatttttagaaatttttaatgggaaaaattgttaaaattaaataccccagccctggatttatttaatttatgataaaccattcattcacatattttgtattgttatttgtttcaataaagaactttctctgatcattgtattttcatcacacattgagaattttgtgaaattaatgttggcagtatttcattaattcatatgttgatttattaatgaaaattttttcgtttcttggcattgttccattttcggacataattcaatataatattgcaatgttaaaaaaaataataattataataatgatggtgggagaatgtgcttggcgatagcctaaacaatgatggaaataccccattattcattctccaaacgctcagtttttcgtcctctcgccaaaatcgactttttcttgtccgtcgcacgggccggggtcacttcatcgcgctcaactctgttgcaacgcgtacagtcagtcggcatgcaacgcattagtcatcagtttcaaattgcaaaatttaatgaaagaagggagggggcatgaaacgagaatcagcaagtggaaatgttttaatcagcgattggctattagcagaaagcaatcacaaagcaaaactcatagggattggaactcttttattttaaagttcacccgctcaatttggcattttcacttcgggtgagccgaatccactgtcggtaggagaagaagcgccgaggcggaggagacggtgcaggaggaggcggaacatgaagaggaggatgagaacaaatagccagaggaggggggctcttttggtgccaaaatgttgcttcagcagagatctcataattccatctgactatgcgaaaattggcgtagcccactggaatcggatttccattggacatcacgttaggcatgacattatagtacaaggaaatggctaatttcttaaacaatcattttcaccgaagaaattgtgaggagaataaattcgccgtgtccaattaattaaccgttaattagcaataatgattcaatccgtcaatcgctagcttccttatacgtgctaacgatccgcgatttgacgttcctgctcccggccgatgtttgttgttggtccactgattggggaatttgaagatgttcagagcgttcactgtgctgagcagtgataaggaagtacagaacaccgatcaaagggaaaaagacggaggaaatgatcattggtcaattggatgcttccaactgaaatacgtgctttcctgccttcccccccccccctcccccctaatgtcacttatttaaagcccctcacggccggtcttcttcttttcattatttccatttgccattgttgacataattgtcagctgatcgtttccattaatccatcgccaattccattctttgcacattttcttccatattcactgcgtgttaagtcatttgcgatggtgggctggaaacgtgattgcggattacaagttgctggggctctgaatttttcttaaagaccaaattacggattcccaaactcctttattggatgaacccagtcatttccgaccctgactaattatgctaattatgacgcaatccctaaattgtgcgaccaacttatttaattaatcccttttttgtaaaaatgtattctcggcaacgataataataataatacgttaattgtcgagaaatgctaatgcgtcgtatatgatggaccttcttggtctgtttgttttgtcctctctctcctccatcgtcccccccattaacatcgttttgccaatttggccacgaaatgactattcctctcggctattttaacacaaacaagcaaaaaaataataaaaacaattaaagccgtgagtgccgagaatattcaccccgttctctcc

SEQ ID NO: 12045 - DNA, 2505 bp, Heterodera glycines
aattcattttttgtttggttttttattttaaaaacacaaaagttaacgcaaaattaaattacaatatatttaatcaatatttcaaacaaatttatatcaattttttaaaacaatatcatttttgaactaatgatcgaatattattacaaattcagatttgcttttcacatcactttttttcggcgcgctttttccaaaaaacttttcgggaagaagggggtcaggcagtgccggtaggcgccgccggaggaaattttgaaaatttgagtgtgatttgttgacagattttcaacaaaaagggctggtttttgagattactagagtcaatttgtgcggattttctttaaaaaatgataaaatgtgtgtcaattaaaaaaaataactgtgtagatttaatatttaatgagtcattaattaacacaccgagtcaattttgagcccctagttcaaaaagtaaatgcatatgtggcgaagtggtttttgtaagatagtaaagggacaaagggtggtggttcgagtccgttgtgcaacatgaatatttttatttatttttgtccaaaatattaaaaagtgacgaattttgggaattatttttgaaggtttttcccaatcaaattggataatcttggtatctttcaaaagctcttgataatgagaagctttttctaagcaaatgctaagcgatttggtgtaccagagaaaagttatgaggctttaaaattttgtttttcttataactttcctatttgacccattttaatattaacctgacctatcattagatgcagaatatttttctctgtctttatgcaaaatttgaagcggatttaacgttaggaaaaaaagttaaacgtcacgaagtaaattcagttttttctctattaacacagataaagaaatagtacgccaaaaagagagatgtttttttctctgcactctctctttattgacacatgtctcgttttttgactcggtgtgttaagaagatgaagttgaaaatttctgccactacgcaaaaaaggatttgaatttactaggtaatggacgttaaaaaaagaaaaaaaacggcaataactttttatggataattatcagtagggatgccaaaaatatgcacgaaaagtggccaaaatatgcgcataaatatgcaaataaagtcgtgaaatatgcaccaaatatgcacaaaatcgcaaaatatgcaccaaatatgcagaaaaaaaaattgaaaattagaggtgtaaaattaatttaaaatattattcctcataaattctatcggttgtttttgcaatttcagatcaaaattttctcaaggttttcggcagtgaagcttactgttgacccattcgcgcatccattcagatttggaaataattttaggcataattaaaaatttttcttaagggatattcaaatcggaaaattttgacgaaaatggcaaaatatgcaaaaaatcggaaaatatgcacaaaaaatggcaaaatatgcatgaaatatgcaaataaaagtcaaaatatgcaaataaaactcccaacttttatacgcaaataccaaaaagaagatgtttttcctactaattagtagtgctgttcgagactctcggtctcgactcgagaaaagtctcggtttttttcggtctcggtctcttgttttcagtctcggtctcggtctttgagactttcgagaccgagacttttttacacccctaatgattgactctttgttaacttaaaattaatataccttttgcttcatttttcgtagtcaaatatgtggtccagtggattgtccacttggttttgttctgcatttttgcgttggatcagttccccttcaagtagttattttttttctaattttcaaaattattccttttcctataggaattcaataacaagtttaacgattaaaatcataaaatattgtcatttttgtactaaatttgttcacaaagtgcactaaaaattcaaacctttctccataggcgcctatcgacaccgccggcacccatttttcaatggaaaattcaaaataaatttaatattctgttagtgcttttttaaatttaaatcaagtataaaaaatccatattatgataattagagattacatttttaggctctaaaaaccgccaaaataggtaggatttaggctctaaaaacacaaaaataggcactaaaaatacaaaataggctctaaaaaacccatttttaggggtgtaaaatcataaattttatccaaggtaacaaaattaagccaaatcagtattgagataaataaaaatgtaattcctaatgataattatggtttatttaaataaatagggctaaaatttgcactttttaccaggcgacgcctaaaatcattaattttcttcttaaaaaattagctgaagatgataaatttggtaattttttggtgaaaatctgttaacaaaattacagtcaaattttctaaattttccccgtcggagcctaacggcaccgccgtacccctattcccgaa

SEQ ID NO: 12046 - DNA, 1764 bp, Heterodera glycines
aagaaaaatttttggaaaaagtctcgagtctcgactcgagaaaagtctcgggttttttgggtctcggtatcgagtctcggggtcaagtctcggaatcggtctcgagcctcggggtcaagtctcggaataggtctcgagtagagatcggcctgtacctggatccaggcctgtatttttcctgtacctgtattttcctgtacttttgtacagaaaatacaggtacaggccatttttgaaatacaggtacaggtacaggccttaaaaacctgtatttcctgtattaatttttaatcactattttttggcgaaatgtatgaaaaaattaggaaaaattcaaaaaatatcattttattcagtgaaactcaaatttgaaaaattaataatgttttggcgaaatgtcataaatagttcaaggtggacttggtcgttttggcgacagcccattgtgctatacctttttttattttcaacaaaatctaatgatcttggtagcattcgaaggcccgtcacatgtcaatttggcgcatgctttaataaaattctaatgttcttatgagcacaaattttttgatcaaaattccgatttgtaaaagctacagtttcaagtagccccgaaaatccttataaaaaattggttaaaatctcaaaaatgtgtctcttttttttgaaaaaatctgttaacaaactgctttaaaaattgcaaattttatcccggcggcgcctatcggcaccgccggacccccgtcccctccccaagtttcccaaaaaaattttttgaaaaagcgcgccgttaaaaaagtaagaaaatcaaaaaaagggtcatttagggatattaaaaattttggaaaaaattcttggtagagggtaagataggcacaaaatgtaacctaattaagcttataatcatcttttagtattcgaaaaattaattttaatattttttataggttctaaaacatttattttttctattaaaaaaaaagtccaaaatttatttattccgtcgaaaaaatgaattattgggtatgaggataacttcctatacaaattttaccattatattataaaaaatcatggctccagtattttatttaaaatgcatcactgaaacgcatttttcagtagcttattcattaagaatgtctgattgtttaaaagaattaaatcattttttatggataaatgtttgaaatattgtcgtaaaaagaataatagtgacaatttaacattaaaattttaaaataaaaatatttgactaataaaggaagcattttttaatttaaatattttttaaaaaattttttattataatatatttatttttttataattgttacaacttccaaaaaagtccgtccgccgacagctgctgcacttcttctccctacacttcaccaataaaataattcatcgttcaattttccgtatttattcacttaacatcagcaccaaattcacccatccccaaaatgctcctcaactcgcaccccattcatgcaataaatttgtgcgcaatttattgattcagccggccgtccgatctcgcgagaattattttctcgaaaaaatgctcctatcatttcataagaaaatgtagaattttttcaaattttattcagtttttgttgaatttaaagctttttgcttttgtaaagactgatttcattatatgaatgcatttgtttggactttttttcgcaagaaaaccattccatttttcattaaaatggcatttaaaaacattttgaatattaatgactcagc

SEQ ID NO: 12047 - DNA, 1577 bp, Heterodera glycines
tttaaacgaactgattttatggccactttctataaaggcgatggcggtcgctgtatgaccgtaaacccagttttttgtatagaaaagggttgtccaaattgcaaatggatacagtatctgatttatttcacaacgccaacacgccgttgaaaataaaaacacaagtgcatgtgatggcaaaagttgtgaaattcaaacgcattttacggccatgaattgccgggaagtgaggcgatcaaaattcataatgatagagaatgtgtggctttacctgttttgaagctaagtcggggatctgacggctaatatgagaataaagtgcagttctctctttaaacgaactgattttatggccactttctataaaggcgatggcggtcgctgtatgaccgtaaacccagttttttgtatagaaaagggttgtccaaattgcaaatggatacagtatctgatttatttcacaacgccaacacgccgtttaaaataaaaacacaagttgcatgtgatggcaaaagttgtgaaattcaaacgcattttacggccatgaattgccgggaagtgaggcgatcaaaattcataatgatagagaatgtgtggctttacctgtttcgaagctaagtcgggtctgacggctaatatgagaataaagtgcagttctctctttaaacgaactgattttatggccactttctataaaggcgatggcggtcgctgtatgaccgtaaacccagttttttgtatagaaaagggttgtccaaattgcaaatggatacagtatctgatttatttcacaacgccaacacgccgtttaaaataaaaacacaagttgcatgtgatggcaaaagttgtgaaattcaaacgcattttacggccatgaattgccgggaagtgaggcgatcaaaattcataatgatagagaatgtgtggctttacctgttttgaagctaagtcggggatctgacggctaatatgagaataaagtgcagttctctctttaaacgaactgattttatggccactttctataaaggcgatggcggtcgctgtatgaccgtaaacccagttttttgtatagaaaagggttgtccaaattgcaaatggatacagtatctgatttatttcacaacgccaacacgccgttgaaaataaaaacacaagttgcatgtgatggcaaaagttgtgaaattcaaacgcattttacggccatgaattgccgggaagtgaggcgatcaaaattcataatgatagagaatgtgtggctttacctgttttgaagctaagtcggggatctgacggctaatataagaataaagtgcagttctctctttaaacgaactgattttatggccactttctataaaggcgatggtggtcgctgtatgaccgtaaacccagttttttgtatagaaaagggttgtccaaattgcaaatggatacagtatctgatttatttcacaacgccaacacgccgttgaaaataaaaacacaagttgcatgtgatggcaaaagttgtgaaattcaaacgcattttacgcccatgaaattgcggggagtgaggcgatcaaaatcataatgat

SEQ ID NO: 12048 - DNA, 500 bp, Heterodera glycines
  misc_feature (13)..(13): n is a, c, g, or t
gttctaaaatttnttgaacaaattttaaacataactgaagtagtgcaaaaacaatgcacagagaaacaaatcaaaaatgtaagtcaaaaaagttaaccctacttggtatttcatgaaagtggtgccgtgtccacgctcttcgtcggactgttttttgaaccatttcgcaatgttgtggagagcaacgtcctcacggtcgaagtaaaaggacttaacaaaagaaatttctgagcgatttagaagatttaatggaaccatgctcaagtagacgtagctggcgtacagctcaatattgatctgtttgttgatgccggcttcagtttcagctgcaaaattctgacggatcaacgattcctggtgttgtgccattgtcaaaaaataaattttcaggctgaggaattggaaaaaaatctaacatttaacgcaaaattaagcaatacttggaaattggcatgcctgtacttggaaagtgacttggtacgatccgagcactgatttaa

SEQ ID NO: 12049 - DNA, 3847 bp, Heterodera glycines
atcaggtccggggttcggaatttgtcgaaatggatgccgaattcgtgatcagcgaacccgaaaagccttagaagcatgttttcactacttttaaaaacaaaaattaattttttcgaaaaatggggggggggaccagctccactattaccaaagtcagtacctattaccaaaagggcgttatatataatagccatcctagaagccctatacaagcttaaacatttttagtacttaatgtattaagtgcgataaaacttttgaggaaaaggattgaagtcaccatcatataggtatcagtaccaggacccttgttttcaggactttttaaaccaacaaaaatttgtgaaaaatttcgacccaaaaggggggggggacccaaactgaattagtaccggtatatttcatattcctttctttaatcttcttttactttagagagtatttgattgagctttacttgaaaaaatgaccgaagaaagtgaagaatattgtttgggaggcagacctttatctgatctgaaggtggttgaattgagaaaggagctcgaaattcgcagcttgcctaaatctggcaacaaaaaagaacttgttgagcgtttgcaaaattttcttcgagatgaaaagtctgagcaaagaactggaggagagtctcatcaggcgcaaaaaacagcaccaacaatggaattgaaccaatctccgagtggggtttcagtgccgaatgttgtggcacaatatcttgcccagcagcaaattcagcttcaagcagccagacgaagtgccggtgatttctttgttaaataagttaattggtccgtaaatctctttggtctctattatattattattctgatattaaagttttgcttccctcagacagcaaaagtttattcagacaatgagaccgaaaatgttcaataagctctaatatactcttgcacatttcattttaacacccatgataaattattgtccttttttaattaaaaataaccaacgaaaaaatagtatttcccttcaaatacatattaaaacattttttgttcattgtcagataaaataagagccgacacttcactggacgattcagcagaaattatgccaatctcatcaccaactgaggaaatccaaccatcgcttgaacagcaaaaggaagaagaaagtcaagaccaaatcaagcaaagcagcgaatcggcacctgaactggtgaattctgatgtaaaggaaccttcggttgagaaaactgaagaatctgctgaggtattaaaacattattgggtccaaatagccataattaaaattcaacaaaattataacagttacaaaagggcgctgatcaacatttggaggtggaaactgataaatctcttgaggaagaaagaacaaatactgaagaaaaggaggggtcgggtgatggttcaacatcagaaaaggagcgcgaaataaagaaggaggaacggacggaagagaaaacgacggaaccgacgaaggacgaggaggagaggagcagccgaacagaggggacacaaggggaccagcaaatcgaagtcaaagccgagtcagacgaagacgaaactgagaaacccgtagagactgtgaaccgaaccgaaacggtggacacacacgccgaagaaatgtctcctgacaaaagtgccaaggcacgctcttcagttgtggaggaggaattggatttcgaggtttgcgaaagaaagatttggatagttattgttttttgcttcctttgttagaacgaggaagacgacgaagaggaacgcgaagaaccggcggatgacgggggaaagcgccgcgcgcatttgaaacagggctcaccagtgacgatgaaatcatttgagcacaaattgggaccggagcatatggagcagaaagtgaccgatgtcatttccaccagtaaaactgtcgcggtcagcgagtccgaagttgggcctttggtcggccaactgaccgcttcaatcaaagaggagtcgagcaaaccgccggagggacagcaggagaataccccggaggggttcatccggcgcagaccttcttcacccgcgaggcgggctaatcgcttaatgattggatttactcgctctgtttcagacaccctccgtcgcgttgggttcacatcagaaaccttaagcggccgttcacaaaggcggccctctttgatctgcttagtaagtttggcacggtggacactactcacttttggatggattccatcaagagcacctgcattgctacggtatgttgggttcagaatttaagaactgccttagattagaataattgtccttttagatttttttaactttggataaatttttaaaataggaacaagctcttccactttagtacgaaacggacgaacaagcccaattggcccgtgaacggcttcacaacgtcgtatggcccgtggcgagcgatttggcactttgtgtggaattttcaactgaggaaaaggtgatggattattggtgacaaatatacagaaacaaatctcattctgtcagctgaatcgacgaaaggcggaagaagagcaggaagcatcggcgaacaattcggcactcggcggaggattgggattgacaattgtggtggataacagggcatggattttaaaattgataattcacttaaactatggagatcttttccagggccgtgggcctgaaactgtgcccaactcgggccccacggtgctcattcagcacgacaaaaagcgacaaaaggacgcggaaaacagaaaaagaaaaggtgccttttgtgaaattaatggtgatttataaaacggattttagttgaggaattggaaaagtcacagaagactctcgacgaagtgttcaagaagacaaagactctgccggccatttactttttgcctttgtctgacgagggggtggtcattttgttttgttggtccatcggaatctgtgaaattaactccgaattcaggcggtgaaacgacgaaaaaagttgtcagtcgacaaacagcagtcacaacagaatagcacttccgaatcgcaccgaaattcgggcgggaatttgtcgcgaaaccgcccaagtgcgagtggaggaatgtcgcgaagaagcggtggtggcggggaaagcggaggacgaagtcgccagtcgcggcgataaacggaacggcgtgggaggggagggcatggaagttgtgaattcgacgtttgggtgggcagtgagtgagtgagtgcttatgacccaaactcagcgacctttagctgcttctcccctcccctcattcgaatatttctccccaattcgttcctttcgccaagatcaaatgtcactttttgtgtttgtttctatccgctttcagttccgctattttctcaattcgtcgctttattaaaggatttactcttccaagaaaagaacacccaccaattaaccaaattggctgattcaactgaacccgtctttgttgtcgccaaattcgaccaaagaatgctcttccattcattcgttggcattgtgtgaagaatggcatgcgcttgctgaccaacggaaatttatttaaacaatttatttgtttccgtgctgatgttcttttattttgtcttggaaagttaaataaagtataagtcccatcatgatcggaatccccaaatttttaataagaaacatcttaaaagcactatcattcgatttttgctatcgatcggtcccgattagtaggcgatgaagcggtactctcgaaagtgctgattcagttgggtacgccctcggtggggagcggggaagtgtgcggttccgcttttcgcctttcgaattcgcccctgggggacgccccttttgcttgtccaccaccagttaataatatgct

SEQ ID NO: 12050 - DNA, 3784 bp, Heterodera glycines
atatttaaaaaatataaaaggaaacaacggatttattaaaaaatcacctaatgaattcagaaaataggcattgttaaggctatatagatttcacttgttaataaaataaataatgaataatttgtttttaaatcgttaaaaaaatatttaaaaaagtagaatttattttaaaaaattcagtgatttacacattttttagttgtttttaatgtttcttaccaagagcacactaagaaataaagttattgggaaaaatatgaaataataagtaaaaaatttataaaattttaattgtaagaaataattttatatatatactataaaataaatcacatttttgtcaccatttataaatataataatgaagaatatcttacagttaaacgtacaaaaaaaagtaatgaaagcgaaaatattattttataggaaaatattattaaaagcgcttgaagaattataattttctaattatataacattttcacatattctactcaataatacgtttttaaaatacatatttcacaaaatatttgtattaagtttttttatataatttgttcttatttaattaattatttatttctcatttagacttattttaatttggttgttttcttttcaatttttatgtccctttgcttctaatttgtatttcccgtcaattcagtgtcactgtaacatcgattgtttttctgctgctgcccagcagccatggtcattccctattcattcattcgttttttttgttttatgatatttattcgttctgttttctgctgtgaatttaatttgctgcctcggctttaaattgtaaaagtaaattgtttggattttggattcgggatacaattctccatccccatttggctaattgtgtgtgcggtaattgcttcttctcgccaattcaccgccatcgcctttctgtgtgttacgacgtccagcaattgttgaatattggcttgtgccattgtcggtggttatcgatcgcttttcagttgagtgttgaaattggacgatgaaaaccgcgtattgcggaaccgcaacccgcctagggtctataggtttttcggcgattgaaaaccgcgcctagcggaacctcacccttttagggtctattggttttttgacgcgatgaaagtcggcggtcgaaatgtggacggtttgttttcgtccacttgaagaccggcggcagaatgttgaaatccacaaattactctcgcctggagatgtaataaatgaataacaaatgcgctttatgtcgtttgctttttagctgactgcgccaattgttcggtccgagggatttgtttaagtccaattaaatatttatttattggagaaggaaaagaaagtcacaataatttggggaacaaatataaaagcaaaatgaatgaagggaagaccatctaaaggggaatgggagcatatttatgggcgagggaaggaacatgaaatggaacagaaatcgattggcattatgtcatgtcattcaaactacggcggcagtgccccgaacaattttgtaagaagtgaacgctaatttgacaaaattcattagaaatagggtacaaaatataaaaaagtggcatttaaaacatataaatggtaaaaataacccagctgatttggcgtcaagaggaacatcaatggaagaactacaaaatagtgaaatatggtggaaaggcccaaattttctttcagaaagggaaaactcttggcccaaaacaatacgagaatatgacccaacgaatccaccagaaataaaggaaaaacaaaatgttatttttgagataaattcagctattaaggaaaaggatttttgtgaatttgaaaaacatttcgaaagattttcaaaatgggaccgtttaaaaaattcaattgcttacgcacttcgagcctttaaaaaggaaaaccaaaagaaggtttcccaaaaatatggaaaaaatttcggatatcaaaataaaaaaaatggaaaggagataacaaaagaaattattaaattaattaggcctttagaggctaaagaaatccttaaagctgaaaagctgattttcaaattaatccaaacaaatttgtctccaaccaaatctattataagaaatttggatttgttcaaagatgacgatgatttatggcgcacaaaaggaagaattttaaaaagtggtttaaattatgacactattaatccaattttcattcccaataattcatatattgcgactttattgatcagagatattcatatgaagacaatgcatggcggtcgcgaattggttaatagcaaattgagagaaaatttttggattcctaaaagcagaaggaaaatttacgaaatattaaaaagaaaaaacaaagaaaaatgcggaatttgtgcaaaatttgcaaataataaatatacatatcctaaaaaccctcccctaccagtgtttagagtaaaagggaaaggtgcatttgaacatgttggaattgattattttggacccctctccgtaaaaacattggatggcaataaaaaatgttggggagcaatatttacgtgtttaattgtaagagcaattcatttggagttagtttccgacataagtgccgaaaaatttcttttagcatttcggcgattcattaaaagaagaagagtgccaaaattaattatttccgataatggtacaaattttgtattagcaaataaagcactaaaacaaatagtactcgaagaaaatatacaaaataaattatggtcagaaatttatcgtgatccgacggtacaaaatttttcatcaaatttgggaattgattggcaatttaattcgccatatgcgagttggcgcgggggagcttacgagagaatgataggacttgtcaagacacatttaattcggagtttaggaaaacaattattgagctttgaagaattaatgacatatttaatcgaagtcgagaggattgtaaacgaacgccctttaagctatataacccaagatgaagtgattgaaccattaaggccaatcgatatattaaatccgacagatggagaacctttctcactaaaattggatccaacatttgatcggaaagacgtgaatgaatattttgaaaagaaaactaaaagagaataattatttgaaatttacaaaaaagcaatttttaaaagcgaaattttttggaaggaatggagtgaaaaatacctattatcgttaagagaaaagcacatcaataaaaataaagaaggaaataaatacccaaaaatcggacaagtagtaattgtgagagaccaggataattatccaagatcaatgtggaaattaggaaaaattttcgaaattctttctgacgtgagcagttggaacccgagggcttggcttatgggcatgcgtggcacccgtgagcagttggaatgggcatgcgtggcacccgtgctcagttggaatgggcatgcgtggcacccgtgagcagttggaatgggcatgcgtgcacccgtgaacagttggaacccgagggcttggcgaatgggcatgcgtggcacccgtgaacagttggaacccgaggcttggcgaatggcatgcgtggcacccgtgaacagttggaacccgagggcttggcgaatgggcatgcgtggcacccgtgagcagttggaatgggcatgcgtggcacccgtgagcagttggaatgggcatgcgtggcacccgtgctcagttggaacccgagggcttggcgaatgggcatgcgtggcacccgtgaacagttggaacccgaggcttggcgaatgggcatgcgtggcacccgt

SEQ ID NO: 12051 - DNA, 1869 bp, Heterodera glycines
  misc_feature (55)..(56): n is a, c, g, or t
  misc_feature (65)..(65): n is a, c, g, or t
  misc_feature (71)..(71): n is a, c, g, or t
  misc_feature (76)..(76): n is a, c, g, or t
  misc_feature (93)..(93): n is a, c, g, or t
  misc_feature (108)..(108): n is a, c, g, or t
  misc_feature (137)..(137): n is a, c, g, or t
  misc_feature (151)..(151): n is a, c, g, or t
  misc_feature (171)..(171): n is a, c, g, or t
  misc_feature (176)..(178): n is a, c, g, or t
  misc_feature (186)..(187): n is a, c, g, or t
  misc_feature (205)..(205): n is a, c, g, or t
  misc_feature (208)..(211): n is a, c, g, or t
  misc_feature (213)..(213): n is a, c, g, or t
  misc_feature (216)..(216): n is a, c, g, or t
  misc_feature (224)..(224): n is a, c, g, or t
  misc_feature (228)..(228): n is a, c, g, or t
  misc_feature (236)..(236): n is a, c, g, or t
  misc_feature (261)..(261): n is a, c, g, or t
  misc_feature (267)..(267): n is a, c, g, or t
  misc_feature (269)..(269): n is a, c, g, or t
  misc_feature (271)..(272): n is a, c, g, or t
  misc_feature (275)..(276): n is a, c, g, or t
  misc_feature (281)..(281): n is a, c, g, or t
  misc_feature (285)..(285): n is a, c, g, or t
  misc_feature (287)..(287): n is a, c, g, or t
  misc_feature (289)..(289): n is a, c, g, or t
  misc_feature (292)..(292): n is a, c, g, or t
  misc_feature (295)..(296): n is a, c, g, or t
  misc_feature (298)..(299): n is a, c, g, or t
  misc_feature (304)..(304): n is a, c, g, or t
  misc_feature (312)..(312): n is a, c, g, or t
  misc_feature (314)..(314): n is a, c, g, or t
  misc_feature (324)..(324): n is a, c, g, or t
  misc_feature (332)..(333): n is a, c, g, or t
  misc_feature (345)..(345): n is a, c, g, or t
  misc_feature (352)..(352): n is a, c, g, or t
  misc_feature (361)..(361): n is a, c, g, or t
  misc_feature (369)..(369): n is a, c, g, or t
  misc_feature (375)..(375): n is a, c, g, or t
  misc_feature (381)..(382): n is a, c, g, or t
  misc_feature (386)..(386): n is a, c, g, or t
  misc_feature (396)..(397): n is a, c, g, or t
  misc_feature (436)..(437): n is a, c, g, or t
  misc_feature (448)..(448): n is a, c, g, or t
  misc_feature (454)..(454): n is a, c, g, or t
  misc_feature (458)..(458): n is a, c, g, or t
  misc_feature (468)..(469): n is a, c, g, or t
  misc_feature (483)..(484): n is a, c, g, or t
  misc_feature (486)..(486): n is a, c, g, or t
  misc_feature (490)..(491): n is a, c, g, or t
  misc_feature (494)..(495): n is a, c, g, or t
  misc_feature (501)..(501): n is a, c, g, or t
  misc_feature (508)..(508): n is a, c, g, or t
  misc_feature (512)..(512): n is a, c, g, or t
  misc_feature (514)..(514): n is a, c, g, or t
  misc_feature (525)..(526): n is a, c, g, or t
  misc_feature (643)..(643): n is a, c, g, or t
  misc_feature (665)..(665): n is a, c, g, or t
  misc_feature (711)..(711): n is a, c, g, or t
  misc_feature (1698)..(1698): n is a, c, g, or t
taaaaacactttttaatcttttttttatgggaccactctcatttaggaggacccnnaagggccangaaacncgacncaccattttaagcccgnccaagcgaaacaganaaggacaaaaaacgggagagccggagacngacaaagaaaaaancaacagcgaggcggacgggncaccnnncaagaaannacaacaaggaaagagcancgnnnngnaanccaagaanaacnaaaagaanaacacggggacaaaacgacaaaagngccccncnanncgnnccaancccngngngcngcnncnncaacngaacgaanangcgcccgcgnggcgacgnnccccaaaaaggnaaaaggnagacccaanccgacgancgcaanagacgnngacnaaagggaagnnaacggggacgcagaaaaagaagacggcacgggcaccaanncgagaaagacnccaaancccnaacgagaacnngaacaacaaaaagnngnaaannagnnaagaanccggaancggncnaaacacaaaannaagcaaaaaattggttcaaaaaaatcataggagaaggaagcgttgcgaggagaaacgtgtgggaggggaagaagcgaagcacaccttccaaagcaagcccgtagccagaaaaaaatnttcggggggggggggaatctgnaagacctttttttgttgcttttcgggcaaaaacaccagtgctattntaaaaaattcagcgcccgagagccaaaaacagggatttgtactaaagtaaaatgggggtccggcggtgccaataagcgccgccgggaaaatttttgaaagtgagtgcaatttgttaccctatgagatttcttttcctaacttttgcgtgctggactgggattagaaaaggacccgaatattcgctcattgccgctggtttgctatgcctcacattctcatccaaactgccagcgtccgcctgcagcgtctctttgagggagcgaatcgcatggcgaatcaatgcgtctctgtcagccgtctcaaattctggtaggttcttttcgagataagttcgcgcactttgtgaccgagcaccaatcgaagcagcaaacatttcggacacgtcccccgagggttcggctttcacaacgtgaggccctttgtcctgtcaaaaagcaaatatacatggaaaagctgtaagagacgaacatcatatccaatgatgagcagtcccacaccaaatgggcggcgtccgtaatattgggtattggactgaagttctggaaaagtcgaatatattcgccagcggcgtcggttacaagaagacaaaaaaataaaatataaggaattagtcttggctctctttgcaagcaatggaagggggggggttgacgaactctttatcaaaatttgttagattttcaaacttactcaagcctaatttacggttgagcagttcaaccgaaattggattatgatagttccagcgaaactcggcgcattcactttgcataaagcgtctgaaataaataaatttaatattcaggtgtaattttctaggccaaaaaatagataaaagttgggcccatcgactttagttagtttattttgagatttgtggtcccactgacatcacgcaattatgaatatttctcaaattttcgctttatttctgtattcgaactcacgccaaaatgcgtccatctgaaataagcccagacatagancaagccgagatgatcgtccaatttgaaaactttctgctgatatgaagaaagctcgttttgtgcacgctaaaactcggaaaaaagtcatctgtggtcactttttaacaactccccctccatacagaatatattgaccattaccataagtgcgaccacaacagcataatcttt

SEQ ID NO: 12052 - DNA, 3587 bp, Heterodera glycines
ttgaaattatttattttggcttttttattatttattttttttgaatgaccaaataaggatttactaaacattttagaaaattgtttttcgaatttcgtttttcctaatttgtaatataatgcttggttttagatgtttatggccgcggatgatagcaatagcgagaaggaatcaaactctttgagcattcgaactgacaaattgctttcggtccctttcaacggagaagagacttccgagaacacatcccaacagcaacaacagcaaacgcccgttgcccttccgacttcatcttctaaaattttatctaaacagcacccactcaagacgaaatggaatttctggtttttgaacaacaaaaagaaggacatggactggttggaaaggttgtcgaaagtttgcacagtttcgaccgtcgaggaattttgggcgtaggttttgtttctaaaaggacatttattatttggttttttagtttttttgacaacattcatcctccatctggcatgtacggctgcgattacaactttttcagagatggaattgaacctttgtgggaggtggcacagaacaaagatggtggtcgactggtcatccaagtaagtcatattccttttaagtcatttgatgaattctcctttaggttgacaagcagcgaaatgagctccttgatggttggtggatggagtttttgttggcatgcattggtgaacaatttggagacgattctgatcaagtttgtggcgccgtttgcaacatccgtaacaaagggtcgaaggtaaaaaacgaatgaattaatcctccactggactaattactttttatttttagatcagcatatggacgacaaatgcgtcggaagaagacaaaaacagacggatcgggtgagttttgttatattttttctgacctaagctgatcgtggaatatttctgtaggcacgtcttaaaagatcgtcttcaagcttccggtggattaaagcctattaagataaatttcgaaggtattatcttgctctattacattttaggcgtccaatcagtgactttcctcagtttcttaagccttaactcttttcggtactttccccttttggggcctatttgtattttaaaaagcaacaaatggagcgtagaattgcaatttttttctcattgcataaatccattgaggaaaacttcgcacaaattgtggcatttatgccctcaagtaactttggcgcgtaatttttggaattctgcgcttcctttgtttaaaaaataaataaaatttaggtcccaaaactgaaaagtaccctcttttcttacttggtcaatgccttctttctttgtatctaaacagctgaaagtatatgattttttaagataaaaatttcagtgctaaaggcaacagacaaaaaatcattcttcaatatattcgtaaaattgattggtcgcctaaaagtcgattgggtggtgcataaatagccttattttaaatgattttctttttccaatttcattttagaccatgaagtggtgcagcagaaggtttgttttttgcttaatttttcaggcatttattttggcttcagacttcgagtgccatcccctgccgcttcatgatttaatgctttgttgttgatttgaaattatattgttagaaacgaaggcaaaattttatggaccgcgccttatgttattggttcggatatgtaccgtgttttatttcattgttttctatttactcacgtatgttagactgataaacgctttatcgtttcacgaaaatttccttaaaccagcttaaaaacataacacacaagtattaataagatcatcaacattgtttgttgttttgacgtcagtttcttgattagcgcctaaaatggtcttagaaaagggtttcacgggatgatatttttatcgcggggggggggcataacggaaaatcaacgcccccctgaaataaagccctccttttcaagggggttgaaaaatagagccaccaggggctctattatatgaaacggtaatattagggttggattctcactttttggtactcattattagagctgtgaatttaagtcgcgaaaaatcttcaaaaaagtcctcgaaaattttcatgaaaaaagtcacaaaaacaatttatatctcggctcttactgaaccgagttggatgcggtttttggcatattatagagagtttagagcagaatcacatatatttttcccattttcccaaaaaaaaaaatttgatatgacttaaattcccagccccacccccccccccccctcatttcacagaaaaaccgaatttaaatgattattcaaataaatttaaaaaggatattttggaatttttaaaaattttgtcatttctaccgatttttcgaacctttgatcactttttcctgatcagtttgggggtcagggccaaaaaagccgaaaatttgcaatagtaaatcgactatgctctacacgataaaagtggtttaaaagtgatttgaacacatacagttcggaattttcccttgttaagaattcgtaaaactatgagtaaaattttactcatatttgctctggaattccataaagaaaaacagaattaagcaatgaatgcaacatggaattttgtgaaaacgcatcgtggcaaaatatttactgggacagcaatcgttgcaagtttatattccgcaaagaaatttcttgaaacggatacggccactgtatgtatcacaaatgtgaaagaaattctttttggctgtggcgaagagtcagctgatgaagaaattgaacaatgcattgctgaggtgaatttgattcaacgatatgaagtgcaaattaattatttttaaagacgcggcgccattttctcttcgatgtccatcagcagtcgtgtgacaaaactctgcgaaaaatcctccctgagctcactttgagaattgccgaaagatttaatactgaacaacttttggatgagttgcgatcatcgccagggccgagcaaagaaaggaaaatccaaatttgggagcatttgaaagtgatgcgacgcataaaacactcattaataaaacactttaagacccattcactgtgccgactcatctctttgataattgtttttccgctgacaattttagtattaaaatcgcaaaaagccatcatctgtcagcagttgtgtcaattgctatcaaacaaaaagacgaagaaggacgaaagaagctcccttttcagccaaggaatgtaaattgttgtgaatttgggtggtgtttttccgaatttacaaaaggatccccagtaatttagttcttttgtgaattcattgctccagtcggatcaaaatggaggagccgttcagcaaccgcgcgattcgactgggaaattaaccgaattattcaataatttgacggtgtactttcgggaagacggtaaaacagcagacaaaatttggacaaattcgaatttaaggcgtcgctttgctgatgggactcatcgagcgaatcgtttgccaatccgtagaaaaagtccctctgagcggacgattcaactccaatgactttctctttttgattgaaaaaattcgagcaaagatggaggaaatat

SEQ ID NO: 12053 - DNA, 3806 bp, Heterodera glycines
  misc_feature (215)..(215): n is a, c, g, or t
cgcggtaaaaccgccccccccctccctttcgccccccctccccccccccaaacccgtgccccaggcacgggttcgcgcggtaaacccgcgcccggcggcacgcctcaaagggcagctgtcccaaaaagcaaataatcatgacgacgatatctggatactaactactaacagccacgggataattctccccgatataatcaagttttttgttattnagcaaaaatgtcaaatatctggaaatattctccaccgctgggttgattgtgacagatctgagaaaacgtttattgcctgagaatgtggacaaacttttatttttgcatcacaatcttaaaatttatgattttgattatgaataaaatttttgggaaaaaattattttaaaaaaatcggaacgtaatcggaatcggattttgtctggctcggcacatccctggtgtaaatacatttcgcctactaaccaaaatcattcatttcgcctacaaacccaaaaaaagatatttggacaacgaatttcattagaatattatattctaaattaatttttaaattgatttattttagtattttttataatgataatttaaatttaacctaaaggtccacggaaactaaaaatttataaaattccaaagaaacaatagaaaatattaaattatgtaaatttgcatcggcatcaccagtagggatcggattcttagttttttaactattttttctgcggctttaactcgacgagaaatgcacgaaaaacacattctttttcgaaatttttcgtttttagtgccactattcatcactaggaatcactatttggagcttcgccactaaaaaaaactatttcggaagttagccactaaaataattttttgccactagtttggcgtttcgtcattatttttgccactattttggcattttttggaaaatttcccaaaaaatagaatcgacctaaaaaattttcaaaaatacacccctaagaatcgacctaaaaattttcaaaaatatacccctaagaattggaaaaatttcacaaaaattcttcccccaaatttttttttcttgttcaatattttctaagaaaatattttgtaactgcaatcagtgaataaaatctttttccttaattttaaattgttttaaaattaaaaatagctatttaaaaaattacacccctaaatttggaactttttcgccactatttttgccactattttggatttttttctcactatttagttaattattttgggattttttgccactaaaaatccgatccctaatgataaggaaggaatgtggaggagggaggtcagttaaacaggtcaaaagtgcaaacacaaagcatgtaaatgacctaattggaagtaaaaaagttgtcaaaagaaaaagaaatagttaagagaaagaaaaagacaaaagaaatagttaagagaaagaaaaagacaaaagaaatagttaagagaaagaaaaagacaaaagaaatagttaagagaaagaaaaagacaaaagaaatagttaagagaaagaaaaagatacaaaatgaaatagttggagagagaaaagatttctcctccccggttgtagtgattaacaaataagcggaggaaaaggaagaaaaaggaaaagaaacgagtgtaaaaaaggaaaggaagatacaaagggaattgtttcgaatctccctaattttgcactataattatgttataaagcgataggaaagggcctattatttgctagtgctgttcgagaccaaaaatttcccgagactcgaccccgagacccgagaccgagaccgaaaaccccgagacccaaaaaacccgagacttttttcaaaaaattttccaattcgcttaaaaatcgttaaaaacattttttgactctattcataactaatttttggttttttttaaattttgattcaattggtacaatatttatcatttcaaaaacgcacaaaacaaaaattcattaaaatttaagtgcaatttgttaactgatttagtccaaaaaatgaaaatattttacgaatttaattgttaaaattatgattgaattcccaccgaaaaatgaataattttgaaaaattagaagaaaaacaactacttggaggggaattactttttttaaaaattttcttatttcttaaaaattatgaaaaattactattacgtttgaaataattgcatttattcaactgaaaaattatgaatcaaaattaaaatgcaaaaaaacagggctcccagattaaaagtttcaaaagcctcatttggtatgcaaaaaagcctcattttgagtcaaaaaagctcatttttacaactttattcaaaacacgcttattccaaaaaacttttggggaacaaggggggccggcggtgccgataggcgccgccggggaaaatttagaaaatttgagtgttatttgttaacagatttcaccaaaaaattaccaaatttggcatttgagctaataaaaattagtggttttaggcgacactgagtaaaagtgcaaattttagcctatttattaattaaaccataattatcataatatggattttttattcttgatttaaatttaaaaaagcactaaaaatttattttgaattttccgttcttaaatagtaataaaaaaatttcacaaaaaattaatgcgtaaataataattatttttatttgttctaccaattttccagggtctttaaaccttattttgcctatttatttaatatgataaatgctaattttaataagttcacgatagaaagttgctggtaagtaaaagaagatggttgacggttaaataacggtggttgcttgttgctccaccaggggcctatttcaaattccgtcaaatcattgattgacgtcgaatcaaagaactgtttcaatttaaaatcaaaggaaacgtttgattatcaaaggtttctgtttcaatttcctttgacgtcaaatcaaatccgaaatcaaatgtttctgtgataaattcttttgatttttaaaatcgtatttcaattttgtttgacgtcaaatcaaccgttaggcgccgccggaaggttttttcggaattttaatgaattttattaagaaattcattcaaaatttaaaaaattttccaatctttcaacccgtcatggttgaattaacttttaaatttttacaacgcacggggtccccgatcccccgacgaagtgtcggcagatcggggggcaaaatgtcgagggccgtggacggggccgaggggtcggggtcggcgcttaaccctacaattaataaaaactacgttaaatttgccaacaatattttttggcatatttcacattttggaaacttttacaggttccttaaaaaatttaaaaataacgaagaagaggtaacctgtgccaatagacgtcgctgggaaatttttaaatgtttcaaagtgatgctagggcgttcgccaaacttccaattttagtttttcataaaaaaacccttcttgaactgttcaaaaacgcaatcaaataaatatagctaataaataaataaacataaataattcaaaaagtaaataatattttattcattattattttttttgcaattggataaataagtaatttttttttgtgaaaagcactttttgtggtgcatttgttgatggatcggagacatcaatttaacaaatgacttggaactatttccatttaatccattcgtttgtctttgattattcattttgctcacataataaatttattttcagaaaattcgtacattttttgccatcctattttataataaaagaaatttccgaaaaattaaaa

SEQ ID NO: 12054 - DNA, 1415 bp, Heterodera glycines
cgcactgggcacttgccatcagcaaaatgtccatggcaaagattgtggcgaaaagcatcacagcgatggggacaatttgggatttggaacatataaaaagattgtaagattgccaattaatcaaaaaacagaaaatttatcaaaaaatggcatagaattcgcatcttttggaattttaaaataggctaacgaaaatgtgaattataaaaaaattttagattcagaaaattaccagtttttgtggtatcgtttgagaattttgtaccgcttattttttatacaattaattcgaaaatcaatttaattaaattttttgttattttttgtccattgaaaactgtattttagcatttacgtagacacaaaagctttttttgaaaacctagatgttactaaaaagcaaaatttgtaaatttccagaaaaaacaaatgaaaattttttttatttcttaataactttttcgagtaggctaggaattttagatatttttgaaatttttggaaaatttataattttttacggcgaagttatgtcccggtgatatttcggccggcgactttttccggtgacgttttgtcctgctcccccaaaaaacacacaaaatatgtcctaaaaaatcaaaaaagggaatattcaaaataaaaatgtaatcaaaaattatttatttctcaaaaaatctatttatccatttcacttgaacaatgctattcaaacaaaaactatcaaactccgaaaaaacaatttataagtagggagggatgtaaattttatgcaaataggtttcacgggatttaaaaatgctggtttttctgttcgttccgtagttgacagaatgacttgaaactttgcaggaaaatagcttagtataagggcttaagggctttcgacctgccaaatttcagaatttttcaatcatgtgcaaactttttacaaaaatcaaaatgtttttaaaacttgaaaatttcacggaaaaatttttccgcttttcccataaaaaatgaataattaatttataaatgcataaattacggaaaataaatattggtataaaattaacttgttattaataaatacataattttggagataattttgatattttttgtttttagagtatttttgttaataagttttggacagaacaggtcaaaatggggcttttttcatttttttagtttttaggcttgaacgagatggaaaagccaaaaacaatttaattataacggtttcaattagacatggctttatttatttattttcttgttaggttttttgattttaaaaatcatttatcaaaatatgattcggcttaattttattgtttttgagaaaattttacgatttgcagccccttaaatttgaaatttttaaattaaatgaaactaactttgcaaatcgtttcaaaaactacaaa

SEQ ID NO: 12055 - DNA, 1752 bp, Heterodera glycines
gctatctctttttttgataaattttatacacatacaaaatgctctcgagcatgatagggagggcggtgcgcaatagaccttttatttttgagggaatttgtaaatttatactctatcccagaaaaatggctatctctttttttgagaaattttatacctcacacaatcgctcgcgtatgagacggaggcctgttcactatgtacattgtatttcacagacgcttattgtatgtagtagttgagcgtgaggaggttttttatctctatactagatattctaggctcatacgattttggtgcattatttaagaaaagttttgttatctataggtacttgaagtgtccattttcattgggactcagttgtacaagtgctcagatggcatcggttggacttcatttcctgatttttagattaagctcgtcaagagctttcaaatggtaccaaatttgtccgaatttgaccgttttaaaggttcataggccccccttttcactcaatttttcgagttttgaaccggttcaaaaaccggttttttggcatttccgcaactcgagacatatttttccatgcttagctccttgagacgaatcgactggacccattttttcacggggcgttcactatagtttatccaaactctctttattttaatttaattactctttttttgattttattaattttttttcgaatttttgtttacaataattgggacataaaattggcctacaaattattaattaaattgttctttttccctcttgacatgatgcccacattttccaagaattttctcacgcacttcggcaatttgtactgaatgccgtctatacacatacatttttgtatctgtaattgctctaattgatgtagaaaaattgaggttctcatattaaacaaaatttatctttctcattcaattttcttttttaatttgtcaatttttacgtttattaaattttggtggtcatataaatatttaattaaactaccattttaaattaattatccttcaatttaattaatgtacttttaaaatatatattttttttgtgtgtgtgtgtgtgttaattgcattttacgttcgtcaaatttgatcattttgatttatttattttgatcaaattattcgtttcgagacggcgccgacactcgcaaagcaaatgaatgtgacttaacttaatcaggcaaattgtttttatttggttttcttaatcaaattttccccaatttgtgaagatatatttatcttttctttctgctattttcatttttttaatctaaaagtgtgtcaattttttaggagaatttaatggcaactcttttcaagtctcaattaataaaactattttcgtaatgtccttactcttaatgatttggcatattttgctgttcatagtttagcttcttactatagggaaattgtcggattttcgaaattctgtttaatgttaagccaaattcttacaaaatctgttcgtttgaaattagccaaaatttttcagcgatttttttaaattggtggtagaattcaaaactaatacattaattattttcttctttgaaattcataataatattctgaacatcataacatcaaagctttgcacatttatttagagttaattcaattgaccttcgatttttgtatttttttttgcaatttttttctgttttttgctcattttttttattttacatttgtacaactttggaaattttcatttttttgtcccaaaaataaaatt

SEQ ID NO: 12056 - DNA, 1282 bp, Heterodera glycines
  misc_feature (1276)..(1276): n is a, c, g, or t
attcatttaacactacataattgtttttctttaaaataatttccaattaaatgctcattttcattgcgaaatttctcattaattaattaattaattttattttccattatttttttggcaaaataaaacagttgcccattcataaatggtttttgtaaataaacaaatatcaattccatgacttaactctcgaaatgtagcatttattagtcataaatgcacacataaattaatgtaaatttaattttgatatgactaatttacatgtacaaaacttgaagttttttacaattttttttccccaaatttgacatttatttgtttaattttaaaatgaatgtaaataagcgtaattgctaatggctttttgccatttatttctttatctgattcattactaaactccgtgtctcccccccctgcccctctccctctctgttcccttttttttatcttctctctcttctttcacatttttccatcgtatctccaatctctttcatttttatctacgctttctctctctctctctccctctctctttttttctctctctctctcttttttctctcggtaattaattatttattacattttttttcattattttccccctcttctttttctatgcttttcctttttgtccatccatggttcattatcctttttcctcaataaatttacgatttcccttctccaacagaagcaggcttttcctttttgctcctcttcacccttttctcgcctaattattttgatggatcgccccttttactccgcgggtgcttttaattggctccctccctctcgcctttgtcgggttgccacgccgccaccctcattaacacaacttaatcaacccatccaattttgctttgctattaattattataagcctctagctaaaaaaaaaaaaattgttttttaggaggatggaaaatggaaaatgcgaatagataaaaagtggtggggaaacggcggtggcgctacacagcacaattaacacttaattattcattgtgccacacccaattcaattcttttttgggtaattatatagcttcagttatgtcaaacttgtacttttaaccatcattccatgaatgaattgtgtaattaatttgtgcatttttaatgtttttatatgaaaaaaatttttaacattttttaaaagtaataaattcggaatatcttcatctaataaaaatttatttttccattatctctaatttctcataaaactattttaattagtaaattataattttttaacaantttatg

SEQ ID NO: 12057 - DNA, 2336 bp, Heterodera glycines
  misc_feature (64)..(64): n is a, c, g, or t
gcagaaaaaattgtctggtttttactatgacaatttaattattaaaatttcattttaaaaagtntaattcgtgtaatatgttttattttcaatttactttttttctcaaaaaaatcttttatttttaatgtttaaatttattttacccaattatttcccattttgtttttattattttccatttagaccagcccaccaccattcatttgcgcacctggaaaatgaaaattttattgacaaatttcatttatattccccacttgctccgtttggaccggtttatacttttaatttacacatacacacagtttaattgacgtgcgttcgtcgcccctcctgccgtccgccgcccgcccttcacgttaattacttactaattgagcaattaatgtattaaagtgtccctctccctcccattaccgtccgcccccgtctgtcactttttttcttactgtcattttgtggtgtaaaatttaatgcgatcggtgattgaaaacgttcccttgatcaattagcaaccagcagtcaggtgggccgggagcacaatttacgacgatatttagagaatttattatttccccttggcaaaaaaaaacaccgaatataaaaaataagaaataaattaatttataattggcttctctttaatttgaagggaataatattttgagcaatttcgtttaattataagcagaatatagtttcaagaatttatcacatcatatgtggttttggagaagtttaaagaggattttttgaaagtaaggagttgagttttttttattgttttaaaggattttttgacaaaattcctcaaattagcaaaaagctgctagaaaaatctgattagaattaaaatttgcccagcctaagttccactagccctttctttataagacaagatttcattgttttccattgattgccaatttaaaatttacaattttcgtccccaattaaattacttctcccgtaaacaaccggttctcgtgcgctctcgaatgtgctgctttgatgttctcgacaattttgtctcctatttttttgacactaaccgccgcgccacacatttctttcacaataaaaacatgtgttgtgttgtcctccctttttcattgacttctgccgctttcaaattgttccaccatttaaatgtaccgccattgttcctaaattttgaaatttgttcaaattttattccttttttaaaggtggagggggcggggactttggcaagattcgttttaattatgtaataaacattttaaatgaatttcaataacggcgcttgaggtttaagctttagtctatcttagatattggaaaaaccaaaaaatctttaaaatcttttcgctattaagttattttattattttttgaattgctcagccgatcgagaatctcccaattaggtgtataggcacaacgcttccgtttttgcccacgcctttcaacagtaattaaattttttttctcaatccgacattactaatgaaaatattttgtttttcattattcagacctatttttattaaattctcatgttagggaaactctcttttcctttttggtcgttaattgtttttgtttgtcctctcattgactgcgctaattactacatttgttttaaaattacaaaaagtaaaaataaataataaaataaacccatttgttataattttattgcattttttaattacttactattttttttattacaatttttgttttattttcttatcatttttattttattaatagaattttctttttattccttcctttaaattttatcataaatgattaatttatattctcccggaattctctctgaataaatttgatcaacatttttgttatcatttttctttttgaaaaaattctcatcagttcatcatctcgaacaatctgtggttaatttattatcttttatataaataattttatttttttgttaacacaaaaaatattaacattttttgaaatcttttttttgctattttaaaataaatgtttattcaagttttcttctgctcatgacgtcatttttaaagaaaattaattaaaaatttcatgacattaaaaaattcgcttgcccaaaaatttcgaaactttttttttcttgtgaaatttcgttgtttccattgttttttagctctcatgcgcatattataatcattcctcgctttctcgctttatctgtctgcttaattataggcctattagcgtagctttgtccgatttgtagcaccacatgtgccatttttgttaatgactgctctcttttttctcggcctctacaaaaaataggattattttgcgtttcaattcccatc

SEQ ID NO: 12058 - DNA, 4186 bp, Heterodera glycines
attcttaaaacgaaaagattacaaaatttgtttgtccattatctgcaaacggtgctctaatttcagtgaggctctaaatatatttttaaacaggaaacattgctgtgacaacttgccctcggattcgacattgagtgcgttgtgaaaaaaaaaatacaaaagctaaaatggattctttttttaatgtgcaaataaagtgacttatgcaataggcattactgccttttattacgcaaaaatagttggcctttttcaataaaaaaaaatcgctaatcattgtaacataataaacttagccaacagcgatagaaattaaataaaatccaatcatcatcattatcatataaatttaatgcattacagaatttaagaaaatgtttggggtcaaagattgacgaacggaggatggatcggaagggacaaaggggtaggtaacttttttttgttgaaaactgtaataactatcaattttaaaagcaataagagaccaatggaaagcataaaataaaataatttactttatttaatgtgtaacgggtttaattcaattattttggtttatttgttaacagtgttgaaaattattatcaacatcgcaattcccacccgataatccactggcaaattgagaaacagcccatcagaagggcaacatttcgacaatgttgaacagaaagtcgggcccgaaatttgccttgacggagtcgttcatgtccacgagagtacagcacgcatacatgttaaacgattcggcttgcaaaaattggcttgcttaagaatgaaacaattcgaatttgttttgttttttgaatccattcatttactcacaaattttgtggccattcaatgtgaaaaaaataccccggttgtttgcgtccattccgcatccgacaacatcaccgggaccaaactgtgcgaatccgtcaagcacatccggcacgcatggcaatttgctgtggatagacccgtcactccacaacgcaatgcttgcctcaaaatgcccgaccaattcatgcatcctcatgtgcgctggggcaagtccaactccaacgtcccttaatattatcaaacttattttaaaacattttttttaattcacgatttcatctgaagaacggtaatttcaaagttaaacaatccaaaagcactggtggccggcataaccgagcgcaccgacacaaaatcttttaaaaaaaataaatatttatttattttattaatattattacagttattttgcgacaaatgctcgaccaacaaaaaatcataaacgtaaattccctcgttgcaatgattaatgtcccagctgtttaattgctgggccgcgagaatggactgaaggcaaattttgatggcttcaacagttcgcgtcagattattctgaaaaaatgaagagggcgaataattaacaatataagaaaaaatatataatttttttattcaattaaatttaatgtctcaaaatcgtggccaaattttcttgcattgattaatttggaaaaatagttaagataattaaaataaaataaataaaaaataaattaataaaaataaattaataaatttaaaaaaataaataaataaattttaaaaaaagtttaaaatagaatttattttttaaaaaattcgttttcaaaattttttttgtcaaaaaaaaatataaactttaagtaaaaattaaattaaattaaacccaccaagcggcgaaacatggacaaccacattgcatcgtcaattggaaaacgcccaccaccgccaccacgaacagggtttgctccggcacttgtatttggttcatcaaagtcaataacatgtgcgcgagtgccagtttgagaaacacgacgggagcgctcatacacagaggcagagcgcgaacgagcttaaaaaaggaatcattatcatttgtgacagcataaccaaaaaatacccctaaacccaatgaaactcaacagaagacaaaaagtcacgaaggcaataataattaagccaattaaaatcattctaaattattaaaatatttaaacattttattgataaaaaataaaatggaaatgagcaattgtcgtaacggataatcggaaaattttccgccggaacattaaaagccttttttttttttttttgcctttggactttacaacttaatctcacggacatttctcgcgaaataaagatttaatctttttttattagcaatcattaaagatgagatatggtaagaccgtacagcattcacctcataagttaaggcccgcgtgcctttagaaatgccatttccaattgactactccgattgtgcatgcgatccgatccaaagtcaacatccaccagtaaagtgcgtcatccgcatgcaattcgcgcctcgcccttgaggaatggctttttcggaacaatggcgtgaagcattgccaacatttcaacacccgaggccggctcgttgaagcttttttggggtcaacggttgttgggcgatttcgcaaaggatcagtcgcattcggactttggggaaattcaccagtctgaaagaaaggaaagcagtgaaaagcagccaaaacggagaacggaccaaaaagacttctcgccaattcgccctcggacaattcagtcgcgagacgactcgtcgcaaaggaaagtttgtcgttgggtctgtcgttccaacagaacaaaatggccatctgatgagaggtcacttccaagtcgaaccttcccgctctgctggtgaacgaaaccttcgacagaacatttggcatttgtgaactttatttcaatgttaatttgctaattaccgtcccccgtggaccaatggtgggcccaattcagctttcctccgcagtgctgctttttttgtagaagtcctcaacttccggggtcaaatcctccaattcccgtggcaaagtcaggtgcgaacggtctcgactcctcgaccatgctccggcattcagaattttgacgcttacacaatctgaaaaaccaaaatgaatgtctgtcgttcagtgttccgtcaaccggccatttggctgcagctgccattttccagcgatttccttagggccaagttgagcatttcctccttttcttagtcggccaccaactcgagaatcagtcttcggctcaagtgcgtcttatgataacgcatgaaaacatctttagctgtgacatatttcagcaccaaaagctaaaaaaacgaagtggcgaaatatgcggaatacgtaacaacaccaaaaagaaagtcaaatttcttttccgttttgtacttcaaatgtaaaataaccattggaccgccctgccctaactcaccacgttgttcagtctctcttgtcgatctcttcagaagaaaactttttcgtcagggccgactttctgagcaacaaatcgcaataatttgctagcaattctggcactttgactcgatgttcgctgtgcgtccactgtttagtatttattttaaaaattgcttttgcgcattttcaacctttttcgttcggtttgggtccaactccaatctgaacacttccgtgttgttcaccatttcttgaaatgctttgtctctgacggtcaaaaagcgcgagtcgttgtaaaaagcatctcggacgagttcggagaacactgagtacatgttgagcaactgttccacgtacctttcgctgtcctaaattcaaatttcgatgattttttctaatattttttccaaatcgaactccaaaaatgtaccgtcacaattcccgccgcgtgttcatgcatggcggcgagtccttctgccgtgatgtgtttgtgcaagacgttgagcaaattgggaattccgtcgggtgtccgattgatcagtcggtagagcgtcttcagcctgttcacctcgttgtttttgatcagagtcggaccaacggccaaaagttggtcttgatattcgatcaccagcacttgaacgcattggtccaccaacttaagcgtttaaatgagtcgacaaaatgaccatctagtgcactttatgagtccaatcaattgataatacctggtttttatacaataactttgttcatgctcgaacaaaccctatctttttggtatcattcgaaagtacaaagtctaacgaagcaaaaatatataaaatcgcagcgtttaggcaattaccaaaaaagatttgattaattaagtaaatacttattattttcgtttgtaactttcttgaaat

SEQ ID NO: 12059 - DNA, 1354 bp, Heterodera glycines
ttcgtttcgtcctacattttcggcactttttgagtttcgttttcgtgtttcgttttcgtccgccaaaattttttcgtttcgttttcggttttcgaaattttatttttcgtttcatgtttcgttttcgtatcgaatgagctttttcgtttcgttttcgtatacgaaaaattttttttgtgattttcgcacagccctgtcccccaccacgaaatggtcatacctaacagtgtaaaaatttctcggtttccgagactaaaaatccgagaccgggaaccaagaagtgaaaaccccaagaaatttcccgagtcgagaaccgagactctcgcacatccctaataatttggcatgcctaaaaaataaatacatactgctgaaattttgaagaaaatttcagcaaatttatgaaattctcaataatattggcatacgagtattctcggctctcagcaattctgtttatccaaagtaaaatcattttacatcatcatattaaaatcaacaaatatgattaaaactcagaaaaaccctaaggcttctcttctcccatttcggtcggatcactcactattcatccaacaattgtcccacgcgtcttcactttgatctttgcctcctcacatgggtccggcacacgcttcaactcgttgaaattcggcattttttgcgcattgatcagcattatgtgatcccaatacattttgccaaattcctcttcccaaacatggtagtttccttgcccaattgttttggctagtgtaaaatcaaacgcactctttgcttccgttttcataaaccataaacccttcaaaattggtaatccgtcaacatattttttcttatattcccgtgcaaaagcacaaattcttgacaaatctatgaaataacaaatttttatttgtgaaacactagagcccggtattttgaaagtaccgggaccgggcttagataattgactgggaccgtgccgccctgtcaaaaaatcccgttttaccgtgcccggtattttttttaattttccgggcccggcaaagcacggcgggcacccgggcccgtccgggctctaaaaacacaaagaatttaattgaaatttcgattgcttaccaaagtaaagttctttgacaaattcccacagctttaaataactgtcggaaaactctttgagtaaaaaaatattgtttttgtttttctcaacagactttttataattaaaataattgattatttccttattcaaagcaagattcaatgcatttagcttttcattagctggtactttgcgcatattaatatttgttgcgacaaatgcggcttcaatcaaaagaaaattatgtaaattagtctaaatgtaattatt

SEQ ID NO: 12060 - DNA, 3217 bp, Heterodera glycines
gagctcatttggagttcgccttgtccaaccagcaggaattttggcttcatgcaatggcattccaatggattttctattaaatttaaatttagaaatattttaaaattacttaccattttcttccgtcttaagtgtttcttgtgccctcgttgaacttgtgccaacttcaacttccttctcctgtttttgtccttttctgcatctctcccaacttttcacatatgcttcagctgctattgataacattttccaatattcgcaaatttcaaccaattctttataagatttttggaatccaatttcttctggctttttaatggtattatttttgcaattcattgccattataactcgccaaaagaatcttttgaggattttaattgctttttccatgtcttcctcctccgtcgtgccatcttcgatcacttcaaattgcggctgatcagagtcgtcttctttttctagcaatggctcatttaacttttcatatttatagttcattccattcgcaacattgacaatttcgatcaagatgatcagaagaagggacagtttgatgaaaggaattttgcacattttataaaataaaaatatataatattttatgccttttaaatttattatataatttttcgtttaaatgccagtttatatatttattaatgggtcaataagaatgaaattgccaacattttacaagcatttcacgtccgccacaaatacatatacaacttcatttttatcaataatatttacatttatctacaaaaaatattgtcatactttattttttaaataaaatgagacgttattttgacaaaatttcagccaaacaatcgcacggagtcgagaattgccagcaagatgaagtgtcctcatcagagtcaattttaaattttatggcaatttttttatagttttttaaatttttttaaagttatttggttctggacgaggactaagtaacggcaaagagttgaacaatttgcacgtgatcaacacgtacaacgacaaggaaatggactcaagcttcaaaaaatcaggacattttccgactgccaaactccattttattataaatcttaaaaataacaggaaaagccagtactaaattcaggacagcagatcttaaaaacagagcattttccgttttcatttaccaatctcaaattcaggcatctgtgaaatcaaatcgaatatccttaaaagatttaaatcttttagacattcatgaaattaatttgaaataattgagtaaaaatacaatgtaaatttaaatatattaagttttgatattattaattttttgcataggaataattgttattcaatatataattattgcttttaattatttttttaatacatttgttttcacttattaattgataattagaaaataaaagaattgaccctaaaattccctagtacggaattggaggcacaaagcttacccgttccgctcatttgtacttttccaataaaaaaaaagaaaatcattttgaaaatgaaagtttataaaagttaccaacagagagattaaatcaatctaaagtctacgcccaaagaaaatataaagagtttgatcactgatcaatgaaaatcctctcctcccatgtcctttcttgcgatcctatgatccaaccatccttgctgattttgatcatttctttttcatgagaattttcgtcaaaccggctgatcagccttgttcatcatctccttcttcttcagtttcagtttggcctcatcacacgggtccggcaccaacaactgcttcaactcgtcggaatttttgtccattttcttcatcattgcatgaactttatcatttgccaccactatcaaaatgccaacactttcttcaagcacaatttggagcggtttattgggcattaattccaagctgttcatttcttggaactgttcaattgcgtcaattggtgagcaatttgattccttgccaaaaatttccataaatttggtgctcgactcacacattgttgaataatctattttatatcattttcattattattttaatattatttaatttttggccacaatgggcttgcttattttgtaagcgctttgattcttgcccgaacggggattgtacttcgacgagtcatgtcaactcttagtgatggtcgagagtctcagtttcgactcgagaaaagtctcgggttttttagtcttcgaactcggaaaatttcggtctagagcatcactacaactcgtaacaatggacaatcttttaatatttttatggaagaaaataattttaaaagttttcaataaaaaatttcataattcccaagtaactatagtttatcaagcaaaatgaaaaaggaaagcgtattttttggggttccgaaattccctgaaaattttccaaaatttttgtctattgaaaatgctcaaaagtattaaattatgtcactaacattttttcaattacctaatccaagttgctgcgcatttttccacagcttatcaccttcacgtttgacttttttcaaaattttcaatttttcttcgtccttcaaattttcatttttcaattttttctgttgtttttggtattttttgaacgcacagctcaaattgctgcaacaagtcagttcctcatcaataaagcatgtaaagcaacctaatgttaaacttaattgcttaaattggtcactcaaatcggaaaatacaccaagttcgtcaggtaaatcggataatgcgttaagtccgttttgtgccggcggattagaaaattgtttttttaaaattgaattttcgaatccatcaaaataggggtcgcctttaaacgccagtcttgtcaagttcagaagatggatattcttctgttttgtctccatttgtccgatcgtcagtttattattttgcttccaaatcaaaaatgttgaaagcaattggtcaaacgtcgcccaagcagattcattttcgaaattaatctttaaattatttgttaaaaataagcaaaaacaacataaattcaaggtaattaattccgttaattgggaagaaaatttcaaaaaatatttaatatttttcagcaaaaaaaaaagtttggaaaatttccttttaatcattagggatgtcaaaaatatgtacaaaaagtggtcaaaatatgtacataaatatgtaaaaaaaaatcccgaaatatgtaccaaatatgtaaataaaatttttaaaatggttattt

SEQ ID NO: 12061 - DNA, 3211 bp, Heterodera glycines
  misc_feature (57)..(57): n is a, c, g, or t
aaaccattttggggtaaaggcgtggcattgtggtgaccatccgcttgaacagtgccncggtttccccacaaaaatcccgcatcatttttttgaagaccagcgctcacgttgatcaaatgatcttggtatggtattttgatgctcttctctcggtctttcattaggcatctgtgaaaaatttgaaaaaaaaaatttttttttttataaaaatagatttttttaaaatttttctttattggaaaataatattcaatgagtgaaattgatgttttccaaaaaataatctaaaattctagttacggatcataattagtaaaaatagtacgtaattagtaatgcgtaattacaggggatccaaaaacgccagaattacgacatccgttagtcgagattttttgagattcgagaaggtccccggggtgtggttgcacgcgggataccgtctctgaacccacttggtcacaatttcgtcaaatgtcctccggatcaaccgttctttcctgcgaaactctcgcagttcagctttctcattgtacccatggcgtttcaaattttcctcgtccattatcaaatgggctttttctttggccacttccgatttctccaactcttcaatgatgcgatcagtggtgccggtcagttgcttgccgtttagctccacaaatggcacacgctgctggccaaacagatcggcaaacaggaacccactggttacacgcttagaaaaaattaatgaaaattaaaaatcaaacaacaacttgtacagtacacacaggggagttatataccgtattttaataacagatcaataatgctaattgcattgtggcctgaccagtcagggctgacatgaccaatgcccattgacccccgcctggtgggcgtgaccatgcccaatctccttcttgatgggtgtgaccaatgcatattggccactgcatggtgggtgtgactgcccattggcccccgcctggtgggcgtgaccaatgcctattggccactgcatggtgggcgtggccaatgtctattgccaaatggcttacgtatatatgggcgtggccaatgcctattggcaaatggcttacgtatataagtttttatttctagcattgtgcttacgtaaacagtaaacttgcgcaacttcagccacgcctccagcttcaatgcagcgggtgaaatcactggcacatcactgtaacaaagaaaagtgtcactgtaactcggacaaccaaaatgaattacaaaagagaggaccaaccatacagggaccacgactctaacatccatttatgtaaccacaattcgagtttccaaaatcccgcgcgggattctgcaaattttaaatacgggatttgcgggattaataccgttggaaccgtcccgtaaaaaaaaaaatttgaattccaatcccgcagcggaatccgcaaatttgaaatttctggtatataagtgctagtgttacccaggatggctgggttcaaatcccatcgggtgccattgttttttaccctttttttattgcgctaaggcgtggataggtgatcaaataaatcacatcttctttccaattctccacaatattttcttaaaattatatatttgttatttgtttttacaatttttaataaattaagaaaaattttaaaaatacactatcaatcaaagaaattgcatttaattgcactaattagtttcgcttcaaattcataaattaatagagcgcggaaagaaaattcttaatgtggaaagaaacatggtggaagaaaaaatggcaaaataagggaaaaatcgctgaaatattgacataaaaagccaaatattgtggaacaaatttataatttcagggtaaaatgtattaattttttttttttaatttttgacaaaaagtgtgtaaaaaaacaatttaattatgagaatcaaaattgaaaattgattaagcaaatttgtttttgataatgaaaattaattttggattttaaaaatcgtgtaatttgacaaaaatgatctttaatcatttgatgattctgataattgattcggaaaaagcgactaagaattttatttgaatttgaaaattaacacagaaaacccttatttttgtgttatatagtgcaaaaattgttaaggttcgaccatattttactggaaatttaattttaaaaaattttaaattttttatgaaaaaacactgaccaaaacaagcctcagagtagcagtgattttgtccttttttaaaagaattttcctttttgaggggggacgaatcattaataggtatttttaaatgtcttttttaaagatttgtcttttttgaaaaaaagttttcgggaaaaattggtatatatttttttaatttcgtatcaattctctttccaaatgtgcaaaattcccccggtggcccgctcatcggcactttttgaaaattatatttgagaaaaattattttgaaggggttgggaaggaaaagcaaattttttttttcttctgaatatgctcgagcctagcattttttgatcatttgttgccaaaaacaaaagcaaaattttcacaaaaatgaagattttggttcaaaaaataatataaaaaaaagtttcatcaaaatttcaaaaaagtttcataaatttaaaaaaaaaaaacaaccaaaatttcccctgcggttttaggataaaaatttttttattttttgttttttttctcactttttgccaacagtgggagaaatttgttctgcaaatcctccctgatcttccgtattgcgccaaccaaattgcggaccaatggcatttcgaccaactttgacacgccccatgcaattttaccaccacaatatttgaaaaatttgccagctactgtcattgtattaacaatgactttgccaaatttgttcataaaacgtgcacccttgtttgagtagtacacatggtacacctaacattaattaattatttttgtatttaataaaagtaaaaaaaacaaaaacaaaaattcaatgcctaaaatgggttttttttcctcatacatatcaaagtcaataaagtaaaattttgtagctctaactgattgaaatcctctctgtttggatgcaaaatttttaaaaaaagttttatttttttatttttccttactataatatttcgggtttttcaagttgacaaaattttttgaaaaagcgagttttacaaaaagtcaaatttttttttaattttaaaga

SEQ ID NO: 12062 - DNA, 1458 bp, Heterodera glycines
ctgatcataaaacagagtaaaaaaaaaatttttggaagatacaaaattaaatatttcagtgaaatttttttcaagagaaaaccctaattttttccgattttacttgagtttttcatttaaatttaaaaaaaattttttagttaggatgttaacaaattatttgaaaaaaaagttttttataaaaaaaagtaatttcttgaaaaaatttcaaaaaaaaaaacataataattaagcacagatttctaaaagaaaaattgctgaattttgctttaaaaaaatttcttaaaatttttttataaaaagttgtttagttttttctttaatttctaactgtgaaaaaaatatttttattcccttgcgataagattttatctcggcaaatttcggccagaaatttgtcccgtcccctccatccgcacctcctcttccgacatttgctgtttgtgttgtttatccaattttggcatgggaaagaagccttttttgatcagtctgagcacatgctctttggtctcgtcctccgctgcatggatctcagccggcaccatggcggccgatgttgcggttgccaactgattttggcaaattttcataagaaaaatggaaaaaagcgaaaaatacaacccctaatttgtaagggtcgactttttaggaattttttaaaaaatagaccaaaaacaccaaaaattttgagcttttcggcaaattttcacaagaaaaatgaaaaaaaagcaaaaaatacaacccctaatttgtaagggtcgactttttagtaattttttaaaaaatagaccaaaaacaccaaaattttgagccttttgtaagtactagtgtttcgttgtttttaggcagaaaaaatcgcaaaaaaaaaagaatttttatgaacgcttttaattttttcaattgtaaatgaaattaataaataattttaaaaaatttttcgaataaggacaataaaccagaaaactttatcaggaaaaattatattttagggaatcaatattgagaaaatttttaaattctaaggggtgttattttctgaaattttcggaccgatttcttaaaggtttatttttcgttcttatccatttttttcatgtttatctgcgcagaaatcgtaggcatttgcttcaaaagcgatcccgattaattaataatttttatattttttttcttgggattttattttgaaaattccaattgtaagattttatctttaaaaattttaaagttttttgaaattatcaggttttcttgaaaatcttctaaattttaatttttttttttttttaattttgccgtaatttcggctagcgaagtttcggggcgaaatttttgtattattgcgaaaaaaatcatgcaaaaaatagttcggaaaataatcctaagttcaagttatggattcaaattactgaaaatcgcaaaaactgtaaccgtaattaggggagttaaaaaaac

SEQ ID NO: 12063 - DNA, 3898 bp, Heterodera glycines
ttagtgcactctttctttgcacaatagggcaattcgccctttttaagatagctataaatcaatcattccaattagaaaatgttaaatgtaataaaattatttgaatatttaatattaaatatgacttaataaaagaattacctcagaaaaatatttaggcccttctacgagggcataattttctgcgcaacaatggctcttttgcaccccttctctccaaacacatttaaaaccactgaaccaatcgttccaatattttttgtgtgcctcaactttttcttgtccaagcacggttccccacatagtaccagtagtatgaattatcttgccaaggtcacttttgcgatcagggtgtggtttcaaaatttgtgaggagcatgccgtcaaccggttgttgtctttgcatgattcacttggtggggctataaattttttattattgaatatgcatctttttagctatattatagatcaggtcttctagagaccgagatcagagtgagaaaaactccaaaatttttcgagtcaagacctgagaccgagacttattaatagactaattctattattaattttttgcgaatttcgtgcctaatgctgggcacaaaatttttgtgcaatttttgacctctggtgcctttttcatgacttttcagtatttttcaaaaaaaaaaattaaaaaatgttccttattatatttcataaaatttccaaaaaaatttcccggctatcttatcggcatcgcagaatcccattgtagctttattttttttgatatgacccaaaaatggcaaaaattggtcattttttgcgcaaaagcgctacaaattcctgtttttcgccccgcctccctgataatttgagaccggatttatatgctctcctattgtttcaatacagtgactgtactatttctctagtaagagaaatcaaaatcctgcgtagcacagaatcctttgcgtgtctcgagtacaaacaagagaaacgaaaaagcctcatttctcttttgtatgagattttttcgcttctctcttttgcactcagattctgattctcttactggagaaatagtacagtcactgtactgaaggcataggagagcagcagaaaatcgctgcgaaccctgtgtatgtgcctgcgggctcttttcacacacgtgcgcaccaacatacccagggtcgtttgtttctgtgaacatcttcaatgatcgaaatgaaattataaaaactgagggtgcagaaatttgcgcgtcggacatttgcgcgaatgtcaaaaatcgggtttaaaatttttgcaatccttgtggtcatttacagcataaaatggtttctagcttaattatttaattcttaagtgatagaaactgattgaatgtatgataattttattataagtaattttttttaaatcacaaatttttaacaacagaattaaggcccttaataaacttgaagactatatttttcttaattattttaatgccgtttatattatgtaagattgaaaaacaagtttgaacccgattttggacataggcgcaaatgtccgaggcgtaaatgtcatttaacaaaagcaaaccatacttttggaagaggtggctgctctgatttacgatgctaaaaattatttttattttattatttattctattaatttaaatttttggtaaaaataaggaaagccgaaataaaactttttcgctttgttataaattgtattaaaaatttacaatttgattagttattttatattatatttgtgataaaatgtaatttttaatgacaaagtatcttttttaatgattgttttatattgcaaattcaattattatttgtttgattaattttcgattaattactttcctgcagtgacccagctcatcgtcaaactcggcatcgtcaattattatggtctttatgtccctttcgtcgcaataaaacccatgaaaaattgctggaaaatatcctaaaattaaaatagtttaagctgttaaatgttaccctttatatttcttttactatttttaataaatttatttttataatctttcttttaaataattttgaaatttatatcaattttttaaataaatttatgactgcaaaatctgttactaaattgcacaaaaattcaaaattttcccggcggcacctatcggcaccgccggattccctattccgaaaaagttttttgaaaaaaacacgccgcaaaaagcgcgcatgcgccgaaatggggaaaaatgctcaccagtagaaacaaaaaatatatttgaaaaaattcattccggcaaaaatagaataaaaattaatcattttttattcatctgataaaatttttaactgtccttgaattgaatgaattttcccgttaggcccttggaaattggtatacccgtcccttgtatcaaaattttccaatagaaaccatgagttaatctacaaccttttggcttttcaatggctgctatatcacaagcgtacagaatacctcttttattgcatagaaaatccattttctttttatgatcactgaaaaaatatttgttttaacattaaaaataaggcttttatatttaccattcaacgacagcagcagtaattttttttttattattaatttttattatttgttgaaagtttttttttatttattttttggcaaaaattaattttttgtgcattaaaacccaatcttataaaaattgaaaaaaaactcagaaatacgaaattgcatacatcgatgtatgctcaaaaacgaccttctgcttcttcatcttaatataaaattttttttagtaatttttctatttatccatttctgctgatacaactagagctagcttgattagggttcctaattcatatcagtgttgccgcgggtcgagaaaaatatcgggtcaggttttggatcgggtcgggagaaaattatcgggtcgggtttcgggttgagaaaaatgtcgggtttcgggtatcgggtttcgtgtgacccgcggtaaccctgggacatatccaacataatgaatgagattttgtgaggatgtgttttatgcaaaaatggacctgattttccttttatagcaaatattttatacattttttatgttttttagcaaatattttacccctttttagcatatatttttattacatatttaaagaatttttagcacacaaaaaccccaactctaattatgtttaatattatataaataccaaccaatgtacagcatttgaaagagtagaaaggtgggcagcaaccaacgaaatcgcttaatctcccacagtaaaaagactcaaaaacagttttatgtttttctatgcgccgaaaatataagatcaaaaattgtgtcttagcatttaaaccgagttttgggccggaaaaaaaactcgaaaattttgcgcctacccggacctatgcgactttagttttcaacacctaacaaatctataaatctgtttttgagtttttttagctaaaggccatatgatcatattttctttttcatggtcgtcaaggtcaggtacctaaaagtcaatataaacatttttatccgagatgggcgcaaagcacccattttttggcactatgacatttcgcttactaacgcaaaatcggacgtttcgcctagggacatttcacctacagggtggggaatacaacaagtgaaatgtttttacacaaaaagaaaggtgcaaggatcatccaagaaaaattcagttaaattataaaaataattaaatttaattgtctattcattaaattcatataaatattataatcaatcaattatatagaaatatttttaattaaaaatgaataaaaatttatatttagttcgtcttgaaccagaaaaattatagaattgaataaatcatggtttatacgacttgcttaaggc

SEQ ID NO: 12064 - DNA, 2166 bp, Heterodera glycines
aattaacatatgaaaaaagaaaaacccaaatctatcgacttttctgacctgtaaccgaggagagaatgaacggaaattgtttttgagaagatttagagaaaaaaactaaaatttcttatgatcataaacataaattgtgttttctcaaactgaaaaacaattttagaaaaaatgtaaaaggtccgttctctccacatttccggttatgggtaagttggtcttttaacatcggcattatgcaccaacacccggtgggggtggctcatcatgatgatcgtgccatcgtcgtaaatttggcggctccggcggtggtggaagacgaacaactaaattataatttattgtaaaaaaatgaattattttttggaccaaattcttcgggcacaatttccaacagctcacgtcgacggttttgacgattggggccacgtaattccacttaaatattattgtttttattatcgttttttgattttttatttatggacatggttttcttaattcttcaaaaatggggtctacgattgaataaagaggtcgaaaaattttaagtggtaggaaagtgcaaacaattaaactatgtcggttagataatgatcattagctacaaaaaggaggccccgttaattaccccctggtgttggtggtctgaaacggtcacgccaacgcggctggcggccaatttgttgacgaaaatgacctctttggtcaggcttaatttaacaatgtaatcgtttataatttaggttcgtaaaaataaaactcaccggagcaaacggcatgttgatcaatggaggcggcctctgaggtgcgctgaatgccccatacaggggacgagccggaggaatggcaatcggcttaaaatcgagagatgtacctccccccccccccaaaaaaaagcccttttctagaaatttctgaaattcaagaattttattgattttcaagtaacctatattcccccgccctgaaaagacccttgttctggaaatttctgaaattcaagaattttattgattttcaagtaacctatattcccccgccctgaaaagacccttgttctggaaatttctaaaattcaagaattttattgattttcaaagtcccccatctggaaaagaccctttttctggaaatttctgaaatttaagaattttgttgattttcaaagtcccccgtctggaaaagacccactttctggaaatttctgaaattcaagaatattgttgattttcaatgtcccccgcctggaaaagacccattttctggaaatttctgaaattcaagaattttcaatgggtacccccgcccctgaaaaagatttctctgtaactctgagatttttgtactttacgaatggcaaagattatggaattttatgttcccaaaacacacctgtgggatcggcgccggagggtatacgattggcggtggcggattggcgaaaatgggggcgaacggaaccggcggtggcaatcccatcggcggcggcatttccatgtgcggtggcattcttatgtgcagcggcattcccaagggcggcggcattcccatgggtggcaggaacggctgcacaaaggccatcgccattggttgttgcgcctgtggctgcaaggcctcccaattctgtgcctccaaaggggccaaattcgcgtggccgtgatggggaccaatgccattttccgccgcttcatctgaaaattgctcattccattagaaccggaaaagtagtttctgcttcgtaaaagcaaaatctgtgttcctcaaacccctaaaaatttttggatcccacttattttacccggcaaatcgtcctgaggcggtaatccgaactcgctttcctcctcctcctcttccggttcctccttgatcactggcaggtcgggcaaatcgggcactactggacgcggcaccacgttctgggccagaaattgtcgtcgccacgcgctgaaaagtgaaagtagaaattaaagagtgaaagaaatacagaatttttacgtaaattcagccaaaattgcagggtcgtagggcgtatttggattaaaattcgtctggtcagggaaataaaatttcccaaatttttcgccgaagtcgaacataatggaaaaatactcctaaaatgcctaaaattttccaagctttcggaagagggaacggggggggggg

SEQ ID NO: 12065 - DNA, 2987 bp, Heterodera glycines
atttacactgcactggtcatgtgaccagttattacgaaatctcgagtttttataatggtaccctatgacacacctccctattttgggtggtcatctgaccaaagattacgaaatcgcggtcacgtgcttattttttaggctggcaccgaaagaaacgcccacttaaattttgggtggtcattacgaaatcgcggtcacgtgcttattttttaggctggcaccgaatgcgtccccgggtcatgtgaccagatatttcgaaatagcagtcacgtgcctatttttaggttggcaccgaatgaatggccatttctgttaaccaaaaaaaagcggtcacgtgcttattttttataccggcaccgagtgagccgccgtttagttttgtcggtcatgtgaccaaagccatcgtttcgcatcctttcattcaattcaccaatcttgcagctattatacattaattttctttttttcgaccgaccttatttaattttctgagtccttaataccaattagataaattattttaattctataattacttttttgtactttcaatttcaatttggtcatagtcaaatccataaattgaggcgagataacatatgttccgccataattctctttacattcatttagcaaatttttcgctttttaattgctcctcttcctccccccgcacacacctcccgagcgacatgcgtttccctctcacataccaaaattatatattttaatttatttcttctcattttttgtacatttttcgatatccataattttcttcatttttctgtccttatttttccataattttctcacttttctgtcctagtttttacccctttgatctcccaaaaacccacaaatttattctgattattacttcattttccagccaaatattttccatattttattcgtccattttctcagtcctccggcgtacgcacccccttgatattcttcgtttttttgccgcactgtaaaatcgcagagaaacgatggtaaaaatagtgtgtactgcagagcgagagaccgatagaccccaaccggtggatttgcgctgggggcaatgatttccttggtagtcaaaacggggggtagacaagaatacccccccccacaatactactgtgactgttcttcataaaatgcaatttatcactgatgatgaattatgatcgatcattttccaattcgttcatttatttcttctgctgatcacttttgttgttctgtccgtcactcattgtcagaagacacccctttttcgatgctttgtcccgcttcttcttctgctgctggtggtgacaatggccttaattaagcgcaattaaacaaaatcaatcgttttttaaatttctcacccaaagcattgtttgttcgttggtccgttcgttcaccaattcgaatggcaccattgacgttggcgacggcgcatgaacagaaaaatgaatttcgtagctgacggaagtgatggcacagacaaatttctaaatattttgaaacggaaaataaatggttttgcagaaaatgtgacgcccacctccttgaaattggtgacccaattgaagtttccttgtccgtcaaatgattggcaactcaatcgcttcagttggtcattttttctcggtgtgtgcaaccatttggacaacaattgaccagctgaagttgcatttggtccatcaaaatcagcaattgtatcgggcaacagaaaacaggaatttatcgaattaatgttgagatcagtgagaattgtggggtgaagtgctgcgacgcaaattgtccagatgatcagcatcggtaaaggccagccaatttaatgtttgtcgcaaaaaagggcaacatttctcgggccaacaaatcccatatcggctgaacatcggcggtgggtgaagaaacccacagacccaaattggtgcctctgtcccaaatttgttgattggagcgaagaaatgcgataacggagtgatcgatgtacctgaatttgacaaacaaattgctcggtgtttatatattgaactgtttgaattacttgatatgaaggcttttaaagcgcaatttgtttggcagcggacggtcgggcaatggaaattccaccgaattggcattgtcggtaaacacagaaaagtttggcaccgcagcaacagcgtgtttgcaaattatgattgttctccaaagcgtcaattcgcttttgccatcaaaatgtttgtccaccaacgcattgaaacggggcgaaagcaatgccaaattgaggccgagttgagcatggtcaaaagatgggagaatgtccatccacacgtcgttgcaaacccagctgaaatgtgaaaaaagtttagtgaaataaatgaagaatttgttactttaacttccttaccgtcgattcattttgtggcaattagcacaatttgccttattcagaatgatgtcaccggagccggtcaattcagtgccgacgattcagtgccgacgattcagtgacgacgattcagtgacgacgattcagtgtacgttgaaaaattgacaattcagtgccagaaaatttggcaaaaaaaatttcaaaaaaccactaaaaatacaatataaattgagtggttagaaattctgcctgatctgtattgttatacctatgctaaataaatccaaaactaaaatttttacaaaatttaatgcaaaatgtgtgatattttatctgaaaaaggaaaactaaaattgcagcacgaaggccatttgttcgttcgtctacgaaaagatgaatgctgacggagaattgaagttttggcgatgcgagaagttcggcaccaaagatgtgaaatgcttggcgcggctacacacagacctgaacaatgtcgttgtgaaaacgtcgaatcaccacatctgttcccaaagcgcaacccatctcgaggcggagcgaattcggacggccatcaaacgacgcgcggctgtgacaatggaagcgccagcggtgattcgagcgaacgccctgcaaa

SEQ ID NO: 12066 - DNA, 900 bp, Heterodera glycines
ctaatcttcaacccctaccaccagcaaacagcagaggcctctacaagctcggtccggttcttttaatgagagtgtatatccctttatttaattgcaaataagcggatcaaacattccttgatacttcgagagcagttaatgtatttttgtaagcctctaaaatttcaaaacaaaaaaaattgcccagttaaaagaaagttgtgctcagaaaggtgcaaagatacccaaaagattggttaaaaccgagttttatattcttttggtcttgtattatctggggcttataaaacacattaagagatacatatcgaaagggtgctatgtcattataaaaaagccatcaaaaagggcgttataaaaaaaaccatcaaatgaaaatttcgaacaaaaaagtatctgtaacttttgtcaaagtctaccaaattagacattcttgatataattcgatagccctaacatttctctattaggtcacctaaaattcaaaaaatttggccaagattgagcaaagttatggccataaatacacatgtggccaggttttcgaatatttttggccataacttttttgaaacccaatgaaattttttgaaattttgcaggctaatagaggacacctagggctatcgaataatagcaagaaaataaaaaacaaaaataatttctaacagattcgtaaaacccgtatcgggcgaaaaataacgcagttacgcgctattcggtctctactgaatacatattatataaaaataatgcatgtcttatttctagcaaatatgtcaaaattgtgtcctgtctcgcaccggattggggttgttgttgggcaccggaaagggagcggatgtgcactttttggttgggcgggaagatgaaaaagaggcgagttgtcagggaaaaatt

SEQ ID NO: 12067 - DNA, 1230 bp, Heterodera glycines
tccgctgctgctggactgagcatgaccctgtggtgtccctgacgtaactgcggatgcatttaaggcgatgttggaatttatttattcggatgatttgaatgggctgatcggacacaatttgtttgacgtgctttacgcgggttggaattttaaaaaattaaaattttaacccccccccccctcggtttggctaaaaaaattttttttaaatataaaagcaattttctgagacttttcaggtttatagaaatcgagaatgcaatttttcgaatttttgtgatagttgaatttaagaattttccaattctaaacaattttttattcaattttgggcacccatttacatttatgtatacgtttaaattcaaaaaattttttttagccaagaaataccaaatcagtttactgatcgccgcgtgcaccgatttcccagtttgggatgttccaaacatttttgaagcatttgcccaggcacaatttatcggggaagaggtggagttttttttatgttcaatccaaaattaataggtggacaattgggcgacagacagaccgccggttttttgggtacaacttcattcatagttggccaaatttaaccaatttgatatcattccatagtcctatctgttctctattggcctgcaaaacttctaaaaatttcgttgcgtttcaagaaagtttgcacagaaatttttttacataaattcgttaaaaatcaacaaaattttcaaattttgcaagctcatagagaaacacttaaaccgggctgtccatcgcccatttgtccctttttcatataccgaggatccaaatttttcgaattttcaaaacttaaaaaaaaaaaattaaaaatgttttttttttctttaggccctcgcttgccgctgtttggagcatgtggattttgacaaagaagacattatgaaggattttctgaaaattgaccaacaattgttgtgcgaaattttggagaattttggctttaaaacgggcggggaaattgcgatttggaatgcggtaaaacataaaaaagaaaaaaactaattaaaaattgaattcaattacctaattaggcactttggtgggcggaagagcaatgtgcccaaaatcgcaaaaccttttcgggggagaacatacgcgaagtgctcggcccggcactttacaaaattcgtttgccgctccttccacgggacgaatttacggaaagcattggtactcaaaagggtc

SEQ ID NO: 12068 - DNA, 1212 bp, Heterodera glycines
aataattttcagcccaacagaaggggcggctgacgctgaaaattgaaaaatttttctgtttttctcgcggcggagaatccggcactgaacgatacagcgatgccgtgaacatccgaggcttttcattcaaaattttggccaacacttacacaatgtctgctgacaagagcaagaaatgtttgggcttttttatcgaatgcaataaaaatggtaaaaaacaattggattaaattcatttaaattgcattcatccgccggcttaatcggcatcccgtcacgcttttcttgggttcccgagccagactttttgaaaaaaaaatgccggatcagaattctggcagtgtatcctatcgcgcgactttcccaactttttttttcaaaatgccgtgatttttccaatgaaaaaaatgccggaccgacgtgttccgccagacaaaattcagaatgtccttcatttatttatttgaataacatgtacacattttaaaaataaaattttggataaaaaaaatttttccaaaatccgaaaccaccaaatgcctatcactaacaattaattaattaatgttttttttaattgaatttgcccattttgttgtacccccgacgcccattattcacagaacccaattggtgctgtacatgttcagcaacgctgcaaattgttgtgcaaaagaaatacagaaactctaccggcggcaacaagcagttcaaggatgccaatttcagcgccgaaaagaaccaattgggtttccgagacttcgtgcctattgaggtgtgtgtctgtctggtcagggatcttacaaaatcacagttaggtgctcgggatgatgtcgatttcggccttccagaatgcttggaatttttttttaatttttgctatgccaaaccgtggattggcattggcaattttagtctccactcactgtggtcgggttgttgtacttcagtctattgacggattgatcgtttaaaaaaaattttatttttggcgcagagaggggaagcgataaggcggtaactgaccccgggggaggggagaacgcagtacgcccaggaacacttcaccaaaaccggactgtcataaatccattccatggggtgggcgggtagagatagtgcccggttttccgtacggaatcggcatctgtttgattttaggaattggtgaacccagccccaatgggtggtacaatgaaaaggatgactcag

SEQ ID NO: 12069 - DNA, 2187 bp, Heterodera glycines
atttgatggtcttgaaaatgccgtttttggagaccatctttatactcggccctccaataattcattttttaagtaataaaatttttttcttataattttttatagtcctaactttgctctatttactcacgttttctcttttcgactttttggtcaaaaccaggttcggggttcgacctaggtcgaaatttgtttcttaattagtactgagaaaaaataaaaagcattattgtatcacacatatatttttagttgataaaaatttcaatttatttaaaataaaattgagccaaagttattaatctaaattccaacatttttttaaatttcgaaatttcattaaattttaaaaggttatagccgaaatcattttggctcgagatttttgagcttttatttagtctcgcaacatccttgttattcatttaatattcacttcccaacactgatcaattcctaaaaattttatttttaaaaattccgtaagcaaataagttttcaaaatttcttcacccataaaaaatgactgttttaattacactcgctcacagccccatcatttggtgcacgccataaaatgcgtcaatcaataacgtttaattggttaactaactaaccatatttaccacgcattatgctcatgcaacattttttgccctttcctcttccattctccgattgtatttttactaataaaattattaagcctgtttttttaataaaatattcagtaaaaaggaatttattcataaatatttgtatggcgagcaatttggtggatcggttgaagctgatgttgagcacggccaatggggcggacattcaatttttagttggccaaggagaagaaaaggaggcgagttggcccacaaaagaatttgataaaattactaaaatttaaaataataataataattcggtatttttttaaacatttattccccaattttatttgcattttcttagcttttgaaagcgcacaaatgcattatgatgactgcttcgaatgtgttcgaatcgatgttccgttttgatgacaaaaaaccaaagactgaaagtaaaaatttagaaaagtttaaatgtttttcaaatattttaaattaatttttagctccttccgctaaaacggatagttcggtagaaattcctgacattagtgcgaatgctttcaaagtgatgctcagtttcatttatgctgaagatttgagtgaattgaacggagaaaatgccatggcagtgctttacgcgggtaaaaataatttttaaattattattttttactttaaaatattttagcaaataaatacaatgtctcttcgctggtcaaagcttgtttggaattcccaattaatgaactgtcaaatgtattcttcgcacatgaccaggctcgccttctcaacgaaaatgtataaaatttggttaaaattaattttaaaattgaagagggttggatttcacaaaaaatttgcgacgatttttatttaacttttgttttaaggatttctctcgtcgctgcttggattacattgaccaaaacgctgaaactttgttacaatctgagcaatttttacaaattgatcagaatatgttgtgcgaaatttttggacgtgaccaattgaaaatcgacgacgaactcaccatttggaatgctgtaataattaattttaatccttcttagttggttagcccgtcgacaattttgccgagaatttcgttaaagcactattttaatgccatcaaattaatcttggtctctttctcattacgcccgttccccgatttttgggttcctttacaaaattaaaatataatccctccaccggcgcttgtcgatacccaataccgcttgatcctttcccgaaatccttctcacagtttggctggttctgaatctgcttacaataagattttaagatttaatcctgaatttcatagcattcattttctaacttcatttcccatttttcaaattagataattaattaattgattgcctattaggccattcgttgggctgacgaacgctgtgctcaaattctcattgattgctccgctaaaaatcgtcgcgatgtactcggcccggcacttttcaaaatacgtttcgcactgatcacaaaaagagatttctcgaaaattattggtaaatataatttctcgcataattagaaaatttattttccactgttt

SEQ ID NO: 12070 - DNA, 1623 bp, Heterodera glycines
aaacgcaaagacaaaaagtgaaaaatcgaatattttttaaaatgtttttttcatcatttttttgcctctgccgactgtcctcacgtaattgaagtgaccgatgttgaagcagaagcgttcaaagtgatgttgagcttcatttacgcggaagatttaagcgaattgaacggacaaaatgccatggcagtgctttacgcgggtgaaaaatttaaaaaataaataaataattatattttaaacatttttagccaataaatataacgtttctctgctggtcaaagccttgttggatgttccgattaatgaattgccaaatgttttccttgcttttgtcgaagctcgtcttctcaacgaacatgtcagaatctggctaataatgaagcttttccctatttttaacaataaattttaggtaccataggttttcagaccccctccaatttttttttcttatttcactttttattgattcattttaaggatttctctcgtcgctgcttggattacattgatcaaaatgccgaaactttattcgaatcagaagaatttttgcaaattgatcaaaatttgttgtgcgaaattttcgaacgtgaccaattgaaaatcgacgacgaactcaccatttggaaagctgtactaattaattaattattcgattaaaaataactaatttcatttgttttttcaggccattcgttgggcagacgaaaagtgccgtcaaaatgccgtcgaatgttccgctgaaaatcgtcgttctgcgcttggtccggcactgttcagaattcgtttcccactgatcacaaaaagagacttttcgctaaatattggtagttttttgtgttaatccggttgattgttggttggtctcaagacttatttaaagtttaacgacaagagaatcgtgtaaacaaaaattatttcatttccccgcagtgacctcctgcgtcctgacaatggaagaactgctcgccgtcttccaattccattgccacccgaatctccgcggttggcacggacagtacccaatggaatttccgtgccatggacgcttttctgatcaaaaaaaagtgacatttgcgatggaaattgagaaattgtcggaatttgcgcgagaaggagtgaacagcagccgttacagcgaaggcatttacataaaaggattgccgtggaaaatatgggcacgaataaatacgaagaaagacagcaccgaaaaatggctgggctttcacctttggtgcaccgctccaaaaggtgggaataaaagtccaatttaaatataaaataaataattattttcatttttacaactaaaagatgaaaattggagttgcaaatgcacggcaacacttcgaatagtttcacaaagaagcggcgtgaaagatgtgacgaaaaaaattgaccaatcttttaacaacaaatctgtcagctggggattctctgatttcattacttttgaggtgaatggcccaattaaaaaggcttctaaaaaaagttcaaaattaagcatttaatggacacggagaagggattatatgacaaagacgaggacatagtgactttggtcatcgatgttaatacggaagagcaaaaggggacgaagcgaaaagtttcgatcgaataaac

SEQ ID NO: 12071 - DNA, 3917 bp, Heterodera glycines
cgattgaaatttccaaccgatgaaaaaggaataatcaaaaggaacttttgggacgattttcacaacaacagattaataaaaaagtcaccagaaaaatttacaatactggtgcaaaataatgttgaaaagcgaattttaaaaacgttttaaaattatgcgaaaatgaataaaaaaatggaaaaaaatggcggaaaactcttcaagcgcaatcaaatttaattcagcgaactggcggtcaatttcccaataaatttcattatatgtcaaattttcatagccaataattatttaattgcttggcgaatttaaaaaaaatataaataaatgtttttttttttaatttaggtggcatgtcctgatctgcctgattctacggatggaaaggtcaaaaaattaggacaaaaactttactgagataaattttaagttaaagaagcatttttagaattttaatgtaatgcagctgaaattctttgtgtttattcagtctatgtattagtcacaacaaaatgagaattaataaaatacttactaagaagtaaacaatttctctttttttgttttaacaaatttttcattttattcaattgttaaagaaaaaaaggtttttgaaaattcttcgtttagtgtgaaaggtcgatcctttggggtgatgtgagggtcccctacttgaggagagaaaaaatcgagccctaatttgtaagacattaatatttttcgatataaaaaaagaaagaattggatagacattaaaaggatcttagtctagatattatgcaaattaaaaaattaaattctttgtcatacatttttgaaactaacctaagttttcagaaaatagggattgagtaaagccttttcaaaaagccaaaattattgacttatctctgaattatataataaattcccaaaaaaattgaaaaaaaaaaattcacagattgcggaaaatcaacatttaatcactatttaatgcatgtatttaacaggaaacactaactgataaaccaacagaaatgatggactacgaaatggacaatcaaaatgaagaaatttctaaactgaacagccaaaaggatgaagttaaaaaataccaaaaggatgaagttaaaaaatatttaataaaaagtaaggacgattttttcggaaagcaataaaatttatttagggaccagttatttttaggggtagattttcaaaaaaatttattttttcacatgaatctataattttcaaaaattctcaaaatatgtaacatgatgaaaatatttacgaaaaatttgcagaaattttgggtttttttgaggatttccaaaaatttctgtaaaaaatgctcaaaatatattaaaaaaatgaaaatatttaagaaaagagttcaaaatatgtgtataaaattatgaaatatgtaaaaagtccaaacttttgtaagcaagaaaaagaatgtttttcctactatttagagtatggagaagccaggaaaaatatgtattgtattacataaaactggcagccctactgctaacaaatggtgctaggtcgtttcgtaaaaagtgccactatgggcgtttcgtaaaagtgccaggtcgtttcgtaaaagtgccaggtcgtttcgtaaaagtgccaagtcgtttcgtaaaagtgccaggtcgtttcgtaaaagtgccaagtcgtttcgtaaaagtgccaccttgggacttttcgtaaaagtgccactgtggtcgtttcgtaaaagtgccaggtcgtttcgtaaaagtgccattataaaaatatgtttagtatagagttatgaattcaaaaatttatgtttgtgttatacatattatataattagtaaactatgaatattgaaaactgtaatcaaataaaatccgttatttttcactgttctttaaaacgttctccaaaaatatggactgaccagcataacaaattctaaacataagaatctcattaaaaataaacaaaacaaacttttgttagcaaacaatcaacgttttcatataagcaattgcaaattttttatcacaatcatagcgtttttgtcccttatttatgtagcacatgtcatgggcatagcaacaacggtaaactgtaacattttaaatgttcgataaaataacaacacaacagcaggtgttgtgattttgatcaacagcaatctttgaaatccaaaaaaagacgctttttattttgtatgcagagaaatatggagtttttcacttaatctgtgcattttttacatttatccaatgtatatgaattctatatgcgtttttttgttgtaaattaatgtaaaatatttctgcttttggatgaaatttatatttttgatcgtcctaattaattatatcggatcataaaagaaaaagctgcaaaaacctcttttaagaaaatatttggtaaaaatggaatattttttaaatttttatttgaagacaccaaaatgaatatcaaaatatgcctattattcatttataactgtctgagctgcagtatgcacaaattaacaaaaatttaaatttaaaaattcgagcctttaggcaattgaaaaaaataggtgacagattttttcagctatttaacatattgcctttttgcattaaagatcatcattttacagttattaaattaattttttttattctatttaaattatccataatgaaaatgcttttttctttaaaaaataaaaataaatttttcctttttattcttttatgagaaaatttaatcttattagtaaaagaataacatttaaagattttaaaatgaaacgagaaaaacccgaaaaggcattaaattttatggcttaatcgaactttttaaacttcattacatttttgtattgccataaaaatatgacacatttaattccttaatttaaagattctttattattcagttaaattttaaaaattttaagtttaaaaaaagtttgggacaaaaatattgagtctcgaatttcgaactttttagttatattttttgcaaatttttgttagaatcaattaaaaacatttcatatttttcaatatgtcctgatttttcacgtttttttcctgtgtatgaattctatatgcattttttgttgtaaattaatgtaaaatgattctcttttggatgaaaatcattgataattgtactgatttttttcatttgtacttttataatcaatccaaacaaataaattctcattttcttcatttattaaaaaatagcaaaaaatttcataatttccgttatcaaattgtaataataaacaaaaatttattgccaattgaaaatgaaatcatttattttattagttttaatattatttttaatcattatatttgatcaagatgaatcaatgaagaaaaagttgcaagaaaagtcttttgatgaaatatttggagaaaaatggcaagaaaaagaagaacaacaacgaaatgaggagaaaataagagaaataatcagaaaattttataaaataaaagagaaaataaagcaaaaaggaagaaaatattcaacaaaagaatggagtaaaattatttcaaaaatagcgaagaaattggggacaaatcgaagtaaaatttaccagtggatatcctccctttcctatgctggggatgctggaagaaattggggacaaatcgaagtaaaatttaccagtggatatcctccctttcctatgctggggatgctgggatagcacataggagaaggcgcgcgtcggcgccttacagtaggagaccggtgctgttgatgtgcgttatcctatggtgttgtactgtaaagtgacgcgatgtcctcttctgatacaacagaactttttgtaacccgatacctaaatactataatttttttttttgccgatatttccattagtattttataattaataaaaatgttttattaagcaattttataaaaaggaaaga

SEQ ID NO: 12072 - DNA, 1495 bp, Heterodera glycines
  misc_feature (197)..(197): n is a, c, g, or t
tcataaaatttatttccccgtctgatcattttcggacacagttcccctgttgaaaaattgtcgggccagaatcacattgtcgaaccgaccaccaaaatgtgcgaatacattaataggatatttaatgtgtggtttattttactgttgctttcattgttgttattgatggtgttgttgtttctgttgttatgcgatcntaagagcaaccagttagtgaacgccgacataggatcatcgcatacatgtgataatccacttctgttcctgtgaagggtcgatgagagaaagttagggtgcgatatgggccacatatttcacacgagggaactacattcagcagggagttgcgccatgcaccaatttgaatgcattttgtacaagtaacgaatgcggacacaaagttcactatgtgtacccgccgttgctgagcctctggcgcaccgattacatgacaattctgcgttgtctcacaatcgtatactaccaatcgataagttttcgggcgccgcggtttgagttgccgaataaagcatccacgttcacggttatgaaaggcaccacatgttctgcaaaagcgctcgtcgcacacatgcccagctcgtcccttccctttgttatttctcacgttccatatcaccccacattttttacatttatgcgatttgtggcaaaagttgctcgacaagtgatgatggtaacagtcaacgttcatgaatgttttgtcacatcccacgcactcacacttaaatccatcgccctgcatggccgccccgcaccaattcgaccacattccttacaattcagaatgcatgaacttttgtgagtgtccgcatttttaaagggcaattcgcatgcaaagcagtagtagtcgcgaccaaaaattgctgttccaactccacaacggatgccatcaaaatgatcgttgttgtaatagagcgatattggtgtcaggaattcttctggtccataactcgcaaaagcgactcaggatttgatggtagagtctggatcatgaatttacttttagcattcattagtctgaattttttgttgaacgctacgtcggtgttcagcgcgcgtacatagtgccaaaaattgcgtcttttgccattgttgttgttgttgttgcttccacttttgaggatgtttggcattcttcggcgcttcggtgggctaagttcattgtttgatcgattgctcatgatgatttttgggattggccaataaatgaggttgtattgaatttttcacttaatttataccccgtactagcagtaatttccataaaattatgaatgaatcgtttcgatactcaatacctctctttttacgatactcaatgcctctttttctctaataaattaaggactaaaatgctagacagctgacgcatcaaaatgagatagacacaggagaaatgtgtcagctgacgccttttgaccccaatgcccagagactggcactagctggtatatttttaaatcatgattcggaa

SEQ ID NO: 12073 - DNA, 2443 bp, Heterodera glycines
ttaattaaaatttatatattgtgctccataattttgtgtaattatatttaaatggcttttcatttttcggattttctaatttttatcgcattagcaaataaagaaatattctctcatcaattaggtagaaaaaaagaaataatatttatcaattaaagtaattattcaaaaaaaaaatttgtgaattaattttttaactaaagatttaaatgaaaaatttaaatattgagatttatttataatttgaaatttaattaatattttagatcccttttcaatggttaagcaattgcaaaatttgactttcacttcggcgcttcggtgggctaggttcattgtttgatcgattcctcatgatgatttttgggattggccaataaatgaggttgtattgaatttttcacttaatttataccccgtactagcagtaatttccataaaattatgaatgaatcgtttcgatactcaatacctctctttttacgatactcaatgcctctttttctctaataaattaaggactaaaatgctagacagctgacgcatcaaaatgagatagacacaggagaaatgtgtcagctgacgccttttgaccccaatgcccagagactggcactagctggtatatttttaaatcatgattcggaatcatccacctttactaattgaaggctcccttagaagataaaacaaaattttattcacgtagtttttaattgcaatgtcacaattataatccacacaatacaatttcagttgtttcaaaatttcatcatataacattccggttgaagccaaataaataaaaaatatgcaatagtgcccacaaacgtctgaggtgggagattgaaatgccattttgtttttactgacatgagggaagtgggacagaaatttctgtacgttaaaagcaacaggaagggccaaactatcaaaataccatatggtgttcaaacgcggaatatacagtgcgacccaatgcgcaccctcttggcgagcctcatccgtgttgatgatcagagatgcgggaaagggtcggtgacgctgttgtaattctatcattttggggatccgatccacgggaaaacatcctctgaagcactctctcgttgtctgacaagtggaaagcatcctctctatttggatgttgttcatttccgttattattgttgttgttgtttttgttgttcctagcttcgttagagttggtgacttggtcttttgtctggtgatttatttttgttttaagtataaaaattgagcggatggcgtacagtataccgcacagcaatgtaagtagaataacaatacagcaaaatacacgtgtccatacccacacgtgcgatccgccacatcctccctcctcagagccggcaacactgctgcacaatgatataataaattctccgatccatgtactgctactgccacctccatatgtagagtcaagcgagtcactgtataacaactgaatggttggtttcacggtagttgtagactgtcctaatattgcagacaacgatgaccttgatatagatgtagtcgttggagaagaagaggaggcggaggctaaccgtctcatatactctttaaactcgagtagggtggtaggagtgattgtaacggtagtgaaatcggtttcataatcatcatcatcagtgtcaagagaatgaatgtcaataaacattttattaagcaaaaagtttttcaataaagcgaatgtaaaatgaacaatctaagcaaagaagtgtctttttatacttgaacatctgtagcgaccgaacgattcttgtccagcataagaagtgaatcgatttctgccattgctattagcactattcctcgtgcaggcactggtgtgttgaaagaaattcgtatcgcggttgtgccttttcggataaggtcgaacgtatcagcggaactctccgtcgatggtgttagattgaatacgaaaaagcattggccccctcagcgtaacgcttcaccgaaattccattgctttccaccgtaccagcatatccgatagcctcatgcatgtcgtgataggcgcgagcaaatcgtccattgggaaagtccaatgaatagggcgcttgggggtagttccgtccgtttgcgcaaatgctgatgtcgcgcacatcgaagggttggaagttgaacggagaggtgccaatggtgcccacgtagctttcattggatacaagtccgagcaccacacgcttgggaacctgatctgaccaaaggttggcagtgaactctgtacggttttcactgatgaacagcgccttcaaagacgtctttcgcagaggatagcgtgctggacggagctccaaacgcttgctaatgtcaagcgccaggctgtccatcacctcggccttcttcacatacagcttacagctgattcctccagatgataacgacgaacctggtccggtggcgcttgtgg

SEQ ID NO: 12074 - DNA, 4033 bp, Heterodera glycines
ttttccctttaactttttagatttttgaatttaatacggtattttcgatcacctggttttacaaaaatttgaagaaacgtatacgcgatcaacgaaagattggtcagaaaatggcaacatccgatgtcaacaaactcaaaaatgtctttgaaacgtccaatgttacggaatgacgaattggcggccaattggtccaattccgaatcaatttccgattcccaattctccaatagaattttttctaattcactttctggctcgcccaaattttttaaaagtgtgacggcctaaacaatttaagtattttgacaatgagttgcaaaaagcacctcaatggtttcttcggaggaaataaggcgtcctttaaggaattcgtataactaaaaaagaaaataattgttttttaattggacgatatacccacttttagcttaagatcctgcattgtctggtcagcatccttttcaattcctttcagagagttgatatatccaaatttgttaatttttggcttaaaagtgacgtatgtttcgacagccttcacatgttcaccgtctctaagacaattctcaaaggaaattaaaatttattattgttagaaatttcactcaaaaacacctgcaatatttggggcactttgatcaaaaactcaagcctttgaactgagccttttgctccattgagtcgttttaccgtttcacaattttttgcgaaagtttcagtcagtgaatcagaaatggctgttacacgtttcatacgtgcagaaaggtcccgcattccctaaacgaatattgtacggattggaaatgacatttataaaagtcaacacacattctgagtgtcgttgagtcggttttgcatgtccctaactgtgcttgttgcattcaaaaatttgctgtaattttcataaacgagcgattgcatttcggaatccaatcgccgaacattgttaaccttaaaaggaaaattactctaattacgaattttttattcgcatttctactagagaccggacgggatcgggatcccgcgggattaaattcgggatcccgacctcgggatccgtcccgaacgattttttaaattcatcgggattgatcgggatcgggatttcatcgggatcccgaaccgggatccctcccgaccattttaccaatcctgcgggatcccgcgggatcgaagtcacgataatttttcaaaaaatctccattttttaaatcaagatcttgaattttaaattaaaaaatattgtcatttgctaatttttcttaaaaaaaatcccttaaaaatcccaaaaaattttacaggtctacaaaattccactaaaattttcaaaatttgacgcaaaagttggccattttgtgacttttatttcttcataaaaagaattttatttttttaatttctaaaacattattctaaatcttattaggtagttttatggcacaacgatttctaagaattctgtccaataatcagaataaaattgttgtctacgcatttttccttcggtgccaatcggacatcacaagacccaagaacccattattttcttataaattagttcaaaatcacaaaatatggagtttttgtataaattctgttaacaaattacatttcaaattttcaaaattttcccggcggcgcctatcggcaccgccgacctccccccctcggttcccctaaagtttttgaaaaaatttgcagcaaaaaaaatcttaaaaatctgattttttgattccgtttctcaaaattattaaaaatgatcatctgaggcgaaaatacaaaaattgatattaattaattaaattgtaaaaaaattatttaaggcatgttgttaaatgctctcattttttaaaatctgattttttgggcatgatattccaattttgaaaaatttctataaaaatcagatataattcacatctcttttttttctcttcaatcgaattgatcaattataaatattagataaacatttgaacaaaacttggcacaaaatgtaaaaaaaataggtttgagcaaatcccgataatcccgcgggatcccgaaaaaaaatcttcgggattgatcgggattcggtcgggatcccgacccgggatccctcccgatcgtttttccaaaatgttcgggattgatcgggattcggtcgggatcccgactcgggatccctccgaccccagttgtccggtctctagtgaaaagtgatttggttgtcaattcaaaataaaaattcttataaattaatttagtaaattatgaatttattcaaatatttgattgactccttaatatttttgttaaaatataaattttttaatataatttttatttcttacaatgcgttgaattattttttataaatccaaaaatgttgtctgtttttgctttttgaaagaacactaaaattagccatatttttatcattctttttgttctatttatttttcttgggtattatatgtgaactagttgaaacttcctattattattgataataggtcgatccttgcatcgcgtttgcagggatcttcaaatcattatttgattgctcttattataacaaattagttattattcttattattctggggttgtatacgttaatttttcaaattattttcgaatatattcaaatttatactttatttatctatgaactactaataatcattattcggctgtacaggattaattttttatgttaattttcatctggttattctcctgtagttctgtagcattcgttatcacttatatgagagagatactaggcggcattaaacgggttatccgcaagagaccgtcctccccgtttccaccctttgcaatctctctgttctcgagctgctagaggagcatctcgctatcgcgcccgccccttgtcatgagcagcatcggttggcgcttgctcggcgtactcgctcgtcgctccgcttcgctccgctcctcgctcacacgcctcgaggggcagggcgcttcgcgcccgccccttgtcgataatgagcagggaaatgaaatggaaaaggaaaagggaaaagaaaagtaaaaagaaaatggaatggaaaagtaaaagaaaaaggaaatgaagaaaaagaaaggaaagggaaaggaaaaggaaaagggaaaaggaaaagggaaaaggaaagggaaaaggaaaggaaacaggaaaggaatagggaaaacgaagagggaaaagggaaaagggaagagaaaagggaaaacgaaaagggaaaaggaaaggaaacaggaaaggaatagggaaaacgaagagggaaaagggaaaagggaagagaaaagggaaaacgaaaagggaaaagggaaaagggaaggaaaagggaaaacgaaaagggaacacttcctaatggtgcatgcgacgtaccggtaaaaggcccggttcgtatttgctcggtacactcgctcgtcgctccgcttcgctccgctcctcgctcgcgcacctcgaggggcagcttacaccattttttgctaggcttagatcacatgcgattttcggcactctgataattttagcgctcataatgggatgtataaaggcgattgtagaaggaattggatgcgctaaaattgtttgagaagctttttgagcgtaattacgatttttacttacaccattttttgctaggcttagatcacatgcgattttcggcactctgataattttagcgttcataatgggatgtataaaggcgattgtagaaggaattggaagcgctaaaattgtttgaggagctttttgagcgtaattacgatttttacttacaccattttttgctaggcttagatcacatgcgattttcggcactctgatttttgctaggcttagatcacatgcgattttcggcactctgataattttagcgctcataatgggatgtataaaggcgattgtagaaggaattggaagcgttaaaattgtttgagaagctttttgagcgtaattacgatttttacttacaccattttttgctaggcttagatcacatgcgattttcggcactctgataattttagc

SEQ ID NO: 12075 - DNA, 1311 bp, Heterodera glycines
aaaagtttttatgcaaatttttataacctttagataaacttttataaccgtaaaaaataattttggtgtttaataagataatgaaaaaatttaatgatttttgattatttagtttgcaatttatttgcgtgcaaatatcttttaaattagaaaaatcatttttaatattttcttaaatgaaaaattaattaaaattaatataatttttcggttttgtggaaatgttaaaacaattactttctacgctataatttattcatgtttttctttttacatcattaaccccaattcgataatctttcctctagaaattttatttttaattttatttcgtgttttataccatttgtatgtctatttgacatgtaagcaataaaatgcataactatcggtttaatttctattatttttttataaattgcgattaatgactttaattaattaatttcgttttgtttgaattttttgtttaatattatctactttaaatatacacttttattattttattcaatgaacagaagtcacaaacacaatattttatgttcgcaagttttttttttgtgaaaagtgccgccgacaggcgtttgggtcagttccatctgagccaaattaaaagcatctaacttttttctcagttggcaaaaatttataagtttgtcatgattcgaaagctcgacatctttagaagccttttataagctatagataggcgattaaaaactagagatcggaccggtcggttttttttcgtttttttcggtatttttcggtttcggtttttaaccgaaaaaaccgaccgagaaatttttgagtttttcggtttcggtttttttcggtttttataccgaaaccgaccgaccgaaataatcaaaaaaccgaaaaaaccgaccgacttttttcaaaaaccgaaaaaaaaaccgaatcaaattggagcgatataacctgttaataataataaattattgcttttttgtgctctttttcattttgaagaattttttgtaaaatattttctgctattttgaaaaaaattattaacaaaaatgcaataaaaacgaaaaatacacccctgagaaatggaaaattttatcaaaaattcatattcaaaatttatttatttatttacttgactacatttttgatttttaaaatatttatctcatttccattttgattaaagtgaaaaaaggaagatttcgagcatttaaagagaaaatttggtcttttttttttgttaaaaaagtttgttgatcactaccaaatcgggggtccccgacccccgacatttgcgctccccccccccgcccc

SEQ ID NO: 12076 - DNA, 2054 bp, Heterodera glycines
aaatataataatacaaaattaaaaataaagtaaaaattgcaatttattagtattctcagaaagacgaaaagtgctaatgtatatttatttagccaaaattaaacaattaaagaacattttaacaagaaatggttattccaaatattattggaaaatttaaaacatggaaaaaataaaagcaataatttaaaactctgagaacttaaatcattaaaataaatattctataattaattttaaaaatgaaattgtgattacgatatggctttcatattggtctctttcgaaccccgggcccgaattcgaagcgaaagtcgaaaattcatttttaacaaaattcaatttttatataaaagattttaacattgtttgagaataatttaagccgtatttaaatttttctttaaaatcttttttaaaattttaattatgccacttagtggaaaaattttcgccgctgctacagaggtttttttcttttctttttttaatttttgtttatttcctcacacccgagtgccgtaaattccgccgatcattgattggcgatcggaatgaaattccgacattaaattattcattcattttatttaaatgactatttatttttaacgaatttaaattaattttttgattaattcatattatttatttgtatttttgcgaaaaatttttaaaaatatttttcttctttttttttgattattaatttaaatttttcagaagtaattttctaacttctattgtttcaattttgtttaattattggttttgcattatttgtcataattttaaggatttggtattcttgctgatgaagagcgagttttttttgcaaaactccgaaaaataaaatattgtctcaaatgttttttcctttttgtttttttcgtatttttattacaaatttcatatttactttttttccttcatttgttttatcgacacttttctgagtcttttatgaatgcatttttataaaaaaataaaacatttattaaaaatgaataatttttaattagaatttcttgattttaggcgatgtttgttttaagattgctaatcaaatgatttgaattttttactgttagaagaaatataaattttacctacacaaatatgtggttaatatttaattctatttttttgttttaaattgctgtttgtagtatcgttaaatttgtttaaactttttctcatgcgtttacacagaattttggtttgacaagataatgtactctattttgaattatattacagatcgtataaataaatgatttttttattatgctaaaaataattgcgctttttaattattttttaattcgtagtataacatgataatttttcagttttcaaagagataatgtgcaccaacgcaatttttatatttaattaattacttaaattgttatgttttattattttattagaaatacaaaataattttgttgaattattataattaataattaattttgtatattttttatgaatacatgttccgcagatgagtcgtgcaaatccatgtgggtttgataatttccttattataaatccaaaatatgaattattaatttttaaaattcatttttaatgaacctctaagtgttattctcatttgctcgtttgtgctttaaattcatcaatcatgtttgaaatctgtacataccgaaatgctcatcgaagagaaaaggtttaaaagaggttttatgtacttaattattttattttattttgttttatttaatttatatgattttttggagcgaattacaaagaggaccattttgaaatttatcaaaaataaaacaaaatgggggccctttagtttgcaaaattttttgtgtatggtcatgaaaatgtggctcgggggtttttggggtccctgatcacgcatctgtcaattatttaaacttcaaatcataaatcgaaaattcaaattttcgatttttttttcaagttcggattcagcattagaaatttgggcaagaagatgtcagattcgtgatcaagagccataaaaccccgtagaataaattacggttttctat

SEQ ID NO: 12077 - DNA, 4696 bp, Heterodera glycines
tccaaaaaattgactggtaaatggcaaatgtgtctccgttggtcttacaggaaaacaaaatggaaaattacgggaaaacctaagaaaattgagggttttgccaaaaaaaaacattgaattttacgacttttcaccaaaaaaaactaacgaagttatcggcaaatggtcatcatcatattttaccttttgccaccgctgatggcatgtcgaatgaacacggacacagaagaagggcatttgtggtgaagcatttcttaccactttttggaaaagaaaaaaaataaacgctaaaatttttgtcggtttaaaaaatcgacaataaaaataaaaagtggaaaaatcaaaaaaaaaaaaaaacatattttttattttaaaataaatcaaataacactacatacctatatgtagaacatggatggtaaaaaagcaagaaaaaatcgctaaataattcgggagagtgccctttcggcgcgatctctaatttttggactataactttttttctttgtcatcaaaatttaacaatcttggtatcattcgaaagctcttcacatgctctattagcttaataaaaagcgaaaagattttttagcctgtaaaaaaatttatgttgaaaaaacttcaaaaatttcgactttttttacaattacatgcagaacttttttaggaaatgtctaatcacgaagaaatacatagaaacagcttctaaacatgtttaactttcgaaagataccaaggatgttggatttagttaacaagaaaaaaaagttatagtacgaaaacttgggctcgtaccgaaacgtccgtgctgaaattcacagcccaaaaattcttggcgtttaattaaaaaatgccaattgcattcaaaaagaaaacaaagatttttttgatcaaattcctaacaatccacacaaagcaagttaccattagaaaccttttgaaaaataaaatcttattctaagaaaattctaagcatttaggcaattttttcttacatacattttattagggttggtcacggtcgtttaaccgaaccgaaatccggcttttttggtccaaaaaccgaaaaccggggatcaaaaatcggccaaaccgaaaactggtacccccggttttcggtttttccagttttaaaaacaaacccctaaagataacactcgccgggaatttttcatttttttgtgaaaaaattagagtgccacgggaccgggaattttgggcaaaccctggaccgggaccttttcgagttgaaaaaccgggaatttttggctgggaaaaccgggaaaaaacagggactagtcccggtcccggtcaaaaccgggaccttggtactcagttgtactcagttgtccgctaccaggtcccggtcccgtggcactctaaaaaaaattaaatatgccgtaccctgtttatattttttgaaaaactcaatacttgtaatttgtcaaaatattattactttacccaacacatttacatgtctaataaaaaaaaattatctaaagtgaaatttgtgaatttgctaaagtggctatatcttttctactttattcgcgggtttacgaaacgcgcaaagtgccatgccgtaccctgttttattatttagaattttttttgaaaaactgaaggcttgtaatttgtaaaaactttcttactcaaaatttatctaaataaaatttttttatataaagtgaaatgtataacgtcaatcttcataacgaggctgccaaaaatattaacaaaaagtggttaaaaaatgtacataaacatgtaaaaaaaatctcgaaatatgtaagaaatatgtataaaaacccaaaaaatgtacgaaaaatgtgagtaaattttaaaaatggctattttttggaaaaaattcttcgtaaaggatgaaataggcataaagtgccataaaaatgacctaactaggcttagaatcacatttagtattttaaaaattaatttttggtattttcatgggtaaattttcaaaaaaaaaatttttttttaactataattttcaaaaatgcttatatataaaaaaatgaaaatatgtacgaaaaatttgcataaattttggacttttttttttgaggatttccaaaaatgtctgtataaaatcctcaaaatatgtaaaaaaaaaaaagtaataaaaatacatatgccaaaatatataacaaatattataaattacgaaaattatgaaaaccccgaaataacagaaaaaatatgtccttgattggcagccctattcatagccatttttcttttactttttcactcattttttccatttgtttttgctcaaattctcttcgaaaagcttcaatttcaatttcacttgtcgatttttgccctttttggctgttcaaaatttgtttttccatttctacattttcgttgatccaaattttctcctcattaattgcataatttaattcctcctcattttccaaataaatttccaatttctttccgcttttttcccaaaaatattttgaattttcattcaacatttggagagcataaattaaactcttattaaaatgaccctctttaaatattggtttcaccgctggtaatttctttgcaaattcagcttttttacctaaacaaaagtgataagaaaatacgaaaatggctttaaatcggaaaattttcgaacaaaattcctattgtgccatttttggtgtgccaccaaattcaattttaataactttccgtcgcagttttggcaccaaatctcgctgtttaactgattgactatggtattgtatatgtctaataatgaagtagatggaagaattaatcctttgcttaaaaagtgagggtccaatttttgtgcactccaaatcttccttaattacacagtttattttacttttttaaaataaaaatataaaaaaacaaaagcgaatgaatgagagaatcgtggtttttcggtttaattacttttctaattgtttttgataaatattaaaatatttaatttatagacaagtggtaaaataattatcaattaaaataattaaatttattccgagttccgacatttttggtgcctcggaattccatccctgccgcacacccatacttttgtcacttcgcccacacccatacttttgtcactttcggctaaccacgcggaaagcggggattgataagatccataaaagaaagggcggatgtgcctcggtagcttaatggtaaagctggccacggaaagggtgcacgagtgggttcaattcccacccgaggcttaacattttgcccatttcgtattgtagtaataaatagggatgtcaaaaatatgtacaaaaattggtcaaaatatgtacataaaaatgtaaaaaaaaatcccgaaatatgtataaaaacccaaaatatgtacgaaaatatgtaaataaaatttttttaaatggttattttttgaaaaaaaaatcttcgaaatcctcaaaatatgtaaaaaatacaacatatgtaccaaatatatataaaatcccgaaatatgtaaaaatatataaataaaagtcccaacaactggggaagagtgattcgcccgtccgaattggctgtgtttatttgtacaggtttagttactgtgtgattttttagatattcgttaggtgctgacaaaggaaggtccccagcaggtgtccgtgggatttccgagggttgaatttatgtgcaccacaaaaaagccagccctcccttctcaaattgagagtaattttttttttggcgggcgcgagtgactttgacgcgtgtgctatgggcccttattgtcccatttttttcacatctccgttttcgaaaaaaacgctattttctcgccacatgcagcccttttgtccaaaacttttcactataatttaaaagaaaaaccataccttcaacatatagtcggaaaaaatattcgtgcaaaatttgcaaatattttcgatgcttttggcattcttcacgtagcatttctctggattccccaacaattttgtcacattgcaaattgtttttcgtgaaatacgaaaagccaagatgcgcctcatattgttgcatcaaatcctctttcactttttcaaaattatttaatcctttagttaatttaataaatttctcaagatttgttgtttgtccttttacaaattcagaaaacaaagcatcttcaacctaaatttgaatttatttaataaaataaaatttatttaattcaaaatcaatagagcccggattttttgcggatagtacttgatgagagaagcacgaaaaacacattttatccgaataatttttgatttagagcgacttattagcacctaaaaaacctaaaacggggtgggggttagcacatatttgtgcattttcgatttttagcacctattttggtctttttccagaaatttcagggcaaaaatgcaataaaaaccaaaaacacaccccctaaaattcgatcccaaaaaatttaaaaaatatacccctaaaaatttatcaaaatttcagaaaatcaccccctaagaaatgaaaaattttcccaaaaattcgttcttcaaaatttatttatttgttttcttgacaagttgcaattgtgcaggcgaaattgatcaaaaatgagtcattttttgtaatttttgtgcataaagacactggatttttcaaatttttagcacctattttgcgtattttggcgttttagcacctattttgc

SEQ ID NO: 12078 - DNA, 3738 bp, Heterodera glycines
  misc_feature (3660)..(3661): n is a, c, g, or t
  misc_feature (3675)..(3675): n is a, c, g, or t
tttttctctctttttttttttttttttttttacatcaaactttgtttgagttggccggccggctcttaattaattgctttgttatcgtcgactttatccattggtagcagcttaatcgcttttcgcgtgatttctttgcctttttcctaggatttttgtttcttaattactttctttaattaatgttcgttcattaattccgatcatcccccttttttacacccaatcggcccctttgatcagctgacggcgcctgtcagccgatcatgagccaacttttggcaaattttcacaaggaaacaaatgttagtactttgaacccttctaccaaaaataattacggtaattctcgaaaaaaatttaaaatttaaaaattaatttattaattaatatttgatattatcaaaattatttattaatccattttcctgttcgttatttcttttttacttaaatattcatttcatttcattaatctactcataaaaatattattttaatcgacaattttctcttctttcgccgtctccttttgttgccaattttcggccaaatccaacttgtgcttttgttggtccgccctattgagcaacatttgctcgccgaatattaaatcagtggagaaagtgtgcaagaaaaagcaaaataacatgggaattgaagagaattatgggaaagggaaaaaagttaatgaaaagggaagggacaacccaacaagtatgctcattttgctcattggatccgtcaatttggccatttttttcaatcaatttcgaatcctttatttaatatatttctctttcctttatatttaattcaaaacattccaaaatgtcacaaatagtttgggaattcaaatccaacaatttgtgtgccatgccgtgttctctcccaaaaatatgctatacccccgtccatttcactgctcccgatttgtgcttgaacccgggcacaaacccaaattcattccagcatttcgttgcgcttagtgagcactcgctcattatctgccttctgatcattttctttggaggatttgccttagggcttatcgcctccattttcttccgttgtatgctcgggaaggtgtgttatccccgttgtattaccaccaaatattatatttattagcatggccatagtccggttggcaccagcaaatctgctcgcaagggagcccgtgatcgggcggctttgcattctttgagctccatctccgttgtaagttcaaccaaattttgcagcacttccttttttttttacccaatgtttttttaagccccatttgatggcaactcctgtctgaggcagcggttcgtgccagatttattcgccacctcaagccttcatttgttaattctttattcacattccgttcacattttcctcttttttttttttttaattcaattttttcacttggctttaaaatatccccttaaataatattcatttaatcataaacgcattgcttattttctaattctttaataaaggcattaaataattagttctatttaaattcttccccatttttgccccgtggcgggacctccatgaatatgtcggatgccctttggcattcgttgtttagcccctccccataattacacgagtgggatggaataatatcctttattcggaaggttgatcaatacaaatatataatgtgtaatatatgtgattagttggggaagggtgaaccgattcgtccggggcaaatagggggagagggggaattggaagagttcgggattagccaattccccctcccgaaagagtgaaagagtacaatgtgctggagggcagctaaagacttaaagtgggcggggcctacatgatcagcttaggcatactgtacttagtaaatggtctacggtaaacacaaaataatgagctaagtcataattataattattatctcatatttattttatattttttgttatttaataatattggcaacaacagtaaaagaagaaaaacggacggacggacaaaatggcaatggaaaataaaaagtcaaaaaacccttccgaaagtgattttatttattttttattatttccaatttaatttaattctaaacaatattaaatattatagacaaagtttttgctaaaatcaaatctattcttttaatgtttggcaatataaagcgaaaaaagcagtaattcaagaaataaaattccaaatttaaggcctcaaatttgtaaactttttgagcaaaaaaaaagattgtttaattaaaaaatatatatttaattaattaatttctttatttatttataaggaaattttaacgaaaatgctgaaagctacaaaaaaaaacctgcaaaaatacattttttaaattttgtttgcaaaatccaacaaaaataattttctacaaattaaaataactgtttaaaatcagatgatataattttacattatcacaaatttggagggtttttagcagcaaaaaaattcgggccaagctcatgatttaggctggtaattataatggccataaatatgtacataaaattgcaaaattatgtgatacatgttccaattagagggttaaattttccaaaatttctttaaattcattaaatttaagcaaaaagttagccctactcatgataattaattttttcatcagccagtgagtgcgctctgctcagcccaagcagagaaccctcgccgcaattggcaatttgccatcgccgggcttctgatcgcctccaatttgttcgtcggcattacttttgcgtgcattgtgccctttttcccgatcgaagtttggcaacgggcagcaaaaaataaataaatattgtaaaataaaaaatgaacagtgaattaattaacatggactgctcgaacaggctttctcggtgtcagggctgggctcgaaaataacccaaagttccagttacggatcaaaattacggaaaatcagcaaaaattcaataaccggcatacgtaattactgggtccaaaaggccgtaatctccgcaattacccccagtcctgctcggtatagaaataatcgagtcgagaaagatctactttcgggtatcgtatcgaaagcaaaaaaaacaaaaattcaggctgaagcgaagggtctgagcacctcacaggtcggcttggtgatcggcatcttccaactgtgcagcttcttcgtttcgccagtcttcggcaaatacgtaaaatgggcgaataataattgggaactttgagaatacggaatagtgatgagagtgtttttgagagtgccaaaatacgaattatgacgggaggatttagggattaataatttttaatgcccctcgataaatctccggaattaacggcttacatcactgtttttccatttttaattcccatctctgcttcagttggttgtcctccgtgttcatcgtgcctttatcggtggtcttttgttcacttctctgtgcacaattgcacttgggtaagtgccagaactgtttgttgctgagctaattacgtattccggattattaaagggtaccgtaataaggattgcagttctaccccagctcttgtctggtgtattttttcatcagtttgtcaccatgctttccgtaatgaatttaggattacgggatcgggaatccagacattaaaaggctaaggaattcaggaacccaatcnncggattgaaccccngatttcggagtccaatcccagcccgaccccatggatttttaattttctccccatttttccccc

SEQ ID NO: 12079 - DNA, 466 bp, Heterodera glycines
aatccaattacagtttaatggtcaccactatagcctttgcaatgctcggcattgtatctggtgctgcttatgtgcccgtgtttaaatggtgcgtcgacgctgcaaagtctgtgccgtggtggatggagtgtgccatttacaatgcaattagtgtaaatgccctaattaagcaacgtgggattggacggcacttcgcctgccatttgcgggtgtatctccggattcatacagtcggcacttgctctcaggtgtgacgacgggaaatttttgctttcattattttttaatgacaagtcaaagatgctgaccccagtctttatctccaactgtttagtgctttcttggccacaagtgtcgggggactgagtgcccagcatttgggcctcccgtggacggcgacactcgtggcagccattcaattggcattcgtaagtcgtgacaatttccggttggactcagtttacac

SEQ ID NO: 12080 - DNA, 3650 bp, Heterodera glycines
  misc_feature (77)..(77): n is a, c, g, or t
tggtgttttatttttataaaaaatgttttcttcacatccttttgtgagcgcaggcattattggaggggggaatgggnccttcttttcaattttgtgttctaaaatgtcaagatttaaaaaatatgaaaaattagttagggatgagatttgtcctaatttgtcacatttgtcctgagttggaggtagcgaccaaaaattgttctggtttcttaataaattcataattttaaaattttatggcagaatgttaatgttttctcaagaaatataagatttgaggcaaaatttggtcatttaaaaatctggttttttgatcccaaatgcattaaaatttatgatttgctaatttctccccaaaattgttataatcgataaagtgtggtgaaaaaattatatataaatatatttttgatccagtaaaattgtaaaaataacttcaagcacgccaaagctttttgcacacaaaactgaacgtggatttgatgctgcggccgccgcaacagttgcgcgatatcatcagcctggacgagcaaggacagagaagagagacaaaacagagcaaaaagtatgccaaaatttgatttttttgggcctgatgtcctgatattgaaaatgttcagatcaaatcgctgctttagttaaaaaattaataaatatttaaattgaaacttgttactgttttccagccgtcaaacatcagctcgaacacctacttggcgctgctaaaatcgctgcgttacatttgctcacagtaaattttttttgaaattgactccaaaattttgtatgtgctcagagactgcgttggcattggtacgcatggactttgacaacaccattcgttttctattggtgggttcggaaaataattgggacaaagcgagcggcgctgttgcagaaagtgcagaaactccacgccaaagctttttgcacacaaaactgaacgtggatttgatgctgcggccgccgcaacagttgcgcgagatcatcagcctggacgagtaaggacagcgaagagagacaaaacagagcaaaaatggacaaaagacacgaaatcaaaacctataagacattttccggctatgaattgggctcgagtattccttccccccaatgaaaaattttttaaacctaaaatgggaaacgttctgaaaaatatgcctttttaaagaatatgaaaaatcggcgaaaatttgaaattttcgatgcggtgccgattagggggtatattttcgtggtctcaacgtgtaattgggttgaggatgacaaatttcaaaataaaccgatgaacaaaaattaaatgaaaatcattttaaatatttattattcttctctttttcaagccaaagttgccatgcgacagtgtcagggcggttacgcgtgctccatcactttcaacgccttacattccaaaatataacaaaaaggcgtagagcatgccgaccatccaaaagaagcaaaaaaacacctatttagaataaattgttttttgatgtgttttaattttataaaacttttttactacacaaaccatcgatgggcatggccatcattgaagggcggaaagggctcctttaactcaattttttctttgttgcacactggcaatggtcctttgcaaataacacatgacgcaaatccatcatattttttacagattttctccaatttggatgaacaactttttgtttcggcgcatccattcaagacaaatatatcattattttgttctgaagttggcatgaattgaaaaaatatatcaaattaataaatatttaaattgaaaaatgaaacaaccatccaaacaagagaatgtctggcaccccatgaagacattgccaggacaatcaacaacatcgattatgtcgtcttcttctgtggctttgatcttataagtagcgataagccagttgatgtctttgcatgccgcgcccttgttccgtaaagaaagcgcacagttatagactaaaaaagtttttatgtgaaagtcgtttaaaaaaatgtaaaacagctatttagaataattgttttttggtgttttatttttataaaaaatgttttcttcacaaaccttcggtgagcgcaggcattattggaggggggaatggctccttcaattcaattttgtgttctaaaatgtcaagatttaaaaaatatgaaaaattagttagggattagatttgtcctaatttgtcacatttgtcctgagttggaggtagcaaccaaaaatttggtcattactgattacttgagaggatttgaattaatcggccgggagtgccttaaaaaattttatgaaaaaattttatcaatgtatttttagtttatattatttttcaaaaattagctgcaaaaattcttaaaagtttcttgaaaaagtttaggtatataaaagtaaaaattttctttcgggttgtttaccattgccattaattttgataaaaagacggaaatttttttgaatttttttgcatttgttgccaaaatttatgaatgattcttattggtttttaaggaagtcttcatagtccgaaatgccaaaatcaaaaagcaaaccatataagaaaattcaattttaaacttcggttcaccacgtatatgattaataaaaatatatttcaattatgtagcgaaatttaaaattgttaaaataaaaaattattaattaatccatcacttattcaatttccaattgtctatttttctgttcgttgtcccttcagaaattaaatattaaatcaaaacttccgtgcttctctcgtaaaatgttaacctcaaaaatgtaaaaatatataaattcatttaacaactcgtaaattatttttcgatttttcttatttatttatttttaaataaaaatgatcttttttaaaatggttaataatacataaatggcatttaaacatgtgttcatcattcattctttcattcattctcaggtgggacattccaagcccgtgattccctccaaccattccttgtcaattgggacgtaaaaatttattaagcctgtgaaaagcaaagaacaattaattttagcagctttcattatttaaataggtaaatattttaaaaatgaaatgtttttattttgaatttttgccaagttttacttttgttctttttatcgcataagccgaccgaaaggatgccaacttggacaaagtgagtgccattgttggccaaaagtgcgccgccgctgtccccctcaaacagaaaagtgacaagagaaaaatgttgggatgggcaaacatttttaattaaaatgtaaatattaatttgatttctgtttaaaaagaatttttttttaatttaaaattcattttcattttttaaatatttaagggtttttcattaattccccaatatttcggattatccccccaattgcctgcatgacagagttcgactcaacacaaatgttccctttgcggccgcgaaatgatctgcagccaaccattttcactgggcgaccatttaacattttggcaggcctcgttaagcccacacaatcatctaaactcattgacacaataaactttaattacagcagacgaaaattatccatatatttttaatttgattcaatccaaaattgggccatattttggataaatctgataataataaatttttagattttgcgccag

SEQ ID NO: 12081 - DNA, 1154 bp, Heterodera glycines
aatccttcaataagagatcatttatgccgtttttgaaccaaaaatgctgaatttgaaaatttgggctttcgactttttttcaaattcgggtccggggttcggagttggccaccagatttgtggtcagtgccctcgaattcgcaaggaacttgtttttatgccaataaaattttcactgacgcattttctaccgacgctttttccgctgacgcatttttccggggggcccagtcgattggtccttacaattttcacactaaattaaattttaatatttactttcaaattttatatttttcacctccaattggcaattcttcggcttttccattgaaatatttgttgttttcggcccaaattttgggagaatgtccaacccgagcagccaaagtccggcgtaatcatccaaaaatgggccaaaaggaaattgatcggaaaattctttgtcaaaatcgagcaacggtttttcggctaaattttcagttttcagttttcaattttattattttttatttttttccatttacttccatttgacttaatttgtgccgaacatttgttggaatggaattgaatttcgatttccgagtggggcgttatgctaaaaaagtaacgaaattgatattggaatgcaattaaaacagataataattaaagagcagttttttaaagccaaaatttgttcaaaatatttaattaagcaaaaatattcatttataaaaattttatttttcatttgagacttgattatgattattttgctaaatttttaaatttagagtcccattattaattatttatattttgataattccgtttcaaaattcaaattatttactttttctattttaacaaagccattaagttttaagcatttggtcacccacttgaagcattctcttcccactgaaaattgcgtgccattcattgaaatacgaacttttttggcatttttgccacactttgcgctcttatccaacaaataggaaaagaagcgaaagcgacgcgacactttccaaagaaaattccctccgccggacaacacacttttgtagcacatgacaaggcttaattaacgtcccaataattatttattggcttttaagcctcaaaacccattgcaattgcagccgtttttcagccgaatggtccga

SEQ ID NO: 12082 - DNA, 4647 bp, Heterodera glycines
aaaggagagaaacaacagaaaatagagcgggcaattacaatagaatttgatgtttaggtcagtcgagaaagcattgagcaaatggcgactaaactgagggagagccttttgcaaatggacccgcaatcggaagttgaccaactgaatgccaatctgacggtaacggggcaatgattaccgtactgtctaatccaaatgggtctttcgcttatgcttttctctcctcgtccgttcgcttccctttcaaattcgattcccttttagcgcattgtgaaatggttcgaattgcttaacgaacaaagggaacgcgaaaatggggaaaacggaggcgaataaaagggacggacgaccgaccgaattcctgggcatcatcataattcgtgcgcactgtttcacttttggccattaaattattaattcgttcatttgtcaacctttgccgccttcccctgccagcatattacgacaacactttgtcattttacaacagaattttcaaatgctattattgtgttttttagatatcgttattacattttaagtcgtttatttatttatcaatttaattttgtttgttattaatttaaatttctaatttggacatcatttcttattttatgcgtaaattaaaagtgataaatgttaaatttaaagcgattatcttggaaatgttgattgaaaaagatacaataaaataaataacaaatgaacgaatgaattccttgtgcctttggatacggtaggaaatggaaagtcgaaaaatatttacagacccaaaataaaaaagaaataattaaaatacgtcacaaattctgtcaaattttgttccgtccgtccgttctctctctgtttattccattgcctttccccgtaatacgataggcttttttgtggattggccttctgtcggtgtttattttgcgtcggccgattgaacggccctttggggtgaaaagggtcgttcattcatttattaattcaaattccctccccaatgctttttcgccacaccttttttttgcctttgtttttgctttttccgctgcttttcctccgtgccaatgccattgttcggtcgcaattggccaatgcgcaggagacgaggtgtcctttgtcccttttctctttttttatgcttttggtccgctgatcagtgctaattgtaattgtttgtctctgtctgatcagatcgcgcgttctcttcgccgatggaaatgtccatttctttgctggccgtggccgtaacatcactttccgtgtctccgacggttcttccattcttttcggcctcaccgatgtccaatctttgccaaattcggtccgtccctccctttgccatttccctccctttgaaaaccccgacagagtgaagtgagtgccgtccgcacattggtggcaaatgtggacagtcagctgaacggattggtggagaatatgggacggatggagtcgcagtggggggacaaaatcacacaaataatggccaaagtgagcgaattgcggcactttgaaatgccattccagcaaaaatgccattccaatgaaatgccattttaaacgctattcttgacccacccccccgttcacctcattagcaccgacaattgtctctgcaactttctaaccaactgaacacttctctctcacgtgcccgtgccaaccggcgcattcggctgctcatcctgaagctgagtggtcaaatcgatcggcttttcaagctaatgagtgtggacgactgtttggcacatccctgcttgaatggtgccacttgtgtggacgggtttggcaaattccaatgcctttgtcctgcacattttgaggtgaatcagctgaatcgtcgatggtgtaaaaccccggcaaattattaagggaaaacactgcgaaaaacgggtggacgaatgtgccctttttgcgaacacagaagtgggatgccaaaacggcgccatttgcaggaataacccagtgagagaagcaaaagcgcaaaaatgggctaaagaaagtgatcaaagcgatcgaaagggcaattaggcatatgcttaaatcagctcaagactcagtgatcaaaatgccaaagtcattccttccgtctgtctcttagtcatttgccggcttcacctgcaattgcactgccgggtggcgaggacgattgtgcaataggaaggacaataaatgtgatcattcggccgatttgtgtggggagcacggacactgtgttaacaatgagcaatcagaggtcagagaaaaagaaaagagggtcggaaaataacggagagagagaggaagtcagacaaaaggggaataaccacgagactctcgggattctccggatttggctgaatctttctcattgtttggtcccgatgcgctctgatcccaattactcatttcagctcggctatcgttgcttctgcgagtcgggcttcgttttgggcggtgacccttcaaatccgacttgcgtcgataacgacgagtgcagcaccaacagcccatgccatccggcaagcattctgccaaaccaaccaattccgctcattttctttgcagggcgtcaattgcatcaatttgccgggctcctttaaatgcgattcgtgtccctccgggctaatcggtcggtctaagagcaaatcaagggcaattaaagggagagattcatttgataggtaacggaattaattgctacgacttcgacgagtgtgccagtgacctgaccaacgactgttccaaggagccacgggttgactgtgtgaacacccacggggcgtacaaatgcggcccgtgtcccccgggtaagaacatttcggctgtctaaatttttttatatcacatttatctagattttgtgggcgatggctttacctgccaaaaggtttcactgtgtgccgatggccctaacaaagtgtgccatccggaggccaaatgtgtagaagaaccggaattccgttgcgaatgtccgccgggcactgtcggagatggcctcgggccggacggatgcgaagcgaacaatcggacactttgccacggggacagctgcttgaacgggggcacttgtcaagtactgatcaaaataaccaatcaaatgatcggcaaaagctgaagctcaacccatcaacccattcatttcactgaatgcccttcaaatccccaggccatttccgtctctgtgttccgttgcaattgccccgaggggtaccaagtgagtcgggcggtgttgtgatttttcaaatggctatcacttaacgggttcaccacttcaaagggtgcccgatgcgaacatgccagtccctgtctgtctcggcaattctgctcagggcacggccgatgccgaaccagtcctttgggctgcgactgtttcaggggcttctacggcccgcggtgccaatttgaggaggacggtgggggacggcatttgcctttttgcgccaattagaataacttcttgattttaagactgcgattttcacacgaacaacgaaacgggcgaaattttgtacgaacaaatggccggacgagggccattgttgagcagaaaagtgtgcacgtggcacattcaattgctggacacgcgcaaagtctcaccagaaagaaaggacaagaaatggaaaacattgctaatctcttttgtggagtgctaattgcttccaaatgagcctattagcgcattgatcctcctccttaatgtccttccttaattgtcctccttaatgaccctctctttcgcttcttttcttgtcctccctttccttctccatttgacactttccctcttcttttgtcaggtgcttcagcttctatttatcaactactcggctccccgtctttttgaagtcacttcaaaggcattgcttatgatttgtttggcctaatgaatatccctttttaagggctgtttgtccgccttcgccaatttgagcattttcgacggggacgagccgggccaaagcccccaattgggacgctcccaaattgcgcacttttgccacggctcttcgccttctccgctgctcccttttcacacctcagggtgaccactctcaacaacattttattactcgtttattgctttgactcctcaggcacaaggcgaccgttcgactttctttccgtcttttaagtgccaacatttttttgcatttcaaatggacggcggagagaccgcgtaagtcaaaaatggaggagggaggggggtaaagcaaatctcaggaaatccgaagggagtgccaaatgaattactcactctcggactaaaactcccggagaatgattagccagtctttaatttcagatctcgtcattcttgctaatccatgttttccttttgctcaggttgtggtggacgactgtctaatgccaacggcggacgcattgaccatttcgatgtccggggtgacgacctttgcgtttggtctgtgccatgtttttccgctcgcgttggtgccaatctctgatttctctcctcaggttcattagtatgccgcctcaatttcacgtccgcctcagcgtcgatgtgctgcgtttgccttccgcccaattccacaattgttctgtcaattcccttgaggtcattcgaacatttctcctcaagcgttccttttttcctttctttcttatacgctcttttcctgttctcttttttcccccatttccttt

SEQ ID NO: 12083 - DNA, 1569 bp, Heterodera glycines
attttccgtaagaagattttgggaggaatttcacaaccttgttataggaaaaactcatatctgactcgtataaaacataactcgaacctcgaacagtaggtatatttgttgtgcaattttatagtccagccttcgctagggctctcaccgcggtgtattttaggttgtctttgatgtatcaaaatttctctcggccgtgttgttgactgaaaaataaaacgaacttaaattattgcaatattgtttatacgaagtcttttgatattattctgacgacttccatgataataaatacttatacaaagtttatctttttatatatttcctcatcccaaacatggatggaaaataggcaataaatcgacaaatattttcaagttttgccatgctatttatctttcgggactcaatttatgacgaaaatatgggctccaattattttttattttctactaacacttttctagtggatcaatttatagattcaggaaattcattgcatgaattgaaaagtatttatttttattaaaatttgctgcttattttccgtaagaaagtttttgggaggaatttcacaaccttgccataggaaaaactcatatctgactcgtataaaacataactcgaacagtaggtatatttgttgtgcaattttatagtccagccttcgctagggctctcaccgcggtgtattttaggtgtgtctttgatgtatcaaaatttctctcggccgtgttgttgactgaaaaataaaacgaacttaaattattgcaatattgtttatacgaagtcttttgatattattctgacgacttccatgataataaatacttatacaaagtttatctttttatatatttcctcatcccaaacatggatggaaaataggcaataaatcgacaaatattttcaagttttgccatgctatttatctttcgggactcaatttatgacgaaaatatgggctccaattattttttattttctactaacacttttctagtggatcaatttatagattcaggaaattcattgcatgaattgaaaagtatttatttttattaaaatttgctgcttattttccgtaagaaactttttgggaggaatttcacaaccttgccataggaaaaactcatatctgactcgtataaaacataactcgaacagtaggtatatttgttgtgcaattttatagtccagccttcgctagggctctcaccgcggtgtattttaggtgtgtctttgatgtatcaaaatttctctcggccgtgttgttgactgaaaaataaaacgaacttaaattattgcaatattgtttatacgaagtcttttgatattattctgacgacttccatgataataaatacttatacaaagtttatctttttatatatttcctcatcccaaacatggatggaaaataggcaataaatcgacaaatattttcaagttttgccatgctatttatctttcgggactcaatttatgacgaaaatatgggctccaattattttttattttctactaacacttttctagtggatcaatttatagattcaggaaattcat

SEQ ID NO: 12084 - DNA, 1156 bp, Heterodera glycines
atcccgacttttctcctgaatggtgaaagtctcgactgattcctacagatttggctgtccctcctctttctgtttcatgtgccattcgtaacaatgattaacgaaaatgccatcatctctgctgctgctgttggtgctgctgatcagcagcaccatgcctcgtcctcctcgtcggccgcttgtctgccaccggcgctgccaaacgacggagagttaaagcagcgccatgtgcagccggctgctgcttcatgttcagcgcccgtctgtggccatgcaatgttcggcaatcggtgtgccgtcggtattgtcgttggactgcttggactcggtgtgctgttggtggccgctttatctccccctacggcaccgccaacagcgcccattggtttgtcccaaatcccgacccaaaatcttggccactccgacccgaatcccgacttttttctcgtcctaaatcccgcccgataaccttggccactccgacccgaatcccgacttttttctcgtcctaaatcccgcccaataaccttggccactctgacccgaatcccgacttttttctcgtcctaaatcacgcacaataaccttggccactccgacccgaatcccgacttttttctcgtcctaaatcccgcccaataaccttggccactccgacccgaaccccgacttttttctcgtcctaaatcccgcccgataaccttggccactccgacccgaatcccgacttttttctcgtcctaaatcccgcccgataaccttggccactccgacccgaatcccgacttttttctcgtcctaaatcccgcccaataaccttggccactccgacccgaaccccgacttttttctcgtcctaaatcccgcccaataaccttggccactctgacccgaatcccgacttttttctcgtcctaaatcccgaccccaaaatcttggccactccgacccgaatcccgacttttttctcgtcctaaatcccgcccgataaccttggccactctgacccgaatcccgacttttttttcgtcctaaatcccgaccccaaaatcttggccactccgacccgaatcccgacttttttctcgtcctaaatcccgcccaataaccttggccactccgacccgaatcccgacttttttctcgtcctaaatcc

SEQ ID NO: 12085 - DNA, 3620 bp, Heterodera glycines
  misc_feature (3612)..(3612): n is a, c, g, or t
cgacccgaatcctgacttttttctcgtcctaaatccccctactaagccttggccactctgacccgaatcccgacttttctctcgtcctaaatcccgcccgataaccttggccactctgacccgaatcccgacttttttctcgtcctaaatcgcgcacaataaccttggccactctgacccgaatcccgacttttttctcgtcctaaatcccgcccgataaccttggccactctgacccgaatcccgacttttttctcgtcctaaatcccgcccgataaccttggccactctgacccgaatcccgacttttttctcgtcctaaatcccgcccaataaccttggccactccgacccgaatcccgacttttttctcgtcctaaatcccgcccaataaccttggccactctgacccgaatcccgacttttttctcgtcctaaatcccgaccccaaaatcttggccactccgacccgaatcccgacttttttctcgtcctaaatcccgcccgataaccttggccactccgacccgaatcccgacttttttctcgtcctaaatcccgaccccaaaatcttggccactccgacccgaatcccgacttttttctcgtcctaaatcccgaccccaaaatcttggccactccgacccgaatcccgacttttttctcgtcctaaatcccgaccccaaaatcttggccactccgacccgaatcccgacttttttctcgtcctaaatcccgcccaataaccttggccactccgacccgaatcccgacttttttctcgtcctaaatcccgcacaataaccttggccactccgacttttttctcgtcataaatccctattgtttggtgccctgtctcgtccctggtttataccatatatttttatgcctccgtatcaagcaagtttcaggcccaacggcggccactgtcggcacagttcgttacgccgcgcggggcggcggcggcacaccgtttcggcaaccatcgccatttgctgcacccgcaggggcagccggcggcgaattatcaccagcaacagcggggcgatttgttggcattgatcagcagcagcaacagcagcaaattgatgccctccgggcacggctggaccagctacagtacgaactgctgggccaagtacagtacgccaccagcgcggcggcgggtgccgaaccatggccacctgccttcttcaccgttgactacaacaaccacccgaaatcactgctcgcccgccggcatatggcatggcaaccgatgcgccgtggcatcattgaaaatgacgtatgtaccatatgcaagtacagtacccttaacccaaatttttgtcagagagatttgaattttttatttttaaacgaaatttcatctaacttttcatttttaaagctacagtatctatatatgtttaaatcattccacatatggccatttggtcagcataggtacacagtaaagacaattttattactgtaatgcattaccgtaacccatttttaaagaaattaaattttgttaaaacggttaaggaacaacagcacggcagcgtgtccccaaggcatatcagttggcagccaatgaagcgtcaacaacagacggaatacggtatcaccggcatgtacggtaggggagggggagacggtggaggagcacaaaaggagcagggtaagtgaaggaaacagggacaacaaacacaggcagggttgccctcatgaatcccggaattcggcattttacgttctgaatcccgacccgaacgttttttggggagcagcagctcgttcgcgccccgtccacccccctcaaaaaattaaaaaaaaattttcaaatagaaattttccaaaaaaaaattaaaatcttctaacttttttaaatctctttaaaatttaaagtttccaggggcctagttcaattcagatcatatcccagatatgacgtgtcatatatcatatgcatgtttcaattatgaacggacttgccataagatcatatcgtatgcggaacttacaaaaaaataataaaatgaagaactttaacttttaattccgtaaaaaaattttacttttaaatgttttttaggtaaagaaattaagggcaaataccaattatgtttttatgatataaaaataaaagtctaaataggcattaaaaagtcgaaaaatagcttaacatctgcacttaaatattttttacttatttatcattcaataatagaggtttcattctataaaatgctttttaatgaaaattttcgatcaagtttaaagtttttatgaacttttatcctacatacgattgggcatgtctccgcctcggagcggatacacccgcatatgatttgcacaagggaaggggtgtcatatgtgacggcatatacgtagaaaagggagttaattgaaacgcgcatatgattaatcataggaaaagtcgtatgccgcgtatgacggcgtcgcagatataatatcatatcggcgatatgatatcatatcggcgatatgatatcatatcggtgatatgataccatggcacaattgaaacgcgcctatgacactatgacacgtcatatcatacgccgcatatgacttttggggtggtttaattgaaatagaaattttgtgtatgatatgacaccgtgtcatagagtcatatcgcagatatgactcgaatgaaataggcccagagggcgcgtaaatctctgaatttcagcttctttatgtttcgaagaattaaaaaatatataaattttaaatttggcacccaaaatgtttattttggcgttttgtacacagtgctgcgtacggtggagcagcagttggtcgaagtgcttaaggctggcgatcggttgggcgtttcggctgacgaaattttggcacatttacgggcacagagcgaaaatggcggcggcggtggtgggggaaatggacgacgatgaaaaagctgaagaacaaacgattttgagactgatcatttgatcaacaaacatcagaagtgatcaattctgacgcatttaattttattaatttatattttgaaagcccgagttatggtcaaaaaattttaaagaaattacaatttcaaactccgatttgatatgccgcagaaacaatatgtagtaatcaatgacttagccaagtctgatcagtaggattaggatggcaaaaaatgcaaataaaatctcgaatatgtatttggaaacacgtcctagaagcttcaaaacaagctaaagttcggaaattcttcgttttaacgcccctatccgaccctagaaattccaattttggacttttttgcccctaaaaattctcgccctagtgattaagtcgagattagggcgcggatttatatatatttttttaaatttttagaatttttgataaatatttttgagtttttcgcgaaataaaaaacagaaaattcttaaaaacaatagaatcgttgctgactttcaagtttatacaagtacagtatacacacaaacaaatacatatatatgatggtatatacgatagaatatacaatgacaggcagagcagtttagaaaattatacacatatgatttcacacattggtgatattataagcgtcatttcatcgtatctcctctcaangttcgcat

SEQ ID NO: 12086 - DNA, 2724 bp, Heterodera glycines
tcaacttcaattccaccaacgccactatttggatcaaaatttataattgatcgttcaaacgcaaaagctgtaatagttgataatgagaatttacttaagaatagcatacggtgcgaaactaaagaaaaggcaacgaaattcagttgtacatttccaccagaagcttgtcaatgtcacggaggtgactccgttgttcactgcgaatgtgagaaaaacccactcactgaaatgttcacgagaaaagaaaatattttgcctctcgagacacatggaagccaagtatcgttcgacactttattaagagcaaaaataaagtcaacaacttcactacaaatgcaagtcacgcttaaaggtcacaaagtcaaagcaatttatgacaaaaataattgtaccgtaaacataaaatcgttagaaggatgttactcatgcaccgatggagcagaatttaaattctcatgtacaaccaactttggtaccgcattggcaaatgtaaaatgccatagtcagaattttcaaataccctgtgacacaaaagggaaccaacagcaaattcagctttcatttaatcaaccgagtgtaaaagaaaaatgtgaagttatatgtccagatggaaaaagtgaaataacaattgaggccactctgaattatgtgagccaacaagacaaaataattatcccttcgaataaccaaaaggaaacacccgtacttggcacttcactagaacaaattacagatatatttaatttcatatataccttgatcaaaaccaatcttttaaattttttaactattgcttttaccttgattctgataatagcttttattttttgtatctgtcctatgatttaccctatgtttattaagcacttccctttccgtcgcgggaatgtcgcgactacgcgaattcggaaaattaatttaaaaaataaaaaacattaaatccaaaaaatatttaaattaattttaaattagacagataaatattaattaattaaatgtgaacgaaatgaagaaatgaatgagggaaaaacattagtcatattagtcataattttttctatccgaaaaattatcaaatgttaaaatttaattatgaataattggaacggaacgttaaaagaaataacagattttaaacaaatgttaaaatgagacaaaatgtgaatgatattaaagaaattgtaaaatgttagaaaattggaaaaggctaaagtggcacaaactggaaaatgagaaaaggttagtaaaattggcaaatgttagggacagaaatttggacatgccaagttggcaaacaattgttcaagcagaaactgccggtataaaaggaggccacaaaccccccaccaatcagtacaccaacggtttctgagaggcattgcctcgtcctccttttcctccctccccttccccctgtgccgacaacagccgccgacaactgcgccgcccgcccgttcgtgccgtcgactcttggccctgtccgttcgtgcgccgacttctgtgccatgccgatccgtgccctgccgtgcccgactaccgccttgacacaccgcccgctcaatgccgcccgtcccgtgccgttgacgtgtgccgagccgaccactcccgtttcggtccccaaattgtgccgtcctccgatctgtgccgtcccccattttgtgccgtcccccatttttcctcattgtgccgtccccatttctgtgccgtcccccattttgtgccgtcccccatttttcccccattgtgccgtccccatttctgtgccgtcccccatttgtgccgttcccccattttgtgccgttcccccatttcccccttcggtttaattacccaagtttgaggactccaataaagtgtattttgaatcgctttcccgcctcacttgacccccagcaattccaccatccccgatcgaccgtcaagcgtccacccccaatcgccccagctctcgccaaatccgggccgttgccagccaacaaactcccattcagtaccggccgctcaatctccgaccgactccccgactcgccctcttcatcccgtcccccccatttgtccatcaccgattgcggaaaggacattttcagaaaagccctttaattgaattaaaatctatattttctggacgacaaaaatgcgttggctgaattaaaattattcttaatgcaataacggggagattaactcacgcactaattctactcacttttaattttttctgcagcacaattaactcgagaaaagtatttttcaaccgagagtggatctgttcactttttttgtcaaaggaaatttgatagactcttttattctcagaatttgtctatacaatttagttcaatattttgaattcacaaatagagatcagatttggaataacggaattaaacaatattgttcgaattctgaaattatttcccaatccaaatcgattaactccaaacgcgatggagaaatactcttttcagaaaagccctttaattgaattaaaatctatattttctggacgacaaaaatgcgttggctgaattaaaattattcttaatgcaataacggggagattaactcacgcactaattctactcacttttaattttttctgcagcacaattaactcgagaaaagtatttttcaaccgagagtggatctgttcactttttttgtcaaaggaaatttgatagactcttttattctcagaatttgtctatacaatttagttcaata

SEQ ID NO: 12087 - DNA, 1125 bp, Heterodera glycines
  misc_feature (111)..(111): n is a, c, g, or t
  misc_feature (202)..(202): n is a, c, g, or t
aaaaatgcgttggctgaattaaaattattcttaatgcaatacgggggagattaactcacgcactaattctaatcacttttaattttttctgcagcacaattaactcgaganaagtatttttcaaccgagagtggatctgttcactttttttgtcaaaggaaatttgatagactctttattctcagaatttgtctatacaatntagttcaataattctgaaattatttcccaatccaaatcgattaactccaaacgcgatggagaaatactcttttcagaaaagccctttaattgaattaaaatctatattttctggacgacaaaaatgcgttggctgaattaaaattattcttaatgcaataacggggagattaactcacgcactaattctactcacttttaattttttctgcagcacaattaactcgagaaaagtatttttcaaccgagagtggatctgttaactttttttgtcaaaggaaatttgatagactcttatattctcagaatttgtctatacaatttagttcaatattttgaattcacaaatagagatcagatttggaataacggaattaaacaatattgttcgaattctgaaattatttcccaatccaaatcgattaactccaaacgcgatggagaaatactcttttcagaaaagccctttaattgaattaaaatctatattttctggacgacaaaaatgcgttggctgaattaagattattcttaatgcaataaccgggagattaactcacgcactaattctactcacttttaattttttctgcagcacaattgattcgagaaaagtatttttcaaccgagagtggatctgttcatttttttgtcaaaggaaatttgatagactcttttattctcagaatttgtctatacaatttagttcaatattttgaattcacaaatagagatcagattttgaataacggaattaaacaatattgttcgattccaattctgaaattatttcccaatccaaatcaattaactccaaacgcgatggagaaatactctattcagaaaagccctttaattgaattaaatctatattttctggacaacgaaaatgcgttggctgaattaaaattattcttaatgcaa

SEQ ID NO: 12088 - DNA, 3163 bp, Heterodera glycines
cttcctccatttccagcaccagcttacagacggcaatctttgacggtgccatagccaggatgcgtgccgacgggtcctctcgcaggatggcagccatgattgccgccgccgtaaaggtcttgcctgtaccagggcccgcctgttgaaagacgaccctcggcactccgtcgagcatccgttccgccgaatcgcactgtcctgccttcaaaagcccaacggcaccctttttcatcttttcctcaacactttgcaatgccacgtcccggggcaccctccgtcccagcagaatggccatgatcacattggcaggcgatgcgtggtccttggcaatgatggagcagccatttttggtcagaagttcagctcgttccctcagcgcacgcgtggaaaccatgggacgaagctcaacggcttccaacgccccttcacgaaggaattcgaactgctcccacgccttctgtcctttggcatcctgaaatgccaaaaacacctcgactctgacctcaaatccgttgtcaagtgcgcgcttttcaatgcgtcggacaaatccaagagcacacggcttggtctcatcattttggtcgacgcggcagctgattgccgtgtcttcttcccaaatttgcaacatgtccatcatctcggccacggagttcaactggtgcctgaacgtgatgttcacctgtgtctcttgcagctcttcgactcggatcagctccgtgatgagagtgaatcgctgtagctcttggtgaattgtggctcgttctgcagcgactgcgcatgccatgactcgctctccaaatccaatttgttcccaggtggagttgctgtcaaagggataggcataaatccgggtttccggttcaaccttggcaattatgttggcattaaaggccaaaatctcgtctccattttttgaatggaaaacccatgggcaagacatagtgctgtgaaattagcactccttgcggacgattgatggtcacaagctgcatttgcaccaggctctgcgagtgcagttcgtttgccatcgcttcagacatgtgccgtcgttgaatgcgcatgatggtgggcaattcaggggcagcaatggtggcgaatttcatggttttgttgccatttttctttgcgtgccgttcgacatacaaaacaaggcccaacgctgagctgaaaggtccctgataacacgcacttacctccttggccacggcttggtgattcaagcgcttgttgaccatgatcagccaatctccggcgcctgcccatcccgttgccgtctgtgcccattcaacgctgaccactttgaccgaatcgccgacttccaatggccgagtcttttggacaatgtcattgtccacccaaattagggcaggccattgctctgtcagctgaactcgtgcagcaatcacgccatttgcagcaatttgggcaaccaggtaccacttcggcgccttttcgtcttcctttttgccagggtatggcccctgaacacgagtcttcgtcaatttgtctttggcccgcaggccgacggcttggaattcgtctatcagagccccgtcctccaaacatgcctgcgatgacgaagagcattttgacgcatttgtttggtccaggcgctttgcctttttcgacaaaaaggtgtggcgagacgatgactcatcacctgaaaacccgccattcccgaaattatcccccccttggtccccattttgctcatccacttccatttctttgaccggctcaaccgtggccaaacccagcggatcgctcggatttaccaatggcatcacttccacaacaccattttcattatcagtattttgcccgcaggcgttctcctcgatgctttcgtccagcaccaccacttcgggcgcttgagctggtacttcctcagcttctccttccatttcattttcagtattgtgcccgcaggctttttcggaggacatatttttgggaaaaggaaatttggatttgttatagctaaaatgtacggaaattaattgaaatggatttgtgaaatggaaaaggagaaaaaaaatgtggggaaagggatacagaaaatgttgaaatgaataagaaatgagaaaatatgtgtgttgtaaggtttatgtgtgattggatcggaggagtggcttatttgccagtcgggggaaatgtgaaatgtgtaatgtcggcagcagaggaagatgacaggcgatgggcgtttgctccgtctaagggcaaagatgtgaccgttgatgattcacaaggacatcgctagctttttgagtcaaattatttgagtgggaatgggaaagaatgagggaaaaaaattgaaaattgtgttgtggtgttcaaaagcgacaatttgtgcatcagacgatggggagagaaaaaaaaaccggtgggaagtgcgaaaagggcaacatttaattgctttttttgaatgcgcggatgggcgcggacctgaaagaggcacccatcagcaattaattcaacaaagtgtcccctcagcgaacggttgagcggagagagaatttgaaaataaaaaattggaattgaaatgtggaaagaaaaaaacaatcttagtccaacggaaaaattcaccaaaatttggaaatcaattttccatttcaaattttgtagccaaaaaactgtaaggtatacgatggtgaaaacggagcggtcacacttgcaatacagcaacaacatctaaggatttttatgcagactaatattgccaaaaagaaaaggacaattaagccaattgttagccaaaaattagatgattgactaaatttgtctccaaaatttttgcttatttgttcgcaggcccaacgtaattgttcttctccatactcagtgattgacgaattataatggtaaagcgcatagcatgttgtgttgcagttcatcgaacacaacaaatgctgttcgaaaattgccgtactattcggtgttagtggagatgtgctgaccgtataggccatgattaacaacacacaaaacagtttggtcagttttcctaatttcgattttgtacactttgagtctgtattgtgcccgcaggcaatttcagttgatcgtctttggttgtcggcagagtgcatttgttgaaaaaaggaatgataattttgtctgaaattgtaatatttaaaaaaggtattttagttaaaagaaaatg

SEQ ID NO: 12089 - DNA, 3651 bp, Heterodera glycines
tccaaaaacgacttacataacgtcataagtttttagcccccacccgaagttgagtctcaaaaaacataatttttgtttcttcatcttttaaaatgtgagttcttatagtttaatgaacctttgttagtgtgtacataaatctgttggatataaaatcgttttgcattggacgggtgaactggcacaaagccgaattcattctttcactgattccaattcatttttcagttacaacctgcaggatgcggagcatgaggatgacatcggcccgaaataagtttttgcatgcgccattcgcctgtgatctctcacacaaagacaaaacgggacgttttcttttccattattgtgccttttcatttgcataacgaagattttattctcaagtaaagacattttgaacttttaaaaacattttggtgaaagtaaaggttatcatctcaccagccattttctaaaaactttctgtttattttcgagtcatgaaaaacaacaaaatgagtaaaagtaagggatgcagatgcgcataacccagagttcccaagtgtccttatttgtaagatttgtccttgttttcaggcttccccaaacttcaaatttttgtgcttaatgatttatttcgccgatataaatgctactaaaattattaattttcgaaggtttttttccccggcgccgcctatcggaaaccgccgccccccccccccccaaaaaaactgttttttcttaaaaaattggcaaaacaccgtaaaaattgttaattttttgttgaaaatctgttaacaaatagtgggaaccttagttcggccccgcacggtttttcacccttcatatgttgtaatttcacccaagcttttaaaattaacaatttgtttaagtattttgaatttaatttggctattttctaatttgcttctgtgattaatgaccgaaaaacctcttcttactccgaccaatcccgtatgaacaaaatttgattcgttatttcttaaattccagtggaatttcagcgattggctcaagtccaaacgtcgtttgccaattttttcgccattgcaaaccttggcgacacgaactccgcttatcgtggcaagccaatttggacaaattatccgacggacgaaatttgtcaatgcgtaattcaattgcttaacgaagtgcctgcggcgaggtgtttagccgaattaccctactttaatttaatggatgaaaaatcattcccgaaatttccgtttagagatgccgttttttatttcatctcaaacctaatccatgagaatgttcatctttatttgtcggagaaggaaaggaaagacgcgactaaatgtgtgatttttgcgatatttttaatttatgtttttttccgaaggtgtcgattattccaatctccaacgagctgtactgcgtttgctgacgaatttgaacacttttcggacggaatattccgacaaaaatttgtcattttccgtcagtctgttaaaagcggtatttctcttcaacgggtttcctccaaaattcctccccattttccttttttagctgttcgaactttgctctgaacttttccgcaagaattgtcagcggccctttttcgcccctcagcagccttccccggcaatgtttttgacaaattttcaacaaattccatgtgtttccgaactgtttgctctgttggattcgaccttcgcctccctgtcgatattttgcttttttcgattttgttttataaattactaatttgtcagattgcacatccgtccggacagtgccgtgctcgcttttgtatcggcccacaaaaatttctacgccaatttcgattggattgccattcacatagcgtaaaattcttacgattaacttcttatatacataattctgttcattttcagtgaaacattccccaaaatcgctgtccatctcgtcaaagttggggccgaggaattctgtgcccattgcaatgacatgctcaacccggcggttcgatttctcatgaaacattagcaaatatattttttttttggcattttcagaatcgatcaaatgccgcccgtgttgttcagctgcaggacgaatacagcgcaaggcaaaacatagcacaaatttagataaatttaaaaaacccattttttaaaatttcctccatttttaggctacgattgttcaaggaaatgtttttgtacatggaaaataaacaaacacttgaattgcgttcggtgttcacttccattgtggaggtgtttaattgacctttttcatttccaatatttcgtttttaaatttagaaatttttactctccggtgaaaattggcgggaattgctctttctcctcaaattgtcactattttcgcccgcggtgactttgccgttcattaatgaacttttgcctcacatcagtgggttttttgtcgattcgttttctcaaaatttcgttggattttttttttaaattacaagtgacacaaatttcatgtcaattgttccaatggacaggaatacaccattttcagttcaacacccgttccttgttgatcgtcttcaggaactcgctgccaatccggcactttccattgccatttcacccacaaattttttgcagaatttttttgagaaagttgttgaaaatgcgagcacggaatacgtgtttaaacttgcaaaaattgtttccttttccctttaatcctttttttctgtcatttgacctttgaatgtgaaaatgctttaaagtggtaaaacaactgctgaaaatctcacccttaattaattgaaaataaaatatttatattttttattgtaattaaaacgccgaattaaattcatttttcattatattacattaaaaaatacctatttgataactttacttaaattacaattctctgcttttcttctcactaacttttgctcccaaaaaatgactccgtccaccgatgaaactcattttggtggcatggacaggccatttgtgcaagcgcatttggaccaattcaattgtgcattggggacggaggacgaattggacgaaacagtcaataaaagtaagcaaatagctcaattaaattattattttttaaaaacatatgttagacctaagtttccgaataatttggtcccaaattttctgggctaaatagcacaatgtcattcagtgttcgatggttccaaaaattccttccctttttgttcatctctttcagttaatgcgctttgcaaaacccattcaattggcgcattggactttttggacggattaattgcgtttatgaaaaatggcaaaagggcgaccgtttcgatgcaaattttggacaattatgagcaccaggtaagtgtgaataattaacgacgatttgttcatttcttcccattcttttaaggtccttttgcgaatgaatgacagcgaaaagcggcggaaagcgaccaaacggacggcgccgttggattatcggaagtgcgtttttcaggggacaacaattacggaattggggaaattggcacgaatttttcaaattaggtaccaaaaactaaacttttttgaaattttggaacttattacgaaacctattacgatttttgataatgttttgtttgttcctttagggagagggaagtgctcaaagaattgccattttatgccgatttatttgctgccgcaa

SEQ ID NO: 12090 - DNA, 1467 bp, Heterodera glycines
gggtacaccccaaaacgtcgccgccgtaacgtcgccgggacataacggcgccgcaaaaaaattttcaaaattttaagaaaatttaaaattatttaagcttttctgaaaatctaagggttaataaaaactaaatttgttgatttctaagaaaaaaatcaaaaaaacatgaaaaaaaatttttttcgaatttttctataattttttccgaaccaggcatggtaactaaaaaattcttgataatttttttaaatacaattttaaaaaattttcggcgacgtttcggcggtgacgttttgtcctgctcccgtttaatccgcccatttttggcatttttcagctcgtctcaaagttgtgattgcccgcggtccattcttcagtggaataatggcccattctgctgaccaatttgtgcaactgcttagtttggttgccgcctctcatgctaacgcattgattttggtaccatttttcaaagaaaaccaattaattttattttatttttttcattttcagttcggcccatttgtgccccagggtatggaactgatgacggattcgcccgaggcaattttctccgatttacttgccgaaattgacaaaaacattcccgccaatgtccgtgtgctcattgtgccaaactcgcagtgcgatcagctcaatgctttgcccagcttcccaacgccgccactgatcggtccgcaaaatgacactgtgccaaatgtacgttttggactgggggaaatgaggcaattaattatacctcattaagaatgtcacttttctgtccgaccccgcactgtttgagttggattctgtccatttcgctgtgtcttcctcagaaattttgttgcatttgtgcaagacggaaatttgcaagtcggccaatgtggagaatgaggaccgaatgcgccgcctcatttcgcatttgttccggtaatttgatgtcgtattggattggatcggtgccgtaaaggcctaaaaatttcggaatttccattgcctcccccttctttcagtgctcgctccctttacccgctgtgcccgtgtgaccaaaatttgccatttgcgccctctgcgagtgccaatgccaaactgcgcctgcccaggaagccgcacgtgatggttctgccttcgctgcttcagccagtcacaaaggtaaagcaaaccgtgacaattgaacacggcttttaaatattttatccatttgatattgttccatgctttatccaggtggtggatgactgcgtggtgctcaatccgggccgcttcgacagagggaagggcaccggcacattttccgttctcgacttggacctttcgagtgccattggcgccacttcggtctcaccgttttgcgaagtctcactcttttcaacccaacaacaacaatgacaaaaatcacatttttgagtgtcgcaattgcccattttaacatttttgacaaaaataaattttcggaatattttt

SEQ ID NO: 12091 - DNA, 4896 bp, Heterodera glycines
aaacagtggaaggaagaaatagcgcaggaaagcaaagaaaagaaaggggagagtggagagagcgaggaggaggagagacggagacagaattggtcggagagcaaaacgacagatctgatcagaaaacaattggcagagatcgaacgagagattgccaggaggatgcagaacaaaaatgtgaagaaggtcgagcggggagacgccgcaattcactttttagggtttttgaatgaatgtctttctttctctcgtcacatcccttgtctctctccatcactctctttctcttgctttccctcttttatttctccgttctatttcctctgtcctttttgttttcttccgcacgggtttcggttcggttcgcctcgctaaatggccctttcagatggacgagcaggagatgaaccagctgttgttgaaccacgcgttcggcttccaacagcaaatgcaaaacgggcggcgacagggcgaagatgtacggggagttggtcaacaaacggaggtcagagcgaatgagtcggtgtcgtgtcgtccatcgtccacctgttcctctgtgtccttcttttttggatgctttcactgtttggccgcttttctctaacctagagtgcgctgggaccgggaattttgggcaaaaccgggaccgggacttgccgggaccaaagaagccgggaccgggacttgccgggacctaagaagccgggaccgggaccaaccgggaatttttaaaaattcaaaaaaatttaaaaaaatatcaaattttaatttatttcgagtgaaaaaatacaaaattaaatttttattttgttttttatttaataaaatccaaaagttaaagctaaattaaattaatgaaaattttcaaaccaaatttatttcaattatttcaaacaataatcaattttggacctaaatgatcgaataatattaaaattgatttacttttcacatcactttttttaggcacgttttttccaaaaaacttttggggaagaagggggtccggcggtgccgataggcggaaattttgaaatttgggtgtaatttgttaacagattttcaacaaaaaaggttggtttttgggattactaagctcaatttgtacggattttttttaaaaaatgataaacatgtatcaattaaaaaaacaatgaggaatcatattttgtcgatacgaaaccaatgagtatacaaaaagaaaattcataaatattttattcctgtagagggattgaaccaagggaaggaagaagggaaagtaaaggatactagccactaggccatttgcacaattgtcagtgcgacttttaaagaatatattaatgttttttttttaaattttttttctttaactccaagtttcgttcctaatttttcactcagacccccattcttaccagtgcttgtttttcccggttgccctaccgggaccgggacctgagcttttcaaaatccgggaccgggacctcggatgaccgggaattcccggcccggtcccggtcccgctctactctaccaaaaatgtccaaaacaaattttttagttcatctggccgtaccaggtgttttcgacagtgattgatttcgaaagtagttgatttcgacagtactttataattaattttctacataatttattgtacacttaaattaatattattatataatttacatatacaaattatttgaagtaattagacttgtataattaggtatgtttgtcaaaaagatttattgctttcttattttgtatacacacggcgagtcaattttgggctccaagtacaattaagttggatttttcgtctaagtggtctgtgagttagtcaccaaaaagggggtctcaggttcgagtcccatgcatgctgtagctgtattttgaggtttttaaagcaaataaataaatgtgaaatgataagacaatttttaaagaagctcaggatttttttttaaattttattcatgtaaacaaagaaaaaatcttatccaactgtgtttattcaaaatcgaattgttcttcttctccattgctatcttcgtccgtctcccgtcggtcaccaatttcttcttgttgttcttcacggtcctgaggcatgggaatttgattttgaacacaattttcaccaaactgacccgcttcatttcgtcaatctttcctgtgttcagaagccaatttgacacaaaatgatggtccaacaattgacgtatttgttcttcgtcgggcattgttttccacaactgttccaaacgcctccacaccgaatgcaatgcttcatcacctaaaaaatccagggcttaaatttcaaaatgctttttgaccctgctcgtctaaaagtgccaaaaattggtgttgtctggcgaacggcacaaaatggttcaacagcaagtggacctttggttttagggctagcaaagtgcgcatccgcggctgatcgttgaggaatgtccgaaattgatcaatcgacgtttccaattcgtccaaatcccgtggcgacaggggttgtgccttaaatttatacttaattttcaaaaatatcaaataaaaaagcacttttgtaaaagtttgtatttttgccaagtgccccaatgtttggcaaatgatttttggccagtcagctgagtaccgcctctccaattggtccgcatgaatcagaatttttctgattgagttccccgtcatgtccttttttctgaacgcttccctcctggtcccgatgttccgaaaaaattcgtttgcaatttccgcgctttctgttgatgtttcgagctctttgatcagagcatttccaatgccctggaagacatgaaaaggcgccaatattatgcgctcaaattcgattgattgcaaaagtggctcatcaacgattcccatggtcaacgctcgcgcagcaacagttggtttctctccattttgcacgagacgcccgaactgctcagcttgattcaccgtttcctccgtcgtcctcattttacacttttccgcgtccaacaattggtcccgacgacattcgcaaataggcgagggatacgtcgttacggctgagccacagtgtccaataattgcccacaaaaagctcagatcaccgccgagaaagctggaaatttaagttcatttcagaaaatttttattaatttttacaatttgattttttttgtccgcaatttcattcatttggctgatctgttgtcaaatgttgcacagaatttgctcaggtttgcccttgtgtcttttgcggaaaatgctgccacaatgaaattgttggccggggaatttgcatgcgccgcatggggcaatgagatggtcaatttagtgaagccctgcccgttgtccccactcaattttaaaatgactttgtctgatttgaagttgatcagattgtcttttgccgcggacaatctgaattccagtgccccggcaatgtcggaacaaaagaaaccgattctgagtggcgtcgaaactgcttcatatcggagcacggcgcagatagtctttttgatttttagtgaccgaaaatttatttatttatttgaattaaaaaacatttttacttttttcaatggtgggaaaacatcaaatttccaccgatcagacgcaagtgccttcatcctctcatacgctttttgagtcccaagttgtgacagcagaagcagtgcatcttcttcatggattgtttgttgttgtcggagttgttccttcttcattggtgtgtagtgtccaaatttgtggcggacttcacgatgtagagtttgcagcgaacatcggctcactgatcgggagcggtctcgatcgatcacatcaacgattttctcggccaaatttcgccgtgaggtccgctccaatgtagccgcattctttttgcaccgtgtggaagttaaagctaaaaacaatttggatgataaatggctctaaaaattctgcagaattttaagtgttggctggtccttctgcgcctgctgttccaattgacggcgcagatcagcgatcattgcgtctctgttgcggacctgcagtcgtagaaagctgatcgtttgttcctgctccttcagctgtttgtccaactgctcggtttgtgtcgcggcgtcctcataagccaaatccacgtccgttgccttgtccatcattgtcaaatccatgtttgttgcattgtcggtagttgtaaagtccatgtgtgttgctttgtcggcagttgtcaattccatttgtgttgcgttttcggtagtttttggacgaacacgcgcatggcgcctgaccggagtggttgacaatggccttgggcttgaatgcgggccttaatttaatttttgcttctaaaatagtacttttttgatttacaaaggtccaaagctgacgttgacggcccactttcggcggcttgggtcgatgtcccctctccatctgctgttggcacggcttcggtctgctttagccctgaaaaatgcagtgttttaaaaataaaattaattttggtcaatttttgtcactttttggcgtcgaaccgactctgcgaccatgctcttggcgccattccttctgctttcgctttgcttcagtcccagaattgcttaacttcataaattttccagttttattacgtgtagataccattttttatactaaaaatgttgcaaataaatttgattttgttgtccttgaaaaaaattttttcctattgaccaattttattgaaattttgcctaagtgaattttttggtcttttctatcgaattctcttttgttatttgaaagtttcttttctaactcgagatcggctcttccatttttacaagggaaaatccccaataaattttaagttttgcaaagttttggcgttctgattactaaataaataataaacttatttgtacttggagcccaaaattgaatcgccgtgtt

SEQ ID NO: 12092 - DNA, 1160 bp, Heterodera glycines
  misc_feature (1132)..(1132): n is a, c, g, or t
caaattttttgtttaaagcgatcgtggacaattccagggatggcacagtgatcgtttccttcggcacttttgccgatattaactcaatgaaaaggggaatgaaaatggcatttttggaaacatttgcccgctttccgtactatgaatttatatggaaagttgaattgtctgatgaagatgccaaagtgtttgccaagtacaaaaatgtgaacccggtcaaatggatggaccaaaaatcgttactaagtgagttaaaaaacgaaaaagtttgaaaattcagttaatcattgatcacttagtaataagttcactaaaattaattacccttaatttctgaggctttaaattttttcatattcggtcaatgcctaaattcttggtatcaaacgaaagctcaaagtctacagaaattttttatttagcgaattgcggaataaatgtttaacagacaaaaataaattgtcttgaatatacacgaaaatggtgaattcctgatttctattgcatactttttcttaatattaacatgttattttcttgtattttcgaaattccagaaacattgcgctttcgttgttacgaagaattttttttttaattttaacaacaaaaagcactaaaatttcaaaaatgttacatgtcggctcctatcggcacagacgggtcaccattttagctgttttttttttttgaaatttagacctaaaaatggcaaaagcagtttttttttgacgataaacggctagaaattcttgtttttgttccccggcgctgaaatttttaaaataacactggacaagtaagcaaaaaattatatgccaagaaatttaggatggtcacttaatggacacgtaattggactagagccaaatttgttaatatttatataaattagtaaaaagtgcactatattaattatcctcgtagaaatttctttttagccaattttggccattccgctgcttgccgaccaactgtacaatgccattatggcacgtgtgaaaggcattgctgtccaattggatgttggccaactcaacggggagggggccgaacagctccttgccgatggacttgacaaggctaattatcaccagctaattataccttaatgagtttaattgctttgcangtgctaaatgacccctcttatagccaaa

SEQ ID NO: 12093 - DNA, 5444 bp, Heterodera glycines
  misc_feature (1674)..(1674): n is a, c, g, or t
  misc_feature (4961)..(4961): n is a, c, g, or t
  misc_feature (4966)..(4966): n is a, c, g, or t
  misc_feature (4968)..(4968): n is a, c, g, or t
  misc_feature (4974)..(4974): n is a, c, g, or t
  misc_feature (4984)..(4986): n is a, c, g, or t
  misc_feature (4992)..(4992): n is a, c, g, or t
  misc_feature (5004)..(5004): n is a, c, g, or t
  misc_feature (5020)..(5020): n is a, c, g, or t
  misc_feature (5037)..(5037): n is a, c, g, or t
  misc_feature (5047)..(5047): n is a, c, g, or t
  misc_feature (5049)..(5049): n is a, c, g, or t
  misc_feature (5052)..(5052): n is a, c, g, or t
  misc_feature (5064)..(5064): n is a, c, g, or t
  misc_feature (5067)..(5067): n is a, c, g, or t
  misc_feature (5073)..(5073): n is a, c, g, or t
  misc_feature (5075)..(5075): n is a, c, g, or t
  misc_feature (5082)..(5083): n is a, c, g, or t
  misc_feature (5090)..(5090): n is a, c, g, or t
  misc_feature (5094)..(5095): n is a, c, g, or t
  misc_feature (5105)..(5105): n is a, c, g, or t
  misc_feature (5110)..(5110): n is a, c, g, or t
  misc_feature (5117)..(5117): n is a, c, g, or t
  misc_feature (5120)..(5120): n is a, c, g, or t
  misc_feature (5123)..(5123): n is a, c, g, or t
  misc_feature (5126)..(5126): n is a, c, g, or t
  misc_feature (5129)..(5129): n is a, c, g, or t
  misc_feature (5137)..(5137): n is a, c, g, or t
  misc_feature (5149)..(5149): n is a, c, g, or t
  misc_feature (5153)..(5153): n is a, c, g, or t
  misc_feature (5157)..(5157): n is a, c, g, or t
  misc_feature (5159)..(5159): n is a, c, g, or t
  misc_feature (5163)..(5164): n is a, c, g, or t
  misc_feature (5166)..(5167): n is a, c, g, or t
  misc_feature (5169)..(5169): n is a, c, g, or t
  misc_feature (5172)..(5172): n is a, c, g, or t
  misc_feature (5174)..(5174): n is a, c, g, or t
  misc_feature (5185)..(5185): n is a, c, g, or t
  misc_feature (5188)..(5188): n is a, c, g, or t
  misc_feature (5202)..(5204): n is a, c, g, or t
  misc_feature (5206)..(5206): n is a, c, g, or t
  misc_feature (5214)..(5215): n is a, c, g, or t
  misc_feature (5244)..(5244): n is a, c, g, or t
  misc_feature (5249)..(5249): n is a, c, g, or t
  misc_feature (5259)..(5259): n is a, c, g, or t
  misc_feature (5301)..(5301): n is a, c, g, or t
  misc_feature (5310)..(5310): n is a, c, g, or t
  misc_feature (5313)..(5313): n is a, c, g, or t
  misc_feature (5324)..(5324): n is a, c, g, or t
  misc_feature (5330)..(5330): n is a, c, g, or t
  misc_feature (5335)..(5335): n is a, c, g, or t
  misc_feature (5354)..(5354): n is a, c, g, or t
  misc_feature (5393)..(5394): n is a, c, g, or t
aatcatttactctttttctcattgtctctactttttttttctctcccttttctttgcttatagccatatgacaatttgctgtggggcggtccttccctttgtctcctcccccaatgtgcttgtatatgcttttcctttgtccatacacacatcactccacctggccgttggattcggatcccgacccccctcactccccgctccgaatcgggaaagctcaccattgttaaacatgtaccatcggaataaaggatattattccacgtattgtactttctgtggtgggcttatcaaaggtacgataacaccataatcagggtcatctcataacaatacaataacaaataattttttgacaaattcagcacatgtgctctctctaaagcatgagaggcacaatagtgtgcatcacaaaataatacattttaaaaaacgttggcaaatttcacttctgtgtctcatggattaaagatggggtgaaaataaggaagggatgcgatacgaatggggaccggtaaattggacaccggaaaattggacaccaagcggaaaaatggacaccgccggaattttggacactaaaggaaaattggacactaagatttcctttttaaaaaaaatcaagaattaggtgaaaataaatttgagtagaataaatgggttaaatgagggatgattgatcaatgggccaaaaaatgaaccaaaaatgagtaataaaacttattgatgtagtgattttctcgaaagtgagcaaaaagttgagtggccgaccgacaggttcaacacttcagaaatgaaataacaaccaattgtaatccaacagcatcaatacaaaaatcacttcatcaaaagtattgggccgacctgcagttaatgaaaaaaatgccgaagcggcagagagaaagtaatcactaattgtaagtaaacacacgccacttggtattaacgagaattttaatgaaatttaggtatttttaatcattgtaaaattaaaaaataaagccatcacgcaaatttgccacacacacacacaatgctcattaagtaataaatatgttttaataatcacgcaaattggccacacaaacaatgctcactaagtaataaatattattttaataatcaagcaaattggccacaacacaatgctcattaaataattaatattttcttttactaatccctccccccccctccctacaattgtgaagagaacataaaatccattcatatatgctatataaaataactgattatttatttttaaattcatatttatatgtatttttatttaatcgatttaatatgaaattcagcagtcaaaaattttaaaaaattacaaaaatattgttttaaattggtggtacatgattataaaaaaagaatgggcattgactgcgtgtaaaaaaatagttttctaatcatcaaattttcaacatctcattttgtgaaattcattgtaatttattttcaaataaatttattaacctaatttttgtcaaaaaacagcaaatgaattgcactatcataaattcgttgtcacctctgtcgaaagtgcgcgacgcctttcggatgacaaattttctgatttgtatagcatttatgattttgtgcgcttttccaatgtacaggttggctcgagaacgcctgacattgtacatgctgatcagcaanggtatggtttttcatcggcagggggttgatttgatcagagttggtcatgatcactcgggctaaatcgccgcgtttcgtaaagtgccagttttgattgataaataaaaaattgtcaatcggctttttcaattgactcatcccgaaaatgagtgaattatggggcagttcgtgcaattgagtttcgaacaaaaatttaaaaaacatttcaataaaacctaaaattttttctcaataaatcggaataaattttcaaattttaaaacctaaataaaaaactcttaaaatttttattgagtggtacgggaccgggacctggtactgaaaaacacgtacaactgagtaccgaagtcatggttttgacctgttttttcccggttttcccatccaaaaagtcccgttttaaatccaaaatgtcccggtcccggttttgcccaaaatatccggtcccgtaccactctaatttaaaacaatttattgtaaatttagaaaataagtgcaacaattaaccctttttatgtttagctctttcccggaatattgttcattttatcattaatcatttccttaccatcaatggatttttttgtgccaaatgttgtgttggattttcttgcaacgattgcattaaattgccagcaatacggtaatgtttgtattcgtttgcattacgttgtgatggcggcaaacagagcacatgcggtgctcttcccattcaattatgcacaaaacatcaccaaaaagtaaacaaaataaacaattcatacctcgagggataaccggttccggggatttccgaattatttgcttttttacatgaccaaaatggcattttatttatacatttcagtccattttttatccaaatttcggcatttcatggaaatattttttttttggaaacaaatcttaatttaaggaaagttttcgtccaatgtgtgattattcatctgatatccatcatttcaattccattttatcagtgtaagtttatgatatgcgtttcaagataatttttcgccaaatatttaagatgttttcttcaacacttcttatttgttcgttacttgtcttttttatttggcaattgtaattcgtctggcatggattaagggttaattaaggatttaatttcctaaaagattggcacatctcatttttgatagagaatttgcaaatttttgaaaaataaaaaaatttaaataataaatccaacaaaattttaaacataaaaatattcgattatggcctaattgcaaaaaattaaatccaatttttcgaaatttttttgccctgtagaactaaatttaaaattattcttgccgaaatcggttgggcttaaccatggaaatgcaacaataaataataatagttttttgcatgttttttatttcaattagaagtgaaattttcaattttttgctctaaatttatcattttcggtcaatattttcttaaattttttggcatgctttttcataaacatttatttaaatagttcagaatttttttttgtaattattcctcctcacccttttcataaatgagaccattaccagcaggagggttttaaaattttaagcacaaaagcgccgttggaataatgccgccactgatgcggcgacggcacaaaatcctttggacaaggaaagtgcgcgaatcactgtggtatgcattgctgtccaaatccatggcatatgttttgtgttacttggtaatctcaccattacgccatggtacacgatgttgacgatatgtacaaattacgacccaatcttgcaacaattgtattacccaatcagtgcgttcacatcgttgttttacatatcagacgaggcaattaatttacaatttaattatttggaatcaaaaaaatttaaaattaattaaatatcattagggtgcgatttttttgtttttaacggattttttttttgcggttttattccgctgttagagaactgcttgaaaaacacaaataaataaatgaattaatgaaatgctgtaagcatcatcggcattgaaaaaaggtttctttgcatgacatagaatttgttatttttggacaccaaatttgaatcgtctaattataaatttaattactttattgacactgagacaaattttcgaattagcccacactgacaatatattttttggttcaacctagcaccgttaaaacattaattaaaactaaattaattcgcccgtcaattgtccaaaattatttttgcagctctttttgttggccgtctgtatggacatgcgtgtgcaattcgcgcaaatgattcggaaaatgtttgtgccgtttcggaggcgtggaacttaaacaatgacagttcaaactgtacaggccaacgaatgcggcacaatgccaatgcgaattagtctcgacatacactctcgaatcattccaggacttgactgatttgctaacaaatgtcttggaaaattgttttatagcaatttaacatttcatcgagaaacaattacttatttcgagcatttaatattgttttttaaaaagagaacaatgaatgaaacaatgtaaaaatttgtatttaattggtcaatattattctacgcttttcaatattagctgacttaattaaaatttttcaagtttgtgttaatttgtggaaccataagctgtagttaatttctgatctttgtcggcttacccatttattcgtcaaaaacatatttttaaattcttgaaaattgtttttgattaaatatttattcacaataaaacatatttacataaatttgaatgttttttccaccattttattcatttttcaattaaataatcaattattttaacaaataatgttcatcatgtcgcgccttcaagctttttctttgtttctatttctgcttctaggctaattggtttgcatcttcccagcgtcatgctgaaatttgcacaatattaaaaggaaattctttaaaaaaaatttaatataaggctcactctgaaaaatttttcatatttctgaaacaaaacaaaaaacattagacaagaggaaataaaaattcttaattttgactaaggcttggactgggcttttggcacagattcatcctgcttgcgagttatgcaaatcgaaaagtacacaatgaaaaattttgaaaattttctcaaaaataactaactctctatatgcttagagcaaattttcaattttatttaatcgagacatgttcaaaaataaaattgcttttaaaaaggccagcaaccgcctctgttcatttgtgaatttttttgcgctttaaaaaaaaatttnttttntnccaaanaaaaaaaccnnntcatancccttaatccanttttttttaaatattnccaaaaaatcaaaaccnaaacctcaantntancccactcacacnctncttccntnttataannccaaccncttnnccacccaaanttttnacatttnccnttnacnttntcccattnccacaaattttnactnccancnaatnntnntnatntnaaaaccaccanaanccacaaaaatattnnnanaataattnnccaattcttcatttttttaaattttattnaaacnaacctttaanttttttttatcatttttcaataaaatttatatttaatttaanattttttcntancttttatatcnaaaaanttttnctattttttaaataaaatnaaaattaagtaagaagatttcatctcaaacaatcaaagnntgttaacctgggaggcgtgtgcaggaatttttttaattaaattttcgttc

SEQ ID NO: 12094 - DNA, 1550 bp, Heterodera glycines
tatcatggaaatataaattgtataggcgtcgcagaaggatcgagtcgataagcgccaataattttccatttattgttttggtttggccagcttgtataattcttacaatttcagctcattaccccctcaaaataaactgtataagtgttgcggaagtatggagttgataaacgctaataatttccgatttacaatttacttaagcaaatttatacagatacatttggaggaaaatgagctgaaaatgtgaaaatttcacaaagatggtcgtgaaaataataagtcggagattatcggcgctatcaactcaatatttccgcaacgcagttagagtttatatttagatgataattagctgaaattttgagaatttcacaaggatggtcgtgaaaataataaatcagagaatattattaacccgatccttctacaatattgctgcagtatttatttagagattaagtagctgaaattgtgagattctctatttacatttcattatcactttgaaattctcaaaatttcagctcattatcatggaaatataaattgtataggcgtcgcagaaggatcgagtcgataagcgccaataattttccatttattattttggtttggccagcttgtataattcttacaatttcagctcattaccccctcaaaataaactgtataagtgttgcggaagtatggagttgataaacgctaataatttccgatttacaatttacttaagcaaatttatacagatacatttggaggaaaatgagctgaaaatgtgaaaatttcacaaagatggtcgtgaaaataataagtcggagattattggcgctatcaactcaatatttccgcaacgcagttagagtttatatttagatgataattagctgaaattttgagaatttcacaaggatggtcgtgaaaataataaatcagagaatattattaacccgatccttctacaatattgctgcagtatttatttagagattaagtagctgaaattgtgagattctctatttacatttcattatcactttgaaattctcaaaatttcagctcattatcatggaaatataaattgtatagacgtcgcagaaggatcgagtcgataagcgccaataattttccatttattattttggtttggccagcttgtataattcttacaatttcagctcattaacccctcaaaataaactgtataagtgttgcggaagtatggagttgataaacgctaataatttccgatttacaatttacttaagcaaatttatacagatacatttggaggaaaatgagctgaaaatgtgaaaatttcacaaagatggtcgtgaaaataataagtcggagattattggcgctatcaactcaatatttccgcaacgctgttagagtttatatttagaagataattagctgaaattttgagaatttcacaaggatggtcgtgaaaataataaatcagagaatattattaacccgatccttctacaatattgctgcagtatttatttagagattatgtagctgaaattgtgagattctct

SEQ ID NO: 12095 - DNA, 2009 bp, Heterodera glycines
aaaaaatgtaagaaaggaatgtacctcatttgtaactgcaatcagtgaataaagattttttttgctcaatttttggctgaaaattatgtcactattcgtcactattttggacttttttcactattttgtcactattttggcactttttcgtcaaattttagttaactatttcgggatttttcgtcactaagtcggttccctattgatgatattgtcagggagaaaaattcgacgaatgaaacgaacagaaataaattacgaaaggaaaataataatgaaaagtggcggtgaagcagccacttttatactaattttgccaatttttacacgattttacaaaagagtcgttcttatgagttcactgtccaaatgtcaggtcacgctataaaaagcctttcctccactttcattttctttccttcgctcactttttccttccttttgctttcgcaaagaatttttgccaaagctagggatataaaggcattaaaattttttaataaatgtacaacaataacaaattggaaaaacataaaattggtaggagtcatttgtatcacatttagcctacgtcaatgtactgccacgtccatgtaaaaatgccacgaccatgtaaaatcatcaccagtgccacgtccatccatgtcaaaagcccacgtccgtgacaaaaggccacgtccatgttcaaaagccaacgtttatgttcaaaacctccttaatttgaaatggtaatgaacagcaaacacgcataccattcacgcaccaaaaccgtggaggggccacgcacaatcagaccgcgttgctgcaacctggcttctccaagttgtttagctcaacattgatttccacaatgaacggttccaagttgtgggtcttcatgcactcatcatactggtcatagaatgactctcgcagtatgatgggccactttcccattcttttgtgcagcaaattcatcagcagccgtcccaaacgcccattcccatcttctgccgggtggatttgaacctaaaacaatttttctgaaaagaatttaacaagttggggatcccttcccgtttctgatcacttcatgcaccaaaaccgtggagaggggccacgtacaatcagaccgcgtcactgcaacctggcttctccaagttgttaagttcaacgtttatctcaacgacgaaggcttcgatgttcccggtcctcatgcactcatcatactggtcatggaatgactctcgcagtatgatgagcccctttccccttctcttcagcagcacattcatcagcaaaggtgccaaacgccaactcccatcctctgccgggtggatttgagcctaaaacaattttctcagaagaatttgacaagttctcatcccttctatttcttatcacttcacaatttttatttctaggaaggttttttgaaccaccacttttgggattcttttgcattcccggtcatgcggcaattccttcacttttcatttaaagctccctttgcattaaacaactagtcaaatcaatgttttctgatcattgatcagtaagcattttgattttgcatctctggtcaaccgggccatattttattggtctgatcactttactcttcaatcaccgctgcaataagcattcacattcgatcactgcagagttcggtttcatattccgatcactttagcccttccgaaattctgttatttggcgatccctcagcgtttctgatcactgcgcactcatgagtgtggagggggcaacacagtgcacctgtttttattcttaccatttgggggtcccatttcattctgagaacaaagcaaatcgatatttttctgataattgatcactaagcattttgattttgcatttctggtcaacagggccatattttatgggtctgatcactttactcttcaatcaccgctgcaataagcattcgtattcgatcacttcagagttcggtttcatattccgatcactttagcccttccgaaaattctgttatttggcgatccctt

SEQ ID NO: 12096 - DNA, 3942 bp, Heterodera glycines
gatcactttagccctttctaaaattcgttatttgacgatcctttgtttttctgatcactgcgcactcatgagtgggggagggggaaacacagtacacccgtttttttaaccgtttttttaagcattttgattgtgcatttctgagcaacccggccatattttatgggtctgatcacttttgttatttcattcactcttcagtcaccgctacaacaagcattcgcattcgatcacttcagagttcggttttatattccgaacactttatccctttctaaaattcgttatttgacgatccatcgcgtttctgatcactgcgcactcatgagtggggagggggaaacacagtataccccttttttgtgcactatcacttttagggtcttttgcattctgatccttttactctgttttcgtttcctatgtttattttgcattttccctatcattaattaattaggacttaccaaacggaaatgcgctgttgccgcaaatctcgccagttcgcctccccggttcagcttttcctcttcctctttcagccactgacagaaatccctcatggcgtccgggatttccctcgcgagcacgccaatcggttcgtctccgacgtacaccgcattcagccggtagacgcctgctgcagcctcacgccctttttcaataaccaatatggcgtgatgaagtgtcataattgtcttaaaatttggattctaatttattcgtttgctaaaaatacctgtgcatcgagttccttggcataatatatttcattctcaagacaatgaaaatattttgcatcatctttgaacaggcttgattgttcatttggcgttttgatacgagctttttcttcatctgctctgacgcgcgccacgacgagcctgcgcgcttcatcatagtcttcatcgctatcgaacaaatcccttggtggcaattcgtcttccattttaattgattgaaagaattagatcgaacaaaaaaatgctaaatttgttctttaaaaaacgaaaccggatcaaaacggcggagaaaagtgatgacatttcggtcgatgtaactgaaaatgaaagggaaatcttgcaaaaattttatatttgccaattttactggatgatgaatttgcgcgtcttgaagtgttcgtccacgtagaagttaaaacggtggctgatcatcgcaattccaaggccaagttgtgaagccggaagcagatcgtacacacaaagccaacaatcggcggaaatgaaactgaaaaaaggagaaaaaaaaatgaaattgaaaattggcattttaattttacattgcttttgccattttttcctccgcttcttttcgtttgtctgacattttgttaaggggaaattattaagcacagtttttgaaggatttaatttgcttattagaaaaacagaaaaaaactgtaaaatcaatgtttcatttaaaacaagaaaatccgagaaaagcaaggaaattctttgcggaagcaaaaaggaaggaaaaagtgagcgaatgaaaaaaaatggaaggggagtgatggcttttatagcaatgcgtcgaaatacgactgattattaaaatcgtgtaaaaattggaaaataaattagtataaaaagtggttgctgctccgtcatttttcattattatccattcttttcgtcgctttcatccaatttttctacctgacaaatttcttcaaaaatcactttgtacgttttgtgcatttcttttcggcattttaccttaagtggttgctcctcctccgccatttttcattttccattccccatttaattttcatcttttggtctgtaggatgtttttgtattaatgaatcgagtcaaaaattacatttcgtgtaaaagaaacggtcgatttcacataattttttcatctttgctaagccaattgaaatccgaaacgaaaactgtcttaataatttccactcaacaaaatgtctgacaaccgaaacgaagcggagcaaaagatggcgaaagcaatgtaaaattaaaatgccatttttaaaatttcaattttaaattttgttttcctttttttcagcttcatttccgccgattgttggctttgtgtgtacgatctgcttccggcttcacaacttggccttggaattgcgatgatcagccaccgttttgacttctacgtggatgaacacttcaagactcgtcgctggaatctgggatcgatgaaaatcaaaatgaagttcgaagcggatggcaccaaggaaatggatgttgtcaatgccaatttggaatcgtttggaattacgcaaaagccgttgccaaagagagtcgtcggattcaaagccatttcattgaagcgagattttgatacttttctgttttgtaaaacgattccatcatttttcacaggtacttcaacaacaatgtcatcacttttctcggccgttttcgtccaattttggccacccgtcccattcatttgaccatcgacgacacatacttcgatgaccgcactttggagtcgatttggcacaacatttggcccatgatcgcgacaaacattcgtggcatccaattgtccaaacaaagtttccgcagtttgcgcaaattcgtgccgtcaattctcgacgactgtccatcgcttcgcgttgctgccaattccaatggtttcttcaccgattttccatgcgatgacagtgccgcggcttcgaatggacaagctgtggccaaatggcttttcactccacgtccggacaatgtgccaaaggtgttcaaatgctggttgaactacggtagctggcatttggagccagagattgaagacttcaaagcggtgatttcgatttgttttatttggcatttttacggtctttggcgcgcactgacaaaataattatgtatatccaaattggggcaccaaaccgtaaaattcatttatcatttcgtatttcttaaccaatttttccctattttaggaattttacacggcttcatctcccgtcaatttcatcgctgtcattcgcattgatttttcttatcatcgtcctctgccatttgtgctgaccaacgaattgacccgggagcaattgatgttgaagaagatgaacgatatcaaccgtgttcttctgatccgttgtccgattgtgcgcgacgaaagcaaatgggccaaatgggagaaggaagcgattggatggaactttatggaccagtggaatcggatcgacatttgagatgggtcagtaaatgaataatgcttattcaaatatccaaatttattgcttttcgatttttaggcctcttgacgcaatgatcgatccaagtgatcagaagcagaaatgattgaacgatttgttgaaaaatgatctatttaattgatgcggagttggataatgaatttgagcccatctgatgtatataaaattgttgttttgttgcgatgatcacaaattgtattctaggaaacgatgatgcacaaaatttggtaatacgaccgatggtaccccaaccgccactcccttttctgaaaccatattttgctttaataatgtttaagacaagatttgagaggtcctaattgccaagtaggcaaatggcaagaaaaagcactcaaaaaagaaaattgacgagaatttaagatacgctccaggggtgtgcgaaaaccacaaaacaaaatttcgaaaacgaaacaaaaatatttatttttcacgaaaacgaaaggaaattaaaaattttaaaactcaaaaacgaaactcaaaaagtgatgaaaaaaggggacgacacgaaaacgacacaaaatttcgtacaccccatttttgttggcattagaacggacgaaacaaacggagatggcattggccaaccaaaagtgaaaagtgataatttgaaacactaaaatttgattccaaactttaagattggccaaaaatcggcggcaaatggcaagaaaaaacattcaaaaaagtaa

SEQ ID NO: 12097 - DNA, 1116 bp, Heterodera glycines
  misc_feature (993)..(994): n is a, c, g, or t
tcattcaagtctaatttgctacataatacatatcaacagaaattccatatgaatagattataatttcatttttgttcattaaagtcaaaattaattatttgttacatgttacatgtaaacataactcccttgggtccaccactataaatatactggaaactttcattttttgttcattcaatcctacaattgttatatgttacatgtcacgtgtaaatcaaattccatataatattttttcctttgttcattcaagtctaatttgtttgcatattaaatgtcaacagaaattccctatgaatagattataatttcatttttgttcattaaagtcaaaattaattatttgttacatgttacatgtaaacataacttccttgggtccaccactataaatatactggaaactttcattttttgttcattcaatcctacaattgttacatgttacatgtcacatgtaaattaaaatccatataatattttttccaattttgttcattcaagtctaatttgctacataatacatatcaacagaaattccatatgaatagattataatttcatttttgttcattaaagtcaaaattaattatttgttacatgttacatgtaaacataactcccttgggtccaccactataaatatactggaaactttcattttttgttcattcaatcctacaattgttacatgttacatgtcacatgtaaattataatccatataatattttttcctttgttcattcaagtctaatttgctacataatacatgtcaacagaaattgcctatgaatagattttaatttcatttttgttcattaaagtcaaaattaattatttgttacatgttacatgtaaacataacttccttgggtccaccactataaatatactggaaactttcattttttgtttattcaatcctacaattgttacaggttacatgtctgtcacatgtaaattaaaaatccaataatattttttcctnntttttgtctttcagtctatgatacatgttacattaaacacaaattccatctatcgtttttacatggtacataaaaacatgattttcatatgaatagactttattttcatttttgtttattaa

SEQ ID NO: 12098 - DNA, 2306 bp, Heterodera glycines
  misc_feature (15)..(15): n is a, c, g, or t
agatttatcgttttncactttttctatacaaatgtatcctgctgagactgtagtcaaaaataaaacaaatttcttagataaaattctcattttgttgtgggaaaatctgctaactaatgccggatttgagtgccaagatgtaaagctgcaggatcttctttagcagaattctaaaatggcaaactcatctgcaatgtataagaagcctgtgcttttcatttaatttacaaaatattaccaggcttataccatttagaacaagttttttaaaaacaagctttactgtcgactaataaaaaataaaataaaattcgtttttttggcccaagaagtgccatttatccatgtaacgaccattgtttcctcagatttctatgaaaagaaatgctatgattaaattttataacagagaatttatcgcaacaaaatccgtccccaatttgttgagtaaaaaacaatcggtcacccccaaatgacatcaatcgcttgtgaaaaagctgcacacacactccaattcctgctcaatctgtgcatcgttcagcgaattcagcagctcccccatttccaatggcactttttcattgtgcgcttttggtccatcaatcacttaattatggatttagaaaatattagctaattcagctctggtggtacttccggaaactgtcattatttgttcattcaatcctacacttgttacatgttacatgtcacatgtaaattataatccatataatattttttcctttgttcattcaagtctaatttgtttacataatacatgtcaacagaaattccctatgaatagattttaatttcatttttgttcattaaagtcaaaattaattatttgttacatgttacatgtaaacataacttccttgggtccaccactataaatatactggaaactttcattttttgttcattcaatcctacaattgttacatgttacatgtcacatgtaaattaaaatccatataatattttttccaattttgttcattcaagtctaatttgctacataatacatatcaacagaaattccatatgaatagattataatttcatttttgttcattaaagtcaaaattaattatttgttacatgttacatgtaaatataacttcctttggtcctccctataaatatactggaaactttcattttttgttcattcaatcctacaattgttacatgttacatgttgtcacatgtaaattaaaatccaaataatattttttccttttttgttctttcaagtctatgatacatgttacattaaacacaaattccatctatcgtttttacatgttacataaaaacatgaatttcatatgaatagactttaatttcatttttgtttattaaagttcaaatttgtagagcttacatctaaatattcctttggtccagccccaataaatactggaatttattttctccattcgtctaattttgttacgtgttacgtcatacatgtaaatacagcctatgtaatagagcttcattttatcgggcgattgtagtccgaaaggtttacaataattccttatcgttaacggccaacatccggtgcgaagctggtcccgcactttgccaagaccagtggactggtgagagttaacgtaggatcaactgaaagaacctgctcataaccgagctatgctatcagcattaaactaacaaacgctttatatttgcttttgatttttaaagaacctgctcatactggagattgtgtgttctttattacattactaaccaacgcttattgtatttttgctttatagttttataaagaacctgctcctatcggagatagtgttttctttgtttatttgtaaccagtgctttatatgtgctttgtgctttttcaagaacctgctcatactggagattgtgtgttctttattgcattactaaccaacgcttattgtatttttgctttataatcttataaagaacctgctcctaccggagatagtgttttctttgtttgtttttaacccatgctttatatgtgcttgtgttttttaaagaatctactcatattggagattgtggattctttattatactactaaccaacgctattatttgcttttttattatgaataactctcataatggaaatggtttgtctgtggccaatacagcctgcctaccctcatgggattttgggcactcagactggcctctttaagtattggtcaatctttacactttccatagctgcactcaatgtcctttttggcaaaataagataggtgagccctgactgatagatttcggcaacggctaca

SEQ ID NO: 12099 - DNA, 2050 bp, Heterodera glycines
tcaattttgaaaaatttatgtccatattttgacatttttgccattttatgtccatattccgcgatttttggtccatattttatggccatattttgcgattgattttatatccatatttttggcatccctattgataaatctcctacctctgttcttttcctcctctgttccgccgctactttctccgatttcattcctaactctaacagtctcgcttttcatcacttcactccctttctccatttctctgacaacctgctccgcaaatgcctgcactggacaggcttttccgtccgtttctctaacagtttcattctcttcttcatttccattctttttttctctattcatttcaacaattttctctcccatttctttgaatttcttccctttctttttctcttttcgtccttcactttcttcaacactctttcccttttctctaacagtcttctccttgattttctccttcagtctgtcattttcttttgccgcttcctttcctttccttcctctaaccgtcttttccttctccgtctcgcactcttcaatactttcttcaattgtttcggtgtctcgcttttctttaaccgtctgccccttatgtttctttgaactcatcttttgtgtctttgcttctccgctcccctcctcgtttgccacaatattttccttcttgaaatattcagcaaacagttcaatttcctttgaatccaaatcatcgacgagtttcaaactgctaaatctgtttatcattttatttggcatttgcgacgaatttgaagatagaggagccctattcaaatgttgcgggtttttatttggagtaacagcgagaactgtgccattgccatcattttgagtcgtaaaattaagaaatataacggcaaaaaatccaaataaaaaattaatgaaactcatcttaaaaatattttttttctgaaaatctttaaaaattagcaaatacataaaagcattaaatcttaataaagccaatcaaatcaattcaatgaatggcaatatgcattaagaaatattttttataaggcaaattgaaagacatgtgatgtgacgtatatatgcttttatggtggatagtccacaaaatgaccaaattttgcgtttttgagccacttccaatggtatggctacgcccttggcatttatatccccaaaagcgttggtcaatcgcaaaccttgaaagcatttgtttttttggtataaaaaatcaaaaaatttatcaatttaaaatttttgggtcagataaaaacggcaaccgaaaacgacatacaagagctgcacagatcgcagtgttcttgtggtacgcctcaaagatggatggacctttgaacatttctccatattgacttaaaatgcttgttgtttgcccttaagcaaggctgaaatattttttaaaattaaagtttccaaataaaaaatgtgtgaatgtgaggaaagcaataaaatataaaagggaaattttactccaaataaaaatgtgtgaatttgaggaaataataaaaataaaagggataattggtttaaaattgtaattaactcatgtaatttcaaattgtaatcatataattaattaaaggtacctgtaattaattaaaggtatattgatttcttattatgatggttttttaagtatcgcccattatgatggtttttaagtatcgacatagcaccaattgaaagacatgtgatgtgacgaatatatatttttatgatggcagcattgtcaaatattattgcttttaattcgccagtacataattaggcagcgataatttcaattaaaagcatatttagaagtttgataatgaagggatagaaaaccttttaaaaacactatttttcataacaaaggaatattcattctctatcctcatagaaggctaccctaaaaagccttaaagcttaaatggtgttgaatttgatcatatcgccgcaggtggcaaaacagcgcctaaaggcaaggaaaattttcgtaaaaatcacttaacctctgaatgatagagaacaaattctctaaccttcgtaaatt

SEQ ID NO: 12100 - DNA, 2766 bp, Heterodera glycines
  misc_feature (2640)..(2640): n is a, c, g, or t
  misc_feature (2682)..(2682): n is a, c, g, or t
  misc_feature (2702)..(2702): n is a, c, g, or t
atctgttcaccgaggaagtgccacggagggtcatctcccagctggtgcccaaccaaaattacattgggcacaatcagaataaccccttttacttcaaccaccacaacgtaagtgccgctttgacatgtatttctggcagaaaaaaaaatgttcaggtgcgggatattgaactgaccgcctctggcaggacatacccacagtttccgtacaacttggactacaagaacaacaggtacgcaagggcgtaccatgacacccaggagcaccttggcatggcctgtacaactgagagcaacgggatcagctacagcatgttcaagactgcctactgcctctatgtcttccaaatgaccaatgcgcaggaggactcgccgggctttgagctgatcaaggagggctgtacagcggtgaacattcggtttgccgaagcggttccgaacgagggggtcactttaatagcctatgccgaggctgacgggctcattctgattgaccggaacagatcaatcactagtgaccttacagtatgaatggtgagaattattcctccgattttgttcaaatgccctcctccaatgctgcacacgaagggattgtactgtgttttccggatgtgatcgagaagtcgccaatcaacttttttctctgcctcatctacctgtttggtgcagcaggtactgcggctgcgggattttacctgtttttgagggagaggcggattcgtcgcaggaatggacaatcggttcatcgacagagctctctttgagaacccggcgacgagaaaatattttgttggcacatttccggccgaccgattgccaaagtgcacgaaatttccctgcagtctaattgtcaatttggtgagtgccaaaaaattacattaaataaaattttgccacttcaggacccgtcgggaatgccgggaacccattggtgcgcaatatgggcgcgttcgccgggggtggcctacttttttgactcctatggcgagatgccaaacgatctgatcaaaaaatatttggcaaataattttcggaaaatttattttaatcgaagaaaatttcaatcgattttctctaatgtttgtggtcattatgttttagtttttatttattttatgtccttaggatttgattttgagtttattatgcaatttttgaaaaggccaagtaattcggatgaatttgtttatgaatttgtgaaacacaatatacaataaaaattattttaaaattaaatcaatcatcatcttcataggaaacgggaacaaaaaatccaaaaaaggtaaaagcacatgacgccaaaaacgattcaaatccacataacccattgtatttatcatagtgctcaatcatcacgcgtgtacttgttccgtcttcgttttcgatgtgtcctttcacctgtggggttttgttttatttatttatttaattaattgacctcatatttttaaaatacctggaggcaatcctcaaactcgaaaatgtagagccgatggcctgagcccactgattccataagaacacaggcatccaggtgctcatcgcgccttgagctattttaaataaaaattattaagaaaattttccgtgacaaacccaagccgtggaaccggcagaacacaatcatactcttgggccgttcgctcaataaaacggatgcattcggacaagcggaagtcttcgtttgccatttaaataaaaatttcaaaaatgaattaaaattataacataaaaatgcggatcaatattttggttgtaaacaaaaaaataattaaacagaattatgcaaacaatttactgctctgaataggcaacaaataaacacattcaatggcacatcaagaaacaaatgccaaaagtgcgcaggaatgtgcaaaagtgatcaactccgtttcgcttatcgagatacatcgtctcgatgctcatcacaaattccccttgcttcaccacaccgtcaacctgtatagcgctaccatcttccgaaacgtagattagccgcggtttgtccctgtgttcgaacacgtatcgcttgtgctgctcgtcaaatggcacaggtgtctcacagtcgaacagtatggcaaatgtatgaaatgtggccaaacagtcggcaagtgcaaacgaaaacaggcccatggcttggcaaattccctaaacaaaatcaacaattagcataaaccaaaatggaaaaattaaaaaatttaaataattcaaaacaaaacccactccttgtgacagacgatccaacatctcaagcagcaccggtgcttcatcttccacaaactcattgcgctcttgtgccagcgggtacggtccatcgagtacaggtggctgcgagttttcgtcacggttttggctcatgatttgtttttgtgtctaaaattttaaaaattaattctttaaatttgaacaaatatttattttgttgaaaaaacacaaaatggtaaaaattgggacaataaaaaaatttttttttttttaacaaaatttggagtgatagatgcaaaataattcgtaataaatggacaaataataaataaattttggcgaattattatcagactggtgtcaaatacataaatgaatggcacagcggtttggcgcaagacaattccagacaatgagcaggtgtgagggaagngcaaacgtaagatgtgaaattaaaaattattggtcaaataancaaacgcccacacctgaaanggtgcctgtaatattttttgagagataaaaaattacaagacaaatcaataataaaactaaaatg

SEQ ID NO: 12101 - DNA, 851 bp, Heterodera glycines
tttaaaattagtattttcatggtcgctgatcactaatataatgacatttattttgacactgattttatttgatcataaatttgacataattacatatcattaatagggatcggatttttagtgataaaaaatcccaaaataattaactaaatagtgaccaaaaaatgccaaaatagtggtaaaaatagtggcaaaaaagttccaaatttaggggtgtaattttttaaatagctgtttttaatttgaaaataatttaaaattaaggaaaaagattttattcactgattgcagttacaaaatattttcttagaaaatattgaacaagaaaaaaaaatttgggggaagaagttttgtgaaatttttccaattcttagggatgtatttttgaaaatttttaggtcgattcttaggggtgtatttttgaaaattttttaggtcgattcttgggatgtatttttcgtttttattgcattttttgggaaattttccaaaaaatgctaaaatagtggcaaaaatagtgacgaaacgccaaaatagtggcaaaaaactattttagtggccaacttccgaaatagtttttttttagttgcgaagctccaaaatagtgattcctagtgatgaatagtggcactaaaaatgaaaaattttcgaaaaagaatgtgtttttcgtgcatttctcgtcgagttaaagccgcagaaaaaatagttaaaaaactaagaatccgatccctaatcattaaacgtaataaaatataaatcattaaacgtatcagttatgacaataaattgcataaaatctgttcaaattcatttccatttggttgaatcgttgatcagattacatcagatga

SEQ ID NO: 12102 - DNA, 3870 bp, Heterodera glycines
tcccaaattcagatttatacagtgaattggtcgcccctctgctgaagtcgtccatctacgtcgaaacttggctggtcggcagaggcgacctcccctccgattgctcctcttcatttaaggcgcattcgcacggattgccttagcatttgtgccgagtttgctaaaacacaacaatttgcaggtgcacaatgtactttccgtgaaggcctcaaaattcgcattcaaaaacactgaggatcactcaaaatgggctgtcagtgaaagtggtcggtggacgtgcattggggacatcaaccggcaacagtcgcaggcgcgccgagggggtgcgttttgtgacggatctatcccataatggacagtaccatcagcaggtggcactgtttgcctgtccaatcccaaaattgcttctctttaccaatctgccgttgcgggggccgagtgttgcgagggagagagtcattgctaatgaatgattggcttggcagctactgtataatgccgaaatgcattctaatgtatttaaattttttttttctcgcggcattttctattcattgttaaccttaaatcggtcagtttttaataaaattggtactttgataaacattactaaactatatgtacttcccttgttttttaccacattgcctttttgaaaaaaaacatatatcttcaatacttattaatttaattattcgtccattttaattaacctataaagaaataaatgattgacacaaaaaccgacggagttggaaatgattcagtgaaagacttttcaaatatggacttggaagatgaagtgatgcgacagaagctgggaaatcagcaggacatccgtgattatttgacagagatagaaggggagctgaaaagggcggaggaactgaccatcgacgattgtattggccaagcggacagaatcgcggaattggcacgggaaattgacgagtgtgacggagcattggaagtgggcagggggtggcgcattggggaaggactgctgggaaaagcccgcccccgcagggcatcgaacgaatgttggcgacttttctcgacgaattgggcacaatcagtgccgacatgcagcacctgaagcagcagtctatcgagatcaaccatcagctgcacaatcggcagagagtgcgcgccgagctgagccaagtgaaaattgggggaagaaaggggaccgactgacggcaaaggaaaaaagagaggggggggggaacgctttacggtttttacagcttacaattaggttggctttgtgcttaaaatattctcattatgccactctcttcagttcgtcgatgatatggtcgtccctcacacgatgataaagtgaatatgttgtcccttttatggctgttaatttggtgctgctgaagttgctgcccccaccatttttcggaaactaaatttttaacgggtgaaaaacacctttcctataaggaacggcgtttttaagatttaaaatcctagttttttttcactaaatcggggggggggtggggtcagctccaattttacaccataaattcctttcttcccaggacaatcattgagagggaagtgaacagttgtgagtttctggagcagttgcacgaactgcagcacaaattgcaattcatcaagacgcagcagttcaaagacgccaaatcggtgggcgatgtgcacgacgtggtggagaatttgaagtataaagcgatggagaagatcagagaatggcttttgctgaagatttcgctcttccgaaagcctttgaccaattaccaaatcactcaaaatgccctcctcaaaaatcggtgttctgacgtcagatcccgtcattacattccccgcaccctttcagcttcttttacgaatttctgctcgcaaatgaccggcaagtggcgcgagaagtcaaagacgaatatgtggacaccaccagcaaaatgttcttttcttatttcaaggcgtacgtttcccggctgtttaaatttcaagtaaattagcggcctttatcacttcgcatcgcattctgttgagatggtcgactctgcgacaaagtccgatttgctcggggccgaggacgtggtcaaacatcccacgacaatctccgcattgccgagtcttttcacttccggcaaaacccaccaagtcggcattgacaatggcctgccgttcacttttcggatcggttccgttcctttcccatttagaaatgaaatttcactttaaaaggagcacaaaattagttggtttttttatagtgtcagggtctgatgcactttacacagcggcccaattttgggctccaagtacaattatgctggatttttcgtcttagtggtctgtgagttagtcaccaaaaggggggtcccaggttcaagtcctccctatgttgtgtgttaatttcaatttcttcttttaaagaagaaggcggaattattttttcattaataaaagttttcgtggcaataaaaaatcatattcaaaaagcgttggttacgtacaacatcgacaattttatgaattttttttagcttataacttggtgaatactagagcaaataaaaccattttatgctcattttgaagggaaaattctggagaatattgtaaattttatttggtttggccttaaattgtggacttggctaaaaaagaattaaaattattgaaatgtttgcccttgtaaaaaattttttcctattgtttaattttcttaaaattttgcataggccaatattttgacctcctctagcgattccaagtttattttatggaacttaagtttttaactcgagatcggctcttctaattttacaagggaaaatcccaaaaaatttttaagtttttgcaaatggcgttctgattactaaataaataataaacctatttgcactgagagcccaaaattgggccgctgtgtttacgagtccaaacgactttttatgagacccttccctaattatttttatttaacattttatgcatatttaaattctagacgcgaagtcgagcgacggttttttcattgggtcatcgccaaaatttgctgctcgatgatttgttggctccgctcattgtgccccacgtggcgcaggaaaataacgaaacggttttttatttatttagaattggtaattaattgttttactatgtctttttctaatttcagttccaattcgaaagtctttttcggagtgttcagtacgctttggtcgaccattgcagtcatgagtttctgttcatttgtgattttttcatggtcaatggtcagtcggccatcgatttatttacttcagtgatgggtcggtccatcagccttttattggtaattttctaattgttttaatggaaattaatgatcgtttttttctagaaaacgttggaagaaaaaattgctgccaatttcgatgcgatttcgctttttctgtgcatttgtttctgcgcgaaatttcgcgaaatgatgaccgaccgtgccgttgtggtcatcaatgggtgcgcatttcgtttgacagattcactgacttttgttcagttattgggatgctttggtcggtttcttatgggctcggttggatgccgtgatgactgcccacagtgacagcgtaagggcgatcgatgtgcgcaaagtgccggtggactcgcgtccccactacgtatgccgaagatatgccgagctgatctgttcgctgttggtgtgcagcgagttggcgtacaaagtgacggacccgcgacttcaagtgggaaaatagcaacaaaaaaaccaaaaagtgcgctaattgcaaaaacaaactcaaaaaatgtgcataaatcatactgtgcaaaggtgggggtcagccaagaggtcttacgatcgactggcacccccgcgggggggtc

SEQ ID NO: 12103 - DNA, 993 bp, Heterodera glycines
gaaattcgccccctccaacttctccccccccccccacctcttacgatcgacaagagagcccccccccctatctatccccttgcacaggtatggcgtaaattgcagaaacaaatgcaaacccttcagaaaatcctttcgcgacagcaagcggagattgagggactgttgacccgacttgccacccaactgaaatcgaagaaggaacggctggtcttccagataaacaattacgacgtcgttctcaccgttttaaatgtgcgcaaaccaaaaaaagaacattttatttgctttcagaaaaagggttttggatttattttccttcaggaaagggttttggccgattccaaggagaggggcagtttttgggaattgcagcagaccaaaatgggcacttacgtcgaggaaattctcagcccgcactttgccccgctcattcaattcgtcaacgaatgtgagccgcttgtcgaacaaaaccacacccaactgctcgcccgttacacgggtaaatggaagaaaggcgagggaaaggcactgacattttgccagggaaagtcgtccaaattgtgcggacattcagcgccgagtggcgaagatcgatcgacgcaataaacgacgaaattttgcattcgtttacaaattacaaaaacggcgccaacgttttgcaggtttgacggattggcatttcgcactcgaaaagccctctccgtttcagatggcattttcccaattcatcagttactaccaacgattgagcaaagttctttcccatgaagtttttcaaaattgtcaagcgaatgaggaattggtctcctaccagcacatcactgaaacaatcaaaagatacaaaccggttttctgacttctttccttccttttcattcttttggttgtgacttttttatcattttatttaaaaagggtgcaagagaggggggtgaaggaagaacgagaagaagaaaaggaagtgagagaaaaaaagtcagcagcgaaaaa

SEQ ID NO: 12104 - DNA, 2989 bp, Heterodera glycines
cgctgcccagcagcagacgacgacgactgcggatgctgcccctaacactgacgcaaccggagcggcgactgtgacaaccgacgcggcgaccactgcgactactccaccgacaacgacgaccgcggacggagcgacggtgaccaacgccaacgaacccggtgcgactacggcgaccaacactgaggcgcccgctgcgactactccagcgacaacgacgaacgcggatggagcgacggtgaccaacgccaacgaacccggtgcgactacgacgacgacggctgcgacgaccaatactgaggcgaccgctgcgacgacaacgacggcgattgcggatggcgcggtggcgactaacactgacgcaaccggagcggcgactgcgacaacggatgcggcgaccaacactgaggcgcccgctgctgcgactgctccgacgacaacgacgacgaccgcggatggagcggcggcgactaacactaatgcaaccggagcggcgactactccgacgacgaatgcggcgaccaatactgaggcgcccgctgcgactactccagcgacaaccgcggatgtggcgttggattagcatcatgacacaacaacagaagaagaataagaaattgccatttatccgattgagcatttgaattgtacatatgtatttcgttgatgtgtgtgtatcatgtatcaatcaatatctgatcacttaaattgtatgtattggtgatattgcgtgtggatataaactaatcaaagtcttgtaaaggggaccaaaaatatgaaaaaaggcgtcaaattttgctagtaaatgtttttaaaaattgatttcttccgcttaataccaatagctctgtgtttctcatttttgcccaccgatcagtgatggatgagtgagcctgaacttagagagagagaggcatacagatccgcttttcctgtccagatcagctagagagaggacactgatcaaagctaacctgataatgtcattaaattaattttgatagaatctgaaaatcacggactccactaattacctctaaataacacctacagaaaaaaagcgacaaaaatggtatcattcgaaagcttaacatgtttcgaatctaattctatgtgtcacttcgcgattagacaattaccaaaaaagttatacatgaaaattgcgaaaaggtcgaaattatgatgttttttcttaataaaattttttccaggctagaaaatcatttcgttttttgtaaggctaatagagcatatgaagagctttcgaatgataccaacaatcttggatttggatgcaaagaaaaaagttatagcgaaaaacataaaaatttttgaaaatctgcccacagataacacacaagtacctaaaatttgtcaggattcgaccgttttaaaaatccgccgaataagtcaggagttatgcctgaccatttttttgatgttgcaattggttgtaacaaattgtagcttgttttacatacatacataattagggcatccaaaaatatgcacataaaatcgcaaaatatgcgcataaaatatgcaccaaaaatcgtgaaatatgcacataaaaagtgaaaaatatgcacataaaattttccaattgagggtgtaatttctcaaaatttcttcaaatttgttaaccataaagtaaaatcttcaaaaatggctaaatgtggtattaaaaatcattttaggagaaaaaaacacgatacagcttaaaatttactcattttagcgaaaaatcacctgaaaagcaaaattttgcttatttttgacataaatttattaatttttaagaaaatttaaatttattcaatattctcgagaaattttggcgaaaaaatgattttttggaaaattttccggtttttgaggtcaaaaaggccaatttgtctgttgggggccgatctattagaggttttttggaaaaacgccaaaatatgcacataaaatatgcacgaaatgccaaaatatgcacaaatatgcaaatatgcacataaatcgcgaaatatgcacaaatatgcaaaacatgcatatggaaagtcatcctagaagcttcaaaacacgctaaaaacatgtttttcgtgcgtttcaggcctcccacagtccaggaaaaaaatatgcatgtgcatataattggactccctatacataatcatttcttctgataaaattgcgaaactcggaaataatgattttcgactttatgtgctctaaaccgatttgtaatttgaaattggtaaaattatgaatagggctgtgaattttagtgacgaaaaatcccaaaatagttaactaaaatagtgagtaaaaatgccaaaatagtgaagaaatagtgacaaaaagtccgaaatagtgacgaatagtgacataattttcagccaaaaattgagcaaaaataatttttattcactgatttcagttgcaaatgagtagggctgggatttttaagaccaaaaaacaaaataggtacataaaaaaataatttttaaaattaaaattcttgccacaaaaatacctttttgagaaaatttttttcatttcttaggagcgctttttgaaattttttttgtcgattcttaggggtgtattttttggttttattgcatttttgttaaggaattttgcccaaaaatgtcaaaatagtgaaaaaatagtgacaaaactccaaaatagtgatttttaactattttagtgacgaagtcgccaaaatagtgatttctagtgaccgataatgacatcagaatcgaaaatttttaatgcagaaatgcgttttttgagctcctttcttcaaatcaatcgagcaaaaaatttagttaaaacctaaaattcacagccctaattatgaatgtcagattcatgctcactgatttgtgaccccgaaaacgcctcacaaaacaaattttatggcattgaaattggtgatattcttatatgtataataaatacactatcaaaatttatatttattagtacattcataatatat

SEQ ID NO: 12105 - DNA, 1094 bp, Heterodera glycines
gctttggcagtcccacaaccggcagttggcaaagcacccatggctttggcagtcccacaaccagcgccatttcgtcgagcagcagcatcggagttaatggtggtcccacaaccataagtttgcggagcagcagcaccggaggtcgtacgatgatttggagatgaagaagcattggaggtcgtacgacgaggtcgcgaagaagcatcggaagttttatgacgagatcgctgaacgagggggggggggggaaatggcggaaaaattacataaaaatgggtggggagaaaggaaatccccgaatttgaataagtcatctcgtcgatgagggaagaaaaagctgttgacgaattggaattgtgttgtgatagcgcaacagagagcaaagaggagaaagggaaatgtgtaacccctaaaattaattgcaacaattaaaattagggataaagccgatttgaaaagagtgaaagcggtaaaagcaattttctattgaaatttaaaggggagggggaatatctgaagacatatgtacttttagcttagatttgcatccaaaatagtgtacaaaacgaaaaatccggaaatttatgcattgatttccctattctgtgttcttctatgccttaaaatttttttgaaaaaactaacaataagcgttctttttgtttttcaattaaacgctctaagtaacaggggtggagcgcgcacagaaaaatcccgcgaccgcggatcgcgcaaaaaaaaaacgccgcgaatcgcggatcgcacatcgcgcatcgcggctaaaaatgtgaaagactcaaaaattttctcttgtgcgtcaaactgcttagcactcgcttagaaaaagattctcctttttaaacacttttttacatcaaatttgttcggcttagttgagaatgaagaagttatggttgatcaaataaaaaatacaaaaaaggaattacgagtgaaattttgaattagcgtgtaaaataacgccataattaaaaatggcgtaattttttgcgcgctaattctaaatttacactggtaaatgccttttttgtatttttattttgatcagccataactcgctttatttccaactaaac

SEQ ID NO: 12106 - DNA, 3899 bp, Heterodera glycines
cacaatggggaataataacattaacctataaatcacatcatctgaattgattttatgcatttcatttttcaaaatcataacttgaaattgaagaaaaatccttttgcaccttttcagagttgccaatccaatttccaatttctctgcaatttttttgtcgctaatttttgcgttttttccttaatttcaaaatattgcttcaccttttctaaatatcttcattggtattattgtgtttaaaattagtttttattaaaaaaatatcaactcacttttttggtgcttttgaaccaattcttttttccatttccaaaatgttgcttcagaaatgcccaattctttcacaaattctttctgtttgcgttggctaaaaaatgttttaattcatcaaatcgttcaataaatttgcgctttttgtgctcataaaatcgctttttaattttgttttaatttaaatttaattgatttttccattttggtattaatttccgagttgcgcctaagaattttgcaatttttgtatcaattttggaactgaattgccatggatatttttttttaatttttcttgaattgcttcaaattttaaaatcctttctctttttttggtgatcatttggaccgattcattttctccatctatttgatctatcagtgcattttcattttcgtcattttgttccgtgtttatcacttttacttcaattacattttgtcatatccatctccaaatattttatcaaaatttggtcgtattttgtcggattcaattataaaaaaaatatataatatatatttaaattccataaattcatttcattaagagaaatatttttgtaaaaaagaaatatatgtatatgcagaaaagaattattataatcttaattaacattgaaagaatagtagcgcggccgtgcgcagtggacgtgctggcgttgggactgggcaatttgggagggcagatggggaacattgggaaggaactcataaactcccgaaggaagggccccatgggatgatcaagcccagggatcccatcccgcctttgatggacacactgggataagtggctttattccggagagactgaagatacttcgcttgaaatggcgaacattaaatacacgtgaaaaataaaatgtgatcgatcaattatcgtcgggaaaggggcgacaataagcaaaagggaaattaaatgcgaaatgaaataaatgtgagaatgtgaaattcatagggcttcggccggcaaacaagaaaacccggatctaccttacacctccaaccttaccaaagaccgtccctggtctcttaccaagattttcgcttcaaaattcgcataagcaaagaaaattatttcaaaaataattttgctaattttcatgcactttttccaattttaaatcaaaattttatgcttcgtgtcactcactcccaaccttacattggatcgtccctgatccagttcaagactcaggcatcactggcaaagtgcccagccatcaacctttgtctgcgagaactgatcaggacttttttcatttttactgccgaagcacatgaaaaaacaattcccaaagtttgcctatgaagcatgaaattttaaaatttttaattacctaagtaaattagcgaaattattttaatttaaaacctagacccccaaaatcaaaacacactcattttccttgccaaagcccccttttccactatctctcttattcctctcaatcaactccggtcatctcgccgtctttcttggcattgacatgccacgtgtcccgttcgtccacaattgtagcactttgtagcgcttcctcctcgttcgccgcgtgtgaatgtcgtccccgtgaattgtctccagcttgtgcttcgccaattttcatcgcgtcttggtgccggtccaatgtcctccgttgccaatcgcttgcgttccaatggtcggccgacagtcctgaaaatgggaagaggggtgttagacctgttttctgtaatagaaccactcggttcatcccaccaatttcgttcattcgcttcagtgttgcccgcaatctgaaatggaatagggagattagggtttaaaaaaacaacacaattacctcaacctttaaatgaaccctcaaaattttaaaagaatttattttactgatgatttcctaagaaaaattcctattacctttcatttcgcgtacttcaagtgctaagtcttcaatcatctctctcaattgttgtgtttcactagcacaatcatttttggcatgattctcagctgaatgttcccaattttgtctattttctgaattagagggaccaggaaaatctcgaggacaataccaacattcattttgaatgtgccctggtcgattgcaaaattcgcagaagagccgagtctccctactcgtataattttgtctgaccgaagtcgagtgttttgcctgctcgttcctttcatcctcttttctgttgcactctgatctacctatttttaatgaatgaatgccgaagcgcttttcactttctaccgaaatctctaactcctgaatgtaagacgtcagctttttgaaatcatttttccctattaatggagccattatttgaagcgaacgctgatactcaggcctcactttctctattagacacctacagagcatctcctccctcgctcctgatggaaattggtcagtcgttgtattcactaggggaactaaccgttttatgaactcgtccactgactcaccatctttctgatagcaagtagccaatttcctataagctaattccctgaaatgtggactatccaactttgatttgatgcttttcagagcattgcttaatgtatccttctcggttggcaaaagtttttcaaaaattgttcgcgtatgagcacctaagtgtaatttaagtcgatttattttgtctgcttccgaccaatttgatccaaagacatccacataatccagaaatttaatttgccactcataaaatgccgaagcagtttcaccatcaaatatttgaggtaaaggatttgaagaacctatagcagtaagcgtattcagataaaatattttaccaagctccgcattattttgcatcatcttgtgcctttgtatcgccgaagcgggagtcacactgaaacttcagtaaattctttgccttgtgctgccgaagcaattcctaattttaattgttttattttcccttttcggtcttatttattatttattatttgttctgtgttttggttttgtttgtttcaattaatttaaaatcactttgtcccgatctgcactcaaaagtggcaagtccgcgatgtaaatgtccgtagttgtacagtccgcagtcagtcgttgcctttgtcctttcactgtctcgtaaagtgatcgctgagtaacgggtccagttgcactatccacgtagtcgaacagcacacaaaatccgttgaatcgccgaagcagggagacgcgcaccgtagctcgacgtgcctattcaaattgtcgggcctcagtcggacttccttcacaatttagtccgccgaagcactgtgccgttgcttgaagccaaaaaagtgccgaaggactgacgatgctgctggtgggtctgttgaatgtccaccaaagcaattccgtccgatgtttgactgttcgctgctgatgtccctttttttttggtgatgaattgaagaaagatcactaattaaatgcttttcgctaaaaagaaataaagaattaaaagtaataaaataattaaatttaaaaacaattaaaaattgttcaacaattaatgaacacataaatttccaattgctaaatgtttattgaaagaatgttgaacgacgccaaagggtggatggaaaggaatggggcggaaggagaatcgtatacgggcaagccaagcgctaatgc

SEQ ID NO: 12107 - DNA, 2008 bp, Heterodera glycines
  misc_feature (34)..(34): n is a, c, g, or t
  misc_feature (94)..(94): n is a, c, g, or t
ttttgggtatttttttgagtctccccccgggggncctttataccgccgaagcgcttttcctctctcagcaggcgcctccttagtctccctcttngactcacctccgttccattgctcctttgtccgcccaggccgatgaaaagtctacaaattgcagaaccatccggtgctaccagtagcgcggccgtgcgcggtggacgtgctggcgttgggagtgggcaatttgggagggcagatggggaacattgggagggaactcataaactcccgaaggaagggccccatgggatgatcaagcccagggattctatcccgcctttgatggacacactgggataagtggctttattccggagagactgaagatacttcgcttgaaatggcgaacattaaatacacgtgaaaaatgaaatgtgatcgttcaattatcgtcgggaaagaggcgacaataagcaaaagggaaattaaatgcgaaatgaaataaatgtgagaatgtgaaattcatagggcttcggccggcaaacaagaaaacccggatctaccttacagtataaatcgaaagatcccgattcatgagtagaaaaaagatatggacgttcgaaaatttgttttttgattaaattttcaatgggtcttgtcctgcaggttgtttgaatccagcagagttgttacaaagtgttgtgttgaagataaatggactttctcttaaggcctttcccctaatcgttgaccggtacattatctcaaattcaataatcattcgcttaacaaaatgcttacactggtttggggttctagtcggttttacgcgtcccatgacactttacgcgtcccatcattttgtgtccatggcatggatggcattcgaggccccacaaattccccgaaatcggaatttcgtgtcatccctggtccatggtattttagccgtcctacacaccgagtcaaaaaacgagacatgtgtcaataaagagagagtgcagagaaaaaaacatctctcgttttggcgtactatttctttgtctctgttaatagagaaaaactgaatttacttcgctctatagaactttttttccgccttacagattttctttaaattttgcatatcgatagagaaaagaattctgcatctttctatagtgaatgtaattttgtctatggtcaaactcaaaagttgtaaatttgaaaatctcacaactcgtttctgggatgtcaaattgcttaacttttgcttagaaaaagcttctcctcatcaagggctttcgaatgataccaagattatccaatttggttggcaaaaagcttcaaaaataatttccaaaaatcgttgttttttaattttttggacaaaaataaataaaaatattcatgttgcacaacggactcgaacctccgccctttgttcctttactatcttacaaaaaccactttgccacacacacatttactttttgaactgggatcccaaaattgactcggtgtgcctaatagtaactaagaggaaaccaattttttttgtttggtattcaataatcttttttaactaaaatttcgttgttaaacctaagctatcatgatcattaagtgtgcttagaggttgcttttgcacatttcgataatcaaagtatacaatcaagaacaattcgacgattcggaaggtataaagtttcgattgacggttcgaaaaaactgtttttgtgacgcgtaaatgatgggacgcgtaaaatgtcatgggacgcgtaaaacagactagaaccctggttggttcaagaagcactctataaatattatgccatccctcaaaatttctcgtcactcaatctaacacacttcctgtactcaacattaggcaaatatctgaaataagggtcggggtcgttttcgcgtggggcgagtttttgaactataacttttttctttgtcaaccaaatccaataatcttggtatcattcgatagccctaagtgttatctattagcctacaaaatttggaaaaatttcgttaaggt

SEQ ID NO: 12108 - DNA, 2301 bp, Heterodera glycines
  misc_feature (2206)..(2207): n is a, c, g, or t
  misc_feature (2228)..(2228): n is a, c, g, or t
gtcgacaaaagcgaattacgcaagtcaaagcatggcatggcggccatgtttcaaatttcctcaacatcttcacggagcgcgaccgacgggcatcaacaaaatacagcccttacgtccagcgatacatagacaaggttttagcactgaaccgaagtctgagccaatcaacaaatccgccgacatcgacaacttcgccatggacaacgacccaatccacaacaaccacaagtcgtccacgcacaacgacaacaaccgcgactacaacgactacacacacaacaaattggccaaccagatcaaccacacggccaaccgcacgcacaaccacgacaacgccaatgccatggtcaatggaccaccgaacgacaacagtatcgcgggtatggcaacaacaacggccccgtccaggaatcaaattgattcgctggcccaagagcacaatcacaaccgaaaaaggacgcgacgtcttctggtgctcgaatcacggcagcactctctgggaactgaaaggtccggaaaactcgccattctgccgtccaccaccggcacttactgcgcaatggacaccactaaccatcacgctgtacaccaagatccaccggccggaaccaatcgcaacggcatggcactgctccatcaaaacgacgacggaaaattattacacaaacatcgtcggcgataagttcgtcgaaatcaacaaagaatttccgttggtctccaaacgactctgccaacgaatggcacatcagcaagaatgcccactcgccaaaacggaaatgcaccacgatgataacaatcgtatttgggcaacaaacgaccaactccaagtggatttccctggaccaatcaccggactcttcaaagggaaacaaaccagctcggcaacaaattgctttgcgcaaccagcaacactgttcgtcaaatggcacagtctccaactcctgtcgccaatccatcgcgcagaccactgcaattacgcctccgagtattgccaactgcaagacaacagctcactcatctggacttcagcatgtccaaacgacaactgcttcatgtgcgacttccaagaagccgaagaaatccacggagaattcaccaagctcaacggtcaaacaacagcattttggatctcggaagaccgacaaaaggcactgaccttcaccgagacacatgcagtccaagcatgcgacgggagacaaatcgtcctatcggagcagaacttcggcattccaaaagagcaatatgacatcatcatgagcaaccacacaagagagagacgcaacgtgcaacccgagcaactcgcttcgcagctttcagctgctcaacttgccacaacaatggcactctcgcagctctatttgaaggaatgccagcgcaatgtgcgtgtcagcaacccaacgcttcaggcacggaaactcctcaagcgcgataatctgcaagcccgatggatcagcgaaacaacaatcgaagtgtttccctgtgttccaatctccctctccaacatcagctaccgaacaacaaaggactgctacaagttcattccggtcacaatacatttgccaaacgcaacaagagacgcattcctcgacccggagatgcgcatcctctcactcatctcaaaaatcgcaagttgctcaccatttcgctaccatcaccttcaagtgcaacaaaaccccaacttgtgggtgcgaatcgactcaagaaatggaaacgtccaacgactggcacaaacagtcatccatgagctttacgagacgatcctcaacaaaacggacaacgatttggatctccacccactgatcttccatcagtggcagctcgacaacgacaccgacttcgccagccttccgcacatcgacgaattcgaagattcggaagaattcaaaaacaagctggaagagcaaacgacgcaacgagcggaagcactcggcgccttacccggcggaatcgaaggatggaccgtcagatggctccaagaacggctacaggaagccatccaatggtggatacgtctcgcctcggcatactctacatttctcctttgccgagacgtcatcctaccctgcttaatcgcatacttcctcaacccaatccgcatcacactcatgactctgatcggatttcgacccaagaatcagacaacgcctcaaatcaaaccacaatacgaggacatgccattgcgggagatgctaagcactccgatccnngcgaaacgacgacaattgccnaatgcatcgactccaccatccgactggacacgacgacaggaaacgcatcattccgaacagagcgagagcgcat

SEQ ID NO: 12109 - DNA, 1074 bp, Heterodera glycines
ttctgcttcctctcctgtcaatttcaacgcccgaactcctcgggctttgtcgacaccaccgcggcgacctgcaccgcactcaacgtcaagcgcacacggccaactccaagcagctcaacggagctcaactcaaaacacggccatctccaagcagctcaacggagctcaactcaatcaatcaatcaatcaacgggtggtgatcggacagagtgcataatgacttttaatatgcataaaaattaaaggaagaactattgttttcgtttaatccaatgataaaaatataaaagtgaattcaattgaaaattcattttaaaatattttaattaatttttaaaaacaagttaattgcctttgcttacattaaaatataataaaatataaatgaaaatgaaatatccgagacaggattattagaagtagaagaaattattgctggacgagagttgtaggggttggatgagaaaatctttcatatatgcattaaaaagctaaaattacaaaaaattgtattaaaaatagaatttgtaaacttttctataacaaattttcattataataatccatcaatctggtatcattcgaaagctcttaacatgttctatttgcctcaccaaaaagcaaaaagtttttcaagcctggaaaaaagtttattgagaaaaaaaacttaaatttcgactttttcgcaattttcatgtataaaatttttgataattgtctaatcgcaaagcaatagcttctaaacagattaaactttcgaatgataccaacaatgagtagtataaagttacagtggtaggggtctaccacaggagagggacactacccccttcataacatatacttggacaggacccctgcccggtaaccttgtgatcaaatttactttaagctatggtagagggtcctggacccctgcccctgtaacttaaaaaacgtttcatttaaagcggtagtccatgaaccctgcccttggaacaaaatacttaggcgaaggtgtcagcagaccccagccgagggaaggatgtcgaaggggatgcgtcaattttttttgtgcagctatagcagcccttc

SEQ ID NO: 12110 - DNA, 4820 bp, Heterodera glycines
attagtccatcaacttttatcaatcaatcgcattttccaccccaataattaaactacttttcttagactttttctatcagaacaaacaggcaaataccaaaactcattttgtaactttcaagtagacttagttgatttggctcacaaagtacaataaatccagaagagttggatatgtatgtttgtatatggatgagttggcttaccccacttcactctaatcgattcctattcatttttctgtgttcggagttttcccgaaacatttgcaccaaaatttttattaggaagcgtctttttttatttattatgcttttctttaagcttcgccccgtaattcgctctcttaggcatggaagatgcccacacgcatttgctcgaactgcccgaagatccgagcacagcttttttcgccgtttttgatggacatggcgaggcattcttcaattccctcatcatttcccattgcatttcaggtggcgctcaaattgcgaaatacgccagtgaaaatttgcatacgcaaattgcccaatcgaatacattccgtacgtttatttaatgacatgcttgttctattagacggttttatgcttttttaggtgagggcagaatatccgatgcattagttgaggcatttttagaattggacgagcaaatgatggccagtgaacagatcagagaggaaatgtccgggagtaagttttctaatccaatttaatgctataaataactcatagtttttcgagttttttttcctttatgtacattttttaaggtacggctgttgcggtgctaatcaaagacaattttatttattgcggttcttttcttttttgtacattaatttttctctattttttaagcaaatgctggtgattcgagggctgtcgcttctgttgatggcaagaaaattataaattttaacgttttaaaatgaatttttttaaggcagggcaattcctttaagcattgaccacaaaccaagtgagtagaatcttttatggattaggaaaaaacaaacaaaattctctcatttttaagacaatgaggaggaaagtcgaaggatattcgcagccggcggatatgtaataattatacaatttttatgcttttttatttcactgttaaggtggaatttggccgagtcaatggcaatttggcactgtccagggcatttggcgactttggtttcaagcagaacaattccaaatcggcacaggaacaaattgtcactggtatgaatattttgtgactaataatagaacgcgtatagcaaatagaataaacagtaaaacttgaaataatttggtattttgtaattattaattaccatttttagcatgccctgaagtggaaataaatgccatcactgccgagcatgagtttattttgctcgcttgcgatggaatttgggacgttattggcaatcaggaagcagtcaatttttgtcgggaacggctgtaccgtggggttttgccagaaaaggtgaatttcaactgttaccacttagaaaatggcaaaggcatagattattttatcattaaaacgatggtgctttcatgggactttaacatgcattgaccctctctctttttatacatcatttaactgaaccccccccccccccccaattgtcagatttgtgagcagctcctgcaaaagtgtcttgcaccggattgtgaactgagcggacttggctgtccgttttcttaattttttagttacatattcttgtttactttaggtgacaatatgaccgtcattctcgtctgtcttttgcaggtccccctcccattttttgcattgatttcccctttattttgctatgctttcccttttattaggattactctttcgacgattacctcgccaaactccgtgccaatgggacgggcttcgaattcgaacatgaagaggaagaggagggtgaaggggtggacagatattccgacgcccacccacagtccgactcagacgagcccattgaagaggaagttttctcaacaccgccaagccattcgccaccagtgctttcgtcggattcagtgagcagggagggaatgacggagcagcaggaggatggaccagtgccgaagttggagaagcaacggaacggcaccgggcaaaaaggtgagcggcacagcattttggttttctactggcaaattgaattacttccgttagttggtgtggaagatatcaccgaggatgtccatgtccctccttcacccgctggcgccgtggaatatacgcaacctgttgattcctctcctggagcacaaacgacttccaatgattcgacacaacagaggaatatgtgaaatggattatttatatgaagattttgtttttatttaattaaataaatggcgatgatccatcatttcataaaattgtgttttcgtgaaaagcctattcattttcttatgtgggtaaattagtgaatgctcgtttcttgaccaatgttttaaaatgagtgagtcgatatttaatggctaagaataaggggaaatactttatttattaaatttgggatattgtctctgtttcacaatgttggaaaatgaaaacattaaaatttgtccattggttacattatgaggtatttatttagtgtttaattatcggattaggccctcaaattagtaggttcttcttgtgagtgtacgcacgcgcaatttcgtcatattttccacagaatcccgagaagcgggaggtgaagccgagaacagaccgatggtacctaaagaaattaaaaagaaaatcagagcaaaataaaacggtaacaaataaggaccaggaaatagtgaatggctgaagccagtggagaacggcacggtaggcaaacaaatattgcatttggctagagacggcgtggcgccgctgcaggcggagaaagacggcagcggtgagcattgggtgttcaaaggagacggcaccacgaagcaattgcatcagaaagaccttaacagaggggcgagcaggacaaaacgtcgctatcgaaacgtcgccgcctaaacgtcgctgggatataacgtcgccgcaaaattttttttctaattttagaaaaaaaatctagaaaaattgtcataaatttagttagctagctaaatacgaaaaaaattctagaaaacctcaaaaaaaatttctatcaagaaaattcaaggaaattttaaaaaattttcacgttttttgggtttttttccggaaattcagcaaatttagtttttattaaacttagattttcaaaaagctaaaatactatattttttttttgcggcgacgttatgtcccggcgacgtttaggcggcgacgggggggggggggggagtacaggtaaaaaacaaaacaaaaaactgttccgggaggggaaagggtaatatataaaatataaatttcaaaaagtcgtcttcagactccgggtgtttattacatatgtgtgttgctggtttttttaacctcaatcagtgccaaagtgcccgaacgtccgcacccatcggcgcacataatcacacttgggttcttggaatgacgcgccctgcaaaaatggcattatttttaaatatgcggcataatatgacaattaccgtatcagcacacggaagggccaatggaagtcggtgtaactgcgccaatcgcagtgccaaagttgaagacgaaaggacttagaattgtgcggacaatgcgtcgcccccgctgccgatctagtcgatgagggaattgccgctccatcgtctgaaatcactttccccgcttagttttgatgccctctgtccctgtttcatttgcatgaccatagtccgccgtttttggttcatccgtgttcagccaaagttccaagtgaacaatggtgaacagcggatcgctggccgcgtcattggatacatttttcacacgaagttggccaaagcgtcggatttctccctcaaatcttaaaaaacggctaactaaaattgaacatatggtcatgccttggccagaagaatgggcagtgacttttggccgcactgccaacgacgacactgctctccgtcagtgagtcggtggtcgcttcacaaagcatgaaaatccattcgctacgctcctgccatatctttaaattttggggataagaacattacaatcaaaaacagagggaaacaaagcctcaatactaataataacaacaatcaaaatcacaattttatgtcattgtttggcaatgatcatggataaaaatcttccattgtaatttaattgtaggaaaggaatctaatttaccatgcgccaaaagtcagggatggtctgctggagcggtgcctgagcaagaatgaacgtgttcagaagcggacctccccggacatagctggcattgatgaagtcgccatgcccacttcatccaaatgggaaagaaaaaacatgacagaaaaacaatttcaacttgtttgaatattcgcttaattttcaaaaattcacaattcaacgcgtgtcgaaatctgtgggcagtcgaaatccccaaaaatttggaggtgttgcttcgtggcggcgaactcctcgtgcgttatgccctcccgaacgagttcagccggaacattgaaagtaactcgggaccaatcggcacaagtcaatcctgaaagcaaaatttgataatatttggattgtttaccacctttaattgcttcaattgaacttactccgattgcgcactttcaacaacgaattcgcgtcgaatgccttttgcgaactttcggttgctgacagttcaactttgtcgaaaaatgattcgagcacgtcaaattcggcaaagaatttctgtaattcaaaacttttttgaaacggga

SEQ ID NO: 12111 - DNA, 1166 bp, Heterodera glycines
ttaacaatttaattaataattttttaaaattggcgtttattaaacattgcatgagaatgcttctcaggtggccacaatggagggctctcttggccttggagtgatgagcggcctttttctttccggccaacttcgacagtacgaataagtagtaatcattcacgttaattaaatcaaagatacatttattatgcctcttcaaaaattacatttaaagataaacccaaattgaaattgccaattaattatttgccatttttcttgccccccccttctgttacaaattctttgctcatcttttgccatttttcccaaaatttcagttttttcggttaccctttggtgttccttctgctcgtcctcctccatttgcttattcttgccattgtttttctgtttttccgtgagctcgcctccgatgagatggaaaggcgacggacgacggacagccgacgaaggcgccaatcgcttcttccgcctgcggacgaagcgcaagcggaagacagagacgccgccgccgcagcagtggcggcggagggcgaaaacggcgaaggacggcaaagtgccaacaattaaaatacaattaccatatttcctaaaatacagcccctctctcaactaaattacaaccccccttttgaggagggttgaaaaataaagccaccaggggccctattttaggaaatacggtattaaattttaatgtaaccgagtccgaattcctctttgaagatactgacgatgccgctgctaataaccgttcctccgtctgctggtgcttttctctcgtccaaaagcgtctcgctgaaatggcccgcgtctaccgggccaagcgagcgccggcggctcagcgatgcctaaacattgtgctggtcgcactcggagttcgtttcatcgaaattccatacacagaatattacacattttcacaagcgtttctccattaaggtgaatcttttcacttccgccggcttaagggacattttatactcttttctgcgctaccgtctccaatggactgaccgggagtacggttggtacagcggaacggacagtgcacttgacagtttgagtgtaagaaatggtgcaatttatttttttttagagatattaaagcggttgaattaagctgttactttccgagaatattcccatttcaaagttta

SEQ ID NO: 12112 - DNA, 2653 bp, Heterodera glycines
  misc_feature (17)..(17): n is a, c, g, or t
ttcaaagtttaaaaacncggaaaagataataatttaaccggtttcgtccgtccctttcagtttaccaccgtttctctctctctctctctctctctctttcatttggccacttccttcccctttctcaggtgatgttgctttaccctctgctgcacaaaagtgccaatctcaccgaccttcagttggctttgttcggtcttttggccaaaatcgtccgtgatgctctgttggctttttcctcctccgtccttttggtttcgcttgcgctgattccgtcgatgactagtcgttttccgactgccggaatgagggcacttgcgagcgcatgcgtacagcagcatgagcagggtgagtacggtaataacctgagcagagttgtggagggaggagccgtagtgtacggtaccctggtaagaatacgataagtgaaaaatgggtggagagtcagtgatatcctaatttgctatccgccatattactttgtcacggtcgaagtacggtaaacaagggtttgttgaactgtggcactgctgcctatgggtgtttggtattaaatgtggcgttattgtgctgcggtgtttggctttctgttccgtttaggcaaagttttttcgctgatcgctctgatggacggcgtcgcttcgcttttcgcttcgcttttcttcaacggcatttatccctttacgctgaatttcttcgccggcacaatgctcatcttctccgcccttctgctcattttccctgtctctcttttggcgtatgtctctcttctttttttctttgctcaaattttcggacaattttaaaaaatttattttgaaaataataaataaattgttttcgctttttttagtaaaattcatttcaacggattggacaaagtgacgcaacgtgagaatcaaaacgaaacatagcaaatgatctgccaatcattttacaaatatttcaatgaatgcgttaacaaatgtttcatttcggggtttttcccaaattttgtttatttcttttattcatttgtattattataaatcaagcattcattcatcctcccctccctcccattcattcattcgttgattttgtcactcgttttgatcgttgtgcttatttatttgcattaatttgtcatctctcccccctttttcctttgcttattcattcgtggcacatttatttggttggggtaacagtgaacatttccttcgtttggccatggcttaattttgttagcattttccacttcggaggtgcgagtgaggagtcagctgatgatgaagcgaaattattaaaccagtcctttaaaaatcgcatttcaatctttacattattcaattcatttattgtctttttttacatatattttcttaaacattcattcataaattattagggtgtgagaaagattgtttctaccgacaatagaggcgagaaaatgtcgaagttcgagacccaaaagacagaggaattctcgattcaaaaaacgggactctccaagaacctaaaataaagcataagcttaggcctaagcctaggcttataagccgaaagcttaagcttagtctaagcctttgtacgaactgccaatcacaataaataataaaataacttactcatttgttcagaatatatttaaaaaatgacacttcatttgttgcttgtccttcccgttttggcgatggctttcgcttttggcaattgccaaagtcaaactataattagcggttccggctgtgtgtaccatgtgagtgtttactagagatgcgccgtgagtgaaaaaacccgtgaaattcacggtagccgtgattcacggcgcatctctagtgtttacctaatttgaatattttgaattatgccgtcgactcagtagcagcaaatggcatttctctccactgattagttgctatttgaaaatgatttttataaattaaaattaccgttaattgtcatcgttaattatgtgaacagaacggatgggtgactgaaagtggacgctcgcggccgttgaccaccaacgaacgcagtcaacttgacaattaccagcgccaatcgcaaagtgccgccgctgctttttccgccgcatttcgtccgccctttccttttggagggccaattaacccgcagttgaatttgccgcaggttataaaccgtttcaaattaaataaattgttaaaatagtaaaatagttttaaatctgctcttttgaaagtggttgatcgatcctcgcgctttcccatcacttaattaatttgccatgcttttcctgtgctttcagatgccatgtttctgttccgctgcctcatgcgcgggcggtgtgtcatgggttgacaattaatcagtgggccgatggacagagggaattaattattcactaatgaaacgaatttgtctgattcacagtcgggggattacaataaagcacataaatattgcggataaaatgctttctattttgaaatcagtaattttttaattaataaaaagttttaatgacttattgatgttgacactaaatggtttttacctgctcgacagaaatggaatttaacagttaattttacaatttatcgatataggtaaactcgaattttgtcagagtataacatcaaaaataaaaataaatcaagaaaatttgtttatatataaagtacaaata

SEQ ID NO: 12113 - DNA, 3288 bp, Heterodera glycines
cgccttatcatccatcagtcggctatattaagtaaaacaagttgtcagaaatgaaaaagtcggcaaaaatcaaaaatggaggggcggccaatccgattattttatctatttataaaatcagagacacataattaaatgactaaccaaaaatttgaatgttatctcaatcttacttgttgctctttgttgaccatattggctatagtaaattgcagaattgagaataatagaaaaaggctgaatttagaaaaacaaataaaaacgaagttatttttgtgagagatttttcctaaaattttggcatttaattacaaaaaaaaaccaattatttacggttgagcttttttgtttaaggaaggaagaataaatgcaaaaaataaatgattgaaattagtaaaaacgtcggaaaatttttggaattgcgtacagagagatgaaaggcaaatgcttcaagtgaggctgacacattgagttggaatttctgttgcttttccaatgaatgctaaaaacggatggtgattcaaccgcctttttcatgttattccctcggctttcgtcctttacaattttccaacaaacgaaaaaaagtacaattttttgaataaatgtcattattttaaatgaaatgaatagtggcggatagaatgtgtaaattccgattttaaaaaagcagcttgtttcaatgtatttctaaaagagaaagtttttaaaaaataaatttaaaattgaatgaaaaatttatattttttcattttttcaaaactttcctcgatggtggcttcgtctggcctactggattaacaaacattcagaaagttgtgccaaaaatgttgaaaaattgatatgacattttcttaagtgttcatactaatagagcaaataacaatccaaggtatcgtatgctacagtaggttggaaatagtaagaaagttatttttttaatttttcaatttgaatttttttaccatttgcctacgctttattatcatatgctttttgttttgaattaaatatgaccatttgaatcattcaactgatcagaagataacttttattttaaatccgaaaggatttgcttgaccaactccgaaaagactgaaatggttagaaatttttgaacgaacttatgcttttcgcctcagaaattttcggtgttttttaaaaaatccaataattggaattttaaagaaacttgttaacattgtgtaatggtcaatttatgtggctcttagtcgactaccatataaaaaaattgtctctttattaatggaatccttttcagaaaaaaactgtaaaaaaccaatcaaaaatattgtctcataattagggatgacatttttagggttttgccaattttttccaaaatgtatttatttattttcttgacaagaaagggaaatggcgctacttaaaaagaggcctcttttgaaaattttttgcacttctttttggtttaaattttttttcaattttttttcgctttaaaaagtcctgtaaccaagtacccgggggttttcgaggtcgctgatcacgaatatgatagatcatttttttgctgtttcaatgatttgtgactacttttagcctttttaatcaattttatggaatagtgagaattttcaaaaattcgaattttcgttagcaagccaaatgcagactagaaccaaggaaaacaattcatacaaccccgacactaataattattgaacagacttatttaaagtaaagcgctaatttttttaaaacaaaatgcacccttatgaggccgagatttgaagtgtgattctgccgttgactgcaacaaatttggtgaaccagttcagagccattcttttcagcagaaacaaaaaagaaatgaattaatttttaaaaaccaaaaatatttaaattttctttttcaattttttgacattttcttttttaaagagttaaattagtaaagtcggttcaattatatatatttgttaaaaattgtcgtgagtggaaaatgcccaaacatttcacattgtcagtgctttccattccctcacttatttctgccaaaatttgccatgaaaatcctttgatgcgcacagtttcgcttttacgttcactcttaatgacttctcgcgcaaattccgacagtttttcaatttccatcgaaagtgtccaattggatttgttgggatcagaaacaaatttctccgtttttttatttttaactataacatcaatgaccaacgtcactttgtcctcttctctgttgtgaaaaccacttttcgggtccatcaatttcttaattaatcataatatgtcaattaaggtaataataattccaattggaactcaccgtaaaggaaaagaaattttcaaatcccctgatggttgatttgttgtaaaaagcacggtcacaaaatatcccaatggaatccttcgccccatctttttgtgagacaattcgaaaagtggccgaacgaacgaagcagcgccattgcgaatcttgatgagcataatcatcgcagttcattcgcattaattaacagttaatttgttgcacctttttcagaagcggtgcacaaacaggggtgccattttacctggaaaacccggcatttgccgggttttgggggtccttgccgggtttttgccgggtttttgaagttgccgggtttttgccgggtttttgggtttttttccggctttcctattttcaattcatttatttgaattttattaaacattttgccaaaattaagagccaaatatagttttcgttaatgttcaggtttattttattcatttttgatcttcattttctagcccgcagaatgtcccaaaaatctatttctgatttcatttccaaagttacatttcaacaatcatcttcaactcaaatttccagcgctgaggaagcaatttcagatttagccgtttctgtctcgagtgatgaatttggggtgatttcaacaaattgactttgcaattctgtcgatattcccttctaatgcattttgtgaatcagtcttttctgttctgaagaacatcaaaacggacgagagaaacagtattgacatgcctttgttaaactcgctaatttcaatcaaattcaatgcaaatatttcatgtcccaatgctcacaattactttctttcattgccaaatttgctcaaacaggtgaaaagcggtgataaatatgttgtttaattgtttttgacgtttttttacagtgaaaaattgacttaaaaaactgccgggttttttgccgggtttttgaaaatttttgccgggtttttgccggggttttcaact

SEQ ID NO: 12114 - DNA, 3868 bp, Heterodera glycines
  misc_feature (3863)..(3864): n is a, c, g, or t
atcttgttgttaccaaaattttgattgaattctccaaaaaaaacttcatcaaaaaatgctataaaaacggaaaaataaattaagaatcgatataaaaatatttaaatttagcccatttcacctcacatttctattggtttctttctcaacagtggagaaaaattatttttgttacttcaaattacattaaaaataacttaaataaatagaatttattaattaagatgaacttaataacaaatggacgaacaaaaacaaaaacattgccgatagcgagaacaacagcaacgttaattaataaaatgatggcaaatttgattcatatcaacaagcacaaccaattaaattatggctaattggttgagtgaaataaatgttttaatattatttgtctaatttaataaaaatgaataaaacttttttttggtactatacgagaaaaatttttggcgcccctacaaagtgtccaagcctcgaaatgtccaagcctcgaaatgtacaagccacgaaatgtccaagcctcgaaatgtccataagggtaaaaacacgaaatgtccaaaactcgaaaaagctcataaaaacccggaaaaggagtctaatttagggttttcggggtcgctgaatacgaatacgaccttcatatcgccccttgcctaacccttgatccacccgaagaagaaataagttcaaaaatttttaaaatatgtgctgtactgacgacttagatttttctattcatttagaccaaatgataagtaataagcttgaaagtctacaaaaactcggaagaagcgttatatttcagacatttcaaacacaaatgaggatgccgtgaatttgggagtggagctttgcgaaccgaatgccgtgataattttctacaacgttgaacaacagactttgaacgaggttgaagttcaataatgaacctttgagcgcggaaaaacaaattttgggagacattgcctatggttgaatggtacgtatgaagcgacgcaaaaaaatagactaaaattattccttttcagaagtgttctttctttgccacttttgccttccagcgatttgttttcgtattttttcgtcgatttccaaaagtttaattatttttaagctgaactagtgacaacaatttcgaccatcaattcagaacacagctacgcggctactccaatacagctcggcatcggctcaccggcgccttgaactctacatggctaaccactgtgactccacaagaacagcctgttcaatattcgttgagctcgctatcgacttcaacagcgccttcagccatacattttttcacgaatgtcgtttatattaaaaatttcaatggactggaggcaacccatctgcattttatggttgttttttaatttactacaggcaaatttaaaaaaatatgtttgaaaggtctctgccaccaccctgccctcccggacttcatctgtaaaattaatgaaaacaccgactgatggatggacgctgcccgatctgagctgctcgccatttcattcgcatgtgacaaaagggatacaccatacaggacgccgtcattatgcgaattttgccggacgagtaatgcaacaacaatggtgaaatccatggccaggtgacgccgatcggtcttcaaattgaaggacattcaagaaaattgaaggatttcgagaattttgaggattcgattgtccatgttccgttataaattttattgtatttttaataaatttatttattttaacttgtgaagtttgtctagggatagaattcggatcacttgcgaactcaaaaacttgttcgaattttggtcgccatcgtgtatagaattcttagtttattttggtattttatatttatatttgggtccagggttaggcaaggggcgatatgaaggtcgtattcgtattcggcgaccccgaaaaccctaaattagactccttttccgggtttttatgagctttttcgagttttggacatttcgtgttttttacccttatggacatttcgaggcttggacatttcgtggcttggacatttcgtggcttggacatttcgtggcttggacatttcgaggcttggacatttcgttggtcagcgatcaaaagggccattcctctcttaggtttttaacaaattcaaaaataacatcttagcaactaccgtcgttttatccatttttatcaaaatcttatgaacgtgacataatggcctattcatctagctgattttcttcagttttcttatccgcgcatataatggatgaagaagacatcgctttggacttggttcgtgataggataaacattgatgtggaatcgggagaattcactgctttggacaaggttggcttgtagttaattaaagaaaatattcacataatcccaaattaggagagtgatgaagtaataggtgacaaaactgcagaaagtgataaacgccttattcttgacttggatgaccaacaagcggggccttcggagcaaaaagtcggcaggagagggcctggacggaagtcagcgaatccgttagtatttgtatatcgtcggcatcattcatccatttgttttcggattcaaggacattggacaatcttctgggccatgcaaacttagaacatgcccgagggcggacaaaggaggccatgacttttcttttcgaagtcatttatcccgttcatttcgactcatttcgaaatttaaggtagtcaagctggccccttaccatgtgcagacatacaaagaactttcggatttgtactcggaattgggccaaaaagagaagagctttgaattcaaaatgttggctgctcttttaaactctaagacaacagccgaagaatgggatgaaatagccgggactgctaagtcgtttaaccggttggaattggctgtcgcatgtttggccaaaggttgttctatgacgtcttcggcactttctttttaatttagcgattcgatgtgaccccgagaattggctttactacgaaaaacgcatccaaattcttgatgcatccggtgaaacggatcttgcaatgaagacacgactccaagctgcccaatcgatcaattgtcaaacttccaaaatcaacttcgcatggatcgataaattgataaaaacggtatttattttgggattttttaccgattgggaaggatacaacgccaacttttaaaatggatactgctcccacttctcccaccacctacattatgaatcagtcccaataaggcagccgattattattgcacgctgaaagacgaagaacgggcgaccgaagcattggaaacgttcattttacggagccgacaattcggacggtccattgatttcgagcatttggctttacttggtatgtggataagcaaaggtcgttttgaggactcagcaaagtcaattcttgcgatgcataacgaattggtcaaggcagtcgatgagaaaggcgacaacgcaatgactgtgaggaaatgggaattatgtgttcatgtgccgaattccaccaaattattatttgttccaggtgcattttacaaataccgattataaattgagcccatttccacctccgtccggttctcattgggtgatcaatgcaaaaatgaattcgcttttgctctcctatctgatcatttgctgggttcatcttggacgcctcgacctcgtcccccaacttattgactgcctcttggagagaccactcggctcttccgacgaagaaaatgcctttttggacattgctcggtcccttcattcaactcatcaacttgtattggccgttgaatatatgcagaaattgagaaaggaaaggcccgagtacaatgaaagcaccgatttttggttggtttttgtgcttttccgactcnntaga

SEQ ID NO: 12115 - DNA, 1329 bp, Heterodera glycines
  misc_feature (1275)..(1275): n is a, c, g, or t
aaaatcattttagagcatacacactgatgacagccactgtcatgttccaaagagatttctattaccagatgccaaaaaaagagatagccatttttttggaccgtccatacctcacatatactcaaacggcccgaaaatcatttttagagcataacaactgatgacagccactgtcattgtttccaaagagatttctattaccagattgccaaaaaaagagatagccatttttttggaccgtccatacctcacatatactcaaacggcccgaaaatcatttttagagcataacaactgatgacagccactgtcattgtttccaaagagatttctattaccagattgccaaaaaaagagatagccatttttttggaccgtccatacctcacatatactcaaacggcccgaaaatcatttttagagcataacaactgatgacagccactgtcattgtttccaaagagatttctattaccagattgccaaaaaaagagatagccatttttttggaccgtccatacctcacatatactcaaacggcccgaaaatcatttttagagcataacaactgatgacagccactgtcattgtttccaaagagatttctattaccagattgccaaaaaaagagatagccatttttttggaccgtccatacctcacatatactcaaacggcccgaaaatcatttttagagcataacaactgatgacagccactgtcattgtttccaaagagatttctattaccagattgccaaaaaaagagatagccatttttttggaccgtccatacctcacatatactcaaacggcccgaaaatcatttttagagcataacaactgatgacagccactgtcattgtttccaaagagatttctattaccagattgccaaaaaaagagatagccatttttttggaccgtccatacctcacatatactcaaacggcccgaaaatcatttttagagcataacaactgatgacagccactgtcattgtttccaaagagatttctattaccagattgccaaaaaaagagatagccatttttttggaccgtccatacctcacatatactcaaacggcccgaaaatcatttttagagcataacaactgatgacagccactgtcattgtttccaaagagatttctattaccagattgccaaaaaaagagatagccatttttttggaccgtccatacctcacatatactcaaacggcccgaaatcatttttagagcataacaactgatgacagccactgtcattgntttcccaagagattctattaccagaattgcaaaaaaagagatagccattttttt

SEQ ID NO: 12116 - DNA, 3650 bp, Heterodera glycines
ttagcattcgcatccatcattaactgtatttgccgatcttcttcggccaatcggtagtccttcttatacatctcgacttggtccgggtgaatcacttggacctgatccactgagaacggcgtgaggattggtgcataggggcggggttggaatttgttgttatgtttttgttgttgttgttggtcagattctccttcggagtccgagtcggaagaaattaaaatggcaggcggtgttggagacgaattttttgatgtagaatgatttgagtgggtaagaagggagtcgaatcgagacattttttgctgtaaatttgtcgaattgattgtgtgagtgtgatggctgattgaatgaaatgtccgattaaaagatgaaaatgattgaatattttggggctcgatcgtctcaaaaaaggggttaaatggatttgtttgtcgcgcaggggtgtgatcgcgcagggtgatccaaacatccggtattattggttgggcgaaaatttggttttgttcattaataaattgttcgtgataaaatgctttcccgtcttccatcgttaaatttcccgaattttttagaaattttcgaactcccgttccaaaaaacatttcgtcccatccgttggaaattcggagtttgaaattttcatcaaaaatccacattatcacgtatttgtcgtcatcttcaaatatttcccagtcatttttgattaaattttcggaaatggtggaagttgcgggaaaatttgaagtgctgagataagcgaaaaaatttgtgccatccaatcggatctcaatttgatgtggtgtttccatttcttccttgtcttttggttggcccagtggattcccttcacttatacatgccacaattgtttccccatcatgcatttcttcgtccgattcttccaattttgaatctcccagctttttattcccatttttatgttttggtttctcattctccaatgattcagtgtcctgttccgcttcttcgtttgtgaagtatggcttgcattggtccatgtgtacagtgaatggttgtccatcggggtcaagttctcggatttgcaaatttggcttctcaattttgatgacgcgaaatggcccttcataatttggttccaatttattctttttgtcatttctgcgtctcaaaacaagcattccttccgtccatcggacttctttcgtgcctttttgttgctggatcatccgattagcacacttcttcagactttctctgatccgagattttgcttcttccatccttttggtcagctcttggacgtatatggccatgtcattgtactcttcgccgtctttttcgagtagcatctcactgggaagccgtggatcaaatccatgaagcacaaagaatggcgaatgatttatttgtgagttaatcgatgtattatatgcaaagcaaagcatcggaagcgcggcagcccaatcttttccgccagtcgtggtgactagcatgtccgcaagtgttcggttgaatcgttccacttgtccattcgctgattggtggtatggcacggtcgtttggtgtttgaatccccaagttttagcaagtgactcaaatgtcgaactgaggaattgtgttccacagtccgtcacaacgatttttggaattccaaattggcatagaaatttgtcaacgaatgctgttgtcaccgtcgtcgcagattgttcccacagtggtagtgccgtcatatattttgaaaatgaatcgattatcatcaagatgtattgaaatccgccttttgccgtcttcaatggtcccatcaaatccaagtgaagtctttcgcatggctgtgacgctggtacaattggacaaatgggctcagagctcatttggttcccaattattttccgtttttggcacgcgtcgcaggttctcacaaatttttgaatgtccttttccattccttcccagtacaaatttcgtcggattttgtcttttgtccgcttctcgcccaggtgacctccttggaaagggtcagagtggtattccttcatcactctttgtctcagactgcttggcacataaattttccattcgcctcggtccattgcacacaaaagatcttcagtaattctccattttccagtaaattcatttggctcctctgaattttgatccttcttcaaagtttcccgtctcttttgtgtgtccgtctcctgtttttgagcctcgcgcatttcactttgtgaaatttttggttcaattttcagccaattaatttgtgtgtcgttgtcgtccaagtatcgtgaaagatggtcacaaaattggttccgttttccagggcgatgaatgatttcaacatcgaatgccatgatagccaattggtatcgactgagtcgcccttccaagtccttccgccggaataatgatgtcaaagccgaattatccgtgatcactgttgattttccagctccttccaaatatggtcgaaaatttttgagggaagcacaaattgctaaggcttctaattcgaccaccgaatagcgcttttcatgttttgttagcactcggctgaagtaacaaatcggatggacttcgccttcacggttttcttgtagaagacatccggcaattgcttttatgctggcatctgtttccacaacgaatggttgtccgaattttggtggagccaaaactggagcagtcatcagctttgtcttcaattcctccaaggctttctcatgtggtggtccccattctgtcgtgctttcattttttgtcaactcataaatgggttgaagtatttctgcaaatccgtagacgaattttcgaaaatatgacagcattccaatcaaggatcggagttcggtgatatttttcggtttcctcaatttgtgaattggctccaaatcctttggatctatccgaacgccattagccgaaattaaatgtcccaaatagcgaatctctcccaacgcaaatctgcatttctctggtttcagtctgaatccaacttcagtcatcgttcttaaaaaggtattgatgtcccgaaaatgttcatcttcagtcattgagccgattatgcaatcgtccaaatacacaagaaatgtcgctgagcacatttgtcggacttcttccatggctcgttggaaggttgttggtgctcccgccaatccgaagggacaacgtagccattcgaacagtcccatgtggcagatgaatgcgctcctttcttcgtgtcctttcgccaatttaatgtgaaaaaatccgcttgagcagtccgccacggagaaatattttttcccagagacttcgtcaaggatcgatttaatcctcggtaaataatatgtcgatcgcttcgtcaattggttgagcttccggtagtcaacacaaattcgataggaggcatcaggctttcggacaagcacaattgggagatgaccatgccgaagtggatggtcgaatgacattttgacgcagcaactccttgacttgacgctctattttcgggtgaagtgcgacaggataacgatagggtctctgttggaccggccgtgcgccatcgattaggtcgatgcggtgtatcgtttgtcctttgaagagtccgacttctccaagtttcaccaaagcgctctcggtctggcggatgatatttttcagcttttcaatttcgtctcgactga

SEQ ID NO: 12117 - DNA, 1019 bp, Heterodera glycines
agaaacgaatgggataaaaagaatcatcaccaaaagatgaagtaaccaaaagagtcggaggaatctcgtgaaaaagataagcgagttcaatttgcataaattagacaattaacgaaattatcgattttaaaaatttaatatttttattcgccaacccaattgttttccatttttggtgaaagtgatctgccgaataacagaattgacgccaattcctacggtatcgcctgcaccgtaggaatattcgacatttattcctgtttctttcccattaatccaaatctttccatcactgtcaattgcataagtgccctttcggcttcgaattgttccatccaatttgttctgctgtttgactgcaaatccgaagctcatccaactgagaaattaataataataaagaaataataattaaaatttgaatatttctgaaaaattttatattcaaaaaataaaaaatctctctcttaccatttcaaatttccaattgaaatttcgtagtaaaaattgtcagacgaatttttgtccagcaaaatcggatgttttgcaaaggcagaagaacagtaaccttttgaggagaaattagtaaagtaaattatttataaaaataccagaaaaatttctcttataatggacaatgagacttttgttgccaatgatttggaggttctcatgacgaaaattggcatcccaataattttgtcggaaatttgaaaatgccttaaaataatccattttaaaataaaattgttttattatttaaatatatttttttaccccttaatttaccttcctctgctttggttctgctctaatgcactgattgtttccacaattttcttctgatcattttgaattttttgagttgcttaaaatcgaattaatttttaataaatgtaaataagcatttaaattgataaattttattttcgttttaattttcttcccctcaccttttgactgctctttttgctggttctccaaaacactgattttttcaaaaattttctctgatcatt

SEQ ID NO: 12118 - DNA, 2878 bp, Heterodera glycines
  misc_feature (2848)..(2848): n is a, c, g, or t
aaaattttggaaaaaaatccagttttttggaaaaacaacaaaaagaagcattcaaaaggtgaggaaaagaaaattaaaacgaaaataaaattaatcaatttaaatgcttatttacatttattaaaaattaattggattttaagcaacttcaaaaaaaaaaatcgaaaatgttcgaaatcggggttaagggttcgaaattttattgatatgagttcagattcgtgcttagcgaccccgaaaacctctggaggcatctttatgcctcaaaaaaaaatttttcttatggggtataaaccagggatggcattccgaggccccaaaaattttcggaaatcggaagtcggaattctgtgccatccctggtataaaccacatagtaccaaaaaatttttttgtcccacataaaattcaaatttatccaaattgtttatgtcattcgcccaccttaagctgttgttgttgatcagcaatcaattcattgtttccatcaaattgtccatcattttccaaattaattgcagcgccattcacttctaaaaataccataatttaatcttttttggttgaaatattcatttaatttcagttttcaaactttcaatttttctcccatttcatttacatacctccattttctgttgctgtgaaatcatctccacaatttattgaattggtcgaaattgacatttttgagtttgataccaataaaacaagcttggattttaaatttcctcgaaagaattttgttgttgttgttgaataaatgacagggaataaaaagacaaataaaaataaattagagttgagcgggaccgggaattttgggcaaacccgggaccgggaccttttcgggttgaaaacccaggaatttttggctgggaaaaccgggaaaaaaccgggactagtcccggtcaaaaccgggaccttggtactcagttgtccgtgttcaggtcccggtcccgctcaactctaaaataaatgactgactattcattcatttcattttgtttaggtgtcagtccctttcttttcaaaatttaggtcggtttgatttctcatcaatgttgaaaattaggcatgtgaaggaatagaagaacaaaatcaaaattgagaatttggttagacatttttttggcgagtaagagaaaaaaggaaatacaagaggaaaaagagagaaagagagagaaagagaaggaggacagaaaaaaaaactatataatgctttttggcgtaaattttttctaattttcggaattttcttcgctaaaaatcaaattttaccttaaagtaaaaaaagtcatgaaaagcgtcaaaaaattgaaaaaattttgaaaaatttttgggcatttggccaagaattttggtgccaaaaaagacattttttcgaaaaatcgctaaaatttatgacaaaaactgccgaaaccccaaaatatgtttttattcccaaaaagtccaaaatatgttatttttgagcttttcatgtgatagcatatgcgcaaaaaaaacatgtaaaaacatataaatccgttccctgcttataattttatttagagagataacgaaaaaatgagttgtgttatctctttccccattttatttttccgccaaaagtcatttgaaaaaaattgctttaaaatttcaaaaattatcgaaattttaaaaatgatgttgattttgcctttctctcccctcgagcccattggcaacaatttaaggcgaataattacgggaggggtcggtttagtctggccgttttagtctggcaagctgattttgtgccatattgattctaatctgattttttttcgaaaaatgtttaatttaatactaaaacatacattgaaaaatcattacgggcacatttcataaatttgagataatgtaccaacgagataatcgctgatgatatcgggattaacattgacattggcatgcccgtaagagtcgaagaattctcgcatcggcgatatcaccacctcgaagtccaacgaaaagttgcaggcgaaaaattcggccatctttgacaatcagttgaggcatacgtgttcaacgcttcacacttgaagtgagaaggcagtacgtaatcaaaatccaaatgaacaaatcaaattttggcataaaaattaggaaaagttgacctttttgtcgcagctttattcggaaaagcagctaacattggtgttgttgtgttctgcaagacttgtacacgaattgtagccggcgctttccacgtctcaactgcacgccgttttagctgggtcacacgtcgctgacactccactgctcggcgctcatgtcgcatgtgtggcttccaataattttgaggacattagcattaatgtcaatgtgtaggctgaatttaaaaaaatattctttgttttatttttgcatacacctttgcatttgttattaggtccgaaaaattcgcaacgcaaacacttctttgtaggtgaacagaaattttaaagttatatataagtatatgctcgacaaaaaatgatattttataaaaagtaattaatttgtgggtgaaagagctaaccagactaaaccgaccctctgactaaaacggccagactaaaccgaccctctgactaaaacggccagactaaaccgaccctctgactaaaacggccagactaaaccgaccctctgactaaaacggccagactaaactgacccggcccgaataaattaaacgcaaatctcaaatttggatatgtataaaaacaaatcccctttttattgctcacccaatgcaattaccgtatttgctctaattatcccccaatctccattaatcccccaatctccaattatcccccagtctaggaaagggttgaaaatnaatccccagtctccattatcccccatgggg

SEQ ID NO: 12119 - DNA, 1210 bp, Heterodera glycines
  misc_feature (22)..(22): n is a, c, g, or t
aaaattatataattaattcacnagagatttagaaaacctcgaaaatcccttatggcctcggaccaatgatttcctagaatttataaaatttaatccataaaaatttttagaaatgaatgcatcagtctggaaaataggtctttttgaaaaattaaaagatggcaaaatggcggagtgccgcgaatgcaaagcaaatggaagagccaaatatgaatttggcctgccagacttcagcaccaaatcgttcaaaaaccatctttttcaacaatccatgctaattcggaatatgtcaagaattttgaagaactggagaaggcgaaaaaaaaatccaaagaaaaagttgagaaacagccgacgatcgaaaatttaataggcacgaatttgaccagcagcggtagttttgtgttggtaaattttacggattttggttttttaggcattttgtctgtggctgacaaacgaattatcagcatgataacctgtaacaatctgtcatttggtttgctatctgacccgacttttaaagctcagtgtaaatatgagctgaaggatgaaagcgattatcggtaaaagtcaaagcaattaaaaaataattttttaggaaaagagttctcccggaagcatacaaactcgtcaaggcaaaaatactcaaggatttagatgattgcgaattttcaaaatttgattttattgacgcgattacatttttgattttcaactcaataaatttgtctaaaaattatcccccccccccagtagtattgggataaaaatctggccccccctgggcagagagatgcgcattcactataggagagtggagagaattagagaaaaagagtaaaaaaatatgcgcgagaaaacagagataagtgattaaattataaagccccgggtcactactttgaatgctaaaatcctcgtccacagcgcagtgcgctaccgtttttgtgttcccccaaattaagcgatcgatatcaacggaaattatcgatttgtgaaaaatttgaatgcacacataattatgaatagggcttcgatttttaggctctaaaaacccaaaaataggctctaaaaatggaaaataggcactaaaaaccctcatttttaggggtgtaaaatgacaaaatgtattcaaaaaagtaaaaatattctgccaaatcgttaatgcaatgcataattttcaaaatcacaaattctgtcaagaaaa

SEQ ID NO: 12120 - DNA, 4103 bp, Heterodera glycines
  misc_feature (10)..(10): n is a, c, g, or t
  misc_feature (35)..(35): n is a, c, g, or t
ccgcctaaancacaattcggagctacatattatantgagtcttttaaaaatttattttaataaatatatcgcattttgtaaaacagacagaacgaacatttgaaatgtacaatagtgacacacaagtcaataaatacatagcgaacaatacgaaggcaggcacaattaagtggcatggcacagattcttttttattggggaaacaatttatgaaatgattgatcaattctcttcgcgtggctttctctgcttgaattgcctctcacaacgatttggttctcaattcggatgcagcggcagatggcagttccctaaaaacatagaaaaattacgtacgaatcggaccgattccccgccccgtccaatgactcacccaatttcgttgtcgttgaagccaatgtggaccaaattggcaggaacatcgtccataatcttcgcaatgcgccgccaagcttcaagctgttcatcaccgaaatccatcgggaagcgtacaacagccactttcgtttttaatgctccgccaccattcttcactttgtaaacgcgacttgacatggacagccgttcttgcgtctgatggttctccatttgggcaccacactccttgaagcggaagggcaacttcgagatgacaatgtaattgaccgggaacgcagcagtggtgaaggactgaaattttggggaaatgaataaaaaatgacggatttaaagatgcacagcaccaccttgaacaagttgttcacaaagtcgttccatttgccttccttccatttgttcagcttcagtgacaccggtccgtgcccttcctcgcgctgcgtgtgaacccacgtgtacaattcacggcatgtcgggtcaacatcagcattctctccatcgacagcaccgtcagcagacggacactcgggcagcatttgcgtgtggattcggtgcaggccggcacagtcgaacagcacggtgggcgacacgtgtttacggagcatggccaagtcacacttcttcaggaacaaagtgctgatcccatcccgcaacagcggccaaatgtgtcgtgccatcactttccaactgcgatattctgtgaagtaagtggaaaattccagcgcaatgtcttcggcgaggagacggcgaattgtgcacagaaaattgatgacctcttcgttgatgtacctgcagaaaggaggcaaatgttttaaggtcaatttggaaagcaaatggccaccaaatggagattgattggaagccgacgacactgtccggcagcggagtggtgggcaatggcaacgtgctgaagtcggagccgtcgatcgatgtcatgatttctgcgcccgattcttccgtcatccgctcacagatgtgaaactcgccgaagcaccacttcctctgctcgaaatgcctgtccaccaaagtgttgaaccgagcattgaccagcgcgaacttcatgccgacttctccacgattgatccatgccaatgtgtccaaccaaacgtcgtcgcagagattgctgaaaaaaggagtcatccatcattatctttcgaaaaaagattaagctcgcttccccacatttggcccatgcgtcgctgctgttgctgatgataaataatggtgttgtcactgtgccgtttgactggtgccgttgcgcccacttctgcgtcggttgtttcgactgctgcgtcgttgcccagaaaaggaggaaagtgaaatgaaaatgaataaaagtgaggacaatggccgaatttggttccttttatactaatacgtattttttcttctgcaaattttgtagtgttcagcaaatgcaattttcctctaatgaaatttgtaattactagagcccggcgggatcgggactcccgcgggattttacgggagtcccgctcccgactcccgcttttttcggtgaacgggatttttaacgggagcgggatttttacgggattcccgttcgggactcccgtcccggaaaattttgaactcccgctcccgctcccggaaatttttacccaaaaacgggagtaaaaatgcactggtaagaattgatttttttggtaaaaataatgatttttcattgaaaatctgttaatatatagccaaaatttcaaaaaaatttcccggcggcgcctatcggcaccgccggatccttaaaatccttaattttcttaaaaaacttgctcaatttgcaaaaattggtcatttttgaacagaatctaacaatgtattgtattaaaattttcaatttttttcccggcggcgcctacggcaccgccggcctccctcctcctccttggtcaccaaaaagttttttcaaaaatacaccgcaaaaaattttgtaaaattaataaagggagtccaaaatataaagttaataaatgttttgttcgaattaattataaaaaataatttatttaagcaatttgaaaaaattttctgatttttgactcagaaataaaatttttttatttcaaatttctcccttataaatttttctatatatttttaatttaataaattgattgccctttaaatttgtgcattaaaaatatttttgtgagtttttaattaaattttcgaattactcccgctcccgcccgggactcccgttaaaaatggacgggattttaacgggagcgggatttttacgggaatcccgttcgggactcccgtcccggaaaattttgaactcccgatcccgctcccggaaatttttttttaccggactctagtaattactaattagtaattatcgttactgttttttctagggttttttgattaccctttttgccacaggtgaattatgcgtataaattgattgattgatcaaaaaatgaattaatttattgattaattaattaacatgaattaattaattaacatgaattaattgattgatacaaaatcaccaccagagaaaaattaaactcaaattcacggtcatgaaaatcttgaatttcacggggttttttggattacggtcacgattcatgtgaccaattcacggtcacggttcacgggactgacgcagcaaaaatgccgttcgaaaaatgaagggcataatttcttcaacttacaaaagtggaaatatacatctcgtcaatttgggacaaattaaaggaccaccatttctgtttatttggcatttgtttctcaggacaaagatttcatttaaatttcttgcataaattttttataaatctcgcaaaatttttaagatttcccggcttggcctacaggcattaccaagtgcctatttttagactcactttttacaaaaaatgcaccaaaattcaccatttttgttccgccttaaccaaatgatcggtcgtcgtctcttaactttgccgccccgcgacgacggacgatgacagtcgtcggttaggcgaaggtccatagtccaccgcttcccccccccggcccctcccaaaagttcctcttttctagacgacatttttcttcatcataaaaattgtgcattatgtaattgttcatttggcccactgtttgttcccctttcgttgccaaatgcccatgaaattcacgtgaacggctgcagggacggacagcgaacggcggcgactgaaggcaattagcagcgaatttgccacttatcaaagacaaattagcagtggacgacgacaatatgacacagcagaatgataacataattattataacaacaatcggtgataagaaaaaaaaattgaggacaaggaaaaagtacggttcaagactctcgagttgtattctgtaaaattctatgtttgcccgtctaagttttgaggcgcagatttgctcggttctcgaccgaactaatctttttttgcgcgcaccggacaaattgtcacttttgtcagtgaggacgaaccttcacccggacgaatgtgggatccaaaaaaccacaattttttttcgtaatatttgcttgattagtctattcctataaatatttccattaatgccacaatggtaaaatggaaaagaagtaaactttgcgagagtctcgagaaaattagtgagatgcattctttgacacttcattaatggcaacaacagttctttctctccctctcctctcggtgacttctttgattatttttgtgctgctgata

SEQ ID NO: 12121 - DNA, 3333 bp, Heterodera glycines
aaattttgcgagacatttcatctaaaaccgatactcttcgtgacatatttctcacaattaaaatcgcgcggagtctgtcgagcgcaaattttaaattgttcaagcaattattgtaagcaataattcttagttcattaaggcaattatcgtgccacattttgtcacgaaataaaatgcgggagaattgtcctgtccaagtttatcccttcagtaaatgcttggcaacactttttattttaacaacattctctttttcttagcaaggtatttcattaaatgtaatatttatttattttaatcttcaattttatcataacgagtaaaattaataattaaatgtactaacttaattataaataaaaaaatgcttttacaaggctttaaaaaatttatcgggattttcaattatggccaatttggacaactacggcaatgatacggtaattaaatgccaagataattatatcatagccaaatttgcagttttatttggccttcaaagatgtccatcccagctggtcactgattggatttgcaggaatttatggaatcattgcactaattggcatcattttcaatttttctgtaatttttatcacaatcaaaaaaaagttggtttgattaattttaatttatatcaatttaaccattttttttataattttacaaatttatttttggtcactcaatggcacaaccaattatcttttggcactttgctgcttttttgaatcgctttttcaacttggccatttcctttttgtgtacaacgcattttctggccagaatttcattgagtgtcgcctagcagcaaaaattttatttattcctttcattggaattggtaattttaatataaaaaattatagaaaaatattttttaatatatttaaatttaggtggaattgctccagcaatatttttcactggcattgatcgactgattgcaattgctttttcggaattgtatacaaattacaatattatccaattttgttaattacagtaattttaagccatgacaaacttaaaaagcaactgtatttggcgctgctaacaattctttgtgtgttctatggtttctgctactctgcttcggtgtaccaaaattcaaaattgggtgatcagatgaccacgggatcttttgattttttaaaggtttgattttgtttattttatttaaaactatttatttttagaatggatcattattaaatacagttggttttttgcttgtttcaatgactttcattatttatgtttgtgttggaattgtgatacgtatcaaagcatcaggtaaaaatccacgctaaattatgcatgccccaatttgcccgattgatggacaaaattgtttttattcatgttttaaattttagtgtttaaaatttttgactaattaaatcatgcttatctgggatgggccaaattgaaaaataaaaagcgaaatttgcgaaactgaaaaatgcgaaatgaaaaaaaagcaaaatgcggaaagccaataggtgcgtaaatgcgaaaggcgaaaagcgaatttttttcaaaaatttaccaatagtcaaaatcatagattttgaggttgtgatgcaaaaaacaaaacaaaatttctgcattttccggttaaatccttttctcagatcacaaaaaatgacaaattctacccattttgggattaaaatttcataaatcaaggtaaaatgagggtcaggcagtgccgacaggcgccgccggaaaatttttggaaattgtaattaaatgtgatagaaaaagttgcaaaagtttcaaaaatttacaatttttttaaaaaataccgaaaaaggcatgaaaaaagcaccatacgtcaaaaaggcacgaaaattacgtgcccggaataaggcaccaaatcgcaaaaaaaagcaaaaaaaatgcaccaaaaagtttaagatagaaccttctgcagcccaaaataataataaactgtaagcattcgttttaaaaatttaacgctccaaaaatattcatttttaggggtggaattttcgcattttgcgccaaaaggcgaaatgcgaaatgccaaaaaatgcgaaaagcgaaacctaggcccatccctgatgcttattgtcttggattcataattgccaaaaatttgttttaattaactctttttttaggtttgccatccgctgattcgatcaatcgtcgcacttttcgtgcactttttttcattatcactgtgaatgtcggcggttattggttttctgcaatttcccatttgctgttaattcccacaatttcatctccgatcactgcttggtttggccatgcaattgccgcattttctgggattattggcgcagtgtcaaatggaccaattttatattttacaaggtatgaaaatttaattttttttttaattattttcaattttagtacggagtatcggcaagcattccaaacggagtttccatttgttttcagacgaatttcaaaccaaaatcaagtggttccactgcagaatacacaattatgagaatttctttgtaaagataaaggaaatttaaaacttactagtatttaattgaaatgacatcagtttgtctaattgttgtcaataagtattaaaattacaactaattaatgaattttcatataactcttttgttgaaattatgaaaatttcactgaaaaatttttaaataatttttctttgtccatcattaatttatagataaaaggtaaatttataaattcgaaaataaaggaattaccgataaattttttaaatcctaaataaataaatttaacatttaatgaaataccttgctaagaaaaagaaaatgttgttaaaataaaaagtgttgccaagcatttactgacggacggaacaaacttgcgcagcacaactcccgcattttatttgtgacaaaatgtggcacgataattgccttaatgaactaagaattattgcttacaataattgtttgaacaatttaaaatatgcgctcgaaagattcccgcattttaattgtctgaattcgtcccgaaaaatacacttacgtaaagggctttaaaataacttttgacaaattgattagggtttttactttttaatttaagtttttgtttttgtgagttccaagaaaattaattaattgaataaaaattccttcattatatttttgattaacttcttggtcaaatcatttgcattgggaattagtatgtaattaaggaaaatttagaattattccggattaacctgaaaatcaattaatctttagcttttttaccatacaaattctatatgaccaacaaatgaaaattaattaattgtgaaataaatttgggttttta

SEQ ID NO: 12122 - DNA, 2523 bp, Heterodera glycines
  misc_feature (36)..(36): n is a, c, g, or t
  misc_feature (46)..(46): n is a, c, g, or t
  misc_feature (68)..(68): n is a, c, g, or t
  misc_feature (112)..(113): n is a, c, g, or t
  misc_feature (173)..(173): n is a, c, g, or t
  misc_feature (2454)..(2454): n is a, c, g, or t
  misc_feature (2460)..(2460): n is a, c, g, or t
  misc_feature (2462)..(2463): n is a, c, g, or t
attaatgaattttcatatactcttttgttgaaatantgaaaattcnactgaaaatttttaaataattnttcttgtcccatcattaatttatagataaaaggtaaattataannttcgaaaataaaggaattaccgataaattttttaaatcctaaataaataaatttaacatntaatgaaataccttgctaagaaaaagaaaatgttgttaaaataaaaagtgttgccaagcatttactgacggacggaacaaacttgcgcagcacaactcccgcattttatttagtgacaaaatgtggcacgataattgccttaatgaactaagaactattgcttacaataattgtttgaacaatttaaaatatgcgctcgaaagattcccgcattttaattgtctgaattcgtcccgaaaagtacacttacgtaaagggctttaaaataactttggacaaattgattagggtttttactttttaatttaagtttttgtttttgtgagttccaagaaaattaattaattgaataaaaattccttcattatatttttgattaacttcttggtcaaatcatttgcattgggaattagtatgtaattaaggaaaatttagaattattcctgattaacttgaaaatcaattaatctatagcttttttaccatacaaattctatatgaccaacaaattaaaattaattaattttgaaataaatttgggtttttatcatcaaaaaaaagccgcagaaaaatggtatttttcataaattggaatatattttcgaaacgtcaaataccttctgagtaaaatttagattttttttttgtaaattttcatttttgaattttaaaaggccccggtaagaatgtatttgcaattcaacaaaacccgttcatgccaatgcttcgtcaatttcttctataacaaaaatgccaaatgtgaaccctttggcacaaaattcccaaaatcaaccagcagggtaattaaaaaaaagaatcttttttttaatattaaattcattaacaatccattaattaggcaagagcagagtttcgatctcaaaattttgaaaatcctcatttcagccataaaaaatcctcatttgccactaaaatacctcaaaaaaatcctcagggaagaaataatgataataaaaattttaacaaaaattggtgcaaatctttttttttgaagtcattatttaaaataacaaatattttatattgaaaataactagggcttccttttttaggcacaaaaaatcgcgaaataggcattaaataggcacaaaaatcctcaaataggcactaaaataggcaaataaaattttcaaaaaatttttattaagaaaaaatatttaattttgggaacaatttttttaaaaattttttcaattcttaagggtgtatattctaaaattttttttgggtcatttctttagggggtgtggtttttcgtttttattgcatttttgttaaggattttttcgaaaatccttaaataggcactttaggcacaaaaaccccgaataggcaaaaataggcattataaaagtcatcgtagacacctcaaaccaagcggaaaacgcgtgcattaatgacaaaaaaaaatttttttctttattattattgtacataggtacattgtgaggaaagtcatatatgtagcaggtgaatgagttgacatcatacaagaactaatgaaaaagctaatattaaatgatcttttcgtaataagagaaaaaacaatctgtcataaattaattgacccgaacgaaacatacagagctaacacttagttgttaattttttttatttaagccgtaatttgatataattgagaaaaaaagtgattttttaaattctggcaaaaagccacacagagctctaataagtatatcagccatttttaactcataaaaaaatattttgaaaatttttctctcatttattatttatttttttatgctttattaaattgaagaaaaaatttatctatcaaattataattatgataatgcgtcattgatgacatagtattcattatttcaattaattagatgttaggagtttgatgattacatatttagttaataactaacaactcggccaaacagtccttttcaaataaccacacttttaagaagaaaaaaaaatcagaaaatatttttaacttacacaaaattgtgtaaagttaatgcataattctttttaaattttctttcaatttattgcaaacatttaaatgataatattaacaatattttttaaatatctatttttacaaaattttcacactgcatttaaattataaagcggcttataaaccgcaattatgcttaaataaattaaaatttaggtcgtcgtccgatatattgtcaagccaatttagattctaaaaatggccactttaaatgacaacaataataatacggtaattaattggtaaaaaagatatttncttttncnnccatttttcagttgtatcttttaaagaaagatgtccatcccagctggtcactgattggat

SEQ ID NO: 12123 - DNA, 2645 bp, Heterodera glycines
ttaaggggtgaccagcagtccacttcatcacgttacccccccccaaaaacaaaagtacagaaagtagcaatttattaaacataattaaattaaaattataattttataatttagtcaaatgccattgatgaaattggcatcgatgatggcttaaatgagctcgaaattggcgagtcttttctgctcagagtgccgttcccacttcggctcccattttgtcacattattcttacggtaattaaatttaaaaaatataaaatatttaattaaattttagttttacgcagcggactctcagcaaatgatggtttgaaaaattttattttttgattttataaaatttaaatttcagggattttgcaaattgggacccaccggaagcataagcagagggacaatccaatggagacaaatgatcaaaaaattgggtatgttttattttaatagaataaatatttgtaattattaatattaattaaaaaaattaatttttagattttttaaaaattggatagctttttttacttataaaaatcgaaaaaaataatttaaaaattgaattttcggcgctccaatcgcggcttggcatcagctgattgtgtccgatgaatgcccttcttcgtctgccgttgcacctgccacgggcagtggccaccgttcgccgccaccgccaccgtcggacgaacgccgacataccgtaccccgtcggcgtaccaccgtttccgtgccgccgcttactgttggaacgctgaaagcacttaccgcggcggcgcaacaacgactccgtgtaaaagcaattgaaaataattaatattaattcccgcctcccttgatttaattgatttggttagggtaattattaattattttttgaaatttaattcattctaattcatttaagaatgaaccaaagggacatcataacaatgccacgtcgggcaaagaatgtgcaccaattcgggcataaatttccaagaataaaaaataaattaaaaaattgaattctgtcattcattaattacttatcgagtccaggggtggaaaaggcttccgagattccggggtattatcgtgccagaagtacgaattacggataatttatagggcctccgttcccacccctggccataattgtattttgataattaaatgaccatactcaaactatgcttaattgattctgatgattaaattactttttttatccattttataatttaaatatttttgtgtaaatttaaatcatttatttattttgagcgttggtcgtgaataattgggctgatccgcaatttatgatatgcttttaatgatttttcttatacattttcatatcgaataaatgggcaatttccaaaaataatttctcccatttaaaaatttatttttaaaaatttctagtaaattaataatgcatatttctaatcatttttctctcccaaaatctgatcgcaatgatttttcgtccgattactttttttccggtcccaaattgcgctttttgttggctttgcttttggccggcgccattaagccatcgccgtcgtccatcgtttcttcagctgttcagctgcacattttcaattccggtcggtcagcgccgaccaaaataatgcaaacagaaaaaaagatggaaaatgggggaggcgcaagatttgttacgatttttgtggccaaacgatgggacggacggacggaccggacgaatttggcccaaccatttgatatgaagcatcaaaaaaagggtaaatatgggaccaaaaacaatcggatgagcgaaaatgagagagagagagagagggacggattgggcggcgacggagaaaaagtcggacgtacgaaaattgggaaaaaagagagggagggaatggccaagggatgggccaagtgcagcttaaaagagtgcttcagcccattggctttatcattctttcattgttgctttgaaaatggctttttgttatttaattaataaaaaattattttagtagcggtatttctttaaaaagcgcctttttggatttgcagttttttcaaaatttatttgaagcaaaaattaagctaaaatattatttgagttgccctaactttccgcttttaatcagctgtcaaatgcttttctatttttaacgaagaattttatgggttttcattttttagattaaattctagtgggctatttttcattgaattttttttcgtccaattatttttgagtttttttaaattccaattttaatttttcatttaatttcgcttaaaagttttccaaaatgtcctcccatcttttgttttccttcttggtcttttgttcgctgctcatttccgccattttcgcctgtggaggtggcccggcactgccggctgaccctttcgacccattgggcccgtggcatcaacgggtaattagctaattatgcgttaattaattcattacgcgattttcgcggggattaagaatgctataattagttagctattaatgataagagtcctcaataaaaagtgaacacatttgcatatttaagcatttggactgtggcattccgccatttgcctatcgactgccgagcggttggttttggcatttcaattttttcaatatcacggtccttaattagccgttccatgtctcgggccaattt

SEQ ID NO: 12124 - DNA, 2280 bp, Heterodera glycines
  misc_feature (1926)..(1926): n is a, c, g, or t
accaaattaaagcaaaaaatttgggcccaaccattttaaagcaaaatgcctaattggggtgaattaaaaaaattagggaatctttccccaaattattcattttgttctgtcccaaagatgcccaagcaaaaatccacgcaatttgggtgaaatatcagccgggagatgaatgcgatgatgagcaggaagcgacgtaagtggggaaaaggatgaaaatgatgccaacgggggaaaagcatgccggatggtttgaaattcgtatttttcaagtcgcgcagtgatcagtgcaattccggaagaggtgagtgatcgaaaaacatttatacaaaacaaaaatgagtgaaaatatttggaactttcctagattctggaaattttcggagatcgaaattatgaatattttaacttccttttatttcgaattttaattttaatgcgtttcaaaatttgattaattaaaatcagccgatcactttttttgcttacaattaggttcgaatgcaaacattcaaaggcgtttgtgggccgggctttttgaagaacgaaagtggcgaagtggtggacaaaattcgccacgtttggttcaacgacgaactgaacgttgagcagaaacaggcggaggcaagaaaaaaagagggagacaaaacgccaaatttaagtgccaaaattaaaaccattgcccatttcagttccgcaaaattgccaaagaaatgctcaaaggcgaatcggttggaatcggagaaatttaaaataaaaaaaaagaaatttaaaattaataatttttaaattaaaatttgtcctaaacccaaggcgaagcgatttgatcagtttgaccaaaaactgtccaaaaacattgcggaacgacagcagacaatccaagcgatgtcccaggcgggccgagacgcgtacaacaaatggacgaatatgcgcaaggaggtggacaaataggcataccgtattttctctttttatccccccggggggattatttttcaacctcctcagaaagggggggggggtaattagacacggggggataaatggagaaggggggattatttttcgacagatttattttctgtaaaatttttgaaatttttgaacatgtcgccaaaaaatgtcatcgcgtcaaaaaaataataattttttattgcatttttttaaagaatttgggaattttacatgaaaaattcgaaaaatgctaaaatattttttaaaaatattgaaaatccaaacccaaacatattttttccgatattttttggaaaatttctcaataaaaattcaagaaaatcaaaaaatacactcctaagactgacctaaaatttaaaaaaaacttaaaaattggggcaatggtaaagttttgtggtttcttcgaaaaattatttaaaaatttaagaaacacattttctaggctggaaaaatgtgctgatcacgaatctgagctcggattttgcaaaatattgattttatctatgatttttatcaagtactagattttttccaaaattttaagaaattagtcgggcgtaaaaagaacacacaggatgttgtagagctcaaaaagagctttcgaatgagctattgaatgtatggagaagtcatgcttttagttatttacgattttttgattaattactagcccttaagggtcatatgagacgggggtctggggttcgagcccgcttggctgtgtttattaaatttttaaacttatttttcgaagaaaccacaaaacttattgccaaaattggtaaatttctcaaaaattcatccctcaaattttttttcttaacaaaattatgtcactattcgtcattattttggacttttcgccattattttggcatttttttagcatttttactatttgtttttttttggaaaaatggtttgatcactcacatttccatttccccccccccnccccccgggggggggggggtaaatggaatttttatttatcaaaccatttttccaaaaaaaaacaaatggtaaaaatactaaaaaaatgccaaaataatggcgaaaagtccaaaataatgacgaatagtgacataattttgttaagaaaaaaaatttgagggatgaataattttgttaagaaaaaaaatttgagggatgaataattttgttaagaaaaaaaatttgagggatgaataattttgttaagaaaaaaaatttgagggatgaataattttgttaagaaaaaaaatttgagggatgaatttaagggctagtaattaaatttcaaaaaatcgtaaataactaaaaacatga

SEQ ID NO: 12125 - DNA, 4124 bp, Heterodera glycines
cgcttggcgcctgagagagcgatcggaaaagtgttcaattcatgtatggcaccgagaatagtcttctcaacagctgccatggctgcgaatttacttcatggtgaaggaaacatcactgatgcagatgttttgctcgttgatgaaagcactcaagctcagtgggcggtggtggttcacctagttgcgcggatgcctaagctcaaggcattgcttttgacgggcgatcggcatcagctcggagtgcatcttcaagaactacctgacattttccactccggatatggattggaaagcgtcatccttcaagcagaggcttcgatagggatgaactacacattcctcacaaagatgtacagaagccatccatttttggcaaagctcatcagctatgcctcatatgaattgcacaatgagcaactcattccagcaagaagcgctgaagaacgctcactcatcacgggctcagattttcttctgccggttcaagaatgtcctgtgggactaattaatgctttctcatcattccgtgtggacccaaaaagcgattcgctcacagatgaccatcaaacagaagtggcatcgttcttggtacaagcacttttggaacattttggcaacgatttttcgtcaagaataatcgttctgtgtatgtacacgtaccaaacttcggaaattgaacgaaagctgaagcactgcggtgttcgtgcactcacagttgatgcctaccaggcacaggagtgcgatgtcatcatcatagtgacaacaagatccaagtattccgagatgggatccggaagaacggacaacatgcacttctttgaagacgatcaacgggctactgttgctctctcaagagcccgccacgctgtcttcatcattggagatttggtttcaataagtgcaggacaagtgtggaagcgcttcatcgaaatggcgataacaagaacaagcgtagtccgagccgagtatgttttggcacttttgggacgaacactcgtgaggtcgtcgacatgcctatttgattcggccaaaagagaatcggtggaggatgaaggctttcttgaaagttgggcattgaagcatgggttgcgcctggaccgaacgaatgcctttggacaacaacaatcacagcagccgcgagctccctcattccaattccagaatcgccactttcctgcactacagacgacagggccctcagatcaagccggtccatctggcaacggtggtcaacaaagaggtgcgcctactttggcaccacagtatggaagaggtcaaggaagacgtggcccggacaaccagtggatgcactacggcggaaacccgaaacgacagaagggtggcagacgctgaactcacatgatgtcctgcgggtctcacttctctccttttcttcaatcagcacggtatgtctttcggtcatattttttttattattaattagttaggtaattttcatttttggcccctatcacttaagcactttatttcctttcatttttctgcactcacaagtttttttttcatttcatccctccctagcttccggtgttcgcaccgtttacgctgtgatataatcagtggggacactttcccaccgcattacggttttaatagatttccgctatttttttttctcaaagcgattttcttttacactagttccgataacaaaattattgtaacactggaacgctagccacgcccattatcaagggcctttaatctaagcatttcacattcattcattcattcttccattctttcgttttactatcctctattttagatactcttgcacaattccactgctaattctcatctcacattcccattccctctcattatgtttcctttctctggtggggatccacctaatcgaagcgctgcggcgtcaaacaatgcactgacagaccctgaggggctctccaatgatttgcctgagttatcagtagttgataaattaatgtttgctggaaagattttaagcacaccagcacggttgtctgatgtggacaagctccatacggacttagttcggactgaggatggtgtcaatcgcatgacacgtcaccttaacaggaagataaatcaaaccaatagggacttgactgaactcaaggatgatactcaaaccttgataactcaagtaaatactcttgcaaatagttatggtacagttcaagtgttgcaaaaccaaaatcagtcaccattagtcaacaaccctcctgtcttaaattgggcaactccctctccactcaggaatccaaataatagctttggcaatgctaatacttcggtggttgaagccatacatagtgaggaagaggatgaggaatttgaattaaatccttcgggattccatcatgttaacatgcttttcgctgaaagcagtccctctttcacgatcttctccggaaattctccattagaattcgatcgatgggcaagaaagttcatggacctgcttgactgcaatggcagaaagtgggatgattctgaaaaggtggcacgcctcaaggcatgccttgatggtgaaccaagacgtatctttgataatttaatgcctgcccacaaagcaacttcttcggaagccattcaaaaaatcaaggaaaaccttgacactccacaaaataaagaactcatctatcaggcactaagcatgtgtaagcaaagggaaggagaatctgtagatgagtttagtgcacgactgattcctctaattgaggccaccacggcggaccttacaactaatgctagtgaggaagtactctgtcgagcatttttggaaaaattgaatccaaatctcaaatttctcactcgaaccctgagtgggcccgtcagaagggattttcaaatattgagaatgaatgcacgggaagcagaaatgatgcatagagagattcctaaatctattccagcacctcttttcccaatttcggaacaacaaaatccgagattcaacaacaccgagccgccgaaccacccggaagccaactttagaacatgggctcccacaggctctaacagagagcctataagtcccagacagaggaaccggaacaattgggataacaatgcccaagcctcaagaggctcttttaacagatcaaataatcatcctcaaaatgacagaagatggaacaatcgcactttcagaaatgaaagacgatggaataatcaaacccctcaaaatgaccgacgctggaatgctcggccagtttgcaactactgtgggaaggttggtcacctcgcgtttaaatgttttaaacgtcgtgaggaatttacccaaccatccaagaatttgaatttcatcagagcaattgatgaacaaaacagattgataaacgatctttcaactaaagtcaatagtttaacttttagaaacgaccaatccgctgaggcggcctctcaaaatataaacactattcaaaaactcaccaaatctagtacagacaaaagtccatctatgatgaatgatactcttaaagcaccctccaaaataagtaattgggaaacgagtaaaatggttcaaccgaaattttttcctgtactaatgggtttgactcttatttcatctctctcttcgactttagttaaagatttcaatacaatcccagctagtccaatgatttgtcaaactcgcgttcaaccaatgccatggtctcttcccaaatttccacgatgccccaggatgtcaattgacacaagcaaaccactaatcaaacaaagacgcaccatctattttcccaattcacttgaattttctaccaaagcctgggcctgtcgcagaattatcaaaagtattcagaaatatactacaatcagtggtgtatctgtagaacaacatcttgactctgaacaaatagtgatgagtcatgatgaatgtctacgaatggcaaacaataagcactgcagcttaggatatctcaaaaatgattcagggttgtggcacacagataggaaaattgaccagacacctcgtccttggttattaggctctttttcctggaagaaagttcagagtgagaattgctttgcctttgaaactgaagtatattcgcacattggtgctacttcaattataactcctgcgggaaccgctcaagctgtccatatgagaa

SEQ ID NO: 12126 - DNA, 1291 bp, Heterodera glycines
  misc_feature (47)..(47): n is a, c, g, or t
tttcttacaggaaaaagctagcgtaaccattgaacatttttatatantttttgagcaaaataaaaatggattttattgctcaaaatgccaatggatttgaccagaaaaacgaatatttggaaatagtatgttttgctaattcatttggtaagtgaataattcaaattttacaaaattcctatagcaaaattttaagaaagccccaatggacaatatgccgaatgaattaatttgaaatggacagacgatgatcaaaaaagtgatcagcttatggtatttcctatttcaacattattttaaatcatatttctcaggactaataaaaaaattttttatataatgaattttttaatttatttggtaggaaaattttaaaaatttaaatgtgatttttaaaaatcatcctttaatttttccttttaaaattcttcacactctcttcaaaattcctcattctcttcaaaatccctcattctttttcgccgctgctcatttggcctccactccctgcaaaaaagattatgatgaaatgcatttatgcacacaatcccccccttcccataccactttggcgcccgcctcttcggtgcgacgctcgggagggtccttcgagacctgggcaaaggaaaaacaaacaaaatatttccttcccatccccccctctctacctcctccacaccaacgcgctcaacgcgcagcccgaaacgctggggcgactctcgccccgtgcgacgcttcaaaaaaaaagaaaaatgctaaaaatagggggcaggaaaggaaaaggcaaacattacctcgcgcaccacgctgaacacctggagagggcgaggcgcattgtcctcattgactccatccgggcgacgaggtcggcgacgacgaatgccggctccacgggccggcatgttcaaaaacatggcccaaaaaatacacaccttaacaccataaaaattaattttaaaaatgaatgaaaatgaaaaattattaaattaaaattaaaattaaatttacctgggcgaggaaaatgaagaggaaaaagatgaacaccatgctgttcacgcatcccgtcgccttggcaatgttggcgttgttcaactgctgcaccacatcggtgaggttgatcgagacgttggcgttgcagggcgccgccaacaagtgttcggagaatgatcccaaatgagcggtgttcaaacactcaattggtttagtgaactcctccgggcggatgcaaacagcatccgcacggagggaggaacaacggtcttcaatgatccacgtgatgatagtggtacgg

SEQ ID NO: 12127 - DNA, 1670 bp, Heterodera glycines
  misc_feature (1619)..(1619): n is a, c, g, or t
cgcccggaggcaggaacaccgctcttcaatgatccacgtcatgttcgtgggacggagaatggagctcattgttgatcagattgccaaaaaaaatggggaggaaattcaaaaaaaggataaattcctagcgatttcaaccccttggccattcccacaaaaatgctatggagaaatgattgtcggatggtcaaataatgaaaggagatgcagatgatcagtccatcccctctggccatcccccttccccctcttcaagcccccctttcttacaatttccaacttttgttcggacattgccgccttttgtcatccataattttattcacaacttttgtcaattgacccccccccccggtaaagcgccgatccgtccgcttattcaatgcagagaaatgcaaaacgaagagacagcaaatttgtttgggacgaatgagagaaaaagaaagagagaaggacggagagaattcacacacacactccgtccacttcaccctttcgctttccacacccatcggcgcacagatggcaaaagaataggaaaaagtttgcaccgccaccacccccccccccctttgttcgctgaccaacagccaacgccgtcgaaatgtagaaattttattaataaaattacagtataatgagggaaaaattttattaaaaaatacagaataatgaggaaaaattttttgttaaaaattacagtataatgaggaaaaagtgcggcaaaattccacccccgcacccacgggtttaaaaaaatttttttaaatacagtaccccgaaaaaaatgcggtaaaattttgcgcgaaaatgggccccggacacctgccggtaacagatgttttcacaccctctcaaaggtgtgaaaacatgtgttttcacaccccccaaccccccaaacgggccccgggccataactactcataataaacaaaaaaactgatttacatgagtgctaacaaaattttatttatcatttattgctcattttgttctgataaaaagctccaaggctcaagaaatgaaatttttcattaaaaattaatattttttggtagaaaaaggcattataaataaatagtatatgcttttctctacatagtgaagttgagccaagtgtccagaggataaaattatctttcaccaatgctaatgaatcgatttggtgcccaattccttcgtccatcgacttaagctggaatttggaatgccaaattcattggcaatttttctctcacttatcattggattttttattttcatttcctcacttcttttcacatattccaatttctcagcatctgtgtaaaatatccttttcgcttaaatgggaccaaattaattgttaaaatgagatttttgaaatttttcaaaatttcaaaaaaacaatgaatttagcaaattaagctataaaccagcgcacttgtaccgaagctcaattatcctgtactaaaagggccatggatcgactttactgatttttagaaatagctcacccaccagtagggatgtcaaaaatatgtacaaaaagtagtcaaaatatgtatataaatatgtaaaaaaaaaccaaaatatgtaccaaatatgtataaaatctcgaaatatgtataaaaccccanaaatatgtaaataaaagtcccgatttttgttgcaaacacagaaaataaagt

SEQ ID NO: 12128 - DNA, 5865 bp, Heterodera glycines
  misc_feature (48)..(48): n is a, c, g, or t
  misc_feature (164)..(164): n is a, c, g, or t
  misc_feature (5835)..(5835): n is a, c, g, or t
tttttcattagcctttttaatttcatacttatttggaaaataaaaagngacacattgaagatgtttaaaataattatttatattattgtacactgacaatggtaacaaattaggtcaaatgttaggcttggattttacaaaaatttgaattcgtcatgaatatntaattaagaggaatattggattatataaattaggccagatgttaggatttggtgtaccaaaatttaaattcattgtccaaccgattggtacatatttaattaggaggaatatttgatcatactaattagatcaaattcgcagcttgggttaaccaaaatttaaattcagcgtccgatttgtgcatatttaattatcaaatgcgcggcttgggttgatctaaatttgaattcgtcgtccgatcggtgcatagataattagggaatttttaattttgcagatacatcaaaattttgtcggtattaattaaagcaaaaatttcaaatttaccgacaacacaaaacaatgaaattgggtcaagaattgtgattaatttgattttttggatataaaaggcagtacgaaggtttaccgttcataaaccaaattcataattccctccaaatattgtttttatgcaaaaataaaatatattttaaatagattcattcgcctcccaccctgctcttttcgtttcttaaaatttttcacatttactgtttgcattttctatattgcattattccaaaaaatttaaaaataaaatttgtttagcatttaccataaactaaatttatttattccaaattttaaaaatgtctacatcggaatcaaaaaatggtaaaaaatatacaagtcctcccttaacattaacaatctttcacctacagtaccggacgacgtcgactgcgaaatgcccgatgaacgtgttttacacctcgaatgttttaaaagcggcgattatggtgtaagtaactgtgatgaattccatataaaaaaattttttcctcaattttaatcagatgatggaattgtacgggccggaccgtgctaaagagatgctgatcgatttgcgcgactatgctgaggcgtacggaatgccatgtcagcatgtgaagatgctgttgtacaaaatggacaaaggactgatcaaatggaagggaaccaagccatgaaacggatgatgagtgatcagagattttggctactggacgaaaggggggataattgaactcattggtgctgggggtgatggatgcgatataaaaaaaaataaaattgagataattgttcaatgtttgttcatcccatgattggtcacacggggctcatttctgagcgcccatctcgccaaaaaccgctttgtctttacaattttaaaatgggtgtggcacctggcccgacttttttgcgtataaatacgggctcaccggatggcaatgttcatttggcatcccattttcaaattcgctattcccatggcaatcaacatctccgacaaaaaatcgttgtgcaaccaaatcctcggccaaacggacctcaccgtgacctcgagtttataaccatcagcggtccacgcctctcgacaccccgcttcattccttttgatgaagcgggccgttgtaggtgttgtaagggaacggagtccgaaattgacactgtgatcacgaaagaaggcatcacgctttggtgcacccgcatagagaaggcccaattcatcccgttcgatgttgtgtatgatttgccgggtcattgttttttccgtctgaaaaataagtctcgtgtgttcaatataccctatggcgacataccctcttctgacacgcacaccactaaacgacggacacacaccaatgaccatcaacacgagctgaagcgcaaagcaaaggtagctcttgacttagtggaggccggactaatggcagatgccatgcaggacggcgcacgttggaagaaggcgaaaacagcaatcaatgtgctcggcaaccttcttttggcggaatcattagacaacacttccgctaatgacacttcgctgaaaaatgataccgtagacatcaaaaaagaagaagaagcaaatatggaggaagaaaaggtgcaggaagagcccaaagaaaaagaggaaaacaaggaggaccttggagacattgacaaaaccctcgatgagttcttcaacagtattaaagcatccacttcaaacatgtagaccatcattgtgtgtaaaaatgttaaacacccaagcattcaacgataaagacattggctttaaattaccatttggtctaattatttcgggcccatcgtcgtcgggaaaaactcaatttctgctaaaattcattgccgaatcggaccatttaatcaccccaaggcctgtatcgatgctctattgttttggtgaaatgaatgcggcggtgcctgtacttcaaaaggcgggagtcgatgtgtacgcgggagtcccatccgaggaattaatcaaacgtctccctaagccccttttgctcattcttgacgatctgatgttgtccatcgatgagagatacctatccgatttgttcactaaaaaggctcatcatcaccaatttgcagtggtgtttgtcacacaaaatttgtttgagcgcaaaataaaagtggcccgtctttccgctcagtacttggtactgatgcgggccccaaattcgttactgtccatccgcaacattggcgttcagctctttccgcgtcagcttgacttttttcttgacgcataccgcaaggcgaccgcccggccctatggctatttgttgattgacatgcatgcatcgtcggacccatcgttacggctgcgaaccaacatatttaaggatgaacaggaggaagatgaaggcacagtcgtgttcattcccaaaaatggagcggcataaccaacaacaacaagtaagggttggacaactgataaaagaaaatgcgcattggctctgtgccttggcccgaacgaaatcctccaaaaaatgtaaaaagttgattcgaatggcaagcaccgatcagctgctttcacttgtggaaatttgtttgaatctcgtcgcttcgcgcttccgacttacaactcgacagaaaaaacgattaataccctatgtgagcactgtacgccggatgagcagaacgaaaagtgagcggggtgccaggcgcgtacttgtccagaagggcgcaggatttggcggattgttcgctgctcttttaacacccgttttggttgaattggcaaagaatgtcgtgagcaaaaatgcataaatacccccacatcattattgttttttcatgcaccattcattcatcattcatggcaaataaatttttacttgtccctcaagaaatttaccggggtctcacctccatgtcggacacgggcgatattaatttggatgccgttaggcgtgacttagaccgcgccagggtcgtacgaacacatccttctcgcaaaaatgtcaactacaaccagcagcttaggcgatatttaaaaatgcggcaagagttaacagacaaaccggccaaagttgagctcaccaaagggataagcgtgctgttgaggcgaggcgctgaagatgaggagggtgaagttgtggacactccaccccggcctcccgctcctccaccaccacctccgccgcctggacgacgtccatggcgtgggccaattcctccaccacatccaccaccgccgtctaagagaggtcatcggcgcccaccaagtcctccgggtcgcgctccatccccgccaggaagtcctccgcctcgcccacaacgtcctcccagaccgactagggcatcgcggagagatggtcgtttggagcagtgggagaaaaggcgaaatgatatacaacgacggcaaccagttgtgcgggaccttcttgcggaagcagctgctgcccccttaccggaaagtgatacagatgatgattatatgttggagagtgggttagcgctgccagcgccatcacaatactatggcgacttgcctgtgctgccctacaatgctcaacgtgaaattgagcagatggacactgctcagcagaggattgccatcagaagaaaattaaaaaaggacgaagcatatgatgatgatttggaacacaaaaaatacagggttcattacccaccttcacctccccggcttccgctcccgcctcgtgcgaaagcaaaaattgaaccaccaccatcacgtcctaccgccaagagagagcctaaacaacaaaagccaacaaagtttgagctaaaaccatcaaaatttgactcctatttacgaccaaaagtcgcaccgccgcctcggtcgaaaaaagaacctgaattcccgcttgaccttcggccatccacatccaggcaggctggacacttgcctcccccagcacccaaaattataccaaaacctgaaccgacaaagaggcctgtgccataccgtatcccgaaaagagagccaaaaattgttgaacaacagccacagccgctgcaacaaccccttcctgcttctgccgtcgaagaagaaatgcccaccgttcctccgcctaggcgggggaccaaacgccactaccccgtaaatggtgagaatgatggtgaggtgcgcattagaaaacgcgtgaggcaagcgcgaagggtgagagtacagtactcacccgaaccgggcccatcaacttctgcacaaagggatgagcaacaacaacagcgtgaactgtttgccatcccgtcaaatcagctgaccatgaatcagcgggttgaacgactgtacatcaaatgcaaccgttatgcggatcgtatgggcgttcgaggaaatacaattaacacagcaaacggcaagccgttggcacatagcaatttgcgaatgaccatcaggtatataattgacaggagagcgggccgccctaccattaagccacctggagcggccatatttgaagagaggcttaggcaagatccaattttgtattcatggacggctcctccaaagaaaacagcacagagcaaaacaacccggacgccgcagacaatcaagaaggaatttcgcccgaaaaagtggagttgatcaactccacgcttgacaagctgtacaacgacccatcctccccagcggcgttcgcaggtgttacagcgttgtggaaagaggcgcgaaaaaagttgaaaaatttacggaaaaaggatgtgcagcattatttggaggggcaccgcacctacactctgatgcgcccccgaagggtgcgctttccaagagccaaaactgttgcggctgggttcatgaccgatgttcaagtggatttggccgattttcaggcgctttcgcgccacaatcggggtcaccgatacctgcttgttgcggttgatgtgctgtccaaacgcctgtttgttgtaccgctgaaaaacaagagagccgacgagatgttggaggcattcagacaactcatcgaccaaatgccaatggtccacatcgcatcttctccgacaaaggcacagaattcaagaacagattgttgaaggaattcttcgatgagcaggaaattgagaagcatgagtcagtgcattcatcagtcaaggcatcggttgctgagcgggccatccggaatgtgaagcagcgactgtaccggtattttgctcaaaaggagacgctgaattgggtggatgcagtacagaaaattgtggacggaattaacagcgctccaactcgtgttcacgggatgcgccccattgatgttgacttttcaaatgcgcagaaagtgtggaagcgattgtacggacaccctgcccttcaaaagcggacgccacgcttccgtaaagatgaatttgtgcgcatgagcagagagaaagggcaatttgagaagggatatttaccanaattatggagacgaaatcctggagattgat

SEQ ID NO: 12129 - DNA, 1392 bp, Heterodera glycines
ctccctcgccctcctcctcgccggccgtgtccatctcctctttatttgtcgtggcggtgaacagttgcgatgggtaacccaaattgagcggcgacggcttcgattgatgctttagggtggtcagctgattgggccgaaaagagagaagggactgagaagggcattttgaagctgaagagcatttgagcaatgtctaaacaaaggcaaacgaatggaaaagcgaaatttgaatttcaaattccaattccaattcgcccactttcgcttcgcccaattcgcgtgaaagtctgtcgcactctctgcgcaattcgtccatctccgtctgctgtttttggagcccattttgttgctccatttgtcggctcgcagctgcggctgcttcgcgttcgcgtgttgcctttaagaaaataaaaatggttttttttaatgcaagatttaaagatcacaaaacacaaatgccaagggttacgcggcttgggcgttacccttttaaaaatatttcaagaattttaaaaacacgctttttagctattttccttaaaaaaacatttcaaatttggtcgataaaatgtcttaattaaattaaattttcgaaaaaaaaattccggcggcgcctagcggcaccatcagcgacggactccttctgtccccatttttctttttaggaaaagtatgccgcaaaaaaagtagcccgaaaataactgctgacaacgagcaagagagcacaaaaaatggtcaatcgcaaaaatagttttacctcagccccaaaattccttgaccctcctcccccccccccccgggggcttcgccctccatttgcctgcaactctctccgcaactcagtccgcagtgtctcttccgctcgcattcgttccgcgtgttcccccatcattcgttgcctttcgctcgcccaccgttggcgttgcgtttgctgttggtcgtgcagcgaattgagctcctccagcagtgttttcgagtgcaattgcccactgcgcaactcctcctccaaaaaggaacattttgcactgaaagagacgcaaattaataattgccaaagcaaagggagggagagggcatttggaagccaataaaaaggaaattgagtgaatgcgagtgccattggcttgccttaactccgccatttgtgcgttacgtgtcgaaagcgtgtcgaacaattgctgacattccgaagacaaagcagcgccaccgccaccatttgtcgtcgccgcggaagtgccaacattggattcggccaaagcgaactcggcacgttccttcagtggcgattataaggtggaattgcatttcccttttgcaacaaaccttgtacgccgcgaactcctccttaagacccgccaacatttgcgcgttcatttcactgtccgcgcggag

SEQ ID NO: 12130 - DNA, 2235 bp, Heterodera glycines
aataaaattgttaaaatgttttttcgtttgtttctctttgccttccatttgttgagttaattcggcaatttgtgcatttttggtgcgcaattccgagtttatttcctccttttgctgttgtaattggtcaatcctttgggaaaactcctaaaattttggggtggaatttatttcttgtttcttcagttgtttttgctaaagggtcacccatttttaaaagtttcagaattaaaatgggaaaatcgtaaaatatttaaacaaaattttgagtacattcagaatcagggtgaaagtttttcaaaataacggaatttataaattgattaaattttaaaaatgcaccaaattttgtttgaaaattattacttttgattttgggatttggggcaaattctccctccccctggataagcctgtcttgtaagcccttttctgattggaatttaattccaccaattcccgtctccgtttgtcattttgtccacctcaacaattgcttccttctcgcccattttcgtggcattgtccgccaattccttccgtgccgcaattaacgcatttttatagtccgccaattccattgcgatcattgcgtcgcctttgcctggagcggagttcgagtccgacgacactttgacagagagttggcgcatttggaccgcgtattcttcggactgaacaaaaaaggggattaataggctaattgtggggacagtctttgcaaatgccctaataatgacaattcgttttttgcctcttttttggcctttgtcagctgtctgcgagtgtccttcagcatgatcagttgcttcttcgccaatttgaccaggtcctcgcgagaaagcaaatccaactgaaaaggcgccgttgggcgatggcaccgaaaaggcaaaccttcgccaacgccgtgccgccgccccccgtgccgtgctgttgctgcaccggcacttcgcctggttggtccttggccattggtccgtccccgtccttttccttcgtcccgtcctttcttgactccgattcattgtcagtttcatcctttggcccattcattttcggcggattaatgtccatttcttcgattggatacaaaacaaacgaaattaatacgtaaatgtgagcctaaactttacattcaaatcacatgaaaatcatttagtaatttatgtatttcttttcgcagtgactaaaacactttttgcccctttttttgcttaacatttgaaattttcggtgcttttcttcgacgaacaaatgaagcaaagctaaacacacaaagagagaaacgcacaattattatttgggttttcttatacaattttgttgagtgagaagtgaacaaatcgtcacaaccacgggaatgtaaacatccgaacaaaaataaatggcaaaaagcagttaaaatctaattttaaatgcaataaccaaacaattttgtgacaatttcaaaaattggatgttacaaacccctgaaaaacttccattttacagcgagttttacacagggaaggaaatgaagattaggacaacacgattttgggagtaattttctaataaaaatttgcagaatcgtaaatgtttccgtaatattttttggtttagtccaaaatcaaataagaaaaaagtaattttaggaaaatgaaatggggagatgaaaaagtgcaaaatatttaaggaaattgacgaagatcggtgccaaaattcttcaacgtgccgtctttgagtgttggatcagccattgcagagtgatatctgaaaacagcaaataaatggcggatgccaatgacaaaataggatttgaaatcaaaatagtggcgatgtttatttgtaatttggtgccgtaccaatgttcgacttttccttgcaggagatggaatagcagcagatttcccggttttggatggactcgagattcatcgcgtcgattagttggccctcgtcgagagcgtcgggaaggtcttttttgttgccaagcaccagcacggggatggcctccaattggggcttgctcagcaattgcatcagctcacttttggccggctcgagtttggatttgtcagcagcatcgacctgaacaatgacgaaagtgtcgtgatgaaagtaaaaatggccaccaaaatgtaccataaaaacaatggcattcacaccgcgacagtaacgctcccacatggaacggaagcgcggctgaccgcttgtaagccaagagcttaaaaatttggggagggattaaatgaa

SEQ ID NO: 12131 - DNA, 1552 bp, Heterodera glycines
aaaaatggcattaaaaaggccaaaattgacccagaattttaagggaccggaaaatggcattacggccaaaaaccaacccaaattggataacatcactctgaataaaaccaagaagtattaacattccatcatttatttcattttttcacagacaaaacgccaaatatttgataacaaaatttgaatttctaccgtagaggggggaccctgttgttttcaaaattttttgtcaataataagtcgagaaaacttctttgcattgaatttttgagatagttgattaaattctgatatcttttttaatcaatttcccaatttaaaaaaaaacgaaatttgaaattttggtttttcgcctttttcgagtttgggttaagaattggtcaaaattggtgtcaaattcgtgatcagagatttacttgctgtgttttttttttgtcttaagtacccataattagcttttcgttgtccatgggttttaaagttgcagagttttaattgttcattgaaaggtttcctttttggtacctttaattgaatttttcttttttaaagtgtctattaaaatggctcattagcataattttgattggcattcgctacgccaattgtttcctttccaattacacaaatgtcttttagcctttgacatcattcaccgtttgtgtttgtttgcgtttcgcctttttttggctgaacgacgccacaaaagaaaatggcaaataaataataattattataaataaataaacaaaaaataataattatcaaatgccaataaatgccattgccccaattatttcgccggcccaatgttttatttgtcctcggaatttttatgtaaattgttttacgcaaattgccaaaatagcagagcaagtgatgccatttattatgcgatacttttggcatttcgtcggagtgccaatgctataaaagcaacggccgtcgcaggacaaaagcgcattcgaacactgagggcccaacttgtgtttatcgtatctgcattaccgtattcttaccattgaaaaccctaaaatttttgcagtatttttttacatttgtttcttaattatttatttcccttttcttaatgatttgcataattaaatgattaattctctatgatataaacagtttaaattatttttggaagattaattaattactgcggtaattttattatgtcaaacattttttgtatttcagcatcttttgtctttaccatattttatgtattattttttaatttttcttcctgttataatacagcctttttggcattcattccaaatttggcatcttttattggtttgtttttcggcattagtcatccagtgccaatttcgtcctcactcactaattaatccttccggcaccgttctctcccccggcatttcccccaccctcaaatattctccaaaatagcgtgagcttcggcccgctttttctttcctgcgcattccggtaaccaatgaagcccctttctcccccgtcccctcaattcctctccgtcccaatgtttcctcccttttccgttaatttcctttttggc

SEQ ID NO: 12132 - DNA, 4303 bp, Heterodera glycines
  misc_feature (10)..(10): n is a, c, g, or t
taaatctttntggagaagttagattttaatatttgtgcacggtaaaataaaaatataaaaatatacattcatcttgtggtgctctatagtttcccgagtcgtacgtacaacaactttattgaaataatatctattcattcattgattttgatatattttttacctcatctttttataatttaaacttctatcattttataaaacaaattaaatcatatgaaaatagtaataaaaaatttctaaaatctaaatgttagaataccacaaattaaataaaataaaatatatcaaacttaaagaaatttcatttgtatattttcactaaataaaaaaagataactatgcttagtatgcgttataataaattagaaaatcataataaagaggaattcctaaacatcgaattaattaagaaatcttttgaaacagtgttgatcatttataataattattgtttgaatatcaaattagaattaaaaaatcaaattaaagccaaaaaaataattttaaaaataaataatcttaacttaaaaaaatgaaataattaatatctttcaatataatcaaaattaaacttaaattgtccttgatatcattcgaaagcctaagtgttttctactatcctgagaaagtttaaaaaaaatttaggcttcatataatttatggccaaaaatgtttgaaaacccggtttccttgtgtacttttggcaataacttttctcaattgagcaaagttatggatagttttttgttgaaaatgttccattttaattggacccaggcctcgtacttttaacaatgagcatattatcactttactctgtgaaattgaaactacaattaatacacggcccatctcatttgactctgctaatcctgctgatcctcggaccctccgtcccatcgactttcttcgcccgttgggtttctttccgcccattttttcgaacctttttgaaaatcctaatacaccgcaaagagactcaactgacagtaccaccacatcattacgagatttgtggaaatcaatttctaattccctgaattcattcaagtttaaatggactaatgattaccttctttcccccagagaacgagataaaaaaataaaaactatttccggtcatataaccaacagatctgtaagtcatctctacccgttggaaaccgaagatgaatattgtaaccgtaatcctcttaatcgtcaaaacactaccacaaaaatataattgggcaaaattccctcccaatttcaaacctaacccggccaatgtgccaccatccccccccccttgtgccaaaacataggccggaaagaaatggacttgggctctccaccaccactagtatcacatcactgatttaattttttcttttgcgacgggaggatgctaatcgcaatttttcccacggcttattcggccgatcacggcctttataacattaaaatttccattttcccattaacattgttttatggcattaaacttcgtttgtttttctcttcttttccgccctcgccttaatcatctcctctgtcacacgctttctttaataaattttttcccgattattggattatcatcttacaatcactgcgatccccaccctatataagaagctcctataagcaaatccaataatcatcaactcaaccattcagcaatgggaaatatcatcgcgcttgaattggcatatcatcagcatccaccagaagatacaacttcccacaacttttggtttttcttcgtcattatcaccatgacaatttttattggagctttgatgttgtttgggatttttattttccgtaaattttttcgtcgccttcccctccctaccaattccagcaaccagcccaaccccgggaatgtacctgatcgcccatactcaccctcgtcaatttccactgtttatgtgattttgatcttgaccctcgttttcctgtcccatactgaggcacaccccaagggaaaaatgggcaagggaggaattttaaaaccgatggcaaaagggtcattacccattattggcacctcggccctttattttggaatggacgcactctttggcaaaaatgaggaagaaagcagcatccatccatccttagcataatttgcgtttattggcttcgtcaccctttttgtcctactcatcatcattaaaattgtcaattatctacgctataaaatacgcccgctcaacaaaactcgaaccccgaaacaactcctatctgtgttagtaactgccccggacaccattgttgcgccacaaaaatttccggatgccggtgtgttatatgatttaattttattataattattggcattttgtttgtgtgcatgtctgtttttgtctcccttttatcttattgatttgtaactgacttatgccctttcctcattcattgagttgttgttggttggtctccttttggtgtgtttgtcttctgtaatgttctgttttacttgaattaaagtgtgaagttgttgtgaattgagttagttttcttgagtgagagctgttttttatattacgtggcgctcctggcttctgggacaactcactgccattgcttaaagaccgggaataacgccgacgacggagctcaaagactgaggctgcaaataaaagaaaatttagtcgagaatttgtcgaagttgctcaaagactgaggataacttcgccatttgagtgatttgctcaaagactgagaagcgaatttgttgaaattgcagacattgttggatttgaattgaaccaagacggttaccgaaaaatgactgcagtgcattcgtttttgagttcgaattcgcctttgaacgtcgtattgggaggcaaccgagggcttgaaaatgatgctgtttggagacacagtgaaattttggatgaacgagaaatgcgacgccgattatttgcagtgagtgccaacaacaacaacctgctcagatgtatgaaagaggagaataaacgtagagagatggaacgaccgattcgatcgaataattttctgcaaaattttgaattgagaaatcctaacaccacggcatttgctcaggtgtaccctcccgttcatgaatcggcacctccaccaaattttgatcgaaatgaaggacaaatgcagtacacacaaccgcgggtcgacaacaaccaagacccgattttcgtgcggcaaattgcggtccattcgaaattaaccgcaaggcatatcacagcaaatccccaacatcatttaactatgttggagaatgaagcttctcaaggccaaatttggcaaaatgatcgaattttggcccatgcaatcaaaagtttggacaatttctcctattcgatgacattgaattcattgccagaattgaagggaaattcgggctcagatcaagtgagatcatttttccaacgcttcgatatcgccactgaggaatggcctgaagctaaacggctaaacgcacttcggtcgaagagttcgggacgcgttgagcgggcacttaatgttgccgtcgcaaacaatccatttcagtacgaattcattaaacgagcattgattcatcagcttgagtcgacagatgcgcgacatatgtcagcttttgatgaattaatgaatggcgtttttcgccggaataacgaagccattgatgactgaaaccaaaaggaggtgttggacaaattctgatcgaaagcggaagaaagttgaaaagaaaccatcaaacactgcgacccaattaaagaaccgaaatttaagtaattgtggtgagaaagggcacaaaaagttcggcccaaaagaacaggtgggaaagaaattcgaagcgcaaaatggcggtggtggcaaatttggaaaaagcggaatgattttttccaagggcaaaaatcccaatgttcaattagggacaattgaaattttggaaggtggggaggagttgaagaaaaaaaggattaatttggacagaaatgatcagcgagaaaaaatcagactaaatgtctcaagtggcggatctcaatcgaatttaggaaaaaatgtgaaaacatttttgaattcttttcgacaaagaagtggttttgggacaattagagcggaggctgatcattggatgattcgaagaaaagtgccatttgatcggggttgggtcgagttgaccgcctcgtgtccgggcccgacttcacattctgcttgtgatcgaccattattgcgcggacttcgatgcaatagcagtgtgctgaatcccagacgacatcacctttcgacagccggatgcgggatgtgcagatgatcggcagggacgcctctcgtcagcggccggggatgt

SEQ ID NO: 12133 - DNA, 1492 bp, Heterodera glycines
gagagctgttttttatattacgccggctctgatgcacccaccgacgaaatttcttcattggccgttgatccctcgaacatcaatgactcgccttcaggtcataattggggtgacagggaaatccaaggaaacccgaatcccccgaaatccccctgcgccccgcttctttccgcctgccaaccgtgcccttcctttgagccgcactttgccgttgtccaactgtactcgcccacaaccttcaccaaaatctgctcaaatcgaacgaacggcgatggtcaaccggacccgcatctcggaaggtggacgaatggaagaccgttgccaagttcgggaagccaacgccattgaacaaaattcgattcaagaccccaccttgtcccatccccccatttctggctgtttccctggacagtctctccacgtccattcacaattccgcgccggcagtgtcgcaaatcgcgacagaggagagggtcctggtaattttggaacacaaaattgttcatacactacagtgttaatgtattgtgatgataaaaactttatgatttaaataattgtcgaaattattcgtcgtgcttagatgaaagatgcaattgagtgataccaatattttaaaattaggctcattataggcgaaagtatgagtaattttctgtccaaatttttccatttgattaagcattttaaaatttgtctcacttttagattagtatattacgtaaaaattaatcaaatcacatcattaatttattttaacgtcatgaaattgttaatattctaaatggtttttatttgcgttattccttgtaatttgtatctataaaattttatttagatctcacgcaaaaaatacagatcaatgtatcaagtcacagatccatatagaaattgtttttttctgaagtattgcgtgtttgaacagttatctatttgtcaaatatgtatctttcaatatttttcatctgctaattaaaagaccatatttatttatggagtttttatcaactcttattttaaaattttaaaattaatattttttcacatgtgttcattaaatagggttttatttgtttaagtcgcttaaatttattatttggacaatcaataaaaatatttataaaaaattttcgaaatatttttatataataatttattttcgtttataaaatattatgttgagtaaggttataatagagttttaatagcaaatctaattattcattatctttaaaagttttgtttttaaataattaatcttaaaaaattaattttttttaaattgaaatcctgaaaaatattatttaacctaaaaatttaaactcttctagtagatttattgcaatcacttcagttaattagattagctctgattagactaaactttgtacatgttgtcaaaaatagaataaatattcaaattatgttttagaacaattaaccagttttagaggtctattatttgctaactccttttaaataaatgaaataa

SEQ ID NO: 12134 - DNA, 872 bp, Heterodera glycines
ctctctctctctctctctatcacttctctctttctttctctctgccctccctctctatcactgtctctatttctttgtctttgtctctctctccttttgtattttaacttttgtacaattagtgagtgcatttggattcgtttattcctaatgttattgcatcagttcgtaatattgttgtattattattattattgtagatttccttctcccctctcccctcgttgaatcataaacttccggcaatttttgattcccatccgtccggatggactctctttccattcctgtctcttccgtctcttccatcccttctgtctctttcttcgctaatcttccttctccctttttactctcctccgtttttcttatctctgatctccattttccttctttgctacacacattccacaaactctcgacgaatgctcccatctccgattttgaatgaatgaaagaaagcacacctttttgcttgaggagcacaaacacaacaaaaatggttatgggaaaggaaaagcgtgaaaaagggatgagagggaagaggagggagagagagaggggagagagagagagaagggaaatggctatctctgaaagtcactattaaatccctaccgggaattggacaccaacttttgtcttctattgtagcggtgaataaagcactaatagcgtgtttgaaaacgcacgaaaaatagttctagacaaaaaatggatatcctctgaaagtcactattaaatcactaccgggaattggacaccaacttttgtcttctgttgtaccgctgaataaaagcactaatagtgtgtttgaaaactcacgaaaaaatagttttttgaacaaaaatggctatctctgaaagtcacta

SEQ ID NO: 12135 - DNA, 2989 bp, Heterodera glycines
  misc_feature (12)..(12): n is a, c, g, or t
  misc_feature (2932)..(2932): n is a, c, g, or t
caacatcaaacnggattgggacgaataaatatttgcaaagctggtagccggacttaaatctcatcaatcccctcctattcaacacattgcatattcactcatcattcttccgctgtggccaattctcatcccccgggggtgcctttgcacttttggccattgttttcatttgtataataattccttttgcttccatctctcccaaatcgcaatccgccggccctttttcgcctgattttccatctcgagatgaatgcagccaaaaagatccttatctcctctcccattttgtttcctttgtttttctctcacgcattctcctcctttcgtctgttccctcatcactttgcagctgctatctctctctctctccccctttttctccctctctctctctccccctttttctccctctctctctctccccctttttctctctctctctctctctccctttctctctctctccctttttctccctctctccccctctctctctctctgactcattcattttctttctttcctcgccatttccatccctccgtttcactaatcaccgtttgtttctcgctcacttctccacatttccatgcttttttctgattaaacatttagcacaattagtaaacccttctgctgctggtccagaaaatgtcatttgattcgtcattctctcggattgacagaatctaaacaccgtcgacagcacaaaaagggggggggggggggggacgataaggctgtgtcgggagtgtccttctcaaattggcaaaaagctttccgtcctatcgaattttgattgctcaccgcccccctcataaatatttccctcgtccaattgcttcgcccctcccctctcagtatttttacggctttttcttcgtcaattttaccaaatttgaaaatgcgtaaagcagcaaaaaattcctagaagaaggagcatggctcaagtggagaatggaatatcacttagtaaaagggtcagtgagattctttttctccatttgctccattcgcttctccgtccaccgccttcggcaattattcaatgaggacgaagtaatcgtcggcactttcggtgcctttcatttaaatgtgttttttatggcaaagaatgccaatgggtcggttggctgcatcagttgcaccccaaaaattttcgggtcaattttgacccattcatttcttttttgaaaatgaaatccttttaacaatggggacggcacaattggaaatggttgacgatcgcaccgtacgacccgtggtgaaatacggcacactgttcaactggcgtgtgcttaattttatgaaactgatgaagttacccaaagataatgcgaagatggagtgaaaaagatgccagcggcaatttccgcccgtttatatccgatgatccgttcaaatttgacacagacgaatgattggatttataatcatttattaatgtatttttgaagaaatatttgatttattttgcaataaagcccggatgggctgaaaaaggcacaaaaaatgaaaatcgctacatattttaaagttttaaaataaatcatttgcaaaataatattgtccaaaaaaattcgcggcgattgttttgcgcaaccatcaatgttgcaatttgactatgatgtgtagggatgggatttttaggcaaaaagctatttttttctgagctccccgtggcctgaaatgcacgaaaaacatgtttttttgggctgttgttaagctacttttcgagttattagtgcctattttctaggcttttatttttagcgcctaaaaagcctaaaaaatgttgaaagaacctatttttgcctattttggcgttttacccaaaatttgttaataatagtgcaataaaaacgaaaaatacacccctaagaaaagaaaattttttaaaaattcatctccaaaatttatttatttattttcttgacaggaatgtgatttaaaaatgatttatctcaatactgagttggcctattttttttatttttttaaaatacattttgtcgttttacacccctaaaaacgagtttttttagtgcctattttccatttttagagcctatttttggggttttttagagcctagagcctacctattttggcagtttttagagcctaaaaatcccatccctaatgatgtgcaaccacagcaatttcaatgcgcgatttgcaaccgcggagttatttttggcgttttgaacattttgtctgacatttggtttgggtttgatccattatgccaccgaattctctctctctccaccctggcagcatttttatccacctttcttttatttctataaaatgccattcctcccaaattgccaataatattccatttgaatgactactgagcagcagaaaagtgctgtcccattgactgaactcctttcctctggccaatgcgctcgttcggcatgggctcgcaaatgccaacttttggttttggagggtgaacttagcaacgggttggaattgcaattggtcgaatttgatgtggcactgaaattcaatgaggcgaagcctttggcgaacattgcgcagaaaatgtcttaaattataccgtttttcattgtttttttctaatattatttttagttttcaaacggacaaatcaaatgagaaagtgcggcaacgaattttccgacttttttcaattttattcgaatgctccgacaaaaaatttgtaaaaggtttttgggttttaattgttgttggaaactgaaagttaactgatgaattactcaccgtcacagaattggtcagcgaattcaccatggacactctccaagaaatgtttttcttcgcttttcccgaccaacgaaactccaccaaaggcagtcttcaggtggaatgaccgttgcttaacatttaaaaggtaatcctccggaattggtgtcctgacgggaaaaaaaagaanaatttcctaatttttgtagaaattcttggcagtaaaatccaattctaaatcactacc

SEQ ID NO: 12136 - DNA, 1008 bp, Heterodera glycines
  misc_feature (941)..(941): n is a, c, g, or t
cgttttggcattgactgtctccgaaaattggaagaaagcgtccgaaacactcgaagttattgcgaaaattcaaaattatactaattacccctcaaatcatacctaattgcttctattttggtcgttttttagcatttcgaacaaaaaacgggcgaactctccgccgaagagcgctctttgctccgtgttcagcaactgcaaacgctgatcagacttcggcacctcccaaaggctttggcactttgcattgaactgctcggacaattcgtcgacttcagtcaaccggacaatgctggcgaattgcctcccgaattccctctctccgtttctcgagtattttgccgaaatatttcctcctcaaatttccgtgccgttcgttccccaaaggacactcattggattctgctctcccaccgtgttcatcttcgtctgtttctgctcctcctcctctttcacatttgttggctcgcctttgcgaaatgcgtcgcccggggagtcaaagcgacggccgacggcacagaaagtgccgccagcagtgccaacctcttctttctgtcgctgattgtgttggcacagtcgtgctgggcccactttggcttcggactgttcgagcagttgtgcgaacatgtgactgctgcggttagaaattcccttctcaattttcgtgctttttccatggcatttttcatccttttttaaggatcgtttcctctgttgcgattttttccgctacgtttcaaatgctgcgttggtggatgaactgctcgatctcgaccatgtcccaatggcactttgcccggacggcgctttccttccgacgaccgagtggcggaaaagcattctcgagggcaaagtgcgattggcgggaaaaccggcgttggctttgctcaaacagtttttgttggaaaaccaacagaaaatgatcgattcccttataggcnttttaatattattgttgtatttattttacttttatccttttttatttcactgtttaataaattaatt

SEQ ID NO: 12137 - DNA, 1553 bp, Heterodera glycines
ttttatttaaattaatttgattatttaattattaaaacccacaattagtgtgatcaattacaaattatctatgaatattactccttttaaattttaaaaacttaaaaaaggcagtccaattttttttgtcgaattatctgattttcgaaaaattcatcaaattaaaaagatacaactttgtaaaattgtgtatttgagaaaatattattgagaaatcccaaatatgattggatttttaatttattattttaaaattcttaaaattaacctcctcagcttaaaggccacaatctacgagaagtgcattaaggaagtacagtactcaattttgaaaatttacttttatgtattaacagatataaattttaatttgtgttttcttgaaatattatttcataaaaattttttcctggccatttaacgcccctccacctgaaaaactgaacaaaccaaaacatcattttaagcgattgaattatacaaatgaaaattaaactttcttttttttcttatttttaaatgtattttaaattaaaagtacattttattttaatttattttttatttgtttatgcgaaataattttgaataacgttactaagaaacaatctaaataaaaattttcttataattttgcacataagtaatcaattttttaattattattattattcgatatccctaaagtattctctattagcctgtaaaaacttcttaaaatttcattaagttccaaaataattatgatccataatgttcgaaaaacatgttgtttttttttgagttgttaaatccatacttttttgaagtgaatatgttttttttgaaatttatagtctaatatagaacatttagagaactatcgaataataaataataacatcaattaattctgaatagtttttcattcaagactttccaattgatgatttttgagtaatgagacgattcaccacaaaaaaagaaaaacaaattgcattaattaatagtattcttgaaaagtttcttattttaatagtaatttacattattcttttaacattttgatttggacattttttggcatcattatttttttttccatttttcacatttttattcacagaatgctacaataaatgatctagccaaaaaccgttggaaatttctcgacacgaaaaacttaccgtaaaaatttcgagcatccagttaaattggttttactttgttgtcctcataacaaaaactaaaaaatttatggtccatccacactttttccaatttccggttccaataacaccaagccttccgaaatttttccattttttaaaaatgtttttcacaattctaatccctgaatgctccaataaatcctccagctaaaaatcgctgccgaccaaacgaacgaacaaccatcgatttatgcattcattttataatattccttcttatcgtcatcggttgaggggagggggggggggggagaagtaagtccatcatctaaatttttaactatcatttgtccttattatctttattttgtattaccatttttacattggttgaccattttt

SEQ ID NO: 12138 - DNA, 1557 bp, Heterodera glycines
  misc_feature (14)..(14): n is a, c, g, or t
  misc_feature (67)..(68): n is a, c, g, or t
  misc_feature (70)..(70): n is a, c, g, or t
  misc_feature (138)..(139): n is a, c, g, or t
tttttactgagttntatcagcgcttacggcacagaaaaaaatgccaaaatcgaaattctaatatgtnnanccaattaccataaataaagtaatttttttgaatagtaaaattaattaattggctaatcattgcctttnnaaaaggaatgacaaaacaaagacaatctcattcagttcgagtgccaatgcattttgctcaaatgtttttgctgtttatgatctcaactttccatgctcaattggttgctgttgataatttaaatccgagacttgaaaaattgtcaattaaggtaataaaaacattctattaatacatttaattatctttcatttatttttttaattaaaatcattttgaaaatatattaaaaatgttttttaattcatttttgtattatcaaatttataataattcttttaatatttaaagcataaaattttaaaataattaaattattttgtaatatttttgagtaaagccattctgatctgagcaaggtagaagaattaattgcgaaaaaatatttaaacaataattcttttttttcttcaaagagatgcattaatttaagatttaatgattgtcttattataaagggttaattgttatttatcaatattttcaaaaaaaaatatttcaaaattttcaaaaattttttacaatttatttaattactgaatcatttcgaattatttattatttttttaattttaggagccagaatttataccaacttgatacatcaatttttaaattaaataattaacgaattaatttttttttcattttattattatttatatattcaattttattctctgtctcactccctctctttcactcttctctctctcactccctctctctctttctgtcaaaaatgatgcatctcattaacaacgatcgcgttttttgttatcatcataaaaatgatattttatcattgacgattttcgactattattttattactttttccacgacagtggcagcccttttcaatcaatgctaacaatgatgaatacgtgaatggcttatttatttatttttttgtatttttaaattaatttcaagttttgctaacctcgtccaaaaaaatttagctgagtttgttgaggattttacgaatactgttcgttcttttccttggtgcgccaccacattagactccgtttatgaatattttatttcttttttcaaaatttttttttatctattcgggtttaaaatttatgaacagataacaaacaaaatttatttgtgatcaaagacctttaaatttttattaaaaaaattacattgaattgaatcatatgattaatattgaatataaagtaaatgcatacaaaattttctcatttttaaaataatttcttaaataaagtttttgcctctttaggggaaggtatcagcaaatcgtataagttttcagtgtaatctggctcaaaaaattaaatttaattttttcagaccaattaaagaagcaaaaatgcaaaaataaacaataaaagcacaaaaacttgttcagacttattcttcttagcatcagatggcac

SEQ ID NO: 12139 - DNA, 3231 bp, Heterodera glycines
  misc_feature (1781)..(1781): n is a, c, g, or t
cgattaatgccaaaaaacagatggccagtaggatacatgttgctgtgaaaatgtaaaaaatatttaattttaataaaaaaagcaaaaacaaaattgtaagaaaaaatcctttaaaatgaaaaatcttctttttcaaaaataaaaatttaaaaactgatttaattgttttttgaattccctgccgattttttctatgccgttaatcacaattcttaacctgacaaagtccatttttttaaattgaagtcatctatgctaatggcactggtcgtaataaaaattgccaacacctcaaactcgcgagtaacaaaataaatttaaacattttattttacaatatttaaaaaaaattaattccaattttatttaaaaaattccaaattttcttttttattaaattaaagtggattttccgtaacagaataaatttaacatttatttttaaaatattaaaaataaaaattaattccaatttttatctaaaaaatccaattttttatgaaattaaagtggattttccggcaattttccgctcggatgacctcccaatttttctttttttctttttgattgttatccgtctcatccactccacaaaatctgtgtgcattatttattcattcattcagtggcggtccccaataaatgtgaacactcttcccaccattgttctatgtacagaaattgctgcccaaattgggctttggtgccctttgttttgtccgccgtcgccgccgcccccaaaaaatgaatgatttttccatttgggcgatcgaccaccaattccattcaaacagtttttgaaggggcgcacagtttggcgatgtgttcaaacagtcagcaatttgatttttggggggggggggatttcttttgtgaaaaaaatttagaaatatttgtagcgaaaggtttgatttaactttgatgggttttataattttgtaaattttggccattttcatagacttaggatttttaatgaattttcaattttgaattttttgttttttcgcgctaaagagccctgatttgatgttttcggggcgtaccagcccaaaaatagcatcaaattaccaatttttagatgaaaatagagccaatggctttaggttttcacaaatttcagcatcgatgccttcctatataatgaattttaaaataaaattttttcgaaagttccattttctatactaagaattgtcggaaagttagtccaaacaatttgttgtgggtccttttctctcaaaatggcatcacagaggattaatagcctgcataataaatggccggagattcacccttttctcccctttagctccttttctttctatctccactttgctctctttctctcgtctctctctctcactcactcacttttttctctctcccttagtttctttacattctcttctatgattggccctctcacctttttcttttctctctctctctctcactcactcactcactcactcactcactcactcactcactcactcactcactcactcactcacttttttctctctcccttagtttctttacattctcttctatgattggccctctcacttctttttcttttctctctctctctctctccctttctcacttttcattgcatatgatttttctctgtttctctgctctgtacaaatttctctatgttatttcctctctctctgcctttctttctctgtctctccatgatatgccaaaaaattgtcccttttctctgttattttcattatatgtatattatatgcctcatttccctntaaaaattcttttcctctctttctctgcccccacttttcacacaaaatgcacactctctcctcccacgcataaatagcatacatttggcgcctccggcgctttctctctggcgttggcgttgtgtgcgcgcgcaattatgaaaatttgttttgtgtcgcggaatccgagccggcgtttccgcccgagcaaaaaaactttcttctccaacccaagcactcaaaaagcaaatgagcacacatattatgcaaaaagtgcggtccactcactcacccacttcagtccattcattcgtctctttggatttttttttgtccgtgcaaaatgccaaaaaatgaattatgccaaaatgccattttcagagtgatttcaatgcctgctgccttacattttgaatggcatttttttcttgaaatttgatgccatttaaccattcttaggttatgttaaagcatctgggtaaaatggtggtaaggaatatttccgaatttctctcgattttcctatgggtttttcgtttacctaactttgtcatggctgatgtcggacgagcacttagaaaatctgtaatcccaactacgggtcggggtcgttttcgcgtggggcgagtttttgaactataacttttttctttgtcaaccaaatccaataatcttggtatcattcgatagccctaagtgttctttattagcctacaaaatttggaaaaattttgttaaggtccaaaaaagttatggtcagaagagttcaacaaaccaaattttccaacttttttggctcgaactttttttatactgaacgaaattttttggaattttgcaggctaatagtgcatctggagggctttcgaatgataccaagattgttggatttggttggcaaagaaaaaagttatagtccaaaaactccgccccacgcgaaaacggcctggcccgtaaacttacaaccctacaaatgagtagaccaaaatacgctttaatgctcaattactagggttataagttgtatgcactaaaatatgtcaaatatgcgcataaaatatgcactaaaaatcccccaaatatgccctaaaaacccgaaaaatgcccaaatatgcactaaaatatgccttaaaaattacccaacatggcttctaactctcaaaaaaaaaagccaaaattgtgtaaaaatacagaattgactttaaaaaagtggcctttttagataatttaaaaaaaaaatttggttttcaaagtgtatatatgcaatttcgaattgaccgagatatgttctaaaaatgcaaaaatggccaaatatgcatttattctcgaaaacccccaaaatatgcttttatatgcactaaaagctttcaccaaatcaaaaaattttaacgcagaaatgctatttttgagcccctttcttcatagcatatgcgcagaaaaaatatgcaaaatcatacaaattataacccta

SEQ ID NO: 12140 - DNA, 3767 bp, Heterodera glycines
  misc_feature (15)..(15): n is a, c, g, or t
  misc_feature (31)..(31): n is a, c, g, or t
  misc_feature (43)..(43): n is a, c, g, or t
  misc_feature (50)..(50): n is a, c, g, or t
  misc_feature (92)..(92): n is a, c, g, or t
ttttcgtcatattangaaacaattcgtcagnttcattcacatnttcgaancatattaaaaaaaaaaacaaaatgcgtaagtcgatcacttcnttcatacaaatgcgaacactattttcaattcggttatcgcactaattcaaacacacttcgtcaattcgtttcacaattttgcacaaattcagaaacaatttgtcaattcgttcaaatttgcacaaatttaaaaacaattcgtcaattcggttcaaaatttcgtacattcgccatttcggttcatattttcgcacaattttcagatataaattcgtcaattcattcttattttggtataaattcaaacacaattcgtaaatttggttcacatttttgcacaatcatacataatctatttatatttgtaatattccgaaacaattcgtcaactcgtttatatttataataattcagaaacaattcgtcacttcgccaatttgttttacatgttcgcacaaattcaaaacaattcattaattcgtttatatttgtaataattcagaaacaattcgtcaattcgtttatatttttgtactaattccaaaacaactaattatttttttctttctctctctcttctttcatattctcgtactaattcaaaaaatcgttattcgtacaaattcaagacaattcgccaatttgtttcaaattgtagtacattcgccaattcggtttacatgttaatacatattcaaaaataattctcaatttggttattattttcatacagtcaattcaaaacaattcgtcaattcgcttcatatttcgtacatatttaattgtataaattcaaaacaatttgttaattcgctttacagttttgtgcatattcaaaaataatttggttctatttttcgtataattcaaattcaaaacaattcgtcaattcgttttacactttcgtacatccgttaatttggtttttactttcgtatctattcaaaacaattcgtcattttgttttacattttacacaaagcacaaattcagagccaaatatatttcgtcaattcggtttatattttcgtatatattcaaacacctttcgccaattcgtttcatattttcgtatatatttcaaaacaattcgccaattcgttcctattttcacacaaattttcaaatataaattcgtcaattcattctcatttttgtacaagttcaatcacaattcgtaaattcgctgcacattttcaaacaaattcaatcacaatttgttaattcgttttatattttgtaatgattaagaaacaattcgtcaatttttcgtactaattcagaaacaattcgtaaatcctttttatatttttgtaccaattaaaaggaaaaaaacaattcgttaattcgtacaaatgcaaacattatattttcatacatttcatctcctattgtcgtatatgcttaaacaatttgttaattcaattcacattttcgtacaaattcaaacgcagttcgtcaattcattccctatttttccccttcttcgtacaattttcacacacaaattcgccttttcggtccttcctaggttcgcacaattttcaaaaaaaatcgctaattcttttaattttgtaaaatctcggagtacggttgcgttgatttgggttaaaactcaaagcaaattcagaacacgtcctcgtcctcgacatctctacccgccctttgttccatttggctcaacttgctctcccccaccaaacactcagtccttctcacgtggtgccatttcacaccaactcagcctcaactcacccctccaagccgaaaggtgtggcggaaaataacacaaaaaaaaaactgacatttaacaattcacaaatttcacaacattccttttgatcacatttacgtttttgatcacatttacgcacattttaacacctaacacattttgcgcattgaaccaattacctcccagctcaggtcccaccccaattaaatcagtaaaccaagtaaacccctggttacgaagtacagtatccagtgatttaagacaattaaatatttgtttcttttggttctaacattcaattctcagttaatatatttggtgcattgaaccatttatatctgccccggaatcacccccaattaaatacagcaaagcaagttaaatcctggttattgtgcgatatccagtgattatacacaattaacttttactttatttctttccctttacggtgcgcaagtccagtaccctctctgatacatcccacttcccctatcatggtcaatcccttagagaatttgccttacgaagatattgttgcgattgaccgtcgcctcttctcaggtagaaacccatccgtccaagcaaaagttagtgacctcgaaaatgtattaagtcaagtttctggctttgaggatgcctcaaacagaaaccttcgctatcttaatcgtaggattaatgcaacaaatgaggcaatctttaaactttctgaggaacttaatactgggctggcaaccatggcatcccggattgattcccttaactaatcaattccggccccctagtccccctcgatttcataatagaaattggcagcaaactcccaaccagaccccctcatgttattattgtaaaaagcctggtcatgtaatcagtgaatgtcggatcctcgcctataaaaatcaaaacagaaattcgcaaaattggacgtcccaacctcctatgttcacccatagcaaccccaacagtattccaatctcccgaccccctccctataacagtggtagaggaaatcaacctcatcaaagaggcacatggcggaaccaacagtcttttcatcatgatcaaaggggtgcatggagaaatcagcaacccttccaccatgacaatcggaattggaatcgctacccaaatcccaaccagccttatggccgaggacgacaaattaattcccttaacacctatgattcccttcccccagactcattccaaaatctttcaatgtctgataatggtccccacccttcatttaacactcttacattctctgaccaagtccaacaacccgttactgcctcaccatctcaaatcaaagaacagctcgtgtgctctggctctgctgataagcaaccaaatctcacggatgctttaaaatccgaaccaaagcctgtttcccccactcctattgtcacaaattgggaaccacacccgcgcagctcaaatttttcaatagctccctttctaactcgttttaattttatcttgtgtatcattactctttctctaagtgcttctttggtatcatcctctcacagtcaatcatccttaaaagtcctccctatggtttgtcagacacacgttgagggcacaatttggtctcttcccatttggctaccatgtccaaaattaaagcatactccttctgacacccctatcaaacaacctattcgccttttccaaccgaacccattcgaacaaaaatccaaggcatgggtgtgcaggaaggtaaagaaatccctgattgagtacaccaatccatggaatgatttaatcattaagcaactcccgtccgaaaatctcccagtattattagatgaatgtaagcaaatggttcaggaaaagtcatgttccgaaggaattctaatccaaagtggggagctccttttctccaataatccaatcagctatgaaaaacggtatcccttccttggctggtcctggaaagcacacaattccacaaattgtttcgcttttcaaactgagatttttgtgcatcattc

SEQ ID NO: 12141 - DNA, 3745 bp, Heterodera glycines
ttcctaacatttgatcatttattcccaaggcttcaagcaaatctttcgtctgcaatttccaccacaaataatcagtggaatatttctgttgatggcactcaacttgcgccttcttcgtccgctggcgccgaagcttcgcaaagggcacaaacatttggcggcggagaaggcaaatcgaattcggattttaattgaatttaattcacaataaatatttctttttttaatttattattttcactgcttttcctttaagtgttttcctccgccgtttctgcgcaatcgcagccccaaaatgaccgtgccaaccaatcgcgcggcagtttatattcctttatgagcagcccttcgccggccacttttcaatcgacgtaatgccaaaatatttttttttttttgtacaaattaaatttcatttgctcagcatttcaagcaataataataataacccattcggaagtgcaattaatggcaattcatcagcaaatgaaccaacaattatcacagtgaaaggtggggggcgaacaaaaaacgtttattttatttgatttttaagggattacaccgcctcagagcagaagacaaaggcattttaagcattaaaatttgaataattttaactatttgttaaaaaagaacagatagaaaatattaaaattgacaagtgacgattaaaaaagactaattaattaagtaaattcaaaaattcagtgcttcgattgacggcgacggcacggcagaaaaattgagccgagagaatgcgccgttgaaaaagccaattttaacggtggaaaggctggatccggtcagctcatcgttctgttgctcggagggggaagaggaagaaaaaggcggggacaaattaattaattaataattaataatgcaaaattaaaattaaaataattaaaaacatttttacgtatattaatcaaatgttttttgcatttaattgactttttaagatgctttttttaggtttccgtgttctaagcattaacaatgatgaagttgcgcagatttcgccctcttcgaccacagttttggcgagcaaaaggccatcgtggaatgtggacggagaagtgattaagcaaatattaatggcattaattggcaaaggccattaattaccgaaaatatattgattatttggacaggtaatgtttttcaatttaaaattgcaaaagtttaggacgacgagggatcaattcccactgaaattctgaacgaagaaccacaggaaacatttaacctcaacgacaatttggagcaatttgtaatgggtaattattgaaattaattaaatattttttgatttaatttaatttgaatccctttaagaaccaacccgaaaaaattacacattgaaatgtcgaatcactcgagacaaacgcggaatggacaagggaatgtacccaatttactatttgcacttagagaaaaatgacggacgaagggtaaatttaattgagttattaaatttacaaatttggtttttattttcagacatttttattggccgcgcgaaaacggaaaaagtcgacgacggcgaattatttggtaccaatgcgatgggcacagcaatttcacaattaattcctttttcaccgttattataattaagatttcaattgatcccaccgatttgcgacggaatggccgaagttttatagcgaaagtcaggtggaaaaagacaaaacaaatgacaaattgacaatgaaaagggataatctgtgcttaggtccaatgcggtgggcacaatgttcacaatttttgacaacggcgaaagtccgaagaaaagttcggccatcggcgactccgtgcgcagggaattggcggcggtgatttacgtgagggattcaattatttgcataattattcaacaaattggccacttattttaggagacaaatgtcctcggtttgaaaggcccacgaaaaatgaccataataattccaggcaattaattacaaaatgtttttgttggccattaagaaagtgattgatgcttatttaggcatttatgttgatcaaaaaaacaattacatccgcccattgtccgttcggccaatttcggtggtttaattaattttggatgaatattttaatgacaaatattcaggaaaaagattcgattttggagagatacaaaacgaacagattggaggagatggtcgtgctgatcaacaaacagcccgtgtggaacgaaggcaagcagaaagggaaggacgatggtcatttgtgctcatttttttgatcagatacccagtcgtacgtgctgaacttccatggtcgcgttacgcaagcgtcggtgaagaatttccaaattgtccattcgatgcacggtaattattaaaatagccatgctttcgacaaacgccaaaaattgcgttgttccattaagcccaatcgtacgatgggcgacagcagcaacaaaattcgatggctgttgacccgagtaattaggcgctcattaattggccaattagcttgttcattagtattaaatgctcagtcaattaagatgaatatgtgataatgcaattcggtcgcattgacaacgaatcgttcacaatggacgtggtcagtgttaagcattgaacatttagcaattaaaaaattaatttattcgtttgcttattagcgataccctctctcaccggttcaagcctttggaattggtcagaatattcaatttcaaaatgaatttttgaatctgttttttcaattaagcaatgagcagcttccatggcaaattggcatgcgaatgaacagagaaatgaaaaagaagaaaaagattatgatgaagccaatgtttacaatttatttggaaaaataaaacaaaaacaaaaaataaaataaataattatatttgggagaagggaattaattaattgttcttttaacaaatagtgtaaatgtgatcatttgctgccacctttcttactgtatgtaccataggtaataagtccaatagaaaaaattccaaatggcgaaaaccatcggaaaaagcagccgcgaatagcggtcaatttgaagtcctttgcgtgaaaaataaatgctttgtcgcagaaagtgatttgtgatcttgtaaaattgggttttttataaattattaaaatttaaaaatgcaataccaaaggattcgaatcaaaatctttgatttccttaatattttcattaatgtcaatgcgttccggcggctttaatgatgcgcgaaactgaaaaattaacagaaccgtttaagtttatttaataatttcaattcgtgagtgattatccaaagcttctcgcgtgctgctgatcattttgtttcttctggcgaaatgtgccgacgacatttattcgtggaggacgcggcacaaaatccaacacgggaatggtcagagtaattttgttttattttgttcagcaatagaatcagtgaataaataagtaattaacagtttaatccaatattaagtacatatttatgtaccaattaagtctaggaattgcagctggtgccgataggatccatcggacaaataattttttatatcttgttaagaaatggtaaatacgatattcaaaaaatttccatatttttgatcctttatacagaccagataaacagcgatttcaattagtgcatgttactatttttttatattttcaggatccattcactggtcatccggatgaaacacgttctcgtggtcagcaacagtcctcgcatatctgcagttgcggagcagttcaggtg

SEQ ID NO: 12142 - DNA, 2581 bp, Heterodera glycines
ttttgttctgagagcatttcgagagcggtcaaactcttgcggtagtctcgaatattttcctcaatcctgaaccataaattcatagcaaccagcatccaaaatgccattcttttctgactttgccttttgctgaagtgcgctcgtctcaaacattttaaaacggcggaaattctcgcgctcgtcctcctgcgcatcttccaaactttttttcttcattttgagaaaaggttccacattttccttaattaataatatatagaaaaataaataaaagccggcctttttaaaatgaaaatccaaccaacacttccgtcctcataatttgtcgacgtttcatccgttcttccgccgttaatggaagcaccgcacttgtggaagtattctttgatttttccttaatttccatggccaatctgaatagcaaatgcaaaattagaatagaatgggttaagttaaatgagaaacaagaaattctgctttttcattcattggacataaagtgggaaaaactttaaagaactttatgtttaattcagggcgcgtatctgtccttatttgtaagatttgtccttatttcgggctattgttcttattttgttcttatttcttaaatatattcaaaattttgaaattttatggcagaatgtcactattttatcaagaaaatataaggtttgcgcaaaatttggttattttttgacaaaaaactgttagcaaatcgcattaaaaattacaaagtttttcccggcgtcgcctatcggcgtcaccggaccatctcccccattgttccccaaaagtttttgaaaaaacgcaccgcaaaaaaagtatttttaaaggcaaaaaaagtcgtcgcttggcttttaatacaaaaattggccttttttggtgaaaatctgtaacaaatcagaattaaattacaaaaaatttttcctcccctcgcacttcccaaaagttttttggaaaaatgcgccgcaaaaaattgttaaaaatctgattttttttatcctgaatgcactaaaattttatgatttgctaatttcctccccaaaattgttaaaatcgttaatgggagacaaaaatatactatttgatacatttttgatcgaataaattgtaaaaataactgatttgaagcaattttgcgaaatgttcttatttttgaccctaaaatcttattttttggccttgatgctcttattttgaaaaattttcgatccgagccctgcataaatcgcgaaatatggaaaaatatacgaaaaatggatatggaaacccatcctagaagctttaaaccaagttaaaaacatgtttttcgtgcgtttcagacctcccacagtccaggaaaaaaatatggatttccatataattggaagccctaattattaccgacgaaatacagtagttgactaggtcaaaaaattcacgtctaccaaataaccttgccttgtgttattgacaaaaattgcatttacatacgttcactagagttcacacatttttgtgcccagaaatttgttcatttgcgtttcgtcggatttgtctaaatccaaaactcattagaacatagcgttcatttataaatattaaacattaaatgcataatgtaatttgaccgaatattcagagatacatttgtgattgttatacgattccattccaaattattacaacaaatggcgtcctacacttattccgccgccggttcgtcggcccgggcggacagcaaaaaggacattctcggcaatctcaagcgcgctttctccgcatggcctgacaaattgttggcattttttttgtttacccgaaatttatgccactaattgtgcctgtttagggagagccatgtgcgtgaccattttgcgcaaggtttacagcactttggcactgacagtgctttccgcaatctttggcattgtggtcaacgcggtgatggacttttcgtcgttgctgcccgtcttctcgctgatggaactcggcttcttgatcggtattccatttttcggttctatttacgtttctaaccaagttttacgcgtcgaataaatgactatccgcggttttttaggccatacattttttcttggttcgtaaatgccttagttcatggtatcaaattgaaagcttaaagtctagaagtttatgggattttctttagaaaaaaagtcatgccataagaaactgagtatggtcatttattggacaagtaaattgtgccttggtaaacttactaagatgtcaaactattattcattggaggtgttttgtgagggaaacagcacagcttcccccccccccccccgccccccatttgggccttatttttaaggctttccatattcgtgtggttgaacttgttgaaaaattgggataattaaaaaaaccactcttcgacgggggggggggggggaagcgttgtgcacccattaagatttgcttacggctggcaattttgctcatagaatgagaataacaacgcgtgttttgttggttcatttatttgcccatttcagcccttatggtcaccaatctgtcgccccaaaatgagaacaaacgtttgtgcttcatgtacgcttttgctttt

SEQ ID NO: 12143 - DNA, 1872 bp, Heterodera glycines
atgattgccgtaagaatggctaaacatggtactaaaaattgtttagaagaaaagaattacaattttttaacttttagtgaaaaagtaaaccgaaactaatttccgacattaatttactacaaattttacgaaaatataaattggtccaatattctaaaaaacgaataactaggtaaataaatatgaacctgcgaattttcactgactgcggttttatggcaaaaaacgatcgtttgctacgttttataaaacggcaaataaaaattgtgtataaatgttttttttactccatccaatcaaaaggtaattttgagaataatcacagctcaaaattcatatggtaatattaaaacaaacagcacagaatcaagaattaaaaacagatttagttttgagaagggatggaaggacgagaagaaaagaccaattggagaatacagcggattatttgatccaatactcagattcatagagtgtatggtaaagaggaaacatatataaaatatggtcgagtaattcgcaacattttcaatatactttcaaagtcttcagatagaatttctgaattttggggtcagttgaaaaaacaaattgtatttatccatttcatctaaacaaataaaatttatgttagaaaatgtatagtttctttttaatgcaattcgtaaggtcaatatggacaaaaactgtggtgtatgaaagaaaaagacaatacaaaaaaaaaggaaaataggtcaggggaattttcaaagtatgaggaaatctattgcaagaaattaacggaacgttgggtgttgtcttaccaagaaattttgattgttttctttttttatagataagataatctttaaaaagtcttcataattccttgctaaaaaccaacttttctttgtttcgggactgaatatacaatactgaattggaaggaatcgcagtttatcaaatgaaacataatatagtaaatagcttaatgtccttccattttaaatattctttttactgttacccgttttatcccatcaacatcgacattatccatccaatcatcatttacaatgtcaacaagaggtcgcgttcgacgttgtcgaggctgcagcagcagcagcagcgtaagcattgagcatgacggctgcttcggcagccatggcgctgcttcccgcaccgcctttgtccatgtcaacacggcacaccgggcattttttgttgtattgcaaccaccggtcaatgcattccgtatgaaacaaatgagtacagttcaacgctcgcaattcgtcgtcggtatcgaaatcgcatagacaaactgtgcatcggtcgcgttcttgctccctaagccaatgagtcgataggtttttttttattatggagggacttacggcacatcggggtccttcacatacgaaagtttttgtgagtgtttcttgatttgttcaagggagacgccaactgtcggaggagaaagtttgaacagaaaaaaccatttgccaagggactcacccggctgtggctcaggggccgtagcagtggccatcgcattggccacaatgtgatggggatttgccgcatgggcaagggcggaagtgacacttgaacccccgttcaaaaccaaagttgcggcatcgtcaacactttccgggttatgtagcaacaaaacattggcctacagtcaacgaattattagtaaggcaaaactaaaaccttaccaagtcgagttgagaggacaacctcggcaccattatgagcggtcgcaccagatggttctgttgaacagcccgttgttgttgctgttggtagaaattattgacagcctcgcgctcacgctcctgctgaactaatcgagtagccaaaatgttctgctgcatcgacgtaacattc

SEQ ID NO: 12144 - DNA, 1815 bp, Heterodera glycines
gcgtactcaaataaattaaaagaattaattatgcttaaattattatttgtaaaatgcctacttactcttcagcggcttctgttaatgacatttgaacaatttttatttcattttttgaaacattttccatcaaataattcagctgatattgctcatagtctcggtataatttaccagcgacaattaaaataattgcatctttgtcatcaaactttttcctttaatttgattaagaaattaaacaatcaataaatatataaactaataataagccttatataaccaaggaataattattgtatttaattttcattttaaattaattttaaatgtttaaaaaattaattaatccataacttttattttttccattttataaaattaattaatccataacttttattttttccattttatacaactctttttttgctaaataaaattaaatagatgctaatgccagattggacttaccatgccattattaatgcattgatcagcatggtatcgcacggattgtccggcattttctcttttgacgtgtcaaacccggccaaggccatcgtccgtctgtgcaattttgtgatatttgctgaattcacgaagccaccagcttggccaatgttcacttcaatcttaagattatattttatccctagccgaccacctcagaatcggaaaagtcagaaaagagttaccctcccccctattcccagaatttcctctccatggagtcgacttttcaacacaagcttttgcccgaaaaatcatataattaaaattatagtaatttttaattgactcttattaaatgatagataattttttcgttaattacctgtttgagtccgtattcggtctctccggtttgatcatttttgcccattcgctcatgtaatcctaaagaatatttcttatattttcatttttagaagatttttaatttgttggaagatgtattaattgaaaatgaaacccacaaaaaatgtaaatccattttttaaattgtttttatctaccaatttccaaaaccaaaattattaaattttctatctaaatacaagatttaagaattactgatcgcatcagaatgaaattgagtggttgcttaatgccttcctcattaacaatgttcataattttcagcaaatccgccacgagttcatttgtttcggtggttgactgaagattctcgcgcagaaattcaatgtcagacgaaacgcgaaagtacaaaagttgcatcagctaaatgcattaaaacaaatattatcactgataaacaacaaaattggacaaaaatattttgttttcaatataacccaaaaatttacttaaaaaaattaatataaattttgaaaaataaataaaataaaattaaattggaaagaaaacgtggaaaatattcaaacattagaaaaattttaaattgagaaaaagtgggtagccaattttgtaattagtgagtttattgtcttttacttttctaattaatgtttcaattttgcatccccggcaaaatgatacatagaaaagtaattatagaaatctccacctttaaaatactgctaatttcagttcctaccgtatgcactgactgcgcttgttcaaaaattacgcgtggaaaagccgttaggaacagtgaaaatggcttaaaagcggcaatgtcaggactaaagcaaaaagaaaaaaatgaaatcaaaatgccaaattacagagtttattttcaattagaatagtgaagtgggaagcaaatgccctttcgttaatttattcgattggaataaatatttttgcaattctgcccgtcttttgttg

SEQ ID NO: 12145 - DNA, 2242 bp, Heterodera glycines
cacattttatattaatttaatactatttttgtctgtctcatttgctgggcttgcatccgcaaattgtatcgtgagaaaggtgaagcattgtgcataaaaaagcaatttcgaaaaattctttgacattttaaaaattttaatataggtaatattctgactaatctataatcaattaataaattttatttattaaaattaatcttaaagaaagcataaaactcatttgagacttaatgtttgtttattttatttaagatttggacataattcacctaaatttctagcaaattattattagaattaaaaaattgaatgaaatacaatgaatctcgagacacgacccgcctcccccccccccccgcccctcacaaaaaagcgggcaaatgccgcgctttcaggattactactcgaaaaaaggaagtgatttaattaagagattatttatgagtatttatatatttttaaataacgaatttatattgaaaaaataaaatatgctataaaaccaaaagcgagcttaggcaaatgcacgtgaaatacattctcattcatttattgatgaatccaatttctgttcgattgtttgtttcttctcacaacatttccggcattggtcggaaatgtttagctaagaattttgccatttttggcgccggaaatttaataattttcaaatacgtgtagccaaagtgttatgccattttagcatcaagaattttcatttttcgaaggccaatgcttgtacccatttttaaaaaattacaattttcatttatttaccaaataaaaaaacaatttttaccaaaacacttaattctgccttatacaataaatttttaagcaattttttcatttcttcattgaatatattcatcattcggtttgctcttcttttttggtgatttgacgtgccggattcccaacaacggtggcaccctccggcacatcgcgcgttaccacggcatacgctctaaatattgaatgaacattttccttgcgctaagacctctcactcattgcatggattttcgagacgaatcgggattcaggacgagaaagatatcggggctaagattaaggattcgggacgtgccggaacatcgctgatttatagtagaggttggacgggttccggtacccggctttttcaagacccggaccggatttttaagcaattttacgattttatttttcatttctactctttggcggttaaacgaaacgcccagtggcgggtttttttgaacaataaattatcagtcagtcattgcttcttttttttgccaatttgtgtacccactcacccaatgattgcgccgtcgcccaccgtcacgcccggcaaaatgaccgcaccgcctccgacccacacaccgcgcccaatgctcaccggccttccgtattcccagccctggtcccgaactgctcggtcccgggggtggtcagccgcgtaaatttgcaccgcgggcccaaccatcgatttgtccccaatttccacccgacaaacgtccaacacgcaacagttgtaattgaggaacacatcctcgcctaggaaaatgttgcggccttaaagccaaaaaaaatgagaattttttggctaaaatttttatcggatttttaagctaagttttaaaaggaaagaaatatttaattgtatataatttttatttgtagcaagacttaaaagcaattaaattttaattgatgattaaaatagtagtttatttaaaaaaatttaataaaataaataaatttcttcagcttggggttcgaaccaaggcagaaattaaagaaagactgatgaagatttagccactatgtgttcgttatgttagaggaacttggttcacgaattagtgcaaagattaaaaattaaattatataaaatgtcaaaaccaaaaaaaaaccatggctttacgcagtttcccccccccccccgcccaaccgagtgattgggctttaggcttggtttttcttttactgtcctgtcgactaattgtccaattagatttgttctttcttcactttacccaccgtgatcacaaaagaacggtggcctaatcgaactcccttcgccgaggtggccaagccgttctctgagaattttgttgcgttccgtcaccggcaatgaaagcgcggcgttgaagcgagcaagccaaaactcgttctgctccaactcggtctaattgtatgtgtaatggaggtgaaacaaaaatggttggaagaaaaaaactagcccaggctg

SEQ ID NO: 12146 - DNA, 1446 bp, Heterodera glycines
attagtatgtaatttttaaaaatagcattctttctccgctgaaagaaaatgcgaggacaaataaaaaaggaactaatttcggaacagcagaaaaatgaaaaaaaatcggaattaaattttaaatcctcccttaagcaaacaatgaaaaagtgttaagtgctgcgtacttggagtgtatgtcgaaacaatcggagggaaaagagcgcaaaaggacagagagtgagagaggagagagagagagaagagagagtaagaaagaaagtgtcagttaataggcagtgaacaaagaaaaaaggaggatgagagaaaaaaagaaattttcttttgttgcactctctgacttttttttgttgttctatgatcattatctgctgctgttggcgctggaggcaattttacaatgttgcactctcgcataagaacaaaagtcacgagagagagaaaaaaatgcgatggcggggcgaacgctttccatcaaagagagacaaaaaaatgcagcgtaaaagaaaaagagaagaaatgcaagagaacgaagagagagtgagagagagagagagagagtaagaaagatagaaaagagagagagtgggcgggggcgggagggggagagagagggagtaatttttggaggcagtcagtctttaaaagcccgtgggaaaaagggagaaaagaaataaatttaattttcgtcctctctctctctcgttctctctctctctttctctccctctgtttcttgctctctctctctctctgtcctctcactcttttcacgtttcactttaaaagcaaaataaaataaattgaaaattgcgccccgccggtgttaagcgccgcgcgtgcgcatctcacgcgcggctattttcaattggggagaggagagaacaataaaaaatgggcagacactaaatcacgcgctagaaaagagagagaaacacacaaaaaattctgcgtctctacccccgcccgattcttttgtcgccgcagtcgcagtgaactgctgttgcctgtgtctgtctgtcacttttatgcaacaagaaagtgatcggagaggggcagagacgcatatttatatgtataatatatatgcatatgcgcaacatacacagttcatgatggatggctgctctattagtgcgcgcaaaaagggcgcaaaaggacctagcccttttatatgtgtgcaatttaaattatgcgcgcaaatattagggagaatttgatgtaaaagtgttaataattaaatttgaaaaggataaaattaatagccaaaaatacggttagccgacttttgcgccgcgccatttgcgccgcgacacttgcgccgctcagcaaaaaagactcttgcgccgcggacatttgcgccgtgccgatttgcgccgcgactcttgcgccgcctaacaaaaactacagtgcgccgcgacatttgcgccgtacagcgaaaaaaga

SEQ ID NO: 12147 - DNA, 2025 bp, Heterodera glycines
gccgcgacatttgcccgttccagggaaaaaaggcatttgcgcctctgattaaaattaaatttatgtgctttattggataagaattgatagatattcattattaattcctttttcgaagcctgtcatgtcaattccatatgaaggtgcacgtaatgattgatcaaatcttgatcattttggttttcattgggaccatatgcgataacaagccttcgtattgcctgatcattaatcggcggattttaagcgaaaaaaataggtaaataaataagggcataaaaattgcgaaaaatggtaaaataggagcgaaaatttgaaactcagtgcgttttttcaatgaaattaaattaaaatcgatgaaaataacttattgagaaaattaattacaaaggaattgaatttcattcttttttcgaagcaaaaaaataattggggtttctacagaaaattctttttttcagttttttgttagtttgtattcttaatcattttttcatatctttgatgaacctattcaatgttaagcttttaatggttaaaaaattgaatgtcaatctttgtgactagtaattttttcgaatttgtaattagttatttttgtcgatggcttatagttttagtaaaacttattgataatagtggaatttttatgaatataatatttttgacagcgcggcgcaaaagtccatttttgctgggcggtgcaaatgtcgcggcgcaaatggagcggcgcaaatatccgcggcgcaactgtctgcggcgcaaatggcgcggcgcaagtgtcgactttgctgagcggcgcaagtgtccacttttgctgtgcggcgcaaatggcgcggcgcaaatgtctcatcacgcaaaaatacatataaatatgtatgtaaataaattgtaagaaataataaatatggaaaatataatattggaagaaattaaataataaataaattaaatatagaaaatataaaaattggccaaaaatacctaaatagtaaatgtttaaatttataagaaataataaatacatatggaaaatataatgttggaagaaaaaataaataaagaaaataacttataataaaaatttaataggaaaatttcgaaattgtttaaaaattagcatttttttaatcaaattttgattaatttatttttacatgtcagtgtttattagagactgagccggaccggatccggtatcggattttctggatccggcaatccggtccggcgagaaaaacctggattgaccggattgaccggattatgagagaccggatccagaatccggtcttttgaaagtgccaatccggtccggtccggcgaatttttgccaggatccggtctggctcgttctctacaataatccttcattttgttcgttttcctttgaaaaatatctctttggcataatgtttttaactttaaatggtcaaaatttcgaatttcttccctcggcggcgcatatcggcaccgccgggcctccaaaacttattttttcttaaaaaattggctcaaaatcgcgaaaaattggtcatttttagtgaaaatctgttaacaaattgcctaaaattttcaaaatttttcccggcggcgcctactggcaccgccggcccctttcccaaaaagtttttttttctggaaaaagggcgccgcgaaaaaagattattattttttttttattaaaacataggttttcaaaaataaaaactttaaaattttttcttgagaaattgaaattttattttttttacggttatcttttcgaccgcgacatttctggtgcaccgaatctatacatataattgatgatattcatattttgcgggttttttcccaaactaacatgtgaaaattttaatttttaccaatccggaatccggttacggatccggcaatttgaaaatctggattgacgggattgtcggattgaccggattctgagataccggatccagaatccggtactttttgaaaataccagtccggtccgttccggcagatttggaaatctcggcctctagt

SEQ ID NO: 12148 - DNA, 1907 bp, Heterodera glycines
  misc_feature (167)..(169): n is a, c, g, or t
  misc_feature (184)..(184): n is a, c, g, or t
  misc_feature (194)..(194): n is a, c, g, or t
  misc_feature (202)..(203): n is a, c, g, or t
  misc_feature (229)..(229): n is a, c, g, or t
  misc_feature (261)..(261): n is a, c, g, or t
  misc_feature (273)..(273): n is a, c, g, or t
ggggggggggttgtttatttttttttttttttttttttttttttttttttttcccccaccccccccccccccccccccccccccccccccccccccccggccgcggcacgaaaatgagatgatgatggagaaatgaatcatccattatcgcgtccgtcgtctatatnnnccgagggaggcccanccacgcgaangaggaggnngaatgaggaagtcgagaaaaggcatntagtggagaggagggaatggaatttgcccttnttatgtaaaatntagaaaatttctgtacggggaggggacattttatagggtcctcccctcaggcggtagcgcaaatggcacagggcaccgccgctgctttctggcaatttagtttcattcgagaaaataaaaattttctcctggtccggcatttttgaccatcactaaaaagcctccgaggctcggtcttgaaaattttttttttcaaatttgacactatttagagtttccggcattttttgccctttaaagctatgaatttccttgccctcccgctcatcgtcgaaagtctcgatgcttttgaatgggtaaaagtcaaaagtgctgagacgggggcgttggaagggtcattaaagtgggtgctattcgggattaaagagctctcgagagtggatattccaaaccatgtgtggtgacccccgacacacatccgttcgatgatccccagactttcacatactccgcttgttgggtgctctatttattcattaattaaaactaccaaaataaaaaacaaaaattttgctaaaatttaacatgctttacaacgttggatagtaccaaaatgccttactagagctccaaaaatatgcacacaaaatcgtaaaatatgtatcaaaaaagacaaaatatgcatataaatttttataaaccaaaggcaaaatttaccaaaattttaaattcgttaaattaagctaaaaatcgcaaaaatagcttgagtaaaaaattcgaaattcgaaattttcaattttaattttaatttttttggcataaatttcattttttaaattacatttttattaatattttcgaaaaaatacccaaaatcttagaggtcaaaagggccactttaaaagagggggacgtttgaatagaagtttttttgaagcgcaaatatgtaaacaaaaccccatcaaattgtggcatttataaagtgggccaatctttttccccgttttgaacaagccaaaaaaaatttttaaaaaaaacttttttttttgttccgtaaaaagtaatctaatacatgcataacactttccccgcatcttacatttattcatccccattttcattctttcaccagcagagcagaaacaggcaaattgatgggtgggagaggaagcgccgggggtaaagcgtaaaaaaagtaaaacaaaaaaaatcgtcattcattttcaacatttcacgtttatttgacgaaaagcattcacagagaggaagggagagagaaagagagggaaaaagagaggagagagagtgagaggagggagaaggagagggagagagatgagagagagaggagtggagggagaggagtgagagggagatggttagtgttagagagagagagagagagcgagagagagagagaaagagagagaaagggagagatttgtgtgagagagagagagagagagaaagggagagatagtgagggaaaaagcgcatacaaagcgatgtgcttcttctccttcttccttttcatctcattttggccgcttttcctactatctttttttgtccaaaaaaacctgtgtcctcttcccattcatccattcattctttcgttcaaccaaaggccataagcccctcgtccccccgggggatggagcctaaatgctaaagctaaaatgcatacacacgac

SEQ ID NO: 12149 - DNA, 2445 bp, Heterodera glycines
  misc_feature (2369)..(2369): n is a, c, g, or t
ttttctagagtccggcgggatcgggactcccgcgggattttacgggagtcccgctcccgactcccgcttttttcggtgaacgggatttttaacgggagcgggatttttacgggattcccgttcgggactcccgtcccggaaaattttgaactcccgatcccgctcccgctcccggaaatttttacccaaaaacgggagtaaaaatgcactggtaagaattgatttttttggtaaaaataatgatttttcattgaaaatctgttaatatatagccaaaatttcaaaaaaatttcccggcgacgcatatcggaaccgccgggcctttaagagccttaattttctgacaaaacttgctcaagttgcaacaattggtcatttctgaccccaatcaaggaacgtattgaaatggaatgttggattctttgcccggcggttgcaatgggttcgagtccgggtgcctgctaacggtattttttgattctaaaaagactcgaactcagttttggaggtatgaattgtccgatttcatttgtcaaatgttcgcctctttgtagcattcattggtttgacttaatttggggcactttaaattaaaaaagtgccgacttttttttgttgttgtaaaaaaccttttgtcaatgcaacagaatgtcagccgttcctgcgtttggccattgtccacggcgaatggaacgtacgcaccgggcaaatgcatcgacaaacggatggcgaaactgacgggcgacgaggcgaacaaaaaggcctaaaatggcacaaaaaatgagggataaacttaccaataaaagttatttttcggcgtcttggacttgtttcggccgtccccttgcttattctgaggggtgactatcagagatttaaaaaaagaactttaaaagaggattcgaatccaaaaaaaaaaaaattgacgaaatcggctaacaaatttttttctttagaaatttctaaatttttcagcgcaccataaaacggaatgtttaaatcccttacgcctaacatctgtttaggcgatcagggattgaaaaaacttgactttgatcccgattttggacaaaggcgcaaatgtcgggacatggattcgatatatttcacccatatttaaaaagaaatccataattttcggggggtaaaattcattaattgataattttctttttttaaatgcaagtaaaatgatgccaaattgaccggcccactcatcatcactcacttctttgagtcgttcaatttgctcgtggaattggcccgtcatcgcctccacatttagcagtttcggcctgccgtccgcgcgcggcgtgtgcagccatttggccaacgcttgaccatccgacgcgtgcggatggtcgtcgggtgggcctgaaatggttggaccatttaaatccatagtatttcaatttcactttgggcaacggagtttaaaaagttttacttttggttcttcattaaacgatttaaaatattttaaatggttttttttttcaaaatttagcttttttatttgtttttcttccattttctgcaattttagatcttttcccctttaaattttaaaatcgaatagttttaaaaactaaaattcgaacgagtttttaaaaaatgaggaaaacaattgggggaaaggggatgaatttactttaaatttggataagatttttaaatccaatgccctcccccctccccttttgcatgccttcagggaacagtccgtccgactcaatttggcgaaggttggcacagtcgcggaggacggacggcgaaacgaactcacggagacgggagaacacataactgaaaaaaacgaatttattaaaaagggaaaataaaagcgttacggaccgatgtacccctttttctgacaagttttttagaaattaaaaaaattaaaattcaaaggcttgttttgggagatttctggatcgctgaatcataatatgccgaagttcgaacgtgaattcgaacaaaaagtcaaaaattcagtattaatcataacacgcacttgaataatattgcacaaaactgtctagagcctccgggaaaatataattttacgattggactatttttaggacttaaatttaacaaaaaaagaatgagtaccctcgacagtattactgtttttaaaaagaaaaataaaacaaaaaccaatcaacaattttgacattgggacgcccattttattgaattggaactgtgttaaaaaccggtcccaatcggacagacagacgcagtctcgaggagatgtgcgaaatggaattgccagaaagaaacggcttttttggaacaaacaaatcggggacaatttttgtgagattagaggtcatttgcaagagagtgagtggtcgaaagttgtnataaatctctgtttacttggattttcgactttgggggggttgtctctctctctctcactcccatttctctgctcat

SEQ ID NO: 12150 - DNA, 1947 bp, Heterodera glycines
  misc_feature (1657)..(1658): n is a, c, g, or t
ctctccatttactacatgtctctctctctctctctcttcttactctctccatttactacatgtctctctctctctctctctttcttactctctccatttactacatgtctctctctctctctctcttcttactctctccatttactacatgtctctctctctctctctctctctttcttactctctccatttactacatgtctctctctctctctctcttcttactctctccatttactacatgtctctctctctcttgtatcattcgtgcccatgcccatctctttcttttcccatcattttgcttcttttttctctctttctctctctgtctcacactctcttatcctcactatgcaaaaaagaaaaaaaatgccaaaaactaaatttcgttttcaaaaattggtatggaaaaatgcatatgcttccagtgctgcggcgacggcactcgcttttccttcacttcgggcgctcacctgtccacgctcagctggcacacattggacgccgccaggggccaaatttgctgggccatgacgtgccatgcgcggacggactgtggccaaatgaccattttaagggcaatggccgagtgacggaagaggcgacgaatgcggtgcagaaaggccacgacagtatgatcaatgtacctgaaaagaaaccaattcaattaccatggcaaaattttttttttttaattaaattttggaaaatcgacctacgataaaaaaatttgtccccggcattttcaatcaaatgtttttccgaaaaattagacggcaaaaaatccaataattgtgccataaatagaaaaattcggtaaattctgtctccaactttgttcgagttcctatccgggtttaggcaatgtattcgtgatcagcggatcggaaaccctgggtaaaacatcccgtaattttaggattttaaaaattcgtgccaaatggggacccaacttcggcattacaataaaacaaagtcccaattctctctgtttgtaagcaaaaccttatgcaaatgcttttgaatgtgatgaaagcgtcgggcggcgccgtatggggaaatgccaactttttgtagaatccgtcctcaaatcggtcgatcagttcgggcccttcgcctttcaatgcccgccaaatttcgagccgaccaaccgaccgatttttgccaaagagatgggcatcgacaatcgcatcaaacacggcactgatcggtgccaacgaagtgccaaccgtgggacggtccaacaaatcgaacacattggacgagcaaaaatcactggaaatatttggaaaactaaatttggggctgaagagtcgagagaaagcaaaataaacccctttttaggtttgataaagtttatttttaataattagcagtagcagacaaaattttaggaatttttttcatttttcagaaaagttatgaccgaaaattggctttaccaagaccaaagctaattgacaaatttaaagcatcataactaatattcttgatatcatttgatagcccgaagagtcctcgattagtctacgaaggttgaaaaaattcatccaaaattcaaaaattatagtcgaaaacgttcaaaaatgaattttttaagttttctggtcatctttttttaatttggaattttaattaaaaggcatgaaatttnncggtacttgtgtgatctcaatctgttgggccatatttattctgaccaatatattactaataaggatgacattttatagtttttttagtgcattaaagagggtttttaagcgaaatttgccaggaaaattgctccaacggatttccaaaaaaatttaaatttctgataggaaaaattatatttttatctcaccgtttaaaggcgaacgcgtcggagaatcgcgagacgcagaacggcaaggcatgtgtgataaactatttgctgacaaagaactgtatcagcacaacgac

SEQ ID NO: 12151 - DNA, 3242 bp, Heterodera glycines
ataggcaaaaaataggcataatttagcaattattcgccaaaccattgaaccatggtttggtccaatttaagagaattgtatgtcattttcattacaaatttaacaaaaagttggcaatgtgtggcagacagaaacactcacacggtgagcgcattctcggcctgttcaaactcgaccaagaagccgtccacgaacgggacaaacacttccgcaatgtcgctgaccaccagcatttcggcccgaccgggctggctcaggttgtagaagtgcaccgtctggtcataggtggccagcccaatgcgcatggaggaggcgccggcgcggaaattttccctgaaatttttttttgaaaaaatcgctaaaaaaatctgtcagccccctcctcctctaacccatagagagcagctcgtttatccctccgaacagaactttttcccattaaaaacccaaaaaaaaaattctaaagaaaattttatttttgaaatttcagcgattttttggaaaattttttaaaaaagttaaaattcattataaatttttgaaaaacggtaaactttttcattttcttttcttgaaattttcgtatgaaaaacgtagtgcactgccgccacacacctcggcaactccctgagcgatgtctttgatgttgcggcagaacagctcgaccagcccggtgcgcaccgcgttgtaggacacgtccagcatgaaaatgtatgccggctgcttgggcggcgtgccattctgcaacaaacatttacaattatggttaaattgattggccccaaaaattgaattaaatgacaaaaatggtccaaattagcgtgaaatagccccccccccctccgtactcactttgcagtactgtttggtggccacaaactcgtaggagcccaggtacagctcgggccgatgctgaatgtcagtgcgtcgtccggtgtgatccaaatgcgcaaaataaccatcctccactttaaaagcatcacacaaaatattgaatcgttgggtgaacccttgtattaattaacatgcctggtgtgctggcacggcagaatggacaccgaaatttgcggcctccgtcaatgaactccatgaacgggcacatgtacgccttgcaacgctggcaccggaccggcccaatttcacccaaatcgatcaccggtggcggatactgcggaattttttttcaaaagaattatttttcgtcgaattgtctctgaattcctatcctcgaaacttttttgggtaaaaaaaatcgaatcggattgatttctgacaaattttttcatttaaacccgagaacgtggcgttaaaaaagtgaatgatttcgcggcgtacctcggactggtgcagcttggcaaacggacagatggccaacgacaggggcagttgggtggccttgaccatgtcctggctttgcggcacggcatacagtgttgagcgcatgaatttcggattggcattccctgaggggaagaaaaaggtagaaaaatgggaaagagcctgtttttttggtccaagatggacccatcaaaccgtgtggaaaacaatggaaatgtgttagacttttgggaaaattcaaaaaaaaaaatttatcaaaaattataccaaaatttttttttttaaatttgaaacgatcagtgtactatttttagcgcctccaataccacatcaatggacttaaaaaatcatttccatcccggcgtaaaattcaaaaatttgtaaaaaaataggcctagaaaatccgagggttccacaaaaaaaaccttggtcctgtgcgatgatttccgtgctgacaagcggtgggctttccgcttgcggaaagccggtcggaaacagtccggaacgcgtgctctggtcatcctcagccacttgaacctaaccaaaatgatcaatttaaaaaatggcggcctaaatttaagcgccaatttaaaaaaatttaaaccgggaaaatggcgacgacgcaaatttaagagccttgccccccctcgcaagaattttccaaaaaacgtggactaaatgaagcgcagcatttccaacacttacaaggcttggcatcatgtccgggtcaagacgctgtcgttgcggctgtggcggttggccaggtggaaaagcgctgccctgctttaaaaaaaacattttttttaaattcccatttattttgcggctcgatgtttgcggtccgtacatccaaaaagggctttttaggctctaattcagtttatgcatccaatcaatgacaaatcctcagtttcctaggccatgaattttcacaaagcaaaagtctcgggaacttagagaccggaatctgtttttagtcatagcaaacggaagccaaattacttggaccgtaaaatccaaccgaaaaagcctgaggctgttgcggcatggaaggaaaagcctggggctgttgcggcatgggagggaaaccctgttgttgttgttgttgcggcatgggagggaaaccctgttgttgttgttgcggcatgggaggaaaagcctgctgttgttgttgcggcatgggaggaaaagcctgctgttgttgttgcggcatgggaggaaaagcctgttgctgctgcgacacaggtggaaaagtgggcggttgttgcggcatttgagtaaaagcgtcttgttgcggcattggaggaaaattctgttgttgttgcggcacggcttgctgttgcggcatgggtggaaaagcctgttgttggtgttgcggcacggaaggaaaagtctgttgctgttgcggcacggattgctgatgcggcatgggaggaaaagcctggtgctgctgcggcacaggtggaaaagcctgttgctgttgttgcggcatggatggaaaggcggtttgttgttgcggcacgggaggaaaagcctggggctgttgcggcatgggagggaaaccctgttgttgttgttgttgttgttgcggcatggaaggaaaagcctggggctgttgcggcacaggtgggaaagtgggcggcgattgttgcgaaaacatttttattttctaaatttcagcaatatctctacataaaattgagttttggtcgataaaacattttggtacattactctttgagtcatggccaatttttcgtcaacaaagagagttatcaggtccgtttttgggtattaattagtgcactaattgacgtttcttttggcgtaaataagacctttttcacaccattcatttttgagaaaatccaattttctaaaaaaaaaaactttattgtgcacta

SEQ ID NO: 12152 - DNA, 1656 bp, Heterodera glycines
tcagattttgacaaggcacgcgcctaccagctggacaatatgcaattgccatttgttaacgacgcattcacttttacgacttattcggtgccgctttattctataaatttgagattattttactaaagttatctccaaaaaaacacaattttttgctctaacgcagcctaaaagtatgtattacgaaagatttaaattccccccccccttttatttttcaaaaaaaaatgcaataaaattgaaaaataggcccaaaaagatagaaacaattgtaggaatatctgagttgacaaatttgtattaatgcctacctttgtttagataatcattttgtgcactctgtacccatggatttggagttcgtgcgcacaaatggcctcatgggcttggccaggtggcgccgaggtccccccgaatttacgaattttctcaaatctttttcaatttccagatttggcactccatcgttttcatttgggtgtcttccgtcgtggagacgctcatttcgttgccattctcatattaccacacatttttcattgaacaaaagcacggatttaacaacgaagtgatccaacaattttttgcccactttttgccatgaaattcttttcagacagtgccatttttcttcaaagaccgtgccatgaaattgggtgtcagtcttgcgctcagctcaccggttgtggccctgttggtgtggatcattcgaaatgggggcccgaacttcccgatttatgcatggcttgccctttcgctcatcatttttgtgcgttttttcgaatttttttgtcagttttgatcccagacacgcaaaaattctccccgtaaatttgcataaaaatttggaggtcagagcacgcggagttctttcgttttttgaccctttccttccgttttctttaaattttgctataatctcccaactttgttcttttgaatttttttgctgtctttgtaaacatttgttcttctcactcgtaaattacggtgttttctcgaaaaacataataatttatcataaaattccaaaaaaaaaaaatcgcggaaaattttttaaattttttttctttaaattttgttgtgttcaggtgatgatgtttgtttaccctgaattcattgcgccccttttcgacaaatattcccctctgccggacagcgaattgaagcgcaaaattgaggcgttggccgaccgtgtgggctttccgttggccaaactttacgttgtcgaaagttgccatgaaaaattattggtttatccgcttttttgcattttcagattccaagcgttcctcgcacagcaatgcgtatatgtatggcttttggaacaacaaacgcatcgttctgtgggtttcttaaatgaataatatttttttttcgattttcttgataaaagttaaattctgtcaataaaaacttgttgaaatcttaggatcatgtgaaaaaataaataaattttgaaatgttcgacctttttgttcgagttaaggattaggaatttgtcaaacttgatgtcagattcgtaatcagcgacgccgaaaacccacgggaattggcatttaaagtggttggggtttctcgttcaaaaaaaaaagaaaattatgcaaaaacaaaaactgacaaaaaattgaactgttttgttcagtttcgacactt

SEQ ID NO: 12153 - DNA, 1835 bp, Heterodera glycines
cgcaattccatgcgttttgagtcgtggacggttcagtcccaaaggcatttggccatttcagtcccgggtctgtaactcttcagggattggtttccgcaaaaaaattctttcggattcttccattacagaccgagagctatcgattggtatatatttcgaccattttcggctctgggccatatgatcaatatttatcgctattttaaattaaatttttcttaaagcatgtattatgatgctaaaactgttggcagtaattttcatgaacatatattacacaaggattataacacatttatgaggcaacattgagaaaacttaggattggatatggaaaaaaaataatttgaatttaatttaaaattgtatccttattttcaaacacctgatttacacacaattattcaatcttgaccaactctttcccaactcatagtttttcaggtaaaactacaaactcaaaattttcgaacctttaccggttttgaaccggtttaaaactcgaaaagtgaagaaaattgaacacttcagatcttttaaaacggtcaaacccgaacaaatttggtaacactcgaaaggtttttaggtgagttaagtctaaaatcagtggatgaagtcgaatcaacggcatctaacgaataagcatagtgacaactgattcccattgaaatacacttcagtaccacaaaaataatggaatgaaaataagactttaaaagcaaaaattacgcaaaaaaaagcatgctcatagtcaattccccccgttgctgtttttgtagatatcttaagaacacacattcaaatgaattttatttttggtaaatggcaaatttcaaggagcgatggaaaagggagcaaatcgaatgcttttcggatgttttcaacccacttttcccaaagattttccaaattcttgggttgattttaccataataagcacaaccaaaatgctgacttcgaataaatttcggattttgaattccggccacaaaagtctgagaatttgtttcatttttttatttggtaaaaaaactaaaaaattaaaaaatgtcgcttctcacattcccatctttttagagcttctcattctcgcatttgtgcgacccgaaatgatctttctgaataccgatcggtgcttaacgtagtcagcaaccgatcggagtatcagaattttcaaaggtgggcaattcggacggaccttttgagcttttcttgaacattttcagtgttttccctcctgccaaagagacagcgtcaacactcagctgtatttccacgtttcagcaccaaaaggaaaattttgaaacgaaaaattcttttaatttcatttgaaggcttctatgagaattttcaggtgacagacgggttttttttgaatgaccgctgttcaggtttaatattacgaggaacagctgaccacaattgccctcggttggtctgccgactaatgccaaatgactgtctcttaagggttcatctctcagatcggtggtcagctcagcttctttctggggcctatttcaattcggatcatatctgcgatatgactctatgacacggtgtcatatcatacgcaaaatttctgtttcaattaaatcaccgcaaaaaaacgcccttaaattataaaagtttcatctaggttattgcaaaaaataattctcttgtttgaaaaattaactattttttcaaaaaatttgctcgatcaaagtatcacatcaatcacttctaatcgcttatttaaagttttttaagctgtcagggattgaaaaaattcaagttcgactccgattttggacataagcgcaaatgtccggggcgtaaatgtggggtaaccg

SEQ ID NO: 12154 - DNA, 1948 bp, Heterodera glycines
agcaagttagcaaaaaaaggcatatgcctaataatccgcgtctctagtgatcagcaccctcgaaaacccaccggatagtgtttttgagagagaggcagagagagggagagagagaaaaaaagaggaaggaggaaagagaaaaagagaaaggaaaaaacgagagagagagagaggaaagaggagagagagaaaaaaataggaaagagagaagaggagagagagagagaaacagagagagagagagagagaaaaaaagaggaaggaggaaagagaaaaagagaaaggaaaaaacgagagagagagagaggaaagaggagagagagaaaaaaataggaaagagagaagaggagagagagagagaaacagagagagagagagagagaaaaaaagaggaaggaggaaagagagaaagagagagagaaaggaaaaaatgagagagagagaggaatgaggagagaaagaaaaaaataggaaagagagaagaggagagagagacagagagatagagaaaggaaagagagtaagacattgatagagtggaatgagagagagagagaataactaaaaatttttaaaaattatgtctcagtgacgaaatgatcggccaccaaaaatacaccccctaagaattgaactagaaatttcaaaaaataaaccctattgttttttttgcctttcagttttcagcgataattaaataaacgtattgttgaccactgagtttcaagtgcctttttttgtcaagagatccagaaaaaaatttaaaaaacaaaacaaacagttaataaataataaatatatttatgaattcgaacgaaaaaaacaacaaaagacaatgatgagagatgtctgagagaaaataaatgagcatcaaatcaaatcaaattccaaacggtgagatcgatcattctcaatataattaattcacttccgcgcaattagactccatttccctcagtttcttccttttcctcctcccttttacgtttctgctcctgcttctctcatgtaatctgattcgtcccatttgctagaaattgaataagttgctaacgacaattcctgacttattttgtctgccaatgagcttgtcacgaatccccaattttgtccattttccgataaaaaaaattgcatttcgccaagaaatcgtcggttttacgccaaaaaatgatctgatcatatctattaattatacgctatttaagaaccattaaacgtgtttttgatttaccccttgaatgaaagtctagcacacgaattcccaaaattgtgctgttttcactaatgaaatctggggtttttaagttgtccgatgcgatgcagtttttctcattgccaatgcaacaattgggctcgagccaaaatttggccaatgccaaaaaaattaaattatgatttataaaaaaaaacatacacaatgctctccaacttcagaatggccttccggtcggaaccaatgtaagagacagtgcatgtgttttcctcaggcgaaatctgctcgattttggccgagtgccactgtccgtccacttcgtagagtgccatgcattgatcaccgactttccactgaaaaaataaatttataaaagtaatgaaaagaaagtcagacagaaggaaatgagataccaaccttctgaacctgttctttctgttggtttgactgtgcgttgtcattggctgaggaagtgttctgaataggatcaacaatttaagggagaagaaccaaggttttcgaagtgaaaaaattcggcgtcatccaaaacctggctatcactcccagaaaaaaatttgaccggtttttagcgaaaaattgctgatttttttataacccctactttgataattttggacccagtctattttttatacccaaaaacgcataaaaaggtatttttaataaatggaaccttattagcacttaaaaacccggaattttagaattcaa

SEQ ID NO: 12155 - DNA, 1352 bp, Heterodera glycines
  misc_feature (1211)..(1211): n is a, c, g, or t
  misc_feature (1214)..(1214): n is a, c, g, or t
  misc_feature (1252)..(1252): n is a, c, g, or t
atcgcagtgcatttgttaacagcttttgtccgaaaatgaccgaattttgctatttttgccattttcacgaattttattaacagattttcagcaaaaaaaaaaaaagtatatttcgtaaaaaaatttacaatagagaaaaacgagattcaatttcgtaaaattttttaacgaaatgcaattcaaaatcgtaaaaattatgggttttttgcacaaaatttcgatttttttttcaatttcgtaaaaatttctcatctttaccagtgctttttcgtttttggtcgaaaattttacgaaattgcctcggacccccttacgatttacgaaattgacctcccccccccttgtccgcctatgtctggggtttttaagtcaatgcaacaattgggctcgagccaaaatttggccaatgccaaaaaaattaaattatgatttataaaaaaaaacatacacaatgctctccaacttcagaatggccttccggtcggaaccaatgtaagagacagtgcatgtgttttcctcaggcgaaatctgctcgattttggccgagtgccactgtccgtccacttcgtagagtgccatgcattgatcaccgactttccactgaaaaaataaatttataaaagtaatgaaaagaaagtcagacagaaggaaatgagataccaaccttctgaacctgttctttctgttggtttgactgtgcgttgtcattggctgaggaagtgttctgaataggaccattaaaatttaaaatcagcaatttaagggagaagtaccaatgttttcgaagtcgaccgatcatacattttaccaaactcggtgtcatccaaaacctggctacctaaaataattaattaaatatgtaatgttttgataatggccaattaaaatatttaatggaatttttcgtttatgccccgccgaaaaaatcatgatcccgaaaaaagaaagcatttttgcagcttcggtctttttaaattgtgccgagtaacctaaacccgacgtattttaagttaaattacctcttttccttctgcggcagagccagattatgacgaaaaccgccacaatgacaacaacgacgacggcggcgacgattccaaacaacagccaatttgttgccgtcgtcgttgctggtgccgtcgtcgtttcgtttgtcccgtccaggcatttcggcctttttcccgcctccttggcggcgtccttgacaactntanatttgtctgttgttgttagtgaacaattttgccacagngaaaatttcgccatgagaatgtagacgaacagcttagaaaattggtaattgtttaaattttaattttaaaatttgaaaatcggcaatttgcctagttgat

SEQ ID NO: 12156 - DNA, 1109 bp, Heterodera glycines
ttatcgtctccacaattttcttttattattggggggtgcagcggaggagagggggggggggaatttctatggtcaccaccagcaccaccatggctaacaaaggaggaggagaagcagtgaaaagcatcgtcttaatcaccacaataaagggatgttttgacttattgttttgtgggtggtggtggtggtggtggtggtggtggtggtgttggtgggggtgacgccggtggtcacacgacggagggcggcgcggcggcgagcccccgggggcacgcgccgcgggagaaagtcgcgcatttcactttcccctccgcctcggcgtctgtggttttgttgaaactggtttatttgctgctgactgatcgcattgtggcgctgatcaggctgctaagaaagtgatcagaaagaacaatggaccgtggaagagagaagaggagggggagaagcatgtgctttattaaaggaactgctaaggggtgattcattccaatttgtaaaaaaaataatcggcaggagacgagggtcaataaaaactgtttgtaagccttaatttttgggatttaatgtggattaccaagttagcatttggatttggagaaggatgaacgacaaaaggaacaccagcgaaagaattttaatcaaaaatttaaagggtccatattttggattttgttaaaaaattaaaaaaatatcaaaggcttttagggcgtttggttggggtggggagagtaacttatattcaaattaatttttagcaaacatttaacgggaagggggggacgggtaggtggaattttaaatttttttaggaatatcttggatttgtaaacaaaaataaagaaatttcagagacttttaagacgtttggttgggctggggagagcaaattttgctttttcaaatttaaattaaagaaaaaattaatttgtttaattatgcgagaacatttgtatggactaaaaatcgtcaaatattttaattattatcaaaaaaattaacatattttttgacttttaattttttcttgaaataattgttttaaaagtcagccccgagagcggaattttgtggtcgttggagtgggagagtttggcggggggggggggggg

SEQ ID NO: 12157 - DNA, 1750 bp, Heterodera glycines
cctaaatacggtaaattccatataaattttgaaaaatgctatataaaatcacctaaatacggtaaatgccatataaattttgaaaaatggtaaataaaatcacctaaatacggtaaatgccatataaattttgaaaaatggtaaataaaatcacctaaatacggtaaatgccatataaattttgaaaaattcatgctaaagcaaatttaaaaaaggtgcaacaaaaaattggaaaataagaaatgcacttgcgttcacaatgaatcagcaaaaaaagtgaattttgaaatgggaaagccgatggaattcacaaaatggaaaataattactgcttgttactgatggtccgtcgccaattcgtttaatggccacgtcacaattttttgacagatttttttttataattcattcaaatcgccgactttattcatttttaacttccgtagcttatcgtctgcaaaaggctgctaagctccggactaaaataaagggaagagcatcaaaaaaagtgaaaaattcaaaggcagatctcggcatcctgattttatacgctgtgagaattattcagttgtccttgaaaactttttgacagattttctcccgttggcctttgggaaatgcgttttctttttttataataaaataaaataaaatttacatttattatttgtccccaaatagaaggtcctctaaagtcaggtccttaaatccttaaatgtcgaccacggtcaagaagaacgggaaatttggtcgttgagatcgcagggcgaattttgggcaccagaaatttgggcaacgggaactttgggcacttctatattaatttaaaaatcagaagactaaaaattcgaatattacgctgtgatttcatcaataaagattcaaaatgatcttttaaaaaattgtttttgcttgaaaattaaaaagaaaaatctgttaaattaattagtagtcttggtattgtgttgagccaagctcagctcaacctcataattcttgggttagccgacatttgcggaccgacttttgcggataatttagtgaattaaaaaaataaatttaacaatatgaactacaatttaagtgaaacaaataaatgatttaaaaaaataaaaataaccaaaaatatacgagtaagtttaaaaaataaaatatatccaaatatataagggattaatatcaaaatattctacgataagtcagtcatcgcatttaaacaatttcaatttgccaaagttgtgtgatgcatacaaaagcaacagtgcaagttgcttttcttctttctgaattcgttttggcgacccatcaacacctaacaaaaataaataaaaaaagataataattatttaatttattaaccataaaaacaaatttggtcaaaagaagccgcaggcgattcaaacaaagcagcaattttggggaataaaatatcgtaacgaacagattctaagccatctcagagcaatacagtatcgcctcgcagctaataattttgacttttgggattgaacatttatttatgtgataattctaagcgaaaaactttttgtttggatacttttcattttttaactcactcatatatttggataattttcacttcaactcactcatatttttggttatttttatttttttaaaacatttatttgtttcacttaaattgtagttcatattgttaaatttatttttttaattcactaaattattttgaaagggtcggtccgcaaaagtcggtccgcaaatgtcg

SEQ ID NO: 12158 - DNA, 2462 bp, Heterodera glycines
  misc_feature (2445)..(2445): n is a, c, g, or t
cgaaaacgaaaacgaaacgaaaattaaaaattttaaaactcgaaaacgaaaacgaaacgaaactttttcttggacagaaaacgaaacacgaaaacgaaaaaataaccgttttcgtacgaaacgaaacgaaaaacacgaaattttttgaacttatttaatccacaatttaaaacattaaattttaaattgtgtcctcaaactaagggaatgaagatcatagtaggtggaaaagctgatgtggctctaataagttaatttttataaagtcttaaagtaaaagagtcagggcgattcgataggtattgatggtgaattttttgacatttaaaagaatttcatacgcagatttgggttcttatcctttttgtcaccctcccccctgaaatttaaaaaaaattatatttaatgtgctttgtcccgccgatttttcgaaaaaaaattgaaaattcaaatttttttaaaatttttattcttattctaaaattgattaaaactaaataaaaaaaatagtcacaaatcattggaactccaaaaattgtcattctgtacagattctaatataaaagtaaatttttaaaaatttgaattttgcaccagaaaattataattattatttttttggtttttaactttattttgaaagttctaagaggattaacgtccggctgtgcacatagaggaggccgaaaaaaatcgaaattaattaaattcaaggttcccaactggaaatttaaaaaaatgagaatttggccgacaaaaacatgcgcttaaaaaatagtttatttttgtgattttgagcaaattttttgagaaaaataaggaaaatttagtttttgaccgtttttaacatattttcactgaaaattggcaattaagggcagactttgaaatttttaggggaattttgggggtcggtggtgccgacaggcgccgccgggaagaattttggaattttcaatgaattttgtaaagaaaaatgtagcatgtagcaaacgaaatgtcttattttttccaaaaaagtgattcttaagggtgtaaatattttcgtctttttcgtccaaattccgtctgacgaaaacgaaacgaaaatttaaaatttttaaatacgaaaacgaaacgaaaattttttgacggacgaaaacgaaacacgaaaacgaaactcaaaaagtgacgaaaaaagggacgacacgaaaacgacacgaaatttcgtacataaatcagtaccaaaagtacttattttataaataaataaaaataaattaatcaaaaaattatatgaataattaatcaattaactgacggacatgtaaaagaatgacaacatttactggatggcatgaatgaaaaatttaaaaaaaaataccaatacataaaagatgtctattttacaaatatgaaaagtgtaaataaattaaggcaatggtaaactttctgtttaaagaaaataaagataaaattatatgaataatatcatgaaatattaacattatatacataactaaaagttctaggatggttaatgcggaggttcttaaaaataattattataaaaaataaaagatagcacaaaaagtcgcttgtataaataaaatctaacaaatgattaaaaaatgtattataaaataatgcaaaaaaaaaatttctgtttttaatcttattacgttaaaaccaataaatgaaaatgaaagtatttaaaatatcttataaaacaaaaatcctatttttgaagtaaagtgtgtttaatcaataaaaaattatctaaataaaaacacttgataaataagggaataatatttatattggttcaaaaatttcaggtgaacctatcaattgaaaatataaattataaataaaaaattttaacaaatataaaaagagatgcacgaagagatattaacaaaaatttcattgttaagaatgatggaatatcaaaatgtcttaaaatgaagaaataattaattaaacaaaatatgaaacgagagcaccaaatgcatatttaaaacatagtaatgataatcaagtaaatgagagtttaaactacgagaatataaataaagacaaaaatttttttattgaaatttccctttagtaaattaaattatataatttcaataataagaattacaaaacaattctaaaaaaataaattatgcgtaaaatgatgaaaagacaaataagaaaagccgtatttccctcctaaataaggaggattttccccgagtcgattgaacccgacattcaaaaatcttcaacacttaatttaatgttttccaacaataataggtgatactgaattttgggttaaaacaatgccaaatggaataccataatgtctttacaataaatttaaaaaatgttttaaaattaattaaatttaagaagttattatcaaaattcaatgtaaataaattataaattaatattgaagtaaataacatcatttanataaaatatttatcacc

SEQ ID NO: 12159 - DNA, 1630 bp, Heterodera glycines
cgaaatttcgccacactcctggtccccatccatttccaaaaaattttttcaaaatttggaagggtttttgccagtttcaattttacaaataaagaaaattgtaaaaattattatatgccataaattcatttttttattcaaagataaaaataattttgcaaagaatggcaaaaaattgtaaagcaaaaaaccaaaagcataataatgtgaaaattttaaaaaactatattttagcagtgaaaattaaataagttatttataaaaatgaataaaatctctacaaaatgccatcgcaaacagcagaattccaaaatgccacttttgttgccaaaaatgataacaaatccagcgatttgtagtcggttggatagagaagaagtatcttatccgtgcgaagcctcattcataattttttcgagtctgatcattttttaagcgttggtgtcatttgtggacatatttttaaacaaatgagcatttttcattgtaaaagttaaaaataaaatcaaatatttgtaatcaaaaaatattaattaacccaaaatttgcaataattttttatatttttatagaaatgatttttattttaaatgccttgcatttggacaaagaaattgttttcatcaacggttttcaatttgttacaatttaagaaattaatttttatgactaaaaaaaatataaaaccaagttagcaatgaattaaattacttaaaaaagcaaattagttcgagttttaacattttttcaaatcaacaaatttaatttaaaatgacccaatttaaatcagaagacacaaagaaaacaaacagcttcataaataagaatgaatcatgctaataaatatggaaaatataaatcaaagtttcgaaattgtagcaaattcctttttccatcgaaaaaagttgtaattccaatttccaattcttgggcaattttttgttgctcatcttcttattttttcattcattttgaaatattgctttacttttcttaatttgtcctatcggaatatttatgtgatgcttgaataaaaataacagaattaaatgattaaatagttttcttacttttttggcattttggctccaattcttttttccattttataaacgtgtcataagaaatgcccaattccttcacaaattctttctgtttgcctttatataaacttttaaattcatcaaatcgtccaatgaattcgcgctttttctcctcataaagctctttttcattttctttttgtttaaatttaattcttttttccattttttaattttatagtattttgctcctaaaattcttccaattttcacatcaattttgtgtcggtctttccgttgatattttcctctttctctcaatttttctttaattgtttcaaactttcgaattatttctcttttttgttgatcatttgggtatgtcgccatttcttcacccatttgatcaactgctgcttgtgatttctcgtttgtctcattttgttcaattttaatcgccttttcttctctttcatttttattccattcttcgccaaatatttcgtcaaaatttggtcggattttcccggattcaattttaaaagcaatgaaaattattaaaaatattaaatagcacaaattcattt

SEQ ID NO: 12160 - DNA, 1210 bp, Heterodera glycines
tcaacaaccaattgtttgtcttcaaagcgcgaataaatctattctaataatctaatcacaaaaattttgattttgaattttgcaaacaaaatgaataatctctttttaataaatcattgtgatctcgaccagaaaattataaagcataacaattaaaatttaaaaaaaaaattctcgaaaaggaaaataaaaaaatgaagaaatttaaaaaaaaattaataaaatatagattatattttaaaaaactatacaaaagaagctgattcattaagctaagatcaatggcggaaatagaagatgtattatgaaaaaaaattctaagtactaatcgggtaatattttcatcaaagaaatctatgccaccaaccgaccaacaaaatcaatcttgtcgatttagatattgaaaataaaaaaagaatataaaaaataatataacttaattatcggacataaataagaaaggtggatttaaagcaaatattttgatgaattcgatttaaaacatttaacatttaaattaaatttttttaataaattcaaaattattaatgagaaaacattataatgtataacttaatttaaaattttgcataaattaaacaaaaacggaataaacagtaactgaaaattagtacaaaaccgaatgattgcaccagtgcaatatttggtccgtagttctactccagaagaaaacagcactaacataacttgaaaactttaacgaaaaaacattgataatgtaaaaaattattgatataaatttcataaatttaattcagaaaaatcagagcgaaaatatttccactttttaatgttaaaataactaaattatttattctgcagtattaaaaatgaaaaaaatattgcgactagaaaactttatttattaatgtggatatcatctatgcaaaaattaaaataacaatataaaataaaaaatcaagtttcttaaaaatttattctacaattaaaacataaaatttatgaattacgttaccttttgcaaaaaaagaaaatttaaataagaaaaaaatataaataaattaaattttataaaatttatatttgtattttataaaatgaaaattaagaaaagataaaaatgcaagtagtatcagtagcatttaagacatttattactttaaaattaataatcatataaaaaaaattattattcaatttgtaaattatcaaatacaagaacctcaag

SEQ ID NO: 12161 - DNA, 4459 bp, Heterodera glycines
tgcaggtcaaattggcctcccaaagaggaacgggccgcgtacgcgtcgtacagctctgcccttcgcgagtcgctggtcgtaatcgaaactgagtttcttcttgcgaacaacgcagtgctgaacacggacactgtttcacttacgcaaaagtcggaagaactcgtcaattatcttttgtgccgaaatgaaattgactgggcggaaagtgaatcaatttgtaagttttatctttaattacgcttcattcgacaccagcctttgtttatacgaacatttcacctttttagctcgatgtttcgatatcgtcgactcaatttcaaaaatacattctgtagatgttgagagggtgtttttggcgctgatcgatcgttgggtcatcgaaggccaagaacagtcggaccaagccgtttcacagatcacttccgaccccgactccaccatcgactttactggcccttcggttctgtccaactcagtcaacaccgatgattccgactttttcgttccggtcctttacgacgacattcaaagtcccatagaattaattgaattcttatcttttgagcaatttcatttcagcaactcggatcattgtccttttgcgacggattagggaaccgacgaagaaaatcttggaattttcacacaagtctgaaattgtgagttggctgttttctttgctaattgttcattatttgttggattaggatgtgtcggtgctccccggcggttatttaaccaaagttcgcattgcctgctgcattttgcgctttctgaccgatgaacagatgaggacaatgttcaacattagcatagaccaattttagtaagtcatcatcggcactgaattccattataatttacgtaactcttttagcggaaatttcgtcactatgctcaaccagcggctttactcattgtgccgcatcgattcgtcgccgaaggatctgaaggaggccgaaagggtggactttgtgcgaaccattctctcgccccaatcaattttccgccaaactcctgaagtctctcccctcattttgtttttaatttttgcttttatttcatcttttaaagatcgcccgtcttttggtttgtctgatcgtcgacaatgacattgatgacctgacaacacttggcaaagctgcccaacgtctcgtccaacttcgtctgtccgtccctctcttggaattgctgaaatatttgcgcaacatcaagggaaaggacatcagaaccatcccaaacatttcggcattttttgctaagacctttgaggcactctttgacaagatcggtccgctttattcgcttgtctaattatgacaattaattaataattagtcctcaatttttatcagatgcaccagcaactgatcggaaggaacttgcttcgctcgttttcttcttgatcaggtaggtactcgttgaaaaggctgtttaaaaggaatcttaaaattattttaacttcatttaatcgcaattttttctttttgcgtattttcagctgccccgttgagggcgatggtcatttcgctcgctccgtttctctgctggcgtcgagtggtgccaacttcgcctcttcgttggtggccatttccgataattcaacgggggtaccgttcgtaatttaatttttctcgtattagttaattacttttttcacaggaagtaaatttggccaatgaaagtggaaagatgactgatttgtgtggtggaaattgaaaagataatgaaagaggacaactattgatgtacacatttattgaaatgcgggtgtgttggcgaattgatattttagtgcaatatttatttaataatattttttggtattttaatcatgtatttttgactctcaataaaataatcaatatataagcaaatgcaatgtgttcattagactaagggttttagtgcagaatacgcgtcccatgaatttcatcaatagcaaaatttttagaccggaattttgaaatgaccgggccgggagttggaaaatagaacgggatcccgggtccggaactccaggtttttcgagactcccgttcccaatttttgggccggggccccgccgtgactgggattttttcaaaatttttggaattttattaaaaattcgaaaaaaattttataatctttcttttagcttagaattatatcaagcctgcaaatcgaccttttttgcttttcaaaacccttttttactgcgcattgtctttttaccagttgaaattgctccaaattttcaaaaaatccaaagttctatcttgaaaatttgaattaaagttttgaggttaaatcattggtaaaaatccaactcgtactttttcaaaactcgtatatactgtgaaaacagaaatttgtctcaaatcgaagtcgagtcgggtttctgcttttaatttgtaatttcccaaaatttagctccccatttttgtttggctctaatgcagtttacgcgtccaatcaatgactatgtatcctaggtttcttaagtcataacttttttctttcttgcacaaaactcacattcttggtatcaatcgggagcttaaagtccacagttgtttttgtataaaaaaaattctcggacaaaggcaacaatcaaaaaattattgttgaatatacacgaaaaattatgaatttcaggttttttcattgcaatttttttcttaatgcaagtatttgctcttttcttgtatttataaattcccgggactttaagctttaaattgatacgaaggatgtatggatttgtcaagtaagaaaaaagttatcaaatgaaacatgaatcaaaatctttaaaaaactaacattttttgttcataatcagtaggtgggcggcacccaccaaaactttacaataattccatcaatgagaagggaaataaatgaaaaagtattgtggaatacagtatttaaatcacggtagccagattaaaattttcaaaagcctcatttggcaggcaaaaaagcctcatttttgcaaaattattcaaaacacgtttaaaatgctcaaatgttatatttttattttttccatgatcaatcaatttgagcaattttttgttagaaataagcatttgggaaattctgagcacgaaaaatcgaagatttttttgcggcacttttcaaaaactttcggggaataaggggccggcggtgccgataggcgccgccgggaaaatttttgtaatttttaatgcgatttgttaacagatttgtccacaaaaatggccaaatttgtgatttttgcaaattttttcgaaattgcattttgtggcaaattttgtgctctttctgtccgtcatattcgtcttatacgaaaaattttatccaacctcctaggaatttttttaaataaagtttacccgatttcaagcattttagggttttcagatcaccctgaaggagtgatctgattactagggctgggaatttaagtcaaatgactttttttgctgactcgaagatttttatgattctttggtttaattttttacctttttggataaaatttgtcattttacatccctaaatttgaaagtttttagcaactatttaccgatttttagcaactagagtgccacgggaccgggaattttgggcaaacccgggaccgggaccttttcgagttgaaaaaccgggaatttttggctgggaaaaccgggaaaaaaccgggactagtcccggtcccggtcaaaaccgggaccttggtactcagttgtccgctaccaggtcccggtcccgtggcactctattagcaactattttgtgggtttttttagaacctaaaaactaactattttggcagtttttagcaactataaatatcatccctatagggttataaattatatggattaacatattttttctgcgcatatgctatgaagaaaggggctcaaaaatagcatttctatgttaaaattttttgatttagtgaaagtttctagtccatataaatccatattttgggggttttcgagaataaatccatatttcgccatttttgcgtttttagtccatatttcggccatttttggcaaattttcataagaaaaatgcaaaaaagcgaaaaatacaccccctaaagaccgacttttttggaaatttttaaaaaatacagccctaaaaagagaattttttcgaaatttctgaaattttttagttatttttccacttctgaaaattttcgctgaaacagaatgaggttattacaaaaattttgggttgtatttgatttgcaattgtgaagctagaatttaataaaaaaaattgccattttttaactgttaaatcaatttttggcagattttagcgtatttttaagtctgttttacaaatattgaatataaatatatttcgtaattttttatggtttaaaagatatattttggcaagttttagtccatattttggtccctattgggtcatgagctttttagtccatatttcggtctttttt

SEQ ID NO: 12162 - DNA, 2481 bp, Heterodera glycines
  misc_feature (106)..(106): n is a, c, g, or t
aatatggtaatgtgtctgatctcagtggggcggtcgctgatcattctgtgcccgatcagcccgaatttgtcttttacttgaaattattttatttatctttcatttntagttgaaaaacagtggaagagtttaatataaattcacttcaatcaattttaattttcattattttacaatttaaaataaaaattcaaccaaatcgattatgattaaaatcccgaaaaaactgactttctcggctagattttatttataattgtaatttttgaatttttctttttatcagggctccgaactgaaaatggccgacaaaaaaccagcatttggggtcaaaaataattattttgcaaaatactccaaataaaatcaaaaaaatgttcgttttttgcgattttgagccagtttttaagaaaaaaaaaagttttggtgtccggcggtgccgataggcgaaaaatggccccttttggcaaaggtgcagaattgtggtcccgatgggaattgggagccctgctttttatgatgaataactggtgatttgtattgattttatcgagcaaatttttgaagaaaaaaataacatgctttaaatgaatgaaatcattattggatttttattctctgaaaaataaaaattgatgtcctatttcaacacttttacagcatgttttatcatcggtaaaatagaaaaaataaataaatttttagtttttaattaattaattaagaagcatttttcgcgcaaaactcaaccgctacagcgaacaatgaaaaagagaaaagtggcgaaaattgcgctgacggaccgaaagttgcgacaacaattgaaagagaagaagcagagacaccaaaaagtgacgatgaaaaagaaacgaaatatttaacaaaataaataatatttaaaatttagttcaaattagaaaaacggaaacgccaagaaaatcgaaaagaataattcaaataaatgaaaaaaacaaaattgaacactgtgcagaggaagcaaaaaaatgcattgagaaacggagaaaaagtgacaatttataaaataattatgaagtggaattaattattcattcagaaagcagccaaatggaactgctgctgctgacaaacacagcagttttgcgtgaaattgtccaatgcaatttttatttcgttggcattccgtcggtcgacgaaagtgacgcgattaaatcggcaaaaattttgtctgagaaaattgaccaattcgccgaaaagtcgacggagcatttggtgatgaaacggattcgactgaacctagcatttatcacaatgtctttggaaaagtatttccaaaattattccacctttttcgaagcgttgaaagaaaaaacgactaaggaaattgatgaactttttcgcgattttggaaaaatggcacaaaaatttaacgccgatggcacggcaaacattctgaacttggaaagcgttaagccaaagctgctttattacttctttttcagctgcttttaccgcaacttgatgctaagaacaaatctggtgattgtttctagagccaggacgggattgggtcccgacgaaattggaattaatccccgggtcgggaggtaatcctatcccggtcttatttcaatactgagtcttggttcggcgaattagagtggttgggatcctgacctgatctctacatttgatctggaactgtcaattttttagtcagatacaatggccaacaaacaattgctgagttggctgtactcaatggaaaaggcaatggacggtcgaatgagtgaaatcattggccatcaaaacccatcgcattccgttccaaaaaaggcaacaaatgaatgaggagagaattgaaaccgtccactttatacctttttaaggacttagtttaaattcattttgtagaaagttttgctctcttagaattttcattgtctgttaggtttttgaagggacaacggaaacgaattttatgtatcttttgtattttacggtattattagagataaagcgtagcaaacaattttaatattcgaagatgaaaaaagtgattatggggctaaaaaagaacgcattgaaagcaaaaacagtacttgaaaaggaagaaagagcaaattaaaacccaaaattcaaggacaaaagacttttgcactttcaatcacacagcttgagattcaagaattgtcgttgcaagataattaaaaaaacataaagcatgtttaagatgatttccgcattgggacttcgaattccacggcaatttccgactcttgaagaaattttaacaagaaatgccacgctttttcttgtggggccggaaattaaaataaattattcgatttcccagctcaatcaatggcagaaatgtttatgtcgcatgaatataaataaataaatgtgaacgaaaggggaaatatttcgaaggaagtcacaaatatttaattaatagcatttgtttttattagctcatcatttttcactaacatattaaga

SEQ ID NO: 12163 - DNA, 2843 bp, Heterodera glycines
  misc_feature (30)..(30): n is a, c, g, or t
  misc_feature (110)..(111): n is a, c, g, or t
tttcgctttttgtcgtgattttttattttnccttttgttttccgccaaaaatgcaaaaattgtgctggcaaaatcgtcaattggaagatcaattacccaaaaaaatacgnnacatagttgttaaatttgaatttttgatcaaattcgcaacggttaccgatcagacaaaaaactttaaattgccattttcggatgaagaattggcgaaggaatgtgaaaattgcgaattcgatgtgcaaaatgaaatcggagaagaattactcagaccgaaaagtgttcattttactatccaagtgaccacaatttaccaaaataatggtaaaagaaaagaatttaaatgaaatttacaatataaaaaatatttcggcttttcctcatcagatgctgcaaatgataatctttccttcgtccgtttcatcgaactcattttgcactacccaaactttgaaaagctttacacaatcaatctgcaaaatttggaccattttggccacattcagaaaagagtgaattttgatccttcgcaaatgccaaaccgaacaaattttgccattttatttgcagagggatccggacagcgaggaaacgaacaaagcgacgaggaaaggggcgccgatttcatcggatattccccgataatcccaggcgtatgtgaacattttgtattaaaataattaacttaatcacgaaaattctataaaactctaaaatattttagcaacgaattgtcgatgtgaaaatggcggttgacttccgaaggcaaataacaaagtacgccttcacatacaaaatggtaatggaactgtttgagtttgaatatgtgagcaaaaatgaattggaaaatgcggacgaatgcgccgtttgtttaaatgaatttgaggaagaagaaaagttcgtcatgatacataagaatgagcggcaacagacaaagccagtaaagaattgaaattaaaattgaataattaaataagcattgattaagcatgtgtttcatgaaagctgcatctttaaatggtttgtgttgataataaagtaatgagctcataattatgcattgataggtttgagaaacaccgaatatgtccaatgtgcagaaatgaaataaaagcaaaaaaagtaaaaagaaaaataattttttaaattataaacttctttgattagtgatgtaaattaacaagtttcttttaccatattggcaaactaaattttaattttcattaacaaatgagagtgttaaggtgatggtggattttcaatgaaattttgtaggtgggtagacagaccatccctgggttatattacaaaacaaattttcctaactgcggaataaatttaaatcataatttcaaaattagttattttcaagtgtagaaactaaacattttttttgtattttttgactttaatttgtctaaagacataaataaaaaaactaaaaattaattggaatgcaacggattagaacctcaaacctaaaaaaccaggggtggtggtcccctcccacaaatttcatttggaaattgcaccatcacctgaacactttctttgtaaattcagcagataaccttgttgccgctgttgcaagctgaagatgagcagcagtaccaaactgagtgtgaaaatgcctttgcctgtctcatcgaaatggcggaaggcaacgatcaaaacgaaaattccttcaaaagaagccaagcaaaaatcgcattagatgaaatgacaaaatttgtggacaatatgaatagggaagcgatcattttattcggcatggaacgagaagaaatatcctacggagagcgaatgatcggaatggaaaatggtcaaattgtgctgattagccggcaaataccgatcaaagagtcgcttgagataattgtgcgcaatgctccacttcaagcactgatggagatgaagaaggaaagtgccatcaaactgcttaatgaaataaattgtgccgatttgaagtttcggaatttggcactgcaaacgatgcaaacaattgaaataatgacagaaaacgaaactgaagctgaggaggaaataatggccaagagattgcgattgatttattagaattaatagtattttgttctataaaaatcttttcaatctattagtattcgtggtgaaacggtagcgagtggtgtccgtaggaataaaagccaaggcgtggctgcgtccctttcctagtgcttagtgatggactagcgagtggtgtccgtaggaataaaagccaaagcgtggctgcgtcccgtccaacaatttcctagtgcttagtgatggactagcgagtggtgtccgtaggaataaaagccaaggcgtggctgcgtcccgtccaacaatttcctagtgcttagtgatggactagcgagaggtgtccgtagtaataaaagccaaggcgtggctgcgtcccgtccaacaatttcctagtgcttagtgatggactagcgagtggtgtccgtaggaataaaagccaacgcgtggctgcgtcccgtccaacaatttcctagtgcttagtgatggactagcgagaggtgtccgtagtaataaaagccaaggcgtggctgcgtcccgtccaactattccctagtgcttagtgatggactagcgagtggtgtccgtaggaataaaagccaaggcgtggctgcgtcccgtccaacaatttcctagtgcttagtggtggactagcgagtggtgtccgtaggaataaaagccaaggcgtggctgcgtcccgtccaacaatttcctaatgcttagtgatggactagcgagtgatgtccgtaggaataaaagccaaggcgtggatgggtcccatccaacaatttcctagtgcttagtgatggact

SEQ ID NO: 12164 - DNA, 2452 bp, Heterodera glycines
  misc_feature (1161)..(1161): n is a, c, g, or t
  misc_feature (1183)..(1183): n is a, c, g, or t
  misc_feature (1185)..(1185): n is a, c, g, or t
  misc_feature (1204)..(1204): n is a, c, g, or t
tcaaattttcaaatttttccccggcggcgcctgtcggcaccgccggaccccccccccccctcctctgtcccacaaaatttttggaaaaagcgcgccacaaaaaaagcgtttttaaagcagaaaaaagtcgtcgtaaatgaggaaaatgatcagcggaaataaaaaaatattggaaaaaatccattccggtgaaaaatacaagccatttgaataaatattaaccatttttcattgcatataataaaaattttaaatgtccttgaatttcatgaattttccccactatgtccttgcaaatcggcatacccgtccttggaagccgaccttggacgatggcagccctgatttgcataattgttgttggagaattaagtcataaaaaaatcgccaaacagttagaaaaggcgctaaaaagaagagccaggaaattttatcgtggaccaaaaaaaatcttttttacaattttggtcataacttttctgaaaaaacaataaaattttcggtaatagttcagcttgataacattttggagttgggtctaaggctgaacatcgatgaccaaccgaagggccagcgatggtttattctcggggtccaatcgacggaagaggacgaaatgtgccaattggcaatggcacagctgaagcaaagtccgatcagtttggccatgcattgccattcctcaattccccgttcatagatgccattccattggaaggcgacgaagtccaactcatcaccggcgaactttccgaaaaaagcgtcactaaatctgccggtgccggtcttctcaacattcgaagattggccaacggcaccagtgccgaatcggaggtgcagtcgaacaacggcacgaagcgcacagagtgttctgccaacgaacactttgacgtctgtcccgagacgggccgcgagtgcgagccctcctgcgattggacagcgttccccgactcaattccgagctgtgccccgcggggagaacagtgtgggctcccgcggtgtgtgtgcgccgagggcttcgtgcggttgagcaaccagcacgacgagtgcaagccgttcagcttttgccaggcgcccgaggtcgacgcggcgacggtgccaattccagcagcagtcactgctcacatccgacagccctcacaatcggcatcacccagtggnaccaccgcttgcagggccattnanatgtgcggccaacgaaacngtggaaaagtgcgggagggcgtgcgaaccgtcgtgcgacacatgtacagcgaagagccgtgtggcgaggcatgcgaagtgagcggaaagcgaaacgagagcggcgagggggcgggggggggggaaccgaaaggggaacgatttgccaatgctcgagagtgaactctcgggacaatgactaagaaaaggggaattcaatctcggcactttttttgccaaggcccctgggtgcacttgcgacgacaatttcgtccgtttgtcagcgcgcggtgggccgtgtgtcgcgtggacggactgtccgagtgagtgccgtttccccaccctctccccgcgatgtttttttcgaatgtccacggccgtttcagacttaaaagagatggctgcgccgactctgcccggcttctcctcccattcgcctttttcctcctcctccgatgcttcttcttctcccgcggccgccaacatttcctcaacgttaacaaccgaagaagaaaccaccgaattggagctgttcacggcgactgaaaatgcagcagaaccgccggaagttggacaatgcgactcaaatgaaacgtcagttggaaacaatgggtaattaattcattaattgcctaattagtgttaacgagtgtggccgggtttgtgaaacggactgtgtgtccattttcgaacgcgaagaatgccacgggtgtgcagcaccggcatgctcatgcagacaaggtgagacacgtgaaaaggatgagtgattggaaaaatgatcaatttccaggatttgcacggagcaatggaaaatgcgtttattggggcgattgtccgacaggtgagcagaacaaagccatcgggataaagtgatcagcagagggtagttgtttctgctgatccatcggtgatcaaccgttaaaaactatccgtcccaaattcagtggcaatcgccgcttcctccgatcagtccaaagggttgaacaacctcgaatccaccattttcccatcgggagaaagagcgttgtcctcgccaacgaagggcacagcaaatggtgccaaatcggtggagacatcggcggaagaaacgccgttggatttgtgcggcggcgaatgggcgtggcctatcggatgcgcgggggaaaagtgcgcttatcgcctcagatgggactatgacgagaaaatggtggccaattggggacattggactcactcattggttacatcactctcagaattcggtcgtgtttttgcttgacacgcgaccgat

SEQ ID NO: 12165 - DNA, 1700 bp, Heterodera glycines
aaattaaagatgtttggatacctttttttttaaatttggtcgtgtgtgggtagtagatcgccttctgtcctcctttctgtggaacaatgtggaagaagtcccgattttcgagtcaattgcatttttgtctctgtctctctgttctgcgttttttcgcccagttcagcgtacagggcgcgtatgtgctttcttaattcatacccgtactttgaagtatttgttgttgacgccgatgatccagaagatgaagggatgcgctaaattagtttggtttttatcggggcctcagaactgtgtgttaatccaaattcggtggtcttttgagtctttgatgttttttaaaaatgaggatttgagtatttttgtgggtggaggagtctgaagtcatttttaggggtgtatttttctttttctttttttattcggtttttaggggtatatttttggttttttgaaatcacgaattgggcgtgtattttaaaaaatcaacaataaaagcgcacaaattcaacacaaccgatgcattttttacatcttttcgttgctttttttctacccgaattttttagttcggtttcaatgactataaaaataatacagaaagaaaatgttgcttattgtttagagaaagacaattattattcagcatttttgtgacatcgatcagttgtaaaacggcaaattgttgtgctaattgaaccgcaaaaaatgaacagacggtgaggaattttttgaaaaaaaaaaaaaaattttcttataactttgctctaaagcaaccaaatttttcattcttaatatcattcgataggcctaaaggttctctattgcctgaaaaattcaaaaaaaaaaattttttgttaactcaaaaaagttatggccaaaaataaataatgactccgcccccgttaatttgtttgactcgcagtgggacattttcggacggacatttgcggacggacatttgcggacggacatttgcggacggacatttgcggacggacatttgcggacggacatttgcggacggacatttgcggacaattcctgagaaaaaattaaatgaaaaaaattttttttgttataaaaatttctaatggaagagtgggcctcgtcagtgcggtgctcttccaaaagaaaacaaaaaataagaaaaaaagtgtgtttcggccctaccgcagacacacaaaactaaagaagcacacatcaacaaattaaaaaatacaagccaaaatatttttttaaaagccaaaacaaattaattcgtaattatttaaattttttattaggcttgctgaaggccccaacaacagcctatttttacaattctacaaaataattggcatgaactaaatgctaatatggcaaagagcataggatgttgcacttaaaaacagttcttctgtttgctgtgatagcatttgcacgtactacatccattgaatttgttctcagaagcatcataattgcaccgtcttcgtcttcaaaggcgcgagggtggaggaagggaggacggaagcggccagagcagatggagaggaggagagacctgagaggacggaagcggccagagcagatggagaggaggagagacctgagaggacggaaggcgcgagggtggaggaaaggaggacggaagttgtgagaacggatgaaggggaggtggtagttcagagaatggaatgtgtgggggtggatgaagg

SEQ ID NO: 12166 - DNA, 970 bp, Heterodera glycines
  misc_feature (931)..(932): n is a, c, g, or t
  misc_feature (934)..(934): n is a, c, g, or t
  misc_feature (936)..(936): n is a, c, g, or t
ctatacgaccaaagtggcgaatttttgccccacgttcggctggccaaagatttggtggagaagtacgaccaccgtgtccgacccgtgatgaatcattcgatgccgacgcgggtcaatttcacgatgaggcgagcaattggggaacagagtgaaattaatgcaaatttaagcctttatcaagtattggcgatcaatgaaaaggtgcaaagtgtggatttaaacttgtggatcatccaaaagtggaaggacgaattcctcggatgggacccgcacaaatacggtaaaataccgaaataaaacggcatatctgatcattaatactgctgtttccaagaccaatttaattaatttattcttttctactgcaccttaattatttattactttttgagagggacggaagggagggggtaattaaattaataaatatccaattaccctgcttgggatgagttgccctttctcggctacgtgtgccattttcccgactgtatcattcaggtggtatcaatgccaccatccttccctatcaccgaatttggctgcccgacacgtatttgtacaattcgatggtgatgaaccgcgacgaagtgagcaaaaaaacagcagagaaacagtgcatttttaaaacatttttagagcgaacgttacataaatgtgatcgtgagcacaggtgggccaaacagagaaagacattagcccatttaattggtcattgaacagattattggaacgatcgacgcggggccgaggtgaattttggaatggaaagtgacaaaaagaaacacataatcagcagtaatcacaaataaattacgaaattatcagttttattgagaaaagcaattaatcaatgatcaaaccaaattggacaagttttcattaattgattttgattgacaattgcaaaaaacgttgactaatttgtgtnncncntttgccaggtgatgttcatgtttccggtattgta

SEQ ID NO: 12167 - DNA, 2585 bp, Heterodera glycines
  misc_feature (164)..(164): n is a, c, g, or t
ttttttttgtccattagtccattcatacaatgatcatttttccatttgtgcacttatccctttggtcattcgtccatttgatcatatgtccatttgagtttgtccgttagtccattcatacaaacagatcatttatacgttttggtcatttgtcgtattgattntttgtcagttttggtcatttgtcagtttgatcatcccattgtctgttagtccattcattcaaactgatcatttatacgttttggtcatttgtacgttttgatcatttgtcagtttgatcacccttcccctccctttctcattaagagccgtgggtccttttgcacgcttctttggtcgttcgacgaaagcccctctattacattgtacacactttcgtttaacatttccattttcttttcaccaaaaggtgaatctcgttctgcccacttcggtgatcactttggtggcggtcaccggctttttcacgcccgcctccaccagcaatgaacgccgcgaaaagctcagtttgggcatcgattcggtcggctaaaatgccaaaaaaaacattcggtaaattgcattgcttttcagttattggcaatgtccattctgatgatgatggtcagttggatgcttttttgtttaatcaattcctttttctctttaggtcagcgaacaaatgccaacgtaacattttattttgtcccattcccattcaaatccaatcaccccccccccccctctgatcagcacttccgaatatgtgccattgttcggtcagtttgtctttggaatagagtcgcagccggggaatgacaaaaccggggatccccccccccatacggggaatgtataatcttttttcggtgactttaaaaatattcaacgagatatactaaaaaaaggatttttataacgtttctcccatttttttctttttttttgctcaaattcttctcctagttcgtcaaaaagttgtttgattcttgggcgtcgagcgcattttttgatccccgtccccggcgaggatacggtgcggggatcactgtttccgtgggtgggaaggggagtggggatgataattccggggattccccccccccggctgcgattggagccaccaaagttcgtttgtttgaccatcggttgccccttgaaggtctcttctacctgtccatcattgtcattattttttctggcactttgatcaccgccctcgtcctcaatgttcaccttcagaagacctataatcgtccgattccgcctttgatcacgtgctttccccgctttccccatttgctcgatcgcaaatcgccttttccctttcagcttcatctttttccataaaatcgccccttggcttggcatccgtccttcaacaattcttttggaactttggcaagaaactggtataacattcgctaatttggtctgatcgtgtaaattaatgttcattattaaggagtgcgcattcgaggattgaatgacgagccacgacggtcaagaagcgattttcgaagacgagtaacgaaaacgcgatcatcgtcacatgggaaaccgccggtcctccaacggcatttggctaccagtgaagcgacagaaacaatggcaaaaggacaaattggcattgaccaatcatcagatgaaaagtcagaaataaataaaaaaaagtcaccccgaaagagaagaggaacagttaaataatcaaaaaattcagaaaaatggtgccgaaaagaaatttgacggctggaaatttgctgcaaaagaggcggattagcagcggtggcggaggaaatagcaaaaaatggaaaaagccatggacagcaaagggaattgacgaagaaatggcagagccaaatttgggagagtcggcgggcgaatgggcgatgttggaacggtcaattgaggaggaggacgaggagagcgaagcggcgacggaatggcgaagtgccaacccaaacagcggactgaacgaggaaagggcggcgaacgcgcgacagaattggcgacgcatagcgcagaaagcgtgcgcacaacgtaagaggaaaggaaaaacctcgtaaagccgatcgaaaggattatcggacaagcaaaagccgaccaaaaaagattggcaagattagctatgccattaatcagaaaatgatcagcagatcaacaaacggacgaattaccatttaagtgatcagatcgaataattttgggctaaccgacttggaaaaaccggcaaatcctactcgtttatagtgaccgaagaactgattggttgatgaaatgcttccctcgagattcagaccgagatgctcttgagcgggctcagcccaccaattctgccggaggccgaattcccgaaagagagtcggaagagattccattcgcggatttgtcaccgggccggctttccttggcatcccccgcccgtcacttcagcccctcctcaccccacggcatttcctcgtccgttctgtcgccgcggctccttccgtcgcttcccaatgcttcatcatcattaactgctgcagcttctgcgactgatcgtcctcgtcatcctcccaatgcttcatcatcctcagtaccaaaagcacccgtaaagaagcctc

SEQ ID NO: 12168 - DNA, 523 bp, Heterodera glycines
tcctcctcctccaacacaacgacgacgcatttggtggcgtcgactggaaattcgcaaaaaaattaggcaaaaattttaaaaaatttcaggaagaatgaaacaatttttataatttttttttttttgtacagcgcgccgcaaaaaaaggtggttttaatagcaaaaaaaaaaggtcaaaaaaaaagtgtagcaaaaaaaaggtggccaccggagaaaaatgtggaccatcgtatgaaaaatcggtccagagacatgcccccccccccgggtttaccccaaaatttcgccgcccggaatttcgccgggacataatttggcgccaaagaaattttttttaaaattctaaaattcctaaaaaaggttagaaattttttctagtaattttttcgaaaaatttttgaaaaatttactaatttatcataaatttcattaaaaaatcgctgaaaaatttttctatttttttttactgagacaccccgtgcacatgtatgtttccgaccttacatgaaaaaagggggggggg

SEQ ID NO: 12169 - DNA, 1846 bp, Heterodera glycines
ggtaggggacctgctacggcgggaaagagggggggggggggggaggagggaatgtagtgcaaacccggtaatttgattttcagcaaatttttttaaaataacaattattcaaacaacagaaaaaaatgtccgtgttttttgggtacacacaaaaagtcgccgagataaaacagtcgaaaaaaaaataatataaaattcaaaatattataagaaaaaccttaagaatggtttaaagcatttctttgatctatttcgaatttactaggtaactaaaaaaaattgcggcgagttttaaatgctttttttaatggaaataaagtgcaaaaaaattttggggaataaaattttctgagcgggtattatataaaaaaaagacccaagaccaattggaaactgagatttaagtgcaacaaatgtttcaaatccacctcaatgacaatgtccgcattttcgatggtccgtcgaacttcggtcgcaaatgaacgcaccgatttggcattggcaccgccctttttggccattttctgacgtgcctttctctcctgttccattttctaaaaattataaaaaattcaagggaaattaaattaatcgaaaaattccgactctgtttgcatatgggaaaatttgcataatttgaggcttttattcgaaacaatgttaaactcacaggtataaaaaatgttgaaaactaaaaaaaaatttctattttttgtgcaatgttttttaaaaaattccagcgcctgggagcaaaaagcaggaatttatagccatttttttgccgaaaatgatcattttgccattttaaaaaaaattttttttactaacgtagaaatttttgaagaaaaaaaatctagaaaaattttcaccgatttgttcgaaatttttttttttttgaaacagtaattgccattaaattttttttaatttcaggggtcactttgggccatgcccgacatttgcggctatgtccaaaatcgggttcaaaattaagttttttttttaattcctgatccactaaacagccataaataagtgatttaaagtgcttttatccgatcatttgatcgttaatggatttttcaaaaaataaaaaaaatttaaaacaacaaattattgattataatgaaccacaagaccgaattttcttaattttaatgctgtttaatctgacagggcttgaaaaaattcaactttgagtccgattttggacataggcacaaatgtctgggccgcaaaagtcggggctccctttgggctacctataaatatttaatttggatgcttctataaaacgttatggtgcattaaggttgctagattatttaccgcaacaatttttgataggattaagctattcagaaataattccgacttttagggtcaatcgcgcgcatccagtcaaatttgaaatttaagcggagttagaaaaatgcatttttcttaatttttagcttgaatgagaggctctataacattttcactggcaacaaaaaagggatggcaatccgagtatggcattaatgaaaaaatcaaaaattttgcacaatttacggcactaatgaatttttttgggaaacctttgcctccgtccgtttctgttccgcctccatcaaaatttcctctttgaatggacatttgctgggcacggaaatttgcttttccgtcttctttttccgctcggattctaaagtttaaaatttttattagggttaaggtaggtactgaaatttccgaaaaatccaaggggttttcgttttaattttttacctttggacattttcttaagttttcgcgagtgttccctgaaatgtgcgctgaattttgaacttcttcttacaagtca

SEQ ID NO: 12170 - DNA, 1005 bp, Heterodera glycines
cgggcaacaacggcggcgccatcgcagcggggacctgttgaagaaaaataagaatgctaattgcaagaaaagtaagaaattatggaccggaaactgtatgaaaatttgcttttgttttacgcataatttaaatttgcacattgctataaatgccacaagtcatcaaaaacggaactgccttaggaggaggcaacggcgggggaaaccccgaattttatgggcgccagggtttttggtccaataaaattgcgcattttgagattttacaaaaaaaaaaaaaaattttttttttttgatagattttatttaaacaatgtccatttgatttttgaataaaattttaaagcttcaaatggtcgccggtgaatttttgtttatgattttttaatgaacgccgaaaacattaagaaaattgatggtccaccaatgttggaagcaaattttccatcgaaaaataggcgcgcatcataaaattttcaatgcctaaaaaaagcggcgccgccgggaccaaccatcaaaattgggccaaaaaaaaatttaccgtcgtcgccatatccatttcgttggcatttgcttcttcgctttcctcgacgggctttgtggacgcaacgacaacaacagtgccgcttttttggcattgtgccgccttttgaagtgcggccgacgaatccgacgccgcgtcgtacagcgtgtccaccgccatcacattttgtggcatttctgaacggtttgttttttgtatatagagacagtctctcaaatatgtgttagataatgggggggggggtaactctttaaaaaaaaaaaaagttttttcaccacaacaaaatttggctaaaaaatggatgcgcagtttgtttcacccagaaaatgaaaaaaaaaatctcaaagttagaagagttttccaagaaatttttacaattagtcttttttataagaacatttaaagaaaagaaaagaaaagtcctgaataattttttaaaagaccgaaattcatcattaaac

SEQ ID NO: 12171 - DNA, 4967 bp, Heterodera glycines
attttaacagtgaaattacagtgcagcaaattgggactcatcacggaatgaacagcagcagttgtgattgctttggacatttaattggccgatcactttttcgtcaacaacaataaattcgtcaaagatttccattttgatggcttgcaaataacaaaaccattttcaagaaaagtattaaagtttattaaaattgaattttaatgaattggtctttattttttcggataagggggacaaaaattgaaagaattttataatatgcaaatgctgcgacttatgatcaatatttttaagatcataaatcgttgtttattcatataaatgaacttgtttacatgtgtaaagaacaaaagacatgaaggaaaaggaaaaggaaaatagaaaaatagaaaattaataaatttatttatttttataaaaggctaaaatatttacagaatattatccatcattttagaaaagataatgagtttaaatttatgaatataaaattaaggaacgaaaatatgaaatttatttccataaaaaatgcacaaatattttattgaaaatttatttaacaaaaaagcgaaaatattttgtaaattttattcattttcgaaattaatttttttttaaattatttaatatatatgtaaaccccacagccttgttaccaactttaccagtagggctgtcaaatatgtaaatacatattttttctgttatttgccctgtcccaaaaattcaaaaattttgttgaaaaaaataatttgttaccaaattgtcaacatggttttcgtaaagcacattctgttaccactcaactttttgaagtggtggtggatgagttcagttttgctttagaaaatagaaaatcaattgatgtaatttattttgatttggctaaagcattcgacacggttccacataaccggctaatatctaagctaaaaagcattggtataaataattccttattaaaatggattcaaaattacttagaaaatcgaaagtttttcgtcaaaagcgggtctgatttctctgatgaatatccctgtctcagtggtgtgccgcaaggctcaatattgggaccactgttatttcttatttacatttacgatttaccaaaattctgcgaaactgaaaatgttaaaattaaactatttgccgatgatcttaaggcctatcatgttctttcaaatatttccttttctccactccaaaattttattaacaaatttaatcaatactgtaaatttaacggccttaaaatcgcttcaaataaatgtttaactttacatttaggacacaaaaatcaaaaaataaattattttattgatgactttcaaattcctaaaaatcccggaaacgaaccagtcagagagaccttggcatttattttactaatgatttgaaatgggcacaacatattgacattatctcgaaaaaagcattacgatctgctttcgctatactaaagtcaatcaaaactcgtgatacgaaaatacttgtaaatttgtttaatatttattgcagaccaattttagaattcggatctccaattttcaatccttatttaaaaaaggatatagaaaaatcggagaatgttcaaaaacttttttgagagtaatatttagacgtaacaattatactgttgatttacctaattatgctgaattgttaaacatttatgatcaaaagtcgcttgagagtcgtaggttaaaaatagacttaaaactttttcatgaaacaatttttggtaaaataaatttacaaaataacgaatccttttctttttccaaaaaccctgtaaaaaatgaattcattataagaacagcttattgctcaaccaatgttagatacaactcgttctttattcgaacctctcgtctctatagacttttacctaaagagacgagattactaaatccaaatgagtttgccaaacttcttgaaagatctgatcttaatttgttgatttctttgccaccccaactccaaaagtgaccaattgattgttttgatattattatttcattatttctttatttttcggcgtcacgcttttgcgtataaatgattgattgattgaaaatgtattaaaatattatatttttagtctcccattattggttttaacaattttggggagcaaataagcaagtcataaatttgagtgcattcaaaaaatcagatttttacgaaatttttttgcggtacattttttcaaacactttttagggaacaagcggggcggaaggcggcagtgccgataggtgccgccgggaaaatttttgaaaatttgagtataatttgttaacagattttgaccaaaaattgtccaaattttgggattctgagccaatttttaagaaaaaaaaagtatttttggggttaggcggtcccgttcggcaccggaacgggccaactccgtctggccaactccgtctgagctaacttttagtcaatataactcttgaagttattgaccgaatcaaacaatcttgatatcattcgaaagctcttcacaggctctattagcctactaaaaattacagaaaatttcgaactataaaaaaagatagaaataaaaaactttgaaaattctgccttttttgcggttttcaactgacaacttttttgagagctgattaatcactgataaatagcttataaatatctctaaacatctagggctttcgaatgatactatgattgtgaagtttggccaacaaagaaaaaagttatagctttttgaacattgctgagacggagttggccagacggagttgacccctaaccggttcggcaccgccgtggaaaattttgaaaatctaagtgacattacgccataaaattacaaattttctgaagaattttaagaaataagaacaaaattagaacaatagcccgaaatcagaatatttcttataaaaaaagaacagatccgagccctggtgtaaaatgacaatattaagataaatatttttaaaatcttaaatttttaaaggcgagcaatgccaaaatcggcggaactgaagcaaatgaaaagtggcaacaaatcggaaaaaatgtgttaaattaattacccaaaatttttttaaccaaaaatcaaaaaataaagtgaaatttataaaaccaacaaaagcaaaggaaaagtggagacagaaggaatatcaatgaaaaataaaaagaataagaaaaaacacttacagaagccgatggattaccatggaaaatgcgttttttaaataaaaatgttgacaattaaatactagtgctgctcgagagtttcggtctcgagacttgcgatattttgacattctgtccgttcagattcgacaaatttttgatcaattttgtcacattgccaattgtttttcatataatacaaaatcccaagatgcgcttcacatttctgctttgaatattcactcaattgcgtttcttggtgacctttcataaatgccgttagcattttgtcatcgacctaattaaaaatgattagacaaattaattaccattattaattaactcactgatgaaattgcatttgaaatgtgaattaaaatatgatgaataataataaattgaaaagggattagagaaaaaaaacattatgtttcactaattattgtttcaatttaataatttttaaaatactaaaaagtgattctaagccaatttaggtaatttttatgtgcattttgtgcctgtttcaccctttactaggaattttttccaaaaaaataagcattaaaaaaaattttatttacatccctaataataatatttgatacatttttgaacgattaaattgtaacaaaataataatcgatctgaaacaatttggcaaaatgttctgattcccaaaattttttatttatttttttaagccccaatgttttgattttgaaaaattttcttcgatagaagaagccctggtcaagaaaaattcaaaaaaaaataaaataaatttaaaaaacaaatcaacaataaacaaacaaaacaacaaatggatggatggacagaaaaaagagagaggatgaagattttaattatagtaattaattaattaattgctttttgcatcatcggctctttttcctctaacggcgggcggtggtgttttgatggtggtggccaacaatgcccagtgcaaactgtacacaaccagctcatacgtgccgatggtgaacgccgtgttgggcaccgatcgaatcaactttgggagaaaaaattgaataaaatttaaaagaaaaaattgcactccaaattaaattaaatttttgttgttttgcgagtgcatctggggtgcacccaaaaatttcgccgggacataatttcgccaaacaaatttttttttttaaattttcaaatttcaagaaaaaatcttagatatttgtttagcgattttttgaaaaaattttcgaaaaatttactaattcatcgtaaatttcaataaaaaatcgctgaaaattttcctaaatttttttgaaattttcttaaaaaattctaaaaattttttcttaaaaaatttctaagtttgttttttaaatttttttgctgcgaaaaaattgtattactaattaaatggaaatgttttcacggggaacaggaccaaacatcgccgggacatataacaccgcaattttttttttttttggttttaaaaaacaaagaaaaaaatcaagtaaaaaaacaaaaaattagtgagaaaacgtcgctgaccttaacttacgtaaacagattttaaagaatttccagttaaaattataattttttctcaaaaaacagaatgaaatagctagaaaacccactcttaaatttgttttgctaattttttagagttttcgaatattgaaaactcattgttttttgagaaaaaattctaagttatagtccaaacactcttgcctgagaaattttgacttggcaccgttttagggcacaatcgtaatcggttttagggaagacgaatt

SEQ ID NO: 12172 - DNA, 1134 bp, Heterodera glycines
  misc_feature (65)..(65): n is a, c, g, or t
  misc_feature (936)..(936): n is a, c, g, or t
  misc_feature (1005)..(1005): n is a, c, g, or t
  misc_feature (1016)..(1016): n is a, c, g, or t
ttgtctaacataaacagaatttaatttcattcttcccacatttaaagctatccatcttctgttangaggaccctttgctccttacctgtacgaatggctgcacaaatttgagtgtgtcgaaagggttctcttcaatctgtttgcgtgttgcctgctgcccgacgatttcactgccatttaattcaaaagtatgcaaagaagaacagaaggttgcggctgctgcgtcctccgacatcgaagggacctgaaaatggatggcgcaagaatatcttcgcttggatttaccattgcttcgattttctgcggcaattccatgcgttgagtaatgttaaaatcgtcttcggccgagaatttgtcggccaatctcagtgggaccattgcacgaagaccttccaaagactttgcccaaaacatctgtggagacggtttttggtatgaacgtctccagcccgccctcccacctgtcggcccttctccgccttttcgatgctctcctctttggccgtgttgttcgtctgcttccgctccggtgccttgtgacttcgtcttgacgtggtgtgcacgagggtgacgggttgtctaaacgctgttgcagttttgcgcatcggcgcctcagaacgtccatcgaagcccgtctttgtctgctgagtttgttggacacctcgcgcgtctttggtgcccctgccgccttttccggagccacgaaggaccaatgacgattcgacacactttgtacgacccatttcaatggctttttaagtcttcaacgttagatgtattttgtttaatgtaatttaaatggttattataatctaactggtaaaccacccatttttgtttgacataaattaaaatgagtttatgttttatttcgttttctcgagaattgttgcaatttaaaaagaaaatcaaagaagattttcacgagattattanggaagagatgtttatatcaaaatgaatttgtccacatcgtataatatgcgaaaacaaattttcgaatanatggttttaantgagttttttgttttgtgcgagacaaataacaataagatcagaaatggacagagaaaaacgcagacgaacgaaccaccgaaacctagactttcttaggaaacattttattattcatct

SEQ ID NO: 12173 - DNA, 3042 bp, Heterodera glycines
acaaaatgatagcgcaagaccaatccgtagcactttcttttcccccgctcactgcgcctgcttcgttcccggctcaccatcggccgcctcgccattgtcgctgagtttacgcttcttaagcaaatcgttttgaagtgaactggaattttccagtccaaatgtacaactcactctgttatcgccagaatttttgttggcattggctttctgttccccgttcgttgcctctttcgcagtgtcatttggtttcttccgttgttccacatagtcctctgattcgtcctcatcctagtaaaaaatcaaatactttggaaaaacaaaatattaaacattgagagctttcgatgagttcaaataggcaagcgccgcctcgtcgtccgtgtccactccctcctcctcttcctctgagtcgtcttcatcttcgagcgcgtcctcagctccctcctcctcttcctcatccgaaatttctgcctcgactaaagcgaaaaatgcaaaagtaattttagtgacaaactaaaccatcgtttatgtcaaatccgtccaagtatttcagctgtgggatcatagcaaacactttgctacgatattccggtccctccttgagaaaaattgcaataatttactttgaatcaaaacgattttttaataaattcttacggtaatagcacagtcgaacaggtcaagtgccgccaattcctccaacttgctcaagggagcaagtgcctccatggactaaaagaaacaatcaaaaaaaagagaaaaattcccaccgtaattttgtttgcgcataaattgatgtggtagagacgagggcaacattcgaccaatttatcaagaccaccgctgagtttgttgtcactgaggtcgatagttcgcaaagtcggcaactaagaaatgttaaaattctgccaatgaaataaaaggaattataattaaataccttcggaagaccatccaatgtagtcaatccaacatttatcagcgaaagtgttgtgagacttgtgaattgttctgtcagcccgctaattgtgttcgctttgcagctgtcgagcagaaggtcttggacttcagaaggttgtctaccttaaaaagcgaaggaattataagacaaaaaaggaaaacaaaaataatcaaaacaacataccacgcaattcagttttgattcgctcttccattttgcagaaaataacaaagtgctaattagatacttatgtcaatataacaaatatgaaacctaaaagcaaataaattcaaccaaagtcgactgtcatattttttctttaagcaagggaaagtagcgaacctcgtaaataatggataaaacgaattcgcattgggaaagagtggacagaggacggccattcgaatctcacgaaaatgaaggtccagcagagcggacacaactattaggacaaaaatggctgaatcgctctcctcccctcactgtacaacgctctctttgctctcccccccccccgcccacgccgaggcagcaaagcaacagaaaggacgaaggaagaagacgccttcgctccctctctctctccctctcttctgttgccatcccttccttcagctgctgttcatcccaaaatcccttgacgccctccgcccccttctgctttcagaaatccaccataatttcccttcccgaaggcattgtttgttctctgcgacctttttctgtctgcaagaatttatttttctcactctctactctctctctctctcgcttcagagaaaatgccaaaatacatacaaaccaaaaatttttattttttatttttgggtttctttcgatgagttagcgtttttgatttttcattccattctcaatttccatgtacatgcacatgtatgtaaatgccaagaatatgaaattcactatacaaaaatttacaaaaaattacacataaaacaacaatggtttaggttgaactttataaaaatgtcgcgaagtcgctcgagatcgagaagcccaattcgacgcggtggcgataggtttcgctctgatcgaggaggaggaggtaccatgtttttctaatttagcaaattactttcggctccttcatttataactaacaagcattggctttatacactcaaaacaaagaaatttgattttatttgatgggaatttttagtttggtctgacctttgctgggaatcattaaaataaaaacacggactgttggccagagatttgtcttcttggacatcgattggatcgaaaacaaaatttatttgtttgtagttaaccacagaaataagttcttttctgcgttctcctcgcactattcagcgaatgtccgactatattcgaaaatctgacgcttggaatcctccataaactcaaacccttcgcaaattgtggtcgatggtgaaacttgtaatgttttcagaccgcggaggcggaaatagaattgatcataaaagcgatagaatggtttatttaaccaatctgccatgggaactcagttggatggagctgaaggacataattcgagaaaaggccggcgaggtgtgttttttctttattcagtttttctgacagaattacaatggtttttggtttattcggttgacccttgttgtaatttggccccggctttggtgttccatccttttaatgttggactacagaaccaatttcccttttgtaactgatggacaggacgtgacggttctgaaaatcaatctctgctgaatacctttgtcttggtagataatgagtcgtttgtacaccttgactcgactgatggtaactcgcattgaccttacaatttacaaatcattgccggggtcaatctcatttttgcctgtgcatgttggtttaaaacattttgcaggtgaatttcgttgaggtcctcgagggtcgtgacggtcggtcaaaaggttgcgcggttgttgaatttaaacgtcgtgatggtgcgatcaaatgtgttgaaagtatgcacagaactgaactcaaagaccgacttatcatcgctaaggaaatccgagtaatatttgatttattcgtattttggaaaaccgagcctg

SEQ ID NO: 12174 - DNA, 2206 bp, Heterodera glycines
  misc_feature (37)..(37): n is a, c, g, or t
aagggcatggctgtctgcgagtattcgcatccgatgnaggcggttcaggcagtttcgatgctcaacaatcagcgcctgttcgatcgtacgatctccgtccgcatggaccgttatccgaaggaagtggaacgccgcgagggaggactgcctgttggtttttgctttccgaaattgcattttacaatgaaaataatttgatatcgaacgagtcttggtaaaaaattgttttgaggtatttgtaacaattaattgtaattattcgatcacaattaaagtaaatgtcatatccgtttccattttcagtttggtctgcgtgctgttggaatgggtttgggggcgaatggcgcgcctctaaccgatgtggccagcgtgatctccagtattagcccttcgcagacacaacccgggatgaatggcacagctggcgcaccgatcactccattccaatcgcccccaaatgttgcccaatttggccctgtagctgctcaacctgtggcagcggggcctccaagcggatttcaacagggcttgcctgatcatggcatcagtggacatttccaggttttgatatctgccgttaccggctagttaattattaatgtcttaattgggtcttttgcccaatagtttccaattgctcccttttcagtctcctcaacccacctaccaaccacaagctaccagtggcttcttcaacccccctcagccctctccacagaaccgtccatccggcggaatggccttcggcggtggaggcgcaacgccacaatacgcaccgacaaagcaaatgggcgttgtcggaggagggacggcgagcgctgcagtttatggacacccaccacaacaacaaactcagaaggtgcgcgcagaatacaataccacaataataagacaaaatttaagtacgagcacaaagtggagccgaagtttgaaatgggcgcgtacccggggtacggaagtggcgcggcacagccagcgatgagcagtggggcaacggacaattaccaaccgtcgcgtgtcattttgatcaaaaatgtaaaatttggtcgtataattgaaatttttttgtccgttcagcttcccgttgattacacatggcaaattgtcagtgaccgcgtgcaacagtttggcgatttggagtcagtggaaatgataacgcccggtgtggcaaaagtgcgttttgtgaagctgcgagatgccgaacatgcgaaggccgcgttgcagggaaccacagtagaagggagggctattggcatcgaatacctttgaaatgcgacaagcggaggcgcgacgtaaaaactcaacgctttttcatcttacttccctgtttggtcacaactatccttcttttcggtataaattttcaattgggaactgaatactcatgaaatttataaatgtttcctcgcaaagtagaatgtcataatgtttatctagaatttttccaattatttacaaatataagatcgggagggggagatgctgatgcaatctgtcccatttcccgtaaaaacaattaattcctcgaaggcgagtaaaaagctaagcatttcatgagtgtttaagccacatgaaataaaacaattgtcacatcgtcgggtttcccccctggcgcattaattccatggagttttgccctccttgcgaacggcgaatcataatgttcatccgctgccaaatggcgtgcgatcagtgcgagtgtgttgcagcgcgcttgcagtgacgcttctgtgggttcgacgccgtcgagaagttccgcgattttttcttcagaaacgttgtcccagagaccatcgcttgcttaaataatttggtttttggttaaatatccaattaaaatgcgattaatggcttacctatgagcagcaaatcgccaggtttcagcttatgctcccgcaagtcggtgctttcgggggtgtcaccaatataattcgccttccctttgtatgttggagaatcttaagaaattatgaatggaaaattaaagaataatggaaacgtacagaaacggtctggcagcagagagagttgataaggcgcgttgaaatctgaaacggcggcagccgaattttatctaaaaacccaacaaatgcgaaaactcacagtgagtctgctcgggtgaacggaacaccacttttccctctcgataaatcatatagccagcacggtggggaaagggagagaagaagtttcatcatatgttatc

SEQ ID NO: 12175 - DNA, 3065 bp, Heterodera glycines
tttcttttctttgaaaattataaaaaaataaatgaccattttttttttttttctaagaaaaaaagcagacgaaaaaattttgtgtttaaaagttttacggggaaatttttttattaaaaaagtcgaaaattgatgaccgagtcgtgaaaattctagccctttgtattatttgccaagaaaaaagtgaagtgagaaccaagtgattggtcgaattttggcttccacttcaatcactggcatcatgcgaatggcattgtaaatggtctgtccgtcggcatggcacaatgcgcccagctccttggcatccatgtcgaacagggcgaaaaagttgaggccacggttctcaattttttgcaccgtactgaagctgagcacatcaatgtcggccaaatgcctgcaaaaacgttgagacacaaaaatttccaaaaaaattttttttgtgtgccttaagggagagttgaatggccacaggcgtttttcaatgcatttggccatcgtcaggcatgcttctgttgtttgagcccagcagcggcgcaacgcaatttcaaacagcgcacgcgcgatgcgtgtcgcgttctgcgagatgtagtagagctccgagatcagcgcaaagttggtgaccatagcgcgcgaaatgtgactctgttgaaagaaagcagtcacattaagaagccgcatcaatttcccaacaggcgcacaattctccctattcccgacgtttccccggatttcaaaacttaattcaaaaaaaacctggaattttttaatcaaggattttttttttaataattttccagcgggaaacaaactgttgttcccatatttttcaattaacaaacgcctcagaaatagcatttgtggcacacacttgcagaagacagttgactttgcccgccgttgtcgcaagtccaccgcgtattttcagcgccgcaccaaatgaggccaactcgtccagatcggtcatctcactgtcccgattctgatcaaattattccatttttattgatcaaaatattttggtcaacaagcacattgtgtttttactttgatttgcgcaaattcgcttgatgctgcgatcagtgagatgatcatttcgtcggtcatcagttcagtgaaacggaccggccccgactcggcgttgatcagttccaccgtttcgaaagtgatgtagaaatgctggaatatttttttcgttagaggtttattttagggaatgggtgtgtcctgatctgctgatgtgaaatgccacaaaaaataataatttagatgaaaaagttgaaagtcaaacctttcgacatgaccttttattcgaattcgggtcagggattcggatatgtgtcaaggactaacattctcacaaacgttgcccgtaaactgccgatttaaaaatatgacaaataaatttatagaaatatttaaaaatatttgtataaattcacacaaaatttttttccccgaaattggtaggtagttctcattaagtaaatgatagttttgtcattcaaaaaagataatgacacttactgaagcaattcggcccaaatcggtggcagaaacaaattcatttctatgcaagaaataaataataaatagccaaaaaatatatatttgtttacactggatcataacggatcatccgattcaaatccaagcgacgtgccgcggagtgacaaaaatcgtttaaaaacgaaaccagcgttggttcacggcgcaactctctccattcaacaccgtactaaaataattttcttttatgaaaaaatggaaatttgcaaaattttaccattaggggattcttgcggagccgaatgtaaaagtaactgaatcgtatccattcaaccgcctctttaatattcgaaatggcaccttaaacgcgaaaaaaacataattaaagtcgaaaatttttgaaatcgatttttggaactttctattttttgaaaaataaaaaaaacgcaccccgtgcaatttcggcgttcaaattgttcagtatacgcctttggaattggctttcaattggcgcctgccggtggaacatttccacgtattgtgccattttttgtgccgtcgtgatgatcacaccatgccctattttttttaacaaactttacattaaaaatgccaaaactctgtgtccattcaaacccaagaccacctttgtcctcgtattgaggacgtccagcacggccaaaaatttgttgcacatccaaaatgccaatgtcgctgaacacgcccttttgcgggtcgaatatttcggtgcccttaaaaaaaccttgccagttaaaaatggaatgtaattgcggttagtgtatttgttccaccaaattcgatttttagccaattggtaaaaaccatccggtattatcgttagagagttattttttcgaaaattgactggccccaataaattttaaaatttaccgcgattaattttagcgttccgaaccctttaagtgtggtgacaaagaaactagacgaacccgaatgatcacagcataggcgggcaaattgacgccccaggcaagcgtcgcggtgcagaccatcacgcgaattgcgccctcggcaaacattttttccatcaaatgccgatcatgacgaactgaaattgaatatttggtgtcattagggagatgaaggccattatgatcattaattaaatgaaattgcaaaaaatgcctaatccggcgtggtgaatgccgagaccgcattgaaagagttgctgcagctcctgactttgcacgtttcgcatctaacaaagaaataattcatttataattactgcgaattaaatataaatactcctcaaaaatgcccacacatttttttgcaaaaaattaggaaattttttccataaaaataggatttttgaaaaattcccaagcatgggagtttgataattaggccaaacaaatgagtcaaagaatcttgaaaaacagttagttaggcaacataccgccttttttgcccttcaaaaagagctggggggggtcggggcgggtgaaccccgaaaaaattttgtggatttggattctgtgtaaaatatagtaaatatacaaaaacattttttt

SEQ ID NO: 12176 - DNA, 1571 bp, Heterodera glycines
cttaaaaagcatcaatttttttggggagcagggcgccacctttgtgccaatggacggggacgaaagcgagcgtcaaaatggaacagtccacgggtcgggtccacccgcaagaattgggccacatcctcataatttggcaatgtggcggacaagccaacaatgcgcaagttctgatggtacagctccacctgtgagagaaaaaaaatgaatttgaaattttcgtttaaaaatttttttttgtaaggatttttaaaaattttccccgggcgtttctcaaaaatttggtgttttcgaaaaaaagacaacgcacctgtcgaagtgtcctggccacaatagactcaatgacggggcctcgctcgtcgtgcaacaaatgcacctcgtcaatgatcatcagacggaccagttggcttagctcttcgtcgtccgccttgcgcgtgatcacgtcccatttctccggcgtcagcaccaacatctgacagaaaataggaaaattagtcgagaattaatttttaaaaaattgaagccaaataaacacataattcatatttatttcaaaatttggctccattggtcatttttaaatactataattcgcaaaaatgaaatagaatttacaatgacccagcatcaaattacacaaaaaaaaaataattttttttttttgagggtgttcgaagagtgaacgtgtttgcgttttacgcccgcacattacgtttccaagcaaaattttaaaaaatcggtcaaagatttttctaaaaatttctttcattattaaaaaaatttaaaattcaagtttttcaaaaaaaaattaattttttttatttaaacaaaaaagaatcttgtttatagatttttcggtgagggagatgagctgctcccattggggaagtaatattttgtggctttcaattaacgtcataattagttaattattacaataaattgcttgggccacctgcgtttcactgatttcgcgtcggctcaactgcgagtcaccggtcaattcgcgcactttgagtcccaatttggccagacgatttgcaaaatttgtggtcatttcgctggccaacgctttcataggtgccaaataaattatcttaatttttttttttacattttttaaattagtttaatttatttatttcgacactttaaatgcatttatgttaatccgtccacttttgctgtccaaattgtctttgatggttttggctgcgcacatcatggcaatgttcgtttttcctgacaaatgaggcgaatacaaaaatgttttcaaaagattatgtttgggaaacgagggtccaattaaacacaaaataaattgggtttgaattttttttttttaagtactataagccgaaccccaatagaaaaattctaaaatttccgaattttcaatgttatttgaataacctgcccccgttggtgcacaaatcagcaaattgtccagtgaattgtatgctctgtcgtacacttgggattggatcacattcaatgactcaattccatcaaaaaagcgttgccctaactgaaaaatttaattaaaaaccattttttttttttaaaatttg

SEQ ID NO: 12177 - DNA, 1578 bp, Heterodera glycines
tttgtaaaatgattttgggtttgagcgggtaaattcctcctcttatagtgggcggagtcctaaatcccaggtatataaatgatgccgagtttaaataaattaacattttatgaatctgaaatggtactcgtcaatgtgttttgtgctcagctattagactgtcccgtcaagtcactgcgcgaccgacttaaccaccccgaagatcgtgtaaatgcgatgaacggattgatggggaagaaagttcgaacaacctacaaagatcgcaatgggatgcacaagacctattttgtcggcggtatcacggagcgcggtgcagctttcgttccggcttatggcaatctacgggcaccatacaacgtaaatgtggcagcttatttttatgcacggcatcgcataaagctccatttcccttacgtgccttgcgtaattgaacgcttttccgggagagctgaggaccgtttctacccaatggagttactgggaattgtggatgacgaaaacaaagggagattgtttggacgaatgtttatggaaattggtgaagaagcagatgatgatgataatgacgaggatgtttcaacatcctttgactcaacactacgatttgatatgggacgagacgagtgttcccaattatggcgatgatcaatatttgcaatattcatcttctattactaaactatgcacttttctacctaaaaattacattttaacactcttaattatttaatcaatatatatttttcactctattaattcggcatttttctacccaaaacagacaacttctttttttcatttattcaaattcacaaaataaataagaaaatgtttacaaggtgtgaccaaagtttaaaacattaaaatctgacttaacaattccctttccaacgtagggcctataacatttctgcattgggccactggtcacttttcctccttctctgatgctagggcgcaggaagtttgggtaggtaactatgatcggctcatagtcaccagtagcggcgaagtccaacacttgttgcttgaaagtttcataccgtaggtgttgattattgatgacatcgtagttgagtgtcatcccgcgcaccttcagcacatactctaacaccgcagcagcaggtgcatttaagcgcctcaacttcaatccgtactaaataaaaatatattagcatattgattagcattttaaaaattaattacttgttttgcaccaccgctgcagtactccacagcggatactcatcggtaaactgacccaaatgtgggccagttttgagtggacaggcgttctttgggtgcacaaagatcaatgaatccgtgtctaaattgttgatcaatatgttatttttacctagaaatgataataaatttaccagtgtataaaagcacgcaaccaggtgttcgtgccaccttttgcatcgcctttaggaggaggagccgcgcagccgaggtcgtccaaagagaaatcactgcaattttcatattttttatatttgattgtaatctttttcccatacctatgttggagcagtcgtgctcctctacccactccttcttattttcatagctaag

SEQ ID NO: 12178 - DNA, 2477 bp, Heterodera glycines
tgacgcggtagccctcttcaagcgctgcgttgagctcaattgaagtgctggtgctgacccatccgcgttgttggtcattatgtctgcagtgatattcgtcgtcaactcctccagtagggtagtctttcgcgcacttcatgcacaatggaaaacataaacgttcaccaactttcacaggcagaaccggaatggtgcactttcgtggcggaatcacccaacatttaatcagtgccaaaggaaagttgttgtcagctgggctcgtccaattcacatcctcgttcaacacgtgaaccttcgggtggcccactggataacgggttgtgaaactgaaaattaaaaattgtaataaaatttatgtaaatgacaaactttatgtatgggtagagtgaagtaaagtcaaagtaggagattttttggtcgacggctgcctttgtgaagagctttagtggtcccgtccgcccggccggtggacgcgtcacggatcaccaacggtccaccatccacatatttctgcaaatttttccgcattccctgcttctgtccaacattcgtgaattctcgcactcccagaagacatcaactcgtgtcactgagtcctcaagaactgtaaccgcttggcatcgcgctccctttgttctccagcagttttcccgttgggcagcatcatgttgtcagagggagagcattttctacaaccgtgccaaacacaacctgcaaacaacttttttttaattgcttaaaaatatagaaaaattaccattaatttcaattacacgcccttctgcctcaatccaaccgttcacagtgtagtttgcaatctttttttctccatcaggtgagtaggctgtctgcacttgtacgttgttttcctcagcataccagaaaagaaagcggagagccagcttgctctggttctgggtgttgtcatagcccttttcagggacaatggcaaggtgctccgccggcagatggttcaacctgaagtgcttcatgcacgcaccggcaacagtcatgcattcccgtagaacatcaatgccatcgtggttttcccggtggtcgattccgtcgacatattcgttccgcttcgacacatcaaaaaactcgcggcggaatgcgacgagagctgccattagaatttcaacgtcattcgtacaataactgaaaaagtccaaaataaatattttaatttaaaaatgttttacctcgctagtgcttcatcgagttgaaaaggctcttcgcggtgctgctcgtaccaatgatcgaattgtcgtcgcttctctggcatcattccgttggccaaatagtcgtcaggggttgggtagatgtgtttaccgtagttctccggacggttggccaaatgcgggaaaaagggtttgtcttcgacgtccaatccgtaggatggcaccagctgagccaatgcgcagggcatcaagttgaatgagtcgtggaacacaatgtttgggttccggttcttttgcttcttcactttcatctcgtacatcttattccccttaaaattatggtttaactttgattaactaattaatgtatgtttaaaaaacacctgacgaatcatttcagggttgaaacccatcttgaacagttcacgaaaaacaaggaccatgtcgaaacggcctccaaagtgcgagaatgcgtaggaatcgcatttcttcggaagatcattgatgatccaaccgacaaacgtctctaacgggttgtcagtgacaacttgtttgtcgacagctgtgtttacaaatcgacgttggcaaaaggcgactgtgcggtgagggccacacactttgcatcctgcggttccattccgccatctaccgttgtcaatacatccgggacaaatcactttggctgagatgaagttaggctgatgctgtctcttctctggctcacgacgacttacaggctgatgttgcattgtctccaagtcaaaagcaacaattcgatatgggtccaattctctaggctcgagcggtttgatgaagcagccacgttcagggttgtggaagtttttacacaggttgcagtagcgttcaccacacacatgaccttttcttccgttcctgttgttgtccgtaacgtcccaaacaacaccacaatcgctgcacttctttgaccgtttgcaaaaaccggattggagatggtgttggaagcaatcattgttgttaaaattcttattgcataaggcgcaatttctgaagaagccaccagtcgcttcacaagggaatgccggaccacaacgagcgcaaagaatgcaacgtgctttacatgatttgctgtgttttgatgctcttccatatggctgttcgcactccaaacagtaaggctttccgaacaggccaccctgcttctgcaccccatcaaagtgattgtcgttgaaatataggagaagaggagtgttgtagctgttgttcacgtatttgtagatgggtttgtagtgcccagttgcccaaagatgaagacag

SEQ ID NO: 12179 - DNA, 1962 bp, Heterodera glycines
  misc_feature (48)..(48): n is a, c, g, or t
tggaagagttgtgcacggacacgagctatctctggaaaataagcaatntaaatgcgtataaaaataaatctgaccaagatcgatgagacggtcaacatgtttgaagtaatttggaaaggcagcaactgtgcctttttcttggatcagctcggcaaggtaatccattgtcattaaatgaacgtgagtcgaaagcttaacctgtctttgaaaaggtacatttttattagtaacacttcttattatattgtaaagtgaaacaattcttttttcaaaattggtaagttttttccggtaatatagtgtcgcggaaccggtaaattggataccggaaaagtggacactaaatttctttattgtataaaaatcagatatggttacctaattgaatggactcataagtcatttggacttatatacacagcgttcggaaactgacaagggaacattccgaactctgactgctcagatcactttaaaactacttttatcctgtagagcatggtcgagctaaatttcggattttggctactgacaagggaacctcgcgaactgttagtcaaaaatttggtataaatatggtatcattggatagagaggatcgtcttctattatgaatttttaggcgctatttaaaaagagtaaccgtttgaaattttttttcacttttttttggtcaattttttttttgtttaaaaagtcctgaaaccaagtacccgggtgttttaaaggtcgctgatcacgaatatgacaattatttgggcctattaagcaaatttggcgctagttataaagtgatagattttgaattttatcaaaaaccataggggggacccttttgttttgtaaatttttttttggataaaaatcgtgaatatacattttattcaccataattgtgctgttaatacttaatattcatcattatgtgtaaaaaaaacaaaaaaaaaatttgaccaaaaaaaagttgaaaaaattttcaaaatagtgctctttgtaaatagtgccttaatgttcttcaattcattaactaaaaaagccaaaatcttaaaatttttgaaggtgtgggattggcggttcgggcacgccaattgatggaattgacatgtaaatgttaaattaaacgaacttagtttgcttctcatttgcaccgtcataaggtgttgtaagcttcatgaccaatgctatgatttggccgtggatcggggcctttgttatgacacttacgtcgaatacgctgacccttattcttggacttgtcagcagggggagccgaactgttcacaaaagcagttcgggtgcaaagcagcgctgtgcgagtgcgataagtgagaaatattaggggattcatttgatttgcaaaaaaaaaaattgtcataaaaagtgggaagaatattcccggagtttttcggacgcactggtcaaaatcagctaccttgactaattcggatccttactcgaataaaaatgcaaattttaaatcttaagaattttgcttgagttttgttcggaattagtcaaatgcatgttcagccgttttcacgactaacaccatttttttaaattgctaacgaaaaaggtcttcccttattttttttaaataactcaaaaacgaattttttttaaatagcccgaatttccccctcgtggggttgagcacttttttgtttgccattgccattttctctgtttttaagaaatgttgtcaattgttggtcgaaattcaaagtgccttctaaacgggaaaaatgcacaaaaacaaaagtgaacagaacatatgaaacggtttcttattcgtctgctgacccatctttcctcttacaattaaatatttttacattgtttttgttttctccgttagttttttcttttatgcttctttttgagcttttttgattacccccccccccccttcgctcgctttttggcctttatttttgtgctaatcatgtatttatgattaaa

SEQ ID NO: 12180 - DNA, 996 bp, Heterodera glycines
ccgttaaatgttcagaacggaaatgctattaatctgctgctagtttggggaggggggatatcggattaccaaatgaatgaaatggagggggggggggcgaggatgggatgaatgcgattggagaatgttcaaaagggataaacacgaaatggtggataatgaaatgagtgggtcggcaaatataatgacgcaaaatctcaaaatagttaactaatagtggagaaataatgccaaaatggtttcaaaagttgccaaaaatttggtttcagcgaaataataaacaaaaaacaagcgagttgaaaaattttttgcaatttgctgaaatgaagattttttttatataattaagggaatttttgtctgaaatttcctacatgcaattaatgaaataaaatatgaaaaagccgcaaaaatagctaaatcactaaaaatgccggccgtagtaatgagagagaaggtgggcagaattcgaatgtgaaaatatgatggaaattgattaattgtgaggaaaattctgatgaggttttcattaaaaatatgattttttttaccgaggaccaattttttatgttaggtaatattcggaatttcatctgccgacgagtcacgaaattctaaagaagaaattcaattgatcaataattggggcagaagacttggggacgatcaatgaataattgggatttaattgtatttgtttgatcctgcaaatttcaatttgcaaaattaggagttattaaatttgctttcacccctggttagatagattttttctgattaatttttgatcaaaacaaattctaatcaaaatttatttttgttcaaaattcaggcagttcacgagccaatcgtcgatgatgaatcatcctcctccgacatgtccgatcatccccagcggctgccgtcccctccgccggtgccatcctttgactataattgtcatgatcaccatcgccatccgctttctgccccgtccacagcagcacattgcttcat

SEQ ID NO: 12181 - DNA, 3212 bp, Heterodera glycines
tggaggtccacattgcttcatcaccatcaaaatggcattatcctgctatgactcaaattttggtaacacgaaaatcagagcgaactccggaaccaggggtgccacggacatctccctttagggatcggaacctaaaaattcggtttcggcatcaatccccgtaattaaatatttgaatttcgtcccactttcattatcataagtatcgatcaccttttaatttggatcgaaaatcggaatttggatcaatctcatagtgtgggagtttaatcagtgattagtgtgttttatatgaagaaatgcggtaaataatatagaataagttgcagtaattagctttgttccgacccttggaggggtgggggatgataataaagaaataagcatgtttttgccccattaaaagaaagcctcaattatcttgctcaacaacaccaatttggctgtttccatcatccgccaccggcgccatttgatggcggtggtgccgtgccgttggtcacggacaaccaaatgaacgattattgttggcacacggcggcagccacctgctgttggccatggcaaattgacgatcacaatgcgctggcggtgatcaatccgacaacaatttcattgctttggatgaacagtgtcaataacatcaatactaacaaattgttggccagcgaattggagacggatcagcaacaaatgttgatgaacaacaaccacagcagccagcaagggtgggattgaaatattaaaaaaataacatgaaaaataatgcggcttaatctctgcgaatcattggttttttagtgaaaaattttttgaaattagaaatttgattaaatttcccattttttgggagtttatgtcaccgaacttaagtttcgtaatcgtataaatctaaatgttccaatcgaaatttttttgcattaccggttttttgatttttcaaaagaataacaaataaggtacaaaattaaatccaagaatgaattacctacactcgcggcccgataaagatatattttcttgtaaaatgccttttttgaaaaattcgggatacggtatgccattaagcaactgctgaattttgcttatcatagtttgttaaaaaaaccaatatgaagatttagttaagaatttaaaactaaaggtgaatcagttatcataaccattctcacgccatgaaaatttttgaaatttttaaaatgtgcgatgcgatttaagcaacgaatggtcacattcaaatggaagggagcatctccaaatacagcttcaatatcctccactcacttacacaatgatggacgatgagcagcagacatcactggagggcggctgcttttcatccttttacggcacaattggaacgggttggttttgaaaatggagaaaatttaaatacactgggaattgtcccaaataggactcgagaattggggcatttgtcatcattttcgggataagatgaacattttgagactgatgagtagggcatagaattatatgcatattgcatattttttttcctggactgtgggaggcctgaaacgcatgaaaaacatgtttttagcctggtttgaagcttctaggatggatttccatatgcatattttgcatatttgtgcatatttcgcgatttatgtgcatatttgtgcatatttcggcatttcatgcatattttatgtgcatatttgggcattttttcaataaatcctctattaaaacgaccccctctattaaagcggccatttgtgctctaatgaccaaaaatttttcaaaaatatcagatttttgggtatattttctgataaaaaagtaactttttaaaaaattggaactttatgccaaaaatagtcagaaaaatagaaaattctccattttttgctcaattttcttcaaaataaataaatattacttttttggttctaaaataatcattcatactatttttagctattttcgggatttttatgcttaaatttaacaaacttgaagagatttgaaaatttgccctcaatttggaaaaatttatgtgcatatttttcactttttatgtgcatattttcatttttggtgcatattttatgcgcatattttgcgattttatgtgcatataattctatgccctactgatgagagttgccttttctaggctttgtcttgcaaaaaatccaatgacgaattcgcaactgttgagttgaaacaaaatttttatcacgggagtcgagagtcaagaaggttgagaattttctcaagaggaaatataattttaaaatttctaatacacctgaatttcttaatattttcgtaatagaaaacatttttggtttcctaatcctttttttgctctattttcaaaaaatccttgtaaaaataagtgcgtttgttagagtttgcagaaaatcactcagtgatcaagatgatccgggaacggccttttcgataacaaaaaggaccctaggagtcctgaatttcgatcttttccatactcttgaaaagcaatgaaatattttttaaatgtcaaaaaatttagtgccattgttgtaatggttggctccctctcaacgcagttgtgcctgcttctgatcagcttcattgcatgtcacttgcttctgatttgcctgtctccccgttctcatccgccactgatcagcccttttttatccatccgaccaaaggcgcctatggcacttcaattttgttcaacaaccattccgatcaaatggcaccaattcccgatcactctacgatgcttgatccgtcggaggctacatcattcattaatcaaccattgtgatggcagatggataaatggataagcataaatgacaaatatactacaatacagtgcaaattgatataattaatctcgagactcacggaacttgactcaattacgaattacggaaaatacggcattgctcagaattttttaaatggcccctgaaacttagggcatggtttcgaaaaccgagaaatttttcttgccaatttactcattcaaaaatcggctttaaattgagtataaaaaaatcgccggaattccacgaaattgtcggataaaaattaattaccgagtctcgagcatcaaatatttcatttattaatttaatttttgttgtttagataagaaagagctggtcattcattcaaaatgccttttgaaaaaaattttcaataaaataaaataaaattttgataacattttatggcctttg

SEQ ID NO: 12182 - DNA, 1575 bp, Heterodera glycines
aaaatttcctttttaatttatttacgagaaaaaattgcaataaataaataaaaatgtacaataaaatgagtgacaatggtcccatattttttgaggggaaaaaccacataaacattaatgatatttgcagttaaatttcattttttatttgtttaagaaaaattattatttaaaaaataatattataaataaaaaaaaaaggtaataatttgtggactaaatttgtttgaaaaatagtaatttaagattaattgcaacattttatttcaataaaaggtacaaagtttggtgaaaaaataaaatcttagaaaatagaataaataattatttaaaatttacaacaacaaaaattatgcataattttaagagaatttaacaaaaactaatgggaaaaaataaataaaatcttgaaaattaaaataacgaattccattaggaaaaaaggatactttttatttataagaggaaaaaaaataattaaagtaaaataacattataaaaaataataaaattaaaaccgttgttcccatttaaaaattggcttttttggaggctttaaagcggcggacgacaaaaatattttacgattatgggccaaaagacggaagagagagaaggaaagaaaatgatgacggatcaatttggcgacgattgcatcatcctttttttgccctccgcttcttcttcttccttttccctttgtttcgcccccaaattcatccgccgtccgtcacagcttttatcatttttaaaaagacaaaatttaaatttgaaatgcccgccaaaaattgaattagcattctgctgcagcagccgaacggaaaggggcgaaacaaacggcggatgaatgggtggtcattgtttgggcccagaattgaaaaacaaaaaaaaattcaaaaggcaagaggggcgggcgatggggatgatttcagtcgggcgcactttaatgctttattatttctcatagaaaggaccaaatttttacttattttgacgtttttttaatattgaaatatgcggccccaaaacggaaaagtaccgaaaatttatgtgatataatttggacaactttaggcaattttatgattttgttttaacaatttactgcatggaaaatttttcgaaaaacctattaaaaacagtagcgaatttacgaaacgacctagcatgtactagctcaaccaccccaccccccccccaaaaaaaaaaaacctgttggaccatttttggttaaagacttttttaattttcttttttttaaatttactggctaatgtaaagaaaaatggaaaaaaaaatcttggaaggtcataattttgaagattttgccaaaattttctaagctatattgaagcgaccaaaattgttttccctataaaaaattaaaattttgagtttttctttaaaaaattgattttaaaggaaataattttacgatgggaaattgtgacaaaatttgcaacagaatgtgtaaatgtaaataatacaacagagaagaggtacaaaagtgatgaagaagaaaaacggggcaaacaaacgctgagaaattggaaatccataaaattaatgagaaaa

SEQ ID NO: 12183 - DNA, 1955 bp, Heterodera glycines
  misc_feature (1902)..(1903): n is a, c, g, or t
tgaaaatacaaaaaataaaataaatctagaaatatttttaaaatggaaattatggaagaatttcatgaaaaattgtttaattaaaatgagttttgaaaagtggattagcaattaaaaattaataaaacaaagtgcaaaagtgaaaaaaaagagacgaaactatggtaaaaaaattggcttttttattaaggatgaacacatttggaaagggatgtaagaatttctattttagcttaccagagttttttttgactcaaatgaggtctataaaattttcggaaaccacaaattttcaacttgtctgaaatactttaaaaaaaagtcaaacttcaaaaaaaaaatcgaaacgatgccttttccattctcaaaatttgtttttaaacctttgaaaaaagtttcctttaagggttaaaattgtaaaaaatggaaaaatttcagtcagaaatcaaatgagaataagctgatagcttatagccaactgatacataacagcagcgacaagcaaataaatgatgacgacattacaatgaggtgtgatggaatggccattttttgcagctttatctgtgaaatatgtagataaatggggcaggcatttgaaagggttgggttggcaacgagtttggcattttgccaaaaatggaaaattgattaagtaatagcatcatcattcactaatgaatgggaaattagcagcaaccagcaactaattaattaacaattagtaaaaaatgggatttgcaaaaaaaataggcggggcttaaagtgtttaggtttaaaaaaatttaaaatggcaagagatggagaggaaaaatgacttgtggctctctcatacatagcaatggcaacgtttgggtgacagcctgtggacaaaaaaatgtttggcaatgccattttgctaggggatcaaagagagagaaagagaaaagcaagaaatacaacagagaaagatgagagatgacaggaagagtattatccaaaaaaatgttagagaaaaaaaggaagcgagagtaagagaaaagtgagggagaaggaagagaaagaataaaagatagaagcggagataaagaaaaataaaggtttccgaagaaaaacattaatagacagagaagcagagaaaaagacatagaacactaagctatgtcagctgccgccgccaaataagcaaaatatttatggccgaaagtggaaggattatggactggcatgaattataaattcatgaaggaagagaagcagaggaacaaaaagagtgtgatgtaagaaagagagcaaggagagagagagagaaactgagagagagagaataagggttaaagaaaattaagaatgagcaattatagaataccagcagcaggagcagaagagaaagaaacaaacagagaaaaacgaaagatcacactaatcagagagggaggacaccatgaataaactgagagagtttattgaatgaggagacacatagagaaaaaggggaaaccaatttcggtgccaaacggagcacataattgatgagcatatccggtccagattaatgcacataaatcgagaccaaagtacattaaataatatattacacagcttgagctttaattgagccaagaaaattagcaatggatgccaagagaataataaattattttattaatttcaaatttaaaattggctttagattttaaaacgcatagaattgcattgaatgatcaaaaaaatgccgaaaatttaagaaaaaatgatgaaaattttgaatgagctatgatcaaaacgggaaagtgatcaaggggattagggtaaaattttttatcaatactcagtaaaaatgccatatttatcctggtaattaaccgttaccgcaccaattaaaaaacagtgataaattagtaacactaaaaaaaattggtnnattaccgcttctggttttttcgtaaaactgaagcgatattacttttacagga

SEQ ID NO: 12184 - DNA, 1035 bp, Heterodera glycines
aaaaaattgttattttccgcttctggtttttcggtaaaactgaagcgatattacttttacaggaatggattaaggcagtgcattgtggtatttttccccaatttggtttagcccaattaattaattgcaaattattgactctcgacagccgtcgagagcgaaatgattttacccccagcgccacattaagcgattgtttatttttgtggtcgccgcgaaccatttaatccgccaattaatctgatcaatggcttttctcgtctgttataagagagtgaagagaaagataaaaatgtgtgtggaattattctgaaggcttacatgcaattttgattaaaaaaattaactaataatttcaatttttccaaaaatttaattaaaattgttaaattaaaatccatttttgtgagaaaaataattaaataatttttttaatgagcaaataaaacatttttgagcaaataaacaatttttttttctttgatgcttattccaatgaattatttataaatttaaaagtttactaatcatataaaaaaataaaaaggctgaaattcatataaaaaatccaaaattttagataaatttcaaatgaaatttaaattaaaatgaaacaagagaaaacaattattttaggcggcatttttttttttggatttccatgtgaataacaatggaacaatttttatgatgacacttaattgcaataggattactgtgcttttttttgcgcttcgcatccctttgaacttttagagagaagtaattaaaaaatgaattgggactgatcaaattagaagaaattatttggacgccgtatatataaaaacggaaaaattattaattcatgaaaatgaggcagggtttacagtaaattttttaaaaaattaaatttaattctatatttattgtttcaatcatatttggcatttataataaagtctaaatttgattatattatttacttaagtcttttacaaattagtttaaatttaaaaggcttattaaaatataaattaatggaaatttaaataa

SEQ ID NO: 12185 - DNA, 4967 bp, Heterodera glycines
  misc_feature (19)..(19): n is a, c, g, or t
tcaaaactttcaaaatttntgtgaaaagtttttgtcatctaaaaactaaagcttaattttaaaaaagaagaaaatttttcatttatattaaaatgaaaatatgatagaaaattttttatgtgtattaactaaccacaataatctttttatataaattttaatagaatttggcataaaattgagcaaaagtaaatttttggctgaaattttgtcactactttggcatttttctaaccttttagttaactatttctagattttttgtaactaaaattcgcggacttagtaattatctttgtcaaaaaaacaaaaaaatcttttttttaatatttccttcatttgattaccaacccaaactctatagatttggaaataatttaattctttttttttgtttttcgattgttttcgaatttaaaatttttaaagggcagtaaagttttatgcaaaatagaattacattaaaaaaatttggataaatgaaaacccatcaaatttaaaaaacccaacaattgttgtccaaatgctcagccgatctctagtggattagacgttcgatgaaaatttgaaccaacaaaaagacagatagccaagattaatgaaccaatgaaaagaaagacagataagcccaaaaaagggtttttgaatcgatcaaaaagggcggctgatcagtgatcaacgggaaacattttcgctaatcttccgttgttgtttttttcttgttttctctgtgcgcacttcaatgttgattccaagagaatgtttgtgaatttttgaatgccataatccttcaatgttttttcgtccgtaagttctttttggaagcctctaattgttccaatttgtccgggctcaatttcaatcactttcccgattttttgcctcaatatttccacattgtccgtggccttcacttgaacggcatatgttattccacaatacgttatgaacactgaaaattcttcatcttttttagcgacggatgaggagggcatcatcaaaagcattgccattattagcccagcagaagcgatgccaacggcggagaacagagaaaagccaaaatgattggttttcattggggcaaatttgatggcaattggagggaatggaaagggataattgggaatgaatgaatgaatacccacaactgtcaatatcataagaaaattggcatgggttatgaatatgctataaatgtaaattgaattgatcaataaaagtaataaatggcaataaaaataaaatgaaatatttttttttataatacaaatgcataattatcctgaaccactaggtgaacggggttttctcctaatttgaacgagttaaaacacgtaaaaaacccttttaaaatttaaaagatcattaggtccagcgatgctgggatttattcaatggaattttttagaattttgtcttctgtagcatttaaattagagaccggcacggaacgggattctgcgcgggattttgctggatcccagtccgcaatctcactttttttggaaaatgagggattgcgggatttgcgagattaatcccgcgggatcctgtcccgcaaagaatttgagttccaatcccgcagcgggatcctaaaatttgattttttttgtgcgggattctgcgggatttcattgattttttgaaaatttaaaagaacagaatgccaaatattttgaatgaatttataatttcactcaaattaaatccattttttttatcacaaatttcatctagaattttcaaaaaatttcccggcggcgcctatcgacaccgcctgaatcggcttttacttattaatcatgtaaaaattgagtcaaaaagtgcgacatttggtcattattagaaaaaatctgttaacaaatcacattaattttcaaaatatttctccggatggtgcatatcggcgggcccctctgttcctagttttttgaaaaaattgcagtagtgactcctgtacgattgtcgccccttttggcgctaaattcaaatttgaattttcgtggtgatactctgtgggagggaggacgcgagcgttgggagttccgctccaacagttcgggagctatctttttatatgctttcctgatgcaatcgcgcgagttcggcggcaacgagttggaggagcacggctgctgatgagggtcagcgatcgccttattatcatcattttacaattttaaatatactcccccccccctattgtactacccctacatcccgcaatgccaaaattggggccgcctgaaaattttttggattttcttggaaaatatcaaaacaaattgcacattttgctggtgagccgccggggcatcatcgagcgggacaatttggagtgccggtgccggaggaggtgcaaatgcatgctgatggccgaattgaagagggggaagttccaagacgcccggaagccgaggaaacggtgggttgacgaaaaatggtgaagcggccagctgattgttaacgacatgttgggcgaccagcaaagggacaaattgtgccaattgttgctgctgctgctgctgctgctcctcctcatcaacaatggctgcgccgtcgacgacaacctcctccggtgatgggacccgggggaaaacctggtcctaaatcaaaaattttgactgtagccgtcccaagggcgtcattaccaagggcatcctttcttcgccaatcagcccaaacaaagcaaaatcctctgcgtgcacgcccacacgggcgatgacgctaaaatttttttgtgtattatttgttcattatcgccaaattccccaaattttgcgggccctctcgatgtcgatgacaccaccaaccgccgcatgggtgtacacggcagacatcagtctcgcaagactgaatccaatctacaaaaacgtttcaattttaaatttccgttctcagctatttttacgtggtcgagcagctcctcatccttgaggaacgtctcatcgcatgattggtatccaattagataccaatacctcacagcaccgcagacgaggcatggcgccttgtcgtacagggccagtgatgtgacctcatactcagttgtgccatcgtcgtcctccgcgatgtcggcagcattttgatcggagtgccgatgccgacactaataaacaaatcaaattatctaagtcaactaaaaatgacgcagtcacgaatgtttatgacccattttgcactcaaaattatgaaaatattttggtggagccaattatcagttttgcctataatctataaattttaactaattttaggatgactcaatacataaaaattatcctgaccgtcccctcgtttaatcataatttcaccagtttttataacgcacatttttaataaaacaagaacatcatctccaacaaattttgcagaaaaaaccaaaatgccctgaggttaggaattaggaagtgtcaaatttgtgatcagccacacaaaaaaacaaaaaataacattgaaaaatttttgatgctcttaacagcaaaaacacttctccatttccccacctcgtcctcctcgaccggcgccctccctccgcccttgccgccaccgcctctaccggcaccgcctctgccggcaccgcctcccctgcgctggagggcaccacggctgccgccttgtcctcgtcctccgcgttggccgccaccgcctttgttcacccgtacggggtctgcattccgtcgtccgccgccacttgcttcgccgcttttccgcccacacatccaaatcgagaagagaatgagcaactgaaaacgtttttgtaaaatttcgaacaaaagcaattggacgacaccaaactcgttttcggccaacttgtttttgccccagctcgttttttgtctatataattatgtaggaatgcagacagcgtgaagtcagacagtttatatacacgtaaaaaatgagttggggtaaaaacgagttgggttttaccaagcaattaatggggggggggcaatccttcataaattcaaaattaattgaagacgcatcgcgcaacaccaatttgttctcggagcagatgaacccattggggtggttgaactgctcactttttttggtgaattccaaagtgatgttccttaaattataccattgaccaaaaattaaataaagaattcaaatattacaatttttgcccttttctgtggcaattccctcaatgagaggcgcaaattggatggaaattcgctgaatggaagcatcacaactgctggcatttttgtcaaccgaagccgagctgtttgaaagcgaaaaagtggtctagttagatgaaacagtctaaaaaagaagcaaatacaaaatttgacaaaaaaaaaacaaaaaaaaccttttatggtaacgaattgcgccagtgatttgtggagagtcgagaaagaagccatatttgcccttgacagcaaatttcatggcattgacaccaagcgaacaaagggcgatgaaaaaagccagtcgacaaaaggaggagtcgggagatgagaagacactgcgattcattgtgcgaagtaaatgtaattttccaaccttttaaataaaaaaaacaattaaaggaaatttaaaataaaaataattaaataacataataaagcaatcgtattaaattgatttacaaccatcccctacggcaaacccttccccaaggctcgcgtccctcccccagagtatcaccacggaaattcaaatttgaatttagcgccaaaaggggcgacaatcgtacaggggtcactattttcctcaatttctttcgcattgtcgggcagcacaggcaaatcgccatagtattgtgatggtgctggtagagcgaatccattctctagcatatactcatcatcatcatcatcactttcgggcagtggcgccgcagctgcttccgcggggaggtcccgcaccactagcggcggcggctgccgctgctgttgtatatcgtatcgccttttccgccagacgatagctgatgctgtaag

SEQ ID NO: 12186 - DNA, 781 bp, Heterodera glycines
ttgttcatgggattgctttgtcacataaatggcaccgtttgcggcacactttggccatttcctcgtaatagggctgaaatgtgcaaattcgaattttgaatcaattgtgattaaatctgaacaaatcacacacattcacttccaagtgatcgggcggtggcggttcgcacgaactttcatcggcgatctgacaatcgttggtcagatcagcacattttgctgtggggaagagtgatcactcacttcaatcatttccaaattaaaaattaaatatttatttcctacgtgtgcagaatttgcaagtgcgtgcgcacttttgcatgtcctcctcgaactccttctggtcgcacatgtgccttagtccgatgcatccgtcctgagtgtccgcgcacgcgcccgtcgcgcacagaccgcacgtggacgcacaagtcgtagacatcggaaagaaactgatcagaaaagagagagtgtgatcggaaatccaccggcgggggttagctccgcacgaccaacaccgactctcacagcgattagcccccccccccccccccccgacgttttcgattcgatcagtccaataaaaaaagcaaagttactttaccaatcacttaccattgccgtcatatttttacataaatgtctttgcgcagcacagttgatctgataacctaagtaatataactgaattgtcgtcctccctccgtttcaaatccttggccaattcgtaaatttggcttccttccacttccccctctccctccctctctcccaaaatgccaat

SEQ ID NO: 12187 - DNA, 1406 bp, Heterodera glycines
tcacccgtaaaccgcttccttcaacccgggcaagtcgcctttgagcggccgcccgtgcgaatttgtgtcgcgcgaggggcatactctctcgcagaaatctttcgtctctctgttctggcaaactgtcgcaatgggcagaaaattgccgtttttgtcctgcaaagcatttttcatttaccttgcttcgcctcattttcttctaacctgacagcgcagaagttccaatgtgctttcgttgcctctttggcgtttccgttgcccctctccctcttcttcttccccctcctcttcttcatcttcttcctccccttcctctttccttttgcgcttccgttgtccctttccctcttcttcctcctcctcttcttccccctcatcctctccctcctcctcatcctttctctcctcctctccctcctcctcatcctccgcattgtttccgtcttccgtttcatcccctccctcatcctcttccacctgatcattttcctcctccccctccgtttcagtctcttcgtctgccccctcgtcttcgtccccctctgcttctgtgccttcatcgtccgtcgcttggtcatcttcgtcccctccgccgtcgtcctccgttgccccgtccccctcctccccttgctgatcatccccattttcattcccgtcagtgtcttctcctcccgggtcagtctcttcttcgtcttgctgatcatcctgtgcttgtacagcccatctcttttgaatgccggccaaaaaaagtgccaatgacagggcaataatttgccataattttactctgagcattttcaaagtaattgaaataaattgaagagaaaaattggaaataaaattaacggttaaaagctgaacaattcgacaaaaatcccatcaattattacgcaagcaaatgaattaatggcagaaagtttccaaatgtttgaacagattttatgggtgaaaaattagaaataaaagataaatttgaaattacagagaattattcaaattttcattgtccaattttttttttttgctaatgtgtgttttcggcactttgtcccttccgcttgttgccatttgtcttttttctgctgaatggagatggggacaagggggtgcccaaaaggtctaagtgccaatgtcttactcttccaatgaccaacagcacagtctttattctggtgtccaatgttcaggatacaatgggcgaccccccaacccgattcggtctcgggaacagagactgatgagcgggagccccgggcaagactgagagagagacaagaggcggatgaacacttataaagagtctcgattagtgaaaagaaggaccgcccccgggatgacattgatggacgaacaatgatcagaggatgagagagagaaaaagagaaataagaaattaagtatatcac

SEQ ID NO: 12188 - DNA, 1534 bp, Heterodera glycines
caaaaaatgagtctttagcactaatgcctgaccaattaatgctaattaagctgcgacggccccatttgtttgtgcttcaactcgtcgtccttttgctcatcgttttttctttcttgaccattttttcggtttccgctacaataaggtgtgctgatatgtgtgttcattcgttgtcagtgatttgattaatcatcttatcgtatgatcaatcactccagttactaattaactcctaattatgtctttatttggctttgctttccctttccaatttctttttttctttagtgttgtcagtgatgactcaatgttggtctcgtgcgttctttcacttttcctctttctcttttacgggttaattagcaattaatgaattagtttgttcattcactgccttttcagtctgtttttggccatttccgtcgtctgtttccaatttcttttgtccgaatatgaggagatccaacggattttggccaagtcaaagtcagtgcattttaaggagaaaaggcggaaaaagtaagcaaattcaaacaaaaaatattataaacataaaatgccattgatcagtttgttttatacattaattctctgataaattgtctttttgatttgatcataaacaaaacaacttcgtcgtaaaccaatagccagaagatggttggctcccaatcttatgtcatgccttttattccttcggtcgtttttcggcactttctcccgattccgtcgattttcggcactttctccattctcttcgattccgtcgtatttcggcactttcttccgtctcctctttctctctttgtcattgcctcgctccctcctcctcattcgattccatgcttctcattcttcgtccaatgcttgccatgttcgtcctcctcatttccctccaccgttcgtttagtgccgaaagtgattcggtccgtttgaacaagggaatggccgagaagcgtctccgtctggccaagtgccggtggtgcagcggaacggtgcctaacggaggcgacacgctcgagggagaggtgcaattggccgacgcggtcctcttccgcttggcattgtgcgtgtggtcgctctgctgcaagttcgggtttgacccatgcgcgggcgaggaatgcgccgtcatcgacaaaggtcgcagttcagtggcggctggatcagtgatcaaaatcagcggggtggtgggcaacgacggatcgttctcattcgcatcgttctgccgacagacggcattcagccgctggtgatcccttttcatcggaggggatgacggcgtggaatggcattttgatcggggccgtgatttccttggtagcgagtgaacacgcactaaacatatatcaatattgttttaattgttttcaattatatttgccagttgcttcccccgagcgtttgtcctatccccactgattatgaccccctttccccccccccccatttccccccgaggggtgccatttcccactgaccttccccaagggcttcgacggcagccgctcctcccccgcctgcttctgatgaggtt

SEQ ID NO: 12189 - DNA, 887 bp, Heterodera glycines
gttttaaaatttttataaaaaattttttatgggaccttctatgcacaagtaccacaaaatcttttatcaaataaaaactatagggcttgcatgactggaacaccttcacaaatttttttaaaaagttagaaaatttgagcttttaagtgcgcgattcgcgaccgcgggatttttctgtccgcgccccactcactgctgtataaccgaaaaggaattcatgctttttaaccgcaaaatatcatttttatgtttggtagtcgaatgatcattttgatttttttcatctgcgagcgaactgatttagacttttcaacaaaaaattctaccaaaatttcttagatttaaatttcggagttcgcttttcaaaaatgtcgtcgtcctcaaagccgaggaattcgatgggtcggatgaagcatttgctgagctcggctgaggacgcggatgtgcactttttggttgggcagaaaaaggaggcgagatttcaatatccaattttgattttctaatttttttaagttttcagcttctacatgctcacaaattgattttgaagcacgcttccgaagtatttgaggcaatgtttcggtttgacgcacagaaagtaaaaacagaaaatggtgagaaaaaagaaacaaattttttattaattttttttgaaattcagcctctgccgaaggtgtcgtggaagtgcccgacgttgaagcagcggcgttcagagtgatgctcgccttcatttacgcggacgatctgagcgaattgaacggcgaaaatgctatggctgtgctttatgccggtgaaaattttttgtgttttaatggccacttaaaaatttttttgaaattttcatggttatttttacaaaatccgggttatgtgggggggggggg

SEQ ID NO: 12190 - DNA, 2004 bp, Heterodera glycines
ctttttaggactttgcccgccaatgtttgctttacatttgtcaaaatgcgacaacattgttcgacactgagcagtttttgcaaatcgatcagaatttgctgggtgaaatattcggccgtgatcagttggtggtcagcaacgaattcgaaatttggaaagctgtaatttaacttttaatgttttggtattttaattgattggtttgttttccgtttaggcactccgttgggccgatgaaaagtgccgtcaaaagggcactttgtgttcctccaaaaaccgtcgtgctgcgcttggcccggcactgttccgaattcgttttcctctcatgccaacggaggagttcaccaaatacatcggtagcagcaatcgttgaaagggaacagctcgtccctcaaccagatcaaatattccacccgagaattaaaaaactacaagcttctaatttccaataaaaaataagaaattttgcataagaaaaattaaaaaaaatttctctggggagacggtgtgaggggaactgatccgggacggagcaggtcgtttccctcccgaaatttttttttttaattttcaaatttagaaattttccaaaaaattcttaggaaattttttatttagaaatttcaagaaaaaaatttcttgatttttttttgatgcaataataagttttttcaaatttttccaaaaaaatcattgactatttcttaataagaaagtccctaagaattttttttgtagaatttccaagtttgaatttttcgggggggggggggcgaaatttgaaaagaaaagaacgacatttgttttatttttgcagttacttctggtcttctgaccattgaagagtttgtcgccgtttaccaattccattgccatccgaattgtctccctgggctttacccgttgaaatttccgtgccatggacgcatttctgactggaacaagcccaagaaaaacagagggactttggcaatggaaattgacaaattttctgaatttgcgcgggaaacaaagggcaaaagccgattcagcaaagccgtgacaataaagggcattcagtggaaaattgaggcggaagtgatgctgaaagaaaattgcaacgaaaagtgtttggccgtttacctttggtgcacttcaccgagaaacggtcggttcactccaaaatctcgcccaagaatttaaaaaaatttataaaaaattccaagaaaacgagaaaattgtaatttatcataaaatccaaaaaaaattgtgaaattttctaggtttttttctttaaaaatttttgcggcgaggatttgtctcgtcgagacttcgagcgacaagattccggcggataataaacaataaattggcattaagataaaagttggagttgcaaatgctcggccacccttcgaattgtcgcacaaaagggcgaggcggagaatttcacggggcagttcaatggccgtgtttttaaccacaaactgaacaatttgggcttcccaaatttgattactgttgcggtgagcggaaatttaaaccacaattaatcaataaaagcaggcctaattaagcaattaatggactcggacaagggattgtatgacaaattagaggacagaatttcaattgtcattgacgtcactgtggaggagcaaaagggagcgaagcgtaaattatcggatgaataagcccaaatcactcaattttttcttttcttttttttgcaagtctttcctctgaattgatgtattgtctttcacatattttcaaaaattgtcagaaattttaattttcaaataaatttattttcaatcaaaactaggcatgcatttattgctcaaaaaaggcttaaaaatgggaaaatggcagcaaaaattcgcagtttttagagcgaaaaaatgcatcattaggaggtgtttttgatatgttggaatgtattaatagaacgccttacataataaattattatatacactttactctatatttccagcatattaatttacatacataagaatt

SEQ ID NO: 12191 - DNA, 1645 bp, Heterodera glycines
  misc_feature (465)..(465): n is a, c, g, or t
  misc_feature (490)..(490): n is a, c, g, or t
  misc_feature (497)..(497): n is a, c, g, or t
  misc_feature (500)..(502): n is a, c, g, or t
  misc_feature (505)..(505): n is a, c, g, or t
  misc_feature (511)..(511): n is a, c, g, or t
  misc_feature (513)..(513): n is a, c, g, or t
  misc_feature (518)..(519): n is a, c, g, or t
  misc_feature (522)..(522): n is a, c, g, or t
  misc_feature (524)..(524): n is a, c, g, or t
  misc_feature (526)..(526): n is a, c, g, or t
  misc_feature (539)..(539): n is a, c, g, or t
  misc_feature (553)..(553): n is a, c, g, or t
  misc_feature (583)..(583): n is a, c, g, or t
  misc_feature (588)..(588): n is a, c, g, or t
gggaaaattgttaatttttaatgcgatttttaacagatttttgtccaaaaatgaccaaattttgccacaaattttatattttgtaaaacagtgacattatgcccaaaaatttcaaaattatgcgtagatttaggaaatcagaacaaaatttggtcactagcttcaaatcaaacatttctgataaatcagaacagatccgagccctggattaaaccccaaagtctcgaacaatttacaaaaaaaaagttcgatttgatcaaccttaaataccaacagttctgctgatcagtcctctttgggctgatcaacgcgatcttcaccggtgtgaaaagttttcacaaaggtttatttatttataaaaaatattaaatgttgctattttttgcaccttccctagaaaaggcgcagttccaaaaatttgtaacacaaggttctttgaaagaacgaataagcaggcgaaatggntaaatatatttcaattaaaaaactnttttatnatnnntcnaaaatnanaaaanncanananaaacattcctttntatttctccttttntatttcttcttttctctcatccttctcttncatanctcacttttagtgggtgggagggaaaggcacacaaaaaacaattcaaaactaaatttaaatttaattaatattttgcctttaagcacctgccatttttacgccagaaacaataatggaaatgcaacagaacgagtcgctggtcattgtgaacagtgacggggaggaggaggaggagttcaccgatgtggtaagttttgccaactaattttttgagttatttcaaaaggtattaggtcactacaaaaaacatacttagctttttcacgaattttgtctcgaatttaactaagtaaacaaattttgagattgagaaattacatgtatttttatccgaggcgtgaaatatttcttttaacggattgccatccttttgccggtgtgaaaagttttaataacgttattttgttatgagcaatattattataaatctaaatatttttaacgccctcccgagagaaggcgcagttccaaaaattagtccacactgttccttacaggaacgaaaaagtgttacaaaataggcaaatatatgttaatttaaaaactaatttatgatgggtttaaaattgaggaaggggagagagaactgatcctttatatttctctttttgtacgccttcttttccccctcgcccgtctcttgctcttagttcactttctctctttttcctcttcttgtcaaaattgaggaagagagtgagacgcaagggaagagagagaaatgggtcgcggtcgttttcgtacgagcacaagtttttggctataacttttttctttgccaaccaaatccaacattgttcatatccttcgatagccctatgtgtcctctattagcctgcaaaatttctaaaaatctcattaaggtccgaaaaaagttatggccagaagaattcatacaaccagattttccaacttttttggcccgaacttttttaaaacttaacgaaattttttgaaagtttgcagactaatagagcatctgaagggctctcgaatgatatcaagatccttggatttggttgacaaagaaaaaagttatagtcaaaaaacatgtgt

SEQ ID NO: 12192 - DNA, 3710 bp, Heterodera glycines
ccttattgacaaaaaatcttatggatgattttttttcaaaaattcaaactaattttcaataaatttttttgaccatattttcgtatttcttgtccatattttagcgtttttcccagatggccaaagtaaatgtttgaaatccctgcagaccaatcaagaatatttaaaatttgactaagaatttttggtttggttgaattctcaaaataaagttacgatgatttttttttttttgctcgaatacaataaggtatttatattttatttatttttccaggaattagagcccatttttctggattaaatcttagggcgaagctctaccaaaaaacatatctattttcctaaaattcattgataaattttggaaaatttcttaaaatttcattgaaattcgatttttttcccgttgacaacaaatcctttagaaaagacggtactcccagtaattgcaatggaaaagatactgtaagatctacggtaaaaagatttttttatactaataaaaaaatagataaaaaaatgctaaatgaacgtaggtaaaatctccaaaatcaatgaaaatttgtgtagaatgttgcgcagggttaattaattaaagtgttgcccgtccgtcatagcccatctgttttctgttcatctaccagccgaatttaagcaattctcagcaggctacctttccttgttcatctaatgacctgaaaataataagcattttgagaaattttcgaataatttttaaagaaatttttaaaattaatttttttttaccagttttgcaaattgtttctctgctgctgaagcgattggcaccaaaaatatgatgtgttgtcggagaaattaactgcaaatattttacatgtttaaaggtggatgtgaattaatttgatgccaaaatcattgtcaaaaaataatacacaaattttgaagaaaatagtattaacgaaatccaaaataatcttaccaatttgaataattacttatttgaattaacgctcacatgtaatttattaatagattaataattaattgatccaccttcattgaagtccagctccaattcgtcataaaaccgatcagcaaaacggttcggaattgtgcgaaacgatgtcaattgcatgccccagcggtccgcaaaactgacacgcctctcgtaagcatgcttctcagctgttggactcctcttggcacttgttgacctgtgccaatattcaacaggtaattagaggaacaattttcttttaaattcggctaatcctgatccctccctcgtgatcattccttgataaatgttcaccgataaatcctgatcactttttgtggcaaaattattctgactcagcctagtagggcatgttttcttaaatccggtcagagcagccggacaaaaattctacaaatcctgatcattcatgaaacctgatcagtgatcactccctgatgaaatatttaataaactccccgatcaatttcaggccacaaatcttattaattagttaataattgctcacaaaatggatttcagtttgaacgtcgtcgttgacccgtcaatggatgatgaggttgttttgctgctgtcctcctcactgtcactctgctggctgttgtactcctccgagtcctcctcctcagttgctgctgatgataatgacagcgatgagtcactgtcatggcaaaaattgtcggcaatttttgtggcatcgaatgatcggaaaaaattgtcttcgcatgattgtaaaaagttgtaattcgaaaggttcgttttggtccgcagcagatgatgattgtcatgatgatgattatgatgctcgtcatcctcactttcatcagaagagtcgggcgagaaaactgaaacaatatttaaaaaatatatattttaaaattttaattgttgttattattaccgtattttctctaatagagccccctctccctcatttaattattttaattgccgtgtgtttcttctaattagccccccgccccctcttgattagagcccacctccccctccaataaagccacccctgccccctctcgattatggccaaaaatgaagccccccagtggatcttaattgaaaaaaatatggtaattaatttttgcaccagtaaattaaatgattttgtgttgtcattaaaaattattcaaaatttaattgcatctattccttttgacagcgatttaaataataaaattatttttaaaaaatcatttaaaattattttaatatttataaaatgtatttaattttttacatttcacatttttgttccgtgagaattgctgctcctccgttttcagcttatcctttgctgtgtatgtttgtttgctgggacaacattgttgatcgcattgaaatcaacacattattaattgattatgtattattgctataattttaataggcaattataaattataagaatttaattaattaagaatgagaaaataaaaaataattattatataaattgattttattaattgcaggctttatgtttaatttatttccattaaaaccatgagttttcccattcaatttacatatgttaaaaaataatatttattaatttatttgaattatgaaaataaactaaaaaattttcttcagttgcaatttttgttttgcacgcactgataatgaaacaaaaataattacttaacattaccggttaaaaacaataataatataataataatattttgtgtgatcttttaaaaacggtagaagtgattgattatgtacacattagaaaatgacgaaaaatgaaacaaaatatttcaaaatatatttattgtacatatattaatgaaaaaaaagtaatttgaaaaaacaaaacaaaaataggtattttggatgggtttaaaatgttaatttgccagaaaaatatatttgtgaaattgaaaatgcctattaaaaaaaaaaaattcttttcaaaaatattaaaatttaattgacggtaatttttcgcaactaaaatttgtattaaaatttaattaattaattaattaattaactcccaaaaatatcacacaatttaattggccatggctatgcccgcggtatatcaaaaagcctaacatcagcagaaggtgcccattaaaaagataaataaatatcactactttttcgtacacacacacacacaaacagcagcagcagcagatgagagttaagagatggagaaaatgagcggggaaaataatgaatgtttgctactcgtgatggttttagtgtggcggtggttgctgctgttggttggacaactgactgctgacaaaatgagagaatgaatgaatgaatgagtgcaatgggagggggtaaaaattggaaaatacaacaaaaaattgaggaaatggaggaggggaaatgtggggaaaactgagctgggggtggggcaaggatgatggaaaaaaatgaaaactcggggaaaatggggggagagggtaaacgggggtaatgggtgaaaaaggcgtaaatagtgggggaaatggagagggagaaagtgcggaaaactgaggcgggaggggggggggggggtaaaaaaaggggaaattcaatgaaaaattggggaaaatgcaggaggggaaaaattgcagaaaactgaggaatgagggggagggatggtggaaaaattttttaggggaaatgaggaggggggggggggaggtgaggcatggaacaagtttacccgtctcctctcctc

SEQ ID NO: 12193 - DNA, 2247 bp, Heterodera glycines
  misc_feature (22)..(22): n is a, c, g, or t
cccccccccccccccccccccncggggttagtagtgttttggcgaggcgagccgaggcgacgcttttgggctccaatgtttggagtattctttgcccatcgtcatcatcacatcagcagcagcagcagcagagagtggtggaaatttccagaacgtcccattcacattgaccacgtggctttacagcagcagcagagagtggtggaaatttccagaacgtcccattcacattgaccacgtggctttacagcagcagcagagagtggtggaaatttccagaacgtcccattcacattgaccacgtggctttacagcagcagcagagagtggtggaaatttccagaacgtcccattcacattgaccacgtggctttacagcagcagcagcagcagcagatgatggacgggaaaaatgcggaaatttaaaaaaaaatccaatttgtttaaggacatactgatatgggaagaatatttcctggtgtataaaaatgggggtactgattttcaaggacaccctttgagtataaagccgcaggtctgttcctcaaggacaaggcaatcgttggaaaataaaaccatgtcatattgaaccacgaaggatggaaaataaagcccttaatttgtttattccctaaggacagttctggtaaaacaaaaagcgtcatcatgatttacaagtatctttttgcaaaataaatcccaggctctgatttccaactgaatcgtggtctttgttctcaagattgatgtaatatataaagccgcacttcattaatgttaagccataacctaacttgtcaaggacaatagtgaaattttcagaccaattaagaaaaggcaaaacaaacaaaaaattgattttaaacgtttgaagtcgaatgagcatttctagaaacgaacaaaaaagtcatgattttcaaggacatatccaataaaatataatattttgaggaaaaaaggaggaaatttacaccattttaaaatgaattttaatataatgaaagaaagatacatttgcttgctgcccgttcattcatttaaagcccccttaaacagaaagccaaaaatatcccgcataaaaaaggaaaactgaaattttatagggcagcaaagcaatctatcaaaatcagtgccaaatgtcatgacggtagccttagagaagaattaatgttgattcaaacgacaaactcttactgcatttatgtgtagaaacaggtgaccttccccgccctcccccctccggcggtgtccctccccgtccccggttttagtgtcgggatcagttgcggggtttcggggtttttttgtgtcgcatcgtttggagtgttctttgctcatcactaattactttggtgaaaatttccagcagcgaaacaccgcagaagagcggttattgacacaaaacacgtggtttttatattatagataaaggtaggaggatagacaaggtggattaactgtgcaaaaattatgtataagaagaaaaaattagaaatttccggaaaattttttgtttattagcgctttttaaatttttcatccgttcatttaaatccaaaattcaatgaagaaattatgtatacaaattaataaagaaaatttagtgaaaaaatatataaaaattacaatttttgtctcaagaaaacttcatcgaacactcaaggacaaaaaaaagaacattaaaaaattttctgattcttgatgacaataaacatttaaggacaaaaaaataaaaattccaaattagattccaagcataattcatgggatacctaacaaagagcctgagcctttcgaaaattaaaaaatttctgatttttaaggacaaaaaacattcaaggacaaagagagaaaggagccgttgctgttcacgaaaaataaattcagtttaaacgaagaataatactgcgcctaaataggaaaattgcatgcatatcaaattaattagaaaaacaggtttttatcatggacggcggtggttaaaaatgaaaaatgtgatcatttttatgtaaaaaaacatttggttggagcgtactttgttgataattttgtgggaatttgctggcaattagtagttcaaaaaacggattgagcaccaaaaaaaaattggaatattctttgaattaatttggtcaagactaattgggaaatttgggttgataagcgaacgaagaagggctcccatcaaatttaaaaaactaattatataggattgatgataatgaagataaaaaagataaatttgag

SEQ ID NO: 12194 - DNA, 4757 bp, Heterodera glycines
  misc_feature (17)..(18): n is a, c, g, or t
cttgcatgggcctgcannggtcggaaaaaaggcagcaaaaattgaaaaaagggatgaaatgcacgaaaatccagaaaagacatgaaaaaaggcatttaaaaattttttattaaggattttagggagcaaataaaaaaagcccatatttggataggttcaaacaaataaataaatatttaattaaaaattgtttaaatttttttagcggagaaagatatcaaagcaactgaagtagcgttagtcacattaatggcaaatattcacaaacaaatttgtatacaatttgacaaaaatgcattccctgttgaagaaattgcaaaaattactgttgaaaaagtcaatgatatgttggtgggttaaatttttataattaatttctttgccagctattttttgggcaaaaattttacatttttaacgggaatgggggccgttcgtcacagacgtttttggcacagacgattcggcgccagcccaagttttttcattataccgaacttttttctttgtcgaccaattcgaaccattttggtatcattcaaaagcttttcacaagctttattaggcttacaaaaagcataaaaattttctagaaatagaaaagttattaagaaaaaacttcaaaattttgagtttttcgcaattttcatattagaacttttgtggtaattgtccactcacaaaatttaataaaacatcactatttttagtaattaattacgtaattacatatttaatttttcaactcaaacttcgtttgattttttttcatatttagcagttttgttgggcttaaaagccattttttattattatttataaatcaattttgaattttattcaattttttgcattttttttgttgtttaaatccattttctggcaatggcctttttatgacattttttttggcattttgcaactctttttgccacttttggaggcttcattgaaaatttctttaaaaatttacatattttttaaaaaaatttttaggaaaaatgtcatcaaattgtcaacattcgtcgtgagaaagcagaaaacacacaggcacaggcacaaaacacaagcaaaaagagcaaaatgtcagggattagcaaaatatttggcggaaattcaaaaattaaaaaaaaattggcaaatttaaccgatgaattaaaatcattggaacaaaaagagcagcaactgtttcgagaaattaaaagtgcagcggaaacaacacaatttgattggaggcatctcgaattgccatgcacaaaagtgacgacgaaaatttagggaaaaattaaaaaaaaatttttttttaattttttggagtggagaaaaatgaaaattggcgcgattccattaaataataattatttaaatagtgatgccatgcaggtatggcacggaattccgacttccaaaaatttttggctttggaattctgactcccgaattttttggggcctcggaatgccatccctgatgccaagtccttgaattcaatgccgtccttgggaattacttgtggaattttaaaaaaatccttttttaacatgggtgtacttgagaagaaatgttccttcccaataatgtcctttaaaaaggacatttacaagttaccaacttgcttctccataccaaatgtgcgtccttcaattcaagggcgctccattatggcattttgtgtgctaaaaactatatggtttagtgctaaattttgatgaaaacaataaaaaatatatattttaatgccgtccttaaatttaaggacggtccacctccattaggattttgtttcaaggacggtccatctctgttagtgattctgtgggtcaaaaaaaagtgctaaaattattttttataattttttattttttaaataatttttcatttattttttttctgttacagaaactcttcgatcagatcaaaacactatcaataacaattactttgaaaaagaatgcaagtacaagaaaatattaattgaagttttatttttgtgtatgattttttccttattaatttttttaaagtatgaaaattggtgatttaaatgataaatttttgatcgattgtacttattttaattgttgataaaaacacgaaaacggcgattttatgtgattattatattttattaattattgaaatttaaaaattagtaaattattaaaaaaaattcatgggacaatgcagttacgaattttgctcaaatttttccccggattttttttttaatttaaggacgaaattttaaatgatctattaatatcatcaacatggtgaaataagtaattttgaaggatttaattaaaatttaccaagtgactattggcaattctacaaaaaattatgaaatatacttagtaaataacaaaaaaaaaattgtgtttggtgaccaacccaccttaatagtcaagtctgaactagtattagaaaaattttaaaaaaaatccatttttttctttaaattcacaaatttttttgaaataattttatagtaaattcttaatttttaaaacatttttcatcgcaaatttcatataaaaaatttctattggcaacgccggcctaaaacctaatcattattttaattttgaattgcaaggagttctggaagcgactttttggtcatttttaggccaaaatctgctaaaaaaaatcggaacaaaatttcagtcatacttttgttttttgtaaaaattttttaggcaaaaataaaattttcacaactcaaaaaagccagcaatcccgcgcaggttccctcaaatttgaaatttccaggcactaataataaattggaagtagagttgagcggaaccagaaatttttggaaaaaccgggaccgggacctgaaaagcgggacctaggttttcgaaagggtccgcgttttcggcatttttataatagcaaaaaatgttttttcattcattttataatcacgcaatttactcgtataattattctttcttttaaaaattattattttaatttttttttaattattatttttattctactagtgttattgaattatttgattctacttgttattagaattattttatttcatattcgacatagcttttttattggtgctgattaatgatttcatttaatttttctacttggcagggttttcctataaaaccaaataaatccaaaaattaaatttaaatatccaaaattattatttcatttttacagaatctaatacaattctttacgtttaaaatcatttaattgctttatttccacaagaatatgaaaattggcatcttattactaccatgtctattgatgatcaaaaacactgttgatcagactgtttctgtgaaaataaaacaatcgaaaggatttgatcaaatatttggcgaaggatgggagaaaaatgttgaggtaaatggaatgggtcaaactgatcaaaatgggacaattggacaaagacaaaatgacgacaaaaataggacaaaaaatggcaaaaaaagtgagtcaaaaatattggcaggacaatttgatcaaaatttggaggtgaaagaagaatcggcaagcgaatgtgatcaaatggaacaaatgtcagaagacagtggacaaatttctgatcatttttcaagtgaaattgaacaaatcaaaaggaaatttacaaatggaagagagaatttcgattaattaaaataaatatacattcggttgaagaaaaattaaaatattaaagcaatttgatcaaatatatggcaaattaaaaacgaaattaaatgaaaaattggaaggaaaagggacaaaatgccaaaaataatagctaaaaatttgggcataaatattagaagtatttataattggaagaaagaaataaaaagtggaacatttataaaatttcaaaaaattgatgatgaaaaaagagaaattgtggaaaaatatttaaaaataaaaaaagaattcatgcaaaatggaaaacattcacagaaggaatgggaagaatttaatgcaaaaattaaacaaatgtttggagtgattcttcagacaattgaaaaatgggccaagaaattaggcaataaacaaaatgctaaaaaaggttaaatttgagtaatttcactcgattttaaaactttaaaatttttttcaagtttgaaattatttttagagcaaaaaattttgacaattgctgaaaaaagggaaatgatgaagcaatatcatcagatgaaaaaacaaaatccaaagctcaccgaacgacaaattgtggcaaacttggaaatttcaccgagctcattctacaaatacaaatccgaattaatgggcgaagcaaaaaaattttgatagggatatattggatttaaaaattatcaaaaaatagagaattctgaattttaagccgataattttctttagtgtttttttatcgttgataatttaaaaaggtttttttttctttttttttaattggcatttaatccacaaatattttgcattcaccttctaattttatttttaatgtgctttaaactaaacattttgctgacgggatgtccactgacagaatatccattagtgatcgaatgtctgggaaccaatcgaatgccaattttacgcacattttataccaatgcctcatccaaatttgttttttacactccatataatttttaaggcattccttcgtttagccaaataaattaaaatttcaatcccaatttgtgagtgctaaccttgtatttttaatgatgctacaacctttctcaaaacccataaaaatgggcgtcctcgaaaaa

SEQ ID NO: 12195 - DNA, 1907 bp, Heterodera glycines
acccttttgacatcattttgatcatttcttttaaatttaaattatatttatacatttcgccaattttatatattgttattttgttttgtctttccattttgtcacacatttttttacaacttcgtctttgatcttttaaaaataattttatatttgtcttctcttctcggcaataaatttataaaaatctatcgcttcggacccttttggttaaattgtttcagtctgcttttcccaaaagagcagtactaatgaaccttccttggtatagcttagaacatgagttgggacatttggacaatggacatttgggcagccaggagtggacaattggaaagcggtcattatgcagtgaatgaaatcttcctattcatagcatgctcacaaataatcagcaatacaaaaatgttatactaccgaaaataatttattcaggacagaaatatagaaaaataaatagacaaatattactaaacagaaatcaaattcagtaaacgattgtatcatcgcctgagtcattgagctacggtcccttagacaaggtacggtgaatcgtacacactgtttccgcgccatactccgccctcgtccacattgtccattttggatttcatcatatggccaattcgggaaaagaagaacacttggccagttttcatgttgcctaccaggcagccaaaaatgccaagctcaggattggcattaacgttgagcattggtttggcatttggacggacaaagtgattctacaagaaaatttaaaaaattaaatttaaaaataactgaatcgagtattttgattataaaattttttttgaaaatttaacggttttttgagtcgaaaatatggcaattgtcgtacttggttgcatttttttaaaaactcgtttcgattccatgaattttgagccaagctcacacccatgagattatttttttacaagaaaataactaatcctctggtttttttgctgctcaccttaacggtcgttgggcgcagcttttccgtgaggtagtaaaaatcgcgctcagcgggcgccatacttttcaatttctttaccatgtcctcattaaaatacattcctgttgggccacaatcattggccttcagcacataatcttgtggattttccatagctttctgcaatattttaattaagaaatatttaattaatagtgttccaaaaacataatcaaaataaataaatgacgcaaaatatcaaaaaggtgcaaaaaatgtgcaataaatgataggacaaatatatgataaaaaataaataatgttaaaatctttttttgtggagcgtctttttatttaaatttgaataaaaatttaaaaaatgtattgttcattttatttgtgaatttaaaaaattactaagaaaatcatttcgtgtaaaaacattttttctaaatataaacaagcagtttataaaaaaatcttcaaattttcaatttcaattttactttactttttaatttttaatattaaattaatattttttatttaattatgttttgcctgtcgtatgccttcctcaatgttttcgtcggcaccgattggccagccttttatttgcacttttcgaattgcttgggccatcccttcttccccgggtcccgtaaagaaacgctcaacaatgccaggcgttgaaagcaccttaaaaagcatttttagttgttaaatctatttgaactatatttgctcaaaattttaaaatggaacaaaattttagtaaaattttaaatccgatttaataacattttggtcacttccaggcatttttcagtgtcaagaaaaaagttatgtgccgttattgagacgaaaaatagccgggatcgggagccaaaagattgcagcattacgggtacggtgtttcgaggtgtgaaaatatatgtctcgatct

SEQ ID NO: 12196 - DNA, 2737 bp, Heterodera glycines
tgaaaaatgtatgtctccaatctccagaagtggatacttgcactcagaactggagagacttttctctagagtcgagattctccagccgcactaaaactaattgttgacttcttacctgttgcattctcttcgccatgagacacaaagaatgacatcggccgacttttcgtaaaaataatgatagtaattaaaaaatataaatgcccattttcacaatggctgttgaacgctcaaattcaacacaaagtgccaattctgcgtcggaaatttctcgaccaatgcgatcaaccagaacagccaccacatatttatcatcaaaaatcagtgatttgtcaacggggtcaatttttaaactaaattactaataaatttatatttgaaaaatggtgccattttaatgtggcttttttttggcttcgttaccgaccgactgaaagcctcttttagggtaatgaagcggtttttgatttttcttgatgttatttcctctaatgtgttcacaatttgtcgagactcaagcatcaaatgactgtatagacttccatgtacaaaaaggatcactgcttgatcatttccaaattgttgcctaaaattcgtattacagcataaaaccccgcactgtaatgaaaatttccttaaaaaggttcaattattcaaaaacacaacctatatattcgaacaaggccgtagccaaaagcaggaatttatagccgtttttggccaaaaatgtgaccagtttttaataataataattattattattttgtttgtttaattttcttaccacgaatagtacagtgtctcggcatacattttgtccgattggtccaccggtgtcaccgtctcggatgcgtcaaggcccgcatttgcgatcattcgccgatgaagttgcgagaagcgtgggcttgtcgcgaagctgccaactgcgcccgtgttcacttcaacctaaaaagaatattgtacaacattttatgtgtttcttaactaatccaagggaataaaatggaaaattaattaaagttttttagaaatactcaaaaaaatatacattttttttatgtttcaagtgcagaagatttcaaatttgaaaaatttaaaatcaaaaattttggaaaggaaaaaaattaaaaatttactttctagattgacaattttaaaatttcattttttttgatgtctcaaaaacatagatcgctttttaggttagttttttgatttttataaattttttaaaattttttatgcttatattacttttatattgaaaatttcctttacaaatattaataaatcatttaaatttaaaattctaaaatattaatattcaaaaataactaaatagaaaaaattgattcttagcagaatttcggaacccaaaagcacatttttatacaaaaatacttatttataataatcacctgcttaagcacaatttgtccgttgtcatcttcgcttgccatataatccttaattatatttgaaaaaaaaacattttgaattttacaaaatgccaaccgcgcgttggcaaaacattgtcacgggctgttgaaagccattattgtacaaatcgtcaagtcttctgataagactctggattatacttttacgctcactgttcagcacttcgcgatgtgcatctttcaaaaatgcgtaatcacttgaaatgcggaaatacagcaaaagcattgcctgaaattttaacaatgtatttcgataaaatttttttgagttttaagcaaaacaattttctgatttgccggtgtcctatcggaaccagggatggacgaaatttcgtttcgttttcgtttcgtcctacattttcggcactttttgagtttcgttttcgtgtttcgttttcgtctaccaaagttttttcgtttcgtgtttcgttttcgtcagagcaaaattggacgaaaaagacgaaatatttacacccgtaagaatgacttttttggtaagaaaaaataagatatttattgaagtattgtattaaatctgctaagaaattgtgtgtaaagtttttaaaattttcccggcggagcctatcggcgccaccggaccagggctggagcgcgaccgcgattcgcggcgtttttttttgcgcgatccgcggccgcggcaatttgaatgtgcggtgcgcggccgcggttttttttttgttgcgcggtgcgccgcgcattttttggttgtaaaatttttataaagaaaattttttgaaacgatgtcttttttgaatattcaaaatttaaatgaaattttttttgaaaacttgtattattttctcaaaaattcattttaaaattccaatttccccgtcagagctgacaaaaccttaatttttctttaaaaaaattggctctaaatcacaaaataggtcattttttacaaaactttaaccaaattgcactgaaattttcaaaatttttcccggcgtcgcctatcggcaccgccggatccaccccctcccatcagttcccaaaagtttttagaaaaatcgcgccgaaaaaagctgtctgaaaaacaaaaaatcatagggtttccatgaatggaactcctttgcaaatttaaacactgactcaccccctcccccattcagtcccttcccgaattttatatgcatcgggattttaattctgtaattttctataagaaaatttgctctaaatcacaaaatagttcattttttggtgaaaatctgtatcgctcaatggacaactccccgaaccctggtatggac

SEQ ID NO: 12197 - DNA, 1520 bp, Heterodera glycines
  misc_feature (71)..(71): n is a, c, g, or t
  misc_feature (97)..(97): n is a, c, g, or t
ccgttggataggggtacaaaaatttgaaaaatcataaatgatttagaaaaaaaaaacaaaaaaatatattnaaagattttcagagaaactataaagntgagtctcatgtctggtactcaattacatgcagagatggcgcggattccgatttccgatttatggggttggaattccgattctcaaaagactggggccttggaacaccatccctgcttacatgcataggccaaaattaaattataaaatcatttcatataattatttatttttcaatgactttttttttttttgattaccgtctcgtccaaaattaacaaatttaatgcaattgccaccattcgctgctgcttctgctccgcccaccagcagattttgcagctgtacgcctttaaaaccacgtcaaatcgaatgtttttgtcctcggcccacactttttcgggaattattgcacataaatcgtccgtataagagcgtcattagcaccaatgtttttacttttacgtaaatgacccgtcaaatgaaacaatacaatatttgcaaaatttaatgcatttggtgcgctttttatgcgaaatttgacccgatagtccttgagttcgcattggccaccatcggcaactaaacaattaattaatactgcctttggtgctgggtcgttacttaaaaaccataataatgggcgttacttaaaaaaccatcataataagaaatcaatattcctttaattaattatatgattacaatttgaaattacatgagttaattgcaatttgatatttatcccttttatattttattgctttcctcaaattcacacatttttatttggaataaaatttatcgattgttttagctttatttttaaaaaactgcgatctgtgcagcttttgtgtgtcgttttcggctgccgtttttatctgacccaaaaaattttaaattgataaatttttattttttataccaaaaaaacaaatgctttcaaggtttgcgattgaccaacgctggccaatctgttgaaacatatactcattattaaaattttctagggtgatcgagatgtcttgatcgcccaacgtgagtgtttcattttttaatgacgtatttccggcaattaaatctaatgcatattttaatgacgtatttcaggcaattaaatcatgtaattagttgcgcaaatattgattatgatggctttttaagtaacgacatagcaccctgcctttgattaattacccattaattatttgacaatttattatttcaattaacatattaaatgaaataataattaaagaattggcagattataatctgaacccggcaatgggatgagctcgcgtttaaaaacagaagcagggtgccgttccaacatggtatattcagcagatttgtccgcatccaaaccaacaaaacaatttggccaaatctcgaatataaaaatttcaatcaaaaatcttttttcatcaaaaaattgtaactaatttacctttttatttggacattttccatcaaataaagcg

SEQ ID NO: 12198 - DNA, 1625 bp, Heterodera glycines
ttttttttgtttttcccattccaatttggcgtttaatctccgcattttcctttagcagttgcggatcccgtagctgttcgctacggttcggcgctgactcctccaacaattggcgctgcgtgctttgctgttgctcctccttggtaaattgggggccagtggtaaatgaacagcaatttgggcacgataactaagcccaaactggcgaaaaggcaagtgagcactgacaaattgtattgtattacaaaaattataatttatattttagatgaaaattcatttttgacgggaattcttttctgttaattggttaacaaataaacaaaaataatcggaaataaacaattaagggttgattataatacagggcttgcaagtgtgcttatttctaagatttgtgcttatttcagcgttacgtgcttattttgtacttatttttggatttgaaaataaaaaaaaatgcaaaatttgaatgacctatttgactatttttattgaagcgaatatttgaattaattcgttttttaaaagaattaagagattatttcattcttgagtgtaaaataaccaaaatttcagagaaaatctgttaaaaaatagtcaaaatgtctatttttcctcaaaattggctcaaaatctcaaaaattggtcatttttggtgaaaatattttaacaaattgcattcaagttttcgaaaattttcccgtcggcatctatcggcaccgccggacacccccccccccccccattcaccaaaagttttttggaaaaagcgcgccgtaaaaaaattttttcaattattttttcattttgaattaaattatcaaaatgctgattttgacgccaaatgatgattttcctattggccaatgctattttgaaaagtttcaattagcagccctggtttttaggctaataaaatattgtttcaagtcatttttcatgtttttattgcgtttccttcgcgctattattagttttcgaaaaaatcttatttttgcggtccgaatcttagtttttcacctattttgtcttattttgaaaaaaaacttgcgagccctgataattatttcgttttaaatataaatataattttttaattaataatattttattaataatccaagtccattcattgatgagtatttttacccgtgacagaaacaaagccgaagaaagggttttgctgattgcgcaggaaaaacgcaatgattggcccggtcaaaaggcacaaaacgccaacattacaaacggacaaaattgttgagcgaaggtcactcaaatagcggggcttcagctgccgcgtttcataggccaggaaaagaccaagcaacagaagaagtcccttgtggccgagaacaatgactaaaaaatattttaaaaaacatatataaatgtgtttaaaagtctcttaccggtccacatttcgtgccgattgctttggcacaattcgagaatcggcattagcatcacatcctcaaggcgcatgccaaccggcgggtccttaaattgtttatgcttttcaatttgcattctttaatttagcaataacaaaagacgcatttttttaaatttgccattttagcttaaatgttttcatgcattgaatataatattgaataaaa

SEQ ID NO: 12199 - DNA, 1585 bp, Heterodera glycines
tttcattgggtccaatccgacccaaaacacagtgataagcaaatcaaacgaaggccattgagccgatcacaatgtaaaaattgctcggatgaattggctaaacgggatttttcacaaaaatgagagcaaacattttttttttgaaattcaattcgccaaccaaaacaagcaaattaatgttggcatttcgtctgttcgttgcgctgccgccctcgaacaaattgccgtaggatgaatgctgcgaaattttcctcaacgcagcgctaatcatcggctgccgaccaacaaccgctgtgaacagagtgcgcacctggcacatcggaaaatatttacaaatattaaaatgaaacgcatagaaattttaaaaattaaaaaaatttactgaatcgccccatgggcttccgctcgctgtgatcgcttgtcccccgccggccccaacgagggctgtgctcaccgagttggcttggccaagagaagtggattcttcctgaaattgaaattttaaattatgattaatttttcaagacttttcggtttgaaagtggacaataaaatttattttcgttaaaatatttataaaattaaaaaactggtaagagtttagtcggaaaatacttaaaaaaatgaaaaatattctttttttccttgacttttattgataagaacatttcaacattgttacagaagggggacagttttttattccaattattaagacctcattgttcgggaaagttgttgccatttgtcgtcgtttctcagcgctgttcaatttgtgggccacccaaattttggcaaaaagtgcgccataagcaaaggtgaagccgatcattagcagaaaaacgcggaactatgaaaaaaagttatttgaaatttaaaaaaaaaatgggtttatacgtggcaaaatgcactgaacaagccgagattggaggagaagcgcagcaagggacgaccacggaaagaaacatcggtcggaaagccgagaaaaacgagggagaacaaacagaaaaaggagccgaccagcaaaatgcgattacaatggggctgagattggatgaaagctcttaataattaataaatgaaagcaattaaaatttgggaaggataggccaaaaaagaagcgcagaaaacatcatttcgaaagcaacaattcaagcaactcaaagcatgcccccatttcactatcatttgcatgtgtccacggctttaagcccttcaaattaccgtttttagagaaatttatttaagaagaaacattggcaaataattttctgatcagagcgtttgtttctggcttactgatcactttctgccgaatcaccgatcattttctgatctctaaagcataatttgctcatgttcgagttccctttcaaaatattcatttttgattcctctcggatcatttttctttagagataaccgatcactctctgatcgagttttatctctcaaatcagagcctcttctcatcgctcattctgctgggcattctccaacctttccccagatttcctcttttttcccgattctctgatcactgatcggtcggcctttcgatccgttcaaaatatgagttgttacc

SEQ ID NO: 12200 - DNA, 4166 bp, Heterodera glycines
  misc_feature (2077)..(2077): n is a, c, g, or t
  misc_feature (2168)..(2168): n is a, c, g, or t
  misc_feature (3379)..(3379): n is a, c, g, or t
catgcactatttcgctgtattctttttatctttgtaaccgttcatgctcgagaaagagaaatagtgcgagacagacaatctcgagaaagagaaatagtgcgagacagacaatcttgagaaagagaaatagtgcgagacagacaatcttgagaaagagaaatagtgcgagacagacaatcttgagaaagagaaatagtgcgagacagacaatcttgagaaagagaaatagtgcgagacagacatggtcggagaaatagtgcgaaacagacaactcaagagaaagaaatagtgcgtaacgcgcttatttgtaaaaattagccataatttacaggaaaaaaacgcaacaaactcaaaaattggtcgaggattatttttatcatatcagcaaattcattaaacaataatcggccttaaataaataaaatatgtatgcttaagaaacaaaaatttaaaggcgattaaacaccaaaattttggtgagattttttttttgttaaattttagccaacaaaaatgtggaattcgtgattttttgccgagacaattcacaaaaatctataaattcgcattttcaaaaaaaagatattcaccaggatttccaattgtgagtttagtcttattttgaagttttttgagaggccaatgaggctatatttttcaaggctttctagtttttttgcgattgtcctgatttggagggtccaaatctgataaaataaaaatgttctgatttgtcagaaatgttctgattttggtgtagcgaccaaaatttgttctgatttcttaaacaaactcataattttaaaattttatggcctaatgtcactattttacaaaaaaaatataaaatttatggcaaaatttggtcattttttggacaaaaatctgttaacaaatcgtactaaaatcacacatttttcccggcggcacctatcggcgccgccgggtcccctgtcctccaaaatttttggaagaagggccccgcaaaaaaagcgtttttaaaagcgaaaaaaaagtcgtcgcttggcttttaattgcaaaattggcattttttggtgaaaatctgttaacaaatcagaacgaaattacaaaaaattttccggcggcgcctatcggcatcgccggaccctctcccctcgcccatttcccaaaagttttttggaaaaatgcgccgcaaaaaattcttaaaaatctgattttttgatcccgagtgcactgaaatttacgatttgttaatttcctcaccaaaatttttaaagatgatcatgggaggtgaaaaatataatatttaatacatttttgatcgaataaattgtaaaaataaaagatttgaagcaattttgcaaaatgttctgattttcgaccccaaaatctgattttttggacccgatgttctgattttgaaaatttttcgatccgaaccctgatataactcacaaaattttaaatttttcaaacaaaaactaagcaaaatgatagtaaatgaatggcggtgtttggggtacaaaattttggttggcaaatgagggagagaacactccgccgtcgcttctggttgtttgatatttgtctggtgaagtgggaatttgggaaaatatcctttctttctttctccacccccgccccgcgccacagcgcccacaataatttgctttaggggccatgtggcgaaatgacatcgtcagagcagcaaaaggagcagcgccaagcaaaatcaatcaatttagcagagagagagagagagtaaaacaattaattttgtatggggagcagagcagggtgaaaaagagtgcgaagaatgagagagcggcagcaggaaagcacattagtgtagataacttgtgggtaatgagaatgagagtggtaaaagattgtgtgtgagagcgcgagagacactaaagaaaggcgaaaagagcgcaaagaatgagagagcggcatggaagcgcattaaaaagagagtaggaatgtgtgggtaatttgtgggtaatgagaaggagcgaaagaaagattgtgtgtgtgagcagaacacgagagaaatcttttgtgggcagagagagcggaaagagagagaagctanagaaaaaagggggtaagagagtggaaaaagaaaggcgccaactgcagtggtgagagatgaagcagagaagaaaaagaaagggaatagtaanggaagaataaaagatggataaagaaggcaaaagagaaattaaaagggaaaagaaatagagaaaaagagttcattaaacaatgatgaaggacaaggcagtcatgcattaattaaatattaattagtgtttgagcaaatgttgccttttttgcagtaaattgcaaattattaaaatttttgatacttaaaaattaaaaaagaaattgctttttttctttcaatttggaaatcaccgaaaaatgtttacacaaatttttaagtattgaaaataagaaaatttttcaaattttgctggacgcttatagaaaaaatgacgtagaatggttcaaaaaagatgcgaaagctgaaacggatctggttacgggatttggattaaaaatatattttgccgaaaaacgggaaagaggatcaattactaaagttcatactttaattaacacataaccaaccacccacttgttgattaggcatcaggccgcgtgatcataaacggaatggaagaagtgagtaatatggcacaattgtcgatatgtgaatatgtgtgcaaattttaaatgccaatatctacaagaaaagaaggttttttatgtttaaaaattataatcttagtttaattattaattacttaggagcagataaaaaatttaattgaaattaatggataaaaatgtttttttaatctattatttgacttggaaccggattttagacaaaatccagcaaaatccagcttgtagaaaaatgatctctgatctggaacgaggaaaaacccaaggaaaaacccaatcctgtatccacaagctatctcaaaaatcctcagacccggtcaaggtttttcaaaatcccgtactctaatacctatgtatataaatagttaacaactataatttttactagtattcataagaaaatttcaagatacacctaaatatcaatggtgaatcccgaatctatattttttgcgtatttgccttcgcttttttgtacaagaatggatttttttaattttgcgagttaatatggtgctgggacgttagtcaaaaaccattaaaatgggcgttagtcaaaaaccattaatgggcgttagtcaaaagacattaaaatgggcgttagtcaaaaaccattaaaatggacgttagtcaaaaaaaaaaaaatttcaaatggaaaatttttgacagagaaaattattcataatttcgcccccaaaatganccaaatttaaatttcggtagccccaattcgaaaagtatccaagaaataattaattaaattgagaaatcggattgagaaagaaaaaaaaaattatgatccaaaaattgtgcggcgatttttcaactaattgcctaacccaaaattactttctaatattcactgactgagactgatcatttttccaatggaagaatttttttgtttgtttgttttgatcacataattatgttaattgcttttgatgggaaatttattttctgttttttggatgggaaaaatgaacacaaattttatgcaaaaattaccaaaaaaagaaaaagaaaaattcttttaattcaacagcagcaacactcagcagatggaggaggagaaatgacagtcaaaaaatatgttatcagcacagaataaattagtatggatttttgaaaaaataaataaaaaacgtaaatatttatcaaaaaatttttttgaaaatttataccaaattagcaaaaaaaaatttttttttgagatgtatataaaacgtatcataattatgggttctttttagcatttattaatggattttgagtaagctgatttttgtatccaaactttgatccttgaatactttttacaatagacctaaaaatttttatttttattttaatcgatctaaaatatttaaagaattttctattccgaattccgataaaattcaatgcaaaacgaatatttttaggtggaatttatatgatttaaaattaattgcttaacaaattaagccactctaaaaaaatgctgaatt

SEQ ID NO: 12201 - DNA, 1766 bp, Heterodera glycines
  misc_feature (11)..(11): n is a, c, g, or t
  misc_feature (18)..(19): n is a, c, g, or t
aaatttattancggcacnntttttcgggtagaaaatacacatttcgcaaaaagtttcataaaaaattttccaaaacatttctaggttgacactgaatctcagaggcatggtcgaatcgggtccggaattaggtaaatccgagttcagattcgtgaccagcgccctcgaaaagccgtggaaactgattttgagaccaaatcaaaaaaaaattaaatagaaatccttattcctaagaattgccaaaaatcccttctaattttttgcgttttttatgcctttttgattatttttcgtgacttaaattcccagccctaaacattagttgagcaaaatgctggcttaattaaatttccaagtctttctattatttgtattaagattattttaagggtttcaccgttctaaaaggttaggagtccccattttgtccattttccgcattttgaaccgggccaaaaacaattcaataggcttaaacttttcaattgttattaaaagtatgttgtattcgaacaaaagaaacaacaaatcaaaaaatgagagcatcaaatctgttccaattggtgagatcgtcgttgtcggaatcaccgctgtcgaaaaggtgctatgtgaattcgacagagattgatttcgacagtacagataaatttttttaaaacaagagtgtattaatattggagccctaaaaatgaagtgatatgagcacattcaaagataaattaaaggattacgattttcaaaatcttcgacggggcttatggatcgagattttgctctccatgtcacccattcatttataatttttaccattattttaatatcaagttaactctttatttacaaatcgtagccctacattcaaaagaaaattcgggagtaaatctacggaaattttcccaaccccttatgaatttttttcgaaaattttaacaaacgattttcaacgtattttgtggtgtcccggatcaccatgaaggagtgacctgatcaagtaggttaaaagaattttttgatgaggatcaaaagataagcaagcatgaattatctcagatttttaaatcaactataaggtggtttttcatgtttgagtcaggattttccgcctcttttttgagcgaagtctgatcaggcgactaattcacgagaatgataaagtagattgaaatattgtagtgtgctaaattttcagcggaatttgaaatttaacaaatttttaatcatcttgaatcagacttttttgcaccactgtatcacttcattttaatacattcttgttttaaaaaatttctctactgtcgaaattaatctctgtcgaattgacaatttttcggatactgtcgaatcaatcattgtcgaattcactcgttgtcgaaatcacgcgcagacagtgaaaaaagcgagcatggtcgacgaaaagtaacagaatcaatcacaaattaaacattatgccaaaataccttttcaaaagaaaatgaacaaaaatgaagaattttttctagatcatagaccggtcaaaaattgccggttccggaatccgtgccagttgctggttccgtctctaaaaattagtaaaacggaaagtccgactcatttttttatcccttaagaaaagataaaaaataacaaattattattaaagattttatttctttcaatgtgcccttgtcttctttttttcgttttgttcatcgtttccttgttcccttttaatttcgggtcaaaattttacgtctgacaaatctcgacatttttgtttcgtatttcgg

SEQ ID NO: 12202 - DNA, 1822 bp, Heterodera glycines
  misc_feature (1775)..(1775): n is a, c, g, or t
ggtcgcctgtgaacaaattggtgctccaaatttccgctgttttcagccataattttcaaaaaaaatttttttctttttggaatttttattccaccaattttttattttttggggtttggagaccactcaaacccaaaattttcaaggcattcgtgtgttggacacgcgccacgaggccaccgccgtgtttgccgcagacgcggccgctcgcctgcgccaggacattggggtggccgcggtcaccgccgggccgggtcagaaaataggagttaaaataacaaaaattttgtaaaaataaacgaaattttctactctaaaattgtaaaaaagggttctttgtccaccacagttctttaaaatccctgaagaatttattccacggagaccaaagggagaggagatggaaggccgaggcatttttttttgctacgcctcaagaaattttccagtattttttttcaaagatcatactagtgtaaattatttaactaattttgggtccaagatggttttttgtgtcaaattttgatgaaatcaaagagaaacgcgaaaagattgtaggaaattgtttgaaattaaaaaaaaatttttttttgccaatttggggaaaattgtccggcctatagggcattttgtcagaaaaattttgccaaaattaaaaaaaatacatgaaaattctgctaggcatcaccaacacagtgaccgcgttgaaaaatgcccaaatggccgagtcgccggtgcttttgttgggcggcgcgtcgccttcccttttgaaggggcgtggggctttgcaagtaaacaatttttaattttgtaaaaaactaagtatttcgataagaccgccgcaaaaaaatcccgactttttttggaaattgccaaattttcaaaaaaaaaccaaatgattttctaaaaaattcataaaaaaggtttgttaaatgagaggggaagggtccacccgtaaaaaatttcaaaaaaatctaacaatcactaaactttttgccacaaaaagtgccaaccgcttttttcccaccaggacattgatcaacagacgctggtccgttcgttgtgcaaattctctgcccgagtcacctgtgtccggaacattgtgccgaccattcggtgccaaaaaaaatttaattattttttttcttttttttgtgccagaaatgccattgccaccgccaaatcgggcacgcctggtcccgtgtttgttgaactgccaattgacgttctgtacccgtacaaatcggtggagcgtgaagctgggctcagcaacgcgcccaaaaaggggctggtcaaggtgagcggcgcgcatttaatgcaattttcattttttgatttttttcgacgtgccaacaaaaaatacattaaatttttttgtatgcttttgctggcctagtgctaacgcattgattacagttaaaaactgaaaaatccaacggcaaaaaaaaaaaattttttttttttgaaaaattttcaatgaaaaattgtaaaaaatgaactttggtattttgaacagatttgttaaaaaggaaacaaatttccgcacataaacttttacaaaaaaaaagatttttttgcattcagaccctgctcgacgcctatgtccgcacacacattgccaacacgttcagcgacgcgtggcaaccggaacagccgttgttgccgctgccagtgcgcgttccgcgccccaccacggcacaaattgaacaattggccaacctggtgagcagcgccagggctggcatgcgccggatgataattccgttttttgngccctccgatttcgaattccgagaatttttagaggcatatatgaaaa

SEQ ID NO: 12203 - DNA, 2474 bp, Heterodera glycines
aaatatcccatataagaaaaagttctttttcttatttagtaatttcgccaaatttattaatggtaataagttactatttctcagaaaaatggggagtaacaaataatttaatgcggccactaaaagattcactaaaaccaaactgttcactcgtattcttaatatttatgtgcctcgaaaaaagcagtgttttatatttagctgagttaattattaccaatagacttaatttttcaaatattcataatattcattaatatatttcctttaaatttcatatttaaggaaattttagtatagcgaaaagctttggtatagcaccgtcactaagatagttaatctttaattcaatgcaattctttggctaacttgtccccccccccccttcgctaacaaattgcacacgaattttcaaaattttttccccggcggcgccttcggtttccgtttggccaagttttttgagcgcttccagtctcatataaattcctgggttcctaggaattccggttccaaattccctacattttccattttgcatatttatgccgtaaaaacccaaaaaattcactaccatagtaaaaaatttttaattttttttttgtaaataaaattaactgatattttattgttgtagctgagctccgccgaacgccctcttctgttggtcggcagccaggcaatggcaccgccggtgaaagccgacgaattggcacaaactgtcgaggtgtcggaaaaaattgaaaatttttaagaatttccattttctagtcactcggtgttccggcgtaccttggcggaatggcacgcggtttgttgggcgcctactcggccattcaaatgcgtcaggagcgcaagacggcgttgcgcgaggcggacttggtcatcctggcaggtgaagcattgggatggctaaaaaaaatttggaatatagacggctcgaaaaacattggagattggaattccgacggcccaaaaaaaattggcaaaaaaaaaaatcgcggaggggcggaacccgatgacctctcccctcatggttctgttcttgcacagcattttatcccgggcattaaaaaaaattttcaaacagcaattttcaagagaaaaatttacaggtgccgtgtgcgactttcgactcagctatggccgtgtgctgtcgccaaggtgcaaagtgttcaccatcaaccggcacagggatacaatgctcaaagtgtgtgctgtggtgagcaggagagggactagggagctgcttgtccgtccctgcaaaaattttatatagattttcaaacttataaaattttatgaaataaacctgaacaaaaattgaaaatgttccagcatttttagaaattttatgaagaattacttaaaaaaaaacattacaaaaatttgcacaaatatccccggaaaattgtttacaaattatattttttctggaaatttctaacatagtaaatttaaaaaaaaaaattttttcattctgaaaacacccttgggctagggcgacggaattctattctattttttttgtcaacataacattcaatgtcattcgtctggttgtgttgcagaaccacggcgtgttctggcacagtgccatggccatccaagcggacgtcggctccacgctcgtacaactccaccaacggatggccagcaactccttcgccgttgacggccatcaacgctgggacgcctggctgaacgcgttgcgctcgcgcgaacgcgacacggacacgcgcaacggcgccaaagcggcggaacggacagcggacggacggctgaacccgttgcgactgttgcgcatgctgaacgaggtgttgcccgacaacaccattctggtcgcggatggtaagaaccatgattattatgagagaaaaataccatccccccctccgaaaaattaaaaaatttctcgaaaaatttatctgcgattttttagaaaaacttaataattcgtcataaaattttgaaattctagaaaaatttttctaggattttttcttgaaaatgttcttttgcaaattaaaaaatatcgctgggaaatggagggggcgagggggtagacgtgaaaaaaaattcaacaatttttttaaggagttgtaaaaaatttttcgaattttcacaaattttcccaaaaaatcgcaaaattttttgattttttttttggaaaatttgacaattgaaaaaattaattgccttctgtcatgtcaaatcacgttttatttatgttttaaaaataaatttttgccaaaaaaggtggtgattttgttggcaccgccgcgtacactgtgctgccgcgcggcccgctccaatggttggacccgggcgcgttcggcacgctcggctgcggcgccgggttcgcgcttggcgccaaggcggtccacacctgactgtccggtgctcattctgtacggggccggtgcgagcgggtacgttagcaaatggggatggatggataatttgggctgacc

SEQ ID NO: 12204 - DNA, 839 bp, Heterodera glycines
  misc_feature (19)..(19): n is a, c, g, or t
attatcatcatccactccncattttggctaaaatattaattaatacgctttgatttgcgctcccaactgctgtttaacgaaacggccgaggctgggaaggttttttttactttttacgaactgacatttcgccaaaaaacattttataattaattttaaacacgtgataacccgatcaaaatcaaaaatcaatcaaaaattcttaaaaagatatcccttacaattagcacaactttaatcaaacagttaaagaaattatcgaatctttgccataagaatactaatacaaaagataaaaggaattatcaaattcattaaatttattcgataaattttataaaagacaataattaatgttttgaaaatgagatcaatttgcgattttggatctgataacaagggaaggtgcggtacccgatcggtggacaaattatgggggagggaaagggcgcgaatttgacagaggtaaacgaagcggcgcgccgtgttggccattcaatggcatccgcaagaatccacgcgcatatccgcataagtcttcacgacaatcacattgttaatgtccttgtaaaggatggaaatggcactcatctgaagcgagaaaggaagaacttctaacatgttttgcgcgggaatgacctgaacgggcacgcaactcggggccgacacggagtgggggtcaattgagtggatgagcgactggacgatggcatggttggtagtgttcagtttggccggcaatggatgggcacaacggccacggcattggtaggcttcgtagccggctaaatgtgattgagtttttcatgaaagtgccaaaaaaggggagggctttcgag

SEQ ID NO: 12205 - DNA, 1731 bp, Heterodera glycines
catgcgtcgtaacatcataatgtcgaattgtttccacctccggattccccctttgctttccatagagtgcccaaatgttcgatggcactttctccgtcttcttttcgccgtaattagtgacactaattaatgtgtcgagtccaaatttgcgtagaaatgcccgacgcaacaaaaggcgttcctccaaattcaatgtgccgttgggaaatgaaactgtcgtcgtcgttttcactgtttgtttcggctgaatgtgtgccttttggctgctcattgcgagtggactcttcagcaaaagcaaaagggcaattattgtgcaaaatgttctcttcgattctttccccatttgatgattatttctcggcacaattccatggcatttcgtacaaaaacaaaaaataggaacgaaatggccgaacattggcacagacagattcgaattatgtagctgaaaaatgattggataataaggaaattttgctgactgatttattggccaaaaatatgaaagtggacattttgggtgggaatgattgtccaaatggagaggtaataatttaagttggttggttgccggggttgtccggaaagagacaaattcttaagttcggtcgctccatccaaaagtcgccccttttgaggtccctcccccattattaattggaccctaagggttttgtctcagctttgccagcagaataaaaaacagacccctttctgctgccggtcaaaggccgacatgctcaatttgagagtcggtgacaaactgccaaaagagggacgaaaatggggagagaaacgggggaaaagaggggggggagggaatgagtgaagcgtaaaataatattatgatgacatttatgacatcaattgggagagcagtgaatgtccgaggcccttcagagagaccgcctactgaactttccctgcggcaaagaacagagatcaaagggagaccgccgaagcgaaattcgatacgaaacagtgaatttgtggtcagcagaaagtgcgggagggcataagggaattttaaggaaataaaatggatgggcggaggatgttcttctgatgttttggtcattttattttcaggggctgacattttaatgaaaaatgaaaaaatgtaaaaaaataaataaaaaaggacaagcaattattacttttaaatgttctcaatgatcaatgccccgccggtccatccaaacgatcgcttttaacgaaatgcgctttaaaccaagggaatccaaatggttaaatccccgtcgacatttaaaatgtgtaaaagttggaggagacggcgcctgtgacagtttgcttcaacgatcaaaaagcggaaacgggaggagactgatcgacgatcagcagcaaatggagggaggggggggggggaggaaaagcgtgggaatggaagcaaagggaagggtggagggagggaggggatggcaatgcgaatgaatgggcgggcattttgagttgatcaaatgcaccccccccccccccgggggggggggaaggccaatgatccacgaattgcacttccaatgcttcgctgttgggtgccatcactcaaaacattatggaaaatgccctatgagccatcaaaatatagttgcctcgtctcattaacaaatcaaatattgcgcttccctccatccatcgccgattaatgccgaatttgacgaccgaccaaatcattcattcattcccaccaaacaaacactttctcactatttc

SEQ ID NO: 12206 - DNA, 1608 bp, Heterodera glycines
  misc_feature (1584)..(1584): n is a, c, g, or t
cccattctccgacccttcccaaacccatccaaggacatttgtcttctcccgcgtctcctcaatcttcaactttatttgtccactgaaattcgaatcccttccaccgcaatgagttcattttcatttccgtgggcgacttttctgtttttctccctaatttcttgcctaatttcgctgacagaggccaacccgaagtttctctgtgagttcgccttcttcatctgatcattttttgtcggactttcttctctccctttttccattaatttcccccattttttggtcattctttccctccccccttttttcagtgtcctgcaaagtaatcgacggcatttgccaaaatgacgaactttgcttggaagaaatgggcattcgtttccccgactgttatttggagcgcaaaattggttaataatttcccaacagatgatccttccttggtaaattttcaatctaagattttctccaaccccaaaaaagcgcactaaaatccacgccattcactgaaggggcaaatggaccacaacgatttctgaaaaggactccagcgatgaaactgatgaaggtgctaataagggggaaagtgaacggcataatgtaattaatgccaataaaggtgctaatgatgaaagatcggattccggtgggtcggagatgagcggagaatgccaaacgaataaaagtgaggatgagacgagcaaagacaaacaaataataatcagaaattgccacctcaaacagtccattcattctgtgcaaaaagacatttagaggcgaatgtttaataaatggaagaatcaatcggcctccgtcgcttcgttggccgtccgtccccctccgatcaatgctttttctccctccgggggatttacgtctgacaggccgagtcccaacggaatcggcttccgcccagaggccaccatttcgacactcctttgggaccatttgtaccgctctttccgtgtccatcgattgaccactccatcagcgagcaatctgatgattttcttgaaaaaaacagttatacaattcgccatcccaaacaaaagattcccatttgtgccgtctacttcgcccttctcggggacgaccctcatggcttggatgggggtgtacccggcgggcgtccctcgtatcccttgcctaccttttccatgtttcggtacggatgttttctccactcggcgtgaagatggccaggactgttggcatagaaaggcagtggctctgccttcttcaacgggaaacggccttcgccgtaatattcgtccaatttcattcgctaaaagggcatcgattgtttttggcattttgtctccttagcttttcaaatccgtaaccgctgttcacctctttcgtgtcaacttcgtcgtccgctttgaccggtgcggtcagtggcgaggcgacaattcgcggaaagaattgccgattgggggagagttcgaccacgtgaagtcgggtgcgttcggccaattgctggtgcgtctcctggttgagcaggccggcgacgaaggcgtaggtcaaagcgatgtaattggtggtgctgcctcgcactttggcgtggaggtctttgatgcccanaaagctgaaaaagcaccgctaaat

SEQ ID NO: 12207 - DNA, 1637 bp, Heterodera glycines
  misc_feature (271)..(271): n is a, c, g, or t
atttaagaaaaagagagagagagagaggaggagaattgacaactaagaaaatgaaaatctcttcgtttctggcccaatttatgtgcattgtccaacccccctccaatcaacgtccttttttctttcttcccactagaaatgccacagttctccacgtatgccacgccacgctttcggcctgcgcaaggcgctcgcgcaatcattcttctgccatctcttctcatcctccatcccgccggggttcagccgcctctcatccaactcacccccnccccccccgcaggggcctagcttttgccaagctcccgaatttatgccatggccatcatattattatagcgtatcatacatatcacatgcttggctgttggcaaaatgaaatggccgccttgaaagggctaattaattgtaaataaaaaaaaacgtaaaattatgcaaaattctcggcgaatttaataattttttgagtttcaattagagatccagtactactgggccggacccagatacacaaatttttattgacccgtagcccgtgcccctatcatagttttcgaccggtacgggttttatggacaacgggttatttcgccagaaagtctgtgtaccccgtatagatgatatgtccagcgtcagtttattgtaaaagttcaaatttattcctttctttaaaaacgttttccaatcctttaaaaaaacgagagattttaataattaaaaaaattatctgtaaaatatttatccaacaattaacacgcaaaaaattttgacacatacaaacattggctctgctgctgatgttccaaccaaacaaatcaatgaatgagcaaaaaccgaacaaaaaaaagcacgcacaataccaatgaaaaaaacacatgccaattcatagggcaataaaaaatttctgttttttccttgttcaatgcaattaccaataattaagcgggagttagggctaggagaggggtcacttctgtccgtctccaccctgatcatcatcatgttgatcaccaccatcatcatccgtcgacgaatttgactgcaacaaatcgtcgtcgtcgtcgtccaccatgcccgcctcgtcttggaacagttcagcatcaaaaacgacaactttgcccgtcgtcgtcgttgttgctgatgatgattgtacattctgggctcctcccgtcgctgcgtcatcctccgcctcgtcgtccagcttcaagtcctggaaggtccgctcgtcaatttcgaacgcgtgcatttgttcatcctgcgatgcaaaaaaaaaggaggaaatgaggcggttaaaattagagaccggacaagagggtcggtcggtcggtttcggttaaaaaccaaaaaaaaccgaaaccgaaaaaaaccgaagaaaaattttcggtataccgtttcggtttcggtttttttgaatttttttatcttttcccaaaaaaaacaataaaccatttttatcaatagaaaaagcgaaagatcacctctgagtaaaattgtagagctatttttttgggggccggcggtgccgataggcgccgccggggaaaatttttcagaatttttaatgaattttgttaagaaaatagccagtttttcagaaattttcctctttttcccttagctttcgacctccccccctt

SEQ ID NO: 12208 - DNA, 3116 bp, Heterodera glycines
  misc_feature (1438)..(1438): n is a, c, g, or t
ctattcgggctttagtagtgcaatttgatttaatacctaacccaacgccagatcaagtgattaatcacttaagggccctacaatacgattagcatctaatgggtttgatcagtggaattagctcatgccaattattttgtagaattgtaaaaataggctgttgttggggcttcggcaagcctaataaaaaaaaataaattaaaatatacataattatttgtttttgcttttttaaaaatttttggcttatattttttatttgttgatgtgtgcttttttagttttgtgtgtctgcggtagggccgaaacacactttttttacattttttgttttcttttggaagagccgcactgacgaggcccactcttccattagattttagaaaaaaatgtttccattaattttttttttctcagaaattgtccgcaaatgtccgtccgcaaatgtccgtccgcaagtgtccgtccgcaaatgtccgtaaggctttctaacattttaaattcctgagaccctaagcgttcgtcgacatttacggccccgacatttgcgcctttgtccaaaatcgggctcaaacttaagctttttcaatccctgatcgcctaaaagctttaacaaagcgatagaaagtgcttgtatccgatcatttgatctccaatgaatttttgaaaaaataataaaattttcaaacaacagaattaaattttctaataaactagaatacagtgctttcttaatttaaatgctgtttaagctatcagggcttgaaaaaacacaactttgaatccaattttggacatagccgcaaatgtctggaccgcaaaagtcgggccgcaaatgtcggggctccgtgccactcccgtttttttctataaaaaattttttatgttcgtgaaaatgatccaaaattttctgctcgaatttgtatagaatgagcgttatggtttgttaaaatcggaaaattgggtaaattttggatatttttaaagaaatacccaattaaaatttaaaaaaaaatccattttacctccgtttcaatgaattcttccagcgtgattcgggtcagccgattctgctcctccattttctttttgtccttcttcagaatgtagccgggaggcagggcatgcctaagcaaaattttgcggaatttttaaaaatttccgcaaaaaaaacggacctgtagatgcatgtgtcgccgtttgggcattcccaaaaccatccgtatttgctgttctccacttaaattttttcagcaattagagtccgaaattttgaaaaagtcgacgggatagggaaaatcccggcgatcccatccgggttctagtcgtaaaccacaaaaaaaaatcaacaaaaattgcgaaacaaattccgaatctcattaaaattcgagttgtttttcaataaaaaaaaactttagcattttttttggaaaaaatntagaaaaaaaatcgcaaggaaatttttcgtggtagtatggcgcccagtagacccatatcgtgcaaaaattggcaaattttttgtttaaattttaaaaaaccccaatcctcctcctcgttcgcctccctcacctgcttcgaggaaatatttgcagagaatgtctgtttggttgggcctcttccggtccttttcaccatgctttttctccgcaacatcttgcagcgttttttcgtcccaattttcattggtctctaaaaatttttcaaggcctaagcgttgaaaaatggaaactatttgaaacaaaaaaagtttgatgagcatcgaccgatattcagttaataaaattttcgaatttagaccccctcaaataaaaaaaattccgcaataaaaaaaaacaaaccgtcttttttatcgcccaaatccctgctgtccacgtacaaattctttttcattgtcttttgctgtatggacaggtcatggctgaacttgcatttgttgctggaaattgggggaaaaataataaaaaaatttgtaagttacacaacaaaaaaaaattcagattttttgagtctgagttagggatttagtttttttaggctaagaaaatgcctaaacattccgaaaagtgacgattagattaaaaaaaaacgtttgtagaaattaccccttggtgcaaaggccttgcttaaagaaaacgcagagaaccgacttggggtcgacatctaaaagcaaaaaccaaataaaatgaaccaaccgatacatttttacgaaaaatgtcgcaaaaaaaaaataaaatgggcaaatggaggcaaagactggtcccaaattttattttaatttcaagaaaactattttaggggtaatccaactaagcagctgcattcattttgcccattttcgaaccccgaacccggtttcgaacatttttcggaaaaatttaaaattcttggcaatattttgcaaaaaaaatgaaaattttaattcgaaaaatgtccgaatccgagttcatccgtgtccgagttcgaaattgagccaaaagaaggcattgattcttgcctcgcgcctcagattctacccatagaaacaatttcctaaaataaaaaaaataccgagaccaatgttcttcaaccattgccaacaaatttggaatgcatttcgcgcccccaaaatattccatcaaatccgtaatccgtaatggtctgtctgtccttgctttatttgtgtgtgctctcaagtacctgcgctcactttttgctgtgttgcttgcacaactggtttgaaaattttgtttatgtctttcaggtcttcatcctcttgcttcttcttcggcgtgaactgcttggagggcgcgcccataatctgagaaattttcgtgttttttttaatttttcataatttttgagtacatttttctccatttgtgccctcaattttttgtttttcatgccaaatgtgcggtcttcagggactttctgttttttcttctcctccgcctttttgcttgttttaggggcattttttggaggcatttttatccgcaaaaaatttctgatggaattaggaaatatctaaaaatcattagttatatgtatgtatacatatagggtctctatagatagcgataaaccaaagggaaaagggacagggcctccctttgatttgaaggcacaaaaaactt

SEQ ID NO: 12209 - DNA, 4996 bp, Heterodera glycines
  misc_feature (1055)..(1055): n is a, c, g, or t
  misc_feature (2897)..(2897): n is a, c, g, or t
tcagatggagggctgtgtgtcggcactgtaccaattcattggcatcggcggactccgtcccaacactgtgtttctgaacttcccgcgcatgggcgactcggacgaccaccacaaggagcagcgcattttcgcgggtccatttcattttaaattaataattaattattaattaaatttcattcaaattcgaattattccatttttaatttggcattttgtccccctccccttttagaccaattgtgttgcggagcgcagaacgataattgcatggttgtggtgaagggcatcaccgactttccccgtcccaatgaccgactccgcgggcacattgacatttggttggtcatcaaattaaaatatctaaattatttcaaaattaatttcataaattaccataattattgaacacttttaattatatatttagatttattaaatttatatactcaatttttttgcttttaatattattaattaaaaaataataatttaattatatttaatgaatatgaaaaatattttagtttgcataatattaattgttgtctaattatttttaaatttttgttttacactctcaaatgaataattaatatttttgcatatttttaaaaattaatcccctaattaatttttcgaatttcatttatcccatttaattgttccttaattcaataatctttttcatttttttttttttgcctttctcaggtggattgtacaagatggtggcattctgatgctgatcgcttatttgttacagcagcacaaagtgtggaaaggctgcaaattgaggtgggaaagtgaagacaaaatattaaatattattttatctttttcaaaattaattttaaatatatttaaatcagaatttacgtgatcgctcaagagggggagcaaaatgaagagatgaaacatcgcctgcaacgtcacatttacatgcttcgcattgatgccacggtgggttaattagcgcactaaaaggcgtacaattaatatgggattaagccccaatccaatgcgatgaattgcgaatttttgaaaattactcncctgatgagagtgttgctccccgatattttttcaatttatcccagccacccccgacaaatttttcgagaatttcatcccctatcccccacttttctctccccgccgaggatcggggaatttaaatcgtaaataataatttaactgattttttaaattaattaattagcagataaaattgccttgtttaatcactcgtcgctaattaccttttaatgaatgcatttctttctttgcaaggtgttcattgtgaatatgattgagcccgaaggtgttgaggacgacgcggtgcagaagacgctgaacatggagcagcggacacggacactaatgaaggcaattaacaaattcaaaattgagtttttaatccattagtgagtcttcagaaaaatttgtccgccctctcaaatgggggactgtccaacggcggcttcacgcccgatgaacgcttccgaagtggcacaaagtgagagaagcaagaaatttatataaactattatttttaaatattttaggctatcatatttcctaaaccccttaaattagaccccccctagaaataaagcccaccttttgagggcaaattgaaaaataaaaccctcggaggctctattttaggaaatacgatattttgattaaaatctacattgggcaaaatggtctatcaatttcaattaaattttattttattattttggaagaaaaaagtttaattatcaacgaaaaaatgcttgtgagcttttctttttaatagtccgctttatgactgactaattttggttttattaattgaaattaatttaaaatttaatttctttattttttcacagttcgcccaatggaaatacgttggccgtgcccaataccgtatgccgaccgccacgagacagtgtcatcgagaccagctttatacagtaagcttttgaatttcgggaataatttatttgcttttttagaaaaactttccaagaagaaaacaacgacactgtaagcagtaatgagataagcatcaaggacattgacgacacgaaggtggagggaggaactaattaaatcaaaacaattaaaaaacctaattatcagattaattagatatttaaatcgtttcttataatgctaattaatgaatcaaaattttatttgttcattaatttaatatatcgcacttcaatttatttaaaaatatttattttttttcaagaaagctaaatatttttttatgaaaaattggttaataattaaaaagaaatcttttcaaatcgctctatttctatattattaccataaaattaataaaaagaataattattatttctcaattgtttttaggttcaaaaaatgaatgccgccgtccgactgaaccaagtcaattttttaataatcttttttcacatttcaaccaatttcgctcaggttattctcgagtattcttcggagagtcaattggtgcttttgtcgttgccaaaaccgcccaaatccatccaggccctcgtcgaaaattatttgtcatatgtaagaaagccaaaattttggttttaaaattccaaatttttcaggtcgaagccctcacggaaggcttgccacgcgtgttgctgatcggagggtcgggcaaagaagtgatcacggcagattcataagggcggcacacccggcaaaagcccatccatccgaccgattttttggcacttaattttttgaaatgcacacatttaaatttaccatttcccaccatttttatgtgtgttattattttattttgtatattattttctatttttgtcttaaatttaatactcaaaagttcattttcatttaatttaaaaattataactctatgcttttcnactcttaatctttttatttggacaattctaatttcaatttttcggaacgtttatctccgaataaatttttttttgctagtagtttctgtgtttctgaaaattgtcaaaactgttacaaattcttaactgtatttttttgatcaatttcaatttatgaataagaaaattaagaatgcattttgaacattttttggacaatttgttaatttaatttgaaaaaaatgcttgaaatggtcacaaataaaattgtacgagtgaataaaattggcataaaattgccaaaaaccagttcatttattttccataattttgttgtgggaatcgcggattttgaggtggagacctaaaaattaaattaaaattaaaatcatttaaaaataattattattttaaatatatataaatttacggctggtatgggaagaaaagatgaggcatcggtggaccaggaggctaaaaatttaattaattaacaaacgaaatttaaaactattatttttattaaaaatataaattaataattaaaattaataaaaataataatttaaattaatttaaagtgttaattaagaaacattaattataaattaattatacaaatagaatgtttaataaattgcttttcaccattaatttgttcccctcacagccaacaaattggccaatgctttgtgagctgactgttcgtgccacgcgaacatcgtacaaaaatgctgaaaacatttgttaattatttgtgctaattgccctattaatgcggaaaagaaagagcttttggaaatcaagcccaattttggcataaaagttcatttttattttttattaggttcaaaattgtaaattttcattgaaattgagggcacaatatgcaaaatcgatcggttattgtttgtggcagcaaattaccgtaatcattggtcagcatatggtaggtggtaaaatcgggcgtggcggcaaaaccggcgcgcaaattttggggcagtccggggaaaaattcggacatgcttccgaactggaatttttactcattaattaattaattgcgtaactaatgattctaatcaatcaattaattggaatgaattaattaactaattaccaaatgcggcgtgttgctctccacgttgtaagtggcgaacacatcgtcctgaatttcaattttagaacatttattttttatttgtttttgccatactttgaacaaaattacgcttccattgacaatcggaaaagcgccctcggggtagaaaagaattcggctgtgcaattcgcgggggtaacggtggtcacgcctaaaaattaaatacaaataaaacattttgaaatatttaaataattaaaattatttattttagaaatgatattcgaacatatgatttttcttttaatgatataaatgagtttaaatagcggaattggaagtgatctgagtcccatttggacttccaaaattctcattaggattatttttcgaaaattgtcgaataaaaatttattttgaattcgttaatcccaaccccggtccgtttttattctaacctcgaaaagaagggcaaatgttcgagattctcgggtgataattagtcatgactcgagaaagcatctcagtcctttttcttttcgaataatttaatgaaatcaaaaattgtctcacgtgaattgggccgttttctgatcaaactcatagccgaacagcatgcgcgatttgaccagcactgtcagtcgaccggatgaaaatgcgacgtcgaccttttcaggaccgtccgggaaaaactggggaaaattttcaaaaacttcaaaaaaatcgcattattaggagggacacctcgctgattttgtaggggcctccgaccaattttcctctgctcaaatgccatgcgtaaccgtccttgaagaggaacaaagtctcggaattaactgaaaaaagcaaaattggggggggggcattaattttatttaaaatataattaatttttatttaaaatataatttaaatagtaattttcccccattttttaccattcgctgccgttgtgatggagtgagggcatttttcagcttcttttcctgctgctgtcgtagctccttcgccgccgtat

SEQ ID NO: 12210 - DNA, 2287 bp, Heterodera glycines
  misc_feature (2275)..(2275): n is a, c, g, or t
agggatgttgttcactttaaacatcaacggtcggtcatttgtcgccactttcgcaaaaccatgcaattttcatgccattgttaggctttttgattcgacagcgtttaaacggcgatgtggaaatcttctgccggcctcgccaaatcatttgttcgcctgaactcagcaccgtccacctgcgcaccgccaacgttgagatggaagttcaggtggtctctccctttgctttattttcctttcatccgatggtttctttccttttcagaccgacaaaaaggcctatgtgaagtacgggtcgaagcgtgtgcacgtgtcgcggagtgggatggtcgtgtcgaatgagaactgttccgcatcgatggaccacattggccgcattgtgtccgcctcttaacttaatgggccgtggtgccaaagtgtaattatgccataatgtgtctagtttctgctattcttttccttcccacaccgatgttaaagtgtactcatgtcctgaatttctgcgatctcattattttgttttgttttattcggtcccttaaatgccggtgaattatgccttaattagtctgctctatattacatttgattgtgtcttttttcaattgtctctcactaatttaaaaacattgttctttgtatgtaaaaattggccgagataaagattatttattaattatttaaaaatacactttaatcactgcaaagatcggaagataaataagtcattgatcagcgattgtttttgtaataatcatggtactcgttctggtatccatcctttccaccgtatccactcttctcgtatccgtccttttcaccgtatccgcgttgcgcatatccgccgtatccgctctgctcatatccgtcccttccaccgtatccgctcttctcgtatccgtcacttccaccgtatccgctctgctcatatccgtcccttccaccgtatccgctcttctcgtatccgtcacttccaccgtatccgctcttctcgtatccgtccttttcaccgtatccgcttttctcatatccgctctgcgcatatcctccataaccgctctgttcgtatccgtcctttccaccgtatccgcttttctcatatccgctctgcgcatatcctccataaccgctctgttcgtatccgtcctttccaccgtatccgcttttctcatttccaccgtatccgctctgttcatgtccaccgcatccctttttatcatatccgtccttttctccgtatccgctctgctcatatccaccacatccctttttatcatatccgtcctttctactgtattcgctcttctcatatccctgctttccaccgtatccgccatatccctcctttccaccgtatccgctctgttcatgtccaccgcatccctttttatcatatccgtccttttcgccgtatccgctctgctcatatccaccacatccctttttatcatatccgtcctttctactgtattcgctcttctcatattcgtcctttccaccatatccgccattttcagtaccataggctccaccgtattggtacggtttatatgtctaaaatgagccaaaaatataataaattatgctaattttgattgcaaaaattggcccattcacaaaacagcttaaagttactaaaatcccttctcacttttggtgcgcaacacacgcagcgagcattctgcaaaatgtcaaactttgaacgatttgacttttggtgctttttctttgactgaccttcggcttgcgcgggtaattcacttcgctgtccgtttttccgtagcctccgctggtaccgtagtcggaattggcaccgtattcgccggcgcttttaccgtattccgtcgccgtgttttgctccgtgcttcgcttgcggcgataatacttaagcaaaaactcgaattcactgtcaaaccgaaaaatcaaaaaatgcctccaccttttggtaatcggatgccgtcggctggcgcatttcgtcgtaatcgacgataaatccgataatggctttcttaactttttaagttttttttggaaatcctttccaaaagtgcaccttcgaaatgctccgttctttacgcgcttaaaaaaataaacataaaatgttggcacaaaaaaagtgtcaaataccggccaaatgacaacactttaggcagtcctcgtcactgttcacagcgatggtcgagcagcggagtctgaaagtgccaaagagaatgggaaagtaattgatattagaaaatcaatttctggtgagagtgtgccttggccaagttgtaantagccgcccttt

SEQ ID NO: 12211 - DNA, 1806 bp, Heterodera glycines
  misc_feature (18)..(18): n is a, c, g, or t
  misc_feature (23)..(23): n is a, c, g, or t
  misc_feature (29)..(29): n is a, c, g, or t
  misc_feature (67)..(67): n is a, c, g, or t
cgaacattcattcatttntaatncctttntaataattgactaattgcctttctttgcgtaactgtcncctttcgtgccgtactccgtcttttcatcatatcccccaccgtatccgactgttccgctgctaccgtatccgcttgttccgtaagttgcgcctcctttcagttgcttttcgctgtttgtcactctgaaattaaaattaaatgcataaaatgggaggcaaataaaatggattcaaaaaaacgaacaccaaaatggaagcgtcaaggtcgcaaacgtaatctgccaaataatgaccaattaattaattaaccaaacaattgaaatttaatggatgaaagtggcggggaatggaggtaattatcctaaccgtcgacgagccgatggggcgatccataggcgtattcgtaatcgcccgccttttccgaataggcgccggagggggaatagggggaataatcggtgccaaaagtctgaaattaatttaattaaattttaattttaaaatttgataatttattcattttttaattttaccagctgtgcaccagcccaaatgataagcattgaaacaaagcaatgaatgaaacgcattttcaaataatgccctaaaagggagaaaaatcattgaaaaagccaaagaaaataaaggaaaagcccagaggggaagcgagcggataaaaggcaaagtgatcggattaaaagaaatagcaaaatgatcagaggaaaaacgagcgggtaaataggcaaagtgatcggaggaaaagcgagcgaataaataggcaaagtgattggaggaaaatagacgggtgaacggagacgacggcgtaattcgttcccgccattagcaaaaacggaagtgatcgctgggaaagagagtgatcagcagagccaaagggacaaaagtgaactccgaacgattctcatcattcgaagcacataaattggcctttacacttcgcttttcccacgccatcgccgacattcccccgacgattggcgagattagccattttcacagcaaagccgagaaaaagtgttcgctcaccgccgccccattcgcaatttctttttaaataaacgcccattcggccgatcgaagggacttttgtttcgccattcgtttcattttaattgaaatttaatttaataaaaatttaattttatttaatttcagtcatttgcccggcatgcgtcttcttctttttcccaactttggcctttttttgtgccttttggctgcagtgactgtttttggcattgaggtcaaaaggacaacggaagtgagcgaacgaaaaattcaaaagaaaaaagaaaaaaaatttaaattcagcaaacaaattcaacaaatccaaattctgtggataaaatcaaaacagaagaagcaccgccgtcgacggtgacaaattcgaagaacgaaacatcgacaaaagaagcagagaaaacggagcacaaagaagaaacgttgaagaaagaggaggaggaggaaggaaaagagaaagaagagcaaaaagaagaggaggaggaagaggaaggagaagaggaagcgggggaagaggaagagggagaggagtttggagaagaggaaggagaagtgacagaggatgaagaggaggaagagggggaagtgagagaggatgaagagggggaagtgacagaggatgaagagcaggaggagggggagggcaaggaggaggaagatcagaaaagaggagagagtgaagaggcgaaaaaggaagaaaaaggaagggaagaggaactgtaaggggagcagaaaagagaagagagaacggagaaggccaa

SEQ ID NO: 12212 - DNA, 2537 bp, Heterodera glycines
  misc_feature (54)..(54): n is a, c, g, or t
  misc_feature (86)..(86): n is a, c, g, or t
  misc_feature (115)..(116): n is a, c, g, or t
  misc_feature (120)..(120): n is a, c, g, or t
  misc_feature (178)..(178): n is a, c, g, or t
  misc_feature (2433)..(2433): n is a, c, g, or t
ttttcaccaaatattcgtcaaagatttctgtgcaatttttatccactgatccancataatgatataaattaggacgctcaaaaaancagttaagagaaataataagcatattcanntttncaagataagatattctaaaaataaataaattaaagcatttaaaatgaatttattattntaatttgacagcatattattcacggcaaatacttatagaattaataaattttctcactaattatataataaataattttaaatatattgtaatgaaataaaaataaagtaatttcattcactattaaataaacaattttatccctactgatcaaaaatatttttgttattccctaatttctttgcaatttcaatgacaacagtagagtagaaattaattatttaatttttatttacaatatttattttgctaatgttaaatcgcgaagtaaaagaagaaaatttttaataaaaagtcagatattttcctgattatgcaaaaatcgtgcaaaaatcatttgatataattactatttattatcttgatcgctaaaagaaaagattttaacacaaataaaattcattatattagaatagtgatttgatttataaagacggaaaatccattttcaattagacatccaattcatttaattctacatttggctttatcttaattgcacagtttggttatgtttgtgcaactaaaatttaaaatctttcaaaaacaaaaactaacggtttgagcagaagcggatttatatagacataaaatgcaaaactagaacaaaaacaccaaaatattgaccaattatatgtaaaaactaaatatggatcacataataatacgaaaaaatggacaaaacgccaaaagatggataaataattacaaattattatgcaccaatttttatgaaaaataataaattttttttaaacttaacgaaaagaagaagaaaatatggacaaaaacttattgatgaataaatttattttttatttgaattttttattaaaataatgagcctattttttgtcttctttaccaatttcggagtagaaaatgcgtcatgaaaattttattgtcataaaaattaaaaatttttgaaaaaatcattaaatcttcaaataacataattaatgctcctaataaactagagaactaagatttcttaattttaatgcagtttaggctatcagggcttgaaaaaattcaacttagaatccgatttttgacataagcgcaaatgtcggggccgcgaatgtcgctcagaataatctcatttttcaatgaatgaaaattttttgggcaaataaaatttgatttttttttatttccgatattttgttcaaacaaaaaattcctatcttttaaggcgtcgatcggagagggactcaacgaaatttcttaaaaaatcatccgttttcaattctcaaacatttcttctacaaattgtttcttccaattacaaatattcgcatttgaagtgttcacaattttagcaatttcattatcactcatttttggattttttctttttatttcccaataaatgttctattttttgttcctccgttattcttttacagttaattccaaattgtttcttccaattttcaattgttccatagttaactccgattttcttacaaatttcggcataattttgtttccattcttttggcgaatattttcttttttgcttatatttatttgaaatttcaacgaatttttgcacaattattagtttttcttcatcagtttttgatttgtaacttttctttttttgaagaccaaattctttgatccatttttgaatataatttcgatttgtccccaatttcttcgctatttttgagttaatttttccccattcttttgctgaatattttcttcccttttgcttaattttctcttttattttataaaactttccaattatttctctttttttgagttcatttcgtttttcttcttctttttcttgccatttttctccaaatatttcgccaaatgacttttgttgtaactttttcttttctgatccaattttgtcaattaaaaataaaataattaataatagtagaggaaataatttcattttttatcgtctcaaaattgtttttggttttttttaatttaaacgcaatatattttcatggacatataaatgaaaaaaaattaattttctgattaaaatgctggcagataaccataattctattgatttaacgaaaaataagaaaagcctactcaattgcaaataatattaataaaaattctcattaattaaaattccatttctattgggttttaatataaaaatcaagaaatataacttaaataaataaaataatacagcgcggagatcggatgaatttgaaaggagttttgcggcggttaatatgataaaatgaaaggatatccaatcgtanaaagcgagtaaggagcagttggaatctgttgcttctggcacgctttatttcggcttattttggtcagtgattttgggtttgcatggaaaaatcaaattttccta

SEQ ID NO: 12213 - DNA, 2007 bp, Heterodera glycines
tatttcgccaaatgacttttgctgtaatttttttctgttctgattcaattttgacaattcaaaatataattaaaaagaatagagggaataatttcattttttatcgtctcaaaattgtttttggttttttttaatttaaacgcaatatattttcatggacatataaatgaaaataattaattttctgattaaaatgctggcagataacaataattctattgatttaacgtaaaaataagaaaagcctactcaattgcaaataatattaataaaaattctcattaattaaaattccatttctattgagttttaatataaaaatcaagaaatataacttaaataaataaaataataaagcgcggagatcggatgaatttgaaaggagttttgcggcggttaatatgataaaatgaaaggatatccaatcgtaaaaagcgagtaaggagcagttggaatctgttgcttctggcacgctttatctgatcacttggaacagtgattttgggtttgccatggaaaaatcaaattttcctaaatcgtgtttaatagacattatagagaatagagagagctacaaaatgttagcataaagaccccgattcattaatccattcataaacatatttacgatttgtccctaattttttcgctagttttaatttaattttgctccattcttttgttgagtattttgttgcttttgcttaattttctctttaatttaattatatttttgaattatttttcaattttttccaaattttttacacgattaataatacaaaaaaagcgaataaaagatgtaaataaaacattttttaaattctcaaaattaaatttatttatttcgtttaaaatgtatgtattttatgattattaatttacttttttatctatttaaatcgcctttctagtgctttaaaaaattataaatatttcaacaaaaataaataaagcaccattttgctatatttaatgaacataaattgactaaattaattcatgtcagtgttgaaaggagttgaaaaaatttccatcttcgccaaatggaaataaatgatgacaaatatttattcacaaagtgtaatcaaatttctttaaaaggcaaaatttttttacaaattttaatgtgcttcaatttagggtccataacttgtgaggaattgattttagcaaaaaattgtatttgatcatatttgtagagaatttcgagatctttctagtatgctttatgcccatgctctttttatactgtgatatgaaaaaatttataaaataaaaataaattttgaaattcaaaaccataaggggacaaaaaagagaactgaaatctttagcatattaatctagatttttttttgtttttttttgtcatcataacaatgggagggattacgaaaatttttaaaattaaaagttgtcaaaaaactcaaattaattaatttttgtttcggcttagaaacaaaatggatacaaaaagaacaaataaatttgttaactcaaatatcaaacaaaaagcatcgctttcgtcctcacacaaatcgatcttttaaatttccataatattcggctgttaaaagtccgggttaatttcaaaattttttgtcccgttaagcaatgaaaatcaaaactaattttattagccgtttctttggtttaccgtgcttactaattagtaccccccccccccggggcttctatttttcaacccccctcgagaggggtattctaatttagaggggggggggggggttactaattcagtaaatacggtatattgattatgaacatggagcacagcaacatgtagaaaccgtaattttgaaaaatacggactcggaccaggacctgaatatccgagttcgctggcaccggcctggcttagaacaaagcccggcgggcatatttcaacttggagaaacaaattccgacaaagtcaattaaaaatggaatgagtttttcaaacaagttctgattttcacatttgtcctgagaaaaagaataaaa

SEQ ID NO: 12214 - DNA, 1633 bp, Heterodera glycines
cggtatttaactatcatcatttaccattgtgtttcaaaaaattgcctgaggcaataaattgtgccaaaaaacacacacattcagttagcggtgtacaaaggtgccgttgtggcgatcaaagaaattcgtttcccgcgaaagctgaaggagctgacacgggacacaaagctggagctgacctggatgaccaaactgcgccatgacaatgtgaacagctttttaggtacgtattcaatttacgcaccagcagggctaatgagtgattccggaactgaaggcccaaaaaaagccatgtaattcgtggttaatattccgagttggaatccagtctctcgtgtatcaatgaatccgcgcaatcatgagagagcattttaaaattcattaaatttttctttgggccagccagacttaacatattgaatacttaacattcttggggtatcagttgatactagatatagctaaatgttctatatgagcctgggaaattgcatatgagttcataaaatcaataaatggcgcatttttgttcgagaaattctcgcctagttaatctcgtaactaccgtatttctccgattattagatcaccctcaagtagaagactccttttgagcagggttgaacaatagaacactctcgggtctaataatcggagaaatatgctaattggttaacgaagtttgttgcttctgatcactgagcctctaagttaatattgaaaagtaaatttctcactgatcaccacgtttgatcagcttagtttgccattttttttgttgttgatcagaattggttattatttcacgtgtgccgcatttttacaggcattatgctgttcccgaccagcatttgtgttgtgcgcgaattctgcactaagtcaagcctgatggacgtgctgcgcaacccgtacatgaacattgacgccgtatttgttgcttcattcacccaggatttgttgaaaggtcggctagacaattgtttttgctgttcttgtatgccagccaaatcatgccatgatgtgtgccgaaaatggcatggcattatatccagcaagcatttatcttgtttcacaattagggagtcttggctttatctgagtgttgtcaaagcacaaatctgctgatctttccattttctgagttttaggcagagaaatggtgaattcaactttataaaatggcaaacaaaaaatgaaataatatttgcccatcgtcccaaaaggacactaaataaacgcataaaattatttaaaaatatcaattttcgactttttccattatttttccacctagacattttgaatgcctataaaattgcctattttcattttgttttgtcccaaattttgaagattttcattcaccattttctccaaccgttcaggggcgcgattatccgggttctgaatggactaaaaattttgccacttcaaattaaggatgattataaccattttcaagtttattcgctgctgataataacctttatggctgagaatcgagcaaagaattaaaaactctttatttctcgcgtttaaattggccaattagagactataattaatttatgaaatgtcataccactcattttatttcgttatcaggtatgatttatttgcacgaatcggacgt

SEQ ID NO: 12215 - DNA, 993 bp, Heterodera glycines
ttattctctttttaatgtttaattaaaaatttaatattcctttattttaagcatctatttgctgaaaattctttccttttaactaaaagattttactgaaaaatttttctatttttttttattacagtactagaaagagacagtaatttaataatttcggctgcaaaaattcaattttatttttgccttttgctttaagtgggagaattatctgtggactgcgcccgaactgctccgccagcccgactttgactttggccacgtggtgatgggcacccaaaagggcgacgtgtactcattcggcattattctgcacgagctaattgcgcgccagggcccattcagtctgctgagcggcactgctgctgatgtgccgcaacagaattcgacgaatgtagggcatgatgcggcacaacagcaggcggaggagggggagcacgggactgaacagtacggggcgccgttgtccgtcaaagaagtcgtccaaagagtggtaattgtttggggctgtactgctcgagaatgtcggccttgattcgagaaaaaaacatgtatttgggtcaacaaacttcggtctcgactctcactaatttcactctcgaacagcatttttaaagtaaaccagacttctcgaaggtgttccgatcaattcaattcaccggaatcttgaaccaactgactaagcccaattttcgatccttttcaaaatggcatcggaactttcatgggcataaaaacatgagaccgttcaacttgggtcggaagaatcccgagtcgggatcctgagttaaatgccgagggaccccgagaaaagcccgcgggttcccaatcctataccaaattttaataattgtaaaataattaaaatactaatccaagttcatttccttggtcaccgaatttatggattgtatataaaaaatgccattttcccatcacagtactcgttggatggcatcatgcgcccatcggtgcatgtgtccaatgccaaaa

SEQ ID NO: 12216 - DNA, 2002 bp, Heterodera glycines
aaattaccatgataaaagcaacccatccactcgatggcaagaggacgaagaggcgggtggcggtgccaaagcccatcaacgcggtatcccgtgtcttcaatgtgcgcctccccgacggaccagctcgcgcattgcacttgcgccccggggtgttccagctcgaagaagcggatgtaccgctgagactcagccgatgcgcggcgtccacgcaaatagccgccttctggtgagtggacaagatggttggctggcaggaagcaccgacgaagcgtggcaagcgcaagaccagccgccgttgatgacacaatgaatggatcaaggccttgtgcatgctgttcaatcagatggcgaaaacggatgaccgactctcgcagaatggcaacgtcgttgcagcagtacatgatcagctgctcacgaagctgaaatctgttgccgttgttgttgttgttgttttcagtgtgccagcgaaccactcccccccccctctaatagagtcactcctcttcgcttctgtttttttttaaatttgaactaatttttatttattttttacttaagcacatttgttccaataattttcaatatttcaggacgaaaagcgtcgcaaagacctgcttctgcagcgaatgttgcccatttcggtggcccaacaggtgttgtaacaaaaaataataacaaatgaaaattgaaattgaaattttacgtgttagtatggacaatcatgtttcaaaaatcataataccgaataaatttttacgaattgtatttttaaaaaataaaatcccatggcctagtttacaaagaaaaattcaggccttcagcgcctttaaaaaaaaaaaagattattccctgatcagtcattaaatcgaataatttttgaacaattatttttcaaaaaagattaattatcccaaggcctatattaaaaaatatgtttaattttcccaagggctgtttttcaaaaaatatttttccagcttctggaggaacgtgaggttgtgcccgaatcgtttggctcggtgaccatttatttctcggacattgtcggcttcacgtccatctgcagtgaaagcacaccgcaccaggtgatcgccatgctcaacaagctgtacacactgtttgacggggtgcgtttgcatatttttgacaatgaaataataataaattaatttattaattatggatttatgcaaaaattgttaaatatacctttttttaattattttttgtttaaattaaataaaattacatattaatttattttatttttttaaatgtagaattctttaaaaaaaattttgctgtaatttttttaaacacagaataagattatgccaactttagtgtaaagtgtttttcatttcaaatgcgcatagaataaaaacttttttacaattaaaatatgttttttgtaaaaaaacaaataagttttacaatgccaactttaatgtaaagtgtttttcatttcaaatatgcatagaataataaacttttttacaattaaaatgtgttttttttatatacagaataagttttacaatgccaactttaatgtaaagtgtttttcatttcaaatgctcatagaataataaacttttttacaattaaaatgtgttttttttatatacagaataagttttacaatgccaactttaatgtaaagtgtttttcatttcaaatgctcatagaataataaacttttttacaattaaaatgtgttttttttatatacagaataagttttacaatgccaactttaatgtaaagtgtttttcatttcaaatgctcatagaataataaactttcttacaattaaaatgtgttttttttatatacagaataagttttacaatgccaactttaatgtaaagtgtttttcatttcaaatgctcatagaataataaacttttttacaattaaagggtgttttttttatatacagaataagttttacaattgcggggggaatgtaaagtgtttttcatttcaaatgctcatagaa

SEQ ID NO: 12217 - DNA, 1028 bp, Heterodera glycines
atttttttttgcggtgtacccccccaaaaaagttggtgaatgggagttgggtccgacggccccgataggcgtcgccgggaaaatttttgaaaatttgagtgcaatttcattatagatttaataattaaaatcggtgaaaatgataaaaaaaaatcggtaaaataaagtgcgggcatgcgggatcgaacattaatccacagaacaacataacctgctgtcttcaccactaaactacaatatttcaataataaggcttattatttcttataaaaaaagtcattcttaagggtgtacatattttcgtctttttcgtaaaattttgctctgacgaaaacgaaacacgaaacgaaaaacaaaattttgaaaaccaaaaacgaaacgaaaaaactttggcggacgaaaagaaacacgaaaacgaaactcaaaaagtgcagaaaatgtaggacgaaacgaaaacgaaacgaaatttcgtccagcctgatggggtgcatcccaaaacgtcgccggccgaaacgtcgccgacgactttttgaaccatagctttgtgcattgtcaattaaattaattattcttggtgttgttcgatagctttatgtgtttaatattaataggcaaaatttcaaacattttcgttaggtttcaaaaaagttacctcactaccctatccatgccgatccatccccgcgaaatccatgggaccatcctgctctatccatgccgatccatcctgaaatccaggacaccctccctgccccattgttgtttaattgtccgttttattttgttgtagcaaagatgccaaaagccaccaggcaatgttcgataaggaaacggaagagtacaaatgggaaatgttgaacgcgcggagcagggaggagcggaagaaggccaaggaatgtgtgaggggctcagtgttactcaagatggcccaggatagagcgttctcggatgaaagaacaacggagcaactggcaaagtcaatgggtgagtgaatttttgtgtgatttaattgtcaaaaattatcctcc
